United States Patent 12,329,181 (MICROBIAL FEED SUPPLEMENT COMPOSITION AND METHOD) - sequence listing, part 2

SEQ ID NO: 102 - DNA, 28681 bp, Lactobacillus paracasei
  misc_feature (4019)..(4083): n is a, c, g, or t
gatgtattgaatcgtgtggtgttgcatcagttctatctgagatcgttcaattaaggttataatggccatgggacctgtccttctctctagatggtatgttatgcaaacaccattttagcaagaacggacaggtcttttttcacattttctgggtggtaactttaattatgcaatctagggctattaaagtattatctttttaaactcaatcaaactttgtcatccagtgactagccgtatgtgcgtcaaatgccatctcaatgtcggccggcaaattgcgttgtagcgataagggcacctgaagcgcttgctctcgcgtaaaaagttgaacctttgcagtttcgatcccgctttttaacgcacgattctccggtagacaagcaatgaacattttgtacacatcttgcgaactttgcttggcataggcgtgcttacgtagtgcccgaactgccagtaattgttgcggtttcacggttaagccggcctcttcacgggtttcttttacagcaatttcacccgcactataacccaaatccgcccaaccaccggggatggaccatgtaccgcctgctcgttcctgaaccagcaatagttgatcctcaataaaggtaaccgcacgaacatcaactttgggcgtcacatagccaaaatccgcatcgacaaacagctttgcttgctggtcactggcaccaagctttattgccagcttagtcgtcacgtcagccagttctgtataacgctgctgatcaaaaacatcctttgcgtaatagttaccggtctgtgcaattgcctgcaacttggccagcaaagtattcaaatcatcttgatagggtgccaaacgatcgcctcctcacgtccaacctaacaaatcagcgcgccatcacctatcacaaccccgtcaatttgaaaaagtcttacgtttcaggtcgcctgacgctgtgtaacaaaaaaagcagtcatcaactgccttttacgatcctatgtaacttgattgttacttcgagctcccgctagttgtcaccgcttgctgattgttcgcatagttgcgcacggattccggaacttgaccgccgaaagactgttgaccaatactgacggcctgcttaaagaaagcttgagcgcttgactgatagccttttccatcattgttaataacggctgtcaacacgtcacttgattgcttggcataatcaaccaatgtctttgccaaggcatcatcccctgaatcctgtgacttgttattatccaattccagccggatcttatcaagtttagagagactggctttagccgactgactgagagttttgttatcactttgcagtgagacctctgtcatcgttttcatcaccaagtcagaaatggtcgtatactgtttctgcaaggtctgcttggtaaaatggttcaccttaatcatcgtcgacccagtcgagctagacgactttgaactttttgactgacaaccagttacaccgatcatagccatcactgatactgcaataacaagccaccttcgcaacttgatccctccccaacatgatgacgaataaccgcatcattaaattaattcaaacataagccgttcgagacgtcaaacatttcaccagttatttgatccctttaaccaaataagctaagcgtcattgtttcgttatttttgtaagtattatctcacaaaaattgccttgctaaacaaggggatattcattatatttgttaatccgaataaatatccttatgttataattattttgttaaactatgactaaggaagtgccgagatgcaaaagcgccgccactcacaaaagcgtgcttcagtctttttacttatcaccttgttgttgtcagttctggttgccttaatcccaccgctcataagcaagccgatcagtgtcggtgctggccagaatatcgcggtcaccggttttggtagtcaagatgctacgattactgacaccactgggaaagatttcacccacgcacccaatctttcgatgtatagcgtgtacaccttaacctatcactggcgaattcctgacgaagtggtcgtcaaagccggtgatactgcgacagtttccctggcagcaaccgttgtatcgcgagccgatgtggactttgcagtggttgatcccacaactggcgccacgattggccatttcttttccaaagcaggtagttcatccggcattttgaccttcacggacttcttcagccattcaacagtcggccgtcaaggtgagcttcaattcatggtaagtggccgctatgatgatagtggtcatcaacgtccaggttggtatatcaacaaagccgggtgggttgtcaatccgccaacaggtgcaactccagaagaaaaagcgcagtatgttgatgaccttggtcgacccaaaattttccagtgggagattacgattaatccaaatatggagcatatcgacaatgtggtgctcactgatacacttggtcccggacagcattttgatacaagtcgtgggctggtcgtccacactggtacttacgatgacaactggttccatgctaccggtaccatcaccccaagctatcaagtgaatggtaaccaagtcaaaatatcgctgggaacgatcacaaccgccattcaaatcgatttgtggactaatcccacctctgcaagtttcgaaaccacagattcttggacgaattcagtcgttgcttcaggcaagcaaggcggtaccggtgctccagcgcaagcaaacggcacaatcacttggcgtaacggcggtagtggcaccggtcaagttggacaggtcacgctaattaaacaagaccaaaaaacacatcagcaggctctcgccggcgctgttttctcactctaccgtgccgatggaaccttggtacacgacgacctcacgactgatacgaagggcaagttaacctttactcaactcctagtcggccaatactattttgtcgaaacaaaggcgcctaaaggatacaagctgaatgcgactcacttgccgtttaccattacccttgataaaccgcaagtgacggtcaaggcctatgacgagaacctgacgccgccaccggtaacgccgtcgacgccatcttctgaatcttccagttcaatgacgccaccgtcgaagccatcatcagcttccagttccaaaccgtctgtaccttctagctcggtgacaccgccgtctaaaccatcaacaccttctagttcagtgacgccgccatctaaaccatcaacaccttctagctcggtgacaccgccgtctaaaccgtcgtcaccttctagctcagtaacgccgccgtctaaaccgtcgtcaccttctagctcagtgacgccgccgtctaaaccgtcgtcttcatctagcgagccttccaagccggctgcttcatcaacccccagccatcaggaaagctcatcttccatatctagcagtgatgtgattccttcattctcttcagaaagcgattcttccgcaagcgtggaggttatcacgccaagccacaacaacacccatcatctacctgacacaggtgagcgtgttttaggctggctagccattgcaataggaagtcttttatcaattactggtatccttttattgattaaagattatcaataaacgcgtttcaaaaactgcagcatgacgatgaaatgaagccatcgcctgctgcagttttttgctgctttaaattttgcttgcgtgtacgccatgaatacgctacgcttacaaccgtaaccattacgctttccaacaaaggagcttttgcccatgttcaaacgattattgaccgccttcagcgtcatgttgttggcaatccttgctgtcgcttgcagcaccagcgccaaatctggcagcaaccaaaagattcaagttgtggctaccgtcgatttttacggtgaagtagctaaagcagtcggcggcgatcaggtgagtgtccaatctatcatcgacaatcccgccattgatccccatgactacgaacccaccactaaagtcggtaaacaagtggccaccgccaannnnnnnnnnnnnnnnnnnnnnnnnnnnnnnnnnnnnnnnnnnnnnnnnnnnnnnnnnnnnnnnnggcaaacacgaaggcgataacgaacatatttggtatgacccacgcaccatgcctaaacttgccaatgccttggcagacaagtttgccaaacaggacccatccaaaaaggccatcttcaaagccaacgccaagaagtacatcgcctcactcgataacctcaatgctttgattcagaaactcaagcaaaacgttcgcgatcaaaaagtcgatgtctccgaacctgtcttcggctacgcgctggactatctaggctacaaggttaacaacacccacttcgcccaagctaccgaagaaggcaccgattacagtgccaaagacatcaacggtgttcaagacgacattaaagaaaagaaaatcgcctttttcgtgaacaacagccaagccagctcgaaaatcgtcgacggtctcgtcaaattagctaagcaacacgatgttcctgtgctcaacgtctccgaaaccctgccaaagggcaaaaattatcgcacttggatgaccagccaataccaacagttagaaaaaatccaagcaaaggccgacaaaacaaactagtctctctgtcctaccacaaaaaaccacttcgtcttcaaaaatcgcaacttgcatcaacgaatacctctctaaaggaagggaaaaatgcatggcctgctgttcattttgtgacaactgacatcttttcgtaaaatttttgcaatgaattcgttttcaaaagccctataccaattgaagttttgcttggcgactcttacaatgtagttgtaaacaggaacaactaataggggagatgttttaaatgtcactgatcaagcatacttttaaacgcgttgagcacatgatcgcagcaccacgcgatccccacgaagaagaacaagcccgtcttcaagaaaacctgttctatacgaacctcagtagtctgcaaccaaaaacgaacgctaagttttgattgaatagatatgaagtgaatgaccgcctcaacggcatgttgaggcggtttttaatgccgtccatttggctttaagaatcaaaatgaccaccttgaggagcaaatgctcctcaaggtggttaaaaaaactttcaggttatgttgttgagcctatgacggctatgccaactgttttagctttcctaaattgttttcatacggttttttttgcagtttaaaccacctccctgttgatacaggcctttgtgctgcctcctcatggttagtgcaatcccaacatcaactcaaccatgaagacttgtatgttctcttttcgagacatcacaatcatgaccgccactaaggccttcaaaacgcttttaaaccatccgatggtgtttacccacttctttacctcaggccatactaaattaatagcaggcaactcaatctaagggttgcacatatcaagccgctctcgctcccaaagcgaaagcacgtgtgatgatcaaagagcaacttacatttcaatgaagaatgctctctaatccaaccaaatagcatctgcagtaacatctgagccatcatcccatgtgatagtccagccgctagtgtaaacagctcattactttgcgtgacgatacttgcgaactccggccaagccaagaaccgcaatcacaacagcaccggcctcagtcaaaattgcgcccgcttggctttcaccagttgcaggataggcatgcttgccattcttctgagcaacccgactcatcggctgactacttgaaggctgtgcggcaacaactggaataacagcagcactggaagtcttcgggttagccgcactggatgctgaggaactggcagcacttgaggctgctgaactgccggcgctggatgctgacgaactagcggcacttgaggctgctgaactaccggcacttgatgcagacgaactggcagcacttgaggctgctgaactgctggcgcttgaggctgacgaactggcggcacttgaggctgacgaactggcggcacttgatgaagctgaactgcccgcactcgatgcagatgaactggcagcacttgaggctgctgaactaccggcactcgatgcggatgaactggcagcacttgaagctgctgaactaccggcacttgatgcggatgaactggcagcacttgatgaagctgaactgcccgcactcgatgcagatgaactagcagcacttgaagacgatgagctggtggcactggatgcccccgatgatgaggcaccactagaaggcgttgacggcttaggaccaggattcaacgcttcaacctgtttagttaatgcagcaataaatgaggccaaggcactttcttgttgcgtattgaaagcttgaatcttactgctattgtccttttcagattgtgcttcttgactggcaaactggtcagctaattgttgaatagcatcgttcaattccgcttgtttactctgatattggtcaccttgctgattctttaaatcttgcagttggtctttgacttgctgaatcttttgatcaatttctttgttattgtcttgatcggttgaaggtgttgaggtttgtgcgggtacgtataaaatgttattgccagcgtatgtgtaatatgaaccatttgaattcattacccacgcattctgcactgtattgtattgaatagagaacccttccgtcacctcaccatcatcaagaagaatgttacggtgtccttgattgctatcatcgtcataattcaacaaatcattgattgatactgaaacaccttccattaattcaagcatagtaggctcttgattataacgattacccataaacatggaaggatctacagaagataaagtttcatctgtgccgtgaccaaacagcttattagtatagtccggatcatgatgagtttctgcaacattggtcagtgtttgaccacgttgttgtacaagcttaagaaagtcttgagttgtagagattggagtcaatcccatagacttacgataattattgactaacatcattgcatactgattcaattcattcttttgagcgtcggtcaattgattgttgtgaacgacatctcctaatgaccaagaaggagtattgtcatcatctgtgtgaacataaataccatccatcatacccgcttgagaaggatccttgaatactggaagattttgcactaaataatttccgttccagttactattattatctctatgagtaacaacattagtccacaaaccatgctctgccacataattaaacgtcccaccattttccaccggtgcatcaggtgtcgtccgctgtgcattcaaatcatcaatctgcgcagtcgcggcttgacttgcagcggcataacttgcatcctgttgcgctttcagtgctgcgagacttgcagcggcacttgagctagcagctgccaaagaagcttgatcttgctgtttttgcgctgccgcttggctagctaagctgttggcataagaagtttctgcttcactggccttttgtttttcagcggcttcagagaccgctgcgtctgatttggcttgatcatattttgcttgttgtgcctgccattctgcttcggtcatgcctgatgaagccggcatgctggtgttggcattggcggcttgacttgctgcttgataggccgcagctgcttgttgttgtgcagctgccggactggcctcaccgttggctttagcggcgttggctgttgctacaggttgggtgtttttaacagcacttgcaggttcagtttgtgctgccgccggttgactcacttgtccatcttgggtgagtgtcactggctgaacgacaaggtgcgtgtctgtttctgcagcattgacaggttgaagttgcgtcaaggcgacaccacctaacgctaaggcaaatgcggaaactacgacccactggctgccgcgtttgtacatcttttttctatcattaacaacatgttctttaacccggttatataacatgttacttcctccaataccattaaaattatgtcttttgattcggagcacaaatttcattatatatatttattaggtatattatgcctaggcaacctgttactagcctttcgttgctggcgttaccgatattgtgccaaaacgggcatccgcaccaaaatggccttgagccattggttattctttagtaatcgttgcatgtcgaaatggtgtcacaaaagtgtctttaaagtcacctgtcccttggatcttttcaagattacggtcactgattgacgcgctttgtgcacttacatactgccaaaagaaatcttgttcaaatgcttgtaacaatgacgcaacagttgattctttctccttcaagcttgctggcaaaatgtcccatctttgtgtcagaaatacttgcagtgctggttgccaccaattcttatagctgcggagaacaaatgttggtgccggaatacgatttggctcgtcaagatattgacgaatccgctcgatgacacttgctaaaataaattgtgtggacggtaataacgcaacctgcgcgccacttggtagtgctttgaatgacttttgcttatttgtcgccagttgataagcttccacactctttgcttgataactcgaagtgcttttaatttgtataaacttgataaagtcatctgcattttgcgttcgataagggactaaatcgataaattgaattggatagtgacttaaaatttgctttgcttcgctaacgggcatcgttgtgttagatttttcatctgcatcaaacaaggcccgaagcaacatcgaagtgtgctgcgcataccaatgctgtttatctcgctttgtgttctgtctcagataatccgttagcgtcatgtcgccagtatctgttttgtttggtcggaagagctgttgataaataatattgttggctggcttaccatctatccattctgcatcctcctcatgcacatatttttgaatgttgacgaagccaccctctctttctgcacgaatcaattcctcaacttgtccagatgctaccgctggattaatgttcgcgatgtaaatctgtgccttctgcggatcatgttcaatcggtccagcagggacaccatcataaatcgttgtttcggtttcattaaaattagctcttgcttgtggcttatggatatattgcgcatctgcttcaaatagccagttgaaggatagttcctctgccattgcttcttcttctttcaatttctcgtattcagcaatcttcttttcaagttcaggacgccattgacctttattttcggtattcggttctcgatatggattcaaatttgctagcaggtctcgccagctctgttcgtctggtttcgtcatagaatcccctccattcatctaggtaaaataactatagtattttaaatgggcatattgcgcctatctaaactaaactaaaaaatttcaccagcaaaaaaggagactgctgaacaggtaacgattttcttgcggcttatgataaaaagtccggcagaatctgatttgacgtcagattttcccggacttttgtcgtatcagggttttccaccctcttacttttcgctcattattttcataattcgttccatattggcataaaagagcgtcatggcctcaatgctattagaccagcttattgatagctatgtttggttttgactgctgcattcttcgcgtcaattcgataccgtaacttgatgatgtcttgaaatgcttgagttgcctgaaaggtgctctggtcttgatgtgtttaagacttaatcgtgacgctataagtttttgtctttgcgcctggttgataacacccttgctgccgtggacattcatgacaatgatgcgtgtcaaagtaataagtccggccttgatcgcagctcttatcttttttaccgtttctcgtgacgcgcgagtccataaaatctgcagggcaaacaaacataccggcatctttgttgaagttccaagtctggactggagtccttgatccgttgagatgattagatagagcaatgaatataactgaaagtgatcacgcttggcaagtttcagatttttccccagatgaggcgatgttaccggtcactttttcaaccctcacaacattttttctattttgattaactaagctttccagaaactgcccatcacattttgacataagagtggcagctcgtttcagttcagtggctgtcaatcactaaattgatgcgactaacaattagcactatgacatccttaaaaaaaaccgccatgaaatgcaggattaacggtgttttttttataaatcttgaaaaatttcaacgtttatcggtaattgtacggcgtttaaaaaataataacaaaaagcccgacattttcgtgtacattgtttgtaggaagctagccccctgtgttgtgagcattatgtcgaaaacaaacacgaggtgatttgtttaacattcagttattaacgaatactgaactctgcaaggtaaacggtggtagtaacgctcttgactgtgctgcagaagtcggtgctagcccacgaaggagactgattttttgaaaactctttccaagattgctcatatcgtcagtgccttgtcaggcgttattttagtcatcaccattatttccattccaaaatacgacagtatggcactgaatgtgtttattctgacagtctcagcaacaatgattattgataactataatcgagaatgctaagacaaatttttaataaagttccattctctcagaatttcacaaattaaataccttgccactaacaacagcctctactttgcagcaattcgcaagcaaagcagaggctgttattttgcgggaaaagtgtaccttctgtctcaaacacatgtatggccatgctttggttttctgttgttaacgaaagaaaagatgtgcgatggcactttttattgataaggtgaagtctcgcaaaattttcgactcacgcgacaacccaacagtgaggttgatatcattttgtctagcgacaccgttgaccaagacgctatacctttaggacttctacaggaaaaagaagctgttaaactgcactatagcggtgatcggcaggcacacttgctagttaggcaaaaagtatccctgaagtcatcatccccacaaccaccgctaccatccccgctaccaccgtgccaacataataaaagatcgccattgaccaccgccgatttttaatcaggataaacgcgtctgccatgaacgttgaaaaggtcgtaaagccaccgcaaaagcccggcagtaggaacaaacgaaacgccgaaagcgctggtagtccaactaaaagtcctgccagcaatgaacccagcacattgatgagtagcgtcgccaacggcttgccgggccagagcattttccctaatacggttataccgtaccggcaaacagcgccgaggccggctccgataccaattaagatcaccattgttttttgtcccttcttccaacgagtttcgaggccaagaatccggctgttgctgctagcagcccgcccagcagattgagcatcaacagtagtgtggcataaatcgcatgccttggtgccaaggtcgcaaagtccagcatgagcgtggagaatgtcgtgaaaccaccgatgacacctgtcccgagggcaagcaacagccattcgggcagatcgaatttcatatccaatccataagtggtgaaggccagtaaaaagctgccgattaagttcacaatggttgtccccatcatggttgtgccatcgtgggtcacgccactgatgacatatcgcaaaatgccaccaataaaaccgccagcaaagacggccaacaaccaactaacatgtattttttcacgatgatgcatcatgatctcctttcgtgggaacgcactcgctgacgcagaaacctctgcataaacatatcaggctaagatctgtcactttgtcctgaggccatttatgctgcaatttttaaacgcaccagctcatactcaaaaaaaagacacctaccccgatttgctcaaggtaggtgtcatcaacttgcgtataggcgaacaccatcgccatttaatttattgaaagtatagcaaatgtttggtccgaacatcaacaacaatgaacgtggtttgtgcatatcttgacacacacaaaacgagttgttattttgttcgtatatacgtgatatattaaaacaatgcgtagataagaacattctcctgaaatctaattggtctctcaatggtaatgggttcatcctagtcgcacttacaagccaactgatgatcgctttttcacatcaacagccgcgctactgctggatcaagttcaattagttgcactgcacaagtatattgaccgcttcacgacctctaaggtataattaaggagttgaaaagaggccaccgggcggcttcccgatgacctcgacgcagttcagatgacgatttggtaaaagctaatccttgaggttagcttttttgatgatcgcgtacgctttggccatactggtaatcagtatgctcagcgcgacgataatcgacgccacatccaacgcggcgaaccgctttcgtctcctgattttggcatggctatcacctccgcacttcaaaaaatgttgaggggtgtgtgccatccaatctgctggactaagaaaaagggtaattagtcctctctctaagcttgctttcagtctataggttttcccgaatgcggtcaataagaaaaattggtctttcgcactcaagttaatctcccttttgcacccaaaaagaaaaaagcgtacgctctattcgtatagaagaacaggcgatgatgttcgccgcaaatgattgtgtagcaatctgatgacgtctactgaaacgacttttatgtcgcttcggtaggcgttttttcgttgttaccaaaaggagagatattatgatggcactttttattgatacagtgaaagctcgcgaaattttcgactcacgcggcaacccaacagtggaggctgatgtcgttttatctgatggcacccttggtcgagccgaggtaccttcaggggcttctactggtgaaaaagaagcggttgagttgcgcgatggcggtgatcgactgggcggtaaaggtgtgctgaaggcggtcaatcatgtcaacacggcgattaatcaagccttgcatggtgtttcgccttttaatcaggctcacgttgatcagatcatgattgatttggacggcaccccgaacaaggccaagcttggcgcaaatgctattcttggcgtctcgatggccacggctcgggccgctgccttggccacccatcagccactttatcgttatctaggcgggacagatctagagttaccacaaaccttccacaatgtgatcaatggcggtgaacatgccgataatggtattgatattcaggaatttatgatcaccccagttgaccggacgtctttccgtgatggctttgagaaaattacgaacacctatcacaccttgaaaaaagtcatcgagaaggccggttacacgactgggttgggtgacgaaggtggctttgcccctgacttgaagaattccgaagatgctttgcaaatgctacatgacgcgattcttcaagccggctacacccccggtaaggaaattgcgattgcttttgatgcggcggcttcttacttctacaaccacgacaccaaaaattacgactttgaaggcaaaacctacacgccagaagaacttggtgcttactacatcaagctgcttgatcaatttcctgaaatcatttcgattgaagatccttacggtgaagacgactgggataactttgccaaatttaccgctaagtacggcaagcgtatccagatcgtggctgatgatccagtctgcaccaatccgaagttgatcacggaggctattcaaaaaggcatggctaattcgattctgattaagctcaatcaaatcggtactgttactgaaaccctcgaagcgattcgcttagcccgtaaaaacggctacaccacgatgatgtcccaccgctctggcgaaactggcgacacctttgttgctgacttcaccgttgccaccaacgccgcccaacttaaagccggcgccccagcccggtctgagcgcgtcgagaagtacaaccagttgctgcggattgaagaggaactcggaagtgacggcacgcgactggcccattttccagatagtgttcaattcgactaaattcagagcaaaagcaagcaagagaccgagcgtttagcgacgatcggcctttttgtctgaaaggatatcgatgcaatgacacaatataacggtctttcacaatctgaggcaaccgcacgcttaaaatcaaatggccccaacgaggtcaaagaaccaaccgtgagtttcatccaaggcgtactcgcgcgtctgtgggaaccttccgcctggattttggaggcagctttagttgtcgaaatcgttcttggcaaaggtattcaggcaggttttattgtgctgatgttgctgtttgcggctgtgaatggcgcgattcaatcaacgcgggctcgggcggttttacgcaagctatcacatgaattgaccccgcttgtggccgtgaaacgttctagcaagtgggtcacaaaacccgcaaaagagttggtcgtcggcgatttaattagtctgcgtcaaggagatatcatccccgctgatgcctgccttctggacaacgcgattcaagtcaacgaaagtagtatcactggcgaagctgcctcggttcatcggcaggtcaatcaaactgtttatgctggaaccgaagtactgactggacacacgcttgctgtcgtgacagcgattggtgcagacagtcgttcaggaaaaacgatcaccttgctcaaccaatcagccgcacccggtcacttgcagcaactgctcggtcgaatcatcaacgaccttgcgattctcgatagtgtgctagccatcattctgatcgttgccgctttaattcgtggtgaaaacttgatcagcatgtttccctttttggccatgttgttcattgcaacgatcccaattgccatgccttccagctttgcggtggcaaattcagttgaagcaaaagtgcttagtcgtgaccatgttttagttagtgatctgtctggcattcaagaagcggctaatcttgacgtgttattggttgataaaaccggcaccatcactgaaaacaagcctgtcgttgtgacgtttacaaatctgtcggatctgcctgacgaaaccgtacgagcttacagtgcttttgcttgtgaccaacaacaccctagtgtcatcgatcaagctattttgacattcactagtaacaatcatgttgaagcaaccctgagcaacttcacaccgtttactgccgaaactggctatgcaagtgcaaccatcacaattgctgatcgtttgctgaaagttcgtcttggctctttaaaagtgctacagtcacgtgatcctgaatcaccaaaactaccacccctagccttagatgcaggccgctcagtcgctgtctcaattaatgagcaccttgttggcgtctacattcttgaagacactattcgggccgatagtaggcaagccattgaagctattaaaaaccgcggtgtgcagctggtcatgctcactggcgataatgtcaaaacggctcagaccattgctttgaaagccggtttgaccggtcaaatcgtagccttttcacgattacccgccaccttttctttgcagaatctagctggcattgccgaggtaaaaccggaggacaaactagctatcgtccagcgattgcaagccagtggacacatcgttggaatgaccggagatggcgtgaacgatgcccctgctatcaggcaagctgaagtcggcattgcagttgagaatgccgtggatttagccaagcgagcagctaaaatgattttgcttgaacccggtttaacctccattattgagattcttgatagcggtcatcgcgtttatcagcgcatgatgacgtggaccatcaccaagttatcgcgaaccgccgaactgacgatcatcctaacgctaggttatttactgaatcattttctgccgttgtcattaaacgcgatgatccttgttgccatcttaaatgatctcgtgacattggtacttggtactgatcgcaccagcatctcccaccatcctgaaaactggcacttaggcaaactcggttttatcagcggcacactcgcaatcggctggacgctcgttgggatgatcatcttgacgctgctcaccaaccttcacgtagctcaaggtcagataagcaccatcattttcaactatctgatcttcagtgccatgctgaccatcctgatcacccgcagcaatcgcaacttttggcgcagcaaaccaagccgcgctgttatgacggcgatcacgattaatatcgtcctcacaatcaccctttcattactcggctggggcattgtggctattcgggcaacaacaattttggctgttctagccatcacgctggtaacaggtgtgctattaactaggatgcggcgacttctctaatattgttttccaaacagaataaaaaagtaataacagtgcagttagtctaatgaattttatataatttacgttatttttcgttacgatccgggcaccggaattttcaaaaaatcagaaatgttgtatcgggttaacctcagtatcgttctgcaccagactaaatccaagtataacggtcatcaaaaagcaggccatttgtgtaaaagccgaacgaaatgtataaaatgtaaaattattgtaaagttattgattcggatattataaaaaagtatgatttgaatgttcaagtgacttgttcgtctcagttcactcttttgcgtcgccgagacaagcaaggttctgcttacaaatgattgattctacttttatggaggaaaactgatgaagttctggaaaagaattgcagtggctgggatggcaaccattgctgcgttatcgctggctgcttgtggtagtaagagtagttctagcagcacaagtacaagcaatagttacacccccaagtcattaaatattcagtttgtaccatcaagcaacgccaatacaatcgaagcaaaagcaaaacctctggctagtttgctgaagaaagagcttggcatccctgtcaaagtcaccgtttcgacagactacaactcaattgtcgaagctatgaagagtaaacaagtcgatgttgggttcttaccacctgatggttacgttcaggcacacgcgcaaaaggcagccgacgttttgttgatggcgcaacgatttgggatcaaacagccaggtgggaaaagcaccgacaaactggttgattcatatcgttcgatgattgttgttaaaaaaggcagtagcatcaaatcttggaaagatctcaagaataaaaaaattgccgttcaagatgttaccagttccgctggctatatttggccgattgccgaactgtcccaaaagggtctcgacattgttaaacaagataccttggttactgtcaaaggtcacgatcaaggtgtcatgtcagtgctaaacggtgataccgatgccgcctttgtttttgaggatgcccgcaatattgtcaaaaaagatgtccctgacattatggacaaggttgaacccatctacttcacaaagccaattcctaatgacacgatttccgtacgtcaggacatgagtgccgccttccgcaaaaagcttagcaaggctttcatcgacattgctaagacaaaagaaggtcatgcgattatctcaagtatttatacacatgagggctatgtcaaaaccacagatagtgccttcaacattgtgcgtaagtatgacaaaattgccactggtgaatcaaaaagcaagtaaagcaacgttgcaaaagcgctagccacctagcgcttttgctatacatggaggaagtttgcatgtcagaaagtaaccacccagttattgagtttgaccacgtctcaaaaatctatcctaacggtgtcgtaggccttaaagacatcgatttaaccattaatcaaggcgaatttgtggttgtcgttggcttgtcaggagccgggaaaagtacactgatgcgggccatcaatcggcttcacgacatctctgaaggcgatgtacgtattgatggtgtttccattaccaaagcaaaaggcaagaaactattgaatattcgtcggaaaatcgggatgatttttcaaagttttaacctagtcaaccgctcgtcagtcttgaagaatgttttaactggacgagtcggctattatccaacttggaaaatggtactaggtttgttttccgctgaagacaagcaacgtgcttacgatgccttgcggacagtagaattggaagataaagtttatacccgtgccgaccaactttccggtggtcaacagcaacgtgtggcgattgcacgtgcccttacgcaaaccccaacgattattctcgcagacgaaccgatcgccagtcttgatcctcaaaccacaaaacgggtgatggatgacttgcggcgaattaaccaagaaatgggcattactgtcgtggctaatctacatagcgttgaggttgctcaagcttatgctactcgcattatcggtattcgggcgggtcaaaaagtgtttgacggtccggttgccgaagccactgatgaaatcatagctagtatttacagcggtaatgagcaggaggtgtcataatgacagctcctacgttaccgaaacgtcagctgcaatggcgcaagtggctgcttactggcatcatggtacttggtttaatttggtcgattgggatcaccaatgcaaatctcgggttgttttttaagaatttcagtcaattcactgtcatttttaccgaaatggcgcatgttgactggagttacgcttattacacaatcgatccgatgattcagacattgaaaatggcaatcattggcaccttgattggctctgccgttgcttttccatatgcccttttagtttcgcgcaacattgtgactaataaaattgtggtaggcatttttcgctttatgctcaatattgtccgtaccatccccgatctcatgttagcggcactttttgtcgccattgtcggaatcggaccagtggccggtatttttgcgttagcgatctttacttttgggatggttggcaagctgttttatgaagcagttgaaacgattgatcctgggccgcttgaagcacttaaggcagcaggtgcgggccgaattgaaatgattcgttttgcagtgttgccgcagatcgcaaattattttgttagcttcgtcttgtatgctttcgaaattaacgttcgggctagtacggtgctcggctatatgggagctggcgggatcggtatttacttgcaacaggcattatccatgtttcggtatgatcgggtcggtttgattgtgctagttatctttgctgttgtacttgtcattgactacattagcggtaaggctagggaggtgcttctatgaatcgctcagcttcattgccaaaggcccccctgcaacatcgttggcgcaattggttactgacaataatcaccttagcgattatcgtttggtcattcacaggtatgccaagtcttgaaatcaaacccaatgcgtgggtcgttaccaagtcaatcgctgcggggttggcacatcccgattttagctatgtttggacaggtgatggcgaggatctgacttctacgctgctgcaaaccttggggatcgcctttttagggacgttcatttcagctattattagtctgccatttgctttttgggctgcgaacacacaacacaagttttggctgacgactcgttctggcaaatttgtcttgactgccattcgaacttttcctgaaattgtcctggcgttaatgtttatcaaagccgttggtccaggctcttttgctggcgtactagcagttggctttcatagtgttggcatgctcgcaaaacttttttccgaagcgattgaaaacatgaacaatcgtgccggagaggccgtgattgctgctggtggcaatcgattggatgtcactgtgatcgccagtttgccacaattgataccagagtttgtttctaatactctctaccgttttgagttggccattcgttcagcatcgattcttggtatggtgggtgctggcggtgtcggaacacctttgattttcgctattcaaacccgttcttggtctagagtgggcatcattctgtatggcattatcattttagtaaccctcaccgactggctttctggttttctgcggaaacggttagtataaagttcggtgaaatcctaacatgtcggatcatttgcagatgaaggtccgctcttcttcgaccaaaagtgagaggtcgatttagttcagtggcagtcgttcaatgatcaaattgatttgatggaaaagaattttcaaggccgaggttcgcttaattctgtttttgatttcagagacaatgaaaaggtacatcaaggccattttcatgcataaccacagattgatgctggaaaaatgccagaagcactcagcattgaaaaatgtcccgttaaaaaaatagttgtgattgctgtatgatgccatggtcctatcaaaaaagactccctgagatatttcatctcaaggagtcttttttatccagcaagtcccgggctgcaactgatcagtcgctaccactgactaatgttgtcttcatatccaccttctcggtcacaacaccttcttgataaaaggtattcgcgatttgattttcttcatcgacaatgctgctatctgctttaacgagcgccatggcgtaagttcggcgttcaaccattttttgaatcacagcgtctgatagtttcaaggttttactgagcatggcaatgagttgtgtgtggtgattattggcccacgtcatatcatcgttgatataggttgtcagcaatttgctcagcgcggtgtgagttttggcataattttgggttgagatcaggaagtcacgattctttgccaagccggtgccgtttgtcagcaacttggccccttgattgacttgtgctgttgccgtatacggatcccaagtgacccaagcatccacactgccttttgcaaaagcgaccgatgctgaactttgatccatattcactaatttaacatcattggtggacaaacctgccttttttaaggcctgaataatcaagtattgggcggcagtgcctttttgataggcgatcgtcttgcctttcaattgcttgagattggtgatctggctgttcttaccaacaagaataccgctgccatattccttggtggcaccagcagcaatcagcgcaatatccgtgccagcagcttttgctgtcactggcggcgtatcgccaacgcgagcgtagtcgatcgccccacttttcaaggcagtcatgagcgcagcaccatcagaaaactccttgaagacgacttgatagccttttgctttcatttttttgattaactcaccatgctggcgagcaatgtcgacaggatcggccttttggtagccgatcgtgactgtttccagatcactggccgccgtcgtggtctgcgtatagccatagacggcaacactaagccacatgattaagccgatcaccaagaaccaaaggtgttttttatgcttcataggcttgtccgccttgcatcagctgtttgcgcagtttcggtcggattactttcccagttgcattgaccggaaaggctttgacaaaaacgacatcggttggacattcatacgctgccaaatgctggcgagcgtaatcgatcaaggcggctttggctttcattgggtcgccggtcacgttttggcgaatgacaaccgccgtgactgcttcgccataaagtgcatccggcaaaccaatcaccgctacttgagcaacccagtctaactcattaaggatattttcgacttttgccggggcaaccttttcaccaccgcgattgatcatttccttacgacggcctttgacaaacagatagccatcttcgtctaaatagccaagatcgccagtgaggaaccaatcgtctttaaaagattcaggatgcggttcgaggtaatcgtgaatgacgtgatcgccgcgaagagcaatttcaccttcaacatacggttgctggctcaaagaaccgtccgccagcatcagtcgcagttctgtacccaccggcttgccggcagacccaattttcggtgcattaattggatttaaggtactctgactcgccgtctcagtcatgccataaccttcgagaatctgcgtatgaaaatacgtctgaaaggctatcaacttatcttctggcaatgcaaacgaggaactgcggacgaatcgcaaatgaatgtcagggtgataagctttcaaggcgttttcgttcatgagcaaaatcgatatgattgtcggcacaactgaaacccacgtgacatggttgtctgcgatgagcggccagaatttgctagcggagaacttcggtgcgatgacaagtttgccacccgaaagtcgggtagccaaaaccgaaatcacctgcgcattgatgtgaaacatcggcatcacgaccatggcgatatcatcagctgataaagcatgacttttggcatcgtgttgggccgcattcaacaacatgcgatgggttaagcccacgcgtttcggcttgccagttgtgcccgaagtgttgaggatcaaagacaggtcctcttcttttggacgtttctgcggcgcgtttatgcgatacgcaagctgactggcatcagttaaaatcgctagcgctgcgatagtatgcagacgaagccgactgcacggcatcaatggttctgccagcttttcgccaacatcaggcaaggttataactgcctgatagtgatacaatgaccattccgccttcagttctggcaacggggtcgcggcagcaatcggatggacaaccgcaccaatctcccaaagcgcctgatttaacgccagatggacgggagcgtttggcaaagcgacaagaatctgatcccctgcaccgattttcagtttattcaactggtcacgcaaggctgcgacgtcctcttcaagatcgcgcccggtataccaagtatcggcagcgactgatttcacaattgggtaatcacgctcatttattagattctgagacaacagatcggtgagtttgctcatgattcaagactcctttcgatgaaactgacaaggactgcggacggccaatcagccacccaaacggcgcgatccggtagcatagccaagcaatggtaaatgaaacaactagaataaagatatagccgattggtagtagtaagatcaacatgccattgctaaaaccaccgagactcaacaagctgcctaacaagctaatagcaatggtttgacaaagataaacgccgaaagaaacttgggcaccatgaccgatcagtcgtgccaaccaatgttcgggtcgcttcgtatgccagaccgcgtatcgctggcctaatacgaatacaaaagcgatcatcacgacatcgtagatcaacatataaggttggtgcggggaaacagcagcgttgtgaccaaagttcagaacttgtttgttaaaaacatagagaccaatggtgccgatactgagactcaaagcaccccagccgattaacacctgatgggcaagaagccactgcttgaccttttcatagtgcaggctgacgagtccaccgctaatgaagaagaactgataggtgaaaacattgaccccataggccttaaaccaccataaccagttgcttgtgttgacatgtggcaacccatacttaatgccgatgactagcagcatttgaacgccgaagctagcgacgactaacctgatatgatgaccagccatccgtttaaatagccacagcatggctggaaacaatagatacaattgtaaggtgaccaaaacgtagtagaggtaaaattgatcgccatgcagcaaggcactgagatagtctggccagaagttggcgatggtaaagccgccaacaccaagcagtactgaacctgccaacaataaagtgttccacaagacgtaaggtacgccgactgttgtgaagcgttttttgtaaaacagcggccaattgcgctgacgccggtaatacaccatcgtcaataccaaaccggtcataaacatgaaacccattcgcgtaaaatgaatcattaaatgtgtggctaagaatccagtactgattaaaccgctggatgtttgatgctgaaatgccgttgtcgtgtgattcaacagcacacccgcaataaaaatcaaacgcataagatcaatttcatatagataaggatgcttaacttttttcggctcgcgccgctcgccgtcattcgcctgcttcatgttgtcaccggctctgacacaatcgcgttcaaaactcgtgctgctgtgttcgcaattttctctggtgattgaccacgagcaccgcttgtttcgtatgccagcttgccatctttgacaaccacaatgcgatcggccatgcgtgcagcttcattaacatcatgcgtgatgagcaaactgcttaaatgctgttttgtgaaaatatcaaggatcagatcttgcatatgttgccgcgtcaaggcatctaatgcgccaagcggttcatcgagcaacagtaactgcggcttagctaacaacgctcgcgccaacgccagccgctgcttttgaccacctgaaagttgtactggataaccatcgcttttgtcagcaaggccaactgctgttaacagtgacttagcttgttgcacgatagcgggatcgtgtgatcgaaaagaaacgttgtccaaattggttaaccacggcagcaagcgatcattttgaaacatcatccgcatgaccagtccattttgacgttggatgtcaccggcagtcggcggctcgagtcctgcgattaggcgaagaatggtgcttttgccgccgccactcatgccgaccagtgccaagaattcacctgggtacaaattaagatgaatgtcatgcaagacagttttatcgttataggtttttttaatctgacgtaaactaataattggatcagtcatgcctcgacacctccttgacgccaactaaggaagactctttctaaacttttcgcaatgaggtcggacaccttgccgagcaatgcgtagatcaaaatacaaagcaggacggtgtccatccgcataaattcttgtgcattcgttgccatgtagcctaagccggaactcgaagaaatggtttctgcgacaatcaatgtggtccacatcacgcccagcgcgtaccgcacacccatcaaaatgttgggtaaagccccaggaaaaataattcgcgtgaacaagtcgcgctttgaaagaccataggcatgccccatttcaagcaattctggattggccgttgttataccttgataagtattgatgtagatcgggaacatgaccccgattgccaccaacgatattttggccgattcgccaatgccgatcagaataatcagcaagggaatcaaggatagatgcggaatgttgcgaagcatttgaatcggactatctaataaggctcggattggtctgaccaaaccgttcatcaggccaagtacaaatccgatactgccaccgatcgcaaacccagctgttgcacgatacaggctaatcgcaatattttttggcaattcgccactttgccacaaggtgatgccatcttgaatcaccgttaagggtgccggaagtaaggaactcgtgagccagttaaaactgaccgcggcttgccatccagccagtaatcccaacggcacgatccaaggcagtaccttgaaccaattgatatgtcttttggtccgcggctttggccgttgcgtgagtgtcgtgacttcttgcatcagggccatctcctttaagttgatggtgttcatactaacgagagcaacttaaagctgacttaactccatttgaagagtttatgacctaatcagcataaaaaaatgccctttcagcacgaatcatcagctgaaaggaccggaagtttgtctaaaatggttcttgaccaaaaggaattcataatcaataacatggcgagcacatttgagttttaaatcatttggctcaattctgtcacttcaaaatttaaaaaagggcatcaggtgttggatgtcgcaaatgattttcgccttattttacgtgcctgtactttgatatttcaccagaaaaagccgccatagttgataaacgagggtgaagaaagcaaccgagatgccaacaaccagaatagcaaaataccagcggccgttgtcaatgaccgttgattgcggaatagcggccacccaacctaatggtaaaaaccaggtgaggatcatttttaacggcgtattgtaaatggaaagcggatattttgaaaattcaaaaaagtcataaactgtctccgataaatctgctaacccttgtgacaacaacgacaccatcccgcctagtaaggttaaggataagaagattaaagaagtggcacagcacatcagcaggaccagcaagaaaataagtaaaggcatgtgcgagctgaatgcaatcgtggtcaaaatcagtacggatatcgccaagtcaccccaagcatcttcatcaaaactttcattcaacaactgaaaaagcggattgacaggtttaaccaacaagccgtcaaactttccttttcgcacataatccgcaatattcagcgtattaatgaaaaaacagcgaaaaatcgcaaatgaggtgctggcaatggcatacgtcgtcaacagttccgtaaacgtatagccctgaatcgtcgggactaacaaatataaaaagcgaagtgccgcaacattaatcaaattttgaatcatcatgccagcaattgaaaaataaaaatcaaaatcgtaaatggctaatgatttgaaattaattttgaaaaaggctaacagtaagcgcgcatatctcgtcatcagctaacctccctgaaccacaacacgttggatcgctattttcagctgcaagtgatagacaccaaataacgtggcaatatagagactctgcatgaacaatgtcggccaaaagtcggcagcctgctgctgtgataacaacttaccaatcgcaccgaacgcgtattgaaatggcaaaaactgtgcgattgttttcaccgctgctgggtaaaaattcactggaaaaacatttcccgacacggccagcaaaacagcagctttaaacgtattgataccccaaatgctataggtgtaaaaagaaaatagccctatgatcgcctcgagttcaaaatacagtacatatccaagcatgaccgccatcaccaacaacggtaacgtctgccacgcaagcgctgactgcctcaccacgaccaataggatgacatcagggataccgataaaaatcaacttgccaaatgaataaccaacactttcccaaaaataatgggtcagtaacggcactggccgcaataacaggcgggcgatattacctgtacgaatatcgtcgtggatagcaaagctagttttcggaaagacggccgtcaatagttgcatgaaaatcaaataagtgatcgtttcggcaaaaacggcacttggccgatgccgcaaaacactttgccacagaaaaaacatcacggcaatcgaaattaaattgccaaataagtagaagccaaacgcatagcgattggcgacactccttttcaaaccaattcgaatcatcatcagtcttaacgtcattggccgccacctgttgtcagtcctgatgaaatgacatattctaagcgtttattcgcaatcgtcacagaagccagctcggttgtcgcgatgagtcgcctcataaaatcttgaacctctttagaagatagtcccgcaactctaaaattgccattgggtagtgtctgcaccccaacgtcagcaagagccgctggcagattagctgaatcaacgagtgaaaattcaatctgtgatggcgtcgcgatttttgacaaagcttgtgcggaaatgtctgtcaacagttttccgtgatcaagaattaaaatgcgtgagcaaattttttcaacatcctcaagatcgtgcgaggtgtacaacaaggtcttgccttcgacttgttgtaggaacttaacgattttattcttagtgaccacatcaaggccaatagttggttcatccaaaatgatcagctccggatcatgaagcagcgatgccatcacctccgctttcatccgctgacctaagcttaacgttctaaccggttgctgcaaaaagtcttttgcatccagtaatgacgttaaatgctcaacccgcgccaaaaaatcttcttttgaaatacgataaatctctttgtttaataaaaacgtatcataaaccgggagatcccacctaagctgactgcgctgcccgaacacgatgccaatgcgttgcgcatttcgctgccgatattttgtcggatctcccgaaaatgtagcaagtgtcccatcatctgcccgcaaaatccccaaaatcatcttgatgagtgttgactttcccgcctagattgcataattaaagttaccacccagaaaatgtgaaaaaagacctgtccgttcttgctaaaatggtgtttgcataacataccatctagagagaaggacaggtcccatggccattataaccttaattgaacgatctcagatagaactgatgcaacaccacacgattcaatacatc

SEQ ID NO: 103 - DNA, 4782 bp, Lactobacillus paracasei
gtattgaatcgtgtggtgttgcatcagttctatctgagatcgttcaattaaggttataatggccatgggacctgtccttctctctagatggtatgttatgcaaacaccattttagcaagaacggacaggtcttttttcacattttctgggtggtaactttaattatgcaatctaggaattaattgtagaaagatgttgatgttggattatgacaaaaatatgcacattattagatactcaagactctcagatttctgaatgaatgaatctgttaccggaagaccaggttgatgcagggcaagcatatgatggtctcggcaactccgaaattattgatactgcttttgaaaataagatatggcaactaagtaagtttgctgccttaaatcaaccagtttcagtcgatattgatgggaaagtatatgccgaaattaggcaaactaagtacttcattggaaagataccgaacgacaaagtcaaaacattctcagccttgtatctaaatgacaaagtggaactgtgggtatctatacacggggggacatataaacaaacaagtacacgaagcgatggttctattactgtcaaaacttatagagacccagtaactttaaaacttatcgccgaagatcagcaaccagctaagacgctcaacaataattccggtgaagaatggtctgaagtcggcaaaaaaatgtacgcagcaaaaagaaagccttattgcctgaattgtaaacatcagcttaaaggcgagcgcttttgccccaactgcggggctaaaataatttatccaggtgaacatcagaacggtatgccaatcaattcatgggaaaaagttgccaatggtgctgataagttttcacaatcagttgacaaaaccgggaaattttttagcgacttcggttgtgcgatgactttaggatgcacaataccaattattataataattatactgttcggtcttatttagtcccttccccaacgcaagcggcgtctccgtgcaagccggagagtggggcttgtgccacataccaagtaaaggatgtgagtcatcatgctaaaaaagatagttgccatcttactcattgttttgttggctggcgcaacaaccgcttgcgctagtgatcaagacgatgatcaaaatgtcgagcagtttaactgagtgttggctggatacaaaaaacccccggccgctgtggtcgaggagcaattagattatgtggaggaaaagaaattgcaaaaagacaactcagataaagctaaaagtttgccagataaaaaatccggcctcttttttgacagaaatgtacaaaatcgttcaatcaaattagttcacaaagaccctgttccccccaaaccaaagatgccggattcggcatcttctaagaataaggattgattccgataatataaattttcaattgtcggtcgaagtcaatgatttgttcactgttttgtggagactcatcatattttttctgtgccaatttcacggtccaatcctgtccatatgtcatcaacccgatttgttgagttgggtcgtcgcttccaggtaggcgattggcgtaaccactagagataagcttgtcgttaaagtcgaaaatgatgacaagcttttcctcactgtattctttattttttaatgcctcaactagcggcgaccctggcaatacggtggcaacgtgaaattgttcttgtatccatatcaggcatgaatttcctagcttaattaagaaatagtaagtgaaggctaatggaacagacaaaatcagcgtaactacgaaaaggccaaattcactccagaagctgtgaccaactgttccccagatttgctggtaaattgcgaggccaccagcagcattcagcatagatatcagaatcaaagcgatagtacgatctgtctgtcttgctggcaaatcgaaatgaatagcatctagcttatcgagccatatgaaagtcaagaacccaaggatacccgctaagattagttgttgcatttccatgatttatactcacctaatttctttttgcatgaatttcattcacttaattatatcacaaaaagccacacagattgtagggggtaaagcctatgaaaccaattacagtaatctcttataagtttggcgaaaaaacttggaaaaattttgaaggagaaccgatcaaaaaatatgagcactcagttctcctagacatttcagacaccgaagtcttcactgataaagaaaaaacagaactaaacgacaagatcgttgtccccttttctagaattagagaaaaacgattcatcaaagatattccgctcagtaacgtaaacgaggcacttaacaagaaaaaagcaggcaggaaatagcgcaaaaagcgcctaccccaccgaccaaagtgaacgggtagacgcctaacaaatactcggagtcataaggctctttgtatactcgattttaccagaaaaggaggcaattcgcatggcaacatttaggaaacgcggcaaatattgggaataccgggttaagtatacggactccgccggtaaacagctggttgcttcacacggcgggtatcggcttaaatcatctgcgcaagatgctgcggaagctgtagaagatgacctcaaacgtggtggcgatccatcaaaacaagacgttctgttacttgattattgggatcaatgggctgaagcataccgaatcaatggcaagtcaatcaacactgtataccgttacaaacttttcagaaagcacctaaagagccgatttgatggccgaaagcttaattctattcgacctatcgaatggcagaaatttattaacgattttgctgctggcaaagatcgcaaggagaaaaccacacgaaagcggccacgtgagcgttcgaaagatatcgttaccaagatgaacagctatgttcgtgggatggtaaaagcggcaatcaatgaacgcattctattttctgattttacctttggaacgaagacatcaggcgtgtgctctagtgggaaagtaaaggtgctagacagccgtgatttcgctaaggttaaagcaattgctattgaacgggcttcgtaccgcaatatcggggcgcttgctgtttatattggctcgatgactggcatgcgaatatctgaagtgttggctttaacttggcctgacatcgatactaagctctgcgtcattcacgttacgcgttcttgggatcatttgtatggaacaggattcaaaccaactaaaactgattcgtcagttcgcgacattgagatatcgcccagcgtcattgagcttcttaataagatccatcaggaacaagcagcatcttatcttcgtactggatatcgtgacgaagaccagatgattatgcgtgatccacgtcacaacgtgattacagacagcgcatgtaacaaagccctgcacgtcattcagaacaaagctgggatccctgaagataagcagatcacctttcacgggttgcgtcatagccacgtcagctacttgatcagcaaaggcgtcgacatctattatatttcaaagcggttgggtcattcagacgtgactattacgatgaaagtctatggtcatttgttagactcacagagaaaacaagaagcacataaggccgtgttattcatggatcagctatgattgtgtttgtcccctttttgtcccccgaaaaataaaaacaaagtaactctaaagatacctaaattgctgtaaatattgatacataagctttttaaaaatctaaaataacctaaagaaagctaaataatgcctccaccgggattcgaacccggatctgtggtttcgaggaccattatgctatccgttgcaccatggagacttataactcccattatagccattctcgaataatttgcatcgtcctattgcttcgaaatcttcaaagcagtaaactttgaaaattaagttctgcctttataatcctgaataagaggccctctatgtcacaaataatactactcattgctgcattgtttttcttcactcgtcatgtatttcgtttcgaaagaatctcacggttaacattagttatcatacccgcttataccttagtgaccggtatattattagtttctcacaagtggcctacctttttggcacttggggtaaccatcttgattggtgccattctgggctggtttcaaacaactggtctaaaaatccacgtttctcaaaaacatgatgtcaatggccttcctatcattgaaattcgccacggatggcaatatttggtaggctggatcgtgatctttatttatggtcttgggtttgcgttgctatcaggatggcatgtggatgttttatcggaacttagtgaggagattgaaaaagatcttttcgtatggaagaacttttcctcaagcacatggaacatcatgatcatgtcagccacagctagtctggtctatacatggcgactgttgcagaaagagccaaaaattcaagccgtcattttcaaaggaacccatcttgatcatcatgactaaagtaaagaaagaatcacggactgatgcccatgatcatcagttgatgcatacttgcatttaattagtttatcaaatggtccatataatttttatccatataaaagtgggtctacactttctggtgttgagaaataatcaacactgaacgtgtaggccctttttggataacgcaaaaagacacctactcagtgtccatgctatgcttgttagcgtcgaaaccaaaagcaagcgaggttatgagtaaatgtcccaatacgatcctacactgtccgtccttggaa

SEQ ID NO: 104 - DNA, 642 bp, Lactobacillus paracasei
ctagaaggcagtcctattcgcatcagctattcgactatctacagaggtatctacctagataatctcggcgttccattgaagagccatggtgctcgcgggctaccaaggctgcttcgacaccgaggcaagacgcgcaaaatcaaaggcaccataaatgaacgccgggggcgcttcaatgacgtgccatcaattcacgaccgaccccggtcggcagaaaatcgcagctggtttggtcactgggaaggcgatacagtacgcggtaaaacaggacactctgcattagtaacattagttgaccgtaaatcacgctatctgctttcgaagcgaacggccaacgcaaaagctgacactgttagagacgtcatgattgagctgcttggtgccttaccagctaaccgagtaagaacagtgactcctgaccgtggaagggagtttgcccggtacagggagctggcagaacgtctgaatacaaaggtcttctttcctgacccacacgcgcctcaacaacgaggaactaacgaaaacaccaacggactgattagagaatactttcccaagaacacagacctagaccttcagagcgaccaggaaattgagacttacattgaacaactgaataatcgaccacgcaaggtcttaggc

SEQ ID NO: 105 - DNA, 1436 bp, Lactobacillus paracasei
aaccactgatttaacgaaaaatagtggctacgatggcggcaaaaagatttcagggattaagcgtcatatggcggttgatattaatggtttaccacaagccattctcgtgacacgagctaatgtatcagatcgttcaggtgcattggctatgtttagtttggctagccaaactttagagctggttcagcatgtcatggttgatggtggctacactggcaatgactttgcggatcaggtgaagctcattttgaatgctaagacgacggtagctaaacgcaacgagctgcatatgttcacggtgttaccgcaacgatggatcgttgaacgttcatggcgttggctagacaaatgtcggcgactttggaaaaactgtgaacgtgcccttaacagcagtcttcaaatggttgtattggccttcctgaagatagttcttaaaagataatagacaggttctaagaccaatctcaccactgagcccatcgccgctccgccaactctctgctttctatcctagtattcgagctagattgcccatggcactgcctcttgaagcgtttaagacagtggcaggcgcctgcgaagttaacgcgaactaccgttatttcaccagctcccagaagaaagatgaacttgccagaatataacacaccttatcttgttgcacgtgaaaactaggtgttacacttactcatatcacattcaattggaggcataacatggctgatttgtggcggacaatttctgaacggcacggcgagttgcttagtgccttggggcaacatatcgaaatatccttaattgccttgatgatcgccgttgtgattgcgattccattggccgtttgggtccagacgcatcacaaaaccgcggcagtgctgctgcaagtgactggtgttttgcaaaccattccttcgttggccttgttagggttgttgattccgtttgtgggtatcgggacactgccagcgattattgctttagtggtgtatgctttattgccgatttttcaaaatacatatatcggtttacgcgatattgatccttcctatgaagaagcagccgatgcgtttggcatgagtcgattgcggaagttgttcaaagttgaattgcccatcgccttaccggttatcttgtcgggtgtccggacggcaatggtcatgattattggaaccgcgacgctggcagctttgatcggcgccggtggcttaggtacgttcattttgctaggtattgatcgaaatgatgcggcgttaacgttaatgggtgctttggcagcagcgctattggcgattgtcttttcgtggctcttaaatgtcatgcaaaaagtgagttggaagatcagcatcggggttgtggcggttgccgtccttggtatggttggcagccaagtatacacttatgtgaccgcaccaaaggaaactatcacgattgcggga

SEQ ID NO: 106 - DNA, 1249 bp, Lactobacillus paracasei
ctagtgcaacgttgagcggtgtggaaattgttcacgcaatacgcaaaagaacccgacgagagttaagtctcatcgggttctcagtcgtggacgaattagaagcattgttagctgcataaccttcaacataggatcaatagctggttagatggtcatctctcagactgtttgcaccagatctagaaaaaataggtaagttcttcaaacaattagataaaactatcgctcttcatcagcgtaagcttgaaaaactccaagaacttaaaaaagggtatctacaaaagatgttttgctgagcttaatttgatcaaatttaggatcctatgaaaccccatgatttaatttttattgtgcttggtcaacacttaattcacctgtataatggattacgcaggaagttttaagggcggtggctgtcttttcccttgcgaggtgaggcccatgggaacatggaataatcttcaggaaggtttcacagtcaatgagcgtcttccagacactctcgttgatgttgctatttgcaatgtttattttagcgttgctaacgtacatcgacaaaaggaacaaataaaaaagccgccctgcgtaactttggccagttacagggtagcttaatgctgtcttattaacttcgccaccgcctttgaagcggcttgcatgggaagtcctgttctagcggggcttccttttttctgtctacattatagcatgactataatggactttcgactatttttaatcaactttctgccagttttagggaacacacgtttgctttatatgctacaatacaggtaaaagctaacggaagtgatctaagaacctgtctagtatctgctgaatctggtagaattgtggaaaaccgactgaggagtttgtcatgccagattatccaagcaatatttctcgagcgcaatttgcgttaatacaacctgatttagaaaacttccgcaagcatacaagaccgcgtcgttatgatctttatgacgtgttcaatgccatcctttactcgcttactacagggtgtcaatggcgtgaattaccgcacgatttcccggaatggcataccgtctaccgctattacgatatgtggcgagataaaccagacccgacagctgattcgctattagaaaggcttttaaaaaaactgttgcttcctatcgctttgcacagggccgatcggcccgaacgtcgtttgtgattgttgatgctcaaagtgttaaaaccactgatttaacgaaaaatagtg

SEQ ID NO: 107 - DNA, 564 bp, Lactobacillus paracasei
tcgaaggggttaaccgcctcatcaagtcactcaaacgatcctgttttggcttcaagaatcagctgaacttcttcaaacgaatctaccaaatcacggcataacatgacaaagacggctccccaaatggagaaccgcctcaaatgataaatttattcttcaacaccagttgacgcagagccatttaagtgaacggccttcttggtgaagtttaaccaatgaatctttgaaatcttgtgaataacgaattggcataaaaatactcctatactttcattttacggactgaataaaaatagtccatttttttagtataagagcatatctgtttgatgtattaatacacgaacctgtgtagccattggcaaagccatatgaatcatacctggttctggtgcaaattttcctcgctgacttgattttagtatactgggtgccaagaaacgagggattgcgcgcatgaatcactttaagggacgccactttcaaaaggacatcatcttagtagccgttggctactatttcagattcagtctcagctatcgtgacatcgttgaattgcttcgg

SEQ ID NO: 108 - DNA, 1489 bp, Lactobacillus paracasei
tcttaatgctgatggtagtcaaacagtcacggccttaatgagactcaagcatgagccaaataaagacccacgaactttgatggagttgtgtggatacgatcctgataagttcgagatggtcttaggcgactacaaagtgtatgagcagcatagtaccgaagacggcacagttccgcagtatagcattcatattcgcgtaaagccgaaacaaggcttatcgataaatgaaatggctgaagcgttcaacgacaaaatcattccggtcaattacggcatgaagaaatcgggcgatcgcaacttagtcatcccattgcctgacctgcattttggctggacaacattcgccgatctaaaagacatggtgagtcaacttagagagataatcatggacggctacaacgagattgtgatcgagcaattgggagatctattccatagtgatcagattcatgtaacacaaacggttagaggaacgcaactagatcacgcaaacatgcgtcaggcattccatgatgctgtgaagttgtttgatcagattattccgctggcaattgaatatagcaatcacgtctcaatgacagcaatttggcaaccgactggcgctgtgcatacttgctagggcatgttggcattatgctcgcacacggagatgtagccaagaacaaactgacaggactttttccatttgagtacaaaaagatattcaatatggcaaaaacatacgaacttcactcaggccactatcatagcgagcggtttaaagatgatcgtggcattatgtggcgccagcttggaacagcaaagccaaatgatccctatgagattaagaatggcttcaccacgggcaaacatctgctgtatgcgttcgtttatgacgacacgcgattgagatgtacttatgaactcaactaatgcgatgaagcgagtcgggtacggatatgtaagccacacagagcaagcaatcattgagaaactatcgagagaagagaaacacatgcaagcaatcatctacacaaagccacactgccaaaagtgtcggcgaacagtattcaagctgtcacgagtcatgccagtgcaaaccatcacagcagacgcggacgactacgagcggttccgcaagctaggctatcgttcaatgccagtcgtaacaatctacgaagcagacggcacacacgatgaatggtgcgatttaagggttgataagatcaagcagtacacggagggaaacatataaacggaaaattaatttacttggttgataaggatgagtatatattcataacaactattaattggcaagaatgtcaatggctcctatgctgtaattacggacaaaaatagtttgtgcgataattgacagatgaggaatattttatgaccaatacagctattcgctacacccccgaatttaagcaaaccttgattgatcttcatgaaaaaggacactcattcaaagaactacatgaagaatacggtccttccttagaca

SEQ ID NO: 109 - DNA, 642 bp, Lactobacillus paracasei
gcctaagaccttgcgtggtcgattattcagttgttcaatgtaagtctcaatttcctggtcgctctgaaggtctaggtctgtgttcttgggaaagtattctctaatcagtccgttggtgttttcgttagttcctcgttgttgaggcgcgtgtgggtcaggaaagaagacctttgtattcaggcgttctgccagctccctgtaccgggcaaactcccttccacggtcaggagtcactgttcttactcggttagctggtaaggcaccaagcagctcaatcatgacgtctctaacagtgtcagcttttgcgttggccgttcgcttcgaaagcagatagcgtgatttacgatcaactaatgttactaatgcagagtgtcctgttttaccgcgtactgtatcgccttcccagtgaccaacccagctgcgattttctgccgaccggggtcggtcgtgaattgatggcaagtcattgaagcgcccccggcgttcatttatggtgcctttgattttgcgcgtcttgcctcggtgtcgaagcagccttggtagcccgcgagcaccatggctcttcaatggaacgccgagattatctaggtagatacctctgtagatagtcgaatagctgatgcgaataggactgccttctag

SEQ ID NO: 110 - DNA, 471 bp, Lactobacillus paracasei
cgcatgaatcactttaagggacgccactttcaaaaggacatcatcttagtagccgttggctactatttcagattcagtctcagctatcgtgacatcgttgaattgcttcgggatcggggtatcactgttcatcacaccacggtcatgcgttgggttcatcactatggccccatctttaagaacctgtctagtatcttttaagaactatcttcaggaaggccaatacaaccatttgaagactgctgttaagggcacgttcacaatttttccaaagtcgccgacatttgtcttgccaactccatgaacgttcaacgatccatcgttgcggtaacaccgtgaacatatgcaactcgttgcgtttagctaccgtcgtcttagcattcaaaatgagcttcacctgatccgcaaagtcattgccagtgtagccaccatcaaccatgacatgctgaaccagctctaaattttggctag

SEQ ID NO: 111 - DNA, 25121 bp, Lactobacillus paracasei
  misc_feature (5389)..(5401): n is a, c, g, or t
ctgagccaggatcaaactctcatataaatatgagctgttcgaatagctcgatttgttgttctagcgaattgacttcgcaaatgttactttttgcctcggtaccgaagtaccaaggaccctgcacatttaaacgaaactttgttcagttttcaaaggacgaccttgtcaaaagacaactttgatatattatcacaagcaatcaatgcttgtcaataactttttttcatacctgatcggtaatcgttgttgctcatttacgacgctttttatcataccaacggtttgcgccatcgtcaacaactttttcaattaaaaatcactctccgaatgttagcgaataatagcacaatattatccgtgatttgtgctacttatatcctggtggccgtcatatctttcggaaaataaaaaatgccgccacaagggcgacatatcatgattggttatggccgcaatgttgggaacaaaaggacatcgcgaatggatggtgcatcagtcagcaacatgactaagcgatcaatcccgattccgagaccaccagttggcggcatgccgtattccaaagcttcaacgtaatcgtcatcgataccttgtgcttcgtcattaccagcactcttttcagctgcctgcgcctcaaaacgctggcgttgatcaattggatcgtttaattctgtaaaggcattggcgtattcaccgccaccaacaaatagttcaaaacgttcaacaaaccgcggatcttttggattcttctttgccagtggtgaaacctcgattggatggcccgtgatgaaggtcggctgaatgagcgtctcttcgacaaactgatcgaagaaggcactgataatatggcccaccttccaataaggttcatagtgaacatcatgttcatcggcaagtttacgcgcatcatcgacactcatttcaggccagaagtccacgccagtcttgtctttaatggcgtccaacatattaattcgggcaaacggtgcgtccagatcaatcgccattccctgataggtgagcttcccggtatctagcaccttatgcgcagcaaaccggaaaatcccttcagtttcggtcataacatctgtcaaatcccagtaggcggcataagtttcaagttcagtgaactcgggattatgcttggtatcaatcccctcattccgaaaaactcggccaatttcataaacacgttccatgccgccaacaattagacgctttaagtgcagttcaagagcaatccgcaaatataaatcaatatcaagtgcattgtgatgagtcacgaatggacgagcattcgccccgccagcctgattgtgtaagactggtgtctcgacttccaagaaaccattgttgtccaagtattcacggacagcactgacaatcttggttcgcttaacaaaacgatcaaagctgtcctcattagaaataagatcaaggtaacgtttccgatacttttgctcgacatcggtcagaccatgccacttatcaggtaatgggcggagtgccttagcaagatgggtcacatggttggctttaaccgtcagctcgccagaatcagttttcatgacttcaccgctgataccaagaatatcgccaagatcggcctttttgaagatcatgtagttgtcatcgccaacgacatctttacgtacatagatctgcatcttcccgctacgatcacgaatatccgcaaatccaaccttgcctttgccacgtttagacatcatccggccggcaattgtcacttctggtttttcatccaacagtgtctctttatcatcttcaccgaattcttcgcgtactttcgctgcggtatgggtccggtcaaatcggtgcccgaatggatcgatgcccgcttcacgcaaggcttccatcttttctcgccgcgcaatcatttggtcattcatttctggttgctgtccgttatccttagccaacacatgttcctccgtttcaatttttaccactctttgatgatgacaattttacatccaaaaagcaacctactctaagaaaaagacactcgtcactgaccagcaaaagtggacaggcgtgtgtcaatgaaacaatgctaatttatgctttagcttgccgttcgcgggcgcgctcttcggtttgttcaacaaaatcatcaaagatgtgatcaacctctgcctgcgtatcaaccatgttcaccgcggctttggttttagccgagcgcggaattcccttcaagtagtaagctgcctgcatccgaaattcccgaacggcctgatgttcgccatgaaggtcaaccagccgttgtaattgcagctttgctgtcgcaattttctcgcacggtgttggttccgggatcaattcgccgtcttccagataagccgacatctgtttcaatacccacggattacctaatgccgcacggccaaccataacagcatcagcaccaacctcgtctaacatccgcttagcatcttgcggggtacgaacgtcaccgttgcccatgaacggaatcgtgaggtgctgcttcacttctttcaaaatgttccagtccgcatgaccagaataaagctgtttacgggtacgaccatgcatggcaagcgccgcggcaccgccccgttctgcagctagggcattctgaacagcatagacatgcttctcgtcccagccagtccgcattttgactgtcactggtttagagacggcatctgttacagctgcaaccatttcataaactttttcaggatccagcagccagtgcgccccggcatctgtcttcgtcactttagggactgggcaccccatgttgatgtcaatgatgtcggctgccgtgttttggtccacaaacttagccgcattcactaaagtctctttggtaccgccaaaaatctgaatagaaatcggatgttcacgcggatctacaaataacatattcagagttttttcgtttttatacatgatcccacggtcgctgatcatttcacagaccactaacccggcaccgaattctttagccgttacccgaaaggccgcgttagtcacacccgccattggtgcgacaactaagcgattcggaatttcaacatcggcaatatgccacatacaggccacctctttcttgcttgcgccttgctaactttacttaaaataagtgtcaactgcaactattcgtgtcgggccatcaaggcttccaagtccgccacactataatgatattgattgccacagaacttgcacgtggtttctgcaccaccgtcctgatcaatcatttcctgtaattgagcatgcggtaaagttgccataatatcgccaaaatgttcttttgaacaattgcaggcaaattttaacggctgcgcatcaagaaattggactggttcgtcaccggcaattcgctgaataatttgctctggtgtcaggccgctttttaataattcagaaaccaacggtaatgttttgacgttggcttcaagtttagagagctccgcatcgttggcaccaggcaaggcttgcaacatgaaaccgccggccacctgaatcgagttgtcggcattgacgaagactgacaggccaactgcagccggaatttgctctgacttggctaaataataggtaaaatcttctgccaactcaccagaaaccaaaggaacttgcccagtgaaaggatcgccgacgccaatgtctttcgtcactgctagtaagccacgtttgccaacagcccgcgcaacgtcgattttaccgaccagattcagcggcaagttaacgtgcggttcttcaacatagccgcgtactgtgccaacattggtaccatccgtgacgagtgcgccaacgggaccgtcgcctttaatgcgaaccgtcaacatatcgtctgcgtttttcagcccggaagccgctaacaatgctgtggcaacaagcgtccgaccaagtgcagccgatgaagcgctccaagtatcatggcgccgctgcgcttcacgcactgtttgagtcgcatcagcagcgaaaattcgaaaatgttcatcacgcgacaatgcgctcgcgatatagtcactcatgtagggtcctcttttctgaaaggtaaacgtggctattttaccagagatgggtgttattgaaaagatgcggctatcgtagtcgcctgaacaagcgtggataaacaacttttatatttgtcgcaaagctctgtccatttctttccataaaaaataccccgcctttctatcagcgaggtattgattgttactaatcaaagctttggtcacgttcggcctatgtaccggccaagtgaaaagcttaagatgtcatttgaatttagttcaggcctgttgccaaagtccaagttaacgtggtttcgtacgtaccgttattaacgactgatgtcttaggcagcaccagtttgatattggtcttgtcccagccaaagacgttagcgccttcaccttcacctgtagccgcatgtgcaacctgatgattggtgtcagtgccactcaaagtcatcgttgttgttttgctgatgtcagtcaatggtaccaatgcaccaaccggcgtgaagccatcatcttgcgattcgttggtcaaaccgtagacattgccagtctggccataagccgtgttcagcatggtcaatgtcgcattgtcaatggtcttgccagtatcggcaccattatcgtccttcaatgaaagtgggccatctgccttgacgctcagtgtccaatccccggctttactgtcagtttggccagttttatcttcagcgttctcagcatcagtacgtgtcgtttgcttatcaacaaccgttgtccaagccttgcccttaacattagccaaagcggtgtcatcagtattaaggacagcggtcaagtttgtattaccgctcttataacttggatagcgagtattgtcagcccgccctgcgttttgtccgtcagcagtgaaaaccgggtaatctgagaagaactgttcgtggttaccaaagtccaaaatcttaggaaccatttgcaggcgcagataaccggtgttaccggttggcggcagttgactaaaggaaatccccgcggttgtcttggcgtcttgcggtagtgcctgaccaccgttaacgcctgcattaccttcaacagtagctgcttgcgttgccgctggggcagcgattgccaaaccggcaagtaaggttgcacccgcgaccaacgcacttgtcattttagtgaatttcattttgaaattcctcttcttaaaattttttacatcgtagaagtctcaaaaaacaacaaatatttttatatataatatctaacgatacgaatatattgcttcagcacttcataggtaaggtgtcaagtttcaaaaaccagatgattatttattaaaatatgataaccttcctcttcaaaggttcacagttcgttatataacacttttnnnnnnnnnnnnnagcattaaaacctcattattaacgaaaatagatcgatcggtcatttttttagcgcaatctgacacaccttttaactatacttaacgagatttttcctgctgccatgccatcatttgaatttagccatggcatgagaagacgaaaaaagtccttctcagcatctctgctaagaaggactttttcaaatcattcaaatctaagcttgcggaccctgctgatcatcgttgtttgaagatgaattgtcagtcgaagtatcgtctggcttttcaacctcatcagaatcagtatcgtcgtcactggcttgctgatcaccagattgtggtgaatcagttttaccactggcttcttcatctgcttgcttttctttatctttgtgttcaagggctgctttggattgctcgaaagtagcggccttttcacttggaaattcatcttggtcacgagcaggcattttgccatcgttgaacaagctgaggatttccttttcattcaaggtttcgtatttaagcagtgcttccgcaatcaacttatgctgttcacggtgggcctcaatgatttcgtgagcctgtttatgggcatcgtcgataatgcgacgaatttcatcatcaatggctgtagccgtcgtttcagaataaggtggtgtctgaccatattgtgcacccaggaacggttggccttcagtttcaagctgaaccgtgccgagacgatcggacatcccatactgcgtcaccatactgcgggcaatttgagttgcctgttcaaagtcattggatgccccagtagactcaacgccaaagataatttcctcagctgttcgtccacctaagagtccaacgatttgttctgtcaattccttcttggtaagtaggaattgatcatcctttggcagcatgatcgcataaccgccagcgcgtccacgaggaatgatcgtgacttttcgaactgtccgcgaatcgctcaggaccaaaccaacaatggcatgtccggcttcgtggaacgctaccatattccgttctttcggattgatgacgcggtcgcgcttcgctgggccagcaatgacccgatcttcggcttcgtccacgtctgaggcatcaattgccttcttacttcgtcgggccgcgactaaggcagcttcattcagtaagttttccaaatcagctccgacaaaaccaggcgtctgacgagcgacttccttaagatcaacacttggtgcaagcggcttgttcttcgcatgcactttcaagatggcttcacgacccttaacatccggtcggccaactagaatcttccggtcaaaacgacctggacgcagcaaagcaggatcaagcacatcagaacggttagtagcggcaatgacgataaccccttcgttaccggtaaacccgtccatttcaaccagtaactggttcaaagtctgctcacgttcatcgtggccgccgcccataccggcaccacgctggcggccgacagcatcaatttcatcaatgaagatgatggaaggagcagcctttttagcctgatcaaacagatcacgcacacgagaagccccgacaccgacgaacatttcaacgaaatctgaacctgaaattgagaagaacggcacaccagcttcaccagcaaccgctttggcaagcagggttttaccagtaccaggagggccttccaaaagcaccccggctggaatgcgagcacctaatgccgagaatttccgcggatccttcaggaattcaaccacttcaaccagttcctgtttctcttcttcagcaccagccacatcggagaagcgaactttgttggcatttttatctgcctgcttcgcccgtgatttgccaaagctcatcacccgcccggaaccaccgccttggccagcctgattcatcatcatgtagaagaagaccatcatgatcacaatcggcacaaccgtaatcagcaagctaaaccagacgccggattgtgattcttcctgcgtgtcggttttaacattgttagcgctggttgccttttggatctggctcaaagtcgcatcgttcgtcggaatatatgtcgaaaacttcgtgactttggtgctctgactaccaaacagactcagcgagttatttgaactagaagacttctgtgccttcttgtattccccactgaccttatagactccgccagatggctggagtgaataactcttgacgttgtcttttttcaactccgacaagaacgtgctggtttcaatctcttgggacgatgttgtcccattatcgcgcatataatacgcaaaaccggtgaccaatagcacaaaaataatgatatacgttaatgtgctactgaacaggccgttttgttttttcttcatttagaacctccggcaacattcgattagtaccttatatactaccacaaacacaacattcagatcaggattttgctgcgtagatttccggttttaatacaccgatataaggcaggtttcgataacgttcagcataatctaagccataaccgaccacaaattcgttaggaacagttgtcccaacgtaatcggcgtgcacatcaacgacgcgaccttctggcttatccatcaacgcacaaatacgaaccgacttcgcatgacgcgttttgaaaatgtcggtcagatattttaaagtccggccggtatcaacaatatcttctacgattaagatgtcccgatccttcacgctggcgtcaaggtccttgataatcttgacttcaccgctagactcggtcgcatccccatagctggaaacgtccataaagtcgagttccatgtaatcatcgatctcacgaacaagatctgtcataaacatgatggcaccttttaaaatgcacaccactaaggggtttttccctgcataatcgtgcttgagctcagcgccaagtcgtgccgtgatggcatggatgtcgtcttgagaatacaacaccttcaaaatatcggaactcatgatttatcctcacttttgtcaacatctggtgattgcaccagtacaacatggagtatatcagtttgatctatggccgacaatcgttctaaaggctgaccttcaacccaaaacacttgatgaccccgagctaaaaccaataattgatcgcgctgataggctggaatttttgtgttaatcaaaaaacgccgcagtttctgaatcacgccattgggtaattgcacaacatcgccagcttgccttgtgcgcaaagtaattggcagtttcactctgaccggcgtgcctttgtcagcagcaacgcttgtctgcaggctgaaaatgccacgagtggtacgatgttgctgatcaagcttagtgaatgtgaccggtttaactggcgcctgccgcgttaagcgaacaatttgttcactctggacagcaattgaaatcccgccgcccagatcaaaccgccgctcttttgtcccgcttagactcgctagaactggcgaaagtagctggcgatcaacgttgggttgccattgctgcagtattttttttaatagcagacgctgaacagcttccggctgcggtgatgcgacacgccaattaaacgttgcgtcatcaacctgcaggcgttgaagccactcagccagttgtgcttcagccaacgctaataggccagtctgctccatcgtgaatgtttgaatatgcgccagcaattgcgtgttttgttttttgaatgcaggaatgacctgatgacgcaactgatttcttgcgtaatgcggatcagcattgctggaatcttcgcaaaacctaacgttgtgctgatcagcataggagcgaatcatcgccttgctgtaaggcaataatggccgcactaaccggcgtccatgccaagttcgatcagcgcgaataccgattaacgcggccggatcgccagagcgcgccagccgaaacaaaattgtttcaagttgatcatcagcatgatgagctgtcatgacaacctcagcatgctgctcagcggcagtcgcggctaagaaggcatagcgtgcttgccgagcggccgcttcactggttggctgcccatcagatcgccgccattgtccagtcaccactggcacctgcaattgttgggcagcggcgacaacaaaggcttgttcctgctgactctctggtcgcaggcgatgatcgaaggttgccaccaccacatctaagtcagctgctttgacagccaggttcaacaacaccatcgaatccacgccgccagaaaccgccacgagcacacgagtatgcggtgcaaagccaaatcgttgaaaaagtttcgggctcatgggcatcctccacgcaatcctgcagaaaccaagaaaatgggcctagaacaaaatgtgctttgttccagacccgatttttaactgcggcgaccaccacggccgccgcgtttaccctcggtattgcggcgaagaacgcttaatcgatcttcgctttccttcaaatatcctgacatcatcgcatcaaaatcatctttggatggttgtgctttgtgtccaaaatgattgcccccgccactacgcgcaccgccttgatagcgattgccgcctggccgcgcagatggtgtatgatgactctcccgatgactattttcgtgttcactttgctgcggtttatcgaccgctttccggatagacaggccaatcttaccatcttggatcgaaagtactttcaccgtcaccggttcgccaacatgcagcacatcatgaatatctttgacataagcatcagagacctcgctgatatgtaccaatccggtcttgccatcgcctaattcgacaaaagcaccgaattttgtgatcccggtgaccttaccagtcactttcgtaccaacttcaactgccataaaaaaagaagtcctcctagttaaatgtacctattagtatagcacggcagaaaaccgacgcaagagcgcgagccagcccggttagaaaccggagtgtaagtggcttgggtcgtgatgaccgggttttggccattgcaaccaaagtccttacacgcaggtttctgggctggcgagcgcgtttaagcaagagcgcgaacaggcccggttagaaaccggaacataagtggcctcaagcctaaatggttgggctttagccatttaggcttgaggtccttatgtgcaggtttctgggtctgtgagcgcgttttagatgcaacagcgtccagagcctagcctttctatttagctgtccaaatcactgattcacattcaaatccggaaccttgttgaccttatcaggcaagttaaaaataatctctccttgctttgaatagagatatttttcgcgaatcagcttagccgtgtagtcatcattgtgcagttggtcgacctgaaccttgagggctgacttgttggcttttaattttgtcaaactgcccttcgctttttggacggcgtggtttgtctctcctaacgccatttgcgttcgaactaaactaagcccgccgaaccccaaaatggcgacaatcacgatcaacagattccgaatccgcttcatatgtacggcgtgcgcccgtggattgggcgtacgcttgtgcttttgttcgtgctcacgcgtatacgcattattcaattgactgatattgttctttgccatttgaccgcaccttcgtttttcaccagccatttacttacatccgtaaatcaataaatcaagtataacaaatcccgagggctgcgagccaataaatacgtattaaaatgtttctttataatcctctttcaaaaccgtgtacatccccgctgcgtcatttttcttggtggtttcaaccaaatcatccgctcggacagtaagcgtcttgttgccaaagttaatcactaacgtatcccctacacgaacatcagagcttgacttagctggtttatcattgatcataattcgccctttatcggcaatttctttggcaactgtgcgccgcttaataattcgagagacttttaaaaacttatctaatcgcataacttaattacctcgctttatccgttgtaagaacttcatatatagtttaccgcctggcaaatcgagcatttctcgcagcgttagcattttaagccaagtccctgcggctaagaaaatgatgactccaagtaataccccaacgactgtcacacccgctgccaccatccgggagcttaacggaatccaaccgacagcggcgtagactgccgcggccatgataccggtcacgatgattaacttagggacgaacagacggatggcactagcacctttgatcgtctcaggaactgcataataaatcaagcaaaggatcaagcccagtgagaggatcgttgcgccacttgccccggcagtaccgaacttcacgacaagcggctggttgatgacggctttaagcaatatgcctagcaacagcgcgacgctaatgccggcatactgatcaagactttgcaaaatagcattataggcattgatcatggcgacaacgacaatagcaaccgcatatagttgcagcgcaaatgtcccggctgtgtctccaaatagcagcaaatcaatagccggcatcaaaacaatcaagccagctgtcgccgccaatgcgaatgctaaattaaaatgcaccaattcggcaccgctgcgaataaactgacggcgctggcgggcttggcgcgcctgagtcagactcggtaaaagcgttgtcgacaaggatgccgctactacaaggcccaattgcactaaaggctgtgcccggtcataaacccctttaagacttttcgcagtcaccatggcgatacctgaagctgtgagcccttttgtaaccgtaaagctatcaatcagctgcaacaaaatcaacaaagctgcgtaaagtgtgatcgccccgccttcacggacaaaccggctaatgagacgtacataagcctgcatccccggaaaacgaaagttctgctgaccaaacacttgccgatatggccgccataacgtcaatgcagccgccgcgccgccgaagaatgcaccggtcattgccacagcacccatctgataaacgctccaatgatattgcaaaaaccaccaagctgctagcagaatcacagcaacacgcacgacttgctcaacaacctgactagtggctgttttagccatatcaaaagtgccttgaaaataaccgcggcctgtggccagcaacggcatcgtcaagaacatgaaagccaccgtttgaatcaacggcagcaattccggatctgccatggcttgcgcgatcacgccaccaaagatttgcaggcctaaaaacaatgcccacgagatccatgttaaaatcacgcggctttggtgcgcgactgttagcttggcctcatcgctatccgcttcagcaactagtttagaaatataaaccgggaacccggacaaagcgaatgtcatgcctaatccgtaaatcgggtaaatctgttgataggcatagaagccggtgtcacctaccatgttttggaacggtacccgataaacggcactgagtattttggcgattagtgagctcaggctcaaaatccacgcgccgcgcatcaagtgcttcatttcttggttgtgcatgggagccctcctatcactatatccactgacaccgaagtctgcttgagctgattgatcattggcatgtcatcacagccaagttgggtcaaaaacaatgaatgcccctacttttcacagcaactatgccgatttcttttccggttgtggattgacaacagtcagtaatccctgcaaaaagccggtcaattgatcaagccaagtcgcagtcttcatatcttttggcaatgctaacgtaactgtcagcttgccatccgtgatcgcgacctgcgctttcaatgttgtcgcacttaacgctttgaaaatcggctcgccttgtgctttagcagttgcttgcggtgacaacacaaccgtcaatttttgccccgccttcgttacgtgattgacccaagccaagtcagcaaaccgcttgagatgcgcaatcgccaataaattggtcaccggttgcggatagtcaccaaaacgatcaatcagatcttcgctgatctcagtttcggcttcatcactgtctgcttctcgaatgcgtttatacaactcgatcttctgacgggaatcggccacataatcagttggcaggtatgcttccagacccagatcaatttcagcatccgttttctcagccgatttaataccgcgccgtttgttaacagcttcttgcagcatctgggtgtaaagatcatagcccactgaatcgatgaagccatgttgctgcttgccaagtaggttgccagctccgcgaatcgatagatcacgcatcgcaattttgaaaccactacccaattccgtgaaatctttaatcgcctgaagccgcttttcagcaacttcattgagcaccttcatcggctgatacataaagtacgcataagcgactcgacttgaccgcccaattcggccgcgcaattgataaagttgtgacaggccgtaatgatcggcattctcgatgattaaagtattggcattgggcatgtccacgccagtttcaataatggttgtggtcaccagcacatcgtaagcaccgtgcaaaaagtcataaatgacgttctccaactgcgtctcagtcatctgaccatgcgcatatccgacacttgcatctggcaccagctcctccagttgactcacggtacgttccatatcttccacccggttatgcaggtaaaaaacttgaccgccgcgttccatttcccgttcaatggcttcgcgaatcacgcctggattttgttccatgacaaaggtttgaatcggatagcgattcgttggcggcgtttcaatgacactcaaatcacgcacgcctagcatggacatgttcaacgtccttggaatcggagttgccgtcagcgtgagcacatcgacattactcttgagttgtttgatccgttccttatgcttaacgccaaagcgctgttcctcatcaatgaccagcaatcccaaatcccgaaaagcgacatctttagacaacagccgatgggtgccaacgacaatatcaatggtgccgttcttaagccccttaatcgtttccttgttctgatgcgctgtctgaaatcgtgacaacaacccgactttgattggaaagtccgcaaaccgttctttcatcgtgtcaaagtgttgctgggctaaaatcgttgtcggcaccaaaatggctgcctgtttgccataatcgattgccttgaaagcagcacgcaacgcaacttcggttttgccaaacccaacatcgccaaccaataagcgatccattggcttcggcttttccatatcatgcttaatttctttggctgaccgcaactggtccggtgtctcaggataaggaaactccgcttcgaacttgtgctgcaggtcatcatccggcccaaatgcaaaccctttttctgcttcacgcttggcatataaatcaattaattcgtcagcgatatcttcaattcgggcagctactttgcgtttggttttctgccactcagcaccaccaagtttattgacgcttggcgttttgccatctgcggaaacatatttttggactagatttagttggtcaactggaatgaacagcttatcgttgttgcggtaaacaatcgtaatgtaatcacgatgcacaccgtcaacttctaatgtctccatcccggtgtattgaccgatcccgtgattaacatgcaccacgtagtcaccaggcttgagctcgttatagcttcgcaatcgctctgtattcgccagtgtttggtgccgtgcgtgacgacgttggcgagcattgaataactcgtgctcggtcacaacgactaatttcaagtcgggcagctcgaagccatttttcaggctgccttctgtcaattgcacctggcttggcaacagcttagtcggggctgtcatgacattgctaatctcaaaatctgacaacgtttcgctcagcttttccagccgatttttatctgtgatcaagaacaccacggtttgctgctgctttacccagcgatcggtttctgttttgagtaacggcatctgactgaaaaattgctgcacgttacggctgggaatattggtcaagctgtcaagtcgcaactgccccatgcctttttgaaaaaggctaaggtaaagccgcgggcgcttatcttgctgtgcaagttcctgaatcgtcaggttcggcgtgctaggtagcagacggccttcttcttgcaactgtgagtaccattctgccgtatcctgcaccaaggttgtatcgctatctagcaaacgactgtaatcatcgaatgctaccagtgcatctggttgcaaatagtcactgatgcgttgctgctctgggtatagttcggccgcatataaagctagattttcaggacgctcgtgggccgatagctgctggccagtcgtcaataaaccatctgtaacggcctgcttagcggcggcatttttcacttttgccttgtaggcattagcttgcttggtaatgcgctcgccagcagcggccaaaacctgatcagtcgccaccatatcggttgccggcgcaatcgtgatctgctgaagtttttgcagactacgttgggtggcaatgtcaaaactgcggatggaatcgatttcagtatcgaacaattcaattcgaatcggatcgtcttgattcaacggatagacgtcaatgatgccgccgcgaatggcaaactgtcccggcgcgctgactaacgaatcgcgtcgatagcccatggcgaccagctgtttggcaacggtttgcggatcaagctcggaagtcatatcaatggccaattcactagctgcccaatcggctggtgacggcaaaagccgcttataaccggccagactggttacgatgattccaggtttgccgctttgaataaacgtcaaagcattaatacgatcgttacgcgtctctggcgaactaaccgcgacttcagctgccaacacatcctcaactggaaaatcgtaaaccactgcatctccgagcaaactgcttaaatcagcagctaattcatcggcatgaaagcgattgttttcaacaattagaatctgctgcggtcgctgttgcaatagtgcgccaaaaaagaccgtcttggctgagcccgacagtcccgtcaccaaatggcgacccgttttcagcttcggccataatgccgacaatgctggatctgcctgcaccatgtcgatcaaattcatcgcgtcacctgcttctttcttctactaatgtacacatgtgcttcaccttttcgccatgaagtcacctatcttttaattaaacttattcatcagctgatcaaacggcatcccatttaaccaatcttccaaggcatcatcagccttctcaatcgcatcatcgattaacggctggtcagttttggaaaacggcgtcagtacccaatcaacgacccgttgccgctgcggatgctgaataccgatttttagtcgacaaaactcatcgctgccagtggcactgataatatccttgatgccattatggccgcctgctgagccgcgtttgcgtaagcgcaatttgcctaaggttaaatccatatcgtcttgcacgacaaaaatttcatctaattgtatctgataaaacatcatcagctcgcggacggcgcgacctgaagcattcataaatgtctgtggtttaacaagaaagatcttttcgccatttagacgggttgtcgcggtagctgcatcaaactccagcttgtcaatcgtcaggttcagtcgtttggccaagccatcaacgaccatgaaccccatattgtgtttggatcctgcatatttctgaccgggatttcctaggccaacaatcattttcattggaacttttatcctccttggggaaaacgcgtttatagttgtaaggactttttttgtgagtgtttctatattctggccggacgagctaactcgcttatcttctggtagcggccggtcacgttttgcttggaaacgcgctcacaggcccagaaacctccacataaggaccggggatctgtaagactgcttcgataagcatcgtgcctttgtggtagcggcctgtcacgcttcgctcggaaacgcgctcacaggcccagaaacctccacataagggtcttcgacataaatggccaaagaccggccatttatgtcgaagaccacttatgctccggtttctaagcgctcctgttcgcgctttaacacgaatagacggattttgcttttccgtccagagcagtataccatactgacgccttgcgtctgtgcgagttgaccgtgggaactgttgaatttcccacattcgtgaaaacagatgttggaaacgcttacgttattggaagcttgcttgaaacaggattcacaagtcttgctgtagtaaggctcgacgccattttttgacaatggcaaaatcatgaaaaagtctatcaaatttgtttcagggaattgataatgtgttatactcaacgtgaaatgcagtttgcatgcacataagaaaggatgatatcaccgtggcaagtattacggataaggatcaccaaaaagttattctcgttggtgacggcgccgttggttcaagttatgcctacgcaatggttttgcaaggtatcgctcaggaaatcggaatcgttgacattttcaaggacaagacaaagggtgacgcgattgacttgagcaacgcgctcccattcacaagtcctaagaagatttattcagctgaatacagcgatgctaaggatgctgatctggttgttatcacagctggcgctcctcagaagcctggcgaaactcgtttggacttggttaacaagaacttgaagatcttgaagtccattgttgacccaatcgttgattccggctttaacggtattttcttagttgctgccaacccagttgacattttgacctatgcaacttggaaactttctggcttcccgaagaaccgggttgttggttccggtacttcactggacaccgcccgcttccgtcagtccattgctgaaatggttaatgttgacgctcgttcggtccacgcttacatcatgggcgaacatggtgacactgaattccctgtatggtcccacgctaacattggtggcgttaccatcgctgaatgggttaaggctcatccagaaatcaaggaagacaagcttgttaagatgtttgaagacgttcgtgacgccgcttatgaaatcatcaaactcaagggtgcgaccttctatggtatcgcaactgcccttgcccggatttcaaaggcaatccttaacgacgaaaatgcggttctgccactttccgtttacatggatggtcaatatggcttgaacgacatctacatcggtaccccagctgtgatcaaccgtaatggtatccagaacatcctggaaatcccattgaccgatcacgaagaagaatccatgcagaaatctgcttctcaattgaagaaggttctgaccgatgctttcgctaagaatgacatcgaaactcgtcagtaatcatcacgatcactgataagtaagcaaccagcccagtcgctggttgctttttttgtgagcgcgagcaggagcgtctagaaaccggagcataagcgaccatggccgtgatggtcggtttttgaccattgcagccatggtccttatgcggaggtttctgcgactgcgagcgcgttatggtgagcgcgagcaggagcgcctagcaaaccgcaaatatctaaatgttttttaataattctgtaacaccacggtaacacttgatattgtcactcatgccgcgtttgaaacaggtgatgttgcttttaattcgaccttcaataccttataatggcgaagtacaatgtcatcttatttgaggaagtgcttgccacgaaacaagaacaaacgaagaacaggaggcagcgatcagtgaagaaaaacaagcgatggctcctcgttgttggcgtcctcgtcgtactcatgggcggattttacatcattcaaagtatgcattatcgcgaccattttctgccaaacacagaaattctcggtgtcgatgtctccggccagaccgtcaacgcggctaacaagaaattgaccgaccaattcgatcaacgtcagtacacatttgttgaaaagaataaaaagattttgaaagttaaaggtgatgctttaggacttagccaagattttaaaaaaggcttaacacaaatccttaacaagcaaaatccttggcaatggacgacatcagtctttgctggtcaaaaaaccaatgctcaggaagaccctactattaacactgctgctctgaagcaattcgcaacttcgacggctgacaagttaaatcaaaatcgtcaggaaccggtcaatgcgaagcttgtgacaagcggtgatcagttcaagattcaaaaggaagttaatggtgatcaaattgatgccgacaagctggcgacaactgtcacaagcgcacttgataaccatcgtcaagtgattgaactaacagatgcttataaaaagccaacggttaaagcatctgatcgcgacttgcagacaactgaacgtgatatgaacaaacttgcaagcactaaagtcagcttgcagattcaaagcactaccgtcacggttccgcaagcaactgttttgagttgggtcactaatgataatggtaaggcaacggtttcttcccaagccattacaaactatgtcacggccttgtcgcaacaatacagcaccattcacaagactcgtcaatttaattcccaacaacaaggtaccgtttccgttcccgctggcacttatggttggagcatcaacattagcgccacctctgctatgattcttgctagcgtaaaagctggccaagacttgaataaagaagtcagccacagcggatctggttatacaaccactggcgacatcggcaatacctacgtggaagtctccaaagaaaaacaacacgaatggtatattaaggatggcaaggtcgtcatggattctgacatcgtgactggtaaaccaggccaagatacgccgtctggtgtgttctatgtttggtctaagcaacgtaacgctaccttacgggggaagaacgacgatggcagttcttatgccagtccggtttcttactggatgccgattgattacaccggtgttggtcttcatgacagtccatggcaaccaaaatacggtggtgattggtacaaagaacatggctctcatgggtgcgtcaacaacccaccagacttcatggcgaagttatatgcagctgttgacgaaggcacacctgtgatcgtgtattaaaaatagattcgcacgacccataactattctttttagcgtcacaaaaaggcttgatacccgatatcaaaggatcaagtcttttttgtttattctaaattgtaaacattagctgatcggacgcgactttacgccacttggcgctaatgtttctttgagtcgtttatcttcattgcctccggaaacggaattcaaaagatctttatcaacaaaacgctggaacaattaggcattcgtaaggctaattggtacaacttcggtaatatcagtcatgcaacaaaaaaaacgaacccattatttaatgacatgtcaggaacggtcactgcacttttaaaaacaatcgtttccgaatagcattgtgcaacagatataacattacctctgaaagtgatcttcagcatgaacagtccagaaaaacgttacaccgccagtgatctatggtatcataaagcaagattagaatattttaataaagtgatacctgtttgatggaggaaaacgaatgttaattaagtcgttagtattaaaaaaggagttcctgaccactgtcaaggaaacggtcacccttgaagacgcgctgaagatccttgaagactccggctttcgttgtgtgccgattctggatgaaagcggcacgatcttccgtggcaacatctacaagatgcacatttatcggcacaagtctcaaggcggtgacatgagtttgccagtgacctatttgctgaagaatgccaccaagacgattccagtcaatgcgccattctttaaagtcttcttcaacattaaggatttaccgtatattgctgtccttgatgaaaatgccaacttttacggtatcttgactcacgctaaactgcttggcatgctgtcagaagcttggaacgttgatgttggttcctacgtgctgacagttatgtcgactggcgagcgtggcgatctggccaaaatgagcaagattttggccaagtatgtgtccatttccgggtgtatcaccttggatgccaaacgcgacgagttcgtacgccgcaccctctttacattgccggccggaactgatgaaaacacattgaacgaaatcgtttcccggcttgagaaaaaaagcttccgcgttgttgaaatcgatgacttgcaatcaggccaaccaatccgcatcgatgaagatctctaatctccatgtaacgctcacataaacaaaagaaggtcgatcgtttaataaacgaatcgggctttttttgtaagcacgtgcagaagcgcttacaagcctgcaagtgccctatggtggtgcgtgtgttggtgcatgatcgtgaacatgaagaacctgccttaagaaccttgcgctttgcgcgaaaggtctttgctgtccacctcatcaaaaatccactataatatgggataacgcattgcttgttgttatcgcgctgcatactaaacgggaggaataacgtgaaacgtatcactcgttttttcgatcagatcgcggccagcatccacttttttaagacacatcgtctcaagcgcaattatcgacgggcacttttattcttcgcgatattgttgccagtttgtgttgtcgcaattatagcaggtcaacggttacatcagccgacaccgtcaagttcgaaagccgctatcgctctatcaaccacaaaaaagaaacaacaacgtcacaaggccaccagtcataaaaccaaggtacatacagccccgaagaacattgactggacagcaccttccgagaaacaggcttatcccgacctcacccagcatccgaatattactttagatgtcaatctaaaaaagcaacgggtttttatcaaggaaggcgacaaaacgctatacacgatgtatgcgtctaccggtattgatgactcaaccccacgaggtgattttgcgattcaagacgaacggggttatgaattcttcaatccaaacgaacaaatgggcgcccattattatacaagcttttatctgcatggaacttatctttttcataccgtcccgacagatgtcggcggacaatacatcaaaaacgaggcggctaagcttggcaaagagcctggctctcatggctgcgttcggttgagtattgcggatgctaagtggatattcgagcatgtgccaacagggacgccagttaaaattcattagtttagtgcctcaaaaaccagagaaacctgttagtcaatcgactgactaacggattcctctggtttttgtgtaagtacgtatcaatcgtcagaatggtgagcattacttttcgctaatccgccaactagttaaattttctcactggccaacgtttgcaatgatgcatcaattttctccgcgcacatcctgccttcatgaatcccccagataactaaacttgggccgcgacggcaatcaccggccacatagatttgcgtgtcattggtcgtgaagttatcatttttggcagtgatgccaaattgatcaaaaagccattgttcagcgccagtaaagcccattgctaaaaccacaagatcggccttaattttcttttcggtgcctgccactggtttaaagtgatcaacctgactaatttctgcttctttgacttggccatctttgccgaagaaagccgtcaccgtcgaggcataggcggtaatatcgccaaacaatgctttagcctctttttgcccgtagccggttttcaaaaccatcggccactcaggccattgattttgcggtgttcgttctgctggcaacgctggggtgatttctaactgggtgatatcagcgcatccctgacgaatcgctgtgccaatacagtcattaccagtatcaccaccgccaagaaccagaacatgttttcccttcaactgatcatttgcggctggcccatcttttaaaactgtttgggtggctgctttgagaaaatctgtcgcttgcataatgcctgaaagttctctgcctggcaccttgagatctcgggcttcgcgcgcaccggtgcaaataacaacccggtcaaacgttttcttcagctcatcagccgtgatgtccttaccaacctccgtgtttgcaaccagttcaatccccactttagtcaacgtatcgatgcggcgctgaacgacatcttttggtaacttcatattaggaatgccatacatgagaaaaccgccaaagcgatcatcgcgctcaaataaagtgacggcatgcccgagctggttcaatcgccaagctgcagcaatacctgccggaccgctgccgacgactgcaatttttttaccggtgcgatgcaggggcttaccagagtcaaccacccagccatgtttgaatgcttgctcgataataaatttttcgttgttacgaattgtaatgccagcgccgttgagtgcctgcacacaggaaacctcacaaggtgctgggcaaacgcgtccggtcatatccggcaacatatttgagcggctcaaccgttcaaacgcacgcttatcctgatcacgataaaccagatcgttccattcaggaatcagattatcgttggggcaaccactcacggctcgtccgccgccaaaaaagacgccatgatggcagaacggaataccacagttcatacagcgcgctgcttgcttacggcgttcagccatgtctaaatcaagttccatcacattaaaatctttgatacgctgcatgatcggccgcattggatcgtcttgtctagggtattttaaaaacccttttggatctgccattctgttccctcctcgtaaatgcgttcaccagcccagaaacctgcgtataaggacctcaagcacactggccaaagcccggccaatgcacttgaggccgcttatactccggtttctaaccgggctggttcacgctctctatttcattgcttcatcaaaggctttttcaatcacttgttcttctgaaagtcccggtttggtgtaagcatcaatcaagtcgcgcattcggtgataatcgcggggatagacttttacaaacgtacctttttccttttcccagtgatccagaatcatctgggccgtttccgagtgagtatactggacatgctttttaagtagttcaatcagaatactgtcgtctccagcttcatccaagtgataaagatcaactaggtcttgactacaatgcttcgcaaaatcgtgtgtccagtcatagacatatgcaatgccaccggtcatccctgctgcaaaattacggccggttcggccaaggatgacggcgacgcctccggtcatgtattcgcacccgttattaccaacaccttcaacaacaacattggcgccagaattgcggacacagaaccgttcgccagcacggccattgaaataagcttcgccaccagttgcgccaaaacacgcaacattgccgacaatcggtgaatgggtgtacagttctcgagcttgtggcggtgcagcaacgatcaagcgaccgcctgacaggcccttgccaacatagtcattggcttcaccgaccaacttaatggatagtccttgggtgataaacgcttcaaaac

SEQ ID NO: 112 - DNA, 94949 bp, Lactobacillus paracasei
  misc_feature (92788)..(92825): n is a, c, g, or t
tttcccattcctatatggaagtaagacccctgagagatgatcaggtagataggctggaagtggaagtgcagcgatgcatggagcggaccagtactaatcggtcgaggacttaaccaagtaagcgtgcaagcaggcgcaggtttctgcgactgcgaacacatttcgatgacaagtacgttaggttcaaggcagcaattaaacaatgatagccagttttgagagcgcaaagttctcataagtgtggtggcgatagcaagaaggatacacctgttcccatgccgaacacagaagttaagcttcttcacgccgagagtagttggtgggaaactgcctgcgagggtaggaagctgccacgctttttttattccggtttagctcagttggtagagcacctgactgttaatcaggttgtcgtcagttcgagcctgacaaccggagctcatgagacatcctgcaaagggtgtctttttttaatattatttgcaggtctttaaacaaggattaagaacaggctggaccagtcatgaataactggtttaacttgacccgctgtacgatcactctcataatatgtaccagccatcacaaatgaaagaagtgacagacatggacaatcgattacaattacgccaacaaaataaaaagcacgcccatcgtggacttaagatcttttcaattatcatgggtgtgttgatcttgctcattatcgcaggggttttctttttccctcaactgaataacacggttcgtaatgtgacgggtaatgacacgcctgttgattctgcagttaaagctcgtctcgtttccggcattacagctcaaaagactggtgatgcgacaaccgatgcagctatccaacgggctgccgatacgttgaaagcaaccaaaatgagtacgattatggctgcggctaaggatcaagatcaggctgcttcacttttacaaaaggcatctggtgttaatcatagtcaagcagaaatggctgctgcggcgctttttcaggagagttctgtaacgccaattcgccaagcgattgcatcaggcgattactatcaggcttatcaagatgctaaaacgctgcaacaacagggtggaacaagtgccttaactagtttcttgtcaggacaatgactcagagcatcgattaacctgcaacacaatcattcgaaagctgaatgttgtgttgcaggtttttttaataagaatgcgcctcgaatgtgtgaaaaggtaagaggcgcttttatgtaaaagaaaagccactcccgaagaaatggcttttgatcttaaatcttgttggggtgattttgtgagtgaacgcgatacgagaaaatgagttcgttatgtgcgcgaatcaatcggcccgatactgtctggtctgacatcaccatgccacctggcagtaatgcatggtggtactgataaccagggaaaaaaggtgccgttagttcgaactgatgacctgtctttgtgtgcaagacctgcacatcacgtaagtcttgttgatgttcatccacatatttaatcaccaatgttgctggtgtcggctgtgacgttaaagaggctgttgcgctgtaaataaagatcagttgttgttcatctttggtcatgactccgaccactgtaggatcgccaacctcactgccatctggtagaacagccttctgaaagttatagccaatcagagttggtgccgttagccgaaaacgctgacccaccgcgttcgttaaatggttctcaggtccaagcgacttgccggtctcatcaacataatgaatggttaattttacttgtgccaaaatgtcccttcctctgtgatgtccagaaaatgttgcggttaagcattgcgagctgtgaagcgtgcttgtttgatggtcgggttttcgagctcatctagcaaggcaacggcaagtgtgtcgctatttaagacagatttgccgctatcatctttcaacagctcgtctttaccacgtacgtaggctgtagctggtccaggctgaaagttagcgcttggcgaaataccaagccagtttacattatcggtccaccgtaacaactgcagttcccgaaattgattcaatggtgtattaataaaagcagcagcgtgtggatctttttttagtgtatcatacaatgtctggtcgccattctttagactgcctgcgccgagaataaaaatcacacgtggcttatcagtgttgcgtaactcatgaattaagtggtcggccagatcaatgtggagataagcttgctcaacagttgtcgcaaaagcatcaataacagcgtcataacccgtcaactgctcgcgcgtcaacgtgaacgcatcttgttgaatcagatctgcatccggtggcaagattccaacacttttatctggatggcgaacataaccggtcacttcatggcctcgtttgagggcctccttaaaaatagccgaacctgcatgtcctgtggcaccaataatcgcaatcttcatctaaaacaacatcctttcatgacgattcgtttctttttcatgatacacttacaaaaagtagatggacaatcattttaacttagaaaatgattctgccaatgatctcatttaccatcaaaaaatgctttacagtgcgatagtgctcctgtataatcttatttgttgttcagcaatggcccgttggtcaagtggttaagacaccgccctttcacggcggtaacatgggttcaaatcccgtacgggtcagtatgccggcttagctcagttggtagagcatcggtatcgtaaaccgagggtcacaggttcgactcctgcagccggcatcttttcatgagtgattcttcgtggaacgtcactcgttgaacacgttagtccttccagttattaactggaaggatttttttgttcaatgtgtagcttcattcgagcgacatgccgccattaactcagcgtgaagaggtcaaaactgattcgtgacagacgtttgtcatcaacatttcttcggttaagcactgaactaaccaccacgctttacatctatcgctcgcgcactcatgctactttctatgatatcatcatacggtaacttaattgtttgaaggggtgcggcatgcatagacaggaaacaaaatcgaaaaagggactcatctggggtattgccatcttggccgttgtgttattgggcggcggtatttggtttggtgttcatcaacaggcacaagcaaaggcggcggccgcctctgcttcaagctctaaagcagcggttcgctcgcgagcttcggctaaaaagatgcgggaggcaacacaagcttctgagaaggccaaagatccagtttataaagactttgccgctgacggcctcagttttaatcaagtgcaagcggccaagcaactggatgtgacagcagtgggtgattcggtcatgctgggtagcgaatatttatacaaggaacttttcccgaagatttattttgatgctggtgtgagtcgacaaatttatgaagcaccggatttgttcaaatcattagcggcttcaggcaagcttgctgacacggtgattatcggcttgggaagcaatggcacatttaccgatgctgagttcgcgtcaattatgaatactcttggcagcaagcggcaggtatattggattaatgtccatgcagatacgacttggacagatgaagttaatcgcgatcttgtttcaatgagtcatcgttatcaaaatctgcacattgttgattggcacaaggcgtcagaaggccatgatgattggtttgtagcggacaaaacgcatccgaccacagagggccagccgcattatgtcgcaaccgttgcaaaagcggttttggcgaaagttaaataaagtcaattggagtcacgattggcgtctgtgcgcagtacttgagactgatcacagacgctttttcaaatcctatgagcaatgccatgtatgcaaaagtggcctgtcagattagcatttgtttgatttttttccttgctcgtgcgaaaacatgctatgctaccagtagcacaaaattggtgacgaaagcgggatgagcgcgatgcaggccttgatagatgtacgggaatcgggcgcttacttactgatgagcgttggtggcagtggcgctttgcggcggcatcttgccgaaatgggcttagtcgtgggcaaaaaagtgaccgtggttcagcctgcaagcaagttgtcaggcatggtgattttttttcaaggtcagcgattagcaattagcgatgaaattgcctagttactcgtggttcgaccgtttgccatggatgctgatacccctgccattgccttggctgatctgccattgcggcaggcaggcttgatccgcacgattaaaggggatccaccgttgcgtcaccgcctaatggatatgggtctcaccaaaggcacgttggtcaaaattcatcagattgcgcctttgggtgatccgattgagctagcggtccgtggttacaaattgagcattcgcaagcaggatgcggcacatgtgctggtgacggaggtgacaagcgatggcgatacgtgaaacgttagcattggtaggcaatcctaacagcgggaaaaccacgttgttcaatgccttaaccggcgctaagcagcatattggtaactggccaggggtgacagttgagcgtaaatctggccggctgaaagcggataatgccttagtcattcaagatcttccaggtacctattcattgtcaccttatagcagtgaagaaatcgtgacgcgcgactttttactaaatgatcaaccggacttggtcttgaatgtggtggatgcaaccaaccttgagcgcaatctttatttgacgttgcaagttatggaaaccgggcggccgttaattgtcgctttaaacatgatggatgtgctggtcaaaacgggccatcgaacgattaatttaaaaaagctgagttatgcattacaggtgcctgtcattgccacgacagcaactaaaccggctgccttacaggagttggtgcaaaccattcaggcgccgctaccaaagccttatgcctttcctgagtatgatgcgcgactcgaatcggcgctgacgatgcttgaggatgtgattgaccagaaggtgcctgccgatcggttgcggtggtatgccattaaggtttttgaaaaagatccgcaagtggtcaagcaattggccttttcttcagacgagcaacatcagatgaatgaaattttacggacggcggagcatgtgtttgatgatacaaccgatagcattattgtgaatgcccgctatgacttcattgcgcgcgtcattgcgatgtgtgtggttgacaaagatgactttgtgatgttgatgagcgacaaaatcgatcgcattgtgacagatcggtatttggctttgccaatattcgtcttggtcatgtgggccgtttattatttatcgattcaaaccattggcacaatcggcagtgattatctcaatgacacggtttttggtggctggctgccaagtgtcgtcggcggcaccttgaaaagttgggccgttgccccatggctatccggtctgattgtcgatggtctgattggcggtattggatccgtattgggcttcttgccgcagattatgatgctttttctatgtttgggtattttagaagactgcggctatatggctcgcattgcgttcgtcatggatcggctgtttcatcggtttaatctgagcggtaaaagcttcattccaattttaatagcgactggttgcggggttcctgggattatggcgacgcggacgattgaaagcgaaaaagatcggcgaatgagtatcatgttgacgacgtttatgccctgttcagctaagttgacggtgatcgcgctggtcagcggcacgttctttccaagcaacagttgggtggcaccatccgcttatttcatggggatcattgccgtgatctgttcggggatttttcttaaaaaaacagccttatttgctggtccaccagcgccgtttgtgatggagctgccagcctatcacttgccacgcctaaccaacttgtatcgcagtgtcatgtcgcgggcacgcgcttttgtgcagaaagcagggactattatctttctgtcatgcgtgttgctgtggttcttatctaatttcaatttcggtttacagatggttgacgaaaatgacagtatgctgcgcgcgttaggaaccatcattgcaccggtttttgcaccgctgggttttggcgactggcatgctaccgtggccactttagccggtttgatcgcgaaggaaaattgtgtcggtaccttacatatcagttttggggcaggcagtgctagcggctttggtcaggctttgcgcgctacctatccggcgatggcaggatatgcctttttggttttcaatctgctgtgtgccccatgttttgcggcgattggtacgatgtacaaggagtttggtgatgcacggtggacatggcgtgccgtgggctatcaaactggcgtggcttatcttctcacgatgttgatttatcaaggcagtctcgtggtatccggccaagccagtgtcatgagcatcgggctagttttagtcgcaattttgctcattgtttatgggctgctaatcaaacggccggttccggcaattgctgcaagtttttaacttgtcaactcatttaaaaaagggagtcttagctcatggcaacatggattattggcggtatcgttgttttaattattgcggttgtagcataccgtacatttttcaaaaaaaataaggctggttgtagccaatgtgaagaagtcggatgcccgctgatcgatcatgcaaaaatggtgcaggcgaacaatcggcggaaggcttaacccgcatgattttttaacgtatcacagctaacaacgcgcgagcccaaactagtgaagcaaatcgctagtttgggttttttaaaactcgcgtccgctgcttcgtctcggtataattgaaccatgcaaatattttcatttgacatccatgttgttaaaaagatagtgcgtgattcagcgtgggctgaagagcacgttcaaagagggggattcaaccatgacaagtaagcaaagtttttcaagcagtgacatcaccagtcagagcggctatttttcagcgcttaaggccacggttgaaacagcattttacggggagaatgtgaagcaggttactaccatcgcccaagcctatgctttagccaaaacagcgccgggtgtgattatcacggatttaccgatcaaacatacggctgaactgggattgccgccagatgccaaggtgttagtggctaatgacggccgtgtagttggtcggacggcagctgcccgccagattattggtcagcctgacgttgatgagactaaactggcggcgattgatcgggaagctgtctttttagggagtcgcaagacttttctccgtggggatgtcacggttggcttgtcctctgattttgctatcaaggcgcatttgatgctgcctgaggcgtatgcaaataatttgtatacgtacttgctgaattttcaaattgatacgccacaacgcaatgctgaatatgaacaatcgcgcccacttccagaagatgacatttatctttatgccgatcccgattggcatgatccggcgtatccaaacggtttggccgtgtttgatccaacgcataatgccgccatcgtgttaggcttacgctactttggcgagttgaaaaaaggcacgttgacgcttgcgtgggcgacggcgcatcggaatggttttgtcgcctgtcatggcggtatgaaacaatatacgcgacaggacggcgattttacgatggcagcgtttggcttgtccggttccggcaagtcaacgatcacgttggccagtcacggcgatcagtatcccgtgaaggtcttacatgacgatgcctttgtgattgatcgacaaacgggtgcaacaacggcgcttgagccttcatattttgataaaactcaggattatccgttgagtgatccgggcattcagtattttctgacggttcaaaatgttggagtgaccctagatgccgctggtaagaaaacactggtgacgcaggatattcgcaacggcaatggacgaaccgtgaagtcacgttacgtcacgccgaatcgcgtggatcatcttacggagagtatcgatgctattttctggatcatgaaggatgataccttgccgccggtggtgaaactggaagatcctgatcttgccgctgcttttggcgtgacgctggcaaccaaacgctcaacagcggaaaacgttatcggtgatgttgatcgtgatcatcttgtcatcgaaccgtttgcgaacccattccgcagctatccgttgggggaggattatcaagatttccaccaactctttgaacaacgccaaacagcttgttatattttgaatactggttcttacaacggtcaaaatgtgaaaccagccgatacgttaggcgcgattgccaagattgttgacgaaacagctgccttcaaaccatttggcctgctaccaaagatgcggtatctgccgttatccggttttaatgttgattttggcgacaacgattatcgcgctcgtctccgtcaacgtttggaagataggttggcgtttattgcgactaaagacgttgaccatgatggttatgatcgtttgcctattgatgccagccgtgcgcttgaagacgtcatcgctgcccttgaccaacaagccgccgcaatgtgagcaaggtagacccacccccaaattttaggatggtaaccatcgtcatttaaccctgaacaaacccatacgcattgcatgaatgattaaaataggggatagtaaagctaacctcaatacacgcagcccattgcactaaaaagatggcagcgtcatgcaaaggagtgcagcgtatggcgattcattttgtgatttatgaaaagcctaactgcgagtcatgccggctcaccaaacgctggctcgcagaacacggtcaacattttcgtacgacgaaccaccgaggtgaatcaaaccttgttgatattaacgccaatgatccgttaaaacgggcgtggagtcaccaaaaaattgtaaaatttcgtgaggccggatatgatcgttttccagttgtgcgcgttcgcgacgatgcgacgggtgatgtattggcaacatggggcggtttccgacctgaagcgttggctagctggacagctattaatcaacttgggtaaggcttcagctactgacatgaaaaagcacctgaccgtttttgtgcggtcaggtgctttttgatttgcatgatcatgacgaggaaactgggcatgattttagatacgccactacctattgcttaactgttgaagaatgctgagctgggcagatggtatttggccgttcatatccggaccaacattgagtaaaagtcgaccgcgtttagacctaagctctgcgatcaattgcttgatgtcatctgcagtaatatagtcctctggccgactgaggcggttataaccaaaacttttgtccatgccgcgtgtcatttcgaaataacgatttgtttgcggccagtcagtacgatattcaagggtgcggtagtcatagtacttaacctcgctgagatcgtctgagtgatgttggtcacgtttaatgacctgcgccgcaacgagattgaaaataggtcgtatccaactggttcgcatccaatcaggaaattgttgccagcggtcattcactaaaccttctgggacttgttgataataatacttgaacagcgtttccaagcggtgatcatctgggtagccgatatcgctccaaagcacatctgggtgataccgatcaatcaattcgtgccactgatgccatacataatctttgtaagtttggcttttgtcgttgcccaatagaaagctgccgtaatctttgattggcagatgcgggaaagtccagtccaataaagatgaataataggttccaaaacgcattccgtgggcgcgaacagcttgggccagttcaccgacaaagtcgaagttcaaatgatagtcaggttcgtacgggttattggtgtgcggatcaaacatgacaaaaccgtcgtggtgctttgtaacgatcacgacatatttggcgccagcattggcaaatgctgcggcccaggcctgcacatcgacattctgggcggtctgtttgaacgtttttgcgaaatctgcataagaggtgttgccataatgcgtccggtgataggctgctacggggctgtttggcaataacatgctgttgccataccactccgcataaggttgatgttcaaacaaataacctaatgatttggttttgattaaagtgccgtaatcaggaatattgactggcgcgtaagctggcacactatagggtccccagtgaatgatgataccgaaatccgcttgtttaaaccagtctggtggattagtgcgatgaatattaacagctgaaggtctggtcatgaagatcgtctccttgagagcatgatacacgtcgaaagctgtcacttctgctcaggtcgaaaaagtgttgccagttaaatgattgatcgatgcatcatttagattttgatgactgcgtattcgtcacccgtttagcagctagagcagcgtacatctcatcacgagcggcaccttgcaatggataatgtcgggcaatcagataggctaaaaaagaaaacacagcaggaatagcgaaaaggacaacgcctaaactttgcaacaagttgtctggcacatgcgttgccttttcaagcgtttgggcgttgtaaccaacgatcagtagtgcagcaccgacgccgattgtggctagtcctgattgtagtttttgcagaaacatattcacggcattgatagtcgcttccataccagcattgagtttgagtcggttgtagtccattgtttccataatgattaaattggcagggacaaactgtgctccggcgatggtcatgacaataccgatgagtaagtagaagacccacggattatcaatgacatgaatttcattaatgataaacatgatgactagaaacggtgccatggccagatagcaccactgaacaccgcgaatagccgaaatgtactgcattgctttttgagaaataagagtgcctgcgaccagtgtgatcaaggttagcaggccaaaatacatggactgtgtgccgagatttttcaccccaaaggcatacttgatgtaataaagcgaggttgcggtcagtaatgcccaaacaaacccaccgacaaaggtaaagtacaagttgatacggaaagggtgattgatcttgatcatctgaccaatatctcgcaatcttggcggcttagcctcctcggtaaccggaccttctttgaccatgacaatgccgatcaacgacaaaatcagaaatggtatgacgatcagatcgacggttaagggaatattggggttgcgctttgttcctagatacgttgcgatcgccatgaagaaggcgaaaaccaccccgacaatattgctggtgatccgtggccatgaaattaactttgcacgcacttcctggtcggctgacatggtactggtcaacggaaccgtcacaataatcgtggcagcaaacataaagagaaaataaacgatatagaggtaaacctctttaccgaaattggagaagttttggggaatgtgaaaaagcatcatacccaaaataccggctaataaactgcctattaacacgtatggtttaaactttccccaccgggttcgcggcgatatatcgatcagatagccagtccagaggtcgttaacagcgtctcataaccggccaacaaataacagggtcgttgccacagcagcggctttgccgggtacacccgaatagatccctgagtagtcagttatgaacatcatcagaactgccgtgtataaataataagctgttgtgctcattaaccccatagtgttgatcccaaataaagtctgtcgatcaagcggatattgctttggataacctttcataacgttcctcccagatagccgtctcggtgcgcttgcaaaagccagagtgcgtaacccatgtttgtatggataacaccgaacagcttgattaaattataggtgatgttctgcgaacttgcgaggaaacgttgttgaaaggttcctttaaattgactgaattaacaactaatggcgcaaaattcaaattgccaatcagatcaagcatccggaagtcaaatattaagatataaattgtcaatatttaaaaaatatttttgttatcttattttcagtgcaactggccatgaaacatgaaaatcacaattagttgtctgtcaagacatgggggcacaactcaaataaaacaagttttcataattgaatagattgcgtgcaatatcaaagaaaaaggttttcacagactgctgtcatgtttgcaaatcgtaataataataggcttttggagggttatataacgttaggtatttaaatattagacaataattatattgattataagacattagtgggtataattaagagcgtaagttgatgaagtcacaagactagggggggactatgaaatgcatacacgatgccaagaaccaaactatgttgaagttgtgaaccagaacttggaacgactgcttgtttttgaaaccgtttttaaggaatatgtgcacacgtgcaaaaacatcgagaaaggaaattgctatgcaagtgaaagtctcgatcatttgcgtttgtacttcaccaagaatgtgatgaaattttgtacattcgttgacagtgtggatgcggaagcagcaccttgtaattatgcggccttccacaaagtactggtgaatggtttgcgcggtattcgtggcggtgttttgaacatgcttcaagcaatcggcactgacaaagtagatcatgaccgatttgccgctggtttagccgaacaacaggctgctcgagctgagatcgatacagctttctcaaaaatcctcgacccaattttttaagccgatcacccgcttctttgtggcataatagaggcaaagctagaactggcgcggttagaaaccgaagtctcaacgtgattgagatcgtgccacgcaggtttctgcgccagcgagtgcgttcaaagaaggggatgacggcatggcagtttggcgcatgatgtttgcgcggccacagtttaagcacagacaaattaagcgcatggtcgatgatctcaatcgtgaaggtaattttggcggcatgccgattcatcgcatcacgcttactcgacaaacccgcgaactcatttatgtcgacttggaatttcagctaaccactgggctcacacaacctttatttgagcagatggcaaagtatattctggtcgcagtcgctgggttggctcacgctccgcaacccatttatcttgccgcaatggcgaatcctttcgcaaaattaaatattagttattacatctatccggatcatagtctggatttgatttattggcagccgttactgaggaagcccacttaatcagtgctgacatatgcattcaccgaaccgcaaacctgttgaacaggtagcccggctcggttttttcgtatccactttttgctcatgaccggtatcgactcatcgttggtgtttaaatgcaacgatagttagcggcatgattagtttgcgtgtgacatctcattgagaaacagtagcgcgtttctagactagcgcaccaattcagactatgggctgattatcaagtagttcataagtatgctaagatatggcaagttatttcattccaaagtataaacaggcaccattaatataacgcgtgatttggcgtaggcagaaaagtgcgatcagtgattagccgttaacacccgcttggggatcgcgattgcgagcgaacgtttcaactattttctatttcagaaaacgcattaaggggagaacaacgattgctagacttaaaacatattaaaaaatattaccagacaggcgactatacgaccaaagcgcttgacgatgtctcagttcaattccgggaacaagaatttgtcgccattttgggtcccagtggttcggggaaaacgacgttactgaatgtgatcggtggccttgatcgttatgattccggtgatttgctcttacacgggcgatcaaccaaaaattttaaagaagccgattgggatgcctatcgtaataactcggttgggtttatttttcaaagctacaatctgattatgcatctgagtattttggaaaacgttgaacttggtctgactttgagtggtgtgtcagcagcagaccgccgtaaaaaggccgaggctgctttgacgaaggtcggtttgaaggcacatatgggtaagcaacccaatcaactttccggcggccagatgcaacgggtggcgattgcgcgtgcaattgtctcggagccgtcgattctattggccgatgagccgacgggagcactagataccgaaactagtgaagaaattatgcgcttaatcgctgatttatctcgcgagcggttggtaatcatggtcacgcataatcctcaactggcgcatgaatatgcagaacggacgattgaattcaaggatggcaaaattctttctgactcacggccattcaaagatgaagaaaaaactgccagctttgacctgcatcgcaccaaaatgagttatttcacggcgcttaaattgtcatttactaatattatgaccaaaaaaggtcgcacttttttgacggcatttgcttccagtattgggattattggcattgccgtggttttagcactttcctcgggctttcaaaaacagattgataatacgcaagcggagactttggcgcaattcccgattacgatctcgactaacgccactagcttaacagcgggagcggcggacaatacaaagacatcgacttttaaaacaacctcaacagttgtggctaagcaaagtgctagtgataaggcgcagcacaccaataagttaaatcaaaagtatattgattatgtgaatggcattagcaagaaactaaccgacaacattggctacacttatggcactggtatgaatctgttacgtgacgtgaatggtaccatcaagccagtccaattttcgacagctaagccaagcagtaatcaaactcaacgtggcttggcaagcgctagttcatcagtttatccggttgatcgcgaaggcggcaccagttatctgaagaaaaattatgaggttgttgccggtagttatccgaagcatgatggggatgttattctgattgttgatcgggacaactcgacgaacatcaatgctttgaagaacctcggttttgatgttaaagatggtcaaaaagtgaaatttaaccagattgttggcactaagatcaaggcaatctcgaataatgcctattaccagaatgttgctggcaatgtctatgtcccaacgaaagattacgcaaatgcttataaacaaaacgacaaccgcgaactgacggttgctggtgttctgcggacgcgctcgaaaacaagtgatggcttgcttagccaagggtttgcttattctgatcggttaacaaaagatcttgtggcattgaacaaagactctgatgtcgtcaaggcacaacgagccagtgacgtgaacatctttaccaatcaaagtgtggacaaagcgactaaggatcagttgatcacggcattaggcggttcggaaacacccacgcagattacgatttatccaaccagtttcaaggataaagacaagattctgagttatcttgataaattcaatcgcggtaagaaaaaagccgatcaggttgtctatacagatttagcggggacaatttccagcatgaccggtggcattatgtcagccattactatcgtcctagtggccttcgctggcatctcactggtgacctcgatgatcatgattgcaattctgacgtatacttccgtgcttgaacggacgaaggaaattggggtgctgaaggctttgggtgcacggcgtaaggatatcacgcgtgtgtttgatgctgaaacgattatccttggcgttagttccggtattctagggatcattatcgcgtggttattgaccttcccaatcaatgccattctttatagcatgacagagttgccgaatgtcgctcaactcaatccgattcatgccgtgatcctcattcttattagcaccatcctgactgtcctcggcggtcatattcctgcccgcatggcagccaacaaagacgctgcgattgctttacgcgcggactaacgcataattaggtaaaagaactgagcaacatatctcgatgatttgcgccacacaccgttttttggcggacaggcggtcatctgggaatgttgactcagttttttgctttggtgctggttttttaactggacctgcctacgcttcacataaacgtgttcgctggcccagaaacctacacataaggaccgcggcaactttatgctccggtttatactcggaccagctcgcgctcctcataaacgcgtttgctggcccagaaacctacacataaggacctcgggcgcaatggccaaaacctggccatcacacccaaggccgcttatgctccggtttctacccggtccagctcacgctcttgcctatttgtcttcaccaaaaaatacatctataatgatagtttattgattggcattttgagggaagtgccatgagagcagctaggggatcatttcctagtgagaggatgtatttcaattgaataattcaaaggatcgcacgtttatggggcatccccgggggctattaaccctgtcgatgactgaattctgggagcggttcagttactatggcatgcgggcaattctgatctattacatgtattacgcggtggagaagggcggcttgggttttgatcagccgactgcgttatcgatcatgtcgatttatgggtcactggtttatttaagtgctacaatcggcggcttcattagtgatcggttgttaggctcacggcgaaccgttttttggggcggcgtgttgatcatgctaggccacattgttttgtcattgccaattggggcgactggactgtttggttcgattgttttaatcgttctgggcacgggcttattaaaacccaatgtgtctgaaatggtcggtagtctctatccggaagatgacctgcgacgcgattctggctttagtatctttgtcatggggatcaacttcggatcgctcattgcacctatttttgttccgtggatggcggataaagtcaattttcatgctggcttttcgctagcagccattggtatgtttgtcggcctgatcttttacgtgattgacgggcgtaaatatattaacccagctgacaatactgctcctgatccgttgaagcctgaagatgttcgcccattggtgatccgtgtggtggtagcaattgcggctgttggtgtcattttactggcgatggccgggttcaatgcgctgacgattgccaacgtgatcagcctgattaccttaatcgcgattggcttgccgatttggtactttgtgctcatgattcgtagtaaaaaagttacgaagactgaacgatcacgggtgattgcctatattccgctgtttttagcagcaatgattttttgggccattgaagaacaagggtctgtcgtgttggcgctttttgcggcccaacagacaaagctggattttggcttttttaaaattctccctggtaattttcaaactttaaatccattgtttattttgctttatgggccgctttttgcatggttatggatgaaactcggtaaacggcaaccgacatcgccgaaaaagttttatcttggtttaatttttgcgggtgcctcttatttatggatggttatcccagtgatgctgtttggcagcagcgccaaagtttcaccattatggctggtcatgagttgggcgattgttgaaatcggggaaatgttaatttctccggttggcttgtcagtcacaaccaaactggcaccgaaagcttattcgtcacaaatgatgagcatgtggttcttagctgatgcctcggcacaagccgtgaatgcgcagattgtccggttttatacgccaaatcacgaggtggcttatttcgccattgtgggtttggtgtccgttggctttgcggttgtcctggccttcttcacaccacggatcgaaaaattaatgcaaggtgttaattaggcttcgaagcttcaacgtcatttggtccatgctgctgacaaaatttggtggaggtgcgctgatggtgaaaattgcgttcagtgttgacaaccattttgatgtgaatcgcgtcgatggctttgagatgctgaagaagcaggccgcttatctggttgaacatgattatcagatctatgtgaatgccggtgatacttacaatgacttcaccaaatctttggcttattttcgcgcactgcaggcagaagttgggtctgcagtcaccattcgctttttggcaggcaatcacgatatggtgaatggcgcaacgtacgatgaaattcaatcagcggttgatccgctgtatctgcatgaaaagattttgccagtgcctggcaccaatgctgtcattattggcaacaatggctggtatgattattcgctaggacagctgggcaatatgaaaaccgatgcggaatatgctcaatggaaacgcgccttttggattgatagtgccattgacgcgcctgtcactgatgctgcgcgaatgcaacgggttttgaccaccacgaaggcagcgctgcaagcgaatcagacgcaccagatgatttatgtgacgcattttgtgccgattcgtgaggcaatggagtacacagttgatcggccgccttggcagatggcaacggcgctaatggggtcggccaaactcggcgatttgctgacaggtagagtgtcggcagtggtgttcggccatgagcattttcgcgatgcgcctaagcttttaagcggtactacgtattatcatcagccgcttggatatggcttaaaacgattattcgagtggcagagtcaagattggtggactgaatggcggcagacgcttgtgacattaaccgtgccaacgttgtcttgaacgctatcacctttaagaatacgaaaaatgcggtcaaaaatcagacaaatgctgttgatttttgaatcgcatttttgtatgctatttaagttgattcgcagcaatcacacggaggagtagcgaagaggctaaacgcggcggactgtaaatccgctccttcgggttcataggttcgaatcctatctcctccatccagtattaaagttcgatagaagacgtaaacgcatggcggaggccatgcgttttttttatttcaagcggtccagctaattgacatggtatagcccaaccgctacgcttaaagcaatatgaggaagggcgtgatcgtatggcaattaaagcgacagatctttttaaattggtatcattgtcgtatccaagtgcgacagatgatggctactttgttcaggaaaatcgcatttcggaggccgataatacttattatcagcgcatttgtttcgtcaatcatcgtggcggcactatcgcgtatggctttgatcaaaaacatgatcggcatccgctgcttagtccagatcagcagtggttggcctttttgagtcaagcatccgataaaacgactcaagttttcttacaggcggtcaatggcggtactgccaagcaattttctgctgaaaaagaaggcgtgtcctactttggttggcaagcggacagtcaagcactgtttattcagacgacagttggcgcaaagccgaaaaagacggataagcagtggccacaaccggtgacggtctcacgtgtgccctataagttaaatggggtcggcttattaccagaacatgtcgcttatgaattacgagtccaacgcctgcgtcaaaagaccagtcgtttggtaatgggccgggagcatgaatttgaagtcggggcgatttctccagacggacagaccttggcatttactgcagagcgcctgcccgatgacccaaatgattttagccaggcaacttatttgttaaatttagctgatcaacaggtaaccatggttaatgatcagttaccgcaagcggccttatcgccagaagcattttcagcagatggcaagcaattgctgcttgtggggtcggacaatcatctgccaaatgtgtcgcaaagtcacttgtggcattatgatttagcgaccaaaacgttgcaagatgtcgccgatgatattgattttgatattccgggacacgttaatggcgattttcaacaggatttatctgaaaaagtggctgattttgccaccgccgactattatctgacgattggttttgaccatgggaaaacgagcttgtatgcaggcggtcccgacgagcagctgacacctttgattggcggacgtcggcatgtaactgattacgctttaacgccggatcatcacggggttgtttttacggaaagcacaatgacggttccaagccgattgagctactttgatttggcgactgaagaagaacacgtgatttatgatcctaatcgtcgggtaacacgcgatatggggttggtgacgccacaaacatttaacttccagcgcgatggtttcgagatcgaaggttggtatttcccgccacagcaggcgacagcttctcatccagccattttatatgttcacggcggaccggcagttggttatgggtataccttcttccacgaaatgcagttcttggctgctcaaggctacggcgtcatctgcccgaatccgcgcggtgggttagggtatggcgaggcctttacagcggccgtgattaaacattacggccaaggcgattatgaggattgtatggcatcagtggatgaagccttgaagttggataccaccattgatcctgatcgtttgtatgtggctggcggatcatacggcggctttatgacgaactggattgtgacgcatactcaccgatttaaggctgctgttacccaacgatctattgctaactggttgagtatgtacggtacaagtgatatcggctacttcttcacaccttgggaactcgaaggaaaatggaccggtgatttatctgatgtgaaaagcctttgggatttttcaccgctagcccatatcgactttgcccaaaccccgacgttggtcatgcacagtgaaaatgatcaacgctgtccgattggccaaggcgaagaattttatattggcttgaagttgcatggcgttgatactaagttcatgcgctttcccaatgccacgcatgaactgtctcgcagcgggctaccgaatctgcgactagcgcgattagcagccctcgtcgattggttcaagacccattcagcaacagaagaaagtcatcaagcataaaggaggcaggccatgacaattggatttattggtgccggcaatatggcacgggcgatcatcactggtttgttagctaaaaatgcggtcacgcctgaggaaattgttctgcatggcgggcaaccgattcactatgaaccgtatgccgccaaaattggcgccaaagcggtcgcgagcaatcaggcagttgcagacactgccgatatcgttttcctagctgttgcccccaaacttggtgtgccgattctaaagacaatcgggccaacgctcaaacaacggcaggtaccgattgtttcgatgcttaccggtgttttactggcgacccttgaagatgcccttggcagtcaagatcaaccgatcctgcgaattatgcctaatgtgaatgtggctatcaacgcggggatgacggcttacgcggctaatgatagtgttgcgggtcaattagatggcttactggacttattgaacgtcttaggtaaaactatggcgttacctgaggatcaattttcgacatttgtcgcgttggcagggtcatcaccagcttttgtttacttattcatcgatagcctatcgcgggctggcgttaagtatgggttaactaaaaaacaggcaacagccattgctgctcaagcagtgatggggagtgcccaaaatgttttggccagcgagcaatcgccatttgatctgattgatcaagtctcaagcccaggtggtacaacagtagctggcttgttggcgatggagcaagcagggctcatgtctgccgttatcaagggagtggacgcaaccattgctaaggatcgtcaaggataagtatgacgttgtacgacgaaggtatagcttgtaatcttggtctataccagttatactggtatatgttatctgtcgaatgaagcattaaacaattaggagtggtattgtgacggttacagtattgaaacacgcaacgatctatactggattagaacgcatcgatgacggctatgttcgtttcgatgacaaaattttggcagttggcgacatgtttgattatcgcgcccaatctggtgaacagacttttgaccttcaagggaaaaccttgattccagggtttattgatgttcacgctcacggcggttatggctttgatgccatggacggtgatgcagatcagattgatgaaatggcaacgaaaatgatgacgcacgaaggggtgacgaccctttttgcaacgaccatgacgcagtcaactgagaatattgacaaagccatgcgtggcgttaaacaggcggctgaacgcaaccacattattcaaggcgtgcatcttgaaggcccattcatcagtaaggtcttcaagggtgcccaacctgaagaatatatcaagaatcctaatgttgatttagtgaaacagtggcaggaattatccggtggtctggttaagctcatcacctatgcgccagaagacgaagggtcacaagcatttgaagactacttgttggcgcacaacattgtgccttctgttggtcacagtaacgctacccgcgaacagatgctgcatagcaaagcaacacatgtgacgcatctctacaatgctcaacgcggcctgcgccatcgcgagcctggtgttaccggtcatgcgatgcttgaagacaacatgtattgtgaattaatctgtgacggcttccacatcgtgcctgatatgctccgcctcgcttttgaccaaaaaggaccagaacgaatcgaattggttaccgactccatgcgtagcaaaggcatgccagaaggtaagagtgaattaggcggtcaaacagtttatgtcaaagataagcaggcaaggcttaaagacggcacacttgccggctcagttctgatgtataaagatgcctttaagaatgcgatgagcttcatggatgcttccttgtttgatgccgttgaaatgtcatcggttaaccaagcacgggaattcaacctgacatcaaaaggcacgcttgaagtcgggaaagatgccgatatcaacgttttggatcgcaataacgatttggttgcaacctacagctatggcgttaaacacgacaccgaagactgaaccacgatttggaggcgatcattcatggatgcaccagtttatattcaaattcataacgcgattcgggcagatattgaagcaggcaaatggcgcgttggcgaccgaattccttctgagcgtgatttagctgtcacgtttaaagtgtcacggatgacgttgcgccaagccattcaaacattggtcgatgaaggcattctcgaacggcgcgtcgggtccggtacctatgttgccaaccagaaagtccaagagaaaatgtctggcgtcacaagctttacggatctgatgcaagcacaaggcaaggtgccatccagtaagacagtctcctaccacgtggcccagccaacaagttctgaagttgaaaaacttaaacttgagcctaaagaacaagtcttgcgcatggaacggattcgttacgcggataagattccgattagctttgaaacggcggctgttccatacaacctcgtcaaaaactttaccaagaaagaaatgacagccagtttttaccataccttggagaaaaaaggcggttatgtgcttggcggtgcgcaacagactgtcagtgcgatgctggcaagcgaacgaatctcagagtatctggacatcaaacgtggcgaagcgatcctacgtttgcgtcaggtatcattcttgcaggacggtacgccgtttgaatacgttcgaacgcagtatgttggcgaaagatttgaattttatctagaacggtaatgtttgctgcttggttataaacgctaggcatttggaaaggtcaaagagcaagatggcatcttgttctttggcttttttcgttggttttgatgctatttgaaagggaatctgagcctaagctatgctgatttcgaaatgcgcgaacaggcgcagaaacctgcacataaggacctcaagcctaaatggccaaagcccagccattttaggcttgaggccacttatgctccggtttctaaccgcgcctgttcgcgctctgtcccattttctctgaatggtatataatgatgaactataaattaagcatcactgcgcctatacgagcgcttgtttgttgttgccacttatccggaaggggagccatgatgaccacacagttgggtgaaggacttacactccacaccgatttttacgaattaaatatgatgaataccttttttgaacaggggattagcgaacgcaatgccgtgtttgaagtcttttttcgggatttaccgtttggttcggggtttgctgtttttgcgggattggaacatgtgatggactacctgaatcatcttaagttttctgaagatgatttagcttatctgcagtcgcaaacagactattcggatgcttttattgattatttacggcatcttaagttcacttgcactgttaagtccgctttagaaggcgacttggtattcaacaacgagccgatttggcaaattgagggaccattggcgcaagcacagctggttgagacagcggttttgaatatgatcaactatcaaacattggttgcgaccaaagccgcccgtattcgcagcgttgctggtgcggaccccctgatggaattcggcacacggcgggcacaggaaacggcggctgctttgtggggcacacgggccgcttatattggcggcttcaatgcgactagtaatgtattggcgggtaaggaattcggtattcctatcagtgggacccacgctcattcgctggttcaggcctatggcaatgattacgatgcttttaaagcatatgcccgcagcaataaggatgttgttttcctcgttgatacatatgacaccttgcgttctggtgtgcctgcagcaatcaaagttgcgaatgagtttaaaggcaagatcaactttcttggtgtccggatcgatagtggtgacatggctttcatctccaagcgagttcggcaacaattggacgatgccggttatgaatctgctaaaatttacgcctcaaacgatcttgacgaaaatacgattcagaacttgaagatgcaaggtgccaaaatcgatatttggggtgttgggacacgtttaattaccgcctatgatcagccggcattgggcgccgtgtttaagttggtatcaattgaagatgcagccggcaaaatgcgcgacacgatcaaattgtcgaacaatgctgagaaagtttcaacgccgggcaaaaagcaggtttggcgtattacgcgtcaagatgatggcaaatctgaaggcgattatgttgccttggcagatgaaaccattgatacacaacgaagtctttatatgttccatccgaactttccgtacatcaataaaacggttaaaaattttgaagccaagccacttctacagacgatttatgacaaaggccagcaggtttatcacacaccaccgttacaagaagtccaagcatatgccactcggagtaccaacgcattatgggatgaatatcgacgcattctgaacccacaggactacccggtagacttgtcgcaacgggtttgggacaacaagatggatctgatcaaagcagtcaaatcagcggtggctgaccgcgaggaataatctatgagggcatcgaaaaggcgatcgcagcatcgttggctaatccttagcttactagtcggtcttgtagttggaatagctgcttatgcgagttacgatcatttttatttgaagccacagattgaggctaaggaagagcggactcggcgtaagtatgaaacagaattgaaccgacatcgggcggttgagcaacgcctccaaaatgaaacgcgaacagcgacatccgcgactgacaagctcatgcagccagttaatcaggcggaagccaagccgtttatgaaaatattggaggctaatcattttagtggtactgcgttgatgatcagacgtggcaaaattattttgaacacaggacttggctatgccgatgctgaatctggacgtttaaatggtccggagacactttatcaaattggttcgattcaaaaagggttgactgccgtgttgcttatgcgactagttgaacaaggcaaagtgcatttgtctgacccgatcagtaagtacttgaccggcattaggacaggcaagcaagttaccttgcgcatgatgctcaacatgcgtagcggcttatcattgacgcgtgcgcagagtgcttcgctttctgacgctggcattgtccgttggtcgattgccaacttaaattatggaacggttcgttatgattaccaaccagtgaattatgttttgttggctggtgtgattgagaaagtgactggccgactgtatgccgatttgattcaacaggaaattttcaagaagttgaaattgactcactctgggtttatgccagagttgtttcacgagtcgaatcaggcgtttggttatagtggtcccattaataatccctacgcaaaacggtacacagagccttctgtgaactataatcgggaactgggtactggcaatatttatacaagtgcgggtgatttgtatcagatcatcaaggcggtgaatcaggggaaaatcatttcaactgcttcattgaaggcactgcggaatttggataatggtcagtacacagcgggggtttataattttggaggctacaccttaacgcacggggtggtggcttcgcaatctgcaggtaccatgattgataccagcggccaaaacgcggttgtcttgcttgccaacacggacaagataacccaaagtctcattaaaaatttgtatctgaatatgattaaaggagtttgactatgcgtccattacaagcagaaatcatcaaagcattgggtgttcaagcaacaatcgatccggaaactgaagttcgtcgtagtgtagactttttaaaagcttatttgaaaaagaacacttttttaaaaacttatgtcctcggcatttcgggcgggcaagattcgagtcttgctggcgctttgaccgaaaaggccatgcaggaaatgcgagcagaaaccggcgacgatgcttatcaatttattgccgttcgtctgccttatggtgaacaagccgatgaagccgatgctatggctgctatcgactttatgcacgctgatgttgtcaagcgtgtgaatattaagccgagtgttgatgcaatggtcgcggcggttgaggctgatgggtcaaagatttctgatttcaacaaaggcaacatcaaggctcggatgcggatgatcgcgcaatatgcgattgctggcaataatgccggtgcggtgattggcacggatcatgccgctgaagccgtgactggcttttacaccaaatttggtgatggtggcgctgatttgacgccattgtatcgattggacaaacgacaaggcgccgcgcttttgaaggtattaggcgcaccggcacacctgtatgaaaaggcccctacagctgatcttgaagacaatcgcccagcgctgcctgatgaagttgcgttaggcgtcaagtacaaagacattgatgattatttggaaggaaaagacgtcactgatcaagctgctgaaacgattgaaaagtggtaccaaaaaaccgcccacaagcggcatttaccaatcacggttttcgataatttttggaaataacgcttaaagacagccaaggcatcaccgatagcaatcagtgatgcgacgggctgtctttttgctggataatgtggtatttttgcgtccagaaaagttaaatttggaagagcgtgagctgagccggttttctgggccagtgagcgcgtttagataagagcgtgaactgagccggtttgaaaccgaagtataggagcggccatttaggtttaaggtcctcacataaaggttttgcgctcgtgaatgcatttaaaggagtaggttttaagatgtcggggaagcatcgttatatttggttgggcgtcatgctgattttatgtgcagtcagcattggtgcgggaacgtacctttggcagcaaaacagccgatccgccgtgaatacgaagtcaaaatccgcaaagacagtcacaaaagcggtacgtcaggatcggggtaaatcaaaagaagaaatattggccatgaccttggatcgtgccgcgacgacgactgaaggccaaccacttgagcaagagttgaccaatgacaagtttattggcagtgccctgatcattaagcacggcaaagtcgtgtttaacaatggcgttggtgatgccgatacgacgacacatcgccgcaacggtccaaccacgctgtttcagattggttcaattcaaaaagccgtgactgcggttgcgcttgcgcaattggccgcttctggcaagctcagcttggatgatccggttggcaaatatctaactggcatcaaaaccggcgatcaagtgactttgcgcatgatggtggctatgcgcagcggctttagtttgcgtaagtatcaaccaactgtaatggatgatgctaatattattcaatggtcgattgccaacttaacctatctgccgcaagataattacgcttatcaagcagttaattacgtgttacttgctggtgtgatagaaaaagttgctggtcgttcatacgagcagcaagtcaaaaacaatattttcgatcggctcaacctgaagcacacaggctttttacccgcaatgctgacagatcctgagcgagctatcacttacactggcccggctgctaatccttatcaaactgcgattggtgaaccagcagtttggtataatcgagaactaggcacgggcaatgtctatacttccaccggtgacttataccggctgttgcgtggtattgatacagggaaagtattaccactttcaactctaaaaacattgcgtaaccgcaacgatggtgtttataacgctggtatttataaccatgctgacttttactcaaccaacggtgtcgtcgccggtcagatggcctcaaccgcgataagtcatgatggccaaaatgccgtcattttgctcagcaactacaattcgcatgcactgaatctgcatgacttagcggttcacctatttagtgagttgggctgaatggctgcctaataaggccacttatgctggtttctaacacgacttgcacgctctgctctgattaaacgcgtttgcaggcccagaaaccgggcctgttcacgctcttcgcaagtaagccttgcgaagcatgacccgcacctgatatactttaaccaacataggggagtaactagcagagtattctgcgacaacgtcaccaacaaggctatgtctggtgttgtcttaaatagtgagacttatggatctactgctggtagtccataggtctctttttggctaccggcccaaatacgaaggaggcactactttggcaaacaaaccgccatatgcattaagcagtgaggcagtcttaaagcaagaacagactagtctaaccgggttaacgaaagaagcggcacaaacacggttaaatgagaatgggccaaatgaacttgcgcaggcagaaaagaagggcatgttagcccgtttcttagatcagttcaaggattttatgattattgtcttgttggttgccgctttgattgccggctttttactcagtgagtgggcggatgccgggatcatcttggccgttgtcttattaaatgcggttttcggcgttttccaagaaagtaaagctgaggaagcgattgatgcgctgaaggaaatgtcgacccctaacgcccatgttcgtcgtggtgatcaggtgctgaccattcctagcagccaactggttttaggggacatcgtgttacttgaagctggagatgtcgtaccggcagatttacgactagttgagagtgccaaccttaaaattgaagagagtgcgttaacaggtgaaagtgtgccggtcgataagacgacggcgccgttggatgctgatgatgtcggaattggcgatcgcactaacatggcattcatgaacagtaacatcacatacggccgtggcgtcggtgttgtgatcgctacaggaatgcaaactgaagtcggccgcattgccgggatgattaattcggccgaagaaaccaacacgccgttgcaagagaacctcaaaagtctcggtaaaacgctgacggtcatgattttggtgattgcggtgattgtgtttgcagtcggtatctggcgtcaagcggcaagcttgccagaaatgttcctgacagccgtttcattagctgtggcggccattcctgaagggttgccagccattgtcaccatcattttagcattgggtacgcagaaaatggccaagcgccatgcactggttcgtaaattgcctgctgttgaaaccctcggcagcacggatatcattgcgagtgataaaactggaacgcttactcaaaataagatgacggttgaaaaagtttattacgacggtcagcttaatgatgcaagcgctggtattcatggcggcaatccattaatgaccatcatgaactttgccaacgacacacaggtgcaagacgatggtaagttactaggcgatccaaccgaaactgcgcttgttgcttatggaaaaacccagaattacgatgttgccaaagcactcactggcgaaccgcggatcgcagaagtaccgtttgactctgaacgaaaattaatgacgacagttcatcgacgcgcagatggcaagttgctagtcgccacaaagggtgcgcctgatgaattactcaagcgggtgactgacctagcaactggcgaaaatacggcgccgttgtcagacagtgaacgcgatgccattttgaaagccaataaagacatggcgacacaggcgttgcgtgtgctggggatggcttataaggtcatcgatactttaccggaaaaagttgattccgatacggttgaaaatcacatgatttttgctggattggtcggcatgattgatcccgaacggccagaagcggaagctgcggtggcagaggcaaaagcggctggtattcgcccgatgatgatcaccggcgatcaccgcgatacggctgaagcaattgccgttcggttgggaatcattgaccaaggcgatgatgatgctgtcatcaccggtgctgagctagatcagcaaagtgatgatgagtttgcaaagaacgtggcaaagtacagtgtatacgcccgtgttgcgccagagcacaaggtacggatcgtcaatgcttggcagaaaaaaggcaaggttgtggcaatgaccggcgacggtgtgaacgatgcgcctgctttgaaagctgcggatattgggatcggtatgggcatcactgggaccgaagtttccaagggtgcttctgatatggttttggctgatgataactttgcaaccattgttgtggcggtggaagaaggccgaaaagtcttttccaatattcaaaaggcaattcagtacctgttgtcggccaaccttggtgaagtcttgaccttattcatgatgaccatgctaggttgggatttgctggcaccggtgcatattctctggattaacttagtgacagatacgttcccagcgattgcactgggggttgaaccaactgaaccaggtattatgaagcaaaagccgcgcggtcggaagtcaaacttcttctcaggcggcgttggccccgcggttatctggcaaggaattctcgaaggtctgctgacgcttggcgtttactggattgccattacctatccagtgcacagcggctcagctgcgattcacgccgatgctttgacgatggcctatgctacgctgggcttgattcagctgttccatgccttcaacgtgaagagtatccatcaaagtctgttcacggtcggcgcgttccggaacaaggcctttaactgggcgattctggcttccttcgtgttgttggcagtcacgattttagtgccaggtttcaatggtctgttccatgtgacatcgcttgattggcatcaatggatcaccgttctcggggctggtgtggcgatgatcgtcattgttgagatcgttaaagttttcgaacgtgctcgacgcaagcaacgcgcataagacaccacaagattgcttagagtcaaaaaacaataggaatagccttgaccgtgatgtccgtgttgtaacggtcatgacagtcaaggcttttatgcgttaattaccggctaatgagccgatgaaaaggatgaagcacatgaataaacaacaaatgaagttagcaaactatgggacgaccattaatgcggtcgttgaagccacacaagacaaccaagagaaaatggcgccgttgtttgaaccgctgcgcaaggcgattgatgagaacaagttggccgattacgaccttgaggcttaccaacaaacgcaaaccgtgtttagcgaggggacaagtaactatgaagcgttgcttgtcaagttgcagcaagtcgcggcgccagtcagattgttggggccccatcatacacttgtacgtgattttgccgctttcacagaggcatgtaaggcgatgaccgcaagtttgcacgcggatcggcaagttgatgtggcagctttcaacgcagctgaaaaagctcaggacgaggcaattcaaaaattcaccaagcaaatccaaaaaatttcagtcatgttgtcttaagctggtcaaaattgtcaaaaaaagtttaagcttatacttgacatgagaactttactcacgtatctttaatctaacaacaaatcaattaactaggacggaggaaaccgacatgacagcattgcttaccttttctgcttggcaaagccaactttaggtaggttgcagacgcaacctgccagacgcgcaggttgtgtctatgttggctctctgttcaatttgtccgcatagataccccaaaagtgggactatgcggactttttttattgccgcgacgagtcctcacctgtcgcggcaatttttgtaagcgtgagccagcccgtttagaaaccggaacataagtggcctcagacagaaacggctgggctttggccatttctgtctgaggtccttatgttccggtttctgggctgacgagcgcgttatgaatcataactgattaagtccaagcgggcacagcatgaattaatttaaaacggaggcggaaacatgaaacgaatgctagggttgatcttcattatggcagcattcttagggattgcctattttcaaaccggcacgacaacaccacagacacaggcaacaccaactgtgggtatcctgcaattgaccacacatcccgcattagatgcgattcacaaggggattattgatggcttgaaggagaagggctatgttgcagggaagaatgtgaagatcgattttcaaaatgccgaaaatgatcaaagcaatctgaagtccatgtccgaacgctttactgaggaacatgcggcggcaacagttgggattgctacgccatcggctcaggcacttgccaatgtcaatcagaaaacaccgatcattcttggcgcgattaccgatccagttgcggcaaagttagtaaagaatgttaaacggccaggtggcaatatcacgggggtatctgatcaggcaccgattgccgcgcagctgaaattaatccggcaaattatgccgaatgccaaaactctcggtgtgattgcaacgtcgagtgatgattccgctcaaacacaggctaaaatggtcgaaaaacttgggccaaagcaaggcttcacggttaagcggtacgcgatcagttcaacaaatgacttaaatcaggtggccacacaaatggttagtcaagtagatgcgatttttgtgccgactgacaacactgttgccagtgcgatgcaaactttggttgcggtggctaatacgcggaaggtgccaatttttccaacagtggacactatggttgaacaaggcggattggcaacgattggtcttgaccaacatcatctcggcgttttaactggccggatgctggcagacatcttgagtggaaagacaaaaccagcaacgacgccgattcattttgaaaccaccggtaaactgatcttgaacgaaaaacaagcaaaactgttaggcatcgacttacctagctcgttaatcaaaacggcagaggcgaaaggaacggtgatcaaatgagtattggcgtatcagcgattggtcaaggtttattatatggtttaatcggacttggcttattcttaacatttcgggtattggatttcccggatatgacggttgaaggtacctttccatttggcgcggcagtagccgtgagtgccattactcatggcatttccccgattgtcgcaacgctgttggctaccggtgcggggatgcttgctggattggcgactgggttgttgaccacgaaaggcaaaattccagttttgttggccggtattttggtgatgaccgggttgttttcaatcaacttgcggattatgggacgcgccaatctatcgctgttgcatcaagccaatcttttccagacagcgttcttaaaagatttaccgccatacttcaatagtgtggttatcggcgttatcgttgctgttgtggtggttggcttgctaatgctgtttctaaatactcagttaggccaagcgtttattgcggcaggggacaatccaagtatggcgcgcagtctcggtattgatcctgatcatcagatggtacttggtctgatggtgggtaatggtctcgtcggtttggctggcggtttgctggctcaaaacaatggctatgctgatgtcaatatgggcattgggatcattgtcattggcctcgccgcgattatcatcggggaagttgtatttggcgaattaacactctcacagcgtttggttgccgtgattctcggtagcattctttatcgcttcgttttgctggttgtgcttgcactagggttcaatgccgacgacttaaaactgatctcagcggttgttttggctatcgcgatcatggtgccacaaattgatcatcgcttgagattacggcgcgtgttgcagaaaggggtgcaagcacatggctgagctaaccttaaccaacgttacggtgaatattcccgttggtacagaagtgaaaactttgcttcaggacgtgaacctcaccgttgctaaaggtgaatttgtaacggttttgggcaacaacggggctggtaaatcgacattattcaacgcgattacaggcgatatgccagtcagcggtggcaccattacgctggctgatcaaactttgaatggcaaacgaccggagcaacgtgcgcggcatattgccagagttttccaggatcctaaaatggggacagcaccacgaatgacagttgccgaaaacttgctcttagctagtcaccgcggtcagcggctaacgttgcgatcacgcggcatgacggctagcaaagcggcgctgaagaccttagcagcgaagacgggcaatggccttgctgatgcccttgacaagccgactgagcagctctctggcggccaacggcaagcactcagcctattgatggcaactatgcggaaaccggatctgttgctgttagatgagcatacggcggcgcttgatccgcataccagtcaggcgatcatgcaactgacgaacgaaatcgtctccgatcagcagctgacctgcttgatgatcactcaccaggttgaagacgccttacgttatggtaaccgcttgattgtgttagatgctggtaaaattgtggctgattttgaccaagccaaaaaagcggcgatgagccgtgatgatgttttggcctttttcagttaaactaaaaacgagtcctcgagatggctatttagccatttctcagaggactcgtttttgatattttaagaccattttgaggaaccaaaatgtcatgatgcaactacgggtgacttggagtaaactattggctcggaggtagatatgacagatcaagaattacaggcccgcgttgagacgatctcgttgaaagcattccatcaaccttttcgccatcacgctgtttttaataatcggctgaaaacgacgggtggccgctttcatccggctgatatgaacttagacttcaaccccaagctatttgcggtttatcctgcgagtgtcaccgatggcattattaaacatgagctggtgcattaccacctatatgatcaccatcgcggctatcagcatcgcgatcacgactttaagcagctcttgactgcagttggcgggtcacgttttgcgccaccgttgccagtgaacggccatcagtacgtgtatgtatgcacccattgcggtcgccaattcgttcgtcgccgtcacattgatgttcggcggtacgcgtgtggtgtctgtcgcggtaaattgcgcctgcaaaagacgttggctagttaagcggtttttgcaaaatcagacttaccggttcaaacccagctttggcatagacttgttgggcagtctgattggcattcaaaacgtttaactgaatgaaagtggcatcatggcttttggcaaaagccgtaaccgcgtccataagctgtttagccaatccctgatgccgttgcgcagggatcacataaagatcgatcagctgggcaaaatgttgcggaacaaattccgcattgtcgccagtgcgagccaaaacgacaagtgcaaacccacttaaagtaccagccgtttcggtcacgaaaagccgagcaaggtcattttgcaagtagtcggcaaaatattgacgattgtcgctagttaatggacgataagtttcaggggccatcgtcgccatttcagcggttagttgttgatagaggtgaacaatggcaccgagatcgataaattgagcttcgcgaagcatagagaaactcctttcaatgacttgtgtgacatgataattgattaaaacagctgctagagagccttgccggtagttagaaaatctaaggtggcaaaaaagacccgaccaacaagatgtcctgttggtcgggtcttttgtgatgcgggcaagaagactcgaacttccatgagcaataatgctcacaagatccttaatcttgcgcgtctaccaattccgccatgcccgcatggctaattaagcacaagaaatattataggaaattagggatttaaagtcaaactttatttttcaagagcgttcgccaccccggttagaaaccggagtgtaagcggacttgaccgtgatggcctgggtttggccattgcggtcaaggtccttacaggcaggtttctggggtggcgaacgcgtttagaaaccgtagtgtaagtgggatggccgcacaatggccattgcgaccaaggcccttacacgttagtttctgggctggctcacgtgtttagaaaccggcggataagtcaatgaccgattttcagtcatttatttatgaggtctttatgtgtagtctcctccaactaggagcgtgttttgtgcaacgccatcgcgggaattctttgacagccaaccttttccctagcgtttccggtaaaagtcttcctcccagcatcactttcctcgaacgtgtataatttgataaaatcaaacttagacaatttggaggtagcagcgcatgacgcaacgcggaaaagcttataatattgcgattattggtattcttggtgctttgattattcttcaggcttatattccaatggtcggatatgtgcagatttttccggcttggcctgcgatttcaacgattcatttgactgtcatcattggtggtattgtattaggctatggcggcggtgccagccttggcttattatgggggttaaccagtctgattcgggcgtatacatcagcgactgatccagtgaccctgctgctgtttagaaatccgattatcgccatcgtgccgcgtgtcatggttggtttggtggcggcatttatttttcatcaattgttcaagaaaaaacaaacaccgttagcgcaaaccgttaaaatggttttcgccggtgttgtcagtgctttgacgaacaccttgctggtcattgggtttacatggttgatgtttgccagtaaagcagcgcaaattgtgccgggtgcggatgcgaccaacctaggatggttattgatgacggctttggcgattaacgccgtagccgaggccttgttgggcggtatcgtgacgccaattttgggtcatgcattattacgattcagacggaaataagcgttaaatgttgtgctgagcggctgtccgaagccaaacaaaagcagaatacaaacgatcataagtggaggccttatcttgacagaagaagaacaagtcgttgatttactcagtgccatggtaaagataccaagtgtggcagcaaaagaaggtcaggtagcagacctgattgaaacctttttagcccctgagttgaaagccggattgattaaacgggaacgcatcagttatgcgcccggtcgtgataatttggtgctgacgatcggtaatcctaatgcccagcgctggctcggtgtggatggccatatggatgtggttgaccctgggaacgtcaataaatggcagtttccaccattctcagcacatgtagaagatggcaagttgtacggtcgtggtgcaactgacatgaagtctggactggctgcagcggttgtggcattcaagcaagctgcccatgaaaaattggatcatggaattcagttgatggcgacagttggtgaagaagttgataatgacggcgcacgccaactgtctgccgccggttacggagatcgtttaactggactgcttgtggccgaacccggcaatagcaatgttgacgctgctgaacgcggtattattgattacacattgaccgcgcacgggaaagcagcacattcgtctcggccagatttaggggcaaatgccattcatgggttgtttgcatttgcgaatgcagcgctaactgcaacagcgccgttgcaggcaaaagaggaccccattcttggtcatgccacgcataatattgatattatccatggtggcaatcagatcaactcgattccggagtccgcatatttgcgcggtaacatccggacaaccatgattgcggataatgatgcgtttattgcggcgttgaaacaagcagctaaaacgacagtgcctaagggtgttcggttgagtctgtcaattgattccgttttaggggcagctgcggcttcacctgataatgatttgattcagttggtacagacagcccgtcaacgtgcggggctgaatcgtggtcaagtggcctatcgcaccggcatcacggatgcggcgttgttctatcatgacggtcttgatttagctatttatggcccgggaaatgaaacgtctcatgagacggatgaatacgtcactttaaaagacgtctttgacagtgttaaagtcttcaaggatgtttttatgaactattaatcatcaatgattggaaaaaaggtttgaccccacaacagataccgtggggtcaaacctttttagtttgcgttgctagataagtgaaattccgcatgatgccgccaagttgcaccggctggcaacacccacggcagagcgtcttggttcatttccggcgaaaagccgactgctacattgggttggccgagaataccgttaaaattattttcggagttgatgccagcgtaagaatcaattctcgtgaatgaagcatcgcttagatatgccaactgccaatcggcggccgcaagggaatagcgttgcgcagtctcacagcgggcagttttagggacaggggtaacatgttcatcggcagtcaacttggctgaaagcattgtttgggcagggtcggcagtgagcagccaaggcaaattgagccggggatgtattttcaagtcggcagtggttgccacctgcatgtcaatctgccacaaattgtcatttgtcaatcggtgggtaatactgagttctcgctggcctggctgaccgtcagcattttcaggtaatgttagggtgaatgtgatggctagatcggtttcttgactggttttaaccgcccaattccagttttgccatgaacccggggctagctcagcgtcagctgcctgtaaagggccggtaaaggcgcctaggtaaccgggttggtgtaagtagtcttccagcgtgacgaacccgagcagcagattaggatcgtcacctgcagcatttggcaggcgaacctgttgaacccgagcaccaaacgttaaaaaacgtagcgtcatctgatggtcattgactaaagaatactgggtaatccgttcgctaccgactttggcaaagatcttggcacttagttgcatgacgaaaacgcttcctctctcaatcccttaagcgtacagaaaaattggcagagattcaatgcaattacgcggtgaatctgctaggcttaaagggaaagagaggggtagacccatgagaacgttactcaaaaaagcctatcagctgttgtgggggctctttattttgggactcgcttacagcttttgggcccgcagttttctgccccgccaactgcggcaatatggtgatccggctagttttggaatcatcagtctttttgttgtgatcaatgccatcatgctttatcatcatcattttcgttttcgtgatttgaaaatggaaactgtcgatatcatggagggtgaaaagtttgaatctttttgcgcgtatctgttgaagcgcaatgggtttaatcacattcaactgacgcaggcttcaggtgatcaaggaattgacattattgcccgcaaaaaaggtaaaacgattggctttcagtgcaagcgttacacaggtttcgttggcaacaaggccgtgcaggaagtttgggcgggccatcatttttaccagctcgacgaagcggcggtgatcaccaatagcgaattttctgattcggcgatcgccttggccgatgacttgggtgtgatgctgattgatcgtaaaaagttgaaacgtttaatgcgccggttgccaagttaaaaagacaactgaaatttgaaagtacaagtaggagcgcttcgaaagcgtagcagaagccgcttagagccttggtcagcgatgcttaacgttcttatgagcaatttttgggatcatgagcgggttttgaattaaggaggaaaagtgtacatgctattaggcttaaaggctagtacagatgagcggcagattcgtgatcggctgcaatatcatcctgatgtattcgaatttcatctcaccgaaaatgattttaccgaagctggatggtcgcattttgtacagatggcagcattagttcagagtcaggtgccaacggtggtttttcatcatccgatgcggtttcgcggccagcgtaatgagcttgccatgaatccgacgaagtatcctacacgctatgactttttaatgacaagttcggttaaactcatgaactttgccaaaaaagctaacgccacggctttgattcacggcggataccgcgttgacacgcctggtgattatgctggctggacagatgtgggcaaagcacaagacattgccttggcgcgcatgattgcttttgctcaggaagcaccgggccatgtcgtgtttgaaaattccatgtcaccgattttccgatatggtgatcccacctttgaagaccgtttgttgcgctggcatttacctttagcctatgataccagtcatacatttattgtgttacatggcgataatgatcggctcatggccagcctagcgcatctgaagccgctgattcggcactatcatcttgttgattccatggggcaaacgcatgatagtttaccgcttggccgcggacggattgattgggcgcgggtcttgccactattgaatcaagatgcgagtcggatttatgaaattggcttaaaggatcagtttgattgtcgggaaatgattgaaagtcatcattatttggaaagcgttgctaaacggttagctgcgaccaaacatccagcgtaatcaattgagcagcaagccaatttgccgtttaacaaatccaaataacgcacgcggttcatcaacatcagctagataaacgaatcgttgctgtaaatcaggttggttcagtaagagttgcaattcccaaacgcgcaatgcggctttgcgctcaggattaggctgaaagaccagttgcggttgatcattaacggttgttaacttaaaatcgtcaaaacgacttggtgtcggctttgtgtcgagtaacaccgaggcgtttttattttgatcggctagtaaagccagcaaatcggtgacacgcatgaggtagccttctttcgaaatgattcattaaggattggtcaagatggttgttgctttggggaacaatcgcatacaatctatttagtaaacggagatgagtagcgtttttaggcgatcgccaacccaaaagtcggtgtaaccgggttggctcacgctcttattatatcagtgcgtcatctgaacgactgtgataaactgaaacggtttatctcagcatatgcttgtcgaaacgcgttcatagccacagaaaccggcacatcagaaccacgagaacaatggctcggccattgccctcgttcttgattatgcgccggttggctgttcacgctctttaggaggtcatcatggaagaagttgtgattctaagtgccaaacggacgccgattggtaagttgggtggtgatttggctggcgccagtgccgttgatttaggggttgcggcagcgcaggcggcgattaaggctgcacgaattgacccagcgttactcaaccaggcgatctttggtaatgtcatgcaggctggttctgggcagaatgttgcccgacaaatcggattaaaaagcggtatggccactagcagcacggcgatgactgtcaatgaagtctgtggctcaggcctgaaggcagtgcggcttgggcaagctgccattcaactcggcgaggctgacgcggtgcttgtgggcggtaccgaaagcatgagtcaagtaccttattacgccgaagcggttcgttcaggccacaaatttggcgatacaacgctggttgacggtttgagtcgcgatggattaaatgatgccttcagtcaacagccaatgggaatcacggcggaaaatgtggcgacacaatttaacgtcagtcgtcaggagcaagatgagtttgctctccgttcgcatttacgcgccgcggccgccgcagctgagggtcggtttaagagtcagatcgccccagtgacgattgctgcccgtcacggggatgtcatcgtagatcgtgattcagccattcggcccgatacgtcattggctaaattagcccaattaccgcctgtttttgaagtcggcggtactgttacagcaggtaacgcaagcggcattaatgatggcgcagccgccttgatcctgatggcaaaatcgaaagccgaacaactggggctccattatttagcgacgatcactggttttgccgaggtgggtattgatccggcaattatggggtatgcgccaaaactggcgatcgataaaatactgcaggcaaccggcggctctatcgcggcaattgatcaaattgaattgaatgaagcatttgcctcacaaagcgttgctgtggctcgtgaccttggtttaaaggatgaacaattcaatatcaatggtggcgccttagcgttgggtcatccattgggagcttcaggtgcccgaattttaatctcattattgtacgatctggctgaacgtaatcaacgccaaggcattgccgcattgtgcgttggcggtggcatcggtatcgccatgcaaatcgcgatgcatgtctgagggagatcgtgatgaaattttacgagttgtctccagaaaaacggcgtgaccaattggttcaagaagggtggttaacaacacaggatgctgcgttgttagctggtacgcatagcttgcctgaagtcacaggagcgcgtctgatcgaaaatgctatcggcgagtttcctttacccctaggcgttgctcgcaatttgttggtcaatggacagctacatcaagtgcctatagcggatgaggaaccttctgtgattgcagctgccagtaatggggccaggcttgcgactgcaaacggcggcgttaggacccatgtagcggcgcatcgagtggtcgctgaagtagtcctgactaacttgaccgacttagtgcaagcaaggcaaacgattttggctcatcagactgatattcagaaagtcattgcggttgcgcatccttcgatgattcaacgtggcggtggtcttgatcagttaacagtcgaatcactaggagcgcagttcttgaaaatccgtttaacgctcgatccgcaacaggcaatgggggccaattatgcgaatacagttgccgaagcggtcgcagcggcggtgacaagctgggtagacggtgatgtgcttgtcagtattctaaccaacgcgccaacagaactcgtgacggctgaggtttcgcttgagccggtttctttagcgacgaaagctgtttctggagatgtgattgctaagaaaattgttcagcttagcgatttagcctttgtcgatgctgagcgggcagtgacccacaacaagggcattcttaacggtattattggtgctgtattggctactggcaatgatacccgcgctgtcgcagcaagtatcggtgcatttgcatgtgcgtctggcaggtatcagcctttatcgcgctggtatatggatcagggccatttagttggtcacttacagctgcccttgccgatgggggcagttggcggggcgatcggtgctttaccaatggcgcaggttgtccgtcggctcggtgggtatcagaatttagctatcatgcagcaagttattgccgccctcgggttggtgcaaaatcttgctgcgatgcgagcattggctggaccggggattcaagctggtcacatgaagttgcaagctaatgccctcgccattgctgccggggcaacagaaacagaattgccgatgcttgtgaacgcacttcgtcagggtagtatggatttaaaacatgcgcaacaatatttaacaaccattcgtttaaacaagaaagtaggccaatcaaaagatgaaaatcgggattgatgcaatcgctatggacaccccagatttctacgttgatttagtaaaactcgcgcaggttcgaggtgatgatccggacaaatatacgattggcattggccaagacgagcaagcggtaccaccttctagccaagacattgtcacgatgggtgcgaatgcagcgacaaagttgttgacgccagcgattcgcgctagcttgggcatggtcttggttggtactgaaagtggtgttgatgccagtaaatcgtctgcattgtttattcatgatttattggcactccctgagtgggtgcgggccgttgagttaaaggaagcttgttatggcggtactgccgcactaatgatggcgcgtgactacatcgccgctcacccagataaaaccgttttagtcattgctgcggatatcgcccggtacggtttggcaacagcaggagaagtcacacaaggtgcgggcgcggttgccatgttaatcaaagcagagccgcacatcatgaccattgaagacgattcggtttatcggtctgaatctattgacgatttttggcggccggtttatcaagacacagcaattgcacaaggaaagtattcaacggaacaatatttagctttttttcaagcaatttggtcacgataccagacccaacgccatcacacagcaagtgattttgctgcgatgacattccatttaccgtataccaaaatgggcaagaaagctttaaagcttgttctgccggacacagatgaagccactggcgagcgactgcaacggcgctttgaggcaagcactcggtactgccggcgagttggcaatatttataccggttctttgtatttgggtctgctgtcgttgttggacaatgatactagcttgaaagcgggtgaccggatcggtttattctcgtatggctccggggccgtggcagaattttttagcggcatcttgcaaccggattttgccgcacaactgcatgcagccaatcacgctaaaatgttggctgatcgtcaggaattaaccgttcctgaatacgaagctgttttcagcgataaggtgccttatgatccagaagattatcgtagtgatccgacttattatcatggtcagtttgttttgaccggtgtgatcggtcaagaacgtcaatatcagcagcggtaatgcttgacagctaataagatgatgaacaggaccgtccctcgacggtcctgttttttgatccatgatcctgatcatcatgaagttaatttgtgaaaaagatttaccaagcatgttatggcgtggtgatgctgtattagttcacttgtttgactgttatggtgtcgtcgcttgctagtttaagcgttttatacgctaaggtcgcaatttgggcgttaaggttgcttaaaccagatgaaagggcttgcattgttatcaataaattgttatactcgtaatcgtaaagaacttacaaaatgtaagtaataatattggaggcaagtgtcatgacagaaaaaataaacgccgcagacgcaatgatcaaggtgctcgaagactggggtatccataatatttatgggttaccgggcggttcctttgatagtaccatgaatgcgctgtacaatcgccgtcacaccattaattatgttcaggttcgccatgaagaagtaggcgcattggctgctgcaggtgaagctaaggtaacgggtcgaatcggggcgacgtttggttctgccggtcctggtgctgttcatcttctgaatgggttgtatgacgcacagtatgataatgtgccagttttggcattggtagggcaagtaccaactgctgccatgaacaccaattatttccaagaaatgaacgagaacccaatgtttgctgatgtgtctgtatacaaccgtacagccatgactgctgagcaattgcctcatgttgttgacgaggcgattcgtcaggcttataagcataacggggttgccgttgtgactattccaaaggatttaggttggacccagattgatgacaattatgtatcatcagccaatctgtaccagaagccgcttttgcctgatccagacccggatcaggttgccgcagcttgggatatcttgaaagatgcgaagaagccaatcttgtatgttggaaatggcgcgcggggtgcgcgcgacgagatcatcgctttctcagaaaaaacgcatattccgatcatcacgactgccttggctaagggaatcgtgcctgatgattataaggcaaacatgggctcggccggccgtgtggcttctaaacctggcgttgaagttgcgcgcggtgctgacaccgtcttgttcttgggatcggatttcccattccagccatactttatagcaccaaatgctaaatacattcaggttgatattgacggtagcaagtttggccgtcgtcacacggttgacttagctgttttggccgatgctaagaagttcatcaaggcactgagcgaaaaggctgatcaattgccagaaagcgcttggtatcgggctgctctggccaacaaggaaaattggcgcgagtggatgacttcatttgaagatgatggctccacgccactgcgcgttgaaccaatcttcaaattgatcaatgagatggccgaaaaagatgccattttccaagtagacgttggcaatgttaccatcaatgggatgcgttatctgaagaccaatgatgatcaagtgttcacgacgtctggctggtatgcgacaatgggttatgccttgccagcagcgattggtgcgcaagcggaattccctgatcggcaagtttggtcaatttctggtgatggtggatttgccatggtcatgcaggatattctgacacaggtcaaatatcatatgccaatcatcaacgttgttttgacgaatgagagtttgggctttattgaagctgaacaggatgacacgcaacagccgcactccggggttgatttaattgatgccgattatggtaaggcagctgaagcgttaggtgctcaaggatttgaagtgcacaatctggacgaattgaaagccgcatttgctaaggcaaaagatcgtaagggtccggttgtcattgatgtgaagatttctgatcttcgtccaattccggttgaacaacttgttttggacaagcaaactcaggatcctgctgctgtggatgcttttgtgaagaaatatcatgcagaaagtctgattccattccgacagttattggaagatgcggagaaaccggtaacaaatgcttaactggttgacttaaaatataaattataaagctttccagcaattaatatgccttgctggaaggcttttttttgcttatcgctatttgaagtcttcattatcagttgccggccttttgcgataaggcgtagagacaaaatttcaaaaagttcaagaaatcgtttacaagaaagcgatttcttggtattataaaagtcgttcgaacgaatagtcattcgaatgacttctgatatggctcgttaagctagcgagtatgctgatattaaaaagtcattctgtggtgaacaataactttgaaattttgaaagcgaggaaaaactaatgggtaagaagacaattatgttagtttgtgcagcaggtatgtcaaccagtatgttagtcaaaaaaatggaagatgcagcgaccaaagatggtattgaagcaaaaatctttgctacttcggcttcagatgcccatgacaagttagattcagaaaagccagatgtcctgatgcttggaccacaagtgcgttatttagagggagatttcaaaaaggatcttagtatcccagttcaagtgatcaatatgcaggattacggcttaatgaaaggcgaaaatgttctaaaaacggcgcttaagctgattgacgagcagtaggaggtcaggatgaacgagcaagagcaactagtgatcatgcagctaattatggccggaggaaatgcaaaaggatcttcttttgaggcaattaaagctgcaaaagtcggtgatttttctaccgcagaagcaaaactgaaagaggcagacagctttctgtcagatgcacataatgcacaaacaggtatgttaaccgaagaagctcaagggaaaaaacatccagtatcattattgatggtgcacggacaggatcatgttatgaatgcaatcacatttcgagacttagcaggggaaatcgttgacctctataaaaagttagctacgaaataagtctaagcgaaaggaatgtgacacgcatgtcagaccaaaataaagcaagatatgacaagagtcggagagaattaagcttaactagtatgtactttaatcgctatttattaatccgttacgtgaccgccggttttttctttgcaaatttatattggttttttcttagtttgggcacacagggcgcgatgaaatgggtaccgttttgtttgaccgttataaatgcagtggtagcggttgaacaagtaagtaagtactggcgaagagatagcaagttaccatttactaagttcggttatgtagttcagttaataagcaatttcctgagcttatccataattgtcgctggatctgggacaaaactgtttccatttttaggacaaaagggtttatctctggcaacgactgttctgttaattggtctaggcatatgtttttatctcttagtgcgtatccgtttgattgaaaaaaatcaggatcggtatttacaacaaataaataaatttgctcaaagcatacaatgagctcaaacaaggagacaaaactatggattcaagtaataataaattgtttaaatttatgaacaatcatttgatgggaccaatgggaaaacttgcctcgttcagaatcgttcgcggagtcatggctgccggaatggcatccattccatttaccatcgttggatcaatgtttttaattattaatgttctcccccaaagttttccggcattagtcggtatttggaagggttcttttgataaggttgcaaatttgtatatgcttgccaatggcgcgaccatgggcattttagcactttatttctgtttagtttttggttatgaatatactcgcattcaggctcaggaagaaaaaattgatattaatcctctaaatggtgcattgctttctatgatggcgttttttatgtgtatacctgaattagtctttaaaggtgggacagcgaccttggtcaccgaaatcaccaaggacaacaagattatagatggttatgccatcgcaggtggggtaactcggctgggaacgactggtatctttacggccattatcatgtcgattattgcagtaaaactttatgcgtggtttgttaaaaagaatattgtggtcagtatgccggataccgtcccagctggtgtttcacgttcctttacagctttgattccgaccgctgcgattgccttaactgtcattatcattaatggtattttgatggcattcaacaccgatatctataagattgttgctattccgtttggttttgttactaacctgaccagtacatgggtaggactaatggtcgtctactttatcatgcatgcgctttggatcgttggcattcacggcgcaacgattgtgacctcgttccttaccccaattgttctctccaatatgcagttgaatcagaagggggcaaacatcccatttgccggagaatttaataactgttttgtgactataggtggatcaggcgctacgcttggaatggttatttttatcgccttctttgcaaaatcggcacagcttggtgcattaggcaaggcatctgttgttccagctttcttcaacattaacgaaccaattcttttcggtatgccagttgtttataatccatatacagcgattccattcttcttagcaccgatggcatccatgagtatggcttacttcgcaatttcaatgcattgggttaaaccgatgattgcacagccggcatggccaacaccacttggtctttcagggttcatcggcacggcaggcgattggcgagcaattgttttagctttcgtttgtgcgcttgtagccttcctgatttggttcccatttattaagttctatgatggcaaactatataaagatgagcaggcaaaaggtgcagcggaggcggcggcttaagaagcggcagaccaattgtaaatggttcgaggactaaataaggaggattattttgacagcatttcctaaaggtttcttgtggggcggcgcagtcgctgctcatcaattcgaaggtgggtggcaagcaggcggtaaaggggtcagcattgctgatgtgatgaccgcaggcgataatgaaactaaacgcagaattacagacggtgttcaatcaggcgagaattatcccaatcatgatgctattgattattatcatcgctatcatgaagatgatcagctctttgctgatttaggcttgaactgttttcggacaagcatagcttggactagaattttcccgaatggtgatgaagaacagccgaacgaagcagggctgaaattttatgatgacgtgtttgatgatcttttatcgcatcagattgaaccagtgattaccttgtcacattttgaaatgccttatcaccttgtcaaaaaatatggtggttggcgtagtcgtaaggtgattgatttcttcgtcaaatttgcgactgttgtgtttgatcggtacaaagacaaagttaaatattggatgacttttaacgaaatcaataatcaggttggcatgatgaatgaatggtctctgttcaccaattctgggctactgatcaagcctgatgaagataaagaagcagtcatgtttcaagccgctcattatgaggccgttgcaagtgccttggcagtccaaattgggcatcggattaaccccgattttcaaattggctgtatggttgcgatgggtcctgtttatcccgcaacaccgaatccaaatgatgtgtttaaagctgagcgaacgatgcagactaattattatctggcagatgtccaagtaaagggcaagtatcctgcatttttggatcgttattttgatcgacatgcgtttaacttggacatcacacttgaagatcgtgatgttttattagctgggaaagtcgattatattggattttcttactatgcttcccatgtcactgaagcctcacaagatgaacctacagactttattaccatgggacacaatcgagaggttaagaattcgacgcttcaacgttcagactggggttgggagattgatccagtcgggttgcgttatgcactcaactggtttagtgatcgatatgaggtacccttatttattgtcgaaaacggttttggggcatttgataagatcaatcaggatggccatattcaagacgactatcgaatcgattatttacgtcaacatattaatcagatgcgacttgcggttgaggtcgatggtgtcaagctgatgggttatacaccgtggggcattattgatttggtttcggcgggaaccggtcaaatggaaaaacgttatggcgtgatttatgttgataaagatgatcaaggtaaaggcacacttgcacgaagcaaaaaagcctcttttaattggtttcaaaaagtgattcgtagtaacggggatgatctcgcctagcatgaaaatgcatgtagtcaaaaaaacgcctttcgaagggcgttttttttactggagacgtggagctagtccggaacagtaaatggcggtataataacatgaaatgactgagcttggaagcaaagttgaaaggcggaaataaattgtctcagcgggaaagtagctatgatattaaaacactcgagaatcaattaatcaaggcgattcaacaaggtgctattcaagatgaagatggtcaactacctgctgagccggaattgatgcgtcaatatcaagtcactcgttacacgttacgacaagccttaaaagatcttgccaatttgggctacatttatcaggcacatggtagcggcacttttgctcgcccacaccacgttgagggggccatatcgcttcaaaataacgttgggttgacggaagaaatggcgagacagggacgagttgttaaaacaacggcaattcatcaacaagtcattacgctagatcaggcagattttttgcctgaaagccagaaattgccgaatgagacgacattaatttcggtgacccggcaacgaacactagacggtcaaccgttcttagtagaacactcgtattatttaagatcgattgtggacaacattccgaatagtgcattaaaggggtccctatttgcttttattgatcaaaagcctggtctgaaagttggattcattgactctgtaattgagtgtgaaatgatttctggcttaccagccaaattctttgggattgcagacggaagtccaagtttagttgttcgtgacgattcgtatctaagttctggaaaattatttgcgttttcgaaaatcttttatgactttcgtaaaaccaaattttttatgcttaagaaaatgcattaattttcttaattcggctgatagtgacatgtaaaaaagcctgctaacatattagcaagcttttttacatgtcactagaatcggatttaagcacgggatttgatactggcgatcaagctatcctcatcagttaaaatggcgccgttaagtttaattaaaccagtggtatacagattgagatagtgaaactggttttctgcaacttgttgcaaagcaccgagtttttgttgattggcggcgcctaaccgtcgactgtccgtgtaaagacccaaaataggaatcttagcagcataggcaacgccgatttcactagcgaccccgttatcgatcacggggccatcgagaatggcaatcatcaaatcagctgacagcagccgcttggtgtcggcttcggcaatcattttcgaatcggcgtatgcctctttgttgttgatcgcggcattttcttgaggcacatacatgtcaacatctggtaaggcgcggcgaatttgggcagcgagttgcgcattgtaattaaaatcagcatgactgaacaaggcgttagcaaagtaaattttcattttttaagacctcgtctgtagtttgcgggattgttggtttaggtggggtgccgtgaagtggtggcctgatgaaacgcgttcacagtcgcaaaatctgacacatacagaccttgaaactaaacggccgtatatggctcggcttctaaacgcggctgttcacgctctttttgaaacgcgttcacagccgcagaaacctccacataaggacctcaagccgtaaccagccgggctttggctggttacggcttgaggccgcttatgttacggttcctaaacgcagctgttcacgctcttgtaaattttaccactgcttcgcatcgtgctgtttgtggaaacatgtcgatgctttgaatccagtcgactttgtagcgtttagtgaggaaaacgagatcacgggccaaggtggaagggttgcaggaaatgtagacaaatttgggtggatcgagttcaaggagggcgtcgatgaaggcacgctctagtccagctcgtggcgggtcaacgatgaccgcgtctggtttcatgccttcctgaacccattttggaaaaatgtcttcagccttgcccactgaataatgggcattggtgaggccatttgctttagcatttgccttggcatcggcaatgccttccgcaatggtgtccattccgtaaataggttgattgccttttgctaaactgatgccgactgttccgatcccacagtacgcatcaattaaggtgtcgtgcggccctaaatcaagtgcttttgcggccaatgtataaagtgtctctgtttgttttgggttcagttggagaaatgcttgtggtgagagttgaaaagtccggcctaacagtgtttcttggatataagggagacctgccagcaggcgactttctttgccccaaattaaggatgtttcgccaggattgatattctgggcgatgctgaccaccatgggaagctgagtggcgatgccattgagcaattcgccttcgtgcggtaattttggactgttcgtgatgaacgtgacctggacttctttcgttgcaaatgattcgcgaacaaccaatgttttgacaattccggagcgctttttctcgttatagatcgggatctgaagctgttcgagaatctgacacaaggttgtcacgactttcattgtcagcggtgcttgggtcagaaacttggttaaagggatgagatgatgtgagtttggagcataaagacctgcgcgtacgtgaccatcaatgacccgaacaggaaattgggccttgtttcgatagtgcgttggttgtgccatgccaatcgtcggccgcaaatcataatgggtccagccagtcggtttaaatttggcaagcgattgtgcgacgacatctcgcttaaatcgcaattgcgccggataagcgagatgattgagttcgaccccgccgatttgtccaaatagcggttctgccggggttacgcgatttggtgacgccgtccgaattttatgaactttggcctcaagataacggtcgtgaatcccagtaacctctgcgacgacgacctcttgaggtagtgcaccggtaacaaacgtaattttccgttgataataaccgatacctgcgccattaatgtctagacgcttgatggtcaggggaaaacgctgaccgattttgacagtgactgccatgaaatgctccttgctttgagaaatggtgacgaggcttaagaatgtttagtataatgaatcatcgggaggatttaatgtgaaaatcaattattcgaatacgatgagtagaaaaatgacagcaacggtgtggcaaaatgacacgccgcatacgatacgagttggcgagacgctagacttaaaggtgcaacgcggcgataagattacttataaagttggtcggtttaatgcgatccacacgattgactatcaaagtccggatgcccaatttgaaattcaaatcaatcgcagcctacaaaatgcctattttgttgtgatgtttgcgatggtagtctttctttggtttaatcgcaacttcagtcaaacgattctaattgcagcggtcattttgggacttgccgggtatgaagccctagtctactttgtcggctacacggcaaaaccgattcactgacgagtctgattcgtatcggctgctgttcgttgctcgcgctgtaggcgttttaagcgttgaaaaaggtgaaaatagtcttgatcgctgggttccttggaccaagtgatcaagggaacagttggatcaaacgggtggcccatgcaagggatcacccgttttggctttgtcagcgttgtaatgatcaaatcaggattgatcgcctcggttggaggcacaacgcgaataaagcctaaatcgtttaaaaagtttaagagatcccgtttgacgaaagaatcatgttcaatcaaaacgttaacgaccatttgcatgtcacgattgagttcaggataattatcattgactaatatatagagaccattaataaattggcttgtaaagtctgcgtagattgactcaggcgccattttgggaattcgtttcaaacagtcgcgaattttggccgtcaattggcttgttcgtgcttcgtcatgcaatgtcgaagcaaaatcaagcctctgactaaaatgaccattcagcacatactcggtgaaacttaatcggtaaagattggctatcatgacttgattttcggcaattaactgacttttggtttcttttaattggttattcaaagaagtgaccagatgtcgcacaaatcgattcactaagttatctttactttgaaaatgggtcatgatctgataatcaatttgatgtggttgccgagtgacggtcataaaatacatacgcgaaaaatagtaatactgtttttctgcttttaattcagaagcagataaattgggaaagtagtctggcgtaaaaatcaaatctggcaattcagtttcaccgtcaaacaacagctgcattcgccgatttggtaaaagggcgtgcccacagttgattcgtaacatctgaatggcgagaatcagtaaagcttctttggacattggttggattggtgacaccaagaaagcctgttttgtttggttgattaccttgagaagtgcttttggttcccgctcttctgcacttgaaaatggccatcctgccccgcgataggctaatgtaaagaaggtgaacatggctaagcgtatatgcaattcatcgccttcaatggcccaagtagtactatttagcgtgacaccattgtcagctaagtagtctcgaaacggcgaaattcggcgccgtaacgttgaaatacttgtttgatggtgctgcttgaaggcgtgaaagtccgaatgcggattcttgaaaaccccatcgaaaaattcaaatggtagactgttttttaatagcgagaaccgataacgatcaatcgaaacatcaggcaaaactgctgcgaagcttgattcgtcaatctttttgtcaggtaagatttggttgagctgtgctaaaacggtctgaaatgccgtataagtctgcgaatacgaaagcccagtattgcggctaagcgtattgatcgacattgtcgtctgttgtagggtcttcattgcccggaatagttgataattaattaagctgtgccggtcaaagaaactggcttcaaacataacgagcctccaaatttatttataaaaagtataacatagaatggcaacgtgattagagaggtgacaggggttcatgagtgaaattacaaagataaccgcccaaaaaaggcgtgggcgctataatatttttattgacgggacttacgcatttccggtgagtgaaaccacgctggtggattaccgcttggccaaaggaatggtattgacagcagagaccattgcccaaatcaagagcagtgaagtcaccgcgatgggactagagatcgggctgacctacattagccaccaaagtcgcacgagcaaagaggtcagtgatcggttagctaaagaagacttaccggctgatgtgattcaaaaggtgctgacgcgtctgaccgatctgggctttttggatgatgcagattatgcgcatcgttacattgaagagcatctgaaaatgggtgaacttgggccgcgaacgctgcaacataagctacaacaaaaaggcctcaagccagacttgttggccaatgagttagctgctattccaacaacagcatggctagatgcggctgttcgcgctggtcagaagaatcttcggcaccaccagcatcgcgcttataaagaccaactgcaacgtctcagagtcgctttaatgcaaaagggattcgatgacactactatccaaacagctatcgcaaccatcgacccgcaacccgatcctgaggcagaaagcgacttgcttaagctggaggcagccaaacaatggcgtctaaaagcgaaatatggtgatcgggagcgcaaacaaaaagttaaaacaactttgtttcgtaaaggctttgatgtggaagctattgatgaagtgctaaacgacttggcggaaagttgatcgtggttttttggaagatcaagctatccttttgcatgcccttgtaagctgccgactcttgctgaaaagcgttcactgctgcaataagtcaacctcaggcacaaatgaacaaagtctggctatcacacatgaggctggcttatacaccggatttttatcgggctgtttcacacgcttgctagtttctaagcgcgcctgtccatgctctgctataatgaagaacgaaatttccaagaaagcgggttttgtatgcggatccctaaagaaggcgactcgttcgctattcaaagttataaacatgacggtagtctgcatcgcacctggcgtgacacgatggtcttgaaaaccagtgaagatgccctgatcgggtgcaatgatcacaccttggtgacggagtcggacggacgccgttggctgacgcgggaaccggcgatcattttctttcataagcattactggttcaatgtgattgcgatgatccgtgaaggcggcgtgtcgtattactgcaatctggccactccgtacacgatggatcaagaagctttaaaatatattgactatgacttagacgtcaaggtgtttgccgatggtgaaaaacggttgctggatgtggatgaatacgaggcccatcgcaaactttggcagtatcctgcaaccactgatcggattttaaaaactaatgtgaaggtgcttgtcgattggatcaaccacggcaaaggacccttttcacaagcctatgtcgatttatggtaccgtcgttacattcagttagcgcaccggatctagcccaaccggtcaaacttggaggcaaaaatgaaacaaattccaaaacaacctgctcaactttttgcgggtcatgcctataccgtcgaaaacagtgatcagcttggtacatttcaaccagcgtggcaagactttgaggcgcaacttgggtttaaaacgctcgatgatttagccgagatacccaatcgatcggcgatggttgtcttttcgccatatgacacctttttatattggatcggcagcttgttaccggctgatgcagcggttcccaaaccttatgaagcgtttcgcctacctgaagcaacggctggtcaggtcaggcagccagctacaagtgtgctgttgaaacaattaccacttgcaacaagctttaataagggtctgcaaatcattgaaaaggcagggtatcctttgccagaaagactcgggcaaacagatcatccttattatcttgaaagctatctgattcaagatggcgcggttcatcaagtggcttatcgtctatatattgatcctcatcagttaaaaggtgtggatgagtatgagtaaggtgcatgaaaaataaaaacaagcaggggattagcctgcttgttgaattgatgcgatcccgatatcttcgtgttgggatcgcatttttctcacatactcatggtttaatcaagtgaagctgataaatttgaatgatcgtcaagccagcttgagtatcatttcacggtggcggatgccggcatcaagaaattcagggcgatcggtcaattgaaaaccgagggctttgtaaaagccaatcgcctgaacttgcgcacctaagcgtagcgcttgaatttgctgggcgcgggcataagtcatgattgcttcaaacaccatcttaccaaggccatgcttgcgataggctttttcgactgcaacacgctgaacgtggtaggcgtcgccctcaggcagaatgcgcgccgtagcaacaggcacacctgcatcgcaaatgacaaaataggtcgcctttgcttcatcggcgtcgacttcgagctctggtggcacatgttgctcttccacgaaaacgtgggtgcgaatctggacgctgtcttgatgaatctgtgaatcgagggttgttgtcgttttgacttccaaaagttgaaccttctttccgttttaataaattgtttgctattatagcactagtaaaatgctgctggggaggtcgaatatgtttgataggttacggcattcaaaattaatgttttggtccgttgaaattctgattttgatttttgtggtcatcgggttgacacaggtttcgttcttgtttgcacctgtggcgacttttttctcaacgctactcattccgattttatctgctgggtttttgttctatctcttcaatccgattgttaaattattgcagaagttccacatcagtcgcaatatttcgattttattgattttcttggtggtcatcggtgccttggttctggtattcatggccgtactgccaaacttgatctatcaggtcactcagtttgttacgaatattccggatttcttaaaaggcgtccggttattcattagtaaggcgtcacactatacttggtatcagcggctaaatattggcaaatatgttgccagtcttcaaatttcgccaagcaaggtgttgagcagagttctgggcggtttttccaccggcttgccaacggttatcggatcagtagccagcatgatgatcagtatcattacaatcccggtgatgctattttactttctcaaagacggtgaaaactttgtgccaagtattcaaaagatgttgcctcatcggtatcacgaagaggttgcaactgtttttacgcgtttaaactcgacactgtctcactatattggcgggcaggccattgaatgtttattcgttggcacttttacttttattggttatctgattattggcatgccgtatgcgtatctcttaggctttattgcggggatcgttaccattattccgtatttgggaccctatattggtattgcaccagctttggcaattgctgccactgagggatggacaaagatgctactcgttgttgtcgttgtcgtcattatccagatgacggatggtaattttatttatccgaatgtgatcggccgctcactggacattcatcctttaaccatcattattttgctgatggttgcaggcaatctatggggattgttaggcaccattctagctgtaccgacatatgctgtcatcaaaacagttgtgacatacttatacgagctttatcgtttccatcaggaacataagcatgacgaggatgctgacagtgatgaggaaaatgctggagaagctcatcagatcaaggatcaagccgatccacaattgaaaaataaataaagacttggtatactgaaataatcgaacgaagcggggatgattccccgttttttttacgaaaggttgtgtttttgcatgggcagtgacccagacggtcagatatggggacaattgatcctcattgtgattttgaccttaatcaatgcaggatttgccgcggcggagattgccgtggtttcaagttcccgtactcgtatgaaggcgcaggcggataaaggcgatcgtaaggccgccaagcttgtgaccatcatgaaggattcgagtaattttctggcaacaatccaagttgggatcacttttgccggtttctttgcgtctgcttcggccgcaacaacgctggcagatcgggttgcaccaatttttggcggctggtcatttgcgcatgaggcagcggtcatcttagtcacgctgatcttgtcttatttttcgttggtttttggcgaattatatcccaaacaggtagcgttacaaatgacagagcgggttgctaaaatgagtgtgaccccgatcagttggctagccaaagtgatgcgtccgtttgtttggctgctttctgcttcaaccaagttgttaatgaaactgacgccgatggaattcaatcatgaaggggaaaccgtgacccgtgacgaaatggtttccatgatcgaaagtggtcgaaattctggggcgattgatcccgatgagtatcaaatgtttgagggaattatatcgttgtccgatacgatggcgcgcgaggtcatggtgccgcgaacggatgcttttatggttgatgcgcaagaacctgatcacacggcgattgacgcgattttgaacaatatctattcacgaattccggtttatgaagaagacaaagatcacgtggttggcattgttcacatcaagaatctgctaaaggaagcacgccgcgtcggctttgatcatgttaaaatcgaatcggtcatgaccgcgccggtttttgttcccgaaaccattacagtcgatgatttgttgactgaaatgcaagtgaagcaacaacaaatggcgatcttattggatgaatatggtggcgttgtcggcatcgtgaccattgaagacttgcttgaggaaatcgtcggtgaaattgatgacgaatcggatcaggttgaaaaattgttcacgaaacaaggggaccatgatttcgttgtctcagggcggatgccgatttcggacttcaatgatttgtttaaaactgatttggatgcaccggatgttgacacgattgcgggttatgttctgacgcaactcggtgccattccttcatcgcatcacagcgaaaaaatgcagctggcaccaggtgtgttattggcgaccggcaaagttgaagggtcacgactcgtcaatgttcatgttcatctatcatcagaaccagaagaagcctcccacgaggccgatagctagcgatgcagtctgtgtaaataggcaacgttgttagcaaattttgtcaattttggaaggaaagcacgatgaaaccacaggaactagcaaaagaagtcgcaaaacgccgcacatttgcgattatttcacatccagatgctgggaaaacaacgattacggaacagcttttattgtttggcggcgtgatccgcgaggctggaacagttaaaggccgaaaatccggacattttgcgaaatcggactggatggaaatcgaaaagaaacgtggtatttcggttaccagctctgtgatgcaattcaattatcagggcaaacgcattaatattctggacacccctgggcatgaagatttttctgaagatacctatcggaccttgatggcggttgatgccgcagtcatggtcatcgactcggcaaaggggattgaagctcagaccaagaaactgttcaaagttgtcaaacaacgtggtatcccgatttttacattcatgaataagttggatcgtgatggtcgcgaaccattggatttgattgctgaacttgaagacttgctgggtatcgaaggctatgcgatgaactggccgattggtatgggtaagggactcaagggtctctacgatcgagtgaatcagcgaatcgagctttatcggcgtgaaggtgatgatcgatttttgccgttgaatgaccaaggtcagcttgatccaagtcaaccattgacgcaggattcgatttatacgcaaacattagatgatatcgaattattgaatgacgcgggcaaccagtttaatttgaaaaagatcatggctggtgagcaaacaccagtgttcttcgggtcggcgttgactaactttggcgttgagacatttttgaatagcttcgttcaatatgcacccgaaccgggaccgaagaaaacagaacaaggcggggaagtgaatccgactaacccagagctttccgcatttgtctttaagattcaggcaaacatgaaccctgctcatcgcgatcgcatcgcttttgtccgaattgtttcaggtgaatttgaacgggggatggatgtcatccttcatcgaaccggcaaaacgatgcgactgaataactcaaccgaatttatggctgacacccgtgaaacggtttcaactgcggttgccggtgatattgttgggttgtatgataccggtaattttcaaattggcgataccatttatcaaggcaaggaaccgattcaatttgaaaaattaccgcagttcacccctgaattatttgttcgcgttacgccgaagaatgtgatgaagcaaaaatcatttcataaggggatgcagcagcttgtccaggaaggggcagtccagctttacaagacctataacacgaatgattatattctaggagcagtcgggcaacttcaatttgaagttttccaattccggatgctgcatgaatatcattcagaagtgattatgaccccgattggctcgcgaacggctcgctggatcaatccagatcaattggatgaaaagatgagcagttcccggaacttattggttcaggatatccacggcgacccgttgttcctatttgagaatcaatacgctgaacgctggtttgcagacaagtatcctgacgttaaattaactgccaaaatgtaatagggtgcttgggtatgagtatcgtggcacacaaaaagcggctgagcaatgtcagtcgctttttgtgtgcgcttattaatctagcaatgtgcaaaaatctcattggtattggcaagcatggcactatccttcttcgggttactctgcttgccgctcaagcttgggaacagtcacttctgccagatgatgacccataatcggcgaaacatcgccaatgtccttttgcaaaagccgttcgagtgtgaaagcaatttccgcacgctgaatattgcggcgctcattggtgaaaagaagttcgatatgggaaggtgcctccgtataaacaactgtcgtttggccaagtgagaagaccttgaccagccgggcatcggtaccactcaattgttggcttactagatttctgaaactgttggtcacgttaatcagtcgcatgctcatgccctccatttctctccctactgtttttattataaaacagtttaacggaaaataataatatgtgaattgaaagccctcgaacgcaatgaagttcgagggctttcttaaaacaaattactttttagatttttgagtggtttcagccttggcaggttcaccaaccgtaatctcaccattactgatgcgggcttcaagttccttagcctttggatggtcaaggtagaagtcagcaacgcggtcttcaatctgttcctgaatgactcgacgcagcggccgagctcccatggcaggattgtaaccgagattaaccagcttttccttaaccggatcggtaacatgaatcgtcaagccctgatccttgatgttattgttggtatcttgaatcatcagtgacacaatcttcaacaagtcgtctttagacaatgacttgaattcaacgatgtcatcaaaacggttcaggaattcaggcttgaagtaattaccaagctgatccagcacactgtgcgtcttaccgcttaaagctgcgccaaaaccaacgtttgcttcggcatcggttgagccagcattggatgtcatgataatgatcgtgtccttgaaggaaacggtacggccttgagaatcagtcaatcggccgtcatccaagatctgcaagaacatattcatcacatctggatgggctttttcaatttcatctaacaagatgaggctataaggatttcggcgaactttttcagttaattgaccggcttcctcatagccgacatagcctggcggtgacccgataagcttggagacactgaatttctccatgtactccgacatatcaaaccggatcatggcgtcttcagaaccaaacagctctttggcaagctgtttagccagttcagttttgccgacacctgttgggccgacgaataggaaggacccaatcggccgaccggacttgttaaagccgatccggttacgacgaatagcgcgagcaactttatcaactgcttcattctgaccaatgacatgcttttcaaggtcaccagccagattcttcagctgtgcttgctcctgcgccttcagttcaccaactggaatgttggttttttcttcaacaatctgttccatatctttttcggtgacagtcggaatttcattttcaggcagattagactgtttcttagccatatcttctaacttagtaacttggtcacgatagaaggcagctttttcgtaatcctcctgcttcagagcagcttgcttttgcttctcggcgtcgtcaatcttggtcttgatcgtttctggatcgacagtggcaatggtcagattcttccgggaacctgattcatccagaaggtcaatcgctttgtcaggcaagaaacgatcttgaatgtaacgattgctcaaagttgcagctgcttcaatggcggcatctgtatatttaacatgatgaaaatcttgataccgcggctgcaggccttttagaatcttaatcgtctcttctacagttggctcctcaacgaggactggttgcagacgacgagcaagggctgaatctttttcaatttgacgatattcattgctagtagtggcaccaacgagctgcaactcgccacgtgctaatgctggcttcagaacattgccggcatccataccgccttcagcattgccagcgccgacgatttcatggatttcatcaataaataagataatgttcttattctttttaagttcgtcaatcaattgttgcatacgttgttcgaattgaccgcgaatgccagttccttgaactagtgaaacgacatcgagtcggatgacatgccgatcttgaagttttgacggaacatcgccattagcgatcttcaatgccaagccctcaacaacagcagtcttgccgacaccggcttcaccaatcaggactggattattttttgttcggcggtttaagatctcgatcacccgtgaaatttctttgtcacgaccaatgaccggatcaatttgaccattccgtgcttgttcagtcagatcaacgccgaattgtcccagcagtcccttgccacggttgccattgcggccgttattaccattgccgccacggcctgcctgagttggcggggtctgagcatttggttgttgcggttgatccattccctgattcatcgcacggaaaatatcatctaagctgccgaaaccaaatggatcggttgcatcagttggtctcatatttcctcctgcttggttcttgagtaattgataacagttttggcagagattaatttcctgtcgagtgccattaacaacggttgaaagatgaatagtggctggattcttatgacagttttcacacagcattttgtcacaaccttcctatctgtttaggtgccacgtgcagtcaaaaaaggtttgacctttcttgacctatggcaatagtatacacccacatttctggaatgcaagcactctgccactaagagtgctaaaaagttgcaaaaatttcagtgacagcaagcacttgcgctttttccttaccagcttttatgctactcttattaggtgaggtgaggcaaatagatgactcaggattacgtcgctttaatagatgagttaaagactggtcagcgggacaaaatcacggtgacgccagaaacgttcatggcgtttcgcgcggcatggacgaattatcctgatcgtgaagagatcgtgggaatggctaaacgtgatggtgtcattgaataccattatcgatcagttgattctcgttaatataggcgccaaatctgatgtggcgcttgtgacaagcttcaaaaaatggtaaggtttacatgaattgttttgggtacgaatgcgcacacaaactattcggaaaaaaactagaaatctagttaatacgaaggagcagatcagtcatggaaaaacgcgaatttaatattattgcagaaaccgggatccacgcacgtccggcaaccttgttggtacaggcagcaagcaagttcaactcagatatcaacttggaatacaagggtaagagcgttaacttgaagtctatcatgggcgtcatgagtttgggtgttggccaaggtgccgatgttaccatttctgctgaaggtgcagacgaggctgatgctatcgctgctattacagacacaatgaaaaaggaaggcttggctgaataatggctgaacatttgaagggaatcgctgctagtgatgggatcgccacagcgaaggcctatttactggttcaacctgatttgtcattccaaaaaaagacggttgatgatccttcaaaggaaatcgatcgcctgaagcagtcacttgatcaaagtaatgatgagttaaaggttattcgagcaaaggccgctgaatcgcttggcgaagaagaggctcaggtttttgatgcgcacatgatgattttggctgatcctgactttactggtcaggtagagactaagatcaaggatgaaaaagtcaatgctgagcaggctttgaaagaagtctccgaattctttattaagacattcgaaggtatgaccgacaatccatatatgcaggaacgtgcggctgatgtccgcgacgtgacaaagcggatcatggcacacttgctcggtcgcaatttgccaaatccagcattaattgatgaagaagtcgttgtggttgcgcatgacctgaccccttcggataccgcacaattgaataagaagtatgtcaaagcatttgtcacggatattggcggtcggactgcgcacagtgcgattatggcacgttcgttggaaattccggctgttgttgggacagatgacattaccaagaaggctaataacggtgatcttatttccgttgatggcttaactggtgaagttgttgttgatccgaccgatgatgaagtagctaagttcaagcaggatgctgaagcatttgctaagcaaaaagctgaatgggctcttttgaagacggccaaatcaatcacagctgatggcaaacactttgatgttgctgccaacattggcacgccaaaggatcttgatggtgtgctggcaaacggtgctgaaggtatcggtttgtatcggacagagttcttgtacatggattctgctgaattaccaactgaagacgatcaattcgaggcctacaagaaggttgtcgaaacgatgagtccgaagcctgttgttgttcggacgatggatattggtggggataaacatctgccatatttgccgcttcctgaagaacagaacccattcttgggttatcgtgcgattcggatcagtcttgatcgccaagatatcttccggacacagttgcgcgccttgttgcgtgcatctgcctttggcaatctgcggatcatgttccctatgattgctaccattgctgaattcaagcaagcaaagcagattttcactgaagaaaaagataagttagtcaaggatggcgtcaaagtatctgatgatatccaacttggcattatgatcgaaattcctgcagctgcagttttggctgatcagtttgctaagtatgttgacttcttctccattggtacaaatgacttgatccagtactctatggccgctgatcgtgggaacgagcatgtttcctacctgtatcagccatacaacccatccatccttcgcctaatcaagcatgtgattgattcggcacataaggaaggcaagtgggccggtatgtgtggcgaagctgctggtgatccaatcatggtaccactgttgcttggtatgggtcttgacgaatactcaatgtccgcaacttctgtccttaaagtacgcagcttgatgaagaagctttcgacagctgatatggctaagatggacgaaattgctctgaaccaaaatatcactaatgatgaaaacgctgatctggttaagaaaacaactggtcagaaataaactttcattatcagaaagaggctattgactgaataagttgacggcttctttttttgaccaaaatttgattttgatcgggctcgctagcattgatttttctgaaacccgctcgaaaatgggactttatctttgccatgcaaaaaggtgattgcgcgactattcgtcggcatctgaacagtgactgactgcagacttttcagaaaagtgttaaggttattatgtaaactaaaaattgagttactgattcatggtatgacactgtgagcggtggttcatttggacttgtagggggaattgcatgtatcaatcaaaaacacacaatcatcgatttaccggtcaccttgcgagtgcgaagacacggttgcggctagtagctttgatttcaacgatgggtggcctgctttttggctatgacactggggtgatcaatggcgcattgccttttatttcttcggaactgaaacttgcccctggatcacagggttgggtcaccagtagtttgacgctgggtgctgcttttggtgccatcttagtcggtcgtttaagtgatcgctatgggcgcaggcggctcatcaccatgttagcgggcttattttttctggcaacggtagcctcgtcactttccccgagtgctggctggctgattggcgcacgactgatccttggattagccgttggtggcgtctctgtgctggttccgagctttttagcagagattgccccaacgagtcatcgtgggcggttagtcacacaaaatgagctgatggtcgtgactggccagttacttgcttttgttctcaatgcctttttaggaactacttttggtaacgttcctggtatctggcgctggatgattgtattggcagtcattccggcaattatcttaggtatcgggacttattttgttccggaatctcctcgttggttaatgatgaaaggacggccggcagcagcacggtcaagtttggaagtgttgcgatctgctgctgaagtgccagcagagattgaccatttgaaacagaatcttgccgaagatactaaacataagcaggcgagtgttcgagcattgaaaaccaaatggattcgccgactggttctgattggcatcggcctaggcgtcattcagcaaattgctggtatcaatgtcatgatgtattatggcacctcaattttacaaatgacgggttttgggcgagatagtgccttgatcgccaacattgccaatggggttactgccgttgctgcaacgattgtgacgttgcaattgttgaagcatgttccgcggcggccaatgctgattgtgggattgattggctcaaccgtggcgattactggtgtcaccttcgctagtcgactaccagcgggttcgtcattccgggcatttgcgacaatcgggatgatgatgctgttcttggcgttcttccaaggcgctatcagtccaatgacttggctgctgatgtctgaaatcttccctgaacaggttcggggtatagggatgggcgctgcaactttctgcttgtggttagctaactttggtgttggcgttctgttcccggttggtctggcccaaataggcatgttctggacattcgtttgcttcatcgggacaaatttgatttcattgctgttcgttctgatttttgtgccggaaacggctggacgctccctcgaaactttgcaccgagaggagaaagcccgcttaaatcattaatgacaagcgatttgttcaagaccaaaaagttgcgctttacaaaaagtttgataccataaaggtgtatcaacaattcgatgaaccttcacaaaggggagccattggctgagaacggggaaatccggacccttcgaacctgttcgttaatgcgagcgtagggatttgtgaatggtcggaagcgaccttctttgtgaacggggactcactaggaggctttttttatgcaacagcacaagcaacttgttgtcattttggaaactgcgatcattgcagcttttgcgatggcattaacttatattccacataccacgggtgtttcggcaattgaactgaattatggtctgattccaattgctgttttggctatgcggcgtgggttagttcctgcagcatgggcaggctttgtctgggggattttggatctgattttgcgtggtattggcggtggcagtgtcttgaatcctttacaaggtattcttgaatatccgattgcgtttaccttggtcggtttaatggggttgacgtttgcatctttccaaaaggcagtgcgcggtagtgaaaaagtgaaggcgagcggctatgcctttgctggtattattatcggcacgtttgctaaatactttatccatttcatcgctggcgttgttttctggggtgcgtatgcgcctaaaggaacgaatgtctgggtatactcgttgatcgtcaatggtggatcagcgttattcagcaccgtcttaacaattgttgttgttggtgtattgctaaccgttgccccgcaactctttgttgctaaggacggcaaatcattttcaacgaaggctgcctaagtttaagacttcaacaacgcatatctgatgaacgcacatcgctctgtgatgtgcgtttttttgtgcgcgggcggcagtctttggcgatggcgactgcaataagttgtcaaaaggaatattagcaacacagatgtgatttcagacattgaaaagctgacgggttaagattttaaaagataaacacgaacgattattaatataacattgagaattgttctcatttttattgaatctgtcgcgctgacgtgctattctcaaaacatcttaaagaaagcggggaacgagatgcaaaaagtagcagtggtcatggggtcaacctctgattggccgaccatgcagcaagtgacggctcagttaacgtcattggctattccttatgagaagcgggttatttcggctcatcggatgccagacgagctggcggattttggtaaacaggcagtggcactggggtttggtgcaattatcgccggtgcaggcggcgctgctcatttacctggaatgctcgccgctaatacattgctgccagttatcggggttcccatcaaaacacgaacattaaatggggttgatagtctcctgtcaatcgtgcaaatgcctggcggggtcccggttggcacgatggccatcggtgatgccggagctgtcaatgcggcgttgttcgctgccgctattttagcgctgaacgattcagaactggctgaccgactgcaagcttttcgcgatgctcaaactaagcgtgccaaagaaagcgaggccgcgcttcaatgattgatgtagtgacgtccccagcaacaattggcatcattggcggcggtcagttgggacgcatgctgacacaaagcgccaagtcgatgggttatcgcgtcggtattttagagccgacacccaattcgccagccggtcaggtagcggattttcaaatcactgcgccctataacgatcaagccgccttaaagcaactggctgatgcgtcagatgtgctgacgtatgagtttgaaaacgttgacttagccgcgttggaggcggttcgcagcgagacgcggattcctcaaggcaccgccattttggcgataacccgcgatcggatcaaagaaaagacttttttaaagacacatggggtaccggtgacgccttttgccgctgtcaaccgtgccgctgagttggcacaagcagtcgcgaccatcggcttgccaagcatcctgaagacgaccactggcggttatgatggccatggtcagcaagatatcaatacaccagatgattttcccgccgcccgcgaacttttgacgcatggtccttgcattctcgaaaaacggcagcaatttgatcgtgaagtctccgttatgatgacacgtgatggccgcgatcaagtgcgtgtttttccgatcgttgagaatcgccatcagcaccatgttttgcatctcacgcttgcgcctgcaccgaacatttcgccggtgttagccaaaaagattgatgatctcgcgactaaaattgcgcttggcctggatcttcgtggtgtgttgggcgttgagctctttatcgaaggggacaatgtggtggccaatgagttggctccgcgtccgcacaattccggacactactcgattgaggcatgcaacttttcacaattcgatgcacatattttgagtatttgtggcttaccgataccgccgattacattgaagcagccagcggttatgcgcaacctgctcggcgacgatttaaccattgccaagcagaaatggcctcagcatcctgaatggcacatgcatgattatggtaaagccgagattcgctccggtcgcaaaatgggtcatcttacggtaactgatgatcgtaatgtgttggacatacttaaacaaatggaggcagcatggtgaacaaaacaacattattgtataccggcaaggcaaaacaggtttatgcaaccgatgatcctgatgtgttgtggatggcatacaccaatcaagccacagcattaaatggcgagaaaaaagcccagattgcccacaaaggcgaattaaatcgagcgatttcgacgttgctatttaaggaattgacagctgccggtataccaacgcattatcttgattcgccggacagcacgacgatgatcgtcaaaaaagccgcgatgttgccgcttgaagtagttgtgcgtaattatgcatccggtcattttgtcaccaagttcaatgttaagccgatgatgaagctcgacccgccaatccacgaatactattacaagtctgatgaacttggcgacccgttcatgaatgaagcccaaattttcgccttgcacgaagctacgcctgaacaactcaagcaagtgcacgctttaactgatcgcatcaatacttatttgacgcaacggtttgcggcgattgggatcaccttagttgatttcaaactcgaatacggcacgctcaaggatggcaccttggtactggctgatgaattgtctccggataattttcgcttagttgatcaacaaaccggggcatcgctcgataaagatgttttccgacaaaaccgtggaccattgaccccggtttatgaagaagtcctttcacgcctgcaagaaaaaggagctgctcatgtttaaagctaaaatttacgtaacctacaaaccttccgtgctggatcccaaagccgaggtcattaaaactgctttgggacgaatggcttatcacaatgttgaagatgtattgtatggcaagtactttgaattaacgttagcaggcagcgaagcggaagttcgcaagcaagtcgatacgatctgcgaccaattactggctaatgtcaacatggaaacttatcgctttgagctagaaccgatggcggaggttaacgcatgaaagcggctgtgatttcttttccgggctcgaactgtgatcttgatttgcaatgggcggtgcgtgccattgctggagccgagtgtgacttgatcaagccaactcaaaccgacttgactgcttatgatgttgtgatggtgccaggcggtttttcctatggtgattacttacgcagtggtgcgattgcacgcttttcaccagtgatggctgccctaaagcagtttgctgcggctggcggctatgtcattggcatttgcaacggtttccagattttgaccgaagccggtttgcttcccggcgccttgcaatggaatcgcgacttgaacttcatctgtgaaccagttgcattgacggtagaaaatgccgggacggcgttttcaaatcaataccaagttggtgaacatttgacattaccgattgctcatggtgaaggcaattattacgcagatccggaaacgttggcggctctggaaactaatggccaagtggttttccgttatgcaaataaccctaatggcagcatgcacgatattgccggtgtgaccaatgagactggtaatgtgttaggcatgatgccccatccggaacgggctgttgaagcactgctgggcggtacggatggcttgggcgtattccaatcgctgattaaccaaacggaaggagccgatgtacgtggtgcacgttgagatgagccccgaggctattgcaacccagaaaccttatttagaccttgggctgacagaggctgaatatgatcgttttgcagaactaatcggccatcagccaaacgataccgagatcgggttagctagcgggatgtggagcgaacactgcgcttacaaatatagcaagccggtgttacgccaattttggaccaaaaatgagcgcgtgttaatggggccaggtgaaggtgctggcgtgattgatatcggcgaaggcaaagcagtggtcttcaaagccgaaagtcataatcatccctcggcagttgaaccttatgaaggcgcagcaacaggtgtgggcggcattatccgcgacattttctcaattggtgccaagccggttgcgatgttggactcgctagcttttggcgacattgaacagccacatacccaacatttggttgatcggatcgtcgcggggattggcggttatggcaatgcaattggcattccgacagttggcggcgaaacaaactttgacgggagctatacccgaaatccgctggtcaatgccatgtgcgttggcatcatggacaaagatcaaattcaaaaaggtaaagctgctggtgttggcaatgctttgatttatgtcggggccaaaacagggcgtgatggtattaacggtgcgagctttgcttctggggatttttctgatgaagaagcagccgatcgctcggcggttcaagttggcgatcccttcatggaaaagctgttgatggatgcttgtctcgaaattaccgggcatcatcaggaggcgcttgttggtattcaagatatgggtgcagctggattggtatcgtcaagcgtggagatggctggtaaggctaacagcgggatggtgttagatctcgacctgattccgcagcgtgagaccgaaatgacgccgtttgaaattatgttgtctgagtctcaggaacggatgctgctgtgcgttcgggccggctttgagcaagaagttttggctgttttcgctgattatgatttggatgcggcgattgttggtcatgtgattgctggtcatcagtatcagctttatcaccatggcaaattggtttgcgatgtgcctgtgagttcgttgaccgatgatgcgccgatttatcatcaacaagggaaaatgccaaaacgactggcccaaccggctgcggattttgaccctatcatcactgatccggtgcaaatatggacggacatgatggcgatgccgacgattgctgacaagtcatctttgtacaagcgttacgatgcgcaggtgcaaactaataccgtcgtcttgccaggcagtgatgcagccgtgactcggattcgcggtactcaccgagcactggcgatgaccaccgatagtaagggccgttacttgtatcttgatccgcaggtgggtgcggcaatgagtgtggctgaagctgcgcgcaatttggttgctagcggggcggaaccgcttgggatcaccgattgtctcaattttggcgacccaactaagcctgaggccttctacgaactggctgaggcggcgaagggaatcattgcggctaccaaagcctttaacgccccagttatttcaggaaatgtgtcgctgtataacgaaacgaatggtgaggcgatctatccaaccccaatgattggcatggttggcttgattgaggatttgagcacgattaccacggcggctttcaagcaagcagatgatctgatttatctggtgggggagactcatggtgattttaacggcagcgaactgcagaagctgcaaacaggagaagtcactggcaagctgttcgattttgatttagaggctgaaaagcagcatcagcactttgttttgaaggccattcgtgagcatctaattactgcagcgcacgatttaagcgatggtgggttattggtcgccttggcagagatggggtttgatgcccaacttggcgcccagattaacgtcacattgccaactgcttggggattttccgagacgcaaggccgcttcttgctcacggtggcccctgaaaatcaggcagcatttgaagcattgcatggtccggcccaattgattggtcgagttcaggccgcaccagaatttgaagtcacaaccgttaatcaacatttttctgcatcgttgcaacagctacagacagcattcgaggaggcgctcccatgccacatgaaccaaaaggcttaaatgaagaatgcggggttttcggtgtttggggtaatcctaatgccgccagcatcacgcatcttgggttacacacactacagcaccgcggtcaagaaggcgccggtattgttgggctgaccaaagacgggatgcggcggcattatgggttggggttactgagcgaagttttcacgaataccgatcaattgacgccattaatcggacgcgccgccttgggccacgtgcgctactcgacagcagggggacgcgtgctggaaaatattcagccgttgcttttccggttttcggatgaagccattgccttggcgcataatggcaatctgaccaatgcgatcagtttgcggcggcagttggaagatcaaggcgcaatttttcagtccacctccgatacggaagttttgatgcatttaatccgacggcaagttggccagccttggctgacacagttgaagaccgctttaaatgaagttcacggtggttttgcgtttgtcttactgacggaacatggtttatatgccgcagttgatccgtatggctttcggccgatggttgtcggggtgttgtcagatggcggctatattgtgtgcagcgaaacagcggctttggacgcggttggcgctgaattcgtccgtgatgtccagccaggggaattaatcacaattgatgatgctggtttgcacattgatcatttcaccacgaatacccaattagcagtttgttcgatggaatacatctactttgcccgccccgattcggatattcacggcattaatgtccatcaggcccgtgtacggatgggtgaacggttagcaaaagaacaaccggcggaagcggatattgtcgtcggcgtgccaaattcatcgctgtctgctgccattggttacgcgaaggccagtggaatcccttatgagatgggtttaatgaaaagtcagtatgtggcgcgaacctttatccaaccgacacaagcattgcgggaaaaaagcgtcaaaatgaagctcagtgtgatcaaaccagttgttgccggtaagcgaattgttttagtcgatgattcgattgttcgtggaacgacttccaaacaaatcgtgaagttgttgaaagaggctggcgcagctgaggtccatttacgtattgccagcccaccgttgcgctttccttgtttttacgggattgattttcagacgaccagcgaactttttgctgcgaatcatagcgttgctgaaatgcgggatcttttagcggtcgagtcgcttggattcctttcaacccaggggctggaagagagtgtcggcttatcggccacggcacctaatggcggtttgtgtgtcgcttatttcaccggccagtacccagcaccgttagatgattatgcctttgccttggataaggaagtggcatccctcaaagtcaatgttgcggaggttagtgcatgactgattataaagacgccggcgtggatattgaagctggcgaagcagctgttcaacgaatcgcggcgttggcaaaagaaacaacgaatgccaatgtgttagccagtgttggcgggtttgccgcagcttatcggttgccggagatttcggagccaaccttgatcagcgccacggatggcgttggtaccaagttgctgttggcattgcaatgtgacgcgcatgaaaccgttgggattgatttagtcgccatggttgcgaacgatttattggcgtcaggcgcccagccactttttttccttgattatatggcggtggatcatttggatgttgaccgcactgaagccgttgttcgcggaattgcttatgggtgtcagcaggctcagatggcattaattggtggcgaaacagcggaaatgcccgacatgtacccacaacatcattacgacttggccggtttcgcagttggtttggtttccgcttcaaaacgcctgccgcaaaaagtggcggctggcgatgttttgattggtctgccaagttcaggtgtgcatagcaatggttattcactggtgcgtaagctgctggcagaaaccgacttaggcagtcaatcgcttgatgacggatcggaaatgctgaatgcgctgatgcggccaactcggatttatgtgaagcaggtgttgccgctcatgcagcaaggattgattcacgcggctgcccacattaccggcggcggcatcactgaaaacttgccgcgggtgatccctgacggtttggtagcaaacattgatccgctagcatggcaacggccagagttgttcgatcgtttgcaacatgccggacatttaagtgaaacaacgatgcgtagtaccttcaatcttggaattggcatgatccttgtcgtgccagaacaagcggttagtcttgttcaagacgcgattcctagtagtaaagtgattggcacggttggcgaagatcctgtcgaaaagctgcactggcaggtgagtcgtcgatgaaagatctagctgtttttgcatctggtcatggcaccaactttgaggcgttggcaaatgccgctgatcaaccagatagcggttatcgcatcgccgcactggtttgtgatcaatcacaggcgccggtgattcaaaaggctgccgcacgcaacattttgacgatcgtagttgattttaaaagctatcctaataaaacggcggcagagacggccatcttagaacagttaccgccagtatctgccttgattttggccggttacatgcgtatcatcgggccaacccttttaagggcattccctaaaaaaatcatcaacttgcatccagctttactacctagttttccagggcgccaaggtattcaggatgctttcgactacggggtgaaagtcaccggcgtcacggtgcattttgtggatgctggcattgacaccggcgagattatcgcccaagtgccagtcaatatcactgatggtatgagcttagccgagcttgagcaggcgatccatcgccaagaacatcaaattttccctgcaactgtgaagaacctcattcaagaaggagcgatttaagtgaagcgtgcattgttaagtgtttcggataaaacaggtttggtctcttttgccaaaggtttgattgatcgaggatttgaattagtctcaaccggcggcacgcatcgcgaactggctgcggccggtattgcggtgaccagcgttgaagaggtgactggttttcccgagatgctcgatggtcgggtgaagacactgcatccaaagattcatgctggcattcttgcacgccgcgatgatccagcccatatggaagcgttagctgaccacgacattcaaccggtcgatttggtttgtgtcaatctctatccgtttgccgccacaatcaaacgcccagatgttacaagggcagaagctatcgaacaaatcgatatcggtggcccttctgccttacgtgcagcagctaaaaatagcgacagtgtctgggcagtcgttgatccggccgattacgaggctgttttaaccggccttgaccaagacgatgctcatctgcgtcaaaagctggctgctaaggtctttgccatcacagcggcttatgatgctcaaattgtgcattatcttgatcctgagccatttcccgagcacttcacaccgacctacacaaagcgccaagatttgcgctatggtgaaaatagccatcagcaagctgcgttttacgttgaacctgatccgaatccaactagccttgccgctgccaaacagttgcacggtaaagaactgtcctataacaacatcaaagatgctgatgctgcgctagcgatgcttcgtgaattttccgagccagcggttgtggctgtcaaacatatgaatccttgtggcattggtcttggaaaaaccattgaaggcgcttgggacaaagcctatgctgctgatccgatgtcgatttttggtggcatcatcgccttgaatcggcctgtagatctagcaactgccgaaaaaatgcacaaactttttcttgaaatcattatggcaccggcatttgatgatgatgcttatgctgtgttggccaaaaagaaaaacgtccggctgcttacaatcaatacagctgatacgccggctgaattaggaacagagacgacagcaatttatggcgggttactgattcaaacgcgggacaatcagacagaaacaccggctgatttgactgttgtgacaacggtgaaacccacagacgagcagctcaaggcacttgcttttgcgcaaacagtcgtcaaacacgtgaagagtaacgcgatcgttgttgcccaagctgatcagacgttaggcattggggcaggacaaatgaatcggattggttcggttgagttagccctcacccaggcccaacaaaacgacaactttgctggcgccgtcatggccagtgatgccttcttcccaatggacgactgcgttgattacgcggctaagcatgatatcaaagccatcatccaaccaggcggcagtattcgggacaaagattctatagaaaaggctaaccagtacggtattgcgatggtgacaactggtgtccgtcattttagacattaaaaagaagagcgtgaacaggcgcgtttagaaaccggagcataagtggtcttgaggtgaactggctgggttttggccagatagcttcaaggttctgatgtataggtttccgcgcctatgagcgcatttaagagaaaaacaggcgcgtttataaagcttccccaccagcaaatacactaggaggttacgatgaaacaggttttgatcattggcggcggcgcccgggaaagtgcccttgctttaaaattcaaacagtctccgcaagttgatcatgtctatgtggcgccaggtaatccggcaatgaccttgctgggagttgatccgatcaacattgatgacaatgactttaccaagttgattgactttgctgagacccaccaaattgatctgacttttgtgggtcccgaagtgccgttagccgctgggattgtcgatgcttttcaggcagctgatcaaccgatttttggcgtcaccaagaaagttgcccagttagaggccagcaaaacgtttgccaaggattttatggcgcgccatcagttgccgactgccggcagcaagacggttcacaatgctattgatgcccatgccgaagccgcgacaatgggcttgccactagtcttgaaaaaggacggtttggcagccggaaaaggcgtcgctattgcccaagatgctgaaacgctggatgaaacgatcgaaaaaatgtatgccgattctccagatgcaacggtgctacttgagcaatatcttgcgggtgaagaagcctctgtcatggccttgtttaatggcgaaaagcgtgtcattctgccgctttctcaggatcacaagcggcgttttgccaatgatcgtggtcctaatacaggcggaatgggggcgattagtccgttaccgcaatttaacgatgatcaagtagccgctgcccatcagcttgtggatgcaacgttaaagggcatgcaggctgatggcttagatggtcaaggggtcatgtacattggactgatcttcacacctgacggaccgaagattttggaatataacatgcgttttggcgatccagaaacgcaagtcctgctgccgcaaatcacaaatgatttttatcaactgattagcgacttattagcaaaccgccaacctagtttgacgttgagcgataaggcctatgcttgctttgttgccgttaatcctgcgtacccgagcagcgcgctcaagacagttcccgtcattgtgccgacagattggccagagggaacttggcttccagcaggagtggcgaaaagtgaccacggctgggaaagtcatgctggtagaatcttctccgtagtagctggggcggagtctttgccggatgccgttaaagcggcaaaaacagccatggagaaaattcaaggcgttttggattatcgcactgatattgggttccacacactgtaaaagtgaatgaatacaatcgcgcctcggctggctagccggggtatttttgtgcgctcaagaaactgcggttgacttttatggtttacagttgtaaattaaaggtgttgatagattacagatgtaaacggaggcaagcgatggaaacaccgaaagttgaaatttcccagtctgaatgggaggttatgcgaattatctggacacttggtccactgacaagtagcacgcttgcaacaattcttgctgaaaaaatgggctggaaagtggcaacgaccaaaacctttttaggacggttagtcaaaaaaggcgccttaaccactgaaaaaaatggacgtgaatttctttatcacactgcagtgggtgaacaagagtctatggatgccgccgtggcggaattatttagccacctttgtcaaatgaaaatcggcacggccatcaatcacttgatgacgaacgtcaccctttcgaaacatgatattgagatcttgcaacaaacgcttttagcgaagcagcacgatgcgccgaaaacagttagttgtaattgtttaccagaaggttgtaaggaggctgcacatgaatgacgatgaaatgaaagcgatgaacgatacgaaaagatcacagactgacaaaaaagatcaaatgaaccacgatcatatggcgatgggtcaccatggcgatatggaccacatgcacatggatcacgactctgaagaagagcatgctggcatggcgaagatgcagatggaaccgggttcaatggatcatgcagcaatggatcagatgcacatgaatcacggcgcgatggatcacatgcacatgcatatggatcacggctcgatggatcatggcgggggtcacatgatgcatatgggaaatctcaagcaaaagttttgggtgagtttgatcgtcatgatacccgtgttgttgctttcgcagttcatggggatggatatccacctcggcgttttgcaattgccaatagtttttcctgggtctgattggcttgtcctgattctttcgtcatttctattcttctatggcggttggccatttttgaccggcgctaaatcagagttgcaaagtcgccagcccgcaatgatgactttgattgcaatggggatcaccgttgcgtacggttactcgctttatgctttcgtcatgaatcactttatcgcgccacatgctatggtgatggacttcttctgggaactggccactttaattgtgatcatgttgctgggtcactggattgaaatgaatgctgtgatggcggctggtaatgcggttgaaaaattggctgcattattgccaaatcaggcgcatgtggttcatggcgacagtgtgatggatatgccattgtcagaggttcaggttggcacgcgattacgggttttggctggtgaacaaatgccagctgatggcgaaatcgtaagcggcagcagtagtgtcaatgaatcgcttgtcacaggcgaagccaaggctgttcgtaaggcaggcggtgataaagttattggtggttccatcaacggagatggggtcattgaaatccaagtgacaggtactggtgaaagcggctatttagcccaagtaatgaagcttgtacaaagtgcgcaagcaaataaaagtaaggccgagggcatggccgacaaagttgccggctggttgttctatgccgcgttagctattggtattctggcgtttattctctggatgccaagcggcctggccaccgcttttgaacggatggtcaccgtcttcattattgcttgtccacatgcattagggttggcgattccgcttgtcattgctcggagtaccagtattggcgccacgaatgggttgttgattcgcaatcgccaagcgcttgaaacagccaagcgagccaagtacatgctaatggataagacagggacgctgactgaaggcaagtttacggttgccacaacgttgcattttgctgatcagagtcaggaagaaattctagcaaccatggccgccttggaaagtcattccgagcatccgcttgcaactgggattaaagcggcagcaattgagcaaaagctaacagtgccagctgctgaaaatgttcaggtcatgaagggtgtcgggctgtcaggcacagtcgacggcattcagtatgagattgtgaatgcccgatatttacaggatcatcagttgacctacgataaaacccaggctgatcagtgggctgctgccggaaattcgttagcctttttgctgaaaggtcagcacgttttgggcatggtggctgaaggcgatcagttgaagtcttccagtaaggcatttgttgccgagttgaaacagcaggggattacgcctgtgatgctgactggtgataaccatgaaactgctaagaaagtggccggtcagcttggtctgacggaatttcaggcagagttaaaacctgaagacaaagttgcgcaagtgaaggcttatcaacagcatggcgttgtcatgatggttggtgacggggtcaacgatgcgcctagtttggctcaagcagacatcggtgttgcaattggagctgggacggatgtcgcgattgataccgccgatgttgtcttagttcatagtgacccggccgatattctcaacttcttgtcattggcaaaagcaactaaccggaaaatggttcaaaacctttggtggggtgctggttacaatattctggcgattccgcttgctgcagggattcttgcccccgttggcttcattctcagtcctgcggtcggtgctgcgatcatgtcgttgtcaacgattgttgtggctttgaatgcaatgacactgcacttaaagcgcgcttaataagtcacgtgtatgacgtatagcatcagagaatgccggcctggcgtcaagatatagatgacaggccggcattttgtgtacaactgatactacatcttgggggtgaaacgtgatacgatgaaaaaagtggattcacaagactaaacagctgggtgcgtgacaccacgtgggttggcacaccctcaaggaaggcagacatatgatcgaaaataaattaccccaaaatcccaaacctaaagaatggcttgccagtgagctttcacagcaacgcatcgccgattacaaaccgtttaactttgttgacggcgaaggggttcggtgtagtttatatgtctccggttgccgtttcgcttgccctggttgctacaatcgggttgcacaaaattttcgttatggtaaaccttatacacaagaacttgaggatcaaatcatgaccgatcttagtcaaagttacgtacagggtctgacgctgttaggcggcgagcctttcctcaacacgcaagtctgcattcgcttgtgcaaacgaattcgtcaagaattcgggcatgagaaagacatttggagctggagcggctatacgtatgatgaattgattcaggattcagacgataaacttgagttgctaaaattgatcgatattttggttgacggtcgctttttgttggcgcaaaaggatctgaccttacagtttcgtggcagtgctaaccagcgcatcattgacgtaccagcaacaatggcggctggcgaagtcaagttgtggaaaaatctgattcgttagttcgttcaggcaattcgaaggacgataagataatctattaaaaaatcggcatcagaggctgcttgcctctggtgccgatttggttgaataggtggctctcaattttgagatctagggttgattcaactacttgatgctatcttattcgtcagctgtctggatgtgacctagtctgggtttgcacagcaatcgcgtgggattcaggatggtgcacagtttgatcggcctcaccataatagctcacgtaaggaaaatggattgtgaccgtggtaccttgattgattaccgaggttaacgacaagtgatggccaagtttttcagctaacttttcagccaagaacaagcctaatcccgttgacttatgattcgaaaggcgcccattactgcccgtgaatcccttctcaaaaacacgatgttgctcatctttggggatgccgataccggtatcagtaatctgtagttgcgtttccttcccggtgttacgaatgagagccgtgattcggcctccttctggcgtatatttgaccgcattggagatgagctgagcaagaataaagcgaagccacttgttgtctgtcaatacgatttgatcggtgccattcagtctgaaagatagtcgtttattgataaagccgttccgctggttggcgactacgtcattgatgagcgggcgcaatgatgtctcatgcagcaaataatcctttgaaaagctgtcgagacgcgagtaatacaagacttgctcgacataaaattcgatttgatccaattgcagattcaaattatccagtttgtcatcaggtacttgcccctcaaaactttcggccagcaacgtcactgccgcgagcggtactttgatttcgtgcacccaagaatcaatgaagtctttttgatcttgctgttgtgctagcagggcagttacttgttggcgatgctgggtcaaaatttgattgtacgttttcgtcacaagttgttcggttgcggattcaccgccaggcaagggccaatctaacgcagcctcctgagcatcgatccgttcctgaagccgagctgcgaaccgccgtacgcgccaataccgtgcgatcaaaaaagcgctggccaatagtgtcactaacaacacagcgtaccaaagcgtcatggccttaacgcgatgctgcgggtcaagccagatgatcaaggccgccagaccaacacaaagaatatagccaccaatcgggcttaaatgatcctttaaataatcacgaaaccgcatctgccagcctcctaaggaacgatgtaaccttgtccaaccttggtttgaatataatctttcaacccggcttcctcgatttttttgcgcaggcgattaatgttgacggtaagtgtattgtcatcaacaaatcgctcgtcttgccataagtcctttaataaccgggaacggctgacgatttgaccgtgttgccggatcaagatttgtaacagtttatattcattttttgacaggttaatttcgttttcgccaatttgtgccataccgtttttgaggttcaacatcaagccgttgtgttccaaaacatcggttccttgatcagcataattgtaggttcgtcgaagcaaggcgttgatttttgcgatcaacacttccatggcaaacggcttattcaaaaagtcgtcagcgcccatattcattgccatgaccatatccatattcgtgttacgactagaaatgaaaatcacagggacctttgatacttcacggattttttgaacccaataatagccgtcaaaaactggtagattaatatccaataagactaaatggggtttttcttgcaaaaagtcatcaaatacagcattaaaatcggttaccacaactggatcaaattgccatttttttaagttatcagcgatcagcccactaatcgtctgatcgtcctctacgatcatgattttaaacacgtgaccaactccatttctgctctaatggtataagttttgggaaggaagcacaagcgcgaacaaggtcaataagaccagtttttatgagctgggtttgtccggcttttaggaagccgcaatcttctaataaataagttttcaggatttactttaaaatgtaaactaagagcaacaaacccgagattctttgtctaacgggagttggcagcacatgcataacacgtttttggtatgataatggcggaggtgcgcgatggcaattcttgaagtatctaacttgagcaagatttttggacaacggcatgatcgagttcgcgctttgaacgaccttagctttcaggtcaacgcgggtgagttcgtcggcattatgggaccaagtggcgccggaaagtcaacattgctcaatattttagcaacgattgagacgccaagtaccggaaaagtcaatattgcagggaacgatcttgaggcccttaatgaacgacaacaagcggcttttcgtcgagatcatcttggttttgtgtttcaagacttcaacttattggatgatatgacggtgacgcaaaatgttttgttgccgctaaccttgcagcaagagcttcagcctgatcgtgctgaacgattacagacagtcgcgaatcaccttaacttaactcccattctgcaggcttttccgggggagttaagtatgggacaacgacaacgcgtcgcggctgctcgcgctgtgatcacccaacccgatcttttgttggcagatgaaccgactggcagcctcgattcattagcagcaactgattttttaaactatctgcgtcaattaaacgaaaaagaaaaaaccacgatattgatggtgacgcatgatcccttcaccgcgagcttcgcaagtcgcatcatcttcatcaaagatggggcattttttgctgaagtaacgcgtggtaagtcccgccagcagttttttgaccgaattattgatatggaagcaactgtcagtggaggaggccatacccgtgtggcatctgattaagacaaatttacggcgccatcgtcacgaggatggcttgcaggtactagtggcagcattgatcagtgccgttatgtatgccattggggcggttgcgaataatgaaccgattttgagcgatgccagcaagcggcttggggatctggatattgttccgattctattgatgattgtgatgatggtcttagcactttttgcgatcagttttttgctttatttcaacactttactcattgctcgtcgtgatcgagaaattgggctatatcgtttgcttggtttgtctggggccaaattaggattgttagtctgtattgagagtttaatgatcggtatattcggaatggctctgggtctcttactcggattgattatctcacctttattgggcatggtgctgattcgattgatggccttgcacacaccgattagtttgatgctctctttcccagctatggttgatgtcgtgattttaatgggcgttgtctacctattagtgggcagcatcaatgccatttatgttcaaaacccattgcgtaattttattcgccagcaggatgtctcggccgctcccaaaccgcaaacatggtggcggttttcccttggcattgctggcgtcgttttgttggctggcagtctgtttacgatggtccatttgttaccagttagtggcgtgttgatgcatatactgccgcgaactcaggggcgtttgattccaccattgttaatgggattcatgctagtggctttgttgctgggacttttcctcgtttttgaggagtttctgcctggcatagtggcttggttccagcaacgaagtcaaatgaagacgcgcaatgcgcatgccatctcaagacatttgatcattaaacgacttcaagggaacgcgcattcattgtggctaacaacattgctgtgtgcgattacgattacgatgcttggcagttctgctatgttgtttcaatataatcaggatctggttcagcgcgagattccgacgactgtggttgcagcaggggcaggcgtggataatgtcacgaaaattttagcaaaagctaaggtcaaaccaactcaagcaattatcctatcttcgaaacttgtgtatgccgaaattcgactaagagatcaggccgatcaggtccgaaaacaacctggtgtttataatgtgattgcgatgcgggattatcaacgcgctgcccacttacagcactatttagctcctgttagacttcgtgggaacgaagcacttctaatgctgccaacgcgaaccagtttccgaccagtcggtgcccgccgcaatcctgatcgagccatcatattgccgggtagcgatgcgtcattattgttaacacgaacaaccaatcttttcccgaccggcagaaacaatttttttgaccgggggttgcttgtcagtgatcggacgtttgacatgcttgaaggaacgactgatcgattgtatatggctcgcttacctaagtccaaagcaaccgccgctgcgttgcgacaattacagcacttggagaatagtcaaaatcttcaagagtatgtcaatattggcagttctgagcgggatggcaatgatttgagagtgacagatcgagccagnnnnnnnnnnnnnnnnnnnnnnnnnnnnnnnnnnnnnncttttggcgcaatccgttgggaattcagtccttccagcagggaattgtgaacactttgtatggctttttgttctttctgattttattgctcggcggcgtttttgttgtggctacgggtagcattttacttttaaaacaggtgattgcagctcgccaagaggcccgacattttcaaattttaaaacatcttggtatggatccaaggcaactccgtataacgatttatcggcaagctgcggttgtctttgcggtaccgtttcttttcgggacaacaattgggctttgtatgattagtgttttgacaacttatcttgataatccgccttcgcgttatttgggtttgatgattttgatctatgcaattatcgattggcttttttatgaggcaactgtgcacattactgcccgcatggtagatgaacctgtttcccgttgggcgattgattagctacggcgatatccgtgggctatctgaataattacacaagcgagtgcattcttaaaaagcgcattaggcgccaataaaaaatccgaagtgattgacttcggatttttcataggcgttaacaagccgtctatgtaacttatttagtttttctgatgcggatcaatcaccgcatagccagcctgatggaagccgtttgcggaggccgcgcgacgaatgaactccttgactgctgacaaggccggcgtattcttaaactcgtagtagtcgttactggattgccaacctgatacgaccacaaagtcgtctgggtgtttgactttctgggcgactaagacttgagtttgaccaagaaaaatatcatgcttatcaatgagatccttaattttggcaaggaaaactttcacgtcatcgctactcaaattaaagtacatgaagtgaatataaccattgtcggcgggcgtacctaaatccgcaagggtttcatattgcaagggcgcggaaaagtgtgcttttccgctggggtcatagatcatgtaatccaaaccctcttcagctggtttcaacagtttcaattgcgggtcatgacgttcgtctagcagtttgacaaggaacgacttgctgccgaagactgtttgtattgtggacattctgaccacctccaaatccattataagctttttgaatggtttcacattgaaaggaaggaaaaacaagatgaaattgacagttttaggttatcttggcggctacccagatgcgggtcacgcgaccagcacttaccttattgaaagtggtgactatcatttattgatggatttaggtagcggcggcttgctttcactagagcagcagtttgatccattaaaattagatgcagttttattgactcactaccatcatgatcacatcgcggatgtcggtgttttgcagtactattatcaattgcgaaaaggggacaaaaaggtgtcaccgttgccgatatatgggcatacaaaagacccgttgaactttgctagtttaacgtttggcccttatacaacggctaaaggctatacggcagacagcactttgcatctcggccctttaacgttaactttccttgaaacccaacatccggtgccagcgtttgctgttcgaatcgttgaagacgtcactggtaaaacacttgtcaatacaagtgatacgcgttgtttcccggcactggcaccgttttctaaagatgcggatcttttgatggcagataccaattttctagcagatcagccacaaccgcgttggcatctcacagcaccagaagcgggaaaactagccaaagacgctcaagtaaagcgcttattattgacacatttgccgcaacagcttgatcttgtcaccttgaaacagcaagcacagactgctgctgggggtataccaattcaattggcagaggatgacttgacaatctcaatctgatactcttgataagccttactttaaaatgataacaagatgtgtaaatcgaggttattataacgtgtattatttattgcaaatgaataagcataattgttgataaaatggacaatagtcaatattcgttaatatggaatttcagcttttaaaaaattatttttctaaatgtgattgcttagcgccggtccaatctcttatactatacctgtagagatgaaaagtac

SEQ ID NO: 113 - DNA, 3763 bp, Lactobacillus paracasei
actcatacagcctatgaagacagtatagcatcttggaaaattaacgtttcaagaggtttatttagtttaccttcaaagcattgctttccacaaatcaactgaaaaaagacctcatatacaagcttagcctgtatatgaaatcctatgcaatcaacgttttacttgactaatggtagaaaacataataggtacattcaaagagtccgcgatcttgatggtgccatcaaaactggcaagatccaagtatcgaagaagcatgaaataggcattcctcaagggacttcaatgagtgctgtgctagctaatgtatacatgataccctttgatcatgccatgaaaacgctggcgcaatcatatggagggatttatagacgctattctgatgattttgtgcttttaattcccaaggcggtttcccgaagctctatacggactgtaattagagatattaatgtgatggcgcaaaggctttcacgcttgcaacttgagaagaagaagacaaaagttttgctgtatacaaaggctaaagaatcagttgttaaacttagcgaggagttagaattatctccctcagtctttgattatcttggctttgtatttgatggacgatgtgtcacaatcagagcgaaggggctttttaagttttcacataaatctaggcattccgttagacaagtagcttttggacaaaaccagttaattaaaggcaacaatatgatttatattccgtatcaggaggcataccatcggcttacaggacaatatttaaatatgtccgaggaggctcaaacctttagaggttatgcgtcaaaagccgacaaaatatataaaacaaataatccggggtatggtgttaaaattgatgatcaagcgcgtaaagtcgtaaaaaaaagccaactatatttaaatgaaagacggaaagaatatgctcaatggcgttgagaacagcaacacaagagtagaaactaaattacagtttacttttagtctggattccgggtcgctcataatgagattggattgatgatatcattgttattgcaaatgacagcttgatcggcctgtacttcgcgtactttcgacgcacggtcaggagcagtaaactgttccacttcgtcaaatcaatcgagcagttgctgtagtgaatactatcgatacaattgtttgttgtgcatcacttgattcacgtcagccaccaagatgagatcgatgaactggacaaagattttcccattcaggattttctttgatgaatctaacagtcatcggccattcaagcgatctttgatgttaccgaatcctttctctatgatgtctttggatcgaaaaatatgaaggaattgcgaagctgttattttctcgtttgtgagctgcgtccgctaccgacagaactccttggcttgcttaacagcctcatccttcggcgtaacttgatgaccgcgttttggggtagccttcacctcaaagaatttcgcgtaatccttggcctgagcctcaaggtgctggcgcgcttgtaactcgtgataaaactcggcaaaatgcttgtcgagtactcggacatcctcagaatgccagtcattattgaaggacagatggaggtacacgcggcgttttcctgaaatgtgtctttttgtatcgccgcattggttggtatggtactctgtcatgacagttatgccgtacacaccgctattatcatcatagttttgaaactggtaaagctctttcatgtggtccagcaaattggttcagtcaagcttgatgccagtccgaatcctgatcagaggcttcaggtgctgaccaagtagcgcgtcaatgttggctttactatagaaaccgcgatccgtacttagcttggttttatcaatttcaaaggcctctaaatcatccaacagcttaatcacgggacagtttgcgataataaacgggcaacccagactgctcaccatagacaagcagaagattcagttgggctggatcgtgttttttgttaaggccataccgaatctgcctcaatccctgagaacaactggagatttaggtactgtcgtaggcataatattcctcagggtcggcttttactttgtcggcgaaagaagtcagtgatttggctcttagtaatctgccccaataagtcgttgctctgttgtgaaaaaatcggctggtttgcgggatgaacatgcagtttttgccagtgattgaaccgatacagcgtgctttcaagttccagcaccaagtactctgcgatcgaaaggatcatgtccgtcaagttaccgaaacaagcctgtaagtcctgagccagacctgttttcacggccaactgggtgagcaggtaagtcgcaccgtaatacttgtgtgagaagtcttggtttggtttaacgggctgtttggctttggccgtacgattccgtccatcagtggggacaatctcaccagtggccgggtccacccgaccgattaagtgctgcgtgctgcgtgactgttgtttttccttgtcccagtgggatttggagtcatatgcataggtgataccggagcgcatatccttcttatagacgatcgttgtataaattcctccattaatcattgcgagaataatacgtaacgattaaaaacaagataaaggtactgatataaattgatagatcaacaattgatcagcacttcatagacaggaatttccggaatccagcttaaatctaagacggcaattggttacttcgtggatgtgaatagaaattggattccaactctttggggcggaatgtcctacagtaaaggcgaagcacatattacgctactaaagccaagaaagaaggcctgagaatgaggattagcgaaatgaactttccagacatcttgaaaaagtatcgtgatcgagatgttctcattatcttcaagtctggaaaacgattaaagacgcatgttgatgaaattgaaaaccaacttgatggttgggatgacgttttgtttatggtgactgctgataacatgccaacagttccagtcgatgcttttctaaaagatatcgaggatatcgatattttgaattaatcatttgtactcacattttgtggatgttttttcttgtccttgtccatggtacggaattacgcttgcctcatcaaaaacttggtgaggtgatttttgtgcaagagaattctgaagtcgttcatttccaacttggtcaacctatgacggaatcaactcaaacgaagaagctgcacaggttgttcttgccttaaatattgtgcttagttaaaattgcaacggcgacataaaaaggctattgagcctattgtatccattttagtttagcaattacaacggagattgtcagaaatcctaatataaacatgcagggaaatagccattgaatttttttaaactatatcaaagtgcctctggaggaaatctttagaatgaaaaaagaagtaagggattatataaaagaagaaaacaatgagattgaattaatgttgggaaagttcactaatttaaaaattatcggcgaaggaggaaacggccttgtttatagtgcagaatttttaggggaacctgtcgcattaaaaattttaggtgaaacctagattgcataattaaagttaccacccagaaaatgtgaaaaaagacctgtccgttcttgctaaaatggtgtttgcataacataccatctagagagaaggacaggtcccatggccattataaccttaattgaacgatctcagatagaactgatgcaacaccacacgattcaatacat

SEQ ID NO: 114 - DNA, 389 bp, Lactobacillus paracasei
ttcgggatcggggtatcactgttcatcacaccacggtcatgcgttgggttcatcactatggccccatctttaaggctctatggcgtcggcatcaaacagctcacgctaaaagttggcgaatcgatgagacctatattcgagttaaaggccgttgggcctatttgtatcgcgctattgacagtaacggtttgaccatggattttgagctgcgaaaacaccgcgattataccgcatcctatcactttttgaagcgtctcttgacgaccaatggtcggcctgatcgattagtcactgatcaatatcgggcaacactgaaagcagtgaagcacctgataaagcaagactatttgagcaaatcagcccaccaatgttccaaatatcgaaataat

SEQ ID NO: 115 - DNA, 1399 bp, Lactobacillus paracasei
aaaacaccaacggactgattagagaatactttcccaagaacacagacctagaccttcagagcgaccaggaaattgagacttacattgaacaactgaataatcgaccacgcaaggtcttaggctggaagacgccatcagaagtcttcatgggtaaaaagttgcacttgagttgacaattcgccgcaacaaaaaacctccagctacccaggctgaaggcatgcatgagggaagtaaatgtgattgcaagggtggcttgccttgcacgatcagtatagcagatgagtttatcaaatacgtaaagctctggtaccggatttgtacaggtttaaaaaagcaacaaaaaagccgacactttgccggccagttaattagtcttttttatctgtgctgagcttgcttttcacatcatctactgtgtctttaacagcatctttggcatcatcaagcttttccttggctttaccaagtatgccttctgctttgccctgtgtttcgcgagctttatcacctgttactttgccttcaacttcttttgctttaccggagatcttgtccttggtgctgtcgactttaccatctaaactcatagatattacctccttttaacatcaattatcatataagcttatacaaagtgcaacaaaaaagccctcagagaccagtccaagggccaaaaggatgaaaaaacgaaacgtatgtgtgaatagtagcaattgacttggaggagaacggctactgctcacgacttcataatagcacattccttgtataagtatactaaaaaagccctcggttgggggccgagagctagaagattagggtagtaccgaggagtgaaaatgagtatttatctggaacaatttaattttagcttattgaaatcttttaagcaacaaaaaagctctcggggccgaatccgagagccacaggaacaacggaagttctttatcagaaagtagagcagcgtcatcaaactgctcacggccattatatttcgggaggcgagtagatgcaatggacagatgaacagatcggtgacattaggaagctcgcctctgaaggctttacaagacgcgagacagccgacaaacttggaattagctatgatgcgcttcagggaaaagcaagacggcttgggatcgagttccagaagccactgaaaaatgaatacgattcagacggcacaaatagggagacaccgtccgctgacaaaaaagtcgctcttaatgctgatggtagtcaaacagtcacggccttaatgagactcaagcatgagccaaataaagacccacgaactttgatggagttgtgtggatacgatcctgataagttcgagatggtcttaggcgactacaaagtgtatgagcagcatagtaccgaagacggcacagttccgcag

SEQ ID NO: 116 - DNA, 396 bp, Lactobacillus paracasei
cgagaacttcgctactatttcccgaagggaacacagtttgatcaggtttcagagaccgatattcaacaagccacagcgcttatcaataacaaacctagaaaatgtctccgttggcaaaccccagttcaagcagtgagcaagcctctttctaggtggtaactttattattgcaatctaggacataccaattaaggtcatatcatcccatatcaaaagagatactgcaaatcactctgcgcacttggataagcatagatcttgtttaaatcactcggcttttcaccagcatcaatggccgctgcgaaggtattgatcaagtcctcagccaagctggctaagacgacagcaccggcaagtcggccggtctttttgtcgacaatggtccaaacttgtgcg

SEQ ID NO: 117 - DNA, 10271 bp, Lactobacillus paracasei
  misc_feature (2716)..(2725): n is a, c, g, or t
  misc_feature (4715)..(4724): n is a, c, g, or t
ctcccatgacagtctttgtaaagtatagatatgtagcctatctgatgtatttagcttatggataacagcctttccttgaacttttatttttttaagttgctatgctgtaatgatcgcataaatttctgttcgtaattccagcataggagtctttattaaaaaagtttgttatgaagtctgtccaaaagatcacaccctaaagagcctttgcgattactctccactttatttcaattatctacttagtattttcatggagatagagcttgtgatgaaaaattatgcgctaatccaaaggctcaggaggaacttcaatgttagtttcttctatttttaaatcacagttttgcatttgatccattatgtcgcggctaaaagaggcctgatccttaaacggtatttttgtggcatcaatagcaagtttaattcgaaatccagaagtccctgacacctcgtaagaaatcgattctggaagcccatattccccatcgtctatatgatgagacgcattaatggttgcttccgcttcttcactagcctgaccactaataaaaaataaatcaccatctgtatatacatcttcgattgagacctcgaaatttttaaaatcatcaatttcagtatcttctacacgcatgtcaggtgcatattggccgtcgtcgttaatctttaatttagcagctttactaatttcattatttggtagattgtaaaattaatccgaacgctgttcggacaaaaaagatcagcttcctttaaaatggtgtttaccacaaacccatcttttaggagctgatcttttgtctagtataacctattccgaacgaattaaaatcgaaaccttttgtgaactagggctgtccaatatccaaatgggcgttcggattaattttacaatctaccataagcctaccgattttttaatattattttattcatcaattttcggcgccgacccaagctctgcctgaatcatccagattttcttctcaattgcggttttgagaccaatgaaaatatcttgggtactgaagtctttttcaacatcggatacttcaatgccgtgttggtaaaggtcttccaagtaacgatagccatcaactaagtgtgcgaggcgttctggggttgttttgtcccattcaccaggccagtcttgaatcttagtgttttcggccatttcttttaaggtcgagtaaggactgccatcaagcgcaatcagccgttcagaaatgacatcgagttggctgtcaatttcttccatgaactcatccatcaaggggtgcaacttcaaaaagttgggtccacgcatgtaccaatgcgtctgatggataatcattgacatctggctcaaatcggcaacgagttgatttaatactgctttggttttcgtatatttcattagattgatctcctttagatatggtcatcataacatagtggtagcttaatctgaaacgttatacactggcaaattaagttatttatagcccgtagaattaagtcgttttgaaaagatggagacgttaattggtagattgtaaaattaatccgaacgctgtttggatgtaagctgattcctgagacaacttttaagagagggtataatgaataaatcatctctcaaaaggaaggaatttttacatgccaactcgttacgacaaagaattcaaacaaaacattatcaacctataagcaaggcgaatcagctgcccaactggccagagaatatggcattggctattcaacagttcataagtggatccagggccaggccaaaactcaatccggtaaatcgccagacgaaatcaaagcgatggaaaagcgactggcttcgctgtctgaggagaacgaaatcctaaaaaaagccctgggcttccttgcgcagaagtaaccaatatctttgattacattcaccaagaaagccatcaccaccaggtaaccaagatgtgccgaatcctcggtgtttccagagctcagtattatcgttatcgatcccccaaaccttcaaaacgccgggccgaagatgcgggcttgaaacaacggattctgcggatctttgcggaatttaagcagcgatacggtgttatgaagatccaccatgaattgaatctggaacttcaaccactgcagcttcggtgcagtccacgacggatttcccggctcatgaaggaactgaatatccactccgttaccgtcaataagtggaaagcgacttcggcttccaaaaccaaggttgaacagcgtcccaacttgcttaagcagggtttctcgaccactggtttaaatcaaaaatggaccgctgatatgacctatattcaaacgaagcgtaatggctggtgttacttatcaaccatcatggacctgcactcacgacggattatcagctattcgttctcaaaaaagatggatactgatttagtcttaaagacccctgaaagcgcggttaaaaatcgaaccattactggggatctgattatccatacggatttaggatcacagtataccagcgatgattacaatcaacgtttaactgagctacatatccgccactcatacagccgtaagggttgtccgtatgataatgcgccaatggaatcctttcacgcttccctcaaaaaggaatgtgtttatccagtgccggtctttgaagattatgaaactgccgctgccgtcctttttgaatatgtgcatgctttctacaataggaagagaattnnnnnnnnnnctcccggctcatgaaggaactggatatccactccgttaccgtcaataagtggaaagcggcttcggcttccaaaaccaaggttgaacagcgtcccaacttgcttaagcaggatttctcgaccactggtttaaatcaaaaatggaccgctgatatgacctatattcaaacgaagcgtaatggctggtgttacttatcaaccatcatggacctgcactcacgacggattatcggctattcgttctcaaaaaagatggctactgatttagtcttaaagacccttgaaagcgcggttaaaaatcgaaccattactggggacctgattatccatacggatttaggatcacagtataccagcgataattacaatcaacgtttaactgaactacatatccgccactcatacagccgtaagggttgtccgtatgataatgcgccaatggaatcctttcacgcttccctcaaaaaggaatgtgtttatccagtgccggtctttgaagattatgaaactgccgctgccgtcctttttgaatatgtgcatgctttctacaataggaagagaattcatagttcactgggctaccagacccccttacaagttgaaattgcaacacttacgagccaaatggccgcctgatttaatgctttccagggttcaaataagttattaatcgcaattaataatttatttgagctgtggaaggtaaacgcggttctgaatgtctcttaaaatctgtctcaaatattgacttcaatccaatccatttttgagtgcataaattttcctttcttgacatatatcaattttaataagtttagaatagcatataatggatttataatgaagaattggagggatcattcatgactaaaaaatacgttgctaacatcgtaccactaaacgcagaaggcattggaacggcaccccatggaactgccacctttgttgaagacggtgaccaattacacgtggcgattgaaatgtttgatacacctgcaaatacgcaacactgggaacatttccacggttttccagatggtaaggcggcccaaattgccacgatggcgcaggatgccaatcatgacggatttgtcgacttgccagaaactgaaccagtctcagggacaacgatggtgccatttgacaacgccccacatcacatggacgtgccaaatgataactacccagtcgctgacgcccaaggccactttgcctacgaaattgatgtgccattagctgatttgcaagcgaagttcaaagaagtctttggtaccgatgacttggaactcgacaaacgggtcatctacattcacggcgtaccacaagacttggctttaccagccaccgttgctggtgaagttggcgcctacgatgcacacgtcaccttaccaattgcggttgggaagattgaagtcgcagactgacctaaaatttgaagtaagctaaaacataacgaccggatgagcctatcacatgacaggttcatccggtcgttatgtttatttctttagactatcgacggaagccttgaaaacgcgaaatcgattgacgattatggttccgactggcgaagcacggatgtttttgattcagcgcctcttgaacctggatgtaagctgattcctgagacaacttttaagagagggtataatgaataaatcatctctcaaaaggaaggaatttttacatgccaacccgttacgacaaagaattcaaacaaaacattatcaacctatataagcaaggcgaatcagctgcccaactggccagagaatatggcattggctattcaacagttcataagtggatctagggccaggccaaaactcaatccggtaaatcgccagacgaaatcaaagcgatggaaaagcgactggcttcgctgtctgaggagaacgaaatcctaaaaaaagccctgggcttccttgcgcagaagtaaccaatatctttgattacattcaccaagaaagccatcaccaccaggtaaccaannnnnnnnnncttaatgctttccagggttcaaataagttattaatcgcaattaatgatttatttgagctgtggaaggtaaacgcggttctgaatgtctcttaaaatctgtctcaaatattgacttcaatccaaggtttttatgaccttttgagtctagctattagggtgttacacttgaattgtaaactgggtaggaaaataactaaactctttgatcacgggaattccataaaaaaacaccttcggtcgtactacaaccagaagagggaaatcatgagaaaagtgattcaaaatacagtatttatagaaatgatgatacaatgctaacttggcgagtgaagcgattacgagctttaggaacaaatatagttttgtcggtatttggcgagcaagataattctgcattagttgctgccgaattgctaatcaggcaacaagaatctaggttgacagtaaatcaacctcattcagaaataatgaccataaatcaactagcaggatatgacaatactgagatttcgtctggtacgtatgcacttataaaaaatgctgtcctagcaagccaaaagcactttggattcaatgccttgattggaccacttgtcaaactttggaagataggtttcaacggtgccaatgttccatccgatcacgacattaagtctcggctacttttaagcaatcccgataacattattatggatgatgcgttgcacaccgtaaaactagtcaaaactggtatggagctcgatcttggaggaattgcaaagggattcattgctgatcaaattcggtctatttggtttgcctatgggattagggctggaataattaatctcggtggtaatttactatttgttggagaatctccacgacgatctgatggccgatggatagttggtattcaggatcccaataaaggaagaaatattggcattggaacggtcattaaacctgcatgtgcagctgttacaagtggtatctacgaacgatttttaataaaagggggtaaaagatatcatcatttgttggatcctcaaactggatatcctttacaaacccaattggctgctgttactgtatttactcgtgattctctgcagggtgaattagaagccaagcgattattttttgctggtaagcctattccaggatgggagaaagatcctaataatttaggcgctgtttttatctatcaaaatggcaatacacaaacggtcaaggcctcaattcattaaatctccttaactataagttatcaggttcactgccgttctctaagagtgacgagattgctactctacaagctaaaaaggaatataattatcctgggtaaggtaaagttaccctttcgagtgattttcctagaaaggaaggtgttcaaatgttgcactatgttggtattgctggaacaaatatacagcggtcaactaatctcaagttacttcaatatatgaagaaacattattctgaggaggcagttattgagattgttgacattagtaatttaccagttttctataaggcttcccaggatcatataccggaagccgtcaacgttatatctgaaaagattcggaaggctgatggtgtcattattgccacacctgagtatgatcatgccatacctgctgtgctgagttctgcacttgcttggttctcttatcgtatacacccatttgctggcaaacctgtgatgattgttggtgcatcttatggttcattaggcacttcacgcgctcaggctcaattacggcagattctagattctcctgaattgaaggctagtattatgccaagctctgaattcttagtaggacactcactagaggcatttgatgactccggtaatttaaagaacttacgattaggtgtccagcttaacggtttattctcagacttttccgtctttgttaagttgaccaaacaaatgattcattcacaaaaacaagctaaagaacaaactaaaaacgtcaattggcaggataactaggaggacaattatgaaaattgttgcaattgcaggaagtattgcagatatatcatacaatcggcaattattaacttttatcgctaaccactatgcttcacagattgacattgaactactggaaattaagaatataccgatgtttaatgaagataaggatcagactcaaagcgcagctgtccaatttctagtacataagatcgaatcagctgatggtgttattctagcaactcccgagcacaatcatacaacaagtcctgctatgaaaaacgtcattgaatggttgtcttacaaagtacatccgttaaatcagaaaccagtcttaatagttggtgcttcttggcatacacagggttcctcaagagctcaacttgcacttcgtcaaattatggaatcacccggcgttggggctttggttatgcctggcgatgagtttttattagctgatgccaagaaagccttcgatgagttagggaacttgaaggactcaaagacaattgcttttctcgacactgtaattaacaagtttatacgttggattaatgtactagacgcactacaggaaaagaaaaagcaagaaccttggcgtcaagaggatcttgcaggaaaacatcctgtcgaaacttctattgatattgatatatccgatgattgggtggaaaaggcagctaaactagttaaggcaacgagtgggaatcattatgtccaactgaatcgtggcgtattaacagttgatcaattaaattggttccttaactcgatgcctgtagagttaacttttatggatgataatgatcaatttatttattacaatcattttctcgatcacgacgctatgctcgcaccaagggatccaaaacaggttggcaacactgccgatttagttcaccccaaacgagccgttgagcacgttcaacaagttatttgggctttacgtcaggggcaaaaagagcttatcgcgatgccagtacctggaaataaaataaaccaaaagtacattatgcatttttacaaagctatgcacgatgcagacggacgttatcgtggtgttaacgaatgggtcctggacatttggccaattgtctctgattatctaaagcgtactggacaaaagcttatcaaggatcccgatagtaaacctgatgcaactacaagtgcctcacaaagtgaacctcaaagggtcttatcttctcgagtagaagggaaagacgtacaaacaattaatgacatgaaaacttcaacagctgatgcggtcacaggtgcttccgagacgactaaataagcagtactgacttaactgataagaacatcaatcgaataaagtttggcgctacgtcaactggtattgaagaataaatggctctgcgtcaactgatgttgaagaatatatttatcatttgaggcggttctgaatgtctcttaaaatctgtctcaaatattgacttcaatccaccatggcctatttgtataatttgaacttgttgcacttagattttaaatccgggagaacgctttttaaaaaagtgttttgatcaatttggtggtgtaaaatgattattggtgataatgatcaaattgcgatcactgaaacgttgatgaaggagagtattacgatggatcaaaaatttttagatgtcatgaagcatgaaggccctgccacaattgtaaccattaatgcgcaaccagcccacgttgttaatacctggatgtcatacgtccaggtaacagacaagcaattgctgattccggcggccggcatgcacagcatagagcaggatttttcaactgacaaccacgtgattataacggttgggagtaaagaggttgaaggtacccagggacccggtgccggctttcacgtttatgggaccggccaattcttaacatccggtgatgacttcgatacaatgaagaagaaatttccttggattaccagagttttgaaagtcgatatcgataagattgaacaaaaaatttaaatcaaagtcgccaaagcagcttatgttgttttggctttttctttttggaaaagcttctttgactgaagcccgcttcaattggcgttatggtaagtctgtagcaaaatgaagaagggaatgatcagaattgaaagcaattgtgattgatcagccgggcggtcctgaacagttaaagttaaaagatgttccaacccctcagacaaaaccagggtggagtttgatcaaaatcaaaggttttgacgaattctcaaaccaagtgcaactttttgttccaaaagacttcggagggagttctccagcctaagaccttgcgcggtcggttattcagttgttcgacgaagaaggcgatttgttggtcatctatgttgtccagattgctgtgcttaggaaagtattcgcgaattagaccattcgtatttcgttcgtacctcgctattgtggcgcatgtgggtctggaaaggacatctttgcgtccagcgcctcgccaatctccttgtactgagagaattcagtcccacggtcgggggtgattgattgtacccgtttaggcgaaagggtcaaaaacaaatcgatcataccctgtttgaccctttctgaattcactttggtaacacactctgacaagagataccgtgactttctgtcgaccagcgtgatcaaggctgaacgccctctcttgccatgcacattgtcgccttcccagtcaccaaagcgagtacgatgatcgagccgatatctgctcagggaaccaatggtcttggacggtgtagttaatgatccgatctctgatttcggaatcgctaagaagcctttatctatgactgttaagtctttcatgtttgtaattggcttgtgcagcggcagccgagtagttttgccaaccgccattgtgtttgatttcacggctaacagtacttcttgaacgaccaatctgagtggtgatttcagtctgggccagccctgttttaaggccgacgagtatcgtttctcggtcaattaaggtaagatgattgtacggactcaaaggcagattctcctcatatatggtgttgtggtaattccattctacaaggactcaggctttgagtctttttgatttgttaatttgttgggatctggtgcaaacagtctgagagatgaccatctaaccagctattgatcctatgttgaaggttatgcagctaacaatgcttctaattcgtccacgactgagaacccgatgagacttaactctcgtcgggttcttttgcgtattgcgtgaacaatttccacaccgctcaacgttgcactagcggttcgaatgctttgaaagcttgctgagcggacacgatgacgtttaatgaatcggtggtcctgttcaatcaaattatttcgatatttggaacattggtgggctgatttgctcagatagtcttgctttatcaggtgcttcactgctttcagtgttgcccgatattgatcagtgactaatcgatcaggccgaccattggtcgtcaagagatgcttcaaaaagtgataggatgcggtataatcgcggtgttttcgtagctcaaaatccatggtcaaaccgttattgtcaatagcgcg

SEQ ID NO: 118 - DNA, 361 bp, Lactobacillus paracasei
aaggtcgatcgtgaggacggctggagcgcttagaagtgagaatgccggcatgagtagcgaaagatcagtgagaatctgatccaccgtatgactaaggtttcctggggaaggctcgtcctcccagggttagtcgggatctaaggcgaggccgagaggcgtagtcgatgacaagcaggttgaaattcctgcactagtttattttgtttaagcgatggagggacgcaggaggctaaggaaagcgcacggctggaaatgtgcgcccaagcagcaagtctgacagcgagtgaaatgcttgcagtcttaaggacaagctgtgatggggagcgaaattatagtagcgaagttcctgatgtcacactgc

SEQ ID NO: 119 - DNA, 569 bp, Lactobacillus paracasei
ttgccatgagctattaagccgccttcgtgcggcatatgaaaaaggagatctcgatcgtagtatcagtcggtatgcgcggtatgagctactggtgattgatgaaatcggctatttgccaatcgaccacgatgaagcaaatctcttgtttcaactcatcaacgccagatacgagaagtgttcgacgattatcaccagcaacactgatttatcaggttgggttgagatttttcaaaatcccaccgttaccgcagcagtactggatcgccttgttcaccatgtccacgttgtgaagattaccggcaaatcgtaccgcttgaaaggtgtcggttgaccgccgaaaacctacatttttaaaccgccataaacctacatttcaaaaccgcccttgacacactgtctaccgctattacgatatgtggcgagataaaccagacccgacagctgattcgctattagaaaggcttttaaaaaaactgttgcttcctatcgctttgcacagggccgatcggcccgaacgtcgtttgtgattgttgatgctcaaagtgttaaaaccactgatttaacgaaaa

SEQ ID NO: 120 - DNA, 403 bp, Lactobacillus paracasei
caagcgaggttatgagtaaatgtcccaatacgatcctacactgtccgtccttggaataccagaccataatatcaaagttgcctttgttcgtcatgaatatcgcggcaacggggtacgtcgccgccagtatcatgtgattgatgccgagctgacttaccggttaacccggtgcccactgtgcggctttgaggccttgcaccctaacgggttttacacggcccatgtgcgcgtcctcaacggggttgaaatgccgacagtcattgacttgcacaagcaacgatggcgctgtcataactgttaccacacagtcagtgccaagacgccactcgtgcaacccaaccacacgatcgccgctcacatgacagagcgaatcatgaagttagcgcatgaacggttgccagtc

SEQ ID NO: 121 - DNA, 361 bp, Lactobacillus paracasei
tagtgccaaggcatccaccgtgcgccctttgtaacttaacctgtactgacttgcgtcagcggttatgcgatgcgaatttctttttcagaaactcatacaaatacgctgtgttctcggcaatttaaaacaattaatacaatgatatccagttttcaaagaacaaagtcgcacccgttagggtgcttgagggtgatcccctcaaaactaaacaaagtttcgtgtgtgcaggtttccgtcagactttcagtctgtttccttagaaaggaggtgatccagccgcaggttctcctacggctaccttgttacgacttcaccctaatcatttgtcccaccttagacggctcgctccctaaaagggtta

SEQ ID NO: 122 - DNA, 361 bp, Lactobacillus paracasei
gtcacaccatgagagtttgtaacacccgaagccggtggcgtaacccttttagggagcgagccgtctaaggtgggacaaatgattagggtgaagtcgtaacaaggtagccgtaggagaacctgcggctggatcacctcctttctaaggaaacagactgaaagtctgacggaaacctgcacatacgaaactttgtttagttttgagaggataacctcttcacgcctatcgggcctatagctcagttggttagagcgcacgcttgataagcgtgaggtcgatggttcaagtccatctaggcccatcaagcgtacgcttgttaattgaacaacccttatgggggattagctcagctgggagagcg

SEQ ID NO: 123 - DNA, 388 bp, Lactobacillus paracasei
ttcccacttcgctcgccgctactatgggaatcgagttttctttctcttcctgcgggtactgagatgtttcagttccccgcgtctgccgccggccagctatgtattcactgacaagcaatacactgatgtgtactgggttcccccattcggaaatctccggatcaaagcttacttatagctccccgaagcatatcggtattagttccgtccttcatcggctcctagtgccaaggcatccaccgtgcgccctttgtaacttaacctgtactgacttgcgtcagcggttatgcgatgcgaatttctttttcagaaactcatacaaatacgctgtgttctcggcaatttaaaacaattaatacaatgatatccagttttcaaagaacaaagt

SEQ ID NO: 124 - DNA, 464 bp, Lactobacillus paracasei
tacgactcgccaattcaattacaatcctgaggatcgtgttgagattcttggctctgaccttctaaaaggccgaagtaccaaggatatcaaggcctatatcaaagagcatttaagcgattacgatgaagtgtgaggcgtaaatcatgacaaaatttcaagaactactgactaatttagacacccttggtcttggcaagatgcatgcatatctgccggattatatcgatcaaattaatagccaacagatgtcgtttacggatgcgatgctcaacctgacggaagcggagcttcactggcaagaagaccaggaaacgcagcgaattattcgtcgtgctcggtttccccaagaaaagacacttaaggcgtttgatttcgacttccagccaaacatcaataagcaggaagtacttggctttcaagacttggcatttatggagaagcaagaaaatctggtattcattggg

SEQ ID NO: 125 - DNA, 361 bp, Lactobacillus paracasei
accgacagagacggctgatttggctactaaaacaatgaaactggccatcgagaataacgatggtatcaagcctgataccgtacacagtgatcagggcacggcttacacaagtagcacctataacacgttcctggcgggcgaaggtatcacgcacagcatgtcacgacccgggacaccaggggataacagcccgatggagagcttgtggagtcacctcaagatcgagagattttcctttgagcactgcttatcggaactagaaatgatgaagcgtattgaggcggcaatcaactggtataacaacgaacgccgccaagaaacactaaacggcatgaccccgatgacataccggaatcatgcc

SEQ ID NO: 126 - DNA, 12098 bp, Lactobacillus paracasei
  misc_feature (11184)..(11193): n is a, c, g, or t
ctcatacagcctatgaagacagtatagcatcttggaaaattaacgtttcaagaggtttatttagtttaccttcaaagcattgctttccacaaatcaactgaaaaaagacctcatatacaagcttagcctgtatatgaaatcctatgcaatcaacgttttacttgactaatggtagaaaaaatgaccgtctactttttggtagacggtcatttttgtagatgcaaagcacgaattcgcagctatgccgctttcttcgcgacttcctttggtaacgtcaacgccagcaacaagccaatcaggcccacgccagcaaacacagcgaaggtaacagcaaaaccgccagcatgacttcgcagcgtggtttgcatgccatccaacaacactgtggcgaacatgacaccggcagacccaaataactgacgagccgtcgttgtgaccgcagtgccgtctgccacaagctcattcggcaaggcattcgcgccagccgtcactgaaggcatcatcacaaaggcattgccggcttcagtcgccatcgccaacataattgccccaatcagtggtaaatgatgggcaaagactgctaacagaccaaagccgccagtaatcaacaacatgccaatcatggccacgacacgcggtccaaagcgatccagtaggcgcccgctaattggattcaaaatactcagcaacaccgcagctggcactaaggacaagccagaaatcaacggtgacaaaccaagtagcgtttgaaagtaaagcggcatcagaatggtggtgacaatcaaaccgacgtatgaaattccggtcagaaacaccgctttagtaaacataccagtggcaaaaactcgcatttgcaacattggtggttggcgattcaattgccgaacaacgaaaataccagctgccagaacgcctaaaatcaacaaactaaccacgccaacagttaagccttttttcgacaaagcacccaaggcataaagtagaattggaaaacttgcggataaaaagaaggagacccagtccagttgcgtcggttgcaatggcatgacagacgcaatggtcaccgttgaaacggccagcacaagcagcgaaacgaccaagaagaacaagaataaagcctgccaagggaaccatgtcagcaaaacaccggaaataatcggaccgactgccaaggctgaacccatgaccaatcccgccgtgcccatcacccgaccacgctcactatgcggcgtaatcgtcagcaacacggtctggaaactcggaaaaataatcccgaccgcaatcgcttcaagcaaccggccaatcatgagcacggtaaaactcggtgcccagatacataagcctgtcccaatggcaaaaatgagttcaatcgcttggaaaagccgttggaaaggaacattatgcaacagccatggactaaccggaatcatcaaggtcatcaccaacataaagccggttgtcagccaagcaactgtatccgctcctaaaccaaaagctttcataaaagcaggataagcggtgcttaaagaagactgcgaaattgacatcgaaaaggtacctgtcagtaacgtggcgacaaaagccccgcgatgtttgatcgttggagagtgcatattaaaatcatctttttctatattagtattgtgggacgtttacattttcattcccattttttcataagactgcataccgcccatccaaatctcagatggtttgacgccacgttctttagccaaggccatcattaacgtatccatatccatcaatttatattcttgctttggcttggctggatcgaatgtttcaatctgtgccatcatgccgccatcttcgtgctcaatgatatggcagtgatacatataaacccctggcagatcaaagcgaaccagcagccgaactgtttccccaggattcacgccaacggtatctttgaaaccatgttcatttggatacggcgcatgcccattccgcgacaagactaagaattgggttccatgcacatggaatggatgaaccattccaggcgcatcattgctattggtaacatcccagtactgggctttgccaattggttgcgtggcatcaatccgctgcatggcgaactttttaccgtcaatcgcaacaccttcgtccatcccctgcatcacaacgtggcgaactggcaaagccggatcaaccactggtgccttcacatcgaacaacttatcaggcaaggtcgtctgatccggtttgaacgcatgaatgcggaactttagcaatggcacatcatccgtatataaggtgacctcgtcgccttcatggtattgaccgaaatcaacaatcacttcggcacgctcagcacaagtcagcatcaaatgggtaaatttgaccggtttcggtaacagcgagccatccccgccaatttgcgtaaatggcaggtcatcggaaaaatgcaaccgccattcacggcgattagcaccatccagaaaacgcaaccggaccttttgcgtggtgacatcaaaatagggattgattgtaccgttaatcattgcggttggcccagcaacaccgtcaggatcataatcagcccggtagtcccactggttgttctcgtgaaaacgccggtcttgcaaaatgaccggaatatcgtcaacgccatagttccttggcaatggcaggctggcttcatggtcgtctttgacaatcaccatggcagccaaaccatgccaaacctgctcggctgtggatgggcacggatgcgcgtgcagccacaaagtcgtcgccggttgttccaatgtgaagtcgatatgcttactttcacccggataaaccggcgcatggcatccgccatcaacataagggccactgacattagccccatgccaatgaaaagtggtcaactcaggcaaggtgtttttcagtgtcacatgcgtatgctgaccacggcgatacacaatcgtctgacctaacagactggtattatagccccacgtcttggtcttcgcccctggcaacagttgtgtttccccagcctctgctgtcaccgtgtaataaacgtcggtcgctgtctctttatccggtttcaacaacggtggcacatttaagggcttctcaggcgcatcactgacctcaagcggcacgtacccgccatcgtggagatcaaacgctggctcatcaaagaaatagtccgtataggttttcatcgtgatttcccccttcaaacgcgttctcagccgcagaaacctgcacataaggaccacaagcgcaatggccaaagtgcggccatcgcacttgtgcccgcttatgctccggtttctgaccgcggctgatcacgctctgactagaattttaacactttttagggttgccataaacataatttagaattaatctaaagtagtatcgaaaaatggtataggtcttatccatacacttgaggaggattttcatgcaacaaatgtcgaaaacaatgggctggctcatgctggcgttaaatgtggtgctgctgattctaattggtaccatgcacaatatggcagcgatgtggttaatgggtctgattatgactttggacgctgtgaccgggttagttaccgcttatcggccccagtcaagtcaacaacacgcccaccagcactagtttgttaagaagttgctgcaagacctttcatggagtcattgatcagcgttatatgttgacatatacatatgttgaatatatcatgtgtctgtacttagatgaacagtcacatgaaagagggtcgtttaatgcagcaactgtcaatgacgcagaaacaaaccatgacgtcagccttacgggttgaatatttttcaacggcatggatggcatttgagttcatagtcggtttttggtccggtatgcaagcaggttccattctcttaattgcgtttggcctcgatagttttcttgaaattatttctggcagtgccctcatttggcgtcttaaaaaagaagccaatggtgcgccatctgcggaggttgctcaagcagagcaacgttccagtctcattgtcggcagtgttttattattactcagtctttatgtcattggcgtttccggctataatttggttacacatgccgcagctgatacaagttacagcggcatggcaatcgcaattgcttccgtgttcctgatgcctgttttgaccattaaaaagcggcacttgggagaaaagttaacctctcccgcgctgattgaagatggcatgtgcaacatcacctgtgcttatatggccgcgactgttctgcttggcagtctgctgacttggttgtttaactggtggtgggcggattctgtcgctgctttagtcttggtttattttgtggctagtgagggctgggaagcgttgcaaacgggattgggacacggtgatgacgcttaactaatggaggtttcggtcacatggacacagacactttagaactggtcacgacagctaaattgactgaggcggaacgcatttttaagttattgagcaatccgattcgcctacagatgttaaaactgctcgaacaacgggaactgaatgtcggtaccattggtgacttgttaggtttggaacagtcggttgtttcccaccaacttgccttgttgcgaaagcaccagctggtgagcgccaaacgggtgggtaaagccaatttctaccgcctcgatgatccgcatatcatcaccgtcatcgatgctatgctcgcccatgccgaccacgtggctcgcggcaagcgacacggcgaataatgcaacaatgggtttgcagtcggagaaggctacgagtcagccataaaaaaacgttacctttaccattttcggcaaaggtaacgttttttttaatggttcaaacgagcgtcttggtcgcgattattccgccaaaccgtcgtgaatcttatctaggttccatttcatcatgctgtagtacgtatcgcctttggtgccttttgctgccaaagagtcagtaaagattttggcgtgaatcgataagccggtttctttagcaactttgttcatggacttcggtgaaacagaactttcgacaaacaaatgcttaacatcggaggcgcgaatttttgctaaaaccgtctgcatctgctcaggcgtaccttgggcttcggtgttaatttcccagatataggccggtgtgacgtgataagccttagagaaatacttgaaggcgccttctgatgtaacgagcaaccgctggcgttccggaatatcaaggaactgagattgggcggtttgatgcagtttttgaagcttagcaacgtattgatctgcattcatctggtaataattggcattcttggcatctttttgcttcaacaccttggtgatggttttcacgtattgaatcccgttggccagatcaagccaagcgtgcgggtcttgttccttcgtattggtcgtcaggtacatcggattaaccccgtcactggcagcaaaaacgtctttgttaaaagctttatgcgatgtttgaactaactttttgaaccaaccatttccgccagtttcaaggttgaggccattgtggaagacaacatcggcttcactagtggcagcaacgtcggtcggtcgcggttcatattcgtgcgggtcggtgccgcgcttgacgatactatagagttcaatgcgatcaccgccgacattgtgcaccatgtcttcaagaatcgagttggtggtgacgacacgtaattgttggttagtacttgctgaatctttctgagtcgtactgcggttgtttacaaaccagaaaacccctgcaaccatggttaaaacagcaacaacactgattagaatctttttcatcgaacagcctcctcggcagtgtgggtagcagcagcggttttcttttctcgttgttttttactgaaactgaagaacgcctgcttcggtgagaagacgaaggaaatggcgaacaggaccgcagctacgagcacaatggccggcccggatgcccagttaaaggtgaaactgaagtaaagtccggtgatggccgagaaaacgcctacgctagcggacgtgatcagcatcgtttctaaccgatccgtccacaagaaggcagttgctgctggcgtaatcagcatcgccacaactagaatgatcccaactgtctgcaaggctgaaacggtgacaagcgtcaacaccagcatcaaagcatagtgaatcatggtggtattcaagccatacgttttcgcaaacgtattatcaaacgaggtgatcagcagttccttatagaacagaaccacgaacaggatcacaattcccaacacgacagcggtggtgacaatgtcgctgtcgctgacggctaaaatgttaccgaacagaatatggtgcaagttggtcgcactttcagccattgaaatcagaatgaaacccaaggcatagaacgcactgaacacgaccccgatagatgtgtcggttttgattttactgttggctgccacaaacccgatcagcaaagccgcaataattccgaaaaccgatgccccgatcatgacgttaataccgagcatataagcaacggctaccccgggcaggaccgcatgggaaatcgcatcccccatcagcgacatgccgcgtaaaatgatgaaacttccgatcaagcctgacatgataccaaccatgatggcggtgatcaacgcgctttgcaggaaatcatattttcccaaagcggtaaagaattccattattgatgtcatacgcgcgcaccctcctttgccgtaaacaagacggacgacaggtcggctgaaaatgcccgttcgatattttgggcggtgtaaacttctttgaccggtccttccgcaacaatgccgtggttcatgaccacaagttcgtcaaaatattttgaaactttattcagatcatgatggaccacaatcagcgttttaccggcatcgcgccactgattcaaaatcgtcatgatctcttgttcacttttcatgtcgatccccacaaacggttcgtccatgatgataatttccgcatgttgcacaatcgcccgcgcaacgaaaacgcgttgcaattgaccacctgataactggctgatctgacgtttcttaaaatcctcaagaccgacttgggtcagggcgtcaagcgccgcctgtcgttcctttttgccaggacttttcagtaagcccaatcggccatatgtcccagtcagcacaagatcttgaacattgatcggaaacgtcagatcaagatctttacgttgctcgacataagcgattgactgctgtacctctttgagtgtccggccggaaaagtcgaccgttcctgattgtaccttgatcaatcccaaaatagctttgatcaaggtcgatttacctgctccgttaggcccaatgattccggtgatcttacctgcgttaaaatgaacggcaacatcagcaaacaccggtgtgtcagcgtaggcaacggtcaggtccttaactgttaacataagagcctccaatttttagggtgacctaatttgctttcatcttaagcttacagaaaattccaaatgctatcaagtgttttttaaggctaacttaaaaaagctaaagaacatgaaccagtgactatcacgaatctaatgcttaaatggcttgcttctcgacaactgccgtagataaaagtatgtaatcgcattcattcataaacgctgaacatcatcaaaaaagagaaccataatcgagataaatgctcgctcatggccctctggttatcgcctagttattttaagttttctgggtgacgctgtaaataaatgacatgtgtgttggtaaattcttcaacaccgtgaataccatcggcgcctccgacaccagattgtttccaaccagcatggaagccttggatgccttcaaagttgaatcggttaatgtaggtctcgccaaactcaatctcgttagcaacatacgaagcggtttccagatcacgcgtataaacggagctggtcaggccatataccgtgtcattcgccatttcgattgcttctggaatgctcttgaatgtcaaaatcggtaacaccggtccgaagatctcattttgcacaatctctgaatcctgcgcgacattggtaatcacagttggttcgtagaagaaaccaccgtcaatgtcagctgggtgaccacctgtttgaatctggccgcctgcttcaaccgcccgctgaaccaaaccgtccactttatcaagggcaccttgattgatcaacggacccatttcggcatctggatcagtgttcggattaccgactttcaccgccgccatctttgccgtcattttcttaataaactcatccgcaacatcttcttgcacataaatccgttcagcgttgttacaaatttgcccattgttatcaattcgcgagtcaaaaatggcctgcacagctaaatcgatatcagcatccttagcaacaattgccggtgccttcccaccaagttccaatgacatctttgccacatgattcgccgcagctgccatgaccttcttaccggacgcggtggacccagtcaggctgataatgccgactttggggttcttcgccaaatcatccccaatgatggacccgcgaccactcacaaagttggctacccctgccggcaaaccgacttcatcaaccagttttgcaaatgccaacgccagtcctggggtgtccgaacttggtttgatcacgatggtattgccggttaccaaagctggccccattttccgagcaatcaggaagaacgggaagttccaagcaataataccaaccgcaacaccgattggctgacgggcaatgataatattttcgttttcattgtcagattgcatcacatcgccggaataaacgcgtgcggcgttggccatatagtcaaaataatccgccgaaaactcaatttcggttttcgctaaggcatgaatttttccttgctccaacatcaaaatcttcaccagttcatcttcatgctcacgcactaaagcagcaagcttgcgcaagtacgcaccacgcgttggagcaggcacgcgccgccaagcattcttagccgcccaagcagcatccacggctgcgcgggcttcctcaattgtcgctgccggtgccgtccacaatttcttgcctgtggaaggatcgatcacggtttcaacatcgcctgatgccgaatccatgaacttgccattgatatacatctgatagtgcgttgactgcaattcagccattgtgtttttcctccttgcaaacgtcttttctgtccgacgaacataagcaaagccactttgctcatgttatgtaagcgctaacttcatacatcttaagtataacgtcatcttcaggcaaaagacataataattgcttgtgagttagcaaacatgaggaaataaaaaacacaaaacgaattcatcgccggtggcttcaggtttcaccaactggctttccgcaccccaggaatttggcctttatgggcgagttcacggaaattaagccgggacatgccaaacttccgcatataagcatgcggtcgcccatccaaaacgtcacgatgatgtaaccgaactgggcttgaatcacgtgggagtttgcttagaccaatatagtcacctttcgcttttaatgcagcgcgttttgccgcgtattgttgaacaagtttttcttgtcgttttgcttttgcaattttagatttttttgccaaaagaatgcctctttccttcactgatggtctttaatctcccgcaaacgagtcactcaaagtattcaaatgaccaccaattattgatacattaccgatttttctgttgcttacgcttagcatcgtgcaaaacttttaacgcccgttttcgggtcttaatgttgggactcttcatacgccgccgtgcactggcaagatctgtcttttccaaaaatgatcacctctttttaattcgtaatcattactatttaagcaacggcagtaaccgtatcacgactgcgatttatctgtcaattagaatttaagaacgacacttttctcaatttttttgaaaattttccttgccagaccgctcactttgctttatggtttaaatcgtaattattacgttttggaaggaagcgggaatttatgatgaagcgattacttgcaggtatcagtgtcgcattgctggcaatttttgcagtcgcatgcggtagtaacggtgccgcaaagcaatccagctcgaatggcagcaagattcaagttgttgccagtcttgatttttatggtgaggttgccaaagctgtgggtggtaacaaggtgtcggtgcagtcgattatcaacaatccggcggttgatccccatgactatgagcctactacaaaagttgggaaatcagttgcgtctgccgatcttgttgtcgccagtggcattggttacgacggctggatggataaggtcgtgaagtcggcggacaaatccaaaaattacttacgtgtcgctgacgatttgatgaataaaaaggaaggcgacaacgaacatatctggtacgatccgcgaaccatgccaaaactggccaataccttagctgataagtttgccaagaaagatccagctgacaaagcgaccttcaaggcgaatgcaaagaaatacatcgcttccctggacaatctcaatactttgatcaacaagttgaagtcgaaagtaaatggccaactcgttgatgtctccgaacctgtctttggctacgcgctcgattatctgggctacaaagtcaatgacgatcacttctcgaagtcaaccgaagacggcacagactacagcgcaaaagatatccatggtatcgaaaccgatattaaggaaaagaaaattgccttctttgtcaataacatccaagcaagctcaaagactgtcaatcaactcgtcaaattagctgaacaaaataatgtgccggttttgaaagtgaccgagacattacctaagggcaaaaactatcggacttggatgaccagccaataccagcaacttgaaaaaattcaggatcaagcaacgaacagcgcaaaatagcatcacttctggtcacaggggtttatcattcccccaatgtttcggcaaagctcaccctctgtcgaagtttcgttaattgctttgatgacaagataaaccatatgcccgggccaacaacaccggacagcacttgaccagaaggaagcccgcgaagaaattcgcgggcttttttgatcgttccgcccacaaataccggtgttacaataaaactnnnnnnnnnngtcatgatcttaggcgcacacgggcaaattgcaacgttggcgcggcatcagttgctgaaagaaaccgatcatcacctgagtttgtttctacgcaatgccgggcgactgcaagacgtcaatccgcaacgggagacggtgattgacggggatgtcaccgacaccgccaagttgaccaaggcgcttgctggcattgacgttgtctatgccaaccttggcaacaagggaattgaagatcaggcaaaatccgtcgtgaaggcgatggatgctgcaggtgtgagtcgattgatttggatttcgacgttgggaatttacgatgaagtcccgggcgcttttggcaagtggaatcatcaaatgcttgatggtggttatcttgaaacctacgccgcagccgccaaagtcattgaaaattctgacttaaaatatacgatcattcggccagcttggctttccaataaaaacattgtcagttatgaattaacggaaaaaggcgagccatttaagggcacagaagtctcccggcgcagcatcgctgacttcgtcgtcaagctgattaacgatccaagcaaacacattggtgcttcacttggcgttgaccaacctaacacccaaggcgataagccttccttctattaaagtaaccagtcatcggccaaatcaaaaagagtttatttccgtgttcatcactgggaaataaactcttttctgttgccatgccctttacttggctacctagattgcaataataaagttaccacctagaaagaggcttgctcactgcttgaactggggtttgccaacggagacattttctaggtttgttattgataagcgctgtggcttgttgaatatcggtctctgaaacctgatcaaactgtgttcccttcgggaaatagtagcgaagttct

SEQ ID NO: 127 - DNA, 818 bp, Lactobacillus paracasei
attatttcgatatttggaacattggtgggctgatttgctcaaatagtcttgctttatcaggtgcttcactgctttcagtgttgcccgatattgatcagtgactaatcgatcaggccgaccattggtcgtcaagagacgcttcaaaaagtgataggatgcggtataatcgcggtgttttcgtagctcaaaatccatgttcaaaccgttactgtcaatcctagattgcataattaaagttaccacccagaaaatgtgaaaaaagacctgtccgttcttgctaaaatggtgtttgcataacataccatctagagagaaggacaggtcccatggccattataaccttagttgaacgatctcagatagaactgatgcaacaccacacgattcagtacatcgccgcgaccttagccgttctcgtatttctattaggcatgaacttcaccgttgccctgaaggtgattactacgccattatagctcaggatcacgctgatacttgtcggcatcgttgtggtcggcactcgattttaacgcctaagttggtcccctgaaatggtcggttatgccgttcattgtgcgccacatacgatttaccactggatttatcaaagacaagtcgattttcacccaagccaactttttgatcacggtaaacgtcataaaagaagacaagaccttcggtcgcgctataaccaagcagtaggcacctcaattgagattcgcagtgagtcagctaatcggcgaaccgaaaaaggacatttagagatggatacagttcgcggtggtcgcgggtcaaaggctgctgttttgaccattgtc

SEQ ID NO: 128 - DNA, 122372 bp, Lactobacillus paracasei
  misc_feature (41349)..(41358): n is a, c, g, or t
ccgttgattattggcggtttgatcgctttgcaatttgaattcaatccaatgcagatgatggtaacggctggtgcttcctttgttggttcgggggttgtgaaatttaatcctgccatgaaagcctatgtcggtgccggtaccggtgatttaattaataccatgatcaccgcctcaattgctgtgttggttctgatgtgggtcaaagataaattcggctccacagcagtggttgccatgccgatcttggttgggtgcggggtcgcctatatcggggtcttactgttgccgtttattgcagcatttaccgcagcgattggcgatgtaattaacagttttacgaccttacagccgattttcatggcaatcttaatttgctgctccttcgccacgattatcattagtccaatttcgactgttgccattggcctagccatccaactgaacggggtttcggctggtgcagcggcgatgggggttgcagcaacagctcttgcgcttgtcgtttattcatggaccgtgaacaaatctggcgtgaccttggcaattgctttaggtgccatgaaactcatgatgccgaacttgttcaaatatccgattatcttagtaccgtgcttgttcaccgcgatcatttcggcaattccagttgcactgctttctatcagcggtacgccgcaatcttctgggttcgggattgtcggcttggtcggaccgctggcatccatggaggctggcctagcaatcccgctggttgtcctttgctggatcgtgattccagttgcagcagccttgctaagtaagctgttgtttgaaaaaatgctcaagctattcgatagcaatgttgtgtttaagttccaaggttaaacagcatcaaaaaagctcacgttttgcgacgtgagctttttttggtgccgtcaagacaagttattcaagatgtttatggccttgcgcatcatacacgcggtggtcgttaatggcgactttcttgtggacggcttgggctaaatcaacatctgtcatctcggcaatgccaagtagataaatggtgacatcagccaactcttcagcgatattggcgtgatcgtcctttaataatgccgtcgttaattcagccatttcatggtaggccaataacatttcgaaatttgtatcagtggtgttccagccatgtttgatcttgttagctaatatatgcgcctgaacggttttggatgaaggaatgtctgatgctttcatcgttctgattgcctcctagacactgacatcaattgaacgtgacgattacttggtaggcgggttgcgtaacttgtcgaccagctcgacgtcaggcgtgacagcgaccgtcttttgcccttcataaaccacaaaacctggcttggcgccattgggtttacgaatctttttgacttcgatccagtccaccggtacattagcactgtcacgggcttttgaaaaataggcggccaacttagccgcttcgagcaacgttttctcgcttggctgatgactatcgatgataacatgggagcctggtatatctttcacgtgcagccagatatcggttttcttagcggtgtgcaaggtcaattgatcattctgcaagttattcttgcccacccaaattttggtgccatcgctggcataaaattgatcaggttttgcgaccttttggcgtttagccccttttttgttggtcttttgcttgcgtaaatagccttgctgctgcagttcgagccgaatatcggccaaatctttcgggctagcgacgtcgatctgggccatgataccttcaagataatcaatttcttcctgattttcctgcatttgttgatggacatgggcaacggcattacgcagttttgtatatttagcgaagtacttctgagcatttctagacggcgtcagttggttggatagtgtgattttgattggccgattgtcatcatagaaattaggcagctcgatgctggtcatgccgcgttcgacctgacttaaataagtcgtcaacacttcgccccgaattcggtaatcatcggccttttccgtttcctctaaggtccgctgcaacttacgctgttttttgcgatctttatcaaggacgttcttgatgacgtggatcaggttcccaccttgctgcaagacgcgatcgtgctcggccttttgttcataataagcatccaacatcgtgctgagggtcggatattggctttgctcaccagtcaatgacaggtaggggattgccgtgaaaacggcctttttgccttgtgccgtgatggtcggcacgggtgtcgccagtgcggcaaagaaaccatcccagcctgcatcgccttggttgagtcgtaacgcaagctcagtagccgaatctttagctaagccttgataatgctgttgcaacaacgctgcgcgacttaaggcgggcgtgacctcgcgttctaatgcgtggtaacgccggtctggatcgtgaaaaggatcggttttgtcttgcttaggcggttcaacgtaaggggcacctggcatcaggggacgataacgattttgatcggccgacacatgccgaatgagatcaataattttaccagtacgttcactgacaaggaaaatattgctgtggcgacccatcatttcgatgatcaaccgcaagccgagttcatcgccgagttcgtcacgggttgagaactcaaagtggagcacccggtcattttgcacctgatgcacggcagttaaggtggccgcattaaaatacttccgcaaagtcatggtgaatgttgcgggaacatcagggttcgtgaatggaatatgcgtgatctgaacccgcgcatattgagggttggctgacagaaggagaggatgattctttcgtcccgctcgaatagtgatcacaacttcattttcataaggttgttgaattttagcaacacggccgccgcttaaagttgcatttagctcgttggccatggcatgggtaaagattccgtcaaatgacatgttgatccgctcgctttccaattgtaccaatcattttaccggtttttgggtggcatagcaaaaagcgggtggtgggggactgcgcacccgctacatttttgttttttatggtatgatgtagacaatcatttttgaaaaagtgggtgtctgtacatgaaaattgctatcgtgacggatagtacctgttatctgccgcaagccgaaattgacaaacatcacatcactgtggtgccgattccggttattcttgacggcgcggtttacgacgaaggcaaggatatcaccaccgaagaattctatgccaaattaaagactgccaaaacgttccccagcaccacgcagccgccgctgggcgagatgctgaagctttacgagaatcttgctaatgaaggctatgacactatcatcagtattcatctggccagcacaatttccggttttgtgaatacattgaaaggtgccgtagatgaggttcaaggcgcaaaggtttatgtttatgattcacaaattaccgttattttgatgggttggctggttttggcagcagcacaaatggccgaagccggtgatgatcctgaggcgatcttggctcgattagataacttacgcacaaccatgggtgagtattttatcgttaatgatctgcaaaaccttgttcgcggcggccgactcagcaatgcctcggcttttatcggtggcatgttaaagattaagccattgttaacgtttgacgatcaaagtcacaagatcgtggcaatcgaaaaaattcgctccatcaaaaaggcttactctcgcgttgagactttgtttcaagaagaacttgatcgagttgattatccggttcgcgcggttgttatccacgctaatgatccagacgaggccaatcgttggttagcagatttacagcagaagtttccaacagttccattcgaactatcttactttggcccagttgtcggcacccacttaggtgaaaaggcaatcgccttagcttggatgaaggattttacgaaagcataatcagaagtcgcgtttaggcgcggctttttcaattgaaggagatgcctatatgttttttgatcaaccgctagcaaaaggaaaaattctgagcgaaaccccgcattatcatgggccgattttcgatgttgtgacgcaacatattaaaacgcctgatggcctcacagttgagcgtgacttgattcgccacgccaatgcagtggccatgttggctatgaccgatgatgggcgcgcgctagtcaatcgcgagtatcgagttgcggtaaacagtgaagtctttggcttaccagccggtttgatggacccgggtgaagactggcaaaccgccgcaagccgggaattgcgcgaggaaaccggctacgtgacgcacgatttgcagtggatgaccgctatccgttcaagtgaagggatgacggatgaaaccgtcaatctggtgttggcacatcttgacttggttgataaaacaaaacaagacttcgatcaagacgaatttgtaactagccgattagtcccattttctgaattagttgcgggtgtcaaagctggcaaaatccgttcggcgcaaacagtttcggctgtgacttattatttggcatttatcgccaaagattaaaatattgattagaggttggggctgagctgtcattcttgcatagaattcgtgattcactagatttcgaataatccgggaaaaatctaggctaagggttctttgccgtggcaaactccgcaatctccggccagatggggctggaacgcgtgacggcgcttcgagctccatctggcctgcgattgctccgccttggcactgatttcttcaaattttcaataaaaattatctatgtgaaaaaggtcaacgtttttcctttgtatggaaattgtggcctttttttgatgacttcgcgttatggtttaacctgattatttgcttaagaaaaactactcagcttaattaaaataactggatttctccgtgcttggtcagaaatagaaagccaatactttgattcgacgcttatcttatgaatatttatgcataatatatttacttttcaagcaattgcgcgtacactcgaaagcaattaagaaagcaggtggcgtgatgttacgcaaaagtgttgccaagctgccggactatgtttcggacagcacaccggagcgactcgcgaaagcagcgggacttgccaagctgacgcgtttgtcattcaatgaaaatccggttggcacatcgcccaaagtgaaagaagcgctcgcaaattgggcgttttcgcaaggacgcaattatcctgatccagatgcactgccattacgaacagccgtggccgaacgactacacgtaaaccccgaccagctccttttttccagtggtttggatgaaatgattgccttgatttgccggacatttttggaagtcggggacgaaagccttcaaccgtggccgacttatccggaatatcaactacaggcagctatcgcgggtgccacaacggtgaatgctgccgtaacgccggcaaccggacttattgatcttgatgatttagccgcgcacattacggccaaaacaaaagtgatttggttgtgcaatccgaataacccgaccggtacttatttaccaatttctcagatcgcccagtttatgaagcgggtgcctgctgatgtgctagtagtggtcgatgaagcctatattgattttgtcgccgacgttccgaatccgtctgcgctgtcactggttacccaattcaacaatttactagtcatgcgaacattttcaaaattgtacggtctagctaattttcgcgtcgggtttagcatcgtgccgcagcatgtaattgctaaaatgcagaatgtgcgcttgccttacaacattagcggtattagtcagacggcggcattagcagcttggcaggatcaagccttcactcaaaccgtgaaacagcaactattgacagcacggcagcaatggtcagctttttttgaggccaaccacattcagcactatgccagtcagaccaactttatgttgtatcaagtcgccgatccccaagcgcttggcgcctttttaaaacagcatggctacttggttcgcgacagcatggtacccggctggattcgccaaagttttggaacacctgcgcaagatgcagagatgcgacaattactactgacgtttcttaaaacggatactgagatccctaattagtggactgattatgcaaaaaagatgtttactttcaaaataataatttgaccaaatattcataaaaaaacatcattgatgctggctgccgcacctttttatgccacaacttttggtggcattatccgcgccgaattaaaaaaaggttgacaatggcaaaatgatggctattatgaaagtcacattaacaaacatgaagttgtgattagaacaagtaagctgatcctgatcaacagagagcgtctattgctgaaaagacgcgattagccagctgaacacacatctatgaacttgacggctgaactaagtaagctgtcacgcatccgttgcgttatcactgctgccaactgctgttcgcaattgctgacagttacttggcaggtgaggtttaggtcgcaagagctaaacaaaattgaggtggtaccgcggtcaaaaatcgccctcggaaacgttttttcgttttcgagggcgattttttttaggcgcgaccaggagcgcttaggtttctgcgactgcgagcgcgttatcgcgagcaccaagccaaacttcatgtcaacgaaaggagctaactcatgtcaaatcggcatctgcctattggcacacgcgacgaattcgggccgcgggccattcgcaaagagaatctcattcaaaccattagtcaacaattcattcaagccgggttcgagcgagtcaaaaccccattgttggaatatcgagatgtgtttaaaccgttagctgtcagtggcgaacaaccttatcaaatgctcgatgatgctggcgaatcagtggttatgcggcctgatctgactttaccgcttgcgagattgcttagtaccacgagtatcgtgccgccagtgcaatggtggtatgtcggcgacatttttcgagttaagaaaagtctaagcggtacttataaccagatcacccaagcaggcattgagcttattgggtatcgctccctcaaagccgagtgggcatgtctcagcgaagcaggaaaaatttgtcgcacgctaggattgacacatctcacgttagagttatcggatgcccagttcgttccgcaaatcttacgaacacttcaactgaatgatgccgcggctgatgcatttcaaaccgctttctttgctaaagagctaagcacctatcaagacctgattgcgccgcttgctacaaacccgctttatccatttcttcaacagtggccatggctttttggcgatagcgaaacgatctttgccgaattgaaacggttattgccgtcgaatgtgattacggatcgcttagccccacttcaacaaacggtggcctttctcaaagaccaatttccggaattgcgcgtgacgatcgatctcaccagccggccaccacaatcttattacaccggcatcttcttccatgcttacgttgatggcggtcaccaatatctttttagcggcggtcgctatgacaaattgctggcaagttttcaacaagaattgttgccagcggttggcttagcttttgacattgatgccgtgactgatcaattgccgaatgcgcctgaccagcccctcacatttgtctatggcctgccatcgcaatggcaagccgcagcagcgatggttgccaccaccccgaatgcaagactgtgtctggtcgatactttggcagaggctcaagctgcagcgacaaaacagcatgctaacctgattgatctttccccaaaggaggcgatcctatgacactcaccattgcgctcactaaggggcgaactgaaacgcaagtcttacccttactcgcggctgccgggattcactgtgaggccattcaagccaaaagcagacggttgatttttgccgatgatccgaattttcactttattttggttaaagccccggatgtgctgacctatctcaatcatggcaccgtcgatattgggattgtcggttcggatattctggctgagcaagggcatcgccagtttgacatgttggatctcaacactggccgttgccgcttcattcttgcttcaaccgcagactttgatccaaagcagacgaaacgtaaactcatcgcgaccaagtacccgcacattgcgcaacagtattttcaaaagcaaggcgaggacgttgaaatcatcaaaattgaagggtctgtcgaattagcaccactcactggtatggccgatgccatcgttgatatcaccgaaactggcacgaccttacgggaaaaccacctcaaagtgttcgccgaactcgcgcctgtctcgacacatctcgttgtcaatcgcttggccctgaaacaaaaacgcacagagatttatcagcttattcaatctttacaaaaagttcgccctcaggaggcatcgttatgaaaattttaaccggcacgttaagccagcttaagcaacaagtcgacattcggcgcaccgccgttgcccaaaatacagatgtacaaacgattgttcaggcgatcatcgcgaaagtcagagcagaaggtgactcagctttgcgtacttatagcaataagctcgatcacgttaccgttaatgactttcaggttgaccaagcgctcatcgatgccgcgcccgcacaactgccggcaaaactattgaaagctttgcagttagcgaaggccaatatcacaagttatcatcaaaatgaaatcgaacgcggtttcgtcgatacgccaaaccctggcatcattcgtggacaaaaaatcaccccgttggctgcagtcggcctctatgttcccggcggcacagctgcttatccgtccaccattttgatgaccgctatccccgctaaattggccggtgtcaaaaagattgtgatggtgacaccgccgcagccagatggccttaatccagttgtactagcagcggctagcctcgctggcgtagacgctatatatcaagtcggtggcgcccaggcaattgctgctttagcttatggcaccgaaagcatcccccgcgttgacaaaatcatgggcccaggcaatcgctatgttgcggaagctaaaaagcaggtttttggcaacgtcgctattgatatgatcgctggtccttcagaaatcggcatcattgccgacgagtccgccgatccgattcgattagctgccgatcttttatcacaagccgaacatgaccccaatgcgcgcgcgatgatggtaaccccaagtgaaaaactggcttcggcagtcagcgaacagatcgatattcaattgccaaccttacctcgagaatcgatcgcgcgagcagcaattgaaaatcaaggattcattgcgattgtagcaaccataaacgatgccttttcattgatgaatacaattgcacccgagcacttagaagttcagttgcctgatccgatcacgtatctagctcagattcaaaatgccggatccgtttttcttggtcaaaatgctgctgagccggtcggtgattatgtcgcgggacccaatcacgttttgcctaccgctggatcagcacggtttttctcaccactgggggtctatgacttcgttaagcgtacccaattcattcagtacagctcagaagcactagcaagtcaggcagacgcgatcgtcaccttggcacaagcagaagggctagatggccacgctgaagccatcatcaaacgtgtccctgccgcaaaggaggtttaacttatgcgtacagctaccattacccgaactaccaaggaaacaacgattacgatcagtctcaaccttgatcagcaaagtggcattcaaattgccactggcatcggtttttttgatcacatgctggatgcattcgctaaacatggtcggtttggtttaactgtcgatgcgcaaggtgatttggatgttgatccgcaccacaccattgaggataccggcatcgtgttaggtgaatgttttaagcaggcgcttggcgataaagccgggattgagcgtttcggcagtgcttttgtgccaatggatgaaagtctggcccgagcggttgtcgatctttctggacgcgcgtacctcgtttttgatgccgaattgactaatcagcgattaggcggctttgatacggaagtcacagaagatttcttccaggcggttgcctttgctggtgaattcaacctgcatgccagcgttctgtatggccgcaatacccatcataaaattgaggccttattcaaagcactgggtcgtagtttacgggctgcagtcgccattaatcctgaagtgcaaggcattccctcaacaaagggtgtgatttgaatgattgtgattgttgattacgatacaggcaacacccgcaatgttaaaaaagcacttgattatctgggggtcaacaatcaactctcagccgaccccgcgattatcatggctgcttccggtttgattttgccgggtgtcggcgcttttaaagaggcgatgaaagccttaaatcaacgacaactggtgcctgtcattcaagcgtttgctgctactggcaagcctttgttgggtatctgtttagggatgcagttgctatttgatcgcagcttcgagttcggcgaaactgctggtcttggcctcattcccggcgaagtcgttgccatcccgactgactcgggattagccgtcccgcacatgggttggaacaccaacagcctcacgcaacccgatttatttgctgcggtgtttgccgatcaagcaacttattttgtccattccttctgtgcaacaacgctgccacaatttacgctggcaaccactgattatggacaacctctgactagcattgttcgtcgcaataatgtacttggaacccagtttcacccagaaaaaagtggcgcgattggcctagccggcttgaaaaagttcaaggagatgaccgaagatgaagctctatcccgcgattgatttgctcaatggcaaaagcgttcgcctcacgcaaggtgattacgaccaagtgagtttaactgaagacccgctctatcaggcacagcggctgacagacgccggatttgcccatttgcatctcgttgatcttgacggggcacgggcacaacgtccgatcaatcgaacggtcattactcgcattcgtgaacaaacctcggcttttattgaacttggtggcggcattcgaacactggctgccatggaaatttatcttacgataggcattgaccggcttattttaggatcggcagctgtttccgatcctgatttggtcgaacaagctattgcgagattcgggtctaatcgaattgcggttggcattgatacccgcgccgggaaagtggcgacaaacggttggttaaccaccagccagcagacggccaacgcccttctaaccgccatgcaacaacgcggcgtcaccacatttatcgtgaccgatattgccaaagatgggatgatgcaaggcccgaatgcccagttacttgctgacttgcaacaggcgatgccccaagccacgatcatcgccagtggcggcatcagttcattagctgacttacaccgcttgcaaaccgctggcattcaagcagccatcatcggcaaagcatggcaaacaggcgctactgaattagcaatgctcaaacaaatggagggttaagatgctgacaaaacgcattatcccatgtctagatgtagatcacggtcgggtcaaaaaaggcatcaattttgtgcagttaaaagatgtcggcgatcctgtcgctattgctaaggcttatcaggagcaaggcgcagatgaactggtcttcttagatattaccgcgaccaacgaagcgcgcggcaccttggttcaaacggtcgaagcagtggccaatcaagtctttatgccgctgacagttggcggcggcattcaatcggtcgcggatatgcacgctttgttgcgagcaggtgcggacaaagtctcattaaactcagccgcagtcgccgatccaagtttgctcacagccggtgccgaaaaatttggtcgccaagcgattgttgccgcgattgatacacgttggcaagctgatcaaaatcgctatcaggtcacggttaacggtggccgaacgccagtcgatctcgatgcgatcacttgggcgaaacaagcagttgccgcaggagcaggtgaattactcgtcacttcgatggatgcggatggcactgaaagtggctttgatttgcgattgtatcaacaactcactgccgctgttcaagttccgatcattgcgagtggcggcgccggttcgacaacagactttgtccagttgtttacgcaaaccacggtatcggctggcttggcagcatctatttttcacttcggcgaattaactgtcccgcaagtgaaaaccgctttaaaacaagcaaaggtggcggttcgatgatcacacttgactgggaaaaagccaatggcctgatcaccacagtcgttcaggatgcaaccaccaaacaagtgttgatggtcgcttatatgaatcaagaaagtttggcaaaaacgatggcaactggtgaaacttggttctggtcgcgtagtcgcaaaacattgtggcataaaggcgccaccagtggcaacattcaaacggttaaaacaattgcagttgactgcgatgcggacaccttgctcgtcaccgttgatcccgccggcccagcatgccataccggccacatcagctgtttttatcgtcattatccggaagggaaggatcttacatgacccaagcaaagcaaagtattccagctctatatgatttcatcaaagaacgtcaagcaaatccagttgccggttcgtacacggattatcttttcaccaaaggactcgataaaattttaaaaaaagtcggtgaagaaagcacagaagtgattgtcgccgcgaaaaatccagatgatccggcgtttatccttgaagtggccgacctcacttatcacgtcctggttcttatggttgaacgtggtatcacggttgatcaaattgccaccgaattggctagtcgcgaaggaaagaagagccgactgcaagaacggtcaaaaatcgagaaatattaatgccttgaagagggcatcgttaatagacaaagcgtgaacaggctagttctgagccagcaaacgcttttaaggaggacgccaacatgctaaaacataccgtcactcatttacaaccttacatccccgaaaaacccttggcagatttggcgcaagaacgcgcattgccgcatattgttagaatgtcagcaaacgaaaatccttttggcactagtgacaaggtacaaacagcgatcaaaaactgggacttcacccaaagccgtgactatcctgatggcaatgctagccggttacgatcagcggtcgcagctgaactgggcgtcactgaaagccaacttgtatttggtaatggtttggatgaaatcattgagctcattgcccgtacttttttagaggctggggatgaagtggttgagccgtggccaactttctccgaatatcagttgcatgcccagattgaaggcgccaaggttgttaacgtaccggtacaagcgacgaccggagcatttgatctcgaggcgctggctcaggcaattacccccaaaaccaaactgctttggctttgcaatcctaataatccgacaggcaccttgctgtcactgactgagctagaacagttcttacagcaagtgccaccaagtgttttggttctgattgatgaagcctacattgaatttacagacgattatccggctaccagcgcactcaaattgttaccaagctttgctaatctggttgtcttgagaactttctcaaaaatatacggcttagccaattttcgagtcggcttcgccgttgtgcctgagcaactggcagcgaccatgcaaaccgtccgtctgccatataatctgagcagtgtggctcaactagcagctttcactgcccttggcgaccaaacatttgtccagacagcccgtggacaggttcggcaagcacgggaggactgggaacggtttttaacgaaggctggtctgccacattatcaaagtcaaacgaacttccaattttttcaggcaccgcaaaagcaagcgaccgctttgaaggaacagctcttgaatcacggctttttggttcgtgatggcttaaagccgggatggttacggatcacttttggtaccacagcgcaaaatatagccgtacaacaaatcatgactgcgtttcagcaagcaaaaaaatagtgacaacgaacccgatccgaccctttcaatcatgtgcatcaccaccaagggatcaaatgcttattgacctaccaattttttaacgctgctattaagcgcatcgttgcagtcacgagatgatattagcgacaactaatcatggactaagcaggtaatgtcaccgcttccattttccgcataaaacctataccattttgaaaaacagctaggaaagcgcccacatttggcgtattctgaagatgtccaaaaaatctaagaggtgaatttgatgttggaaaacaataattttgatgaagttgtccttaaacgccacaccgcccgtgaatttgatccggaaatcaccattagtaaaggcgagttgttacaaatgattacttatgcgacaaaagcgcccagtgccttgaatatgcagccaacgcggtttgtcgtcgcacaaagcaatgcggccaaagaaaaaatcgccgcagttgctggcaccaatgcaccggaaattttatccgcgtccgctgtggtacttattggtggcgaaaccgacttgggaccatttgaggaggatctcttcaaacgggcggaagcggctggtttattgactgatcgggcgattgagcatcaaaaaccaatgattgaaaatcttgttgccacgtttaaagaaaaccaacaagcattacgcgaatttattattcaaaacagtagtcttgcggcaatgtcgttcatgttggctgcccgcgcctatggctatgaaacaggagccatgacaggtttcgatcacgaaaaaattattccggcacttgatttggatccgaatcatttcttgccgacattgctgattgctgttggtaaaccaaagagtgcaccggactcactgtatcggattccagcaagcaaaatcactgttttcaaataaagtgctacaacattgcgcaactcaaagatgatcgccgtcaacgatttcagcatcaagtgggtgcgtgcgtcatcacaaactattttgctggacgttgccatgattaccaaaaaggccgcttgtttacgcggcctttttggtatcgtcaccgctagtcattgctttttagtttgagaaatgccacagcgaaacaagttttcacaaaaaggagttgggttgattgccctataccattaaaattaatgcaccgttaagtgttcaacaggtccatgatttgtatcagcaaacacatttcaataaaccgatcaacgatccgacccgcttgcagacgatgattgacgaaacaccccttgttttgagcatgtgggatggcgcaaagttgattggctttgcgcggtgtctgacggattttgaatattgctgttacctaagtgatcttttaattttgcctgcctatgaaggtcatcaccttgggcgtcagctcatgacaactttgcaagcttatatcggtccgcgggtcacgctgtcattgaaggcagcagattcggcgatcggcttctatgaacgcatcggattgccaaaagccgataacatgtttcgaattggcagggagggctgacaaatgattaaaatcgcaactgatcagccaattactgctgaccaattcattcatgtcctaacagcatcaggtatcaaacggccaactgaggatcgcggccgcatgcaacgcatgctcaacaatgccaacgttttattgacggcgtgggacgatgaacagttaatcggcgttttacgcggcgtgtctgatcgctcttattgtacgttcgtgtcagaattagctgtgtcgaaggattatcaacatcaaggcattgccaccaagttgcttcaccagttatggacgatgcaggggcctaatatctcaatcatgctgctatcagcgccaagtgccatgactttttatccaaaagttggctttgaaccggtgccgaccgggtttaaggttcaacgccggtattaatcggatagctgaggatatgccatcacgggcagtgaccatataaaaaagaatgatttgccgtctttaggaaaatcattcttttttcttgtctataattctgatgggacttaaggatcgtcatggcaagccaggttcgtcgtgggccagatatagctaaaaatgtcgacgtttggcaccgatcttgttttgaattttggcccattagcgctgctagcggcaactaaagaacagaatggcttaccacgaaagtttgcgcagccggtgccagaaccagtaagcaacaccaatgagcaacaagccagtgaccacaaaaatgcggccaattggcacctgatctgccagtggtccatagaccaacatcgctaatggataaattcctgtcgataggatggcccaaagcgaaaatacacgacctaacttatcagcagggacattttcctgaagataaatggtttgaccggcttgaatcaatgggtaaaagattccggaaacaaacataaacagtaaatagaaactaaaggattgcggcagtcccatctcggcaaaggcaagaccactgccggcaaacccgatggcaatcaagccgagttgatcgcgaaaatgtttgtgacgggcgatataaaggccgccaagtcccgcgccaatggtccaaaaccactcattaaacgtcaaatgccaaacttctgatccaaatgtccgattaacatacaatgttgataattgtgatgaaggggcaacgaggataaacgccaacccagtaaatagcatgaaggccagcaaaatcggtgttcgtctgacatattgcaacccggcgagaatcccatcggcgcgtttggctgctcgatcatgactggcactcggtgttggtacgtgcaccacactcaaaaacaggatggccaacgcggcagataaggcgtctaccacaaaaatccaaaaaatcccaaggtcacttaaaatataaccagccaacagcggcgacatcacgagcatggccgccatcaggatttgattgtaaccatttacccgcgtgagatgcttggcagggaccagttgtggcaacaaggcattcgctgcgggattttctaaaccgttgccaaaactacgaatcacagcaatcacgagcagcagccaaagatcttgcgtcataaaagcaaagatagacgcaactaataatgtcagtaaggtgacaacagccgccgagagcacaattaacattttacgattatagcgatcggccaacacgccagccgtgagcgagattaaaatcgctggcaacgcggtcgccagcgagacataggtcatccatgcccctgacgacgtttttagcgcaatatcccacaacacagcatagaacacggtcgaactgccaaaaacaaataaattttgactgagaagaaacgctgctgtttgcgcttgccaacctagatttttatgtgacactctcaacacccgaaatcagttagaatagaaactgtccttagtgtaaatcaaagtgatgtaaaaacctatgatctagcccagacgaactattagcacgtttgaatggcagtttctgactcacaaaacaagttgaagatacccaaggggacgtatacgagatgacacagaaaatttttattgtcgaagatgacgcggtgattgccaaaacgattagtgattacttaaatcgctgggcgtttgccgtcagcacggtcaccaagtttgaccaagttgacgcggaaatctcagcggcggcaccagacctagtcatcatggacatcagtctgccatattttaatggttttcactggctaagcgagttacgcaaacatagtaaggtaccagtcatctttttaacaagttctggggatgatatgaaccttgtcatggcgatgaacttaggagccgatgactttctggctaagccgattgaattgccggtgttgctggcgaaaattcaagggatgctgcggcgcacttatcaatatcagcaaattgacaccaatttatcgcacggcgcctttacgctcgtgccgaccgataatcagctaaaaacggctaagcaggttgttgctctgacaccgactgagacaaaattgctgagtcttttgttcagcgctgatggcgaggtggtgtcgcgcgaagcgatgatcgaaaagctttgggaaggcgacgacttcattgatcgcaatgctttagccgtgaacatgaaccgtctgcgcaagaaggtcacttcaattggtttggcgcaactaattgaaacggtgaagggcaaagggtaccggttggcaagtgaggggacaaagccatgatgaaagcttattgccgctcgcgttgggcaatttggttattgctagcgaccttactggcaacaggttttttggccagctggttgttggccaactcctttgagattgtcctgaatatgtggtttttcgcgacagcgccactggcagtgattgtgagcattgattattggcgttttcgccgtgaatggcagcaactgcaagacgatcacccaattgatcctgtgcagatcactgatccattaagcctggcttattatcaaaaaatccaaacgctgacgcaaaagctgcgcacaaccagagatactgcccacgaacaagaacaagaaacgctcgacacgctgcagctatggacacatcaaatcaaaacgccgctgaccgcgttagatcttctattgcaagtcgaacctgttaacgccaaagatgcccgacttgaaatcagcaaaatcgatcggtatcttgcggtcatgttgaactatctgaagttgacaacattaaataccgatcttgttttaactgaactgccactcaaaccgttagtcaatgagaccgtccgtgacttggcgaagctgtttatcgccaaggacctgaccgtgactgtggggccattgccaactgttattagtgacagtcaatggctgcattttatttttgaacaattgctaaccaatgccattaaatataccccgcacggttcaattaagatttatgccaaaggggatgctgtcatggtggccgacaccggtatcgggattttggccgaagatttaccgcggatttttgaacaaggttattccggctacaacggccgcgcaaatcagaaagctagcggtttggggctatttttgagcaaacaaatcgctgaaaagcttggcctgacgctaactgtcacctcagaaattgggcaaggcagcacatttgccattcattttccccaaacgcggtggcaagtggagtaagctaccttaccagcttgtaagcaactacgagtcactgtaagtaggcatggggcatcatccccgctaagctaataaatgaaaggggacgatcacatgtcaacattacttaaattaaaaaatatcgaaaaaacttataccagtcgcggggctcagccggtgcgtgccttgacgaacatcagtttcactgttgaagccggtgaatttgtggcaattatgggtgaatcaggttctggcaaaagcaccttgctaaatctgattgcaacgctggacgatccaaccggcggcgatattagtctaaacggacaggatctgagcaacgtcaaggaaggtgcccgggctaagtttcgtcgagaacacctcggtttcatctttcaggatttcgacttgcttgacaccttcaatgttcaagacaacatctttctcccattagtccttgccaagaagcctctcgaaattatgagaaatcggctaactaagctcgcaccacgactaggcattgatgccttgctgaaaaaatatccttacgaactttccggcggccagcaacagcgcgtggcggcagcgcgcgcgatgatcaccgagccagaaattttgttggctgatgaacccaccggcgccttggattctaaaacttctacagaactgcttgatctgctcacagatgtgaatgccgaaaaccggcaaacgatcctcatggtaacgcacagtgctgtggcggccagtcacagccgacgagtattatttattcgcgacggtcaaatttttcatcaactttatcgtggggatctcgatcaaccagcctttctaacccgtatcagcgagacgatgactgccatgctgacaaaggcaggcgatggacaatgaaattctactttaagctcgctgcaagtaacttgaaagccgatcgccgcctgtttgttccgtttgtcaccaccactagcttcctgatggccgtcaacctaatcatgctgaatgcttacgccagtagtgatgtcttgtttaaaaagctgggggcagccgctggcaagtcactgttcatgttcggcacagatgtcatcgtgattatctctgtgattctcgccatctacgcaaacaattttctgcgcaaacagcgtattcgtcagttaggactttacaacatcatcgggtttggcaaaggtgaactcggcaaaatgatggcagtggagaagctgctgctgttactaaccactttactgttcggtggtattctcggtaccgtcctttcccgcatcagctaccttgcgctcgccaaaatgctcaaagtcgaccacaatcttgactttgggttaagccagcaagccttcagtatcgccgggatcattaccatcggcttattcgttgttttgctgttagttgatgaactttggctcattcgcaaacggccaatcgaaatcgtgcgagcacaacgagcaggtgagcgggagcccaagacaaagtgggtgacgctaattgttagccttatcgccttaattgccggctactatatcgcggtcacaacaactaatccactacaagcaatgagtatgttttttgttgccgtgatcttagtcatctgcggcacttatggactgttcaccgccggatcggtcttcgtcttaaaatggttgcgaaaccgcaaaaattactattacaaacccaagcattttatcaatgtagctaatttactctaccgtatgcaacaaaacggcgctggccttgcatctattgccattctggtgacgatgaccttgattacgctcgccagcacggccacgttgttcttcggtatcaatgaagtcgtcaatacgaatacgccggttgatttgtcatatgttctcaaggcaaacgacaccactgcacccggcaaggtggcacggatggccagcgcgaatcatgtcatcatcaagtcacaacacacttttgttggaccgtccagtacgatggctttacttgatggcaatcgtcttgaatcgcaggccaatgtcaatggtccgttcagtatgggcaatgcgcgctcggtgcaattgatgaccattgagagctacaaccgttttaccgggcatcatgcccgcgttaagtcaggggaagtgttgatctatacatccaaaaattttcctagcaagaccattcgcattggtcaaaagacttacaggatcggaaaacgtgcaggtagctttccaaatgcacaagcgacttttatccccaatctttttattgcctttcctgaagagaagcaaatgatcgacgccatgcagcatctgagaaatgcacgctatcaaaacgcggctgaggcacaagctgatatcaccacaagtcaagatgtgatgttgcaaggaagccatgccaatcagcttaagctctatgaagcggtggtcaagagtcgtatcgctgaatcggcctcagttcaatcgaaagccgtgaattacgatgagaccatgagtatcatgggcagctttcttttcctcggcatcattttcggcgtcaccttcattttggcaaccttattgatcttgtattataaacagttatctgaaggctatgccgatgcccgccgctacacaatcttacaacgcgtcggcttaagcctgcgagaagtgcgcgcaaccatcaacagccagttactaatgctgttttatctgccattactcgtggcagggattcatgtcggatttgcattgccattcattcaacgcatcatgatattgtttggcttaccgaattggcagttcttcctgactgtctcactcatcacacttggtatcttcgcgatcatctatgtcctcatgtacaagctcaccggtaacgtgtactatcgcatcgtctcgcgtcgccaagctaccagtcgcagctaactaaaaaagcgtcgaaacgccagtaaaaatactgtcgctcgacgcttttttagttgatgccagcaattaagccggctgcaatgccttgatttcatcaatgatcttcaacagcgtttgctcagctgtttgatagtccgccattttatcggcaaactgctcgtcaaaaccagccaacccgccagcagcaaaggcatactcataggcatacaccgcttcataggcggccgcaaaccgctttagcaaatcatgatattgttcgccgccaagttgcagcgccatctgaatcacgcgaaagtccgtatacgccatctcaaattgaactgcccatgcccgcataaaatcatgtcgggcctgaatatgcaggaaatgatgctccgttgtccatgctaatcggttcactgaatctttaacatctaacacaatcaatcccacctttccgtttcgatctgactcgattataggctggtctggcgaaataagctttcaaaagactcgatgatcaacttcagtaaccatctctcgtcaattaagcttgttcatgcccgcgatcggttgcttttgcggccgtttcagaaacctcacgcaaggcttctttaccgcttttatcactgagattgatatacagatctgttgcacttgtggtcgtctgcccgagctgatccgcaacctgctgtacatccttggtgaccgtataaatattggttcccaaagtgtgccgggccttatgtggtgttgatggccgaccataatcggttgtataacgcttgaaaaaggcttcgattgtattttggcgaatccgattgattttttggccgacaactgtcacaaacaggggagaagtcggcttttgataaccaataatagccgctcgctgcgttaagtaagcctgaacatacggatcaatccagtctgcaaaattgacgcgatcctgaaagttgcctttgcgaacaacttggaccgtatgccgatccatgttcaaatcttccagattcatattcaccaattcgctgactcgaacccctgagccaaacagtaaggcaatcatggccaagttgcgcacttttgtcgcctcaaaatagcgccgcggcttggctggcagttgttgcgcataactttgatccaaccactgtaaaaacttagcatcttcaccgtccacaaacagcatttcctgtagcttgtggtttcggtaactcgcagtttcagtatgggttttaagttttaccttgttccagacattccgatagaaataaggttcgccatctgcatggggttcactttcctccgtcaaaaaccgataaagcgccttgatcccgactaagcgcaaagcaacactgcgacgcgtcattcgcttgttgtggtgcgtcttggaaggccgttcaagcaaatacgctataaatgcctgagcatcacgcaacgacaaatgttctaacacggtcagcgggacggtttgcgttgaggaagcggccgtcacaccactgttaatcagccagttcagaaactcttgataaaaatgtaaatactgataaagcgtcgaatcggcgatcgggatcgctttttgactctgataatagtcctgaatgtaatccggcagggcaggtagcattgtatgaattaatttcgaataattttgtgtcgacacagatttcacctcgaacgtatgttttcttttagataatgttagtatacgcgaaaacaactgtccttggcgagggctagtgttgatgaaaaatgaccggtggtgctggttcagccattgttctgccatgtgaagcagaattgaataaagttttagctttatccaaaggtgagcaaagatgtcagcaaacgcctgttggtcagacaaattttagctgacataattctggtatgaattcagctattaaatgagttcacttcggtcaatcattcagcaaacttattttggccatttgtcaataaaataaatttgctgaatgttgcgtgaccctcaattgttgttgagtcaatttcaaactacacaactcaaaaaatcatcagtcaactcgaagccggctaactgacgagaatctcacaacatcatgaagcttgaattgatatgcatttttctggttttggctggcatgacattttcaatcaaacaaatgcatgcaactcagcgcaaacgcaacgtcccaagtcataattgattgccttggtaaaaagttcaatcgccaccaccaacattacgtccgaaccacaaatttttgacagccatctgaaagaggggacacccagattcgcagatcaagtgccaaagccaattatttatattctagtttacataatatatattatgcgaagtagcgtttgaagagacggcatcgtgccattctcgcaatatttacgttggcgattatttgattcgcaatttcatacagcacctgatagtcgcctcattttttgaaccgctgcttgcagccaagtctttaaaagcttctacaatctttggataaatcattggatattttttgcttgagttttttcgttaagtcaaactatcaagttgaattcccgaactcgtctcagaatgcgtctctcagcatgcctcaaaaccatccaaaatgacccatgacaacttgctgttgattcgacccgcgaattgctacacaaatttcaaattcacgcatcacgaactgctagccagctttatatttaacagatttcgcaaaaagatggctagagactttttgcaaacaaaaaagccgcaactggctagctgcgacttaccttagaacaattgtgtgcaattaaagatgaaagttaaccttcaaacgtgctctgcattggcggaacgacctgctttttgcgggaaacaaccccaggcaatgccaaacgcgcgtccttgtcgaactgttcgttgaaagcactggcgattttatcgcggtcagcaccgactgcgaaaccagttgaattgctgtccaagatgtcagtggcaatcagcaggaaatcgtcgtagcctttcgcctgcgcctctttggtcatggcactgatcaattcgtcctgacgtgcgtaaatgtcgttcagatcgacggtattgacctgtccgatgcgaatagacttgccgcccatggtgaaactcttagcatcgccttcgataatgtccatatctgacttggcggccaaattagtgcctgccttcagcatggcaagaccatatgactgcaaatcaattccggcaatcttcgccatttctggcaaaatcttcttatccttgtcggttgcggtcggcgacttcaacaacagcgtgtctgaaatcaaaccagaagccatcaaaccagccaatgttggcgaaatcttgaagccatattcctggaacatctcaaaaatgacggtattggtgctgccaaccggttctgctcggtaaaacagcggcgctgccgtgtggaagttagcgatgcgatgatggtcgacaacagaatcaatcgtcacgtcttcgatatcactgacactttgttgaaattcgttgtgatcaaccaacatgacatgatccgtctcgttggctgccgtcttgataacccgcggtgcctgaaccttgaagtgatcaaggacaaacttagtctcatcgttcggttcgcctaatgctaccgcctcaacatccgtgttgcctgcctgtttctgaaattctgcccagctcatggcactcgtaatcgcgtcggtgtccgggttctgatgcccaaaaatcaaagtcgtcatcttatctgatcgctcctcaactgaatagtttacttatcaagtttaacacggttttcactgacccgcgacaagtaatctttttccttcagataatcgtcaaaggtctggaagaagttcgagatccgcggaatgtcagctttctctttgcgataaacaaaagaaatctcaaagcgaatggccggatcaaacgcaatagcataggccttgatttgatcagcgcgtgcccgaacaaaactggttggtaaggccgtgttgacccctgacaagttaacgaattgggttaactgatatggcgtggtgaaatgtgcgaccacgtgcgggaaatcaaccatttgattcttgtacgcctcacgcagaagctgtccaaggaaatagtcgtcaggataagttgcccaaggttcagctaaagtatctttgaaatggattcgcttacggttagccaaggcgtcatcgtggtgcaagaacagcaattgttcatcaataattttcttgctggcgtatggtttccagttcttaatggtctcatctggcagattcatgatagccaaatcaatctggttgttttccaatgattcccaaatttcgtgacgggtcatcatccgtagcgttacttcaacttcaggattcagttgatagtaatgagcaatgaacgcaataaaggcgctatcctcaattgagcttaataacccaatattgatttttccgacggttgcactggttgtttgttgaatttcgtcggttgtctggttcaagatctcgtagatctcatgggttgactttaacatggtctgaccagcgtcagataaatgcagtttcttcccgacagaataaaacagcggtgcccccaccgtccgttccaatttcttgatctgctgtgttaaggctggctgggtaatgccaagcaattgggcggcttgggtgtagttcatggtttctgccaattgcagaaaataagttagtgtctttgaggaaaaaatgcgctcttgtttcgttttcatagggcggcttccctttcgtttataatttaataatatcgttcaaccatcatcataagtggcaatgaaaaaaaacgcaacgaatttgccgcgtttttaatcgttacgttaagttctagctaaaaattcagttgctcgcaactggtttcggacgccagctttgccatccggtataatccttaacgtgcagcagattctctgcattcttaacgcgatcggcagacggcggttcgatgccttcaagcgggtacgtaatgccaagctcgtgatactttttaacgcctaacgtgtgatacggcagaatctcaactttttggaccacgtttttgtccaatgtcgcaatatagtcccctaaccgtttgagataagggtcaaagtcagtgcgttccgggaccagaacgtggcgaatccacatgtcatcaccatgcgccgacatatactgcaccatatccaaaatattctcattaggaaaaccggtgagctttttatgctcggccgaatcaatgtgtttaatatcaactaatgagatgtcagtaacagccatcagcttttcaaactggccaaaccacggttggtcacgcgtgaaggggccacctgacgtatcgaggcaagtcgaaattcccagtgccttagccttggtgaagagttcgagaatgaaatcgatttgtaccaaactctcaccgccactgcaggtaatacccccttggtcaccccagaatgctttatagcgctgggcatccgccaaaatttgatcggccgtcatttcttcaccaaccccaatgttccaggtgtcagggttgtgacaatactggcaacgcatgcgacacccttgcataaagacaacgaagcgaataccagggccatcgaccgaaccaaaactttcgaccgagtgaacataccctttgatcgggccatcatgatcctgaccaacttgttctaagatatttaatgggctttgtgactgatcgatgagtttcatcttattgcctccactacaacatcatgtgtcgttttcaattgattttcatttcattctgccaaaaaacggcaacagcatcgttgccgtcttttggcaaaacaggaatggcttcctgtcttgagttaagctgcttacatttcttcgaagaaggtccgagcaatgacatcgtcttgttgttccttggtcaaatctgcgaagtagacgcagtagccagaaacccgaacggtcaatgttgggtattcttctgggtgcttctgagcatcaatcagagtctccttattgaagacgttgatgttcaaatgcatgccgctgttttccatatagccgtcaaccatgtgaaccaaggtatccttacgagtttcatcatcgtggcccagtgtgttcggagtaaccccaaacgtattactaatgccgtcagttgcgtaatgatacggaatcttggcggtggacatcagggatgccagtgcgccgttcttttctgcgccatatgccgggttggcacctggtgagaatggttcgcctttttgacgaccgtttggtgttgtccctgtattcttaccataaaccacgttggaggtaatggtcaggacactggtgctcaacttcgcgccgcgatacagatgatgcgtgttcatcttgttatagaaggtcttaaccaaccacttagcgatgtcatcagcgcgatcatcgttgttaccataacgtggatagtcatcattgtcagcaacgaagtcaactgcaacaccgttttcatcgcgaattgccttgacatgaccatacttgattgcactgatggaatcaaccgcgtgtgacaggccggaaatcccggttgcgaaggtccggttcagttgggtatccttcaatgccagctgtgcagcttcataataatacttgtcatgcatatagtgaatcacattcaaagcattgacatacgtgtcggccagccagtccatcatcttgtcgaacttattcatgaattctttgtaatcaatgtaatcgctggtgatcggtgcatattcaggccctacttgcgcttcctgaatttcatctttcccaccgttgatcgcatacagaactgtcttagctaagttagcacgggcaccaaagtattgaacgccatcagcaattggttgtgctgagacacagcaagcaataccgtagtaatcggtaccccattcgttgcgcatcagatcatcattttcatattgaatggttgaactttggatggatacttcggttgcatagcgtttgaatccttctggcaagcgttcgctccaaagcaaggtgatgtttggttctggtgctgcgcccatgttgtccaaagtcttcaggaaacggaaagccgtcttggtaacgtggtgacggccatcattgcccattcctgccaatgacaaggttgcccagattggatcgcctgagaacagtgagttatattcttcagtccggatgaaacgaaccatccgcaatttcataaccaaatgatcaatcagttcctgtgcctgttcttcgttcaacttgcctaagcgcatatcgcgttggatataagcatcaataaccgtatcgatccggccaacggacattgcggcaccgttttgagtcttaacagcagccagatagccaaagtagatccactgaacagcttcttgcgcattagctgcaggacgcgagatgtcatagccatattccttggccatcttcttcatgtcgtttaaggcacgatattgttcattgatttcttcacgcagtttgatcacatcgtcagtcatttcgccgtcgccagtcaagttataatccttgaacttctcggccatcaaacgatcgatcccgtaaacagcgatccgtgggaaatcagaaacaatccggccacggccgtatgcgtctggcaagccagtcacgatcttgtaatggcgagcctttcgcatatcaggggtataagcatcaaagacaccttgattatgggtcttacgatattcattgaaaatcttgtgttcttgaggatctgtcttgaagccataagattccaatgcatcttcagccattcgaataccgccaaatggcatgaatgctcgtttgaatggcttgtcggtctgaacaccaacaatcttttcaagatctttgttcaaataaccagggccgtgtgaggtgatcgtagatggaatattgttgtcagcatccaaaacaccgccatttgcacgttcttgcttctttaaatttagaacctgattgttcaggactgttgtcgcttcagtggggccagcaaggaaactttcgtccccgtcatattggttcaggttatgctcgataaaatcgcgcacattaatttcttcttgccagtcgccgccgttaaagccttcccaataattaggaactttggtttcgtcaagctgtttcatagttgtttgcctcctaaagtggattacagatgtgacagttcttacaaacacagtataacacgccgccaaatctatgcaagcgttttattgcccatataataggcgttatattgttttttaagtgtgcttcgtcgcttcttttcgcccatgatttcgacattttgttaagttgtgcacaactgatctgtcctataataatcaaaaacgccgccatctgtattagtacagacggcggcgtcaatgatcaccatttattcgacttgatctgctggttcttctttggtttgaacaaaaactggcttgccaaggacatcagtgtcaatgacaaacgaaccattcgaatagcggtcacctgctggatgttgtgccggattaagggtcgttaccttacccgtatcggtcaaaacattcaggcgggtagcgtcatcgactgacatcatcgcgacaatccgatgcggatcacgcttaagctcacgcaagaccagtaaaccacgacgggcacgactcatttccccgacctcgcttaatgccatctttttgaaggcgccacgttgggtcaaaataccgaccttagccgtagttggatccttcactagaatgaaattgacaacctcatcgtctggctttagatccatacttttaacgccggttgcccgggcaccgacagttgacacatcgtttaacgggaatgtcagtccgtaagcgtggcggctgaccacaaagacatcctgttgctgatcagtcgtgaagtatgcattggtgacaatcgcggctgggtctttcagcttcatcgccatcatcggcttactcttgtacgtccgttgcggctgcaaatcacttaaggcagtttgtttgatgtacccgtcacttgaccctaacacaaaactgccagcgccatcgagttgatcaaaagcaaacactgccaagactttttcgtcagtgccaaggccaactgtttggcttaagtgttcgccggtgtctttccaacgcgcatcactaatttcatgcactggtcgataaatgacatttccggcatttgtcacgatgtaaagatgctgcaacgtactcagttcgccagtgaaaatggcaagatcattggccttcaaaccattgtcggccggatcaaccgcctgataactgcgcagtgaactgcgtttaacgtacccatcacgagaaacctgcaccataacggtttcatcagccaccgtcaccgttgtcgccacttcaagcgtttcaattttggcttgaatgctgctgcgacgatcatccccgtactccttggcaatccgcttcaactcgccttcaatcacccgatcgcgggcagcggggcgggccaaaatatcttgatactcggcgattgctttcgccaattgtgctgcttctttctgtaaagccgtgatatcggtattggtcaatcgatacagctgcaaggaaacaatcgcttccgcctgagcttccgaaaaatcaaacttcttgactaagttacgcttagcatcccctttatccttggaagcacgaatcgcggcgatgacctgatccaaaatcgatagcattttgatcaagccttcgacaatgtgctgtcgagcagcggccttgttgaggtcaaaacgcgttcgccgagtgaccacatcgcgtcgatgttcgacgtatgcttccaacatggccttaagtcctagcaacttcggctgcatgtcggcaatagcgaccatgttaaagttgtatgcaatttgtagatcggtatttttaaataaatagtttaagatgccatgtgcatcggcttctttttttaattcgatgacaacgctaagcccaaaacggtcgctttcgtcacggacttcggcgataccgtccacttttttgttgatgcgtaattcatcgatttttttaatcatctgcgctttattgacatcatacgggatctcagtgaccacgatcttctcacgaccgccacgaatggtttcgatgtgtgtccgagaacgaaccacgattttaccgcggccggtttcgtaagcttgcttgatgccatcaagcccttgaataatcccacctgttggaaaatcgggacccttgacgtattgcattaaagtatctaaatcagcagtgggatgcttcagcaagtataagacggcagcaataacttcccgcagattgtgcggcggaatttcggttgcataaccggcagaaataccggtggcaccgttcaccagcaaatttggaaacccagctggcagcacagtcggttcctgtgccgtgtcatcaaagttcaacaccatatcgacggtttccttatcgatgtcggccagcatttccttgctgattttgcttaaacgcgcttccgtgtatcgcattgcagctggcggatcaccatccatggaaccgttattcccgtgcatctgaatcagtggggcccgtaacttccaatcctggcttagccgaaccatcgcttcataaatggagctgtcgccgtggggatgataattacccatgacattcccgacacttttagccgacttgcggaagcccttatcatacgtattgccatcttggttcatcgcaaataaaatgcgacgctgaaccggtttgaggccgtcacgcacatcaggcagcgcccgttcttgaataatgtatttcgagtaccggccaaaccggtcgcccatgacctcttctaaggtcagttcttgaatctgattggccaatggcttttactttcctttcttgtccagttgtttgacgatttgcttggcaccaaactgtaatttttcgtgattagcagtcggggtttccaaaatactgccgtcgtcatccatatcaaacttgacgttatgctcaatccattcacgacgcggctcaacgcgatcacccatcaaagtggtcacgcgtcgttccgccagctgagcatcgtcaatccgaacccggatcaaagtccgcgtctcaggattcatagtcgtttcccaaagctggtcggcattcatttccccaagtcctttaaatcgggtcaatgtgtaacccttgcccatggccttggtctctttggccaactcttcatcggtccaagcataactgatcttggttttagcaccagcgcctttttgcagccggtacaatggtggcaaagcaatgtaaattcggcctgcgtcaatcagcggccgcatgtagcgataaaagaaggttagtagcaaaatctgaatatgcgcgccatcagtatccgcatcagtcataataatgattttgtcgtagttggcctgctgcagatcaaaatccgcaccgacaccagcgccgatggtgtaaatcatcgtattgatttcttcgtttttaacgatgtcctgtaacttggccttctgggtattcagtactttccctcgcaatggcaagatcgcctgaaacttccggtctcggccttgtttagctgaaccaccggcagaatccccttcgacgagatacaattcgttacgcttagggttcttggtttgcgccggggtcaatttaccggaaagcaaaccttggtccttcttgcgcttgcgtcccgtccggctatcatcgcgtgcttttcgagccgcttcccgcgcatcacgggctttgacggctttacgaaccaactcttgcgactcttcaccgttttccatcaaaaaagttgacagcttgtcatagacaatcccatcgaccacagtgcgggcttgcggcgtaccaagcttgccctttgtctggccctcaaattgcaaaatttcttctggaatgcggacacttaaaatacctgcaaaaccttcacgcacatcactgccttcaaggttcttgtcgcgttccttcagcaagccgacttttcgggcaaactcattgaatgcacgggtcatgccgctgcgcaagccaatttcatgcgtcccgccatcaccagtgcgaacgttattaacaaacgaaatcaggttttcagaatagccatcgttatattggccggcaaaatcaaccacgataccgtcctttttgccttcaaaattgatcacctgtgacaatgcgtctttgccttcattaaggtatttaacaaaactgaccaagccatcaggatagtgataactgtcatgcttgccggtgcgttcatccgtcagattaatcgtaatatttttcagtagaaaggctgattcgcgcaagcgttcggccaaggtatcataactgaagacggtggtttgaaaaatagtcgggtccggcttgaacgtgatggtcgtgccattaggttcattaactttgcccaacttctgcaaactgccatcaggatgaccgccattgataaaatgctcctcaaatgcgtgcttatcccgcacaactcgcacagtcaatgactccgataaggcattgacgacgcttgagccaaccccatgcaaaccaccagaagttttgtaactattttggttaaactttccgccggcatgtagcacggttaaaatgacttcaatcgtcggtttgccactcgggtgcatccccgttggcatcccgcgaccatgatcctgtacggtcacagagttatcggcgtgaatcgtcacattgatctcatccccaaaccccgcgagcgcttcatcgacagagttgtccacgatttcatagaccaagtgatgcaaaccgcggccatcggtggatccaatatacatccccggacgcttccgcacagcttccaagccatgcagcacctgaatggatgaatcattatatgcttgcgttgctttatccatagtaaactcccttttttgaacaactaagttatagaatacaccacgcgttgagatttcagaaataaaaaataagagcgcgagccatcccgattagaaaccggagcataagcggccttgggtgcgatggttgggctttgaccattgtgcccaaggtccttatgtgcaggtttctgggctggtgaacgcgtttcagtagagcgcgagcaggggcggttagcaaccggagtgtaagcggccttggacgtgatggttgggctttgaccattgtgcccaaggtccttacacgcaggtttctgggctggtgagcgcgtttaggcatcaacaccatcaacagcagacctcaccgtattgctctcagaactcctgttttctcctcaaaatcgacccagccggctaataccatcattgttcatttaaattttattagccgtgtcaatgtcccaaagctcagcagaaaaccgcacttccctaagcatggcacataactatgacttcttgacgtgaaattcatcgcccgctggcaccatatctacgctgtgccccgccatgatccttgcacaaaacggcaccaaatcgcgccacaacccgcttcacaggttttattcgaatgtacgttcgttttattctactgacgtatcactcaaaagtcaaaaatgctaaaatagtttctagtttgagaggaggggcacatttgatacttgtgctttgttttatactcgcgtatttcataggcgccatcccgtttggtgtggtcattggtaaactcttttatcacacggatatccgcaaaggcgggagtcacaatattggcaccacaaatgcttatcgcatgttagggccagtcggcggctcaattgtcttggtgctggatatcttaaaaggcacgttggctgccagcttacccattctctttggcatcgagcatcattggctggtgctgatcgtgggtttagcggccgtattcggtcatacattttcaatctacattcgctttaaaggcggtaaggcggtggcaactagcgctggcattttacttgcatataatccgccattttttgtcattgcatttgccatctggtttagtttgatcttgctaacgtccatggtcagcgttgccagcacactgggtatggtgttgatcacagcttggtcgcttgtttaccatgattggttgctgacaactgttgcctgcgggttgctggttgtctttttgatcaaacatcgggcaaacttcaaacgcatcaaggccggagatgaaaatatggtgccctttggcctaggccaatatcttcgtcaacaccggggccgctcatagtcaccttttgatggcaaccaaaaagacatccgaaactggatgtctttttttcatgtacttaatcgacaaactgatgacaccttagaaaatgctgatcatgtaacccttctcaaatgccgtgccaggttcaagtcgattgatcccgagtttgcgcgtcaggtcgccagtgctgccaatcgtgtcggcgatgccccaccaaggttcgatgcagacaaagtcgccagtggttggatacggactccaaacgcccagatatggggtatcggtcatggtaacgctgacaccatgtttcgtcttgtcagaaaccaagttgaaggttgtcttaccaagcaacgcgaaaattaaagcatcatgatcaaatgtttcgtgcgttaaggccaaattggcatcagttgcagccaaggtccggtgcgtgtaatcaatgccttcaccagcaaccaacggaatctgaacaagcgacttacgcggtttgaagttcaaataataatcggagaattgagtatccggcgtcattgggaccttgaagcccggatggccgccgatgctaaagaacagtggctcacttttgtccggattgtcaacgtgatacgtgacatgtagattgttattttctagtgcaaacgtgatgattaaacgaaaagcgaacgggtacatcgcccgcgttttgtcatcatccttcagaacgaagctcgctttaaacggtgtcgcagagagcaccgtgaaatcacgatcacgggcaaaaccgtgctggcccatgtggtaagtcttgcctgcgtaatgatattgattgtcagccagcgccccaacaatcgggaacaagaccggggcgtggcgaccccacaccgcaggatctgcttgccacagacgctccctgcctgtcaggttatctttgatactggtcagttcagcaccatgccgactgattttaactgtcaaaaagtcatttgcaatcgttaccatacatcctcatcctttacctacaacattattgttaactacaaaatataccgcgtcatgtttgaatcagccgcaatatggccaatcttgtcatccacatattgctgggtgacggtcacagcgcccatcgccatatctggaccttcataaagtacgtcttcaagcagtttttcaagaatggtcgccagtcgccgcgctccaatattatcagtgtcgtggttgacctgagtcgcaatctctgcaattcgatcaaccgcttccttcgtgaaggtaatcttcacgccatctgcaccaatcaaggcgatatactgcttgatcaaagcattgtctggctcggtcaagatccgcacaaagtctttttcggttaagtccttcaattcaacccgaattggaaaacgcccttgaagttcagcaatcaaatcactaggcttagcctcggcaaacgcacctgagccaatgaacaagatgtgatccgtattgataggaccatacttagtgttaatctgcgatccttctacaatcggtaaaatatctcgctgcacaccttcacgcgaaacttcgccgctattatgcttgtttcccgcagcaattttatcgatttcatcgatgaaaatgatcccgttattctcggcactttgaatggcgtcgtgataaatgtcggcatgattgaccagtttgtcagattcctctttgatgaagatttcgcgagcttctttgacggtcatggtccgctcaacttttttcttaggcattaaagcgccaatggtgtcgcttagatcaatgcccatctgaccgtacatgtcacccatgccaccgccttttttctcatcattgacagcaacggtgatttcatgatcttcaagtaatcctttttccagttgctctgccacgctcaaacgcttattgcgaatatcatcggtcacttcgccgcctgcgtctgcatcatcgccagctggcattttgccattttgcatcccttgcaacatgctcatcatctcggccatcggattggtattcttttccttacgaatggccggcactaaaattttaaccaaacgcttgttggcttctttttcagcacgtatgcgaacctttgaaaattgcttctcttcttccatggcaacggcagtttcggcaagatctcggaccatggattcgacgtcacggccaacgtagccaacttccgtaaacttagtcgcttctaccttcacaaatggcgcctcaactattttcgccagtcgtcgtgcaatttcggttttcccgacaccggttggtccgatcatcagtaagtttttcggggtaatctcttcttgcatttttggcgataattgcattcgccgataacggttatacaaggcaaccgcgacggcccgttttgcatcatcttgtccaatgacatattgatcgagtttttcgacgatctgttttggggtttgtacttctgccatcataagcctcctgtaggtcaatgtaattgccgacggttacaaactaaaagctttcgacaataacattgtggtttgtgaaaatatcgatatttcctgcgatattcaccgcttctttggcaatgtcagctggtgtcatatctggggcatgccgcagcatcgcgattgccgcggcttgcgcaaagttgccgccggagccgatcgctactacgtcttcatctggatctatcacttcgccagatccggatacgagtaacaggtcatgctcatctatcacgatcatcatggcctcaagtttctgcaaggtcggatccttgcgccaatcttgagccagcgcaactgcggaacgtcgcaagttgcccgcataatgctccagcttcttttcaaaccagtcttgcagggtgaaagcatctgccaccccgccggcaaatccgatgacgacttgatcatgatagatccggcgaactttctgcgcgttgcctttcatgatgaccttttcgccaagggttacctgaccgtcaccggccaaagcggtcacaccatcttttcttactgctgcaattgttgtcatagtcatgctcctttttaagtgagcgcgagcagaagcgcttagaaaccggagcataagtgggctagcctaaatggctgaattttggctatttaggcttccaggtcattatgtgcaggtttctgcgactgcgagcgcgttatctgcgtatctcgtcggataaaaacagctaaagtagcgattaatctgttatcgccaatgttcttagcttaaaaaactcagactgcttttgcatcatgctttagtcttaattatgcttcggataatatttcatatactcattttttaaatgtgccatggtgacatgcgtgtagatttgtgtggttgataaacttgcatgacccagtagctcttgaacagttcgcaggtcagcaccatgatccagcatatgggttgcaaaactatgccgcagcatgtggggatgaatgttagctgtcagcgtcgtctgcttgatgagctgatccaaaatatattcaatgccacgcgaggtaatcggacgcccatactggttcacgaatacatatcgatgctgtgcctgacttttagccatcaaaacttgtcgaccatcttttaaataggttcgtagtgcttgctgggcgtactgtccaaagggcacatacctatctttgttgcctttaccatgaatcaacagtaatgccgtattgaaatcgacctgattcaatgtcagtttggcacactcggaaactcgaataccggtgccatacaaaacttccaacaaagcgcgattacgttgatccagcggggttttgccagcaactgtcttgaacagttcctgaatctcggcttcatagaaaaattgaggtaaatgatgatgctgcttttttaattcaaccagctcaaatgggttgcgtttgacgacatcaattcgtgtcaaataacggtaaaagcttcgcaaactactgatttttcgggcaatcgatgtccgtgccaaatcctgtttgttaagatcagtcaaataagtttgaacgtctaaatcatccacatgccgaaagtcagtaaacccgccgttggccttgagaaacgcctgaaattcttgaagatcgctcaaataagccgtcactgtttccggtgaatactgccgttcaacttcaagatactcttgaaacgctgcaattggcttcattgaatccctccgataatacattaacataaaatgcagccattgttgacgctttcagtgcatcaacaccatcaagccgccgaaataccaatgaaaaaatcccggtaacccgagattttttgcgtccttaaacttgttcaacccgattcatacctgcttggaaagtagctaaatcttttaatgcacgatcggctaactgctgattgcgttcttttttattgcgtactttgactgttaacgctggcatgatgccaaagttcgcattcatcggctggaagtgatgggcggatgtgtgagtaatgtaatgcgccattgaccccatcgctgtagtttcgggaaaaatcagcggggtttctccaagcgccatacgggccgcattggtacccgcaatcagaccgctagcggcgctttcaacataaccttccaccccagtcatctggcctgcaaagaacagatcaggccggcgtttggatgcatatgttggttccaaaaccactggggatttcatgaaagtgttgcgatgcatgacgccataccggacgatttgcacgttttcaagtccagggattagtcggaaaacccgtttttgctcgccccatttaagatgagtttggaatccgaccatgttatataaactcgctgcagcgttatcttgacgcaactggacaaccgcgtaaggttccttacctgtccgtggatcttcaaggccaactggctttagcgggccaaacaacatagttttaataccgcgtttggccatgacttcaatcgnnnnnnnnnnttcaaaaaccgtcatcttttcaaaatcatggccttcagcaacttcggccgaaacgagcgcttgatagaacgtcaagaattcatccttcgtcatcggacaattcaaataggcggcttcgccacgatcatagcgcgactttttataaacaatgtcctcgttgatcgtattcgcatcaagaatcggtgcggctgcgtcaaagaacgacaaaccggcctcgccgttcagatcaacaattgcctgtgctagcccgggcgctgttagcggaccggtagccaccactgtgatcccatcaggaaatgctgacaattcctcattcaccacatggatatgcgaattgctcgtcaacttttgggtcactagctcgctaaacggttcgcgatccaccgccaaggcaccgccagcagggacagcggtggcgtcagcactttgaataatgattgaatgtaactgacgcatttcttcctttaatagacccaccgcattggtgatctggttggcgcgcagtgaattcgtgcagacaagctcagcaaaattgctcgtgtgatgagcaggtgtcattttagcgggacgcatctcgtataagttgacatctacaccggcctgagcgatttgccaggctgcttctgatccggctagtccggcaccaatgacattaactgttggcatgagtgattcctccttgtggtggcgtggcgcaattagttcgttcagagaaaatgtgagttttgcggcacgtgtattttggtggcttgctgatgtggtagcgactcagcttgctattgtgggcagactgaatctttgagcaagctttctaaaggcgcgaacaggcgcagaagcctccgtgtaaggacattgaagtctaaatggccaaagttcagccatttagacttcaaggctggtgatgctccagttccgaaacgcgcaaacaggcgcagaaacctgcacataaggacctcaagcttaaatggccaaagcccagccatttaggcttgaggccacttatgctccggtttctaagcgcgcctgtttgcgctctgcccaagtttacccgaaaaaaacagtgagtacaaagataacatactcactgctttctcaaattatgctttttgcaaggcttctttataatcgttatttgggcagacgacttgggtgccagctttgctctttttctcaactaagaaatgtccgcagaccgggcaatcgcggccgactggtttgtcccatgagacaaagtcgcagtctggataacgcgagcaaccatagaagacgcggttacgcttgctcttacgttcaacaacttgaccgatatgacatttcgggcagacaaccccgatctctttgacaatggccttggtgttgcggcaatccgggaatcgggaacaggcgtaaaacttaccataacgacccattttgataaccatcggcgcaccgcagacgtcacagttgaagccggctggttcgtctttgatttgaatcttcgcgatcccagtttcggcgtgagccacttctttttcaaatggcttatagaactgatcaatcaccttaacccaatcagcctcgccggtttcaatcccatcaagttcagattcgacattcgccgtaaacttgatattcacgatgtccgggaagaattcaacgatcaaactgttgacgatctcacctaattcagtcggttcaaaccggcgagcattcagtttcacgtagtaacgtttctgaatggtttcgatagttggcgcataagttgacggacgaccaacgccattttcttcaagcgctttgacaaggtttgcttccgagtaacgggctggtggctgtgtaaagtgttgagccggatcggtcttcaacattttgacatcatcaccaactgcaagcggtggcaaaatattgtccttttgatcgctgtcacgtgatgagacatacaacttggtaaacccttcaaacttagtctgactaccgttggcgcggaaagtcacaccgttttggtctaacgtcacggccacagtgtcaataatcgccggggtcatttcactggcaacaaaccgactccagatcagccgataaagtttcatctgatccttgtccaaaactgccgtcaaactatccggtgtccgtaatgtgctggttggccgaatggcttcgtgggcatcttgtgctccttcctgcagtttaccttggcgaattttgacagcagcataagcttcgccgtatttctcatgcaggtaatggctggtttcagttttggcaacatttgacacgcgagtcgagtcggtccgcatgtacgtgatcagcccaacggtgcctaacttaccacctaagttaatcccttcatacagttgctgggccaacatcatggtctttcgggtgcggaatcccaacttacggttagcttcctgctgcaaggtactggttgtgaacggcggggatgggaagcgcttgcgttcctttttaacaacattcgtcacagcaaacggcttagttttgtccacttggcccaaaatcttttgaacggcctcgttgttctttaaagcctgctttttattcttcaggccatagaaactagcactgaactttttactacggcccttctgaaactcagcatctaatgaccagtattcttctggcgtgaagtttttgatttcattttcgcgatcaataatcagctttagcgcaacactttgaacgcggccagcactcaggccttttttaactttcttccataataaaggactgatggaatagcctaccagtcgatccaaaatccgccgtgcctgctgggcatctacaagatccatatcaatgccacgaggggttttgaacgcatttttaacggcatctttcgtaatttcgttaaaaacgacgcgatttttggcttttggatccaaacctaaaatgtgactgacatgccatgcaatggcttctccttcacgatccggatcggctgcgagataaatcttgctagcttttttagcatcttttttaagggatttaatcacatcgcctttgccgcgaatcgaaatgtactttggctcgtagtcgttatcgacatcgacccccatctgactcttaggtagatcgcgaatgtgccccaaacttgcaacaactttataggttcggccaagatacttttcaatagtcttggctttggctggcgattcaacaatgactaacttcttgtcggccatgaacgcgctccttccggtggcattgcctagtaggcaagccctgattaatttgtgcgatgctgacgattcgtcgtcagtaattgatgcgtcctaaggcggcaatggatcatctgccaccggcgcgaccatcaaagcaatcgcaactggtgtcagtctaatggtcaatgccacctgctgactcaaaacagttgctatcataagctagtcattttgctcttgtcaaatcaaaagaaattttttctactataaagtaagcaaaaatgtgcacctcaagggtaaaaattcaagttttctaccaacgtctctggaccagtcaccaacgccgctcctgcctgaatcagcacatttgtacctgctcccaaaggcgcatcaattcgattaggcaacgcaaaaacttcgcgattatgttgcaaagcatagttagccgtgatgagactgccgcttttcatctccgcctcagttaccatcacaccatgggcaataccggcaataattcgattgcgagcgacaaattgaaaacgctgtgggccggttgctggtggatactcacttaaaacaagcccaacatgcgcaatctgcacctgcaaatcgcggttcttggcaggatacacctgatcaaggccgttggcaatcactgcaatcgttggcagtcgggcactgagggctgcctcatgcgccatcgcatcagcgcctgctgctagtccacttacaatcaccattgacggtagttgcggcaataactgcgccagcgccgtcgctgaatagccggttgcacgccgcgaaccaacaatccctaacgttaattgattcaacagacccaactgcccacgataaaaaagcaccaacggcggctgcggaatttcccgcaatcgtggtggataagcagcatcaacatacgtcataaacggcacgtgttttgcagcaattaattgttgactaaactggtcagtcaaacgtttcttgagttctgcctgaaacggtgcgagatcgtcttttcctcggatagcttgttctaaagcaactgccatccgcggattctggcgtgtggcaatgtgccatgctagtaaaaaattgcgcagtgtcattgttggtcgtcctcccgcaaataaactacgcaaacacgacatcgacacactcaatgaagcactaagagcgcagtcgatcacggacaggcccaaaactgcggcgatgaattggggtaacgccgtgcgccgccaatccggcaagatgtgcctttgtcccgtatcccatgttgtccttaaaatcataaccaggataaattttatcgtacatcatcataagccgatcacgaatcactttagcaacaatactggccgcagcgatgctgatgctgttggcatcgcccttaattaagcgtttttgcggtaagtcaactggcacgtgcattgcgtccaccaacaaacattccggagcaactcgcaaatggtcaacggcttgagccatcgccaattcagtcgcatggtaaatattttcacggtcaatcgtccgattatcagccacgccaatgccaactgcaatcgcttcagttaaaatatgcgggtaaagcacattgcgttcatgtgcggtcagctgtttcgagtcattcaccggccactgaaaatggtgcggcaaaatcaccgcagccgtcacgacagggccagcaagtggtccccgccctacttcgtctaacccagcgacatactcataggttccccataactgacgctcatacctgctacgataacgtaaagccacctcttcggctgcttgatgggcctgtcgccgttgatacgctgccagtaatttgccagcaccaatgcgactgtcttctttaagtgccgccaaaatagccggtgcaacttcgtcagcagccagcaatgctttgtactcattcagcgtcggcatctgtctcaccaggcttctcgagggtaaagcgtcccaattttccttgtcgtgcatcaaaaatcaagcgctcagccatccgatcgtaagcctcagcgaaaccctgtgatttcgtcaacttaaccagcagatcatggggcgcttcatttaaatcatcctcggtgacatggtatgcctttttcaaagcagctggataatgcgccataaagtaagtcagcccatacaagccaaccatgtcttcttggaaaactgcatcggcaattgcacctgtaaaggctaaccgcatcccaatcgtttgtgaggcaaacttcggccaaagaatcccaggggtatcaagcaattgaaagttatcactggccttcaaccactgttgattcttcgtcacgcctggtttgttgccggtcaccgcgatgttacgccgaacaagacgatttaacaccgtcgacttgccgacattggggatgccaatacacatcgccttaatcatcggattacgaatgccgcgcgcctttttccgagcaatcttttccgccatcaacttcgtcgccaattgcggaatttgctgcaaccgcttggcatgctgggcatcaatcgcaatcgccgcaaacccttgatcctgataatattggacccacgccgccgtcaacgccggatcagccaaatcctgcttattcagcaccataatgcgcggcttgtcagccaccagctcatccaacatcggattgcgcgacgattccggtgtccgcgcatcgacaacttcaagcacgaggtcgacttgtttaatcttttcttgaacttgtttccgggctttggccatgtgaccgggaaaccattgaatttgtgccatttgtgtaactcctttaggactaagacaattaaaatctcagtatgaactatttcctaacgactagcatactgtatttatgtgaaaagtaacaactgcctgtttttaacctcgatagctacaaaagacttgttggtacgctcagtcacatactttttagtcgttaaccatctcgccaagcttctttcgagtttcttcatcccctggcagttgcacgccgataatatcgccagcccccaaaagcttcagaaaagtctcaatcaaatagagttcgtatgcattaggaacgttgagcagcaaccgttcttctcctaactcttcgacctttagctgatcccacgtttgcttaaaaacgggatcatccttcaccgcggaatagacttcaaataagacctttgaatccggcgttcgactatataattggcgaaactttgccgtaagcgcactggcataattttcccagtcaaccatgacagcacgaaaatgcggatcattgaacgtgcgaaaaaccaaatgacgtcgcaacgcactctcggctaaaaagttgccataaatagccgtatacattttgttagctgctaccaccgttaaattctgatcaagcgcaaaagcaggatttggcatctgttcgtcaacaaaccgctgcacactgtcatatgaagtcgattggtcagtcgttggcgggatttcctcggccaaattgaaaatataattcgtttctgcttgattcaacttcaaagttttgcaaagatctctcagtacatcagcggaagcagatacgccagttcttccttgctcaatgcggatataccaatctgtactgacattggccaatgtagcaacctcgtcccgcgttaacccaggcgtgcgatgcttaatatccgggacatcaaactttgcccgatcagcatgtgtccgtttatatctcaaaaaatgccccaaaaccttctcattcattttgctcacctcaaagtaggacagcttatcctaggatagccatggtctggttgtgtaccagcctctgctccatactatatgcgtagtcagatgacacaacaagaaaaagcgtgagttgtcccggtttctaggacaatcaacacgcttaaggaggaagcattatgactgtaaaaataggaattaatggttttggccgaatcggtcgcttggcttttcggcggatacttgaagttggtccaaccgcgaacattgaggtcgttgcgatcaatgatctgacctcgccaaccatgctagcccatttattgaagtatgattcaagccacggcactttgaatgctgagatatccgcaaccgaaaatgccattcgcgttgatggcaaatcttatcatgtttacgccgaacccaatgctgaaaaattatcatgggtggcaaatgacggcgttgattacgttctagaatgtaccggcttctacgcttcaaaagacaaagcccaggcgcatctgaacgcaggggttaagcgggtcctcatttcagcgcctgcaggtaaagacgtgaatacaatcgtctatcgagttaacgataatacactcactaacagtgacacaatcgtttcagcaggttcttgtaccacgaattgtttagccccaatggcagatgcactcgacaaagaattcggtgtcgaagttggcaccatgacaaccgttcacgcgtatacttcaacgcagatgctacttgatggacctgttcgcggcggtaatttgcgtgccgcccggtctgccgctgttaacacaattccccattcttctggtgctgccaaggcaattgggctcgtgctacccaaactaaacggcaaactgcaaggtcatgcccaacgcgtccctgttactgatggttctttgaccgaattggtgaccattctgcataccaaagacctcaccgtcgataccgtcaatgagcatatcaagccatacacgatcaacaacgaaagctttggctggacagatgccccaattgtttcaagcgatattgtaaataccacttttggctcagtctttgatccaagtcaaaccgaagtcgttacggcaggcgacacacaattggttaaaaccgttgcctggtacgataatgagtatgggtttacctgtcagatggttcgaacgttgattaagtttgcacggttggtttagctaggtctcgttttgttgaaattggaaaaagcatattttgaggaagccagcaaattggcttcctttttcgcgcttaagtcatgtgtctcgccaagcgctcggcagtatgcgctcgtctttgcttaccgttcagataatagagtctcccattagcaaacaaacgaataatgccagctacaaataaccttgtatcgcaaacactcgtccattatgatacctataagtgcaaccgttttctaactcgttcaaatcatatatcaaaattcgaaacactaattaaaaaaagacattatgcagatggcacaaaaaccgcttaaaaacacccaaataatcattcaaaacttcgtgaactcacctattccggagaaactactgcctttcgttgatcctgatacaatcgaagctactttggaaaagttcggtacggcgatgtatatgcaaaccggccacagtccctctggatagactggcatcaatcggatactaactgtcatggaagatcagctaacgccttttttcaaagatccagtagcttacgcgacacacgccgccactattcaaatctttttaactttcaatgtgcaaccgcgcctaaaagatcccgaagcttttatcaccggcgttcaaaagcttggtcaacaacatggtgttacgatgactgctgaaaatttcgagattgatcagttgaacgtcatcgcaggtttcgatcaaccagccgacctgcccgaagtgaagtacgctgctgaacggggaatcaaaatcagccgcagaggcgactactttatgaccatgaaacgacccgaaggactaccacatgcgactcaggtcggtaaatacgaatggaaaaccgtgacggctgagcgtaccaccaaagaaggattctggtttgctttagatttagtcgaactcaagaaggatttgactgcatctcacgtctatggcatgccaacgctcatcttcattgcattagtgacaaccttctatgcgagtatgtacgccgacgccatcgagacgccaaaacgttgggcggcaccggcacttgaagatctgttccaaaaagcacgccgcgacctgcctaaatcggcttttaaacgttattggcgggcgattgatcttgtggtggatgggttggcacgttgtcatagaaacaggtggatgaagtgagaattgtgctcaaaaacaggaaacattagcattcgtagtctaggttgaagtaacaatgggtttatcgcaacggtaaaactctatcaacaaagtaagcaagattaatttttaaaaaccgcaactcaaaataaggaacgtcagagtttgacagcattgtcaatggtttctggcgttccttatatttatatgatcattcccgaatgatcatgatcgatcacttggcaatcttttccaccgatactccggatgctcccgctgttctgctaaccaatattctcgcaggtactttaccggaaacggcacaaccgtatactgtctattgcgtacgaattcaacgctcatcatagcagccaactccggaaaaacttcatcaacgaccttatcaccgtatgacaatggcaataaacgacgcaatgtcacagctcgtgcaatatccggctttagggattgattggcacccacgaagtactgggcaatagagtaaccgttccactcttcaattctcgttaaaccgatccatttcaaccctagaagcggcgaatccggaaggttgcgttgcaatgtacttttcaatgtgaaggaagcttttgcttccaagaattgattgacttgcctcatccccggttgccgtggattcagccctgcatcacgcgccgcttgatccagatcctttaaattaaaagtgctaggactttctgcgaccaccgattgtaattgcttgaacgccgtcataaatgcttcatcatcagcatctattggtcgcaccctttccagctcctgacctgcgttttttcgagaaagaattttattaggattgcatagctctaattgtttctttatctgttcaccatccggcatcgttgtgcgggcaaattgctgaatcataatctgtttggtgccaaactgaacgacacaatcaacccgatcccagatatatttctgtttttttgagcccagcactttaaagactttgtcacaaatccttgtgtactcgtcatccgttttaagatgatccgccttcaggactacctgttttttagaaaacaccaaacccattgtcatagtaaatgctaattttgtaaccatgacctcaggcgctggcaattcgcgtatgtattcaaagcgatagaaagtaaacggctgaatttttctagccaaagcagcgtcgaccattgttaattgcctattcgctagatcctgtttgatacataactcttgcgctagcttaatcaaggctggatcagtggcagcgtctcgactttttttgccatcatggggttcccaactaactccttcatctcccttttgataggcgccaaatttttcaaccgtgacatgttgaatgatgcggtctactgttccaacttcataatgatcatacttcgcgtgatcgcgtgtatctcgaattacttgaatattaagtcccgattgagaacttcgcgagcaatggatatttaccttgacctgttgcacgatttgactttgttttagtgcagcagtcattcgattggccaattccgcagccaatgaatcattcgcctgcggataaatattgatcgaacagcctgctatttgtttccaaatcgcgtcggtcctctcaagctttagctgacacgactgctcaacttgactttgatgaaatttgactgaattacgaagatagcgagtagtattttgattaagattatcaagaagcgctcttgcaatcccgactttgcttctctcaaacgatttcaggtttttaatagataaaaatttaacttggtttttccttgaggtgtggttgccctgatagaagtatggtccatcggaaggttggtaacaacgttctaagaatcctcgagcgagatccaacttgtatagcggcctcttccagtcccattctgctgtttcggtatatgtctgaacatttaattcaagatcctggtcccaattcacttttacattcaacgcgtgacattgtcgtcttaagtcttggcgttgatactgccattcttttcgtgatacgagtaattctggcgttttattaacctcagaaatggctggttgtccgaatgcttgttgattgaggagtaactgtaatatgtgattcggataaatagaatctgtttccatttctgccaacataatctcgcgcatctcaagcttctcaacctgttgtaataaaggtagttgacgaaacatcagaacgtacatattgcgacgaggcgtcatgaccgcctcaggcaaccaagaagctatcaacttgttgtaattcgaaaaggcgccttcttttacagtcacttgtaaaaatcgataatctgactgtagtgccattaaattgagtttatagtcgagcctagtcgtctgaattgtcatttggtcttgcatgcaaaaacctccctatttgtattttttgttctggggtcaacacaagctttccttgctcatcaatgagtccagagatttcaaggattttcccgtcaatcgtaatggtcggtttacctttgttaatcgcaactacattggcgatgatgactcgccattctcgaccagtgttaacttgcaagtgcctgagtttctgtgcaacatgctgccgttccttctcagtatctttgttcggttgaccctgccaatttttaaaatcaatagccacctcgccttgacactgaaaatcaaataattcgttattggctaaatcgtcaaaatcctgaagtttttgtcgccactctttttcaaagataaattgacccgccacttcacctatttgaccgcgatacagattcctgtattgcaccgggttcaaaataagttcattcggcaaccattctgtcggaatctccaaatcttcaaaatgtgtctttaagccgggataacggcacattatggtcaatcccgatgcctcggcggaaatttccattccgattttactaaagtcaaaacagccgctatcgcgtgtatcgggtttgacttcatattttgtttcgtgtttttctgcaggtaaatattgaaatccagactcatcgttacgccgtttgaagaccgcattccctattcgttcttcctcagaagcagttggatgttttgccacaaatagacgaagatcacgatagtactccgcatcttgttcattagtttgtaaatgggattttaaaaataaaagatcacgatgggtatacaaagtggcattctgtttgaaggcttccgatctcgtcttttcgaatgtcggcgctttttcatctgcatagtccagcaaacgccgatattcgaagcttgtctcttccagatcgatcccgttccctgtgatactgcccagtacattggcacttgccaagatacggacgcatggcatcttgttgaaagcccggttcattcgtcccagcgcctgaatgatcgtccgcgaataactgacataaagactacgtgcatttttaggataggcctgccatcttcctcgctccaagttagtaaaaaatgtgtttaaggtcgtcacattgatctcgtaagtgtcaaaaagatattctcgttcgataatggcgcggagtccggacgcatccatcctaaactgacgagtgttggtaagaatatgcgtcacatcgccaagatagatgcccgccaaatcaacactttcatgtcgtaggtcatatgaattggctccttttggggcgatattcacggcatgttcccgttcgaattcattcatgacatgttgaagattttgacctactccaaccgtttgatacgcactgagaatatagacacgcttatcttcatgacttgggatggctaaagcttctgcgagatcggactgaacgttctcgccatttcgtggcgaaataactttcaatttggtatcggcagcttctgtaaattgttgagttaaaagttctttaagccgatcaaaagtcactgaaaggtattcttgatccatgccaccttgttctttccccggcaaaagcgactgcaagcctaaaaaagatgtcagcatgggatcggtcaagaaaacaacgaaactgtcgaacaaagcaatgtagcgttgtttaaagtagtctttgccgcttcctccctcttgctcgttgttcttgacagcattggccttcttttctaatgctgcatctagttgtcgaattatagtggattcaatcaccaacccattttgtttcaaacgattttcaaagattgaggcgaatgaagtcccaatattggccatctctgcgttaacttgaatgtttccttttgcatatcgcccttcaaaatccagttcttcttgagtttctgcactcaaaaattcgatcccgtttatcatgcgaggacctaacatctctctcagataagtcaggtcgtaattatctagcactgttggcaaagtagcagttgctgataagccaagaatgttggctttatttagtaaattcaacaggtacctttccggagttactttaaaaaaagaagcgtcaatgtcagtccggaattcatgctgataatcgttcatcatttgaaaaaggcttagaccttgttgttgaaagcgatgggtgctatgcgcatgataattagatttaatgccttgagcagacgagtaatcatggcccagcgagagtaaaaccttaatctgttcacctgacagtccgagtgcgttatagatactatggcaagcatcatcaattgtcatagcatcatcaaaatttgactgttcagaattttttaagccttgataatcgcgagctcgatcacgaaaaaagcgcgttgttcgccgcaaaaatgtgtaaaccctgggcaacattctctgaaagtgcaagtcgtctcgcgcctgttgccccaagacaacctgtttcaaatgatgatctaagtatgcgtgccagggcttacctgcgctgatcaattgtctttggggcgtatggatcacaaagccggaatcaagcgaaactgcctctgtcttatacaaatgcctcaaggcaaacttggagcgcagctgtttaccctcctcttttaaaacattaaactgttttcttgctgtgaagcaatctctcaactggcttggtaaaacatcttcatccatttttttgaatccttggtgcaaagcttcgaatagcataatcaggtctgcctggatttttaaagcatcatcgatcgctttatccaagacttgttgtttggtgctatcaaattcgtccatgacgatgagcgcattgtgaatgattggggcaaactgaaaagacttagcgtgttcctggaagaaaggcgtataacttctggtaaattttgccgttgttaaaatgatgatttgtcgacgataaaggtcaatcgttggatatgtttcattcaaccatttagtttccgaattcacttgtttcgcaacatagtcacaagctttcttctgaccttcgtcgtcaaggggcacagtcaattcgaccgaatctgccagttggaccgtgattgcttgtcggaattcgaactcggcttttctcagcgcctcccacgaggtctgggaatcagcggcttgatgtttataggcttgaaataaaccaagatgcatctttaggttcttaaataccttcctaacagattctgatgatcgatatttggccggcatttgttggttatcccagtccccaatgattttattgacggtatcttccaaagaacgtaaaatagccactcgttgattaaaagtaccacagcttgatctcgcatgtttgttccaggctgctttaaaagtatgctcattgaaattctttttttggtcagtgacaaagaaagcccgaaaattctcatggtcagctgcatattgacacaatgcttgtgcaatcgtgtaactctttccagtaccagtaggcgcatttaaaagcatgagtgcatgctcaggcgatcgtgattctagatcagtgatcatcctccaaaaatcggaaatttgcatgtttcaaactccatctcttctttattttttcataacagcatttgcagcgtaaaaagcgccttcatgactaatctttttgatcctcactgtgaaggactcaaaaaaactgtcaggtcagaacagcatgctctctccgcgatatatacacgatttttgttgaaacactttaaaactaaagtaacttatacttgtgtccaggttggtattgtttaagcgcttaagcaacttaaacataatagtacaaaacttaattgtacactttttaggtcttctttcttacaataatcttatacatttaataagattattcgataaacaatattattataactaatagaaaatgtcttatatattgtttagccgatctttaaatcgatattatctcatcatcaagcatgaaaactattctccaaccgaaacctcaaccgaggcaccttttcatcaacgcactcccgccaaaacgtcacatgcgcctgatcaatcggatttaagctttcagtcacatccggactcgcagcggtttgctccggataccagcacaaataaaaacgtccaccaacagatgacgagaaaatccgctccactaagatgtgctctggcctaagcgtgacgtcaacctccctctgatgtgttctcaaaaaagtcatccacgcattggtccttacaactttattcggatacaccgcaaatccttctaattcaactgacatctctttccctccgtttggtttctagcaataggtatcaaaaaacgcgtacacacctcctaaaaggcatatacgcgcatatcataacctatttgattttcacttggctaccgcatccacagccgccttcatcatcggatcatccttggtcaactgtgcactcaacttctgcgcgagcgttgccaacgtatcctgatccgctgttcctgttgcgtcaagcttatttgcttgctggaacgttttgacagcggcttgggtggcatcgtcgtattgactattgacagtgacggagccgactttaagtgccgtgagcatttgttgcaaggacttcacatcgctgcctttatcgcctggtttgagctgagtggcgttgatcaaggtgatcttcgccgcggctgggtagtcgaccttgatatcaggtgtcaggcctttgtgattgatccaagtgccgtttggcgttaaccatttagcgatggtcagcttgagttctttgttgctgcccatttcgccgacattttggacggtgcctttgccgaaactcttttcaccgacaagcggaatgttgctgttttggtgaagtgctgcagcggtgatttcactggctgaggccgaattaccatcaattaagaccgccgttttttcagtgactttaaagccgtcatcgagttttttgccagccttatagacttccttggcaccgttgcggtcttcgacttgcagaacagtttggccgtttttagagaacatggagctgatggacaaagccgcactcatcatgccgcccggattttgccgtaagtcgaggacaaaggatttggccccttctttgcgtaatttcttaacagtggccttgaattgtttgacggttggttcgctaaaagtcgaaatagtaatgacgccgacctgtttgttggccgaagcaagttggccagtgacagtgtcaaccgtgattttctgccgtttcatcgagaaagttgcttgtttgctgccgcgcttaacggtgacggacactgtggtaccgattttaccgcgaattttggcaactgccttgctaacggtttgtttggagacatctttaccgttgaccttgagcagcacatcgccgacttgcatgcctgcttttttggcgggcgtatcaggtaaaatgctggcgatggaaagactgtcatgattttgctggacggtggcaccgataccgccaaatgaagccgaaatcgtgtcatcaagattggttttatcgttattctgcaagtaaacggaatatggatcatctaacgttgccagcatacctttaatcgcgccatcggttaatttggtcgtattgacgcttttatagtagttattggtaaccgtctcataagcagcaataacgggtgctagttccttggggacacctgttttcaaaacactttgttgcgcttgctgataagaaagcgcgtaaccgcctgcgacaccaccgccaagtgcgacgatgacaattatcaaaacggcccaccacggtaatctacgtttattgatacgaatcgcctcctgtgctttcactcgcctcataggcgcgatacgtttcgtcaaaaacggccatgcttggcaaataattgccgtttagttccagataatcgcttagtcgatggtaatccttttcttgcttaggaaagctttgatccaaaaaggcatttttcgcaaattcagcaatttcactatggtcattggggttacgcagggtcatgagatattcgtaaaaagtccgatgcattattgatccttccatgttttgtcgataaaagcctgccgttgtgcatgttctaatgcataacggcggggattcttagcataaaactgttggtgctcaggctcagccggataaaacggcttggcagcttcgatttgcgtcacaatcggatcactgaagcgcccactagcagctaaggccgtttttgaagcctctgcagcttcgcgttgggcatcatccttcacgaaaatcaccggtcgataattatcgccgcgatcctgaaactgacccatagcatctgtcggatcggtttgctgccaatagatgtccaacaacttcggatagctaatggtgtcggcatcgaaggtgatttctacagcttcagtatgtccagtggtgtgagacgaaacctgttcataggtggggttggcgacatggccgccagtgtagccggacactacattcaaaatgcccggctgctcttcaaagggttcaaccagacaccaaaaacatcctccagcaaaaatagctgtttcttttttcataaaatattcagcttctttccaatgatcactgattatccgggaggtaaactgcgaactctaagtcatcgttcgtcggatctagtttagttgcccgaagcgtcatgccattttggagtttaaattggctcaattttagcacaacgtttcctgccttactatcaagactaacccagctagggattttataactatgcccaatatagctcattacgaaactaatcgggactggcaatgtaccgacgttcaatttctttgactttagcaaaacatcgccatttttaagtaccaacggatcaaaggtcaattggaacttgacattattgccaagaaatttgaacgaaccattcaacgccgcctcattattgccaagggtgacggcgtatttaattgggctgtccttcagataggtttttaaataatgtgccatgattcggttggcactactcttggtgactttaaccgtgaaaaccgggtcgtttgaaatcgtcttagtctctgtggctgtgttcagtgaaaccggcgctaagacggttttggtaaaccaaattccgctacccaagataaggccaatcaggattaaaaatgcccatttccaccagttaatcattgaccagctgatcgatttttgtttgcgctgccgtttcttttctgtcaccctaatcactcccaatctttctttgtggctgttagtttcgtcatcaattgtttagtcatttgcgcataaccggcattattaggatgaaaatgatcttgcgaaaagatcagcgggttgccatctccagatgttgcttccttcaaagcctcttttgcagaagccttgttggcgactgtctccccatttgataagaccttatcgatgtcaatgtaatagacacgttggaagccttgcaaggtcttttgcgttgcctgattccacgcgctcacgctattagtcatcgctgtcatttttggaaaataaacataaaacggattatagatgccaaaaacataaatcggtgccgttgcgttctccttacgaatagttgtgagtaaggtcgttagatgtttctgaaaagccgtgctaccagcagtgatctctttttcagacaagctaagaaaatgttgctgcaacacatgcatcagatcattgccgcctgccgtcacggtaatgatattggcttgcttcaaatctgtacgaatcttcgcctgtttattgatgcgactaagaatctgggtgctggtgttaccactaacaccatagtttttcgtcgtgacttgatattggccggtagcttccaaatcggcctgagtgagtccaacaaaaccaccgttattcgtggcatcgccaacgccgtatgtcagcgaatcgccaaccgccgtcagcttgagttgcttcggctgatcagccgttagtttgacttgactgggcgcagcggcagggccgaatacttgccagcttaaaaaagccgctataccggctagcaaaatgacgccgaatgaaataagaaaactttttaacttggccatggtgcctcctgtgtttctggtcaaatgactggtattaataggctattgtacttgacgttgtacaaattaacaaaggcgctccgtctgaatgatcattgacaatgaccaaaaacagtcgacaagggcgcccagtttgattcaaaaatggtgccggctttgcttctctctaaaatcagggcacaagtggccgcagatgcccgcctaaccgttttaggcatcaccagctgtcgttgccttgatcatgcctgaaaccgtgcatacggcgttttcaagccacaagtattcgtgctttaaaaaagccggcgcttccgccggccagttaaattttattaaaaattaatcaacgtagtacgtaattgcaaacgcacctggccctgtatgggttgcaatgactggatcagtcggtcgcaccagaatcgggacactcggtagcacttctgcgatgcgccgaccaatgtcttcacctaattccttagcgccggccgttgaaataccaacacttttgatgttgctgagtttggccattttagcaattgtttcggcgatgaaattgttaatcgtcttcatcccccgacctttgcgtaaggctttcaattcgccattttgcagttgcagaatgaccttgatgttcaaaaacgatgaaattaagcctgaaacacgactaagccggccacctttgaccaaattgtctaaattcgttacgccaaggaccagtgtcgtgttgtcccgcacttgctcaagcttatcaagaatcgttttcatatctttgccggcttcggccatttcagcagcgactaagacctgaaaagccatcgctcggtccgtgaactgcgagtcaatcaccgtcactttgcctttcgcaatttgagccgcttgccgcgaagaattcaccgttccgctgatcgtttcagtcatatgaattgccaaaacttcgctgccgtctgctgtcagtttgtcgaaaacatcggcaaacgtaccgacagctggttgcgaggttttgggcaggttttgcgccgcagccatttcatccataaaatcatcccgtgtgatggtttcgccatcaatgtaaacggtattatcaatcataatggtcagcggtacaaccgtaatgttatgttggctgatctcttctggagtcagttgaacggaagaatccgtgacgatcttgatatttgccatgtctgagccacgctttctgttaggttcgtttatcgaactcattatagcaaagtccagaaatattgtcagtacatattatctagttatcataactagattaagttgtattgtgaaacgtaccatgctaaaatcgtaagtgaatcgaagcgtgcccggcaattctcgtaaagaaatctgtaccggttgcaccaaggaggtagaagatgcgcgtggcaaaatcaaagcattatgaatttaataatgaaatgtttagtgcgataacccatgcatttgccttagggctggcagtggttggcacgattgcgttgggtattaagggcgccaatagtggcagtcagcttgagttaatcagttacttaggatttgggatttccctcatcatcttatatacggcttcaacggcgttccacggtttctattttagcaaggcgcgccatgtcctacaggtcctagatcactctggcgttttcatattaatcgctggctcctacctgccttactgtttggtcgcgattggcggaccattagggatcggcttgctaattgccatctgggcgctttgctttggcggcatcctctacaagctgttcttcttgaatcgcttcaagcatctggaaaccatgatttacgtcattctcggctggctttgcttaatcggcatggtgccactgtggcatcacttaggaccgattggcttctggttactggttgctggcgggttagcatacacaggtggcgctatgctgtacctgcaaaaaggcatcccctacatccatgtcatctggcacctgtttgtcattctcggcagcctgtgcatgtacatttcaatttaccttttcgtttaatgctaactatataaaaaagatcggctcgctccgtcagacggagaagccgatcttttttgcacatgagtcaattttagttaaaaaaacgaactacaaatgcacataactatttaagttccttaaaaaatttctttagctgctaaacgcgtcagatcatttttgcttttgccaaacttcataagtatgcgtcaaagcggggttttgatcttcgacagttcggcttgaggttttagtaaacgcatcccaatctagtggaatcattttagtgtcacctgcaaaactgccagctagacgggtcacgagcaaggtatcaaccatgtctttaaaggcgctaaagatttgagcaccaccggcgatgactaatgcctgatctgcatgttccttcgcataatcaagcacttcagcaacctgatgcaagacaatcgcgcctggtgcctggtaatcagcctggtgcgtcaaaaccacgttcgtacgatctggtaatggccgttttggaaaactttcgtacgtgcgacgcccaaccaccatcatttttccttcagtctgagtccggaaataatgcaaatcatctggcaaatgccatggcaaatggccgtctttaccgattacaccatcccgatcctgcgcccacaaaaatgctaccatttaaaatccccctcgtttttgatacgtctgatggtactgcaatcagtcaaaaccgtcacttaaacagcttcgatatcgccaataataagctttctcgccgacaaggcagcccaagcacgtgcttcgtttaaacggcaactggtgccttaatggccggataaggatcataattcaacaatttaatatcttgcatatcaaaatcaaaaatatcgtgtttatccggattcaagaccaaggttggcgcctgccgtggcgtccgcgttaattgttctttgatttggtccaaatgattgacatacaagtgggcatcgccaaatgtgtgaatgaagtccccgacttgcaacccgcattcatgggcaacaagatgggtcagcaaggcatatgaggcaatattaaacggcacgccaaggaaaatgtccgcagagcgctgatacagctgcaaggaaagtttgccatcattgacataaaactggaagagggtgtgacaaggcggtaacgccatggttggcacatcttctggattccaagcggatacgatcaagcgtcgcgagtatgggtgcgtcttaatctgctcaatcacatcccccagctggtcgatggtgtcaccacgactggtatgccacgcccgccattgcgagccataaaccaatcctaaatcaccgtatttagctgcaaatgactcgtcagtgagaatacgttcgtcaaacttggccatctgttcacgataactggcggcaaattcaggatctttttggctgcgatgaccaaaatcagtcatatccggaccatgataatcggggctggtaacccacttctcaaaggcccattcatcccagatgtgatttttgtgctgcaataggaaacgaatgttggtgtcgccacgcaagaaccaaagtaactcgcttttaatgagaccaaagggcacctttttggttgttagtaaagggaaccctttgctaaggtcaaaccgcatttggtgaccaaaaatactgtacgtgcctgtatgcgtgcgatcaggcttgaaatggccttcatctaatactttttgggcaagatcgagatatggctgctctaacattgtcttcttccctccagtgggcgtgtgttcaaacatactgatccagttcggcaaatcggtcgaattttttatcaattgtttggttgatcttgtcaatttgggcttgtaagtcacctagtttgacataatcttcaccgttgacttcggccatagctgccttgactttggcgagtttatcgtccaactcgtcaagctcattttggagtttatcatactctatctgctcagcatatgtcagttttgttttcttctttggcgcggcttttttcggtacagcgtcagcggctgatgtttttggtttggctgccggctgcttggtttgttgctgagccagataatcagagaattcgcctaccgctcggtcaatccgcgcgttgccattgaagatcagcaattgatcagccactttgtccaaaaagtaacggtcatgtgacacggtgatgacggtgcctggaaattgatccagataatcttcgagtacggtcaaggtggcaatatctagatcattggttggctcgtccaaaagcaaaacattaggttgacgcatgagcacctgtaacaaataaagccggcgtttttcgccgcctgacaagcgaccaatcagcgtaccatgcatactgcgcggaaaaagaaattgttccagcatttgggttactgacacgcgttgaccatctgcttgcacgacttcttcgccaacctcctgcaagtaggtgatgatgcgtttgttcggatccaaattggcactcatctgggtgtagtagcccaaatgaacggtctcgcctaattcaatagatccgctgtccaatttttgtttgccagcaataatattcagcaatgttgacttgccagcgccgtttttgccggtaatcccaatgcgagtgcctggttgaaccagccaattaaagtcttttagaatcggctgatcgtcaaactgcaaactggcatgatgcatttcgatgacttttttgcctaagcgggcgctagcaatctgaatgggatccaactgctggtttgcttccggtgccgcatctttggcagcttgcaaggtctgaaagcggttgatgcgcgcttgttgtttcgttgaacgtgcctgggcaccagcatgcatccaagctagttcctgcttgtaaagctgggcctgcttgtgattagccgacttttcggcctccaattgctcagcctttttggcgacataagcctgatagttgccttgatactggaataaacggccgcggtccaattcaaaaatccggttcgtcacgcgatcaagaaaataacgatcatgcgttaccacgaccaaagcgccgcgataattgctgagatacttctcaagccacgcgattgaatcgaaatccaagtggttcgtcggctcgtccaacagcaataagtccggcgattcgatcagcacttgggccagaccgacacgcttttgctgaccaccggaaagatcgccaacacgcatgctcaaatcatcaatgtgcagctgcgtcaaaattgttttgatatcggtttctgcagaccaggcatcttcttgcgtcatgcgggcatctgcttttgtataagcggcagttttttccggattcataggatccttggtatattcggctagtgcttgttcatattggcgaatcgcttgaaaaaccggtgagtcaccatgataaatggcatccataatcgccaagtcaggatcaagatcgggaatctgagccagatagctgatgcgatattgcttgggtgttttaatttcaccagcatcaactgaatcaagtccggctaatgcgcgaataagcgtggttttcccagcgccattcaccccaattaagccaattcgctcgccttcgttaattaaaaaatcaatctgattgaataattgtttgtcaccatatgccttactcaggccttgcgctgttagcgtctgcatgttgtccctcatttcactcgtatcgttgtccatcttagcaagaagcagcgcacaagaaaaggccgacatcaatgccgacccgtacgtgatcacgattagatccgcggatattcatcatccacggtatgtttttcatcgatcacaatataaagatgaccgtttgctgcaagcttgctactctggtactcgttatcaagcccgcttggatccttttgcttgaatgggaagtagatttgaacgcgctttttgtcttccgcgttaaagaccaagtccatcttttcaatatcttgatacttagtggcgcgaccaaacatccccatctccagcgaaccagtgttgatatcgcttgacttgacgtggtcagcttcaggcaaaatctcaaccttaaagctcttgcaaggatgaatctcttgaatctgaccgccgtgaatgcgtccgtaactcgtggttactcgactgatccagacgtccgccagttcatcatgctcaacagtccattcgtcaccgttacgaaaatgaaaaatcaattgctcaaaaacatgttctgccattggaaatcccccttcactgtcatgcagaacgggttggaaacgcactggtggccaactatgctattttaaagccgcccagctgatcaatcgtcctgtttgacgttgttgaatgtgcttacatgctcatcataacacactcacaaacgatcttgagacatttcagttgcgatcggcaacaacttttttagttcatttggcaaagctccagcgacgacacgctgctcgatttgattgagtgctttgcccatcgctggcccgggacggacccccgctttaatcagatctgcaccggtcagcgctaattcttttttactatgaatcggtaaggccgcgtaagcctcagctagctgctgctgatcaaagtcaggcgtcagcagtttttgaacctcgctagccgttgtcacggccgcttcaccagcttggtaaagatcccaagcagtcggattcggcatcacctgcagtagcttgacagtttgcgtgaccaatgtgatcagctcattggattgcttccaggcctttagcatcgccagcggctgtgttcttaaaaggaaaatcaatgccgcccagccgcttgccaaactggtcagctgcgtatcaggcaactgagaaaattgcgttaaagctgtttcatgagccgccattttcggggcgtaggcaaacaagcgagtctcaataaaatcttgcaagccagcgcgtcgatcaatcccagtcagcaaccgattaaattctgcggcgactcgttctacagaaatgtgcactaacagtttggcattgtcggcgattgccgctttggtggctggctcaatgccgaaccccaattggctctcgaatcgaactgcccgcatcatccgcaaagcatcctcatgaaaccgttcatgaggattacccactgcccgcagctggtggtgctgcaaatctttcaggccgtcaaacaaatcaatgatcgtgccatcatgccgaacagctaaagcgttgatagtgaaatcccgacgctttaaatcttctgctaaggagcgcacaaaagtcacatgatcgggccggcgaaaatcctgatagcgcgattcggttcggaaagttgtcacttcatagccagtcccgtgatcaagcaccatcactgtgccatgctcgatgccggtatcggctgtccgcttgaaaattcgcttaatttctgccggatacgccgaactggcaatatccacatcgtgaatcggcagccccagtatcgcatcacgaacactgccgccaacaaaataagcttcataaccagcagcttcgattttttttaaaatcggaatcgctgccttaaaatctggctgggtcaaatctagtcgcatttcaaactcctttttccaaaccggcaaccaccattaccacaattaagccgaaatatgacatttctgttagaataagcttaaattcttttttgggaggcggcctatgtcacgcaccacgcgtacttgttgggatcttttaatgattgttcttggttgtgctttatatgggttcgggcttgtttatattaatattgcgaatcacttggctgaaggcggcgtcaccgggattaccctgctaatccgctattggtggcatctcgatccggcatacagcacaattctgctgaatattccgttgctcatcgttggttacaaatttttaggcaaacgcgccctagcttacactgtttttggcaccttgatgctttctgcttggctgtggatctggcaacgggtacctttaaccatcaacctcgatcatgatctttttatctccggggttttagctggactgtttggcggttttggcagcggcttgatttaccgccatggcgggaccaccggcggcacggatgttgttgcccggatagttgaacaacagaccggcgtgccaatgggacgaaccttgttggttttcgatgccgctgtgctaacgatctcgttgacgtatctgaacatcgaactcatgatgtacactctgcttggtgcctacgtgttctcacaaattgttaactttacgctggatggtgcttacgcggcaaagggtcttttaatcgtctctgacaaaagccaagaaatcgccactgccattatgaacgaattggaacgtgggacgactttcttacatgctgaaggcgggttcgcccacgatcgcaagcaggtcgtttatgctgtcgtttcgtcaactgaaatcgcccaaacaaaacggctgattgaggccattgatccgcacgccttcatcagcatccttgatgtccatgaggccttgggcgaaggcttcacctaccagaaaaaacgccgccgactactatttggtcattgattcgcaacgattaatccgtctcggtgttgagttcatccaaacgggcctgcatctcgtcgtcagtaggtaccagtttcaaatatcgcactaaagcggctttcaattcggcgcgagcaccagtcgactggaagaaatcaatgatatcgtggagaaagtccggggaatcctgaaagcgattgaacgctaaaaggtaattctcacgggcttttttaatattctccaaccgatcgtagcttttagccatattccaataaatttgtgggtcaacatcaccactacgatcgatttggtcaagaaagtcaacattttcttgatcacgctcttcctgcaccaaaaagttgctccaagcgagcatattaccttgatcttccggatcaatcgccaaggccttttgtaaatacgtctcggctaatttgacattgtcttcactaagcgctaatttgccgcctaaggcatatagcgttgggttcgtatcatcgaccatgacgccggcttgaaccgtgtctaaggccttgtcaggctgattctgggcctcataagcacgagcaagtggcaaatacgcattggcgtaagttggatcactgtcaatcacggcttgaagattggtgatcgctttagccggatcatcaagttgtaaatacaagccacctaattcgaaccggccattgagatccagtgcatcaacaccgacatcttcataagcagccactgcgtcttcatactgccctgtttgcgctaaactggccgccaaccgtgcttcgatgttaaccccagcaagttcagttgtaccggctgctagcagctcgttataagcactaatggcctcggcaaaatgaccccagtcaaaatagaattcgcctaaagcgaaggtcaccaccggctcgtctggcgccaatcgcttcgcctcaagcagtttttgctcactaacctcatataaaccaagtgtttgatagacgtcggcagcgctcaccagactttgaacataggcaggatcacctggctgaatgcgactaagataattcaaggcggcgtctgtatctccgtcagaaactgcaatatcagctaaagccgtcgccagatcgccttggtcagggtatcgccctaggagcccctgataaagccgcttagcctgaccgttaaacccaagcgcatacagttcttcggcaaggttgtattgggtttcgtcgtcatcgtgggccaatacttgggtgaatagctgcttcgccgtttccatctggccagcttcaatggcatcaagcatttcttttgcgtaactcatggctgcctccgttgatttcattttataaaaagcctaaagattgtcgttactgctagtttaacattgcgttttgctgattccgaactgatgagcatcaaaagctctccagcaacacttgactgcgcataccgctattgtcgctcgtcccgcccctggtcgctggcgaatgacgccaaaacgcgcaaaaaccgagtccagatagactcggtttttggttgtttcatcattgcctcaggtgaaccgcttatttaacggcgtccttgagtgctttaccaggcttgaatgctggtaccttggatgctgggatcttgatctcggcaccggtttgtgggttgcggcccttacgagcggcacgctcacgcacttcgaagttaccaaagccgatcaactgaaccttgtcaccctttgaaagggagtcttggatagaaccgaatactgcatcaacagctgcggttgcatccttcttggtcaaaccagttgcggttgcaacactttcgatcaattctgctttgtttgccatgaacatttcacctccatattgattagatgcgttaacacctaaacatgcccattcctgacctctcaggaatgaagaaacaatgataatatgtatcaccatttcaggtttaaacatagcatagcaagcccgttgtgacaaggtttttgccaaactttttgctgtctgatcaaggatcggttatcgaaaatcacgatttttgacatatttttttaaatgaaaagacaatattcagccatcgccgaactacttgcgtttacgtgcgatgatgtgaatcggtgtaccggaaaaatcaaaggcctgtcgcaattggttaatcagaaatcgctcgtacgagaagtgcagcaggtcgggatcattaacaaaaaccacgaaagttggcggtttgacggcaacttgggtcatgtaataaatccgcaagcgttttccgttaactgtcggtgtcggtgtaacagtaatggcatccattaagacatcatttaggacactgctttgaattcgccgagtttgattttctgaaactgctacaatcatggctggcaagctctgtaaacgctgtttcgtcttggcagaaacaaaaataatcggcgcataatccagatattggaactcctgacgaatcagattttcaaaatccttcatcgtgtgattatctttctcaactgtatcccacttgttgacgacgatgatgatgccacgaccggcctcgtgggcataaccggcgacctttttatcctgttcgcggataccttcttcggcgttgatgacaaacaaaacaacatccgaacgatcaatcgctcgtaatgcacgcatgaccgcgtatttttcggtgttctcgtaaaccttgccacgtttacgaatcccagccgtgtcaatcatcgtgaaggtttcgtcaactgcttcgaacttcgtatcaatcgcatcgcgggtcgtgccttcgattggactcacgatgacccgattttcaccaagaatggcgttaactaaagacgatttaccgacatttggccgaccaatcaggctgaacttaatcgaatcgtcttcaactgacttatcttcggatggaaatgctgctaaaacagcatccaaaacatcaccaaggccaatcccatgagtcccagaaagtggatagggttcgccaaaacctaatgaataaaaatcgtaaatatcttggcgacgttcagggttatcaaccttattgactgccagtacaaccggctttttagcccgataaagaatctgggcaacccgttcatctgcatcagttaccccgctttcaatatcagcgagaaaaaggatgacatcggcttcatcaatggcaatttcagcttgatccttaatttgcgccaaaaaaggttcatcgcctaagtcgatcccaccggtgtcaatgacagcaaattctttaccaagccattcactcgtgccatagatgcgatcacgcgtgaccccgggcgtatcttccacaatcgaaacccgctcaccgagaatacggttaaaaatggttgacttgcccacattcggacggccaacgattgctaatgttggtaagaccataaaacggcctcctttctgtgacggcgtcatgggatttgtttcccataaaaaaagttgagccaaggctcaactttttaggttcaagatgactacttgttatcatcctgatcatcattgcccttagcagcatctttcaaggcatcgcctaagatgtcgccaagtgagaagcctgaatcatcttgctgatattcagcaggaatcgacgtggattgatgacgatcattgccacgacgaggacgtgaagaacgacgacggtcaccacggtcgctattgtcacgactgctgttgccgccttcatgagattcttcttcagaacctgctggacgttcctgcaaagccttgatggacaaagcaagacgatgtgcatcagggtcaacggaaagaaccttgacctgcacttcttggccttccttaaggacatccgctggggttgctacgtgttcgtgagagatctgggaaatatgaaccaaaccttcaacaccagggaagacttcaacaaaggcaccaaaagtggtcaaacgtttaactgtaccagtcaaaacagagccggccggtgccttttcttcaatgtcgtcccaaggttgtggcaacgttgctttgatggacaaggaaatgcggttgcgatcaggatcaacgttcagaaccttaaccttgatttcttgaccaaccttcagaacatcgcttggcttgtcaacatgatcaaacgaaatctctgaaacgtgaaccaaaccatcaacgccgccaagatcaacaaaggcgccaaagttggtcaaacgagcaactttaccttcaacggtgtcgccaggttgaatcttcgcaaagatttccttgcgtgcttcagccttgctggcttcaacaatcgcacgatgtgaaagaatcagacgattttcacttggttcgatttcaatgatcttgaattcaagttccttacccttgtattggctaagatcttcaacaaaatgatcttcaaccatggatgcaggaacgaagccacgaacaccggcattaacaaccagtccgcctttaacgacgctggtaaccggagcggtgatggtttcacctgcttcatacttagcttggatttctttccaaaccttttgcgcttccaaacggcgcttggacagcaggaactgcccattttctttatctttgccaaccgttgaaagcacaactaaatcaagcttgtcgccgacttttgcaacatcgtgaatgtcatcgattggctgagttgataactccttgatcgggaccacaccttcaacgcctgttccttcgatcccaacgatcaattgtttatcttcaacggcaagaacgtctgccttgacggtatcaccaatctttactgtggtgacactcttaagggcgtccgccattgtttcggtgttctcattaacgttattatcactcatgccaaaaaatcctcctatgcagctgtatactggatctattgtacttgaaaacgaaccaaattaccacctattattttaagcccttgactatttcgtctttacttggcctatcagggataaaattcgttccaccacttcatcgatggtcattgatgtcgtatcaattctaatcgcgtcagaagcctgacgtagcggggaaacggcccgatgagagtccttgcgatcgcgttcggcaatctcctgttcgagggtagctagtggtgtctcaatgcctttttgaatattttctttgtagcgtctttttgcccgttcagcaactgatgccaccatataaatcttcacttcggcgttaggtaaaacggtggtgccaatgtcgcgaccatccatgacaatattgctggatgctgcgatatcccgctggcgtttcactagttcagtacgtaccttgggtaacgctgacacttgcgaaacattgttggtcacgtctggttcgcgaatggctaaggtcacatcttcatcattcattaagacgcgctgttcagggtcacccggttcaaaccgaatcgtcatgttggcgagatgctgcatgatagccgcctcatcgccaaagcccagctggtctttgatggccatgtaggtcacggtgcgatacatcgcgccagtatcacaatagataaaccctaactccttggcgactcgtttcgcaatggtacttttcccggcactggccgggccgtcgatcgcaatttgcatactttcctccacaacacacgaccctgctcatgccaatacgcatgcagaacagggtcgtgtcatgattatttcactttcaaaaccgtgcccggtgcaatgctggaacccgcactcataccgttcatctggagcaactcatctaaggtcattccatgattgacagcgattcgataaaggttatcgcctgcttgaacggtatatgaactgccagccgtgctggcacttgcttgctcgctaggctgcgctgatgcactggtctgttcttcttgttgggaagtaacgcttggtgcttgactaggctgagtcgacgctgcctgtgacgaggccactgaagtcttcgaggctttggaagccttcgatgatttctttgattttgaaactttactgctctttttagtactttggatcacaacgcgatcattagaaaggttagcgccattgcggctttgatcaccagaaattttgacataaataattggtgccaaaaccacaagaattaacaagatcgctaaaatccaggtcaattttgaacttccttgcctttttttcttggtggcaacgcggctcaaattaccttgatcatcacgatcatcgtcaaacagcgtttcccaaggtttacttggatcctcaccattggtgcgcttgtgatcctcattgtcatgttggtgttcatctttttccgccatcacgatccccctcactactgcgcttattgtatcatattgaccagcgtcagggcgtcggttatctaaagatttggtgaaatactgcctgccaagaagctaattttggttgttcttgtggcacttcaggctgtagttggcgcaatatcgtagtggtgatctcgccacagcacaaagccgtatgcggttcaattggcgaatcaaaatgttgcagcagaacagcacgacggcattctgattcattaacaaaagccgccatcgctgcgaaactggcctgtttctcagttagtctgtgctgtaattgctgctgcgtagcctctaccgaaaagccagcgtctacatacgcttcaatcagattgatctgcggatcgtcaaaagtgcgatacgcctcaggatgcgcatagatgagccgaatcaatgccgcatctggcaacatccccgccaaaatagcgccgtgctgaacatcatgatcggtcaccaaaagcgccgctagactctgcttgccatcacggccggctcgtccgattgcctgataataagcttcaagcgattccggcacataggtatgcacgacgaaccgtacatttgccttatcgatccccatgccaaacgcactcgtcgcacagataatctgcaactgatccgattgaaactgtcgctggattagatcgcgttggtgccgatccaacccagcatgataaaaggccgcagcatggccggctttttgcaatcgtatcgctaacgtctcacacgcggctcgggtagcactataaatgatcgttggccccaccacctcgtgcaataactgatccagtcttaaagccttttccttatctgttaagccggtctcaacgccaaggaaaatatttggtcgatcgactgacccagccaaaattgctggcgattgcatgcttagatgttggacaatgtcacggcgaacgggctccggtgcggttgcggttaaggcaagaatcgcatctgcttgcaattgttggcgaacttgtcccagctgcaaataagcaggtcgaaaatctggcccccactgtgagatacaatgcgcttcatctaccacaaataagcctagggtcagtcgtttgagcgccaagagcacatcagcgcgttgtaaaatttctggtgagacaaaaatatagtggtaacttgccaatcgtttgagaatttgggtaaaagcaaccggtggcatttgcgctgacaaggcaatgacccgtttttctccagctgcttgcaaacgaccaacttgatcattcatcaaggcaatgagcggttcaacaattaaacttggcttgttactgatcaaagtcggcaattgataacagagtgatttcccgctgccagtaggtaaaattcccagcgtgtcatgtccatccaacaccgattggatcaaagccttttgtccaggtcggaattcttgaaagccaaaatgttgttgaagttgtgcttcaagttgtgacacgcggccacctcccttgaaaacttagaatctggaacaatcgaatctgaaaaaaagtacttccaggaatggctgccaacaatgcctgatgatcgtagatttgcgtcacccgatcaagtgcacggtgaattttaagcggcaccaaatgctcaatcggcaacgtttcacccataattgccgcgagcaacagatgttcattaatcgtgctttgcttacggtggctgcgattagcaattgttggcaacgccatgccagcgcgtgcttgcgccaaggtctgccgcgccggtcgcgaaacgaaatcgcggggtccgccccacaacgccgtccacatactcctagtattagcgagctgctgaaccagtgccgctagcgcatcgagtcgttcaaagtgagcctccaatgttgctggcatcagttgtccggcgtagtcatggccaatcatgttagccgctaacgtgtcagctaattcagtcggcagtccttgaaaaaggctgcttaatgttgtaacggcagctcgatgatcgacctgctgataccactgcttcacaacttgctgtgtcgcccaattaacacttattggttgataagcactgttcgcataactcgcctcagaaagcacttgcacgcctaagaagaatcgcggtgcgaacaccggtaagttcatccacggctgataatgtgtcggtaacggtaactgggtaactgctgcttgcttgagatgctgcccgttttccgttaaaatcaagccggtttcagtttcacgcagcattctttgcactttcaatgtcgtgatggccgctgaaaaagcttcttttgacagacttggataaagatgcaaccattgcagttgttggtgaatcaaggcggcgtaaaggattgaaatggtctgcttaccagttaagagtccaaaaacagcccgctcacgccgcggctgctcactgaaaaattgaatcacaaaatcggtcagcaaagcttgtcacctcatttctcaacattgctgtttaagtgttatgtatcgtattaaggagtttgaatatggctttatatggcagagtagaacgtccagagtgtattgcttgcggcttgtgtcagatgttggcacctgccctttttgattacgatcaagctggcattgcttattataaaccagatcgcaacaccggcactgagcctttaaatgatcaggccacgatcgactttcgattggcctaccaacgctgcccgacccacgctatcaaacgtagcgatcacccgttcaacgcgcgcccgttttctgagacggggaaagcttaactgctatagtttcagattacgcgaaccaatagcacgtgatccgaagattgacgtgattcgtcgcaagacaatcgattttacgctaaagaaaaacatccgtcgcttaacaaagctgacggatgttttttagttgattgattaaatcattaatgactaggttgaatctcacgccgagctaaccacggtgccaaggccttggcaatcgcgaagaatgcaactgaggccacaattcctttgattaagttgaatggtacaacgccgattaaaacgtaacgcgtcagcgacataccaaggttaaaattgaagaccgccatgtacatcggcgtgatcaccagccaattgagcacactcatgacaactgtcaggcttgcggtacctagtaccagaccttcaatttgccgcaacaaactgtgcttgccacgaatcgtgtaaacaactggaagcaggaacccaacgctcgcaatgaaagctgccagatcaccaattaaattgacgaccccgccgcctgttaaagcaaaatgcacaagactccggataaatgcaacgccgatcccgccagccgggccatataataacccaccaagcaaaacaaccagatctgatagatcaagcttcaggaacgggaaagcaggaatgatcggaaatgaaaacatcatcaaaacatacccgatcgccgctaacaacgcgataccaaccaaacggtgaaccttggaactacttgccataaagcattacctccgtgaggccgtcttccggaacttaaaaagacctattcctccttcagggggaataggtcttgattgaatgtagattcaaaaaagccccatcttcttccatctagactatcactatcggtaccggagtcacaccggttccaccgcataagcgggtcgcggactataccgccggtcgggaattgcaccctgccctgaagacgaaccaagattatttaattaacaactttactttagcaaaggcgccggaaaagttcaagcgtttgcactgaaaacgttaacagtttcaccaactacttattttccgattcacccgctagttttcgcaaggcttgcagttcttgcggcttgattggccgatgttcacctggctgtaaccccaccaaagttaagttgccatacgcttcccgagatagttttagaactgggaagccgactgctttaaacatctttttaacctgatgattcatgccttgatgaatggtcaaagatacgatcgccgtttttttagctttatcagtcgagataatgtctactttagcaggcgcagtcatcttgccatcaacctcgacacctgttttgagcggagccaaggcaggtcgattcggtacaccttgaaccttggctacatattttttctcaagcgcgtaacgtggatgcatcaaatggttggctaaatcgccatcgtttgtcatcacaagtaagccgcttgtatcgtaatctaatcggccaactggataaagacgctcagtaatatccttaaagtaatcggtgacgacatcacgtcccttattatcttgaacagcactaatcacgccgcgcggtttataaaagagaaagtagcgcttagcctctttgccaatcggcacgccatccacttcgacttcatcatgcggaccaatcttgatgcccatttccgtttcaatttggccattaactttgacatggccagttgcaatcaacgtttccgcatgtcgacgcgaagcaataccggcatttgcgataattttttgaagccgttcagttttggttgtcatgttgttgattttgctccattttcttttcgtctatagtagcttcctcttgatcatcatcgtgccgaaatgccgtaaacaaatcaacctcacctgtatcggcaggcgcatcagctagcggtggtaaatcagcaaggcggttcaacccaaaatagtcaaggaaaaactgagttgtcgcatataaaattggtcgaccaggggcttcttttcggcctgcctctttgatgagttgtcgcgcagccaaggtagttaatgcgcctgagctttgaacaccgcgaatttcgtcaatttcaatccgggtaatcggttgctggtacgcgataatcgcgagcacttctaacgcagcctgcgataatcccgcagctggcggcccggcaaaatatttcttgattgcaggtgcgtacgctggtttggtcagtaaataataccggtccgcaaactgctgcaattgcaggccacgctgatcatcagcagccagccgttgtcgatacgcgtctaattgctgtcgcatcgcgctttcgctgatttctaaaatgccggccagctcacccagcgtcacgccgctttcgccagctgtgtaaaggattgcttctagtgctggctccattaagcagcctccttcaaggtcactgtgattggatcaaatggcgcctcttgttcacaaataacctgatcatttttcatcaattcaagtaaagccagaaaagtcgtcacaacctgctcaaccgactgaaccgacagtaaatcagcaaagagacattgcccgcctttttgcaatgtctgtagcacttcgccgattcgtttttcaacggatacaggttcggtttcaatgtgggcaatggtttggcgagtggcttgttgtgccttcatcacacgcgccatggccgcttgtaaatcaactaatttcaccgaacctggcgcaagtggcaaagccattttggcgtctggcaatgtggttggcttggcataggcttgtgcgcgtttagcctcgcgtgctttcaaatcctttgccgcttcttggtagacttgataggtcaataattgtgccactaaatctgctcgtggatctggcgcctcatcaggagccatcgtttcgggttcaggttgcggcaacaaaaggcgacttttcaagaccatcaaattagcggccatgacaaaataatcgccggccacgtccagcgccagatcctgcatttgatgcaggtaatctaggtattgagcggtgatctcagcgatcggaatgtcgtaaatgtcaacttcattcgtccgaatcaagtgccaaagcaagtctaacggtccggagaagtcattcagcacgagtgtcagtgccatggtcatcctcttttcgaaacttgttaaaggcggcgattagtggtgcatgttcaagggcacccatcaatttcttgtttgggaaaagttcagtcagttcagtcaacgcggcaaatgccgttgcttggtcacgaaaattaggtgaaaagcttaaatgccgcaccaaaacaaagtcagcacttagttcaatgccaacgacaccaacaaaatcattcttatgtttgtatagatacaacgcatgggaatcatcttcggtgtacatcttgagttctgtctttaaatgcccgacatctttcagatccggaataaaagacaacaatcccatcgcgatcttctcatagtcgtttttgtatttaaccagcatgtttgcctccaagagatactctcgtaacactctatcatagaaacgcggcagtagcaaagggcagagcgtgaacgtatgtgtcaagcttttctcggttctacgctaatcaagtttaattctattgtccgatttggctccgccaactctctgctttctatcttagtattcgagctagactgccatggcaatgctgatggccacaatctcttagtcatcaaacatattcttagaaaggaacaccctgtcaaaatagctacccgcgcggatgcgttttatgatagaccgcaaccagatgttgattgcttaaatgggtgtaaatctgggtcgtgctgatgtcgctgtggccgagtagttcttgaaccacgcgcaggtcagcaccgttttcgagcaaccttgtcgcaaagctgtgacgaagagtatgcggtgtgacatctttttcaatgccgatacttgcaatatatgctttgaggttcttccagatcccttggcgagtcattggcccaccgtgaaaattgacaaaaacgtttttaggttgtactcgtttgagtaatttgggtctggcctcttgcagatagcgatccacccattgtgtggcttgcggactaatgggaaccagtcgttctttgtcccctttaccagtcacttgaagtagattcattgccaaatgcaattgatcaagacgtaaatcaacaacttctgaaacccgtaacccagtggcatacatcaactcaaaaatagcgcgatcacgcaatcccaatggcttgtcggtatctggtttggccatcaaagcatcgacttcttgactcgacaacgttgctggtaaatgttgggcacgttttggggtgtcaatcttggtcattggatcagctgaaattgccccttcacgcagtaaaaaccgataaaacttgcgtaaagcagaaatcatgcggctaactgaagcaggtgccttggtggcattctgctcctttaaaaaggactggatggtactgaactcctcaggaaatgtccttctttttcgggccgctagccaagccgaaaaagtgatcaaatcctgctgatagctagtttgggtggcttttgccaatccgcgttcaacatttagataatgaataaaatccgcgatcaacccatgcatgatgttactcccgagacgccttagctgcggccgtcaaaatcgtatacccagcttcctctttcactaagccagccttcaacaaatggcccagtgcgcgcttaaaggcgcctttactgatgccaaaggtttgcttaatcgcttcaggatcgctcttatccgtataagcaattcttcctgaaggatcatgctgcaaaactgccaagatcatgccagcatcatcaccgatggcctgataggcacgtggttttagcgacaaattcagctcgccattggcactaaccccgatcacgcgagcatgcaaaatttgcccaagtcgcggttcagcatcgcgctcacttggatggataaaacccaaataaaaatcatcggtcaagacacgcgttccagccatcttcaaccgataagccgtggcagtaacatcagcattcatctgttcaggcttcgcgcgatttgcaaccgcgtggatgatactttcatcagccagattgccccacatccggtcttttttgtcgactgttaaggcaaccattaattgatcgcctttttgcggccataaacggctgatttcaggtaactggtcttcactgaccacaatatctttgtctggtaagccaatgttcacaaataccccaagatccttacgcacttcgactactttcgcaaaagcgtaatggtcgcggccaactgtcggaacttttgtggttaaccgagcctgcccttgcttattttcataggcaaaaccctcaacatcactgccaacttctggaagttcagccaactcactgcgatcaatggccaaagtgacgccatcatgctgagcaaagacttccgtgtcattgtgatccgtcacttgtgcggtgacaatactgccattaaaattcatttatttttctccttaaaccagcgccatagttgccggtcattaatgtccaggaacaagattaaaaacggtcaagataacataggtgaggccactggcgatcaccggtccagccgcaatgccctttaagaacacgacaccaataattgtgccaaaaaccaatgccacagtcatttccgggctcattgccagcagaccgacaccctttgccgacaaaacagcgactaaaacgccgcacccgatcgcaatccagccagccggacttttaatgacattaagaagctctttaaagccgatctcaccggttgcaattggcaccatgatagcggctgaaatcacagtcacgccccaattgatcccttgcgtctgaagcaatttcaaaaagttttgagtttgcgggatcagcttgagaaccatcacagcactgaccccaattatcaggcttttatttttgccgacaattgcaattgctaaaatacctagtaaaaaaagccaactctccacaggtgttccctccatcatgatgctgaccaaactgccagcgttatcgcttacgagattgcatactgtttcttattataagccactcgcacgcacctgacgacctctgctcatacatttatcagtaagttgctcaaaacaggcaacgctactgtttttttggaagaaaaaaaactcccaagtttccttgagagtttttcctaacctttaacaggtcattttgaagattaaagggcgttggtagcacctttgtagatgatcccacgacgggagtcaacagtaatgatctggccatcggagatgacgctggtagcattttcagcaccaacaacaactgggatacccatagcaataccaacaacagctgcatgactggtcaagccaccggtttcaacaaccaaggcagctgctttttcgattgctggcaagtaatctttgtcagtcgtcttaacaaccagaatgtcacccttttgcatcttagcagcagcttcttgagcgttgcttgcgatgactgccttaccaatcgtggattcgtcgccgacacctgagccttgaaccagcttagaaccaatgagttgaaccttcattacgttggttgtgccagattcaccaacaggaacaccggcagtgatcaagatcagatcgccttccttagcaaagccaaggtcttgggccttcttggttgccaagtcgaacatagcatcggtgttagcaggcttttcagcaatgattgggtaaacgccccagttgaccatcaggccgcgttgggtcttttcgctgaaggtaatggcaagaatgtcagccttcggacgatacttggaaatcatgcgggcagtgtagccggattcggtcgcagcaacaatggtcttaacccctaagttgcgagccgtgtgtgcaacactttggccaacagcttcggtgacgttcttgttactgtattccttcaatgcgaaggcatcctgatccatcatcgctgcttcggtgtattcgtcaatccgagccattgcagcaacggattcaaccggatagtcaccattagcagattcgccagaaagcatcgttgcatcggtgccatcaaagacggcattggcaacgtcgtttacttcggcacgggtaggacgtgggttttcttgcatggaatccaacatttgtgtagccgtaataaccggcttacccaaagagttgcacttcttgatcaagcgcttctgaacgatcggaacatgttcaaatggaatttcaacacccatgtcgccacgagcaaccattaagccatcggaaaccttcaagatgtcatcaatgttgtcgatgccttcttgtgattcgatcttagggaagatctgaacattaagtgcgttcttttcttcaaggagttcacgaatgtctaaaacgtcttgaggcttacgaacgaaggaagcagcaatgaagttgatcccgttgtccaagccgaaacgaatgtcatcggagtctttttccgtaatcccaggcaagttgatggcaacaccaggagcgttgacacctttcttaccaccaaggacaccgtcgttttgaacaacggtaacgagttcacggttcttttcgtccttttcggtgatcttcatgtcaatcaagccatcatcaaacaaaacatggccgccaacgtgagtgtcatcataaaggccaggataggtaacagcaactttttccttggtgcctttcagacttgcatccatggagatgcgaactttgtcaccggtgtgaaaatcgatcttaccattcggggtatcttcaagagttgtccgaatttcggcacccttcgtatccagcatgataccaacggtcttacccgtgatcttttcagcttcgtgaaccatgttcatccgtgccaaatgctcttcatgatcaccatgtgagaaattgaaacggaaaacgttggcacccgcttcaatcaacttaacgatgatatcagtggtgttacttgcaggtccaagcgtgctgacgatcttggtttttttcataagtgaaatcgctccttgaaattatttaaacagacgttaatgtcgtttgtttacgagattaaaatgttaactcttccgctaaggtgtagagcgaaagttctgcgtgatgcttggcatcaaacaaggtccgaacatcatgtgccgtgatcttgttgttttcaatgccgacagccaaagcgcctttgccttgcaacaaaagttcaaccgcgtatgaacccatttgtgaagccaaaacgcgatcacgtgcggacggtgcaccgccacgaacaatgtgtcccagaactgtcgaacgtaattggaaatcgccatgtgcggctaattccttggcaaattgatcagcgtgcatcacgccttctgccaaaagaatgaccgcatgcttttgaccacgttcacgagaactttgcaacttcgacgcaattttcttaacgtcaaagtcgtgttctggaatgatgacatcctcggcaccaccggcgacgcccgaccaaagggcaatgtccccagcttcacgacccatgacttcaatgacaaaggttcgttcatgtgaagccgcggtatcgcgaagacggtcaacagcttccacaactgtattaacggcagtgtcaaagccaattgtgaagtccgtgtaaggaatatcgttgtcgatcgttcctggcaggccaatggtgttgaaaccgtgacgcgtcaaagctagtgcaccgtgataagagccgtctccgccgatgacgaccaacgcctcgatgccaaacttgtttaattgttcgaccccgcgcaactggccttcttcttgcgcaaattgtggataacgtgcggaatataacatggtcccgccgcgttgaatcttatcaccgacagttgattcattcattttgaaaatgtcgccggcaactaacccagcaaatccataattgatgccatatacttcaaggccttcgtgcatcgccttgcgagcaacagcgcggaccgcggcgttcatgccaggcgcatccccgccactggtcaaaataccaatgcgtttcattatttcacctcatgcatattcttttgcgatttgtcccatcacaaatactcattgagtttaccacttttcagaaacaaagtccctgaaaatgagaacattttacaattttctctattcttcttgtcgttttcgcaacaccacattagccgcaccaaaccgcgattcaagatcagccatcaagctggtgtcagcagtgacccagtatcgcttatctagcaaaacactctccttgctggtcgtgtcgacagtgataaccggaattggtccatgggcagtttgcaattttttcagtaaatcggtccgggcgtcaacattatccgcatccaagcgaataaataactgtgcttttggtaaggcctcaagcaacggtgcggcatcttgaatccggttcacaatgagttgcaagtcgtcattgcgtttttcaactcgcccgttcactagtaccaccatgtcggtctcaattttttctaatgttggatatagattgggaaaaaccgtcagcgaaacggtgccagtcgcatcctgtccatccacaaacgccataggcttcccagttttggtccggatccgcttaatgtgtcgaaccagaagcaaaatatcaaccgtgcgaccttctgctaaatccaccacattgactaatgtgtattgcgttttcaaaggggcatatttgtcaaccggatgaccagaaaggtaaacgcctaaaacattagcctcttcttcaagccgttcgcctgccggcatttccggcaccacaatcggtttaggcgctagcactgaaaatagcccaacatcattgccagcaagtttaaccgagttgattaattcatctaagttcgcaattgtctgtgcccggttatcatcaaagctatcaagggcaccggcaagaatcaatggtttgaaattatctgcctttaaccacttcggctcgaggcgctgtagtaaatcgcgaaaatctttaaacgggccatttttacgagcggtaaaaatggcttcggaaaagtcacggcgcatccctttgacagacaaaagtccaaagcgaatcttcccgtcgctcaacttaaagccaccattgctggtgttgatgtcaggacctaataaagctacctgacgcgctttggcttcttgtacgtaagtccggagcttcggcaaattattcatactagcattcatcaatgccgcaaaaaaggcggctggatcatgcacttttaaatacgctaaccaaaatgcgaccatactataagcaactgcgtgagaacgattgaagccgtaattcgcaaatcgatcaatataagcataaaccgttttggcagtcgcctcagggaatccttgcttgaccgcaccttcaatgaatttatcctgttcggctgccagcactgatgatttcttcttactcatggcccgccgcaacaaatccgcctcgccaagactgaacccgcccatgacactggccacctgcatgacctgctcctgataaaccaagacaccataagtcggtttcaaaatcttctccaaggccggatcaggataagcaatcggttcttgcccatttttgcgggcaatgaacgtgtcgatgttttccattggacctggacgatacaaggcgttaacagccacaacatcttcaaaatcagttggccgcagtttgcgcaaaacatttttgataccagcagactcgaattgaaaaacgccgttagtatcaccgcgggcaaacaaagcgagtgtcggttgatcattcagcggaatctgttttggatcaaacgtccggccagtatcacgggtgacaaaatgactggcggcggctaaaatattgaggtttttcaaacccagaaaatccattttaagcagcccaagtgcttcaacatcatctttgggtacctgcgtctgttcaagaccatcgccactgggttgcaaggcaacggtgtcagttagtggttcttcagaaagtactatcccggctgcatgcgtggaataatgtcgcggcaacccctctaatgctaaagcggtttgaaacagcatgcgattttttggtgaatcagccaccaaatttttcaacggctgactctgatcgtaggctgtttttaaatccatgtgcaacaagtttggaattgctctgctccaagtattactttcaaactgactcatgccgaaaacgcgtgccacatctctgatcgcctgtttcgcgccgaacgtcccaaaagtaataatctgggccatgtgatttcggccatatttgtcatggacatattgaatcagctcgccacggcggttatcaggaatgtccaaatcaatatcaggcatttgcgctcgagcaggattcagaaaccgttcaaacagcagatcataagcaatcgggtcgacttctgtaatagccagcgcgtaactgaccaaggagcccgcagctgatcctcgcccagccccagtcataatattgaccttgtgagcgtaattcatcacatcccaaaccaccagaaagtaatcagcaaatcccattttgataatgacatccagctcatattgcaaacgctgctgataggttgtcggaatcggctgatcgtgaaaacggttagcgaggccttcttgagccagtttggtcaggtaatctttagacgcaagctgatctggcgtttggtaatgaggtagctgcggctgcttgaacgtaatcgtcacatccgtttgatccgctatctgagccgtgttgtcaactgccgcctgtagtccagcagcaacaaaaggtgcacttgcatctgctggcggttttaaccaccatggcccagcatcggttaaaactgggtcacgaaagttcaactgactaccatcaccaatcgctgccatcactttttgcgtaaaagcatcagtcggatcacgatacagaacgttgcctaacgccattaggtgaagttgctgactagtcgcaaatgccggcaatggcgtatctaaatgagcctcatccagaccaacatacaccgcttccggctttttattatcaagctcctgtaaaaaagcgacagctctgtcgtgatcgttagcagcaactgccgccgaaaatggtgaatccggtaaggtgatggcgactaagcctgtcaaaggcaataagtccgcaaaggccaccggcgaagttgctagcattatctgcgtggagatcttaagtaactgatggtagccctgattatttttggcaatcactaaaagtttggcatcatcaatcgcgatctgcatgcctaataacggcttcaagccagccgctttcgcctgtcgataaaactcgactaaaccataaacaacattagtgtccgttaaggcaatggccgaataaccgcgtgattttgctgcgctgataagattcgacagtgccaacgggctgtgtaataaggtataattgctatgaacctgtaattgggtaaacgtcatcttgccacctcgcttctattataccggaaatactcacaatttcagttgaattcgcttgtggtcgtggtaagatgacgacagaaaagagggattccatgcgttatctacctactattatctggggcgtgatcctcggccaagttgtcggcttcctgatcagcgccttgagcggcggcagctacgacccgaagacaagcgcgattatcagtgtgatcttcgttgtcattttattcttcttcccgccaatcatgcagcattttgcaaaacctgcggaaaaaccagaacattaattaaatcgtcaatgacgtcaaagtgcccgattattgctagactggcatgtctaacaataaccgggcactttgcatgtgctgacgtttttggaatgagtgacgcaagcttattttgtcacatacaggtaaagtgctgtggtggaataaccaacatcaattttgacgccgtgactcttgattgtgctaatggtcgtcgcattgtttttagacttagcatccttcgtcaatttcttaaattgcgagaaaactgacttggcatcagcaccgaccgaagttgtgagtaacccgaagtcagtggcaaacgtctgcatcttcttgctgtttttcaaaactgataatggtaccacaacggcaaaccccattgccttgccatcaacaatacttgcgcgataatcgccgcttgctgattttaagattgaatgaatgcccgtcttcgccgttgccggcagttgggatgctttggtattggcattggcctgagccatcagtgtcttcaattgctgtgcttgctgagccattgccatcttctcagttggactcatggtcgcagcgttcttttgagcattggcacttgccgcctgtgcctgttttagcttggcttgatccgctttaggtagactggataccgccagcatttgattaaactttgccgcaatcgtgctataagttccgagcgattgaccagctctcaccgtgacattagtttgcatgctaccggcttttaagttcaccttttgagccacatcgctaacgggcacattgaccacaaacgtgcctgaattgactggcacactgccttttccggcatcacttgtataactgacgcgatccacaccgcgggccgtccctttaacaatggcgaccagtccgtcacgcccatatgaggttttggtagtgcttaattgttggccgcaacctgctagcacgaatgccaataagccgaccatggtatatttccaaattttcattaaaccgaacaatcctttcgctatgcacaattcaataacgaccaacagcataagcgttccttcgctgcttgacaagcgaaatatgactcactgtcacattgacggtaaaacattaaagttttgatcagcagttgccttgattaatgggtgttcctgcaaataatcggcaatcaattcggtcatatctttttgattttctcggatgactttatcaggaccaaacattttaaaattaccgccaccagccgcacggtattgattaaccgccacatcataagtctgagtgggctgtactggcgcaccgtgataaagcagccgagttactcgactgcccacgggctgatgaatatccaaagtataatcaatgccctgatacatgtcataattgtaatgctgaggttttggccgctcaaatcggggcgtcaccgtcaacttgccatcagcatctagcgaaaaatattcggcacactgttccagagctgcttttaaatcagcgccggttaaccgcaacacagctagcgtgttgggataaatgtaattcgtgacgacatcccgcatgtcgatggtttcaccaaaccctcgcccttcattgttaaacaaagcggtgcccgaaatgtcagtatcggtgctggccatttggactttttgaataaactcaatgtacggcacctcatgaacccgcgcagcaaatggatcctgaatgcgcatatccccttcaacatgagctaatggctggtctaaccaagtttcaacagtttgattcagatcagccgctgactgcaaaatggttgggctcgcaattgatccgcctgttttgactaacacggctttgctagcagtaacttggtagccgctcgctgtctgatttaagtcaagtgtgatcttaccgatcgcttccccgcggtaacctggctgggtgatcggcacaccgttaactaatccggccaattgtcgatgttgatgacccgtgactaaagcatcaatccccggtacttgggtcagcgcatatccgacattttcgccggttaatggctcagtcggctgaccggtctgcaagttacgctcaaaaccgccatgataagcaacaatcacaacgtcagcttgttgacgcagcaatgggacatagtgcttggcagtcgctaccacatcttgaaaagccaagccggcaatatgggccggtgcttcccaatgtgggatatagttcgttgtcaaacccagaatggcaattttgacccctgagcgctcaatcaattgataaggcgccccaaatgctggttgaccattttcggtgatattagcgttgatggttggataggtcaatgtcttcaacgcttgccgcaaatagtcgctgccgtaattaaactcatgattgccgataatgccggcatcatacccaacctcgttatacagtcgcgtcaactgatctggctgcttgctgatcttcgcaacgtaataggccagtggtgatccttgaagccaatcgccattttcaatcgtcacaactggtccttcagctgctgccttctgagcatcaagcaccgttttggccttggctaatgaaaaaggcaaatcctgatcccgtttcacataattagttggcaagacaaaaccatgcgtgtcacttgtcgatagaatggttagtttcattttttccctttcttttccgaatcatcagcagccagatcaatcattttttcaactaacagtttttgtaaaacagcattaatggccattgtcacaatggcatgctgggttgtcgtcatatctggtttattgacgcggctaatggttaaaccatcgctaaaatccgaatttgcctgctcaattgcgctgctaaaagtgagaataaacgcatcgtaagcttgcgcaaccggccgattggcaagtgaaaattgaatacctgccgcaatagcatccaacgcaaaaactggctttagcatcgcaatgactaaaatattggctaattgttctggacgatactttttcttaagcggggctttaataaccccctttttaacataattattgaccatcgtggatgtgatctcgccaaaccccagcggtgtgacaatatcattgacatactggatcacttgatccatatacaagtcaaattggggcagatcagtccagcgcggaaactgcgcctcttgaagttgccctagataatcggcaaattgttcgttatcagccatatgctgccacctctttcaagaagagtataccatgtgagctagacttgataaccattcgtggaccgattgatgctaatattttacccaatgatcaaagtacagccttcattggtaaggtcgcttatgttccgacttctagctgctcgtactcacgctcaccataacgcgtgcacctgcccagaaacctactccgttcaccataacgcgctcgccagcccagaaacctgcgtgtaaggaccttgaacgcaatgaccacagtgcggtcatcacgttcagggccacttacacgcaggtttctaaacgggctggcgagcgctcacacacaaaaagccaacacctaagatgttggcttttgattatgcatttgcgttatcgtcggacttcttaaccacttgtgcacccttgtagtaacccttaggtgaaacgtggtgggaaatgcggtattcgccggtcgctgcgtcgaattgcaagttaggcacattcaacttgatatgaccgcggcgcatacgcttcttggtctttgacgttctgcgtgctggaactgccatgagcggaaaaccccttttttagtaagatttctaaacaactttatacggttgatgatcaaaatgcaagtccaatcatcatcacgcgtggacagaatgctatctgtcacagcaacgataatcatacatgaaaaggcgcgtcaaggcaagggtctttacagaaaaaatcagttgtcagccggtttaagctttgaccggcactgtttttgccttaaattgcaactgatcgtccgcaaccgtgatgacgacttcttgccccggcatcacagtcccgcgaatcaattctttagccagcggcgtttcaaccgcactcgtaattaaccgctgcagtggccgggcaccaaacgctggctcataccctttatgggccaaccactcttgcgctgccggtgtgatatccagcgatatctgttgatcggccaaccgcgtgcccaattgcttaagatccttcacagcgatcttttcaacatctgctaatgatagtgggttgaacatgataatatcatcaatccgattcaaaaattcaggcttaaaggctttgccgaccaattgccgcacattatccttggcttgttggctaacggtaccatcttcttgcacaccgtccagcaggtactcggagcctaaattggacgtcatgatgataatcgtatttttgaaatcaacggtacgtccctgaccatctgtcaaacgaccgtcatctaaaacttgtaggaggatattaaaaacgtccgggttagctttttcaatttcgtctaacaaaacaatggtatatgggttgcggcgaactgcttcagtcaactggccgccttgttcgtagccgacataaccaggggccgccccgactaatcgcgacacactggccttttccatgtattcggacatatcaattcgcaccatgtgtttttctgaatcaaataaatcttctgccaatgctttagcaagttctgttttgccgaccccagtgggaccaaggaccaagaagctgccaagtggccgacttggatcttgtaaaccggccctggatcgcaaaacagcatccgagacagcgctgacggcttcattttggccaatgacacgttggtgcagattatctgccaaatgcaataacttctggcggtcaccttcaaccaacttcgctactggaataccggtttcccgcgaaatcaccgcagcaatttcattggctgtcacgctttcttgaactagccaagattgcggacgatcactgtgttccatcgtctgcagctctttttccaactgtggaatcgtgccatgttgcaagcgtgcagcagtttcaagatcgtagcgactttgggcatcttccaattcatgcttagctttatcaatcgccgacttcttctcgttaagttgacgaatatctttcttttctgcttcccactgagccttgagcttatttgttttctcttttaagttggccaattcagcgtcagcatctgctaatcgcttcttgctggcaggatcagtttcattcttcagtgcttgctgttcaatttccaactgcatctgtttgcgctctgccacatccagctcagtcgggcgggagttcatttctacgttaattgtggcacaagcctcatccaccaaatcaatcgccttgtcaggcaaaaaccgatccgtgatataccgattggacaaagtagctgcagcgaccaacgcggtatcatggatccgaactttatgaaaaatttcgaatcgttccttcagtccccgcaaaatactgatcgtatcttcaacactaggttcctgaaccagcacccgttggaaccgacgctcaagggctttatctttctcgatgttttcccggtactcgtccagtgtcgtggcaccgatcagatgcaattcaccacgggccagcatcggcttcagcaagttaccagcatccatggagccttctgccttaccagcaccgacaatattgtgaatttcatcaataaaaagaatgatttggccttcactctttttgacttcttttaagaccgccttcaagcgttcctcgaactcaccgcgatacttcgcgccggcaacaagacttcccatatcaagtgagatgatagttttattcttcagattgtcaggcacatcatttttgacgatccgctgggctaaaccttctacaatggcggttttgccgacccccggttcaccaatcaaaactggattgtttttagttttgcgactcaaaatacgaatgacatcgcgaatttcttcatcacgtccgatgatgggatccatcttgccactgcgcgcttcttttacaagatcggtaccgtacttttccaaactcttataagaggcttcagcatttttgctggttactttttcaccaccgcgcaggttctcaatcacctgtcgtaatcgctttgcatcaactttggcatcgttcaacaagaattgggtgatcgggttgtagcgttgttgataaagggcgagcaaaactgcctctgtagaaatataggtatcgccaaattcatccttcacactgttggcatctgtcagtagctgcgacaggttttgggacatgctttgtccgtatgcgctagcgccttcaacgacaggctctgcttccagtgccgcatcaatcgcagcattcaagccctgcacattcacaccggcttcacgataaatctgttcagccaattgattaggctgcaccaggcttttcatgacatgtgggatgtcaatttcttgatgacggcgaacttgggcaatttgttgtgccgcgccaagtgcttcggcaacggcttgcgtaaaattatctgggttcatgaatacggatgcctccctgaaaaatatcgtcttacattatagttttcattttcacaatacgacattggtcagttaaggtcaaactattttttaaatttcatgatgatttaaaaaaatcgtaggaagcccgtcgctgtgttgcttgcacaactgagcctcaggtggcctagattgctccgttttggcactacggtctttaaaatcgcattaaataatctatgtgtaggcaaaaaggaacaattttccaatcgtacaatcgaaaaattgttccttttatttgtttatttgtctgactgagaattttgtcacgggctcctctattgacagctaggtacgacagttcaatcctcaaaggtctacttttttgtatccgtcgcatccgttgacggttcctcttttggtgcttgaactggcttaggggctggcttgtcagttttattggattttgtcagctccgtgatccgctgttgcaactcacgaatctgttttttagcactcgaaacagcactggttgagatcaaccaggtcacaacggcacctatcaacacggaaaccgcaataatcactatcaacggccactttagctgaataccgaagaaattaaccgaaacgtcttgcccattcaacaaggcaaaaacaattaaaatcaatgccagaactaacccaatgataaaacgttgttgacccttcatacgacctacccctttacttcttattaaacataccagcagctaaccaatcgcccaaatgcgggaacaaggtataaaaatctgcgccaagattcataaaccacggtgcattgatttcccgaactggtcgaccaaatgtcgctacaattcgccgcgctaatttatctggatccaaaaccagccaagaaacgctagccaaatagtctaacgcattggcttcgctaaagaaattcgtggcaattggtcccggattaaccgtggtcaccttaacaccgaatggcttcagttcaagacgtaagccattactatacccaatcaccgcaaatttggttgctgagtagatagctgacttaggcgtcgccatttttccagccattgaagcaatgttaatgatttgtccttgctgacgcgtgaccatatcgcgacccagcaacttcgtcagatacatcatccccagcacattcacccgaaacatgcgctctactacctgcatatcggtatcgaaggctgtttcaaaatgaccaaacccagcggcattcaccagaatatcaactggcccaaccgtttcgtgaatttgatcaacggtcgcttcaattgcaactgggtcagcaacatcaacagggaaagcataagctggtcggccggaaagcgtgctggcctctgcctgtgcttgacgtaatttctcccgccgccgcgccaaaaagacaacggttgcgccttgctttgctgcctcaagtccaatcgccttgcctaagcctgacgatcctccagaaataaccaccgtcggatgttggttcatcatgatttcctcctctgttttgatattcacttgctaccgctgagctttatgatttaactgtgacagcaggttccgattgttcactccgaaatggaatgttaatttcctcgaagtctttgacaacatgcgtatttggaaaaatctgccgcgccgttttttccaacatcgctaccccgggactcagatatcgtgccgaaatatggttcagcaagagccgcccgacacctgcacgtttagccaacgccgctgcttgtacattggtcgcatgataatactgcttagctaattggctttcatccggtccaaaggtactttcgtgaaccaacacatcagcgcctgctgctaaaggcagcgcgcgattgcacatgcgagtatccccgaaaatggcaaccgttctgccaggttgcgcagggccaatgaaatcgtggccgtcaaaaatccggccatctggcaaggttacagtttcgccggccttcaaagccgcataaaccggtccagaaggaattttagcggcacgtaccttatcaatcaacaactcgccaggatgcggtttttcttcgatccgaaaaccaaagctcgtaattcgatgatccaagcgatcaaaagtgactttgaaagtttgatcttcaaaagccacgcctggatgctgtaataaaacaaattttaacgggtaactgagatgactttgagaaaccttcaaactggtttttacaaaatcctcaatgccagaaggcccgtaaatcgtcaacggatctgtgccgccttggttggagcgactggccaaaaaccctggcaagccaaaaatatgatccccatgcaagtgagtaataaatactttggcaatttttcgtggtcgaatagcggtttgtaaaatctgatgttgtgtgccttccccggcatcaaacaaccaaacctcattacgctcatcaagtaattttaaggctaaactgctaacattccgggacttggaaggcgaccctgcgcctgtgcccaaaaattgaatttccataccatacttcctattctgtcgaacttcactttgtagtctaccacaagttcctcgccattttcgcggtttcaatgttggtaagccgagatttgcaaggtttaaaaaagacgaaggtggacggctaactgcaaccgctaataaaaaaactgagcgacttgatgccgctcagcctcatgaaatcaaccgacatatttgtctcatcaacgcaatcaatcatctgtcggaagcttaatttttcaccttgtccagaatcgttttcgcaactaatgccgcatattgtggattgccattcggattcatatgaaccatgtcgttatagaaccaatcaggatgaccattagacttgtcataccaatcaatcaccgtcagattcttatactgcttctgggctgcggctaatttgctattaacatcattctgccaagcgcgcgttggtacgcgtacattaatccagaagacttgccgatcaggaccgatggcttgcatcatttgcgctagctgatcatctgaaaatgggccgttagttcctaacccaatcagaacgatattgcccagcacaccgcggtcagcgtaactgcggaccaaatcaatactattgatcatttgccgagaaacagcagcgtcaatcacagctttagggaacagctgttgaagcccattttcaccgtcaagcatgacagagtcgccaatagcagtgagtccaatgtcttgtgcctgttgcaattgaatctgggtcaagccgtattgttcatactcacgattgactggatgcgttttagcttgagaagcatacttggcttctagcgccttggaacttgattcttcggccgctttattcttgtcagccttcttttgtgcagcaatactggaacgcattgctgccaaccgcttttctttctctttagtggaaacaccacgcttctttaactgctgtgctaaaggcgagttgtcaccttctgctttaacagaaggcgctttggctaatccaacactaccaatagctaagataatcagcgccacataactaacccagcgcgttttccccatacgaactttaggattagccaagccctttaggaatgcccaagtcttgtgataattaaaatgtgccgccggttgttcaatgaagcggtaagaaagttcggtgataacaacaattagcaccacttcaatcaccggatataatactgggtgatccgcaatgttacgaaaacgattctcccaaaagatcatgacgggaaactgatacaaatacaggccataactacgactgccgatatagctgaacaaaggattacttaacaatctgtcaaaatgagctgccggatgcgctaccactgccaccaaaatcgttgtcacaattgagaacaataccattccgccttcataaagaaagctgctctgggcatcaattgtgaagaccatgactagtaagccgagaaagctggcagtaccgagaagatcaagcccaatcacccattttttacctaagtgttgcgaaagccggccacttggccaaataaaggccagcgctgctccgaataggattgagaatgcacgggtatcagtaccgtaataaagccgacttggatcaaacgctgctggctgtacatgggcaatggtcatcatatacaagattgccatccaagcgccactggcggccgcaagaatcagcacaatgttcgcaatctgatgccggctcttaaccaatagcaacagcgccaacacaagaaaaggccaaatgagataatactgaccttcaatcgacaacgtccacaagtgcgtaaatggggattccccatttgcatatctagcaaaataggattgcccgttcaaaatctgccaccaattgtacacataaagtaaattggtcaataccatcatgtgcaagttatgcagcaagttttgcgagaataacgtgatataggctgctgtcccaaagaggacggtaattaacccaggatataggcgtttaaatcgtcgaataaaaaaacttttaaaatcaattcgatgattgcggtcaaattcgatcaacaacccatccgttatcaaatagccggacacgaccatgaagatcggtacgcctaaatatccgccccgaaacaactcggggcgtaaatgatacaaaataacaccaataaccccgattgttcttaaaccatcaaatccatgaatgtaccggcgctttcgtccacgcgtctgtttcaattgcggccccaccattctgtctaaaaataacttccccagccgttcagccgaagatcattcaacgaactcaaatgtaaaatcatcaatggcgactaaatcgccgctttcagcaccagcatcacgcaaagcatcatcaacccccatgctgcgtaattgccgagcaaagcgcatcgcgccatcttcatgatcaagattggccattttaaacgcccgctcaatcttgtcaccagtgagcacaaacgtcccgtcactatcgcgggttactttcaaagccggctctggttgatacttataatcagccgttttaaccgccgcttgtttcggctcaaaatgcggtgctgttttgagtacttcggctgtcttgtgcatgagtggcgtcacgccacgatgcgtcagactcgaaatttcaaagatatgatccgccgcgacgccacgagcaagtaacgatgccttaaaatcagcaaatcgttcagctgcgccgggcaagtccatcttggtcgcgaccacgagttcaggccgcttcaaaatgttatcgtcataagcccctaattctttacgaatttgatcgtaatcatcaagcggctcgcgtccattatcaggatccatctcaactaggtgcagtagcacacgagtgcgttcaacatgccgcaagaactggatgccaagaccgacaccttgtgaagccccttcaatcaaaccgggcaaatcagccatcacaaaatcggtaccatcatctaattgaaccataccaagattgggtactaacgtcgtaaattgataagccgcaatttttggcttggcttgggttacaactgataacagtgtcgatttaccgacagaaggaaaaccaactaacccaacatccgcaagcaccttcagttccaatttgatgaaacgatgctcgcccggttcgccattttcggaaatttccggcgccgtatttttgggcgaaacaaagtgcatattaccgcgaccaccgcggccacctttagcaacaaccagagtttgacccggctcagttaaatcgcctaaaacctcgcctgtgtcagcatcggtaactgtcgtaccagccggcactgcaatccgccgatcttcagcagcgcggccatacatttgcttgccttggccattgccaccagctgacgctttaaaatgccgttgataacggaaatccattaacgtgcgcaaaccttcatcaacgtataagatgatgctgccgccatgaccgccgtcaccgccggccgggccgccaaacggtacaaatttttcgcgccggaacgcgaccataccgtcgccgcctttgcccgcctgaacctctacttgaacctgatcgacaaacattggcgatctcctttcagaaaaacatgtcatttgattatacgcgatgtttatatttcagtacagcgtaacgcatacctcaactattttaacacgtcccaagccggtactcacccttcatgcacaagaattagaaaacattgccaatatgccgcgtcagtcggggtactgacagttgttgaatgtttttgcacgttttaggttgcttttgacggtttcatcagtataatgaagaacgaggtgaaacgaaagtgcttacagaagaacgtcggcaatatattcttgcccaattgcaacagcataccgtcatcaaatctaaggcacttatggctgctcttgatgcttctgaatccacgattcgccgcgacttggacgagctagaggcagcaggtgagctcaaacgcattcacggcggtgccaagcgcatcaatggcctcggcgatgaaccggatgtcgcgagcaaatctgcgcagaatttgcgcgccaagcaaacgatcgcgcaggcagccgttcgtcagattgagcccgatgatctgatctttttagatgctggaaccacaacagcacaattaattccttttttggccgacattggtgtcacagtcattacaacgggggttgataacgcttctttgttagctgattatcaaatctctacactcatgctgggcggcatggtcaagcccacaaccaaagcgttgattggcgccacgacggctgaagccttgaaccattatcggtttgatgttgcctttattggaactaacggcgttcatcctgagtttggtcttactacgcctgatccagaagaagctgtgatcaagcgattggccattcaccaagccagtaaacctgtcattctggcggatccaagtaaatttgagcaagtcagtttcgtccgctttgctgatatctccgatgccacgatcctgacaagttcattacaaggactcccaaccagttatcagcgatttgaaaatattaaggaggttcattcttgatctattcagtaacgctcaacccttcgattgattatgtgatcgagttaccggaacttgaacttggcgctgtcaatcgacttacgcacgccgttaaattaccaggcggcaaaggcatcaatgtgagtcgaattttgcaaacattaggcctgccaacaactgcttggggctttttgggcggttttaccggtacctttatccaagatcggctcgatgcgattgacatgccttgtgacttcacaaaaactgctggtgatacacgaatcaacgtcaaacttaaagcagcgtccgaaactgaactcaatgcaagcggtcctaccattgacgctgctgaaattgccgccttcaaaaacaaattagacaaacttgaagccggcgatgtcgtcgtcatgtctggcagtttaccaaaaggcttgcctaacactttctatcgggatctgattccggtgattcatgcccacaaggctgattttgtcatcgacaccactggtcaagcgttactcgacacattgcctgaccatccccttgtcgtcaaacctaatcaccatgaattagcagcattgttcggcgatccagaatatacaagcacagatgccatcatcaaagctggtcgccgcctacttggtcttggcgctcagcatgtcttgatctccatggcgggggccggggccttaatgatcgaccaagatcacgcttggcatggcaccgttcctaagcagccagcggttaattccgtcggcgcaggcgatagtatgttggctggttttaccggcacatttgcgcagacacatgacacgttggaaagctttaaagtcggcattgcctgcggttccgcgaccgctttttctgaagatcttgccaccgctgacaaaatcgctgaagtgaaacaaacaattagtataactgaagtttaggaggacaaaatggacattcgtgatttactactaaaaaatgtcatgatcatggacctcaaaggaacgtccaaagaggctgtgattgatgaaatggtcgctaaataccatgcagaaggtattgtgaccgacgaaaacgagtatcgccaagatattctgaagcgtgaagccgaatcaacgactgggattggcgaaggcattgcaatgccgcatgctaaagacagtgcggttactcgagcaaccgttcttttcgccaaaagcgatcagggcgttgactttaacgccttagacggccagccggttcacttattcttcatgattgctgcccctgaaggtgccaacaatgaacatctggcagcacttgcagcattatcttccctgctcatcaacccgaagctcgtggcagatcttaaacaagcgaagacaccggatgatgttttagccttgtttggtaaggcgcaagctgaaaaagaggctaaagataaagctgaagaagccaaggaaaaggctcaggaagaacaagaaaaagctgacaagcaagcagaattcaaggcagaaaaacgccaggaacggccatttatcgtagcggtcactgcttgcccaacagggattgcccacacctacatggctgaggcagccttgaaagaaacagcggaaaagctcggtgtcgatatcaaagtcgaaacaaatggctctgaaggtattaagcacaaactgaccgattccgatatcaatcgagcagctggtgtcattgtcgctgccgacaaaaaggtagcaatggatcggtttaacggcaaaaagttgctcaatcggccggtcattgacggcattaaaaagcctgaagaattgattgaagaaacgcttcaaggcaaaggccaagtctttcatgctgcaggcaccgataacagtgatgcggccagtgaagaagcttctggcggcactttatggaatcgcatctacaaagacctgatgaatggtgtttcaaacatgctgccatttgttgtcggcggtgggattatcatggcgatctcgttcatcctcgaacaatggctgggcaagacatcgatgtggttcaccttcaccaacaacttgggaacctttgcctttagcttcttagtacccgttttagcggcctacattgctgaatcaattggcgatcggcctgcgttgatgcctgggttcgtcggtggttatatggccaccgttgcaacggcctccgttgtgaaggctcaaaacccagctggcttcttaggcggtctggttgctgggttcgcagctggttggatgatcgttggcttgaagaagctgctcagcaaaatgccacattcacttgacggtatgcgcacgatcctgctctatccagtcatcggccttgccatcatgggtttgctgatgttcttcatcatcaacccgattttcgccgctatcaatggcgcattgatcagcttccttgaaggcatgggtactggtaatgcgattctgattggcgtcattctagccgccatgatgagtatcgatatgggcggtcctttcaacaaagccgcttatacatttgccatcggtgtctatcaagcatccggctttaaagatggtcggtggatggccgcggttatgattggtggcatgattccacctttggccattgcggttgcttcaaccttcttcccgaagaaattcaccttgcaagaacgcaacgctggtctttctaactatgcacttggcctgaccttcatcactgaaggcgcgatcccatttgctgctactgacccgctgcatatcattggcagctcagtcatcggctcagctattgctggcggtttgacccagttatggcacgtcaacgtccctgctcctcatggtggcgttgttgccttgctgctaaccaaccagaaacttggcttcatcatgtcacttctgattgggaccatcattgccgccttaatcctcggcttctggcggccagtcgcaaaagaaaataaataagtaagcaaaaagcttggcgatcaatgtcgccaagcttttttgtgccgtgagaccgaaccggaattccacataagagcttgtggtgcgttaaattcctagccaaaaaattcgcttgccgtgccaaactccgcaatctccgaccagatgaggtggcgacgcgtagctagagcggagacggcgcttcgagctcgcaaaacccgcggtctcgaagtcgcctaacaacatcagctccagagcccgtcgctgtgttgtttgcacggctgagccccatctagcctacgattgcttcgccttggcactagatctttaaatctcaagattgtttgttcttactgatggttataaacgatgtcctaaacgctcctacgatttgattaaacccgtcgagctggtgtcggctctgccgtcagcgacagcttcaatgcctgcgcaacttttttagaaatacctagctcctgaatatcttcaaggggagcttctttaatcttattgatcgtcttgaatttccgtaacagcttcagccgcgtcttgggtccgacccccttgataccttctaatcgagaggccaacgagttcttggcgtgcagctgccgatggaaggtaatcgcaaaacgatgcacctcatcctgaatccgttcaagcaggtaaaagccttgcgacttaggatcaagattaatcagctgatcagcattgccaaataacaatgctgccgttttatgcttattatttttgaccatccctgccacgggaatatcaaggttgagttcgttttccaaaacatccttagctgcgttcatttcaatctcgccgccatccatcaagatcaaatccggtaacggtgcacgctcctttaacaaccgggtatagcgccggcgaatgacttcgcgcgtattagccgcctcatctgcgccattatgcgttttgtcagcatccaacttgtactttcgataattgttcttagctggctggccatccacaaactgcaccatcgccgacaccggatcagctccttgaatgtgactgtggtcgaatgcctcagccacatgccccattggcaagttcaaagcggccatcagctctttcatcgcgccaatcgtggtacgattatccaattccattaaacggaatttgtcttcaagcttaatctgactgttcttagcagccaaggccatcaagtcccgtttttcaccgcgctgtggcgttctaactggaatctctaggatatctgccagtactttattatcaagcccagcaggtacgagaacttcgcgtggtttcacattattcttgcggctgtaaaactgtaaaataaatgattcgaattcttctttagcagtgttcaccactggaaaaagtcgtgactcacgtttcattaaacgtgcttgacgaataaagaagacctggatactgatccagcccttatccatataaaaattgaacaaatcacgcgttgtattgtcgtgtgaaataattttctgcttctccaccgtctgttcaatataatgcagttgatcccgaatttctgcggctcgctcaaattgaagatttttcgcagcccgctccattttagccgtcaaactggctttagccttgccaacgttcccattcaagaagcgcttaatacgttcaatttggtccgtgtattccttttccggaacagtccggaagcaggcacccagacactgacccatgtgataatacaagcacggtctgccttgatagccgttacagcgccgcaatggataaaccttctggataaaatgcatggtttcttgcgctgcatagacatttgggtatggcccaaagtaataaccgccatctttacggatagtaccagtgatttcaatcttcggatcgcgttcatgagtaattttaatgtacggatagccagtcccttttttcaacttaatgttgtaatacggctgatatttttgaatcagcgtaatttcgagcaaaaaggcttctttgtcagttgaagtcacaatgaaatcaaaatccgctacctgtgacaccatcgccgcaactttaccgtcgtgtgaactcttgaaataagaccgcacccgatttttcaggtttttggccttgccgacataaataattttgccgttgatatccttcatttgataactgccaggcagatctggcagcaacgataacttgtgttcaatgtgtgctgaggccatcgtaatctccttataaaacaaatgttcgcctaacattataaagattctaaaaatagattgcaagcaagcggctttgatcagtgatggcatgactgcccccacttagcaatggtcacttcacaccaaaaacacctcaaccagtgccgcttaccagctgctgggtgaggtgtttttgcttattgggcaagaatcttggataggaagtcttgtgtccgttcttcttgcgggtgttcgaacagttgttctggcgtccccttttcaaggattttgccgccatccataaaccatacttcatcggccacactacgggcgaagcccatttcgtgggtcacaacaaccatggtcatcccggttttagccaaatcctgcataactttcagaacttcgccaaccatttcaggatccaaggcactggttggttcatcaaacagcatgacatcaggatgcatcgctaatgcacgagcaatggcgacacgctgttgctgaccaccggaaagactggatggataagcatccgccttttcggctaagccaacttgatccaagatttctttggctgttttggttgcttcttcatcggtcacagctttgactttaagtggtgcgagtttaatgttttccaaaactgtcatattggggaacaaattaaaactttggaacaccattcccattttttctcggacattatccagctctttctcgctcaaaccaactaaatcagtaccttcaaaaaggatttccccttttgttggtcgattcagtaaattcaggctacgcaggaaggtacttttcccaccaccggaagcaccgataacaacgatcacatcgcctttgtcaatggtttcggtgatatcgttcaaaacaacattgtcgccaaactttttggtgaggtgattgatttggattaaaggtttatgctgcatgattcatcttcctttcaaaatgactcaagagcttggacagcccgaatgtcagaacaaagtagaggaccatcgcgacaaggattggttgaactcccttgtatgtcgcggtttggacaaccgttaactgataaatcagatcggtaaccccgataatggaaacaatcgagctttccttaatcaaggagataaattcgttaccaagcgctggccaaatattcttgattgcttgtggtaaaacaacactcatcatcgtctgccgctctgacaggccgagcgaacgggcagcttctgtttgccccactggaatgctatcgatcccgctacggatgatttcagccacatacgccgccgagttcaaggaaacagcaatcaaccctgcaattagcgcaggaatatcaatgaagatccctatgccgaaatagacaaacatgacttgaatcatcagcggagtgccacgaacgaactcaatgtatgacacacctatcaaatgtgacagtttattcttgctcaaccgcagcaaggcgaagatcgtgccgagtagaaccccgaagaaagcaccgatagcactaatcaacagcgtatactcgaccccttttaggaagtaggtccagtaatggatcatactggtatcttcagtattggttttcatgtaactgccagcagttttgagatactggttaattaaacctttttgcttaatctctgccaagctcttgttggcggctgccactaatgaatcagagttcttagcaaaccctatcgccgtaccgactgtgtcgcttgataagttgaagtgaccgggaatctcaactaacgaatcatcatttgacgtgtaagccttcgctaccgcaccttcagcgacaacaccagctaccttatgtgtcttcaacgccaaaatcaggtctgtgaccttagtcaagcccaatgtggaactcgtcttcatctgtgttttcgctaacgtctcttgcaagctgccattctggacgccgactttcttgttcgcaaaacttttatggtctttgtagatcttagcatccgttttgttgaccaaaatgtcttgtccagacttgtagtacgtatttgaaaagtcaactgacttccgtcgggcattcgtcggtgacatcgccgccaacaccatgtcgaccttacccgtctgcaaggcgaccagaagtgagttaaagttcatctgtttaatgaccagctttacacccagatccttggcaatcttacgcgcaacttcaacatccatgccaacaacttgattcttgccattcttgttgactaaaaattcatacggcgcataatcagggctcgtgcccatcaccaacgtacctttttgttgaaccttggccaagctgtcatcagcatggaccgtttgcatattcaatgtcacaacagccgcaaaaacagcgactaaagcgatcaaccagcgtctcaaatgcttcataataccctccttgattacaagagtgtactatacactcaaattgatttttatgcaatatgcattcatatttttccaaatttttttgttcgggcgacttacctagacgcgccccagtgttgatgctatactttcagcaaggaaaggggtggcgtgcatggcactgaaaatcaacacacaaaccaacctgaatgacatgttcgataagtttgccagtctgcctggtgataaggagaacgcaaccgggccagatccaaaacaccacgacaagttggccaagaaagccaaagaaaaaacagaaaaagaagcaaagaaatagcgaagtgcccacgcacttcgcttttttcatacctagaaaccgattattttttggcttgtgggtatcgtttcgccaattcctgaaggttactcgttgcaacatcatcaaaatcaatgtctgcccacaaagcaatctgtgataaataccacaacacatcgcctagctcatgttgcagcttgactttatcaagatcctgtccctgaaatgtatatttcttgattaaatcgatcgcttcgccgctttcacttgccaaccctaatgacaggttagtcaaaacgtgttcattgccagctaaggtgcgatttgctttttgctgatagtcattgaaattcatgctttatcttccctccaagccagccgtttgttcaagccaagaccagacagcctcataaccttcaccagttgttgccgaaaatagaatcacatcgtcggtctgattcaaatcaagtcgctgtttgatctgtttggccacatgcagccgtttactttttggcgtcttatcaattttggtggccaccaccagtgttctgagctgataatattttaaatactgatacatactgatgtcatcagcagtaggctcatgccgactgtcgaccagcaaaacaacaccgcgcaatggttgccgcgtcgtcagataagtctcaatcatggcggcgaacttcgctcgtgcggttttgctgaccttagcatatccatatccgggtacatcaacaaaaaagagtcgactatcaagatcatagaaattcaatgtctgcgttttacctggcacaccagaagtgcgtgccatggctttgcgctgaatcagtttattgatcagtgatgacttgccgacattactgcggcccaaaaaagcgatctctggatgaccgtcctcgggatactgagcggccgcaaccgcactaatagttaatttgacgtcatgcacgtccatctcaaacggcctcctcttggctttacctcaacgtgatgtctaaacacaacaccgcttcaaatagtttagcatattttacgcagcctcgccggagaaaccggtcgtgattcgggtgacaccttatcgcaaacacggccgtggctaacctcaaaagaatttttcaatagtcaaaaaaagcaccaagcttttcgcttgatgctttcatgacagttgcgttttaagaagcttcacggcccttggttaagaccagttgtggcttagccttaccttcaacagctgacttggtcacgacaaccttgtcaacatcgctgcggcttggtaagtcaaacatggtatcctgcatgatggcttccataatggaccgcaaaccacgggcgccagtgtcgcgcacaattgcctgatgggcaatcgcctttaaagcattcggggtgaattccaagtcggtatcatccaagctcagcagcttttgatactgcttgaccaaggcgttcttcggctcggtcaaaatccgtaccagatcgtcttcattcagcttctcaagcgcggctaaaatcggaatacggccaatgaattcaggaataatcccaaattgcatcaaatcttctggaataatttgctgcatcagtgacttatccggatcaacttgctcgtttgaatccgttccaaacccgatcgtcttttcaccaatccggttcttgacgatattttcgataccatcaaaagcaccgccaacaataaagagaatgttagtggtatcgatctggatgaactcttgctgcggatgctttcggccaccctgcggcggtacgttggcaatcgtgccttctaagatcttcaataaggcttgctgaaccccctcacccgaaacatcacgggtaatggaaacattttctgccttcttagcgatcttatcgatttcgtcaatatagacgatccctttttcagcacgctcaacatcatagtctgcattttgaagcaatttaagcaagatgttttcaacatcttcccccacataaccagcctcggtcagtgtggtggcatcggcgattgcaaatggcacgttcaaaattttggctaatgtctgggcaaggaaagtcttaccggaaccggtcggcccgatcaacgcaatattacttttctgcagttcggtgtcatctttcgttgcagtctgcatttggttaactcgtttataatgattataaaccgcaaccgacaaagctttcttcgcggcatcttgaccaatgacatactcattgagcgtcttcatgatctcgactggcttaggcacttcaagcagattctgataggcttcttctttaaattcttcatcaatgatctctttgcagaggtcaatgcattcattacaaatataaaccccagggccagcaacgattttcttcacttgatcctgtgacttgccacaaaaagaacaagtaactggacccgtcgtttcgacgttgtcaaacatctgattcaaccctttcttgataccttcattctaacagaagcgtcaagtgccgactagcggaagcacacccaccgttttgtcaaataacttgcctttctttctgctaaaagaataacgtcaagtatacgctaaaaacgcgttcatacaacaaaagagacgatcggggatcgtctcttttacgtggaaacggcaaactatttgtcagccttggcgtcagaagcttctttgtcagcatcatctttagctgattcgacttcttttgcactgtccgtgatgatatcaatggcttgtttgacaccaatatcatgtttgagcatatcttcactcaaagccttacgaacggccttttcgtccatgttgtattcagaagccaagtttttgacttcttcgttcacttggtcttcggttggctgaatatcttcggccttcacgatggcttcaaggactaagtttgtccgaacacgcgtagctgcatcagcctcaaactgcttgtgcaaatcatcctctgatgtaccagttaattgatagtacatttttggtgagatcccttggcgttgcatgttgccaagatattgatccatctgattatgcacttcttgctcgatcatcgcatttggcacttctttgatcgtcgcattgtcagtagcttccttgatggcagcttcctgaacggcattctttgcagcttcctcacgctgatcggtcaattccttcttgatttttgctttcaattcatcaagggtatcaacatcatcatcaagatccttcgcaaagtcgtcatccaatgcaggcaattccttaactttgacttcatggatcgtggtcttgaattcggctgctttaccagctaaatcagctgccttgtagtcttctgggaaggtgacattaacggtcacttcatcaccagatttgtgaccaacaagttgttcttcaaagccaggaatgaatgagtttgaccctaattccaagctatagttcttggaagagccgccgtcaaattccgtcccgtcaattgtcccgacatagtcgatcacaacggtatcaccattttcagctgctttgtcgtctttaacaacgagttcagcctgctgttcgcgacgcttttccaattcagcgtcaatatcctttgcagaaacttcaacgttctgctttggcacttcaagacccttatactggccaagtgtgacttctggcttaaccgtaacggttgccttgatgacccaaggtttgccttcgtccatagaatcaacattgatttgcggctggtcaaccggatcaataccagattccttaacggctgcttcataagcgtctggcagcaagatgttcaaagcatcttcataaagtgcagcgtcgccatacatccgtttgaacacggtgcggctaactttgcccttacggaacccaggaaccgtcaagttcttgcgaacacgttgaaacgcttggtctaaaccttgttgaatttgtggtaaatcgatttcaaaggtgagctcaccatcattggtgccctttttttcccattttgcagacatgctgtacctccgacaattagtctcgcaatttcacattgcatacttaatgtatgatacccgaaacccacttgaatgtaaatgttgtggccaaaaaaggcgacatcagcgtcgctttttttcacattcccccgccctgagagctttgaagcgatagattccgatttttaagctttccagctaactgcaattatcaagtaaattgcaaatcataaagttctttataacgaccgttttgcgccatcagttggtcatgcgtaccagattcgacaatctcgccatgttccagtacgagaatattgtccgcatgccggacggttgacagacggtgggcgatcactaatgacgtacgatccgccatcaaccgatcaaaactagcctgcacaaatcgctctgactcattgtctagggcagccgtggcttcatccaaaataacaattggcgcatttttcaaaaagactctagcaatggcaattcgctgcttttgaccgcctgataaacgaatcccccgttcaccaacttgagtggcaagaccatcaggcaattcgcgaataaacgttgcaatgttggcggcttcggcggcttgccaaatagccgcttcactagcatttggtgtaccgtattcaagattctccttgatcgtaccatctaatagaatcacatcttgcgaaacaatcgcaatctgttgccgcaagctctctaagtcagcttggcgaagatcgaccccatcaagcgtaattttcccttctgtcggatcataaaatcgatccagcaagttcgtaatggtcgtcttccctgcacctgaagatccgaccaatgcaatcacctgttctttagcaagtgaaaaatcaatattcttaagcacaagtactgacggatcatagctaaagccgacgcgatcgaattgaatgcggtcatgaaaacgcgctaacttgatcgcatttggcggagataccacccgcggcaccgccgcctgcagtgtttcaatccgctcaaaagaaaccgttgcttgctgcaattgttgaatcaagccggtcacttggcgaatcggtgcttgaagaatacccagataagctgtataggcgacaattagcccgactgtgaattgcccatgcattacctgaaatgcaccaaatcctaaaatgatcgccgtaccaagatagttaacgaaatcagtgatcggcgaaaaagttgctccaagacgtgttgctgtcagttgattatcgcggttctgctcattaacgttttcaaaggtattcgcggttgctttttcagttgtgaaactcttgataagcccaatgctcgtcaaagcttgttgaatttggttattcatcacacccgaactggtgcgcacccgccgataagcagcgcgaattcggcgcacaaaaatattattcaaaacgaacaaaacaggaaacgtaagcaaaatcagcgccgtgagctgccagttttgaatcagcatcaacaccagcacgacaaaaaagctcagcatacttccgaacaggcccaaggtgttgcttgagattaaacgctgcaaggtgttgacatcactggttaaaaccaccattaaatccccggttttacttgtttcaaaataatgcatgtcaagtcccaacgtatgccgaaataaagcgtcacgcatacgggcgatcgcgcttaaactaacctgtccgatccaatatgtgctgagtccacttagcaaacccgccaccgccgtcagcaataacgctaatgcgatcgtgccaatcagcgatcccatggcgcgttttggaataacttgatcaatcacatactgcgttaagcgcggaaccaggtatgaagccacggccacaccaaccaaggccacaataatacgtaataatttgcgcttcatatccgcgagttggtgccagaaaaatgcgatcatccgccaagttgtagattttgccaaatgaatggcccccttttcgaaactttatcatataacaataattttaatttggcgattaaaacgctcgggctttttataagtgttgactaattatacagaaagtctcatcatacaacccaacatgatcaaagaaagaaggcttcattgatggggtacccgattggcaagttttcaaaaatggtttcactatcaattgacacgttaagatactacgaaaaggagcgtctaattattcccgctcgcgatcaaaataatcgccggacttactcagaagccgatcaacgctggattgcattcatcaagcggctaaaagcaactggcatgccaattaaggaaatcaaaacatatgcccgcttacggtatcaaggcaatagcacgattgacgaacgtcttcagttgctcttcacgcaaaaaaaccgattaacggcacaacgacaggagattgatgcacatatcgcttttttggaaaataaaattgccacctactatcagctaaaaaccaaattgatggcagaaaatttaaaaaagtgattgacatgaagttaactccagcatttagggtgaaggtatcctaaatgaaagaggtcatgaatatgtcagacaaaacacgattagaaaatggtcaggagacgcttgccaaggttgatggtgctgccgctgctaacgtcatgcattcgctagcagacattgcgcctgatgtcggtaagtatattttggagtttgcttttagcgacatttacaatcgtcccgggttggatctaaagcagcgggaaatgattactgtgaccgcgctgctcatccaaggtgataccgccgaccaactgcaggtccatctcaatggcgcactcaatgtcggtttgaccaaaactgagattgtcgaaaccatgattcaatgcattccttatattggttttccccgggtactaaatggtttaactgatgcgcgtcgcgtttttgaaaccagatgagtgtcatgaaacaaaagcaacgtttgcaacaggcagcaactcttatacgccaacatcaccaaatcgttgcatttactggtgccggtatctcgactgaatcagggattcctgatttagatggtattgatcaaatcttacacaaatcacacaagtttgctggtgacgtatttcgttttcttgatccaacagaagcaatcgccgatccgcacactttttaccagctatacagacagactttctgtcaacccaaggcacttcccaataaggcccatgaagcgttagttaaactcgaacaggctaagaaactgcttggtgtagtgacaatgaatgttgactatctacatcaaaaagccggaacccgcaatcttgcggaatactggggcgatgtccgacgtaatcactgcacgatttgtcatcgcccctgtgactggcaaaaaacgtcaacttctgccgtcccgacatgtcctaactgcggaggattgattttacccgattttgttttaagacacttggcaacttatccagacgaaattcggcatgggcagcaaatgctagcaaaagccgacctgttattaatcattggcacgcgttaccccgccaccagttttcaggtaagctgccccaagatcgtcatcaatgcgtcccaagtttctatggaaaatttggccgaatcaaataccgtttatttatctggtgaggctactgaacttctcagcagcattatagcgtgaaaatttagatcaatgcattggcggctcggtaatatgttgaatgcgcaatatcatttattggaaatacaaagaaagaagcaaccctataatggtgacttacaacaaccgatttttccacggtgaacgtcccttatttggtcagaaacatgcgaccatcattggtacaacttttggaaaaggcgagtctcctctgaaaaaatgccgacacatcaagttaaatcagtcaacttttcagtgcaaatatcccctttggtacagccagcacattgcagtgtctaacaccatctttgaaaccatggcacggtcaggtatctggtatacggttgacatcgcaatttcggacagtgcgatccaggcgccgaaaacttttcgccgcaatcaagatatccgcctaaaaaacgttcacttctccgatgcaagtgagagtttgtggaactgtgatcacataagcctcgatcatgtgcaagcaagcggcaactatttcggcatgaacagcacgaatatcgtcgccgactatctcgatctgattggtgattaagcctttgatggtgccaaaaatgttgagatccatcattctacccttgttgctaaagatgcattttggaactgtgaaaatgtcaccatatacgactcaactatcagtggtaattaccttggttggaacgctaaaaacctgacgctcatcaactgtacaatcgaaagcaatcagggactgtgttatatcgatcatttaacgatgaagaactatgcactgcttcattcagatttggtttttgaatacagcaacaatattgatgcagacatttgctccgatatcgtcagcatcaagaatcctagcagcggccgcatccgagcgcagtctattggcaaaaccattctgaaagctgataaaatcgagccggataaaacgcagatcatattagcacagccaagcgaaattaaagtttctgcataaaaattttaacttctgctttaaggttcaaagtgtgagcaaagaagcgtaaagatccttgctttgcttatatggtctctttgatcattgatagtgttaaaagtggctgggtcataattcttagtcagctattaaaagcgaacaatcttccgcttattgggaaattgttcgcttttgccttctcatggattatttattgcgattttaaagaccgtagtgccaaggcggagcaatcgtaggccagatggggctcagccgtgcaaacaacacagcgacggtccttggagctgatgttgttaggcgacttcgagaccgcgggctttgcgggctcgaagcgccgtcacagctctagctccgcgtcgccaccccagctggccggagattgcggagtttggcacggcaagtagttcttaacccagcaccttcctacgactattcggcgtttaatgaatcaaaaaatattacgagtaaattattgtccactctctccacaccacgaaaaaaccgggtctacactttctggtgttgagaaataatcaacactgaacgtgtaggccctttttggataacgcaaaaagacacctactcagtgtccatgctatgcttgttagcgtcgaaaccaaaagcaagcgaggttatgagtaaatgtcccaatacgatcctacactgtccgtccttggaataccagaccataatatcaaagttgcctttgttcgtcatgaatatcgcggcaacggggtacgtcgccgccagtatcatgtgattgatgccgagctgacttaccggttaacccggtgcccactgtgcggctttgaggccttgcaccctaacgtgttttacacggcccatgtgcgcgtcctcaacggagttgaaatgccgacagtcattgacttgcacaagcaacgatggcgctgtcataactgttaccacacagtcagtgccaagacgccactcgtgcaacccaaccacacgatcgccgctcacatgacagagcgaatcatgaagttagcgcatgaacggttgccagtcaaaaccatcgcccgtattatcgggatctcagcctcctcggttcaacggatcattgaccaaaatctcaaactccgaccggctcgccagctacccacgcgactctgctttgatgagttccgttccactcatggcatgatgtcgtttatctgtcttgatgccgattcacatcatctgattgccttgcttggtgatcgatgcaaccgcacgattaaaaacttcttcatcgctcattattcactcgctgaacgcactcgggtccagacggtcaccatggacatgaatgcagcttatcagacgattattcatgaggttttccccaaggcccaagtcgtcattgatcggttccatatcattcaacttgcggctcgtgcccttga

SEQ ID NO: 129 - DNA, 1043 bp, Lactobacillus paracasei
atcgaaggcgttaaccgcctcatcaagtcactcaaacgatcctgttttggcttcaagaatcagctgaacttcttcaaacgaatctaccaaatcacggcataacatgacaaagacggctccccaaatggagaaccgcctcaaatgataaatttattcttcaacaccagttggcgtagagcccaaatttatgactttgaacgcaaaaaaaagaccacgactattcgtgatccaagaatcgggaagacaagattcgaacttgcgacccctacgtcccgaacgtagtgctctaccaagctgagctacttcccgaggaagcggaagacgggattcgaacccgcgacccccaccatggcaaggtgatgttctaccactgaactacttccgcattccgagtatttagttctaatcggcgccagcttagtagcggtcgatgatgcacccagtaggagtcgaacctacaaccttctgattcgtagtcagacactctatccaattgcgctatgggtgcattcaacaaaatgccgaggaccgggatcgaaccggtacggtcatcactgaccgcaggattttaagtcctgtgcgtctgccaattccgccaccccggcataaagtgaaaagcggaagacgggattcgaacccgcgacccccaccatggcaaggtgatgttctaccactgaactacttccgcataccgcatattcaattattgagaccggggagaaaaaaccacctattggaaccgagcttttacttcacagtacaatgcgggtgaagggactcgaacccccacggtcaaaaaccactagaacctaaatctagcgcgtctgccagttccgccacacccgcaaaaggtgggttaaaaatgagccgtgacaggctcgaactgtcgacccactgattaaaagtcagttgctctaccaactgagctaacggctcaatggaggatacagggctcgaacctgtgaccctctgcttgtaaggcagacgctctcccaactgagctaatcctccatatgtaagcgtggcagcttcctaccctcgca

SEQ ID NO: 130 - DNA, 361 bp, Lactobacillus paracasei
ataaacgctgaaagcatctaagtgtgaagcccccctcgagatgagatttcccattcctatatggaagtaagacccctgagagatgatcaggtagataggctggaagtggaagtgcagcgatgcatggagcggaccagtactaatcggtcgaggacttaaccaagtaagcgtgcaagcaggtgcaggtttctgcgactgcgaacacgtttcgatgacaagtacgttaagttcaaggcagcaattaaacaatgatagccagttttgagagcgcaaagttctcataagtgtggtggcgatagcaagaaggatacacctgttcccatgccgaacacagaagttaagcttcttcacgccgagagta

SEQ ID NO: 131 - DNA, 10426 bp, Lactobacillus paracasei
  misc_feature (8560)..(8590): n is a, c, g, or t
agaacttcgctactattttccgaagggaacacagtttgatcaggtttcagagaccgatattcaacaagccacagcgcttatcaataacaaacctagaaaatgtctccgttggcaaaccccagttcaagcagtgagcaagcctctttctaggtggtaactttattattgcaatctaggcctatattaaaaaaaataaaatagaagctccgattctatatattcttgcgtgtagaataggaccttttatgtcactagtcactaaacgcttccactcccttggcgggaaagtttatattaatccagatggtcatgaatggaagagagcaaaatggtcagctcctgttagagaatactggaagcagtctgaaagaatgatggttaaaagagctgatttgattgtctgcgatagtaaaaatattgaattatatattcgaaacacttatcgctcttatcgtcctcaaactacctttattgcatatggtgctgatcttcctcgaacattcaagaccagcgataagacagatttagtggaatggttaaaagaccataatttaaaagaacgtgatttttatttagttgtcggacgttttgtgccagaaaataacttaaagacgattatcactgaatttatgaaatccgatactgaaaaagaattagtaatcatatcaaatgttgagcaaaacaagttctataaacagctgcttttggaaactaagtttgatcaagattcacgtattcgatttgttggcacagtctataataaggggcttttgacattgattcgaagtgttgcggccggctatattcacggacactctgttgggggaacaaacccgtccttattggaagcacttgcggcaactgacgttaatcttttgtttgacgtcggatttaataaagaggttgcagaaaaaagtgccatttattggtcacttaaatctggatccttgtcagctaagatccatcaggtggacagtatggattcaaagaaaattaaaattctaggtaaagaatctacggatgttataagagaacggtattcgtggctttatattgtaaaggaatacgaaaaacttttcacaactcatagagggacagaatagtatgcgagttcttcattattttttgggatggccaccggcacgatcaggcggactgacgcaatatgcagtagacttaatgcatgccgaagcaaacaaaggaactgaagtatacgcattatttccagcttataatttcttccgcaacttttgtccgctgtcagacctcaaaaataaatatgattccaaggttatcaccttttctctgaataattctgaaccgttgcctttgaagggatcaataagttcgcctaaagattttatgaagcctggtaacataattgcgtatcttaattttttgaaagaccttcatcctgagatttttcatattcatactatcatgggattgccgcgtgagtttttgttagcatgtaaacaactgggcattaaaatcgtttttaccacacacgactattttggcatctcacccaacccaaagtttatatttgatggtaaggacttttcttgcaaaaattcgaccgaaacatggcttgcttgcagtactgattctgcttcagttacaaaattaaggctttaccaaaatccactttatccatttgtgaagagcacattaaggacatttaaaagaattttgcaaaaagataatattgcagaaaaagattttacgcataaatctggcaacaataattttcataatgaggatttgaaatcttttcaagtactcaggaactactatctagatatgcttaaactgattgatcattatatttttaacagttttgtgaccaaagacgtttacctcaaaaaccttaactttaaccccacttttgacgttgttcctgtaacgaccgcagaagtcaaattgccaaagaaacgaatagttttgccaatgtacacctctagaaatatacttaaaattggttatattggcccatatacgaaggaaaaaggatttgacttattagtggatgttgttcaaaaaattcccaaatcaagagtcaaactgcacatatggggagattcttcatttacgggagtgtcttcggggaatattttcaaccatggccgatttgaacataaaacaatatcagatgttttccgaacattcgacttattagtgataccaagcgtgtggaaagaaacgtttggattgacggcgcttgaggcaattgctaatcacactccagtagttatcagttcaaaagcagggagttcgatgttggtaaaacaacttttcacgtttgagcccacaaaagatggattaagtcaatggtttgttgattattgtaaccgagccattccaaatgaacagtttatacaggtgagtcaatcgttaacgtcgatgagtgaacaggcagaagcaatccagaccgtatactggaaagttttagaaaagtagagaaagggggggaatcgataatggcaaatcaaactgttgtgttgacggtgacatatggaaaaagagcagactatgtttcaaaaatggctcaaaagttaaaggaagacacaaatgtttctaaaattgttgttgtcgataatgggtcggacaacagtcttgaattggatgaattagcgaagcagtttggctcactgatcacaataattcattccgaggagaataacgggtctgctgcgggttttgctagaggattacagtatatttttgagaatttgaagaaggctgattatatttggctactcgatgacgataacctgccctcaagcgagtgccttagcattttattgaggcaatatcgcagctgccaaattgagaagggaatattcgcagcgtttagagaggatcgtaaggaattacttgcaagtggtggaagtcattatattccaaattccttttttggatttgatttaaaaacaaaactactctttaataagaaagatattcaaaaagaatctgaagaaaaattgcttgcatgtgatactgttccttacggtggtctcctattgcccatgagtatagcaaaatcaaatggattgccaaatacgaactatgttctttacaatgacgacaatgattatacctatcggcttacaaaacagggatatcaactaaacgtttgtgttgacgctttgatacatgatttagaaagctcttggtatagacgtgagcaagtcccaatgtttcaaggtatttttaagacgaaaatgttacgcaatgctgtttacacaattaggaacagaacatatttcgaaaaaaataacattgtaactaacgatactgtatacaaccttaacatcttgatatacctaatctatgtttttttgttctacatgccaaaaacccgaaatggctgggttcgctttgttctggtcacaagaatgataaaacaagggttatgtggacaacttgggcccataaaaaacactaaatacgaatacgcggtgaaatgatgtcagttaggttaatttctagaagtacaaaaattaagtttatcttccctttgattttaggattttttttgtcattttttaatcgaaagaaacatcttgggccaaacactcctttagtcttagtagggggacatttgggaaaagaatttgatgataatgccaaagccatgtatttgtatttagcattgaagacagatgtaaacgtctattggatgcaagcaaaagattcaaaatataagataaaagaaattgaaaatccaaagatttcaacaatcggcagtatagagagttacagactttacttcagttcgagatttgttttctttacacattcaaattcaactgatattgcacctttagctgatcattttatgattcatagaccctttgaggtatatattagtcatggaatagaagcgcttaagggaccaattaagggcggtagagttgaggctgatttatttacggctgtatcgccatttgaaaagaaaattaaggttgaagattggaagttaccaagcagaaatgtaaaggtgactggtatggcgagatttgatgcttattggccatcttctgataagaaagttcgccgaatcctctatttgccgacctggcgagaatgggatctcggatctgacggcaaaggttgggaagaatctgaaacatacaaacatctcctccagctttttgatgatcaacagttactaacgttgttagcagaaaatcaagccaaactgattttccacccgcatcctttcatgaacgggacgatggggatatttaaacaaagatcgaataattatatcaagttcgattcatcgacgccaattagtcaagaaataatggactgtgatgccctcataactgattactccagtgttgcgattgattttctgtatcttgataagccattaatattttatcaatttgatcaaagtgagtttttgaaacgcagaggagcatatcttgattataagacggaattatttggtccagttgtttataacgaggctgccgttcgagaggaagttcagaagctattagaaggagattttgaatcaaaaagggattcaaaaatcagtaaaaaattatttgcttttagagatcatgaaaactgtaagcgaatatggctgactgctattaaagaggggcgaatcagacatcaaagcaagagaggggggtaattaagtgattaaggtaatagttgctttcattggagtcgcgttaatttttttcagtgtgtattacttttttaatcctcgtcgcgaattcaaacctctttactttgctgttgtactctttgctatctcatttagtatagctttatcccatcagacctataggattgttggtgaggatctaacactctacattcatttttataccattgtaatttttacattgctactttttcacattagacctacaatgcttaaaccatcagttgattgggttttctttataccactgggaatacaggcgataatctcttggcgaactgggttaattgtaagcttgccagattttttaagactaggtttgaattatgcaacgatcggcatgattatggctattgcgaaaagcgctcccaaattctcattaagaacttttttcaagatcttcaattatctcgctatttttaatggcattttgtctgtggcccaaatcattacaaaaaagtcattactgttaggaaatgcggatagttcaattttatatactgagggtatcgtagatactttcagggcagtcggaattgcaggatcaaataattccgctggtaatttggcttgtcttttatttgtcatctgtttatacaatttaagagataaatttggttggcttcccctttcaggcgttgtaatgtctatagtggcggcgttacttgcacaaacaagaattgcttttgttggtatggctatagctgcatttatttggttttttagttatgaaacgtattcccgcaatgctcttctaacgaagtatataatgggtattcttttcgttttaggcgctatgtttgtcttgggtatcgaatttgataaaataatacaagttttcttttcagatagaggaagtacacaggacgctcgctttagccagtatgtaaatgcatgggacttcgggcttaagttacatccgtttttaggaataggtatgggacagtggagaagctacctttataatttcaccagtattgttgatattcccatacattcccagtactttgccgtgttaatcgagaatggtatttttgcttttgcgggttttgttcttttcaattttagtttggctaagaaagcatttcaaactgataaggataacaggacactcagaagttttgtggtggcttttttcatagcaaattttgtggttgcaaacttcaatccaaatcagatatataccgtaaacatcgtcatatactatttggtgatttgtctaattgcttattataaaaagcgaccactgtcagagtttaacttgggtagcaaaaaaaattagttctagccttgtttaaacgccagaactaggagtcagaaatgaaaataagaaaaatattacgtgacttttcgtacagtatttcgtcaaacctaatatcattagctgtctcgactttggttgtgttgattgtcccaaagtttataggggttaccgaatatgggtattggcaactgtacattttttacacaaattatgttggagtccttcacttcggttggctggatggtatctatttgcggtatggaggatatcattatagagatttagacagaccaacatttttttctcaattcattcaattcttaatatttgaattgtttttttgcttgatccttgtgagtgttgggctcagttcaaattctccagagaatcaatatattatcgtgtcaactgcttttgcaatggtcctaatcaatttgatgcagttctttttgtatattctgcaagataccaatagaattagagaatacgcaatagtgactacgataggtaggattctgtattttgtaggggttctcttttgtcttgttgttggaataaaatcatttcaagagtatattgttgcagatctaatcggccgtgcaattgctttattatatgcaatctacacttgccgagaaatcgtttttttgaagcttacttattttaacgcgtcactaaaagaaacttggctcaatctaagcgtcggggttaagttattaatagcaaactttgctagtaacctaataattggtgttgtgcgttatggaattcagctacactggggggttagggttttcggaaaagtttcattaacattgaatatatctagttttttgatgacttttattagcgccatcagtttggttctatatccagtcctccgtcgtatgaatgaagaacgattacgtaaagtatatagtgtgataaaaacattacttattttcgttcttttgcttggcttattcgtctactaccccttaaattggatattaccgatatggttgccgaaatacggcgaagctttaaaatacatggcaatactttttccaatgtgtgtctacagcggcaaattctctctcttaatcgtgacatttatgaaaacttatcgactcgaacgtaaactcctcattgtcaatttacttattttagctttgagtttagttttgactatgtttaatgtctttattctaaaaaatctgacattaacaatggtctcaatgatagtgattctttggtttcagagtactcttggtgacctagattgcaataataaagttaccacctagaaagaggcttgctcactgcttgaactggggtttgccaacggagacattttctaggtttgttattgataaacgctgtggctcgttgaatattggcctctgaaacctgatcaaactgtgttcccttcgggaaatagtagcgaagttctcgattgaaccgttcgttcgtgccccgttcattcgggtgataggcatggcaaaagtaaatcggtatctgatagcgctttgtaagcgcctgatcgcaggaaaactctttaccgtgatcaaccgtcactgatcgaaccggccccggaaagtttaccatcagtcttgcaaatcctttgagaacagcattttgtgataagttttcaagcttagttgtcgccattaaacgtgtgacccgatcgacaatggtcaaaacagcagcctttgacccgcgaccaccgcgaactgtatccatctctaaatgtcctttttcggttcgccgattagctgactcactgcgcatctcaattgaggtgcctactgcttgattatagcgcgaccgaagatcttgttttcttttatgacgtttaccgtgatcaaagagttggcttggctgaaaatcgacttgtctttgataaatccagtggtaaatcgtatgtggcgcacagtgaacggcataaccgaccatttcaggggaccaacctaggtttagcttctcagttaccatccgcttcagcctaggcgtcaaaattgagtgccgaccacaacgatgccgacaagcattggcttgatcctgagctataatggcgcagtaatcaccttcagggcaacggtgaagctcatgcctaatagaaatacgagagcggcctaaggtcgcggcaatgtattgaatcgtgtggtgttgcagcagttctatctgagatcgttcaattaaggttataatggccatgggacctgtccttccctctagatggtatgttatgcaaacaccattttagcaagaagagacaggtcttttttcacattttctgggtggtaactttaattatgcaatctagggtgaagttgttcttgaaaggagcatagggattaagaggagccatggccttttactggagactatagtggtagcactcttcatggcaggaaattacctaattggcggattaggatcccttttagggtatttagttgttgtaatagtctatttcaagttaaaccaaagaaagattgtaaagggtgtacgggtgttaatgaaccattaaatagattattatgtagaacttttcttttttcatgaattcttattttaaaataaattgagtttctaaatcttgtgacttagcaaagccacagatnnnnnnnnnnnnnnnnnnnnnnnnnnnnnnnaagacacaagaataataatgaaaatttaattataaaaaagggaaaagctctccagctccggacaatgcttttcaattgtgattgaatgtgcaaatagtaggtctttacgaccattgtctatgttttaaaagaggagtaaagttgaaaaatatttcaaaggatttaaccaagttatccaaatttcaaatattgattgctgcaggtataaaggtgcttaggggagtcggtactaaaccgtttcttcaacaatctcatggtatactttttgttggtaagcacgttcatatttcgaatcgacaattaatctcggtcgatagtaaggtcaaatttgaagactattcagagattcaaggcctgtcacagcatggtgttcattttggcgaagcgagcactattggccgtgctgtacaaattcgaccttctagttattatggggttggacatattggttatggttttcaaattgggagtaacagctctattggtcccggagggttcatcggttgtgcaggcaaggtattaattggcgacaatgtgatgattggcccaaatgttactattattgccgagaaccataatttcgacagaaaagatgaatcgataaagaaacaaggagttcatcaagaaggaattgttattgaagacaatgtttggattggtgctaacgttactgtcttagatggcgtaacgatttcaactgggacagttattggtgcaggcgctattgttaccaaagatgtcccagccgatagtattctgatagataaactgacaccgcgggtgaagccaaggataagataggtattcaagaatgattcttcgagaactagacaatgaaagacatttttatttggaattttttgacatcttaatattaggcaaattatttgaacattaatagattaaacatctgatttaaattttatcggaacaaaaaaattagctttttaggttagccctttaaaaacattcgtaaagaacgcaagtttgtttaatagcaagtctttgacaacaaatttgggttgatcctgcattaggaatgttataagattgcatgaaacaggtattttgggggcaacatttccttagatgataatattggaggggtaaatttggagacagcatctgaccacagaagagttcatgtcgagcaggttaatcttggtggattgacgccaagatatttaattacaaagcgttgtttcgactttacggccagtctagtcgggctgattttactgagtggactgtttttagttcttgctgtattgatcaagatagatgatcctcatgggcaagttttttattcgcaaacacgtttaggaaaagatggtcgactttttcagatgtggaaatttcggtctatggtgaccggtgcggatagaatggttgataagttacttaaaaaaaatgacgttgaaggcgccatgtttaaaattaaagatgatcctagaattacacgtgtggggcgtgtcattcgtaagtatagtcttgatgaattacctcaactttacaatgtattgcgcggagatatgagccttgtggggccgaggccgcctctgccacgggaagttgttaagtatacggactatgatcgtcaacgtttgaccgttgttcccggggttaccggtttatggcaaatttcagggcgtaatgatcttggcttctcagagatggtggctttggatattcattacattaacaatgcatgtatacctgaggatcttaagattttattcaaaacagttcttgtagtcattcatccaacaggggcgtattagcatgattattttattctgacataagattttgcttataattaatatagctattaac

SEQ ID NO: 132 - DNA, 361 bp, Lactobacillus paracasei
gctctcgtatttctattaggcatgagcttcaccgttgccctgaaggtgattactgcgccattatagctcaggatcatgccgatacttgtcggcatcgttgtggtcggcactcgattttaacgcctaagttgaagcggatggtaactgagaagctaaacctaggttggtcccctgaaatggccggttatgccgttcactgtgcgccacacacgatttaccactggatttatcaaagacaagtcgattttcagccaagccaactctttgatcacggtaaacgtcataaaagaagacaagaccttcggtcgcgctataaccaagcagtaggcacctcaattgagattcgcagtgagtcagctaa

SEQ ID NO: 133 - DNA, 361 bp, Lactobacillus paracasei
accagaccataatatcaaagttgcctttgttcgtcatgaatatcgcggcaacggggtacgtcgccgccagtatcatgtgattgatgccgagctgacttaccggttaacccggtgcccactgtgtggctttgaggccttgcaccctaacgggttttacacggcccacgtgcgcgtcctcaatggggttgaaatgccgacagtcattgacttgcacaagcaacgatggcgctgtcataactgttaccacacagtcagtgccaagacgccactcgtgcaacccaaccacacgatcgccgctcacatgacagagcgaatcatgaagttagcgcatgaacggttgccagtcaaaaccatcgcccgt

SEQ ID NO: 134 - DNA, 703 bp, Lactobacillus paracasei
tttcccattcctatatggaagtaagacccctgagagatgatcaggtagataggctggaagtggaagtgcagcgatgcatggagcggaccagtactaatcggtcgaggacttaaccaagtaagcgtgcaagcaggcgcaggtttctgcgactgcgaacacgtttcgatgacaagtacgttaggttcaaggcagcaattaaacaatgatagccagttttgagagcgcaaagttctcataagtgtggtggcgatagcaagaaggatacacctgttcccatgccgaacacagaagttaagcttcttcacgccgagagtagttggtgggaaactgcctgcgagggtaggaagctgccacgctttttttattccggtttagctcagttggtagagcacctgactgttaatcaggttgtcgtcagttcgagcctgacaaccggagttttttatggagagttgtccgagaggctgaaggagcatggttggaaaccatgtatacgggttttacctgtatcaagggttcgaatcccttactctccgtttttatgcttctagatgctttctgtagcttcccggaatgctggtataaaggcatttcgggatttttgtttccttttattttcggttgtttttttcctccggtgcacaaaatgtgcacaagctaaagtctcgaaagtgcttgtagcgtctgggatacctgctctttt

SEQ ID NO: 135 - DNA, 1301 bp, Lactobacillus paracasei
aataatcgtctgataagctgcattcatgtccatggtgaccgtctggacccgagtgcgttcagcgagtgaataatgagcgatgaagaagtttttaatcgtgcggttgaatcgatcaccaagcaaggcaatcagacgatgtgaatcggcatcaagacagataaacgacatcatgccatgagtggaacggaactcatcaaagcagagtcgcgtgggtagccggcgagccggtcggagtttgagattttggtcaatgatccgttgaaccgaggaagctgagatcccgataatacgggcgatagttttgactggcaaccgttcatgcgctaacttcatgattcgctctgtcatgtgagcggcgatcgtgtggttgggttgcacaagtggcgtcttggcactgactgtgtggtaacagttatgacagcgccatcgttgcttgtgcaagtcaatgactgtcggcatttcaaccccattgaggacgcgcacgtgggccgtataaaacccgttagggtgcaaggcctcaaagccacacagtgggcaccgggttaaccggtaagtcagctcggcatcaatcacatgatactggcggcgacgtaccccgttgccgcgatattcatgacgaacaaaggcaactttgatattatggtctggtattccaaggacggacagtgtaggatcgtattgggacatttactcataacctcgcttgcttttggtttcgacgctaacaagcatagcatggacactgagtaggtgtctttttgcgttgtccaaaaagggcctacacgttcagtgttgattatttctcaacaccagaaagtgtagaccccgaaaatcgtcagacctgggagactatttaccatggaattatcccaaattgatgaattccgggacaaggattgaagaaacaaacaaaaacaaggaatgattccgggagacatctgactgtccctagagatcactccttgtttttttggtcaatacgtcatttggaagggtgcttaccttatttgtgattcctgccttcactaaaagcaaatcggattcgacgccagaaatatgacagagaaagattcgatttaatctgttttgatctgcgcattttttgttggactgtccacacttgtcgatgtcagtcataaaatgtaggaaaatggcgatttgaaattgtcggttttcctacattttttgataccatgaatcacatcgtaaccaaggaggaaaacgatgtgagacatgacattcgagaggaagttagaaaatttatgattgaggatatgaagcccaacttcgccgccattgcc

SEQ ID NO: 136 - DNA, 3919 bp, Lactobacillus paracasei
ggttgaacgttgcatatgcatgtgcctccagttatcagctatttaaaatagttagttgattatatgtctaactaacattattctagcctaatccttttgttagtctatgtcaacaaaaactaacaaaaagaactgaacaaattttgtccagttcttaaatcaccttgaatttccatgtcctcggctagtgtgcttgcaaatatgcctgaacgaaactaatcatgtcgcgcgactgttgattaaacaatggcggcagttgatcaaagtcaaagtattgcaaggccaacgtttctttgggatccgcttcagccaaactgccgccgaccggtttgacgagataaaaacggcagatgatttgggcctgatcaccattgggataagttgtaaatccttggtcgaaagtatgcagtgccttgactggttccaccagtaaaccggcatcctctttcatctctcgttgcaaggtttcgacaaaggtctcaccgtactccatcatcccacctggcaagctccagttaccggcatctgtccgtttttgcagtaacaattgtccctgctcgttcaccaccgcaccggcaacagcgtttaaaaaaatcggcatgtgtccgactttgctgcgaatctctcgaatataatttgccacttaactgcctcttttctcgaatcggttaatctgattatcaagcagtcagccaattggcgcaactagctgcaagacaattcgaacactttgtctagacgctggtatgcttaaaacaataagctcacggtaaatggtccaatcaaacaaccccaaccaaatttgaccgcaaacaaatagacggccatcctcgcaactaaaagtcgcaatgacagccgtcttttcaatcacttaagcaattgatttttggattagtccagcttattcttgctgttgacgttcaacttttcgtcgaagtcataaacaacaggttcgccagtcgccatttccaagttcatgatgtctgcatcggaaatgttttcgatgtacttggtcaaggcgcgcagtgagttaccgtgggcagcgatgataacattcttgccagccaacagatctggtgcaatatgatcttcccagaatgggataacccgttcgagggtcactttcaggttttcgccgccaggaatgatccgtgggtcaagatcagcgtaacgacgatccttagcagctgaaccttcgtcagttgctttcaacaatggtggcaaaacgtcatacgaacgacgccagatgtgaacttgatcggcaccgtatttatcagcggtttccttcttgttcaagccttgcaaagcgccatagtgacgttcgttcaggcgccatgtcttcatttctggaatccaaagttgatcggattcttccaagacgtaatgcagggtcttgatcgcgcgggtcaaaactgaggtgtaagcctgatcgaattcaagaccagcttgcttaaccaattggccagcatgctttgcttcttcgacacccttttcactcagatcaacatccacccagccggtaaattggttggacaaattccattcactttgcccgtgacggatcaatactaatttcgccatatcagagaatacctcgcttttatgatttgacagtcttctgcctgtttacagaatctcatgttacaccattttcagtaagttcgcacccgctttctctggtatattggaaagggattgttgccaaaagaacatacgacgcaaattaactgcggcttgatttgcttttggcaacttttagcacgcatcacaatcataattgtcaccttttactgaaaatatttctggaggttcatgtgaaaaaaatttggctatcaattgctggcgtttggctcatcagcgtcatttactttatcgtctatctgacagttcccgccatgcaggttgcggttaatgcaagcggcctgttgtcattggttcatggtgtcatggatctaatcttacttggcggtgcgtttgccttaatcgcaggcgcgttatatcgaatatttcatcgtcgttaatgataaagacagttttttgttatactctttttgtacaactttaatttcattctttatattcagcactcatacatatctttggagggaacactatgtttaagatttgtccaaattgtggtgcgcataatactgccaccgctaaattttgtaccagatgcggcaccagtttagccggtgtcgttgcaacagccgaaacggcggttcaaagtgcacaaccgacttctgagaatgaagcctcaaccgccaacacagcagctgttagcgaacaatcttcagtgccaagcagtctaacttcatcgacagctcagaatcaacctgtaacgccgcaacaagcgcaaagtcaggtcacaccgcctgacaacagtcagcagcaagtgccaccacaaccagctggcacacagacacaaagtcagcaaacggctcaaggaccagcaccgacagcgcagccttaccagcaggctgatcaaacgcagcaacaagcacaaacaccgccagaggagccaaatcccacggtggaggctaccaaaaagtatgctggcagttactggcgctatctggtcgacagcattaaacatcctgcgactgtgacgcgaccatatcaccagtattttgggctaaccagtttagccatcacgattgttagtttggcattaaccattgccttgatgactggttccgcagtgtcgtcattgccaggcgcaattgctagtaatgtgttgatgaccttcctaaaattagtctttctagtggcggtcctgatgattgcggtggtcgccgtctattacttagtcgtcaacggcatgcttggcgatcggcgccgatcttttctgacatttaccaccgagtatgcctttcactgcaactggatggtctttttctcagtgtttacgctgctcatgcaaatgcttggtatgattaacatcggttcaatcttcctgatttggttgctgctatcgctgggcagcgggttattcgtcatctctggcacgtatatgttgttcaccgctcagtcaaccaaccgttttgataaaatctacgcctatctaatcgttggtattttactagtcatcgtgttcttgatcatcatgacgttcggcctttcaagtattctcggcggcattggacaaggtatcaatgattttggccgcagctttaacttttagacaagtatctactgcttaatccaacggctttttagacaaaaatgggtctacactttctggtgttgagaaataatcaacactgaacgtgtaggccctttttggataacgcaaaaagacacctactcagtgtccatgctatgcttgttagcgtcgaaaccaaaagcaagcgaggttatgagtaaatgtcccaatacgatcctacactgtccgtccttggaataccagaccataatatcaaagttgcctttgttcgtcatgaatatcgcggcaacggggtacgtcgccgccagtatcatgtgattgatgccgagctgacttaccggttaacccggtgcccactgtgtggctttgaggccttgcaccctaacgggttttatacggcccacgtgcgcgtcctcaacggagttgaaatgccgacagtcattgacttgcacaagcaacgatggcgctgtcataactgttaccacacagtcagtgccaagacgccactcgtgcaacccaaccacacgatcgccgctcacatgacagagcgaatcatgaagttagcgcatgaacggttgccagtcaaaactatcgcccgtattatcgggatctcagcttcctcggttcaacggatcattgaccaaaatctcaaactccgaccggctcgccggctacccacgcgactctgctttgatgagttccgttccactcatggcatgatgtcgtttatctgtcttgatgccgattcacatc

SEQ ID NO: 137 - DNA, 361 bp, Lactobacillus paracasei
aaaggcttttaaaaaaactgttgcttcctatcgctttgcacagggccgatcggcccgaacgtcgtttgtgattgttgatgctcaaagtgttaaaaccactgatttaacgaaaaatagtggctacgatggcggcaaaaagatttcagggattaagcgtcatatggcggttgatattaatgggttaccacaagccattctcgtgacacgagctaatgtatcagatcgttcaggtgcattggctatgtttagtttggctagccaaaatttagagctggttcagcatgtcatggttgatggtggctacactggcaatgactttgcggatcaggtgaagctcattttgaatgctaagacgacggta

SEQ ID NO: 138 - DNA, 457 bp, Lactobacillus paracasei
gtcattgaagcgcccccggcgttcatttatggtgcctttgattttgcgcgtcttgcctcggtgtcgaagcagccttggtagcccgcgagcaccatggctcttcaatggaacgccgagattatctaggtagatacctctgtagatagtcgaatagctgatgcgaataggactgccttctagtgacaagcgaccggcaatctgctcaggcgaccaatgtagcaccgtgatatatcgaatgacagcgtcacgagtccccggtcgatcgaggatccgaggacgcctgctagccaagcgaacccgccggtagcggtcctgagcggtggctgccgaatagctccgccagccgccgttacgtgcaatttcacggctgactgtactcttggaacgacctatctctttggcgatggtatcaagagttttgcctgtagagataccaagcagtatcgattcacggtct

SEQ ID NO: 139 - DNA, 361 bp, Lactobacillus paracasei
cctgtttggtttgaatgaatacgtcacgcaacaggaggccatcgatatcgcacttgatactgagcccaagctcaagcaaacctacgagacctacttagcgcttcatgatgctttgatggtgaagaaacatcccgcggaactggcaaacctgttagctacttacgagccaaacggtacggccatggacatgacgatcgcgacgcttaagcgacacaaagtcgctgttctcgccgctgtcaccagcccttattccaacggtccgatcgaaggggttaaccgcctcatcaagtcactcaaacgatcctgttttggcttcaagaatcagctgaacttcttcaaacgaatctaccaaatcacggca

SEQ ID NO: 140 - DNA, 517 bp, Lactobacillus paracasei
tatgaccaatacagctattcgctacacccccgaatttaagcaaaccttgattgatcttcatgaaaaaggacactcattcaaagaactacatgaagaatacggtccttccttagacactattcgcaaatgggttcaggcggccactgtcattgccattgatcatcaaggtactgctgtgactaacgaacagttcaagcaacttcaaaaagaaaatcgccgtttgagggaagaactcgatattttaaaacgagcggcggtgttgctggcaaagcgttggcgctggtccgcgtcaagtagacaggtgaaataattaaagtgcctatgcagttttctttacggcatgattccggtatgtcatcggggtcatgccgtttagtgtttcttggcggcgttcgttgttataccagttgattgccgcctcaatacgcttcatcatttctagttccgataagcagtgctcaaaggaaaatctctcgatcttgaggtgactccacaagctctccatcgggctgttatc

SEQ ID NO: 141 - DNA, 361 bp, Lactobacillus paracasei
tccgacggaatttcacgtgttccgccgtactcaggatcctggacggagggttcgacgtttcgcttacagggctttcaccttctgtggcgcagctttccagctgacttcgactacgtcggactttggtaactccaatgtccagtcctacaaccccgagaagcaagcttctcggtttgggctcttcccacttcgctcgccgctactatgggaatcgagttttctttctcttcctgcgggtactgagatgtttcagttccccgcgtctgccgccggccagctatgtattcactgacaagcaatacactgatgtgtactgggttcccccattcggaaatctccggatcaaagcttacttatagct

SEQ ID NO: 142 - DNA, 386 bp, Lactobacillus paracasei
tatgcaactcgttgcgtttagctaccgtcgtcttagcattcaaaatgagcttcacctgatccgcaaagtcattgccagtgtagccaccatcaaccatgacatgctgaaccagctctaaattttggctagccaaactaaacatagccaatgcacctgaacgatctgatacattagctcgtgccacgagaatggcttgtggtaaaccattaatatcaaccgccatatgacgcttaatccctgaaatctttttgccgccatcgtagccactatttttcgttaaatcagtggttttaacactttgagcatcaacaatcacaaacgacgttcgggccgatcggccctgtgcaaaacgataggaagcgacagtttttttaaaagcctttcta

SEQ ID NO: 143 - DNA, 422 bp, Lactobacillus paracasei
tctaaagcttggtaacgcaaggaagcatccattgaatccaccttaaactgcaagccgtattttgattggatgcccttatacccatcttgccggtcaatgaactctaaatcaaatccggcgcgaatggatggtgcaattttgccaagatcgctaatggtatgcagatcataacgcttggcaaaactttccttaacgactaaagcataggtgttgttatacgccatcggtttgagatagctcaggccttgtttagcaagcagtttctttgcaagtggataattatctttaccagccgtcacctgttgttgctgagcggcagatggtttcgtcaaacttgccagaaccgtcccggaaaactcagggtatatgccgatcttatcggttctcaacgcattgtacaagaagctcgtctgtccaaagtt

SEQ ID NO: 144 - DNA, 450 bp, Lactobacillus paracasei
ttaatgggtgctttggcagcagcgctattggcgattgtcttttcgtggctcttaaatgtcatgcaaaaagtgagttggaagatcagcatcggggttgtggcggttgccgtccttggtatggttggcagccaagtatacacttatgtgaccgcaccaaaggaaactatcacgattgcgggaaaactaggcagtgaaccggatattttgatcaatatgtacaaagaactcattcaaaaagctgatcctgatgtcggggtcacgttgaaatcaaactttggacagacgagcttcttgtacaatgcgttgagaaccgataagatcggcatataccctgagttttccgggacggttctggcaagtttgacgaaaccatctgccgctcagcaacaacaggtgacggctggtaaagataattatccacttgcaaagaaactgcttgctaaacaaggc

SEQ ID NO: 145 - DNA, 443 bp, Lactobacillus paracasei
gagcttcactggcaagaagaccaggaaacgcagcgaattattcgtcgtgctcggtttccccaagaaaagacacttaaggcgtttgatttcgacttccagccaaacatcaataagcaggaagtacttggctttcaagacttggcatttatggagaagcaagaaaatctggtattcattgggagtccgggtgtcgggaaaacgcaccttgccatcagtatcggcatagaagcttgtcgccagggtaaacggaccctgttcatcaattgccatgagctattaagccgccttcgtgcggcatatgaaaaaggagatctcgatcgtagtatcagtcggtatgcgcggtatgagctactggtgattgatgaaatcggctatttgccaatcgaccacgatgaagcaaatctcttgtttcaactcatcaacgccagatacgagaagtgttc

SEQ ID NO: 146 - DNA, 361 bp, Lactobacillus paracasei
tgtttagcgtcaggcgcggtttgatgaaaaagccgccagtttgtcttcatgatcttataaggacggctgtgtttgtcatcaagctgtttgagcgcttggacgcgtacctgatcaagggcacgagccgcaagttgaatgatatggaaccgatcaatgacgacttgggccttggggaaaaccgcatgaataatcgtttgataagctgcattcatgtccatggtgaccgtctggacccgagtgcggtcagcgagtgaataatgagcgatgaaaaaatttttaatcgtgcggttgaatcgatcaccaagcaaggcaatcagacgatgtgaatcggcatcaagacagataaacgacatcatgccat

SEQ ID NO: 147 - DNA, 464 bp, Lactobacillus paracasei
tacgactcgccaattcaattacaatcctgaggatcgtgttgagattcttggctctgaccttctaaaaggccgaagtaccaaggatatcaaggcctatatcaaagagcatttaagcgattacgatgaagtgtgaggcgtaaatcatgacaaaatttcaagaactactgactaatttagacaaccttggtcttggcaagatgcatgcatatctgccggattatatcgatcaaattaatagccaacagatgtcgtttacggatgcgatgctcaacctgacggaagcagagcttcactggcaagaagaccaggaaacgcagcgaattattcgtcgtgctcggtttccccaagaaaagacacttaaggcgtttgatttcgacttccagccaaacatcaataagcaggaagtacttggctttcaagacttggcatttatggagaagcaagaaaatctggtattcattggg

SEQ ID NO: 148 - DNA, 361 bp, Lactobacillus paracasei
tccgacggaatttcacgtgttccgccgtactcaggatcctggacggagggttcgacgtttcgcttacagggctttcaccttctgtggcgcagctttccagctgacttcgactacgtcggactttggtaactccaatgtccagtcctacaaccccgagaagcaagcttctcggtttgggcttttcccacttcgctcgccgctactatgggaatcgagttttctttctcttcctgcgggtactgagatgtttcagttccccgcgtctgccgccggccagctatgtattcactgacaagcaatacactgatgtgtactgggttcccccattcggaaatctccggatcaaagcttacttatagct

SEQ ID NO: 149 - DNA, 361 bp, Lactobacillus paracasei
ggaaaacgatgtgagacatgacattcgagaggaagttagaaaatttatgattgaggatatgaagcccaacttcgccgccattgccgagcaatacaattgtgattaccggaccgttaagaaagcctatgaggaggtacagcatccaacaataccagctacaccaaagcccaaacgccctagcaaactggatccgtacaaaaagcaaatcaatgaaaagttagatatttcgtgctctgccatggcaatttacaaattcatcgtcaaacatggcttcactggcaagtattcaatcgttcgagactactgtgccaaatataaggatcatcaagtacataaagcgacgattcgagttgaacatact

SEQ ID NO: 150 - DNA, 436 bp, Lactobacillus paracasei
cgtgtggttgggttgcacgagtggcgtcttggcactgactgtgtggtaacagttatgacagcgccatcgttgcttgtgcaagtcaatgactgtcggtatttcaaccccgttgaggacgcgcacgtgggccgtataaaacccgttagggtgcaaggcctcaaagccacacagtgggcaccgagttaaccggtaagtcagctcggcatcaatcacatgatactggcggcgacgtaccccgttgccgcgatattcatggcgaacaaaggcaactttgatattatggtctggtattccaaggacggacagtgtaggatcgtattgggacatttactcataacctcgcttgcttttggtttcgacgctaacaagcatagcatggacactgagtaggtgtctttttgcgttatccaaaaagggcctacacgttcagtgttga

SEQ ID NO: 151 - DNA, 361 bp, Lactobacillus paracasei
atggactaccagggtatctaatcctgttcgctacccatgctttcgagcctcagcgtcagttacagaccagacagccgccttcgccactggtgttcttccatatatctacgcatttcaccgctacacatggagttccactgtcctcttctgcactcaagtttcccagtttccgatgcgcttactcggttaagccgagggctttcacatcagacttaaaaaaccgcctgcgctcgctttacgcccaataaatccggataacgcttgccacctacgtattaccgcggctgctggcacgtagttagccgtggctttctggttggataccgtcacgccggcaacagttactctgccgaccattctt

SEQ ID NO: 152 - DNA, 412 bp, Lactobacillus paracasei
caaccgttcatgcgctaacttcatgattcgctctgtcatgtgagcggcgatcgtgtggttgggttgcacgagtggcgtcttggcactgactgtgtggtaacagttatgacagcgccatcgttgcttgtgcaagtcaatgactgtcggtatttcaaccccgttgaggacgcgcacgtgggctgtgtaaaacccgttagggtgcaaggcctcaaagccacacagtgggcaccgagttaaccggtaagtcagctcggcatcaatcacatgatactggcggcgacgtaccccgttgccgcgatattcatgacgaacaaaggcaactttgatattatggtctggtattccaaggacggacagtgtaggatcgtattgggacatttactcataacctcgcttgcttttggtttcgacg

SEQ ID NO: 153 - DNA, 390 bp, Lactobacillus paracasei
gatcggttccatatcattcaacttgcggctcgtgcccttgatcaggtacgcgtccaagcgctcaaacagcttgatgacaaacacagccgtccttataagatcatgaagacaaactggcggctttttcatcaaactgcgcctgacgctaaacacaaacagttcctgtttggtttgaatgaagacgtcacgcaacaggaggccatcgatattgcacttgatactgagcccaagctcaagcaaacctacgagacctacttagcgcttcatgatgctttgatggtgaagaaacatcccgcggaactggcaaacctgttagctacttacgagccaaacggtacggcaatggacatgacgatcgcgacgcttaagcgacacaaagtcgctgttctc

SEQ ID NO: 154 - DNA, 23272 bp, Lactobacillus paracasei
  misc_feature (22213)..(22305): n is a, c, g, or t
aacactcttcgatcgagttcattgatgaatctgcgaagttgccagttttttttgcgacgtctttgcgccaaaataacctccgacatgtcaactccgttaccactgtaccaaaaaagcttagtggtgaatcacaaccccgtcggatcatggttcatcactaagcttagaatgtttttttgctgatttttaatcagctcaacaactaatgctaacagggctacgacaaacatgccgaaccctagcataagctgtaaagcgtccgaaatggacacaaggcttctcctttcgttggtatcgtggtacgttggtttttacaccataagcaccacctccaatctacgaaagtcgccaccgcctttaacttttctgctatgtttagtatagcatataattggctttgttcctagaggcgcaaggcatacagcagtcttgctaccgcaaaaaaagcctcttcggccaaggccgagaagcgtggggcgcctgccccgcccacgcgcttcgggcatctgcctgccgcgaggattcaatccgaccttggcaacatgatggaacggaacggcaaaaaccagtcgttctcgtcgccagctcgacggaggcccagcaggtagggcattacatactttgctctagtcctgctgcacgttgctttttatgctgctggggtttaaccggctgagtttgttgatatttctgttcatcttctttgtctacagcgttgtagccatactgcttaatgagataggcgcactgctgtggatcgttagcttcaaagtagcccacaactttatctggttgtttgcgatcaactaaagcgtattgattctgatctttggcgattagtttgactgtttgcccgtcctcacgacggtaggttttttctaactgctgatccattgttgctggatgttgggccaacttagctaactcattccagtctttagcaattttagtcactggcagaataccattgtcagcctggtaacgtgtgttgtagtaagaagatttagtggctaaatgttcgcggtcatgatcctcaataccaggatttaattttttcgtaatggcgtcccaattaggcttgttatcatcggtgcgattagctttgatgaattttgctgcggttagtaaagcctcatctgaattaaagttagtttttccagggttgatgagcatgctgcttttggcaatggcttgtggcagcgggaaagcctgctggtagttcgttgaaaggttggtcgttgctttaactgctgctgccaattcacgccagtcaatgcccgcctgatttgcagcctgtttcaagccctggtaagtcgtctgggtgatcgcattatcctgtgggaaaagcggcttaaaggtagttacctcggcttcggtattagctaagatggagtcttgcagcttgtcatatagctgatgaccggctgggtcattgtcggagccaacataaatagtggccggcagttgcccttttgttttatacatattgacggccatattcaccacactctcaactttggtaccatcaactgaggcaatcatgcaattcgttagctctgggtgttgcgtccagtaacttaacgcatcaatcggtgactcaaagacatacaagtcttgaggttgccccaaactaaaattgaagccaaaacctgattgcgaattagcagcaatctttttttgagtgccacgtttaccgtattttttaaaatcgatttccgtaccttgaatactggcgccaaccgccttgccattgcgggcccattgaaagatcaggttgttttgtgagtcctgaaaaatgaggctcttttggtacagacggtcaaccagatgaggattaatgcccctagcaatggtgaggtaatcacgtgcttgatcaaagctatcagctcgtttcaagtagttgtgataggctgccttcggcgcggtttgaatctttgtttcatcgtagtgaccagcgttgagaaacttgacagcctgatagaaacctttctgatctaaaaaggtggtggcgaattcaatcgcaccaccacctaaattctgggagttccatttccataggttctttttagcatcaataactaaggagtcgtgatcgacaccgcggtagtaatcgcgggaatcctccttgagatcaatgccagcgctacgcgcaatatcaactaaggacaatttacgcgcacgattgatttcggattgcgtcaaacgctcacgtttaccactattgaggtttgctgtttgttccggagcatcgttaagcgttgcttctgcggtctgtgcttgatcaaagcccaaagtttgagcggcttgatcagacagctcgatcgtatgcacactggcctcattaatctctttgagggcttgtgccatcactttaggatctttcgcccaagtagcaacataccctaatgaataatcgccagtgtcgatgccaatgttttgcatggcaatgtaagcaacagattcggcttgcgcttctttccaagctcgtggtcgatcagcaaatgtctgaccaatgccatgtagctgactgtggccgtactcatgaaacagcgtcttgagtttcatagccgcatctgtttcttgtggactaatcacaatttcttgggtagacggccgaaagaaaccgcgaacccccagttcatcaatgggcgcttcactgactttaacgtgaccttcggtgttgatgacatcaacgacagcgtgatataagcgatccacgttttggtgatcgcccaaccgctccttaataaaatctgttgcggatagtaaagatttgccgttggtttgactgacatcgaatactgagccgtagcgataaccaacaattgctcgttcagcggtcgttttgtatttgacctgttcctctggcgtgagcctcttaacgattggcatggtgatcttgatggcgtgttcacccttgcgaatgtgacgacctaatttgtcccactgcttaaaaccggcaacccgcgttgcattaggatgctgcatattaatcaagagcacgttgcggacggagtaaccatggaaggcagcgttttgccgaaggtattgcttaaacttttgagtatcagcaagtgcgcttaattgttctgtggctcgctgcgccatctcatgttcccaggctttgatctcagctttagtcctcgccatcttcaccatcctcctcccatgtgacgttctcttccgcaccaggaaccggtttgatgatcggctccaaagcgtataacgctcgatactgattgtcggcaacctgctgccaagcaacccgtctcattttggtggacgttggttgcaagctgacggttggataatcggcgaggttgtcaatcacgggcaactcactgccgagcacttgcatttcatctgcataaatagctggcatcatcattttcctttctatatagaagacaaacaaaaaacgccctagtaaaagcgcgtctgctgtgcctgtttcttcttgtcttgttcacgttctcgatcctgatcagactggcgtctttgatactcgcgtttggctaaccgctgtgccttgatatcggcgttgaaaatcttttgtaggccgttcaagtgattggctactgatggttgatgatgtgtttgagaaacagcttcttgttcggtacggtaagctgatatatcttttaaaatactgttacccatccgggcatacagttcatgtaatttgttatcggtatagtcttgcgcacggttagcttcttttgtgccactgccatacaaggcttcacggaaacgtgtttcttgtgcgagtagttgtttaaattcgcccaactcttctggcttgcaacgcatcaaatagtttcgtgacatggcatctaactgaccgcgatagggctgcatggcattgttgttgtacttccaaagacggcgatcacggggtaagcttttgaccagctcttgatacctaacggcaaagtctaggctgctctgatgacgccaaacagaacgctgatcgggttgtagtcgttgacgaatgaggtcactgatccgtgcaagtgaacgatcgcgatcaaccatttcgttagcaaaggccgccttgaaatggttcaagatcttcttaggtacataacctttgcgctgccattcttgataggtctcaccgtgcttaccttcgaccgtaactcgtttccattcacgggtaggttgtggctccacaatagcaacgtggatatgaatgttgtccgtgttgcggtgaatcgcagcagaccaaatagcggaatgtgtcatacccattttaccggtgaagtcgttcatggcgacccgggtagcgtcccgcaacttggcttcatctaactgtttggtcttcggattgtagacattgttttcagctaggaagtcatttcggaaactgaatacggactgccacatgactgactgatgcttttgtgcaacggtgaattgtttctttaactgaacgcgttgtgttggtgttagatgatcgtattgatcagtgaagatgccggaagactttttcggattctccatgtagtggttgtagccgtcaactgacagaatattttgttggtcaaagtgatcaattcgaattgcctcttctcgatcaatgtagttgatgtagctgccaaacttcttggcatgggctgcgacaaaatcagtcacattgacaatgcccggtgatactcgactaggcatcagcaccaccacctcgatggtgtacttgagtcgtttggtgacgaatgtactcggtcttaatctggtcactgacaatcctacgagcaaccgttgttggcttcattgtgtcatcgggaatgggcaaattgtcccagccgttttgaacgacaacaccgtcaaacagtttcaacaagaccaacaagttacggtcagtcatcgtgactttctttgtggtgggtttgagttgttccataattccctggacaatttcatggactagttgttgtttctgcataacttgttggctcagttgatggtgttcatccattaaagacttgagggcagcacttaaagttttaagatcattctgatccatatatttttgaacgtcctctggattagcgaagccttcaaggttggaatccaaagtcactgtttttctaattctcactaggcaacctcctaaccgcgtcaacaaaatcaagataggctttcgtattttgctcaatgatgattgccatttgtcttgttagttcgcgcaaatcggacacatcaccactgagtaagtgatcggttgcgtcatgatgaatgagttcgcgaagataggcttctcgtgatagatgagcacgtttagcagaagattcaatacccgccaaatcttgctcagataaatctctcactttcaattccgccattcttttttcctcctttaaaaatatgacgccaacgaaaacgtcactgctttgatagccacgcttccaaaatatttgatttgttgagccttaggttgtacttagcaagctccggattttgatttagttcccgttgcttttcagctacaaggtgatccaactttgcgattgcctgatcgctcaaggtcatcatgactcgacgtgtttcgttttttttatccatctcaaagcctccttcatagtgatgacaaactgtcgcctggcaaacccacacggcgttaaaatcgcgtcacgttaccggacgatttttggtaaacagttgcgactactctggtcaaaacgtcaacgtttttcaccagccaaacgatcagaaaaatttgagttgcgaaccaaccgacctcaaaaacggctcgatcgaaacaagcgtatttttagggtgatctgacaagtcctaaaataaagaaagagcataaggtaaatctgaccccaaaagtggggtaaaccgcagtgcggtttgatttatggtggggtcacgttcctagtgaattgttgtattatgagataaaattcaacattagaaaaaagacgatgttgaattttagaagaaaatccaacatttatcaatcgcgcctaatcccttgtgcgagttggcatacagaggatagtgtttaatatttctccaaaatgcaacatttgccaaaaatggcacctgaccacgcgaacaagcacagtttcggtgttgcaccgttcacaactcactagtgacttgacgacaacatgaagtgcacacaacaagttgcaccaactgcaagctaacatgtgcactcaatgatgagcgtaatgttgatagcgcttctcgtaactttgaagattgttctgggccaccttaatggcactttgcgtgtcgctgatgtcttgtttcttgtcttgtatattcgtctcggtttgcgtcatgcgttgttcagttgctcgcttttgcttgccgacttgcaagttggcggtgtctttttgacgggctaaactagtcttcaaaattttcagatcatgattgtattggactagcttcttttctaaggaagcgactcggtcggtcgtgttactacgtaaaatcttgaggtagttcttaagataaacaccttctgttagggacgtcaccttggtaggatggcgaaggtctaggagaacaaaatcaatcgcactcgtgaccactgacaggtcttttcctaaacctagtttgacaaacaagcgaccattgctgatcgcacttttcttaagcttgaccacgtaataatcatcagcgatctgtttcaattgggtatgaaagtcattgccgctatgtgtctttttggtcacgacgacagtcgttaaaggtgccagcgggtcaatggtgttcttggtaacgtagaagtacatggcggcgctttgcttgtctgtatcgatcccagcaaattgaaactggttgttgccttgatcgaaggtctgaccaagactgatttgtttgttgtcggtttgacgaggccataaaacgatcgcaaaaatgagcaaagaaaaagctgctagaagaatacccagcagcttgacgtagcggagactgtacttgtttttgtcttgaaagtgaataccttgattcatcattttaatgttcacctgccttaccaccagccagcactttgtcaatttgctgctcttgatgacccgtatactgtgtcaccactttgccctttttataatgaactagggtcggtaccttcgtgatgcctaacgcagctgccgcttccttgttttgctcattagcaacgctggcaaacttgagttgtccggttactgaacgccagaagtaagtgcgataaacttgctggcacactgaacacgtaggactgtagtaaagaatatattgatccttcttttgtgcattgatggtgattggtgttgccacattgatcattgccttcggtgcgtaaacatagagcgctgataaagaagacgtagcgatgacaataccgataacagcattgatgaggaaatgtctaaacggatgtttcacggtgtcacccccgatagtgcgcggttagaatcaaaggcagctaacttgtagtcgttgctgaccttcctgaccgtcccttgaaaaaccatcgtggttttcttatttgtgttcgtcttgttgttaccaagttcgtaacgtgccattaacaagtagtcatcaccctgtggcgtgacaaaaacgcgcaagtcgttaatagtcgattcttgaaacccatttgcactaatgggtgtatcacgatcaggcatgaaactttggatcgcctcacccgttaggtaaggtttcatggcttcatactgacccattgtggtggccgttttaggcgagtacatgccttgcaacagcccattcatcatctcagtgatcttctgtgttgtgtctgttagattatctgattgagatgatgtcgtagtcgattttttactagcgttgtcagcttgacttgacgcacgatcgacctggttagaaagtttgagcgcctctaattgagtctctaatgatccatttttagatgccatggtacggagttcttgtttttgctgactgatgtttttgttggctgtattggctgacgtccagccatagacaccaacaccaagtgcgaggatcatcatgacactgaccagtattgttttacgattcatgtttacctccttgttctatggtctgaccgcaaagtctggttcatagtctttatagggacgaatatggcagacgtcattgggctcaggttcctcgatcacttgaccatcaccagcgtaaaaagcaatgtgatgtgacgcgccatgatcaccacaaaagatcatgtcacctggttgtagttcactcatgacaggtttgccaccattgaatagcatcgtgcctttactctccaaagacaccgtgtattgtgggtaagatttatgcgtgacttgcattaagacgtaaccaacaaagccagaacagtccatgccagtggctggagacttgccaccccagacatagggaacgccaagatatttcttcgcttcggtaatgatggcactcccattaccgacacttcctgcacccgagttgcacgttgttgttaagggggcacctgcatcggcaccgaattcaagcattgtttttttgaccgaaggtacccagttggcattcagtcctgtgggatcgttagccgcacccacaggacagtagaccgatccaagcttctcaaccgttgataactttcgctcgacaactaggttatgcaaggtggctgccgttgcgtcgatgccggcttcaatagttggatatgaaatgatggtgctacctgacatctggcctgacggattgttttgatgactcacagccgaacttttcccccagccactttcgtgtcccatgatggacgcaaaaagagtaggcgaaacgcctgccttgttggctgctttgatggtgtagtcagcttcatctttgagcacgccactcgtaaaatatttggaccatgcttgctgataggtgtctttgttgaaattaccagtcgcagaaatactgccggtaatatcgcagtcactaccgccacctttcttatcgtttaacccagcaaacatggctgcgatgaggaccatgaacaaaacaaaaaacagtacgaaactgcttaagctgccaaagatcaaacgcaacaaccaacgtttgctaagctttttcacatcaggcaccacccttgaagatggcaagttcttgcttcgttacctggaagtgcatatgcagtttttcagatcctaggaggaacatggcttcacctttatcaaacttaggaatctgtaaaaactcgctaggtgacagaatatcacctagcaactgacgcaagatacgtgggttcttttctgttccaatggttgtcgcatcatgcttcaaaacaatcttgtattggcataaggtataaatctgcctgagcgcattaatggcactgaccgtatcacggtcttgcgcattatcaccgctaggaaacatccgctccaaccgctgtgttgctaaacagatggcaccaaaggctttacgatcttctgacatgattcggacaaacaaatcagccacataagctttgttggtattcagtaaagtgtgacattcatcaacgaccaataagaagtggtgaatatcctcgagtgaccgctcaccgtcatcaaatgcctttttttcaatccgcccttgcttcatgcaaacgttgtagcttgaaatcaacgcattataaatctgcaaatcttgtacttcttccgggtaagaatccgcaagcgctgagaggtcataagagaccaccaactcaccgtcataatcaggcaaggtagaatgaacatcaaataattcgccataagtcttccgcagattgttaagcgtgacatagatatgatctagcagtttcttttccatatcgtctgtgcggttttggcgtttttgatcaacaaagtcaatgagttgactgagcgtgggataatcattggcatctcgctccgtaataaaaggcttctgagttaagcctttactgtcccccagaagccctagttgacgatacaagccgtcgcattgggttgcgaagtattgagcctcttgccggctggcatcgtggttaaataaacggtacttaacactcaggtccttgagatgagccttgtaactaccaactggatcaacttcgttgctatcacccacggtcacacttggataaacctgcaatagattgattgtgccgtcacgaccatctaaactaacgaccttcccgcctagagcgtgcaccgtgtctctaaactcaccggatcgatcaaagatacgcactaggtcactcctaatcgcacgctcccaaataatctttttgagctgcgttgatttacctgatcccaggtcaccactcaaaaacagattgtagtaagttcgctgtttgtcgactaaaaactgatcccaatagacggttccaccagtctgcgtgtagccaaaataagacccaaacgggtcatttaaagaagtctgattatgcgcaaaacttaaacctaaaacttctccgctcagcggaattccttcgcgcgcattcttcaagtaccgctgttcaccagcaggtagaaacatcgcctggtactcttccataccttcaccaagaaagacagaggctttgaagctcattttgcgaatctgcttcacgacttcgtttactttacgttccaattgatcacgagttgccgcatagcaatacactcgaatgtaggtctgcctgatgacctcaccgtctttacgtagtgataagctcaatgatcgcagcggatcaatttcattttgaatctcatctgaatcggcaatatttttcgcatgatctaattgcacggtcagttccgtaatagcctccgcaatattgtcgacgaaatcggctttattattattgaccgtatccaccgttgttgtcactccagggatttcagttatacctgtgagccaaaagtcactgaactcctctggaatatcaaaaatatggatcgtcgtcatatagtgatcacccatattcagataaagttcgttgcgcgtatcaataccacctgcaggttgcgttttaaaaacaaagtgctgatctaaatcaagcttcttcagtttcactaacactcacctccggattattcatcatttgtaacatcttctccttttcggcaagtcctgcacgctcaaaggtataaagcgttgaagcatgcctagctaattcgagatttctttccagctccggcacactgtcgccaaagaaccagatccaactgcttagcttgcgataggttttttctagctgcttaagaacagctagatcgtgttgtaacagctcaagataaatgggattacgagtctgctcaattttccgccggaaataagtctgttgccgttggttggtctctggaaaattcatgtatagttccttgatcgaaccagggtattgttgatgtaacccccaaagctcactctcaatttgatcagcgtcttgaacggacagttcaaacaagtcaaagcttttgggcttgaatacgtccgcataaaacatgagaccattgtgagccagcttaatgtagccagaatttgtgataccaacaactggataaatacgaccaacaccatccttgcgttcctttttcttggctgcctctttttggcgtttacgtgcttcaacagcgtcaaactttgttgccacgatgctcacctcgcttgaatagtagttgtctaattggatcgtcaattgcatggtaaatgacccgtttgcgcagtaacaactgtttcataacctgcaagttgttcttttgtggtacaccggattggattcgtaacgctgcagttagcacaaacattaaaatcaacccaaacaacgcgacagccatgggtgttgtcactattaacacaacaaaagtgaccccggaaacagcacctgcaatgaagacatcgcgtatggtcaggagtttgttgtattgtcctttgacaatgagacggcgcgaataaatcaccttatgagccatttaagtcacctcctaaaggttggctgttcattatgattttgatatgagttctttgcactttggattactttgcgtgtattgcttggaatggcagcaccgcgattataggaacgctgtgccaaccgaacggtttgtgaatgcttggcaagtgccggaacgactctgccgccccacatttgacctagcgtccgtgtctcagccggaatctgctgtggcgctgagccagtatcaacggcttgcgttccagattctacttgcgtaccactatctggactagtattccctattgatgctcggtttcccgcctgactaccaacgttgctggtcgctgattggccccgggtgttagtcccagtcgcaaagtttgatccttttggagccggttgccccatcgtacgttgtgctgttttaggttttgaaagctcgccttgatctccttgcattggttcactaccactcagtgaagccatgtctggcccagctgctgctggtgcctcactggctggttctgtgccaatcaacgaagccatgtctggtccagctgctgccggcatctcacttgccggttcagtgctactgagcgaagccatatctggccccgtggttgctggtgcctcactggctgcctctgtaccgctcaacgaagccatatctggaccggcaccgctcgatgaagttggattagcgtctgtgccactttgtttgccaagcgctggatctgttgtcgctggtgtttccagatcaggtgtggctgcgttttgtttggctgcctctgcaccaatgccatcaatggatggtttactaccgctagaacgattactcttattgctcctaaaagcatttgcaaaaccagcaccatatcctgccgcacgagtagcgccatgcgccgttgcgtgtgccgcattgctaacaccacgtgccataccacgacctaggccaccagcagctcgaagacccatcgcaccaccaacaagggttgccccaataccgcgtgcaccgccatccatgccaaacagacttgtcacaatatttggtccgttaatcaaaaacatagcaccagctataattccgaaacactgagccactgggctttgttgatttgatggattcgcaagggcacttgtccagaaggtgaatagttgtaacattaccgaggttaaaaacaacacaatgaaggtatcgcgcagcttttgtatcaaggctaaattacgtttgcctgaatcaatatcagacaaggccatgccttgcgccagcatggtaataaagccgatttccataatggatacgaaaaccttgataatgactaagatgatcgcaatggtaaacgcaaataactcgaaaaacgtcaaatacggatgaaatgagtaccggtagtaagcaatatcgtggaagaatgccttcatatcgcgtaattgatacttgccgtcaccgcccattgtcagctgatgcgacataatttcattcccagtcgcatttagtttagatcccatgtgattcaatagcgtattcccagtatccagtgtttcattaatatctaggttattgacgtcgtcaattgttttgatgcttgtgcttggattgggtgatagggatttccaaccgtcattgttgatccgcattaaatcagtcatattgttggagacgattgagaccgccggacgagctttttgtagtgatgttccgacgccagcaacgaccaatccggacagggttgacgtcaaggtaccaaggccaatgaagataaacaacgccaccatgagattgttgatcttctggtgaaagtcagtcttggtacgatgaatcatcataaaaccaacccaggcaatacccaacgtacaaagaacccaaaagatgggctgatacgcggcaacaaagccactgacatcttttgagttccaaaagtcgatgagtttaaatgcttgactgtacatactggtcaaaccatcagccaaattcgctaacatgcgaataatttgccagccaatccagcgtaggccatcgttgatccatgttgctttgtgcaacactggctgaaacttttccaaatattcaatggtactcaagcattgtcaccttctttcttcttgaatgcgtctaacttttgataggcaaaatccagttgcgcagcaaagtctttcatagctcgccgtgcatttagccaatgagtcatcgcttcaacagaatccagcgactgatattcagcgtagtcatcttgtgtgagcagctcctgaacgcccttttcaatcatttgaagttgcgatttactaaacaaagtcgatagcggcgtcgcttgttgatcaatctctgtagtgatttgtttcttagggtctttaggttccggttcctctgaacggtgaatattgtcttgatctggttttgattcctgtcccgatttttgagatcctaatggtggcgtttcttcggtactttgatctgtattttcgtcagttgctggtggttcagacgtgctttgttctacctgcggctcatcgctgtcggcattgagtgaatgaccattcactttaactgtgatttcaggatcatcattttcattctgcggttcaatcgttgtcacggtaatatccagcaacatttttttgagatcaatgtcgttatgcgctggcttcttgtcgccatacaactcggcaaaggttgcctggtgattaaaccgcgtcagatattcaaacgagaatggtaactccgtgccctcatccggattagcatgaatcggccaagctgtgatcgagcgattgttgagatcagatcgttgcttgctacgaattagcaccacttcgccttttctgagtcgaagcaactcatcaggcatcatgagtcttctagtttcttgcgactcgccaaacgacttgtccgtgtccattggtgccccgtgacgcgatggtgcaattactgttgtttgcccaatttgcttggagaagtattctgcatcatcgtagttgtcagccaaaatgtcatacttgttgccacaggcacccatgatttcggcagcgccttccttgccataattggcctccaactgtgcaattgactgcaaaatcaggtaatagaccagaccacgtccacgaccaacgttgaggtaatgtggtagtccttcaatacgtggcaagttacctagttcctcatacagattaatcaccctccgcttgagctttgagtcagctgcgagcgtcgccatcttagccaacacgtagcccacctgcgatagaaaggtcgccactagtgagtagttcgagttgtcgtaatctgggtagatgataaagaaagccactggtttgtcaccagtggctaagtcggcaatattaaagtcatttgtggctgttaagcggccaatattactaaaggcatagttcttaatgcctgccatcgtaccagtaaagataccgctacgggtaatcccttgcgaaaattgaattgtgccatactgcaatttggctggatcaccagagggcaacttggagaagaacttgtccagtttggtcatgccattctcatctggattagcccctagttcactcaacatagtggtgacagtatacatcgtgattttctcaggtgtgtgttgatcaaagcagaccttacataccgctagaatcaaggcatttagcagtgaaatagacgactgttcccacatcggttcctttgcattcggattgtggaaaatactgtaagaaaaggtattacacaacatctgcgcattatcaaagtctccagcagcgtacgcttgtttcactagctcaagtgggttataggcaatcgagtaagtcggatcaactaggtttaaagccgcaactcgataaccacgtgcctcaaattctgctttggtgctacgaagcatttcgcctttaacatcggtgataataacagagtcatggacggatgcccgcataatgaaatccagcactggcaaggagaacagcgttgtcttcccaccacctggcccagccacagcaactgtattggtgccactagtatccactaggtcaacgccatgatgctggtcggcaccgcgatactgctgcacaacagtcttcaattcatatttgtccatttgatcctttttaatatggagctgaggtacccctgacttaccgacatatggatagtcatttaatggaatggcgatacttgcggccgccacctctgctacccgtgcaaagcgtccggtgcctttttgtccagtattaatggactgaaaggctttgcgccaacgataggtgcgtatgagtacataaatgaccagcgcaactaggccaaccaagtacaacagcactaccagcagataggtgaaatcaggccataaaaagttagccggatgtagtaccgttgcgacaattgtttgtaaactaggtgcctgtttcatcagttttaggaacattgacggaatatgtgtcaaccaattaagaatcagtagaccacctatcaaccacagacctgcaatcgcgattagaaatcgtttgttgccaagcgcttcacgccactgccttttttcgtggttcatgctgacctcctttctgctgtcgctctttattcaccgcggcgcgccatccattccactaatcgccaatatacctttctaaaccttcgataagcgattttaagcacgtagagtgctaatgccacgatgatcgtcatgacaattaacatcagtggatgctctttaatcccatatatgtcttgttcgaggatatgcgcgtagactgccaaaacaagcagtccaatcatgattccccattgaggaaatattacgcgcaagctttgcacaaaaaagaccgcacatactagcgcagctgctgtaagaacaaattgatataactgggattgcgtcaacaaggcagcaggcagtgcatgatacagtaacaccagtgccaacaggcttacaattagctcaagcgcacgctcactgtgctgccgcaacgtggttggcttcatttgatcggctgaaacaccggtctcatagataatcgttgctgttttacaccactctcctgcaaccgatatgccaatcacctgataaccggccgcgatcaggtatcgggtggtttcattaacacgatcatcgaggccatcgctggtaaaactggaaattgtttttatcgctcgcatttttcctcctagttgaagcctcttggtaatacattgctgtagttcgatgactctgtgggtgtgtcgtgtgtcgctttaggtggattgttcagctgatcatcaactgccggtacggcttctttaacgattttgacgaaactggcggccataatgaagtatctggtcgttgattgccctggtgcctcactgaacacactggcgtcaaagcgaccagtgatcaaaacacgatcacccagcttaacgttcttaacgaaatctgcggcagtttcgttataaagtttaacgggaacattgaccttcttagtacgatcttgatgatctcgaatacattccaaataggtagaagcggttagaaaatcctgattttggcggtgtttcacatcggttatgacggttcctgataattgaacactattgatgtcttccatgatgtcctcctattccactgtgaccacaatggtctgttcagcctgttgtccgttctgatcagttgctgtgtaagtcagcgtataacgacctgccttttgcgtattaacctcacccacataggaaattgttactgggccgttagttgacgttgcactcacaccggtcatgggatcaaaatgatccccctgtttaatggtctgatcttgtaaccctttgaaaactggcttttcagcaaccacattaatgacacgatccttggtagttacatggccccacttgtcaacgtacgagtacgttaccgacttttgtcctagtgttttggtatcacatgctgtcaccgtaaaatcactaggagtcgcactatatggatcactaacagagacccctttgcgcaaatctggcgttgatccttgttgaaccgtcagtgcatcaagtcctgaaaaactggcgtctttagcataaaccgtgatgttaatggtcttggttgtttgtccaccatcatgatctgacacgctataggtcagttgagacgttcctaacttagttgtgtcaacgttgcctgtaaccttaatatccttcgttaaatcaccatcttgcacatcacttgccgtgacatttaccacgggatcaaatgaagtttccacttcgattgtttgatcgtctgcactgataactggcaaatcattggctaccgtgatcacgcgcttcgcactggtcgtttgaccggcactgtcggttaccgaataggtcagggtgtacgtcccctctttgcttagatcaacatttcccgtcaccttaatggccttagtaagatcgccatcctctttatccgaagccgtcacgccatttagcacatcaaaagtaccattatgtgacagcgaaaccgtttgatcctccggaacatttaaaacaggggcagtattttgctccggttgaacaggattaaccgggtcaactgggttaacaggattatctgggttgtccgggttgactggtgtaattggattgacaggtttgtctgggtcaaccggctctatgggattaactggtatcggcgttttgccatcatcgttagttttaccttgatcagtttgtgacgtctctgttgtgtcattggtcagtggctttacgctagccgtatcatcgctattgtcatttaaagcctttggtggttcaactgccgccgttgctgccgccagtgatgcttttgctgctggcgtatctaaagttttcgcaatggccgcaattggattactatccaagacactgttggttgccgatttgaaagcctggtcttcacttgaagttgaggtgttgctgtctcctagagcctggtcaataatatcgttgactgtattcttgcctttctccttcttagcttggctgcctttggatgctttaggcttctgcatttttgtctggtaagacgacgtgtgagtggcctgttgattactatgtgcttgtgtggcagcccaaaggccaccagctcctagtagcgcaacggctgttgttgtgatgatgatatgacgtttcttattattcgtttgttgattcttcatagcgactcttccctcctaatgattttctgagtgctaaccagttgtgctgatctttgagtgcttgtttccgatctgtttcagagagttttgaattatttgcgtccgctttagccttctcataggcagcctgataggtcttaccaacttcaagcactttgtcggcatctttattgttcatggatttcgcaagtgtcgccgcttgatccaactttccctcatgaatcaacgcgagaaagatcagctgttgcagttgtggactctttatttctgaattgatggttaaagcattctctggttgattctggtaaatataactgatagctagttttacttttctaactgccgttagatccgcatcttggcttaccgaaatgaccgttgaaaacttcttctgcatataagccaaatcgaagcgtccattatttgatgggtacttttggacaaacgcagctagcgatttttcatcattgtccttgactaacctggcttcaatatcgctatgcttgctgggataaagctttgcagcttgaacgtaagaagcattctgaataagcgtttgataactcggcacaggctttggcctcatcaaaaagagcataaaaatagcaacgactagaatcgttgctgctgctagcacaaagcgctttataatttgtgcagataaccttatttttggccgcttcaattgtggaaattgccacattggtttctttcttgcctgccgccgtaacgggactggctttgatttttgcggtttttgctttgcagcagctggcgctgagctttccgctttacgtactgcttcttcctctttggagacaattggtttgagatgatgagccttttcttgacgagcaactactggcaaggtttcttggactgcttttggctgttcctcaatcgttagttcctgtctaactcggtcggaaaatgctttaaatgcttcaggcgattgatcactcaagacggtttggtaggcatgatctagaatcaagagaaggttatgcagccagccttgtcctgtgccaattggaagattatcttcatactcaatgccgtcctgaccaataattttgaagttcacatcttccttgaagtgatgttgaatcgcataatcgtcagccgcactaatcatcttttcggcttcggataaagacagttgtctctttttctttagaaattgacgcaactttcttgaacattcaaatttagcgtacacggccttctcctttcttttagagtgaggcttattcagaccgaattaacctgccaagccttgtaaccaagcaactgcggcagaagcgaaaataactacaatcagcccaatagcaacattggtcataccatcacgcgcctcgcggattttctgttgatccttggtcatgtgagcaatacccattaagccaaacttgactgccgcatagccgccggcaatggcaataataaaacctaaaatagcgctcaataaagcgatgacttttccttgcatattaatgtccttctttcatattgagattcttgagtgcctgtagaatcagttttcgatggctctcaatctcatcagtcattctttggtaaagccagtcttcatatgcgagattttgttgtttcaaaatctccgttagcatttgtttctgattgttcatttgtgccttactaattgccataacgacacctccttatttttaatgcgactcaacaaatcgctgaaaaccgttttgcgggcgaacataagccacgatcacgcgatctttacttggtaacacccgcacaatctcaccaatacaagttgtatcaggcagaataggccaccccgtttcgatacttaatacggcatgccgtagtttcagcatcaaggctttctcctttggatgtggaaatctaatttcaagaaggccgtttttccgtttagcttccttgatgtcttttgtttgaagaaccaaattgaacatacgatcacctcctatatcaagtttttaggaacggacttaatacgctctccgctaatcactaaactgccgtctctttttaattccgctgaccccacctttagaaccaaaacgtttttcagctggttaggcggctttatattgccaatcaccaccgtcataccaggcttaattggataatcagcatgatccttaacccatgaagctcggactcgataagaaagagcatcatgatctttcgaaatcaacttcaaattgcgatcatgtaaccaaatacctacaggttcagccatgttcagtctcctttctttaacgcaaaaaacacctgcaattagctggcatttggcgttcattattttggcattagccaaggccgcttcgtggaatcgaaccacgattcccagtagcggcatttgttgtcccgtgacacaccattaaattgcgtagcagagcacaactttggtaaaatggaggtacgttaatacctaataaaaacgcgccctagggcgcgctttttgcttgttgacgatgtttttcaagagcttcctgtcgttcctcttcacgagaacacaatccgctaatccgaatagttgtaagctcacacaaaaagataaagcctagtaatatccagaaaatgcatttgagaatcagccacaacaccttaatctctcctcacttttcaatttttgaattgtaggacggtaaaaagcctgaatcataaagtcttttctcagtagcaatcaaccgacgcaccaatgttgagggtcgttccttagtaacctgacaaagggcaagaatgtcaatggtccggacaaaaattgtccggttctgccgaatgcgtatggttgtcacttaaattcacgcattatcagatcttttatcagcgtttaatcttgtttaacgtgcaagagagactacaaacaagccctggcatctggtctttccccagggctgtgcgcctattgaaaggttacttatgcagctgctgactttcttttgcaagcaccgcgaccgttggtctcgcgatcatgattgtagaaggtgttgtaacgagcaatggattcagtgacgtctagaattgattcatagttgatctgatccagccggacccattctcgtttcaatagcgaatggtaggcttcgatccgcccgttatcagccggtttgcctttgcgcgaatatgagtgacgcaggtgcgcatctgtcaatgttgtctcaaataaacgactggtatattgactacccatatcgctatgcaccatcttaaaagtataacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacgctgttgcaaggtaaacccattttgggttgatcagttgaatataggtgatatcggtggtcacgacctcagacaagtcagctaggtgtcgcattaaattaggtttttgtggcatgtcagtggttgtggtaggctttttagagcgtttacgatacattgtcgattgaatccccaattcacgcatgactttccaaatcgtgcggtcacttaagcggcatttaagtaatttacgaatgcgtttagcaatccgcacgtatccgtaaaattttcgacgttgccaaagaacctgaaccagctctttaagcttaattcggcggcgatttcgtgacttaggatgccactttaaccagtcatagtaggtactcgaagggatccgtaacgctcggagaataactgtgatgcggtgcccccggctcaattgatcttgaatcataaaaagagcggcctttcggccgctatgaatcaacggcgctggtccgcgtcaagtagacaggtaaaataattaaagtgcctatgcagttttctttacggcatgattccggtatgtcatcggggtcatgccgtttagtgtttcttggcggcgttcgttgttataccagttgattgccgcctcaatacgcttcatcatttctagttccgataagcagtgctcaaaggaaaatctctcgatcttgaggtgacgccacaagctctccatcgggctgttatcacctggtgtcccgggtcgtgacatgctgtgcgtgataccttcgcccgccaggaacgtgttataggtgctacttgtataagccgtgccctgatcactgtgtacggtatcaggcttgataccatcgttattctcgatggccagtttcattgttttagtagccaaatcagccgtctctgtcggtgctacgcaccaagcaatcacgctgtggtcatgaagatcctttacggcgcttagccgtagcctctgtttgttgtcc

SEQ ID NO: 155 - DNA, 361 bp, Lactobacillus paracasei
tttactggggcttcaattctgggcttcgcttgcgctaactcatcctcttaaccttccagcaccgggcaggcgtcagcccctatacatcatcttacgatttagcagagacctgtgtttttgataaacagttgtttgggcctattcactgcggctgaccttgcggtcagcaccccttcttccaaagttacggggtcattttgccgagttccttaacgagagttcgctcgctcacctgaggatactctcctcgactacctgtgtcggtttgcggtacgggtagtttatttctcactagaagcttttcttggcagtgtgacatcaggaacttcgctactataatttcgctccccatcacagcttg

SEQ ID NO: 156 - DNA, 361 bp, Lactobacillus paracasei
gcggttaaccccttcgatcggaccgttggaataagggctggtgacagcggcgagaacagcgactttgtgtcgcttaagcgtcgcgatcgtcatgtccattgccgtaccgtttggctcgtaagtagctaacaggtttgccagttccgcgggatgtttcttcaccatcaaagcatcatgaagtgctaagtaggtctcgtaggtttgcttgagcttgggctcagtatcaagtgcgatatcgatggcctcctgttgcgtgacgtattcattcaaaccaaacaggaactgtttgtgtttagcgtcaggcgcggtttgatgaaaaagccgccagtttgtcttcatgatcttataaggacggctgtgt

SEQ ID NO: 157 - DNA, 361 bp, Lactobacillus paracasei
atgactaaggtttcctggggaaggctcgtcctcccagggttagtcgggatctaaggcgaggccgagaggcgtagtcgatgacaagcaggttgagattcctgcactagtttattttgtttaagcgatggagggacgcaggaggctaaggaaagcgcacggctggaaatgtgcgcccaagcaacaagtctgacagcgagtgaaatgcttgcagtcttaaggacaagctgtgatggggagcgaaattatagtagcgaagttcctgatgtcacactgccaagaaaagcttctagtgagaaataaactacccgtaccgcaaaccgacacaggtagtcgaggagagtatcctcaggtgagcgagcga

SEQ ID NO: 158 - DNA, 361 bp, Lactobacillus paracasei
tggaacgagtggcggacgggtgagtaacacgtgggtaacctgcccttaagtgggggataacatttggaaacagatgctaataccgcatagatccaagaaccgcatggttcttggctgaaagatggcgtaagctatcgcttttggatggacccgcggcgtattagctagttggtgaggtaacggctcaccaaggcgatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttg

SEQ ID NO: 159 - DNA, 361 bp, Lactobacillus paracasei
actgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagcgcatcggaaactgggaaacttg

SEQ ID NO: 160 - DNA, 361 bp, Lactobacillus paracasei
tgtatccatctctaaatgtcctttttcggttcgccggttagctgactcactgcgaatctcaattgaggtgcctactgcttggttatagcgcgaccgaaggtcttgtcttcttttatgacgtttaccgtgatcaaagagttggcttggctgaaaatcgacttgtctttgataaatccagtgataaatcgtgtgtggcgcacagtgaacggcataaccgaccatttcaggggaccaacctaggtttagcttctcagttaccatccgcttcaacttaggcgttaaaatcgagtgccgaccacaacgatgccgacaagtatcggcatgatcctgagctataatggcgcagtaatcaccttcaggg

SEQ ID NO: 161 - DNA, 519405 bp, Lactobacillus buchneri
ccccaacgttgggtagtcgaacgatcttttagttggctagagaattgtcggcgactttggaaaaattgtgagcgtcaattaaccaccagtctgcaaatggtcgttttagcgtttttagcactattacttaagagattttagacagcttctaagaatgcttccaagtctctgaatatgaactctgatcaaattagtcaaactgtctttggcaacaagacagccaccattaaagtattgaagtaaaaccacttaaaacaagttcatgaaatatttaaaataggcgtccagaacaacactcttgttccgggctcctatttttttgcgaatattctgtctttgaatttttaagttacacagcaagcgtgaatgaatcttaaaccacaatcttctttctcaaaaaggtcattgataccagcaacagtacagcacacacggcacccattacgatattaatccacgcaattgcggccactggcgtcgcttcggccaaagacacaatcaccatgccaacactcccgaaaatggttccaccggcactgtacagagcagaggcggacccattatcgttttcctcttgtttcaataccaaataagttccgggtggccggaccgcactgctggccagggttgctggaaactgggttagggcaaaggcgatcggtgacatccggccgaaaaccatgactaggatgccggcaacgatcgtgaacccaaaagctgtatagacaatcgtaaaccggtcaatatacttggaaagcggaatatagaccagtggccccagcagcatgccaattgcgttaaacgagaagaacaggctaaacatccggctactgaggtggaacgtattttggaaaatataggaagatgatgaaatataggataatgacacaatcgacatgagtgaaaaagtgattagaagtgcagtaaaaccgggattaatcagcagtgcccccaagcggccaaatgatttcatcacactggtggtcccacgttctgaagcatgagtttccttaaagataattgagccatagattactgagagtcccagcaatgcttgggcgaaaaagatcccccgccaggaaataaacgtcaacagtaacgacccaatcaccggtgcaaccgcaggtgaaatgaccaccatcgactgaacgatggccaacgtcgtttcctgttttcgaccaacaaagacatctttgatgaccgccgtggcaaccgtcgtcgcaactccaccaccaatggcctgaagaatccggaagaaaatgatttcataggcattggtcgcaatcccacaaaggatactggctaacatgtacaatgtcaagccaaccaataaaatcggccgacgaccatatcgatcacttaacggcccccagaataaagtggcgatcgaataaaacacaaaaaatagaattaaagtcaggttcatcacaatttcgggaaccgcaaagaacttggtcatctccggaagcgccggcagatacaggtcggttgaaagtggcacaaaggcactgagcagagccaaaaagatgataaaaccggtatttcccattcttggttgaactttactgtctgccatctttggcacctccatcctttgtccatttcatattaaccgcaaactcatcggtaacctgatcgagttcgtggttttcttcttgaaagccttcgttaatgtaaaagtgataggcacgggaatttttttcatagactgccaacgttaattccgagcgggtttgtttggcagcactgagcagatgagaaccaatcccttgaccacggtactgcttggcgacaaacaatccggcgatgtagttcccttctattcccaagaacccctgaatttgaccgtcctctgtgtcaataaacagttcggctttggcaagttcccgtttgaccccatcataatagttggtccagtaagttggattgacaaacgaatgggcgtccagattggcatccaaccagatttgggcaatttgatttagtttttcgccttttattccttgaatatgctcaatcatcgttggtccactcccaatcaaggttcttttagtctttattgtaaaacaaaaatggcattccaaggtggaataccatttttgatttcatgttatttgacaatcttcacatatttcgtatttccggtaatgtacccaccggcaacgtgatacctcaaagcaccatgattagaaacactgtttgcatgtgagtaatcgtagttcttgatcttaatcttggtgcccttcttgaagtgcgtccgcttattacgtttactcaagttgacatcttgataacggtagattgcttttttaactttgatatagcgaggctgcgtctgcttatccatagttaccagtttccggtttgcggtaatgtattggccgtttgtcagtacaaatcgggttgtcaaattgtgcttaacaattttggtaacctgaagaaccgtgccttgtttgtagtttctggtcttggcagtcaaattcttgtacatataggcattgaccccgcgcggattaataaccgtcacggttgagtgcatcgtctgataataaactggacgaacgtatgcccactgtgcggtgatataacctgtcttgccacgattcttagttaagtggttcacatcgcgaacctggtaacgaaggcgaccatttgcggaatgaccgtatccagtgacaacaaacatcggccggtaaacgcgcggcttggaaacgtaacctgctcgacgttcatgagtactaaaggtcgtgttctggtagagataaattttctttaacccgtacacaacggtccctttgggcgctggtgtcgggcttggagttggcgtcggtgttggtgtcggcttcggcgttggtgtgggcgtcgtatctttcttcacataaacgtctacaggagaagttgtcgttccccagacaacggttggctgaactttaccattcaattcagttcccgatgctacatgatatcccgtaggcactgtcccataggtaaggatcttattgagatcccaagtatcaccagctttagtggaactggttggagtcaaagtgaagtgattattgggaaaacttgtttgaccgtcgacgtcaacaaattcagcgttcaaatttgttaactgattttcatctggggtgacttccaacttagcatacttagtttgagtatccccggcatcattactggcataaattgggatttcataggtttggccagcctgaattttgtcgtaggctagcatagattgatatttataaccattgccaaaatgcaactggttggcagaatgcggctgattatgatcagacgctgtggcaaattgttttaaaacatcctcatcactcttcaatgtctgactgtcattgttaaataacattttacgagcattacttaatgatgttttaatggttttcactgtcagtgttgggataaaccctgcgccaattgtactgttgtacatcatttgagctgttttatgaagaggcgcaccattatttgggatgtttgagatattcgatgtaacaatgaacttatcggtgactgatttagttgtaactgcgaatgggatattcaaatcgcgtccagcatctgcggcactcagattttgaatttgaataaccaccttaccatttgtgctggctgctgcatcatatttccatcgaacttccggctgatttgccattggtttatcattgtcaggactttcataaactttcagtttttccggatctgcaatgggattattctgagaatcggttgacaatgtccaagtaaatgactttggaactttatcggcatttgtcggtagtgcaacttgaacccatgcgacagttgcattttgggaataccagtagagcaatgcttcatcggcaggtgcatctgatcccattggcgtgtacgcatagaagttgccgtcccatttatcttccccgtcgctattaaacccgcttggagcagtcaaaccacctaacccgccgaaaatctcttcgttcatggtagtcgcaccaccaccggatgttcccggaacattgttaacattcagatgaagttgctgaatttcggcagttgacgtaccccttgcataagttacgtggacagggtaagtaacagtgcttttctggttaagatcgtcagttgcaggctttaaataaatcgaaactcccgctttggccaaacttgcatagtcaattccatccttggcagttagtgtaatagtagcttgatccccatttgaatcagttgacacatcaaagaagtttcctgacgaaactgcattgatctgcagcgaatctaggtcaaaacctgccgtgccactatcatccttaccaactgaaatcttaatttgatccccggccttaatgccagcagtcttctgcagcaagaaagtcatattaatggcttgattactactgtatgtactcgtgtcattaagtgtagttgaaaaactaaaagggttctccagcgccgtatcatcagctttagcattataaacaccgatgatcatccccacaaacatcgatatgacaatcatcatccaacacaaaaaatattgtttacttttcctacccttataataattattttttggtaaaccttgataactatgcattaaaatacccccgtttccatatcttcattgtaatattcctgagttctgttttcaattgccaaaagatacctctaaggttaagcagacatctggaatatccgctaaactacaggattttgcggacttttgtcccgttttcatgtacaattaacttaaaaataaggaggatttcccatgtcaacctacaaaaacaaagtctacctcgcatccccatttttcagtgatggtcaaaaagaccgcatcgcccaagtggttgccttactcaagcagaacccaaccatcgatgctgacggcatcttcattccccaagaccaccaattcgaatcagaaccctttggcagcttcaaatggcaggacgccgtcttcgcatcagatatgcgccaagtacataaagcggatgtcgtcgttgctattttggattatcaactggaagaaggcttaacggaacccgattcaggcaccatctttgaaatcggctcagcccacgaagctaacattccggtcatcatggtccaatttggtgaaaatggtcaattaaacctaatgttggcccgcagctacaccgccttctttaacggcaaagacgatattcaaactctcaaggattacgatttcaacaacctggagcaaaaatataccgagaaaaaagttctttaatgatatgtagaaagacaactcaaaaaggaagtgaaacatcaggaacatcctgatggctcacttccttattttagttaatattctttaaaatgaaaatgaatcaaatcagccaactaatgatcactcggcacaccattttctaccggcaacgacaaatcagctttgtcatccgcaggcaacagatgaattgcgtgtttcaacaggaacggtgcgatcagcgttgacaaaataatgaccagaatcaaatctgaataatacgaatccgacagtagtccagaggagaaaccaatttgagcggtaatcaaccccatctcgcctcgagaaatcatccccgaaccaatcatgtaactactgttgaggttaaagccgttgataattgcgcccagcccgcagccaaatagtttactgatacaggccagaaaggtcaagacaccgacaaataacagtgagttgccgatatttgcaaacgacatgtttaacccgatactgacaaagaacattggcacgaataccgcgtagccgatcggttccatgtgattctcaatcgtctcccgataaggggtatgagcaacggcaatgccggcaaagaaagcaccaaccgcaccgctcaggccaacggcttcagcaatgtaggccattcccaaacaaatgaccatcgaggtaattgtgacgctggaggccattagcaggcgctcgccgatctgcatcagatagggaacaatccacttgaccatcaaataagttagggcaaaaaaggcgatttgctcgataaaaatcagggcgaggttggttgatgaatcaccagttttgacaccggcagttcccatcacactgatcataattgacaggagaatgacgccaataatgtcatcagcaaccgcggcaccaagaatcgtcgctccctctttggtatccaaggacttataatcccgcaatacttcaacggagattgagacgctcgtcgcactgaagacgacgccgataaagatggcttcaagcggcgcgaacgagaatgcccaacaggccccaccaatcatgatcactgggaagataaccccaataatcgcaacgataattgccggccgtaaatacttccgcagcaatttcagattactttccagcccgccaataaacatcaagataatgacaccaatctgtgaaaatagattaatcaaattatccaaatgaatccagcccatcatagccggaccgacaacaatcccaaccaggatctggccgataaccgacggaatcccaattcgattggccaagtgcccagccagtgtcgtcaatatcagtaacagacacagggcaccgataaacgccatgtcatggcctcctttctcatgatacttatgtgtttataatctattatatgtgttttaggttctatgtgaatatgtgtcgacaaatcagtcgttttcgatctgagtcgttttagcacccatcatggcaccaatatagtgaatggctaagccaatgattaatccaatggcggctggcagcaaccagtccatcccaagcgaagcgccaggaagaaagtcatctaatttcaaaattgtgctggcaaatgcagacttggaaataattgccggagctgcggcgatcgcatccaaaatcgctgggataatggtaaagatcgtcgtccagatgtatacccgacggtcatgattgaacaatggtgaggcaattgagagaataatcagggtaatggcaagtgggtagaggaacatcagcattggtgttgaccaggcaatgattgtatcaaggccaaagttggcaattccaaatgacagtccggtggcgatgattaaccaagctcgataagaaattgatgggaatttagcatgcaaagcttctgagaatgaagtcgagagtccaacggcagttgtcaaacatgtcaaggtggccatcattgccaagagaatttcaccggtgatacccatgaaatgattggcaatctggttaaaggcaatcccaccatcaatggataacttgaaactaccaaggctggtagcgcccaaccagatcaacgcaatatagataatggcttcaagcccgatgcccaaggcaccagatttcatagtggtcattgaaatttctttggcactagtggcgcctaagctcttaatggcggtaacgatagcgattccgaagagtaacccggcgatacaatccatcgtgttataaccttgcaggaaaccgttgagaatcgaaccattttgataagcggcatccgcaattggggcctttgaagctgagctgattgggctcatgaatgcaaatgcgaaaatgatcgcaagtaatgctaagaatgccgggttcaaaatttttccaattgagttaataattccagtgggtttgcgtgatgcccagaaggtgatcccaaagaaaatcagtgagtaaatcaacagccacattggttgttgcgttggattcaaatggctggcaaaggcaatttgaaatggggttgtcgccgtccggggtgtcgcaaataagggtccaagggtcgcacaaaccaataccatgaagaaagtcgcatagcggctgccgattggtttggcgagatcataaattccgttactgtgagtaactgcaatcgcaataatagcaagtaaaggcaataatgttccagttaacagaaacccgattccagcagacatccagtgagcaccggctaattgtcccaagtgaattgggaaaatcaagttaccggcaccgaagaacatcccaaacaacattgaaccaataattagataatgtttaaatgataatttctttgtattattttccatattaagcgctcctcataatttatatacgctaaaattcccgttattttatactgattgttggtgactcggctgatgccgcctgacttgcttcgatttaacatgtttctcattttgaagacctccttaagtgcaaataaaaaacgtctcttaagatcgatacgatcttaagggacgtttgcacgtgttaccacccaaattctcgacagcttcacaactatcgactcaccatgtacggccgaaggaattcagcgatacactggcgctgtaatgggcgctcccaacaaacactcgcggactcgctcgcatttgtcgctcgaaggctactttcatcgcttaggcttttgaatcgttctcacttacccgattctccctgaaaaagttctaagagactactctccttgtcttagcaaattctaatgtttctgattgacacaaatactaatacgatttctgatcgatgtcaaccagttttatttaactaattttacgttgtgggtagtataggctaaatgccaaccttttggcaatgattgatgggcaaatttaccggataatttgttggatttaagaataaccactccagatttaaggcccttaacatctttcactaccagtttaccgcctagtttagcagtaccggatacggaaaccttgtcgccagagttgacattcaagctgcctttaccactttgcgtgtaattacctttgaccacaacattcttggcagagagggttaagttaccacccgctaaggtcaagctgccgtcacccaaggcgttatcattttcagctgccagagttccagctttgacagtagttccgcctttgtatgagttatttccaagcaagctcagggatcctgaaccttccttggtcaggctgcccttaccggaaatgttattcttccaggtgtcggctgcgttaaagccgcctttggaagcatccatgttcacggtgacgttgtccaagaaggatccaaaaccattagcagcttcaaagaggttcaaacggccccaaccttcagtatcatcagtcattgggtaacctgatggaataccagtggtatagaggacttcacgtctttgagtagcatttagatatggtaatctggtttgtaagagcacttcagcgccctttgggacaaccattggcttagtggtatcaccaattggtgagaagccataggtcaatcgataggtgtaattcttcaggttggtttggtaatcgctaaagtcgtccttggctgatttatcctgagccttggccaaatctttttgcgtgtcctggtaggcttggttgatcagctgcttgttgtcaggatcgtttaaggttgcagctgtcattgctgttccgattactcgaccacccataacagctaatggtgagtgtcgtccggcaagtactcggtcatagccgacttccgaagaacgggtaatcaattgttgataacgctctgggaacaggtaggccaaggtttcaccggtttcaaatgcggcggttgtatggccgcttgggaaatcataatcgttagcggcagccgaagccatcacattcttcaagtatgggttaactttgacttgatcgctttgacgataaggacgggtaaatttgatgtaagcctttggtgtccctgtaccagaccatgctgaatcttctgcaatatcaaccagcttaaccgcggaaccgagagttgagttttcatctgcccactgcatcgagctgtagggtgaacctgcgggaagcggggcatcgggaacggcattaaaatcagtctgaacgttggtatccttgataaatgccggagcgtagggaccaaaaccactaatcaggttatatcgcaggtcccgccggtcagttaagtatgaacggtcaatttctgcttgcgaagcaccgttggtaatttgaattgatttgtccaaattgtcttggagcactttttgattcgtttttgtaccgtcagttggattccaatagcttaaaaaggtattgttgaacaacgcgatcgccggattggtgtccggagtcgagttggtcttcacattttccttatagtgatcgacgaaatacccatatgaagctggaaccggattcaactcgtttgagacactggtatccgacttggcgtttaccttcacatcattaccttgagcacccaaaactgcagctccggtcaacgtcagcacaaaggcgcttttcagaaccgttttcaaaatcgtactgctatgtctacttcccatgcttaatcctcccaagatgaaataatttctatgaaacgattatcagaacaacaagtatcagcaaaaccacaaacgatatttcccaacccaacttgggggtatgtttgatttcgtataacattgttgacatgatcacaccatcctttagatagtccctgatagccatttctgattcaactttagtgtactgggatgacgtaaattacccgcaaaatatttgtaaaaagtgggtaaatattgatgtttcacatgaaacattccgttagattggcggcctgcgtgcatctgctctataatgtcggcaaggggtgatgactttgaacaaacatctaacacttttaatcgcaaccggatctctactgacggccgccattgtttcaatgcaaataccgaccacattggatgccaaagtaaagatcacaaccaatcagtcttacaagaaaacatcatttttgatcaattccaaccgaaacgcccatgtttggaatgctaaatacaatcgaaagttacataatttaaaaaattacccgcggacaaatttctattcaaccaagcgggtcacgattcggaccaatcattattttggcagttattactacattcatagtgccaacaataagatcaagggctatgtttggcacggctttctcatcaaaggaacctactacaagggtggcttttatcgctaccccaccttcaacgtactgctttccaaccagccgtatcgtcgtggcggcatgagtcggattggcgaatgggatgcttctggtgtgtatgcatcttcgaatcgtattcatgggactgttaatcaaaatgagctaaaaccgtttgcgataacccccgccctcaatgatcagaaacaggctttgacatatctaaagcaaaattggtcttacctacctgaaatgttgaactatggtcagcataatggcgcgcgaattgtgatgcggaaagtttactatgcaaccaatcaatggctaaaggttcctatgattgacattcttaacgggccagccatcagtggtaattgggaagaaatcaatccatttgcggcggttttggatttgtcaaagttgcccaacggcgccaagccaatcgccaattacgatgttggtcaagtaaccgtcttaccgctggggagtcgggcctttgattttcccgatccaactgctcaagtcactaattataacagcggcccgatcacgcgtatttacggcaacaacttgggccctaatcataatctctccctggttgatttgaaccgttggctgcattacgttccaaccaatgacatttttaagctttccaacactcagccaaccttgaaagacggcatctggtactttgctcccagctttgaaagtggggtcggttcaggtacccaccttcagcaaatgctcaaccaaatcaatccaactcagtcaccttactatcggacaatgaccggtgaaggcttcatccaggcacactatgaaaatggtcactggcaccaacagtttgaactctcaacaaacttaccggccttcaataaggggaacgggatcaccctcacaatttccaaaatgatcaccaaatcatcaggatccagttcatacaccactgctgacaacgctaacgccaaaaccgtcaagcattttgacagtaatgatgccgatgtttcggattacttcttcaagccggcaagctactatgaaacatttttgaataatgactaacaataagagtccgctagaaatgacgaatggtttaatatcaaacgaagcgttaggtcatttgatgaggtttccaaaatcagaaggaaagtttcacaaagtcgttgaaatcgttttctcttatttgcacgtgtttctaaacaaaaatatcaaagtttgtgaacaaaatggttgcactcagcttggataggcgttatatttttaagcatacttataaaaagtaagcattacactttagatttaggagtgattaatttatggcaaaaatgacagctggtcaagccttggccaaagtactggtaagctgggatattgaccatttgtacgggatcaccgctgactcaatcaataataccgttgatggtctctatcaggaacgtgacaaaattaaatacattcaggttcgccatgaggaagttggctccttagccgcaaccgccgacgccaaattgactggtaaagtcggtgtcagctttggctctgctggtcctggggcaacgcatctcttcaacggattatatgatgccaagatggatcacgcacccgtggttgcaatcgtaggtcaatccgcaacgccaattatgaatacctatttcttccaggaaatggatcaagatccgttgtttgttgacttaactgattttcataaacaagtcaccaatccggaacaaattccctacgtgatggatgaggctatccgctacgcctatcagaccaagggaccagcagttgtaatcattccggataatctatcgggtgaagaaattgattttgaaccttataaaactgccaaagtcttaaaaccggccaccaccatgaatgttgaccaaaaagctgtcgaccaagtttacgatttactcaagcaagcaaagcatcccgtcttatgggcaggtctcggcttgaaagatgctcgagatgaagtcgtcgccttctcagaacgattcagtgtgccagtgctcaccaccgctccggcaaccggggttatgccgaccgatcatcccaactttatgggatcgcggggacgtctgggaaccaagccgggctttgaggtaactcaggcagccgacttaattatcctggcaggaaccaattacccattcagccgtttcctacccaagggaatcaaatttgttcaaatcaacaacaatgttgaagatttagggaaacagcatgatattgacctgactgtcttagccgatgccaagccgttcctggccaaattaaatgaaaaagaaccaatagccccaaccccattcctcaaggctgctcaaaaggataagcagaactgggacgcatggttgaataaagtcgctgacgacgaccatgatggcttagcgccggaagcagttatccgcgccattaaggaaaatagtgatgacaacgcagtgtttggcctcgacgttggtaacaacttaatgtggtctatccgccaactaccatttaaccacgaccaaaagcttagtatgtcagcttggtttggaacgatgggctacgccttaccagcaagtatcgccggtaaattgagttacccagatcgccaggttttcagcatttctggtgacggtggcttctcaatggtgatgcaggatctgctgactcaagtgcagtatcagctgccaatcattaatgtcgttcttgaaaacggcgcattcggttacattcagcatgaaaaaatcactgcaagccaggaaccatatggtatccacttcattggtgccaattgggccggctttgctgacgacatgggtgcgattggcattcaagtcaccgatcggcaatcgctgaagggcgcattcgaaaaaattaaggaactccaagtaaatggcaacaccaaaccaatcttaatcgatgccaaggtcaagaaccaggatccggttgataccagcttcatgccaatcgatcccgaccaattcgatcaagcagccattgacagttacaccaagcaatcgaatttatttgatcaaccagctctttcaaccttgctgaaagaagaaagcaacagttaaagatacttgaatgcaacaaagacctattaaccataaaaagccaccaatggacgatcaatccactggtggctttaattagcgatgaatcattttcagtaattaattagcccctgctcacctttgatcccagccgagatgaaccacgaacgattatacaatcgataccccgttaaattagcaagccagggctttgagaagtgaagtaaaatcggatgttgtaatgaggctcgtttggaatttttgtataaaagtttgaattaagggggcattattctacttattatgtgatgccaactactcgctcactcattagtcagccacaactgtctcgccagcatccgtgtcatcctcacgcagcaggtcgctcacttcttgacggcgaccataaacgtaagtcaatgaaaaactaaccacaaaagcaatgaccatgctaatcaagaatgccgggatggcgttggtcgcaatactaatgaatcccaaaacactattagagcctagtgagactgccaaaacatgggtaagtcccaaataaactgaggcgacagccgaaccgatcattgaggcgatgaatgggaactttaacttaagattaatcccaaacattgccggttccgtgattcccagcaaagcggacatactagctgatgacgccagtccccgctgttgcttatccttagttaaaaagaaaaccgctagtgccgaagcaccctgagcaatatttgatactgacgcaatcgggaaaatgaaactgccaccggtttgtttcacgttagcaattagctgggtctcgattgctggaaaactctgatgcaggcctgtaatgaccaaaggtgcatagaacaagcctaagacgcctgttccaaaggcccccgaagtctggtacagccacaataaaccgttggttaagccatcactgacatcccgcataactgggccaacaatcataaaggtcaaaattccagtcaataaaatcgtaatgagtggtgcaaatgtataatcaagtgcttctggaagtcgtttatggcactgtttctcaatgactgacagcagccaggccaccgccaacattggaatgacggatccctgatagcctgcttgggcgactggcatccccaaaatgtgccaataaccaagtgaatgattggcaaccgcattgctcacatcgtagccacttacaagggagggcgacaccatcatcatccccatggcagctcctaagtatggattcccaccaaagcgcttggtggctgagaatccaattaagaccggtaaaaatgcgaacggtgcgttagccaagacattaataaacgccgcaaatcctttaaactgagggtatgcagcaactaaagaagcagtcataaataggtggggcgccactaaaacattgtgaagtgccattagcaaaccagccgccacgattgcgggaatgattggaacaaagatatcagccaataagttaatgaatccaagaaatcctttttgggtctttttaatcgttgtgataaacaaatgcatatcctcctcaaaatagtcacttcgaaccattctacgggttttcgtcacagatgcaagaagattgacagaatttcttgcctgaaagcacctctacaaacgttttcattaccatttccatggacagacaacatctatcaaaaaatctgtcttaacttgggattataaacacacactgtggttgcttgtgctatgatttgagaggaagtttcacatgaaacaatttgaccattggagggtctgcaagtgactaagtataaagttcaatcattagtattcatcctcgttgcctttatgttggggtgcaacgaattcattgttgtcgggattctgccggatttatcggcccaatttcacacgccaatctcaaccatgggttacttggtcaccatcttcgcgatggtttacgccgtcagtacaccatttgtcacaatcctaacaagtcggtacagtcgctataaaaccctgttaaccctgatgattgtctttttgattggtaacacactcagtgccctttcaattggctacctaaccatgatggcctccagaatcatcaccgcaacgacggctgggtcaatcatttcactgatcatgacttttgccagcacgattgcgccacgtgataagcgagcttcactggtttcttggatctttgccggcttcagcattgcgtcagtctttggggtgccgatcggcgttgccgtcagcacaagcttcggttggcgttataccttctggggaatttcggttatcagcattctaactttccttctattaacgcaaatcctgccaaagaaagttaagcagacaaccagcaccatcaaaaatcagctgacaattttattggatccccgaatctattacggtgtcttcctggtcttattcacggccgcaaccatgtacggctactacacatatattcgcccgctgctcaccacgtcgatgggcttcagtacccagagtttgaactggctgttgttcatcatcgggattatgagtattatcagtaaccgactttcgggaatgctggcagaaaagcccaacagcctgcaaaaagtgccgctcttttacgttgccgatatcctcttactggcagtttttccatttgcattacacagtaaaattgccggtctggccatcatattgatcctgacattgattgtgacaatcatcaattcaccggttcaaattcatttcctaaatctggcagaatcagaatacccacagtcgctggtctttgcctcatccctaagttcaattttcttcaactttggtatttctctgggatccgcgacggcttcgagtttagtgggcatcgttggcctggatagaatcagtattggatcggttgtttttgcagttctttcgcttggttcgctatttttgattaaccgggccattaaggcgcattcgtcaacgaaggcgggaaactagtttggcaccttgcattggcagtatgataaatccatcacacgcctaaacgcggttctgaatgtcccttaaaatctgtctcaaacattgacttcaatccaaagttcgttcgaatcaaaaaccactatttacaggaatggtagcaaatgtacaaattctgaagaataattaccaaactgattcatagaacccttgcataaaaagacaaacgaaaagattttgaatgattaatcccataaatacccaattttggctatttgatttccaaaatttataatttaaccaaaataataaaggtaacactgagactacagcaatatcattcacaactgatgtcacggaatatgttccttcagttattagtcttaaaacattaccaattatgagtaaaattatttcgagaattactagctgtacagtaatcttgcttgtttgattatcaacaattggcttgcatacaaaatatttcttagttaaaatacccacgcaaatataactggtaattagtatccagataaaagtagaaacagtaagccacggcatcaacttcggcttaacaaacggtaacgttcctgaattaaataattgaaaaaaggtaactccattaataacatatgcaaacaatggactaatcataaaattcagccaaaatataattgttaatcccagagatttattcattcgtgcagctcccttcattgatcattaattcctataccacagaacatgtggccaatttatatgaaacgaccctcctttccaggcagaacaattagttgaattacctttagttaatccaggtagacagtagtcaccgaatagaggttctttttacacacttattttgtctccggaaatgacaaaattagctaacttttgtttagaactgaaaagtaaaagtatgataatcagcgttgctgtccaagattttgtctggggatttccctatatcttcctagttttatgtgcaacggtgaactcactcacccaaaagtgaattagcttcagcttaatttcccaaacagaacccaagcttctaagtcccccagcctttagtttttaaactactcttaatcaggtatactgaagtagatgtgaggaggatacttatgaaaaaatggtctttgttgttacttagtctaggattagggattgttatgctgtctaatccaactactcatgccagttctggttacacggttatcaagagctcatttcctgctggggttggtaaaatgtatcatgcagctaatccaaaacagaacgcttatgtttggacgaccactaagcatactaaaaaattagcgaacattaaaaattatccaaacacttcttggcattcgaccggcacggttgtgcttcgtcataatcataagaatgctgtttactaccgagttgacgcaatttccccaaccaaaaccaagaaatcggttagtggttggatttggcggggctatctcaaaccgggctataaccctaactttaccaaagttaaaagcattagccttgataatgctacaaacgaagaatataaccagtttatcaagcaatctaaataccagcagctaacccgtgatattctggcgctgtttcccaatagtaccgtctccaagccattaagtcggtatgcgttgtttcgtgaacctaaggataaaattattaataatgtagccactttcaaggcaatggatgactttttgaatgtcaaaaaccggttaaccaaccagcagcggttagctaaaattaaggcgattttagaggctaatggttatactgctgctaatcggcaaaagaaatacgtcattggcatctacctcactaacttccagtggtccgatcaatatgataccggtgatatgcaccaaggatttgtgattggaaccaaataaggagatacttaatgacaacgccgcttcgtatgaattgttccatcgaccccaaatatgtaatttctttcaatgcgtggaatgactgttaggtgccatttcccctgatatgatatagtcaaagtcccaaaaagtcctgatagcatggacaccaaagccccaacagatacaaattgttggggacttttcttattgatgataggagaaatgaagtatgcacaagaagatactatggttgattcaatttgcgattaattgcagtttcatgatttatttggcaagcttcccgtcaaatgcagtttattctggatcaggttggtccattttaattggtctatttcttgtaatcattgcggttgttgcagcgattattttgacaaatttggttacagaaagatgaatggtctttactggatgtaagctgatcccagagacaacttttaagacagggtataatgaataaatcatctctcaaaagaaaggaatttttccatgccaacccgttacgccaacgatgcgtcgggtaaccgtcacttgaccgacatacaaaaaatgccctattaatgacactaatgaggcgctgatgaaaagaactgccgaaccagacaactctcattcaaattaattgctttcacatgcatatgaattacactgagtttgtataaatacaaacaaaggagcgattttgatgaaagcattcggttacgaaaaaaatggcggtcccgaggtgtttcaggagtatgaagtcccaacccccgaaatcaaatccaatcagatcttaatcaaaacggaagccttcaacttaaataactttgaagcattacagcgagctggtcaattcaagccagtcgaccaccgaatcatccccggaagagacgttgccggctttgttgaaaaagttggcgaagacgtcaccggctttgacattggtgatcgggttgtcgctcacggccatcattcctacgcagaatattcaattggcgaggattccaataccgtcttaattcccagcggtgttccctatctggctgcggcggggattgtgactcccggcctagccgcatataaaggtgttcacctgtttggcaaagttcaagccggccaaaccgttgtcgtgaagggggcttctggcggggttggctcacttgccgcccaaattgccatggatgttggtgccaaagtcatcggcgtcggttccagcgaaaatgaagaatacgtcaaatcattgggcgttgatcaatacgttgcttacgaccaggaagatccagcggaggttctggcagacaccgctgatgtcgtgattgatgctgcattaaacggcaacggtgccgaaagtgacgtcaaaatcgttaaagatggcggaattgtcgccagtgttgccgacaacgatgcaccaaccgataaaacggttcatttcaatcacattcacccaacccaggaaatctcggatgatgatgctttgaatgctatgttaaaactgatggcggcaggcaaactcaaaattcgcatcggttacaagctgccatttaccctcgacggggtcattaagggccatcaactgctggactccaagcacgccggccgaattgtgattgccaagtaagattgtgataaacagaaagactgaagcgcaaaaaggtcagaacatcattcaccagaatgatgccctgaccttttaaattggatctatttcatctcaacttaaatcgcttatttcgaagaatccttgcccttatctttatccttcacaattgcctcagagtatagtttatcgaccaactcgggatttgatttgccaggattcagttcaacaatctggccggcagccgaataaacaatccactccgccaggttaacgatgtgatcaccaattcgttcaagaagcttaatcaccataaagtaactggaactggccgcgattgttgcggtatccgattgcacggcctcggtaatttcatccctaattaacagatactgttcatcaactttgacgtcattatccgataactttttagcggcgtcggcatcgctcttcacataagcatccagtgcactttccaacatatcccggacttcttcggtcatcttggcaatagccttttcaaccttgggaatccgcggattacctttgacacgaatggtttcgcgagccatactaaccgcgtgatcaccaattcgctccaaatcagaactggcttttaaaatactgatgatcacccgaaagtcggtcgcaaccggctgttgtaaggcaatcaagctcaaagcctgtttttccaatttcatttcatccgaattggtttcctcgtcggcatcgatgacttcttgagcggcttttttatcatgctcaataaatgccgtagttgatttataaatttgttcactgatggtcagccccatttccacaaaccggccgtggagcttttttaactcgtcgtcaaataattctctcatcgtctctattcctcctagccaaactttccgttcaaataatcgctggtcttctcatcatcagggtgaataaacattttctcggtcttgctgaattcgaccagatcgccgttcaacagaaaggccgtcttgtctgaaattcgcgaggcctgctgcatgttatgggtgacgatgatgatggtgtattggtcgcggatatttaacaaagtatcctcaattttggcacttgaaattggatccagggcggacgttggctcgtccaacaacaccacttcaggctgaacagccagcactctggcaacacagattcgctgctgttgaccacctgaaaatgacagggcattatcgtaaaggtggtctttgacttcatcccagatcgctgcctgcttcaagctggtttcaacccgctcgtccaaaacgtgcttatccttctcaccagccagccgcagtccataagcgacattttcatagacgctgaatgggaacggattaggctgttggaacaccatgccaactcgctttcgcaggtcaacaatgtctgttccgggggcgtaaatatcttcgtcttcaagcttcatcgacccggtaattgtgacccctttaattaaatcgttcatccgattgagacaacgcagataagtcgacttcccacagccggatgggccgattaaagctgtgatatcgtgttcttcaaagtccaaactaatgccatggagcgcctctttgggtccataacttaaatggacatctttactcgtaatgatttttggcattgttcagcctcctaaccgaagttcccggagatataatcttcggttgcctttatttgtggtgtcgtaaatattttctcagtcacgtcgtattccagaacatggcccatgtggaagaatgcggtgtagtccgcgattcgtgacgcctgttgcatattatgagtcacaataataatggagtaattcttgcgaagttccattaaagtgtcttcaattttggcagtggaaattggatccagcgcactggccggttcgtctaagaggaggatatccggcttcattgcaacacatctggcgatacaaagccgctgagcctgaccgcctgatagggctaaagcacttttatcaaggtcatctttgacctcatcccaaagagcggcggccttcaggctttcctcaacgcgtttattaagctcttgcttgtccttgataccattgcgtttgagagcaaaggtgatattttcacgaatcgatttggcaaacggattgggccgctgaaacaccatactgatatgcttgcgaacttcatatacgttaatcttttttgaattaatatccatatcccgatacataatttttccttgaacggtcgcaatccggtcgttcatccggttcagacagcgtaaataggtcgatttaccggatccggaagccccaatcaaagcggtaatgcgatgtcggggaaattgtaaggtggcgtcgtgcatggcgtggttgtcaccataaaacacctgcagattttcggtggtcatcgctttttctaacggaatatcgataatgtgcgttttattatagtcatattcttgcataataatctcctacttcgttgctgtcatgcgtttgtacaaccaacgtcccaacatgcgggccaataggttgaacagtaaaatcacaacgatcaatacagctgatgccccacttgaaatcgaagctgcatcaggggtaaccccttcagtgttaactttccaaatatgcaccgctaaggtttcagctggtcgcataaaattcaggaaactggcactatccatcggattccagtcaccgtaattaaccgtcggcgcactttgtccagcggtataaatcaaggcagcggcttcaccaaatacccggccggcacttaaaatgattccggtcaaaataccaggcaaagcggctggcaggacaatcccggtgatggttttccaacgtgataaaccaagtgataacccagcctcacgctgtaattcggaaacatcctggagcgattcttcgatacttctggttaacagcggcagattaaagaatgtcagggcgatggcaccagccagaattgaaaagcccatgtggaagttaaccacaaataataggaagccaaacaatccaacaacaactgatggcaatgagctcaagacttcaacagcagttcgaatcacgccggttacccagttgtcaggggcgtattctgaaagataaatcccagaacccagggcaattggaaacgaaatgatcagcgtgaggaccaacaggtacatcgagttgaacagttgatcccgaatgccgccgccagcagcgaacgattgtgctgccgacgttaggaagtgccatgatacatggggaatcccagtaattaaaatgtagccgagcaggaagaccagaatcgccaaaacacaggcaaccagaaaataaatgacgccagtggcaatgttattactcgttttagaattcattttttcaggctccctcgctttccgattactctgactaagatgttaaagactaatgacatcaatagcagaatcaaagctagtgaccataaagcgttatttggcagggtccccatcgtggtgtttccgattccggtcgttaattgactagttaaagttgacgatggtgttaataatccatgaggcatgagaacagcgttaccaataaccatttgaacggccagggcttcaccaaatgcccgtgacatcccgaagataacggcagttaaaattcctggagtggctgatcgcagcaccactttataaatggtttgccatctggtagctcctaacgccaatgacgcagaccgataaaacatcggcacagctttaatactgtcaactgaaagtgacgtaatggttggtagcaccatgacgaacaggaccaaggttccggcaagaatcccaaaaccagtgccgccaaatgagtgacggatcaatggcacgataactgagagcccaatgaaaccatagacaaccgaaggaattcccactaacagttcaataactggttggagaattttggttccccgctccggcgcaatttcggtcatgaataaggccacccccagtgcaaatggggttgcaaccactgcagctagtaccgtgacactaaacgaagtgacaatcattgggagcgcaccgatctggggattaccgtgtttgtccagtagggccggattccagttggtgcccgataagaatttccataaactgacatggttcgttgtgaaggttgctaacccacgggtggtaatgaagtacagaattgagataaccagcaagctgacgaagccgatgcagagatacgtaatcccgcggccgaataagtcttcgtgcgtcgcttttgatgggttttgaagatcatgtttgatttcatccatgattaacctcctataatttagtcgaatgaattttaaatgagtaccttaacttgaggaaggctggaggcatttgatttgccttcagccttcgttggttttgtgtttagtttgtagagttaatggtgcgtgaagattacctagtgaaaacttggttcgagccatgagactgagttctaagtgcactttgattaaagtgtccttggaaaccgcctctccaggagcacgtttgttaggtgcttttgtgctcccttctgcctttaaaatacgctctgacgggccagaggctaacttctaagcgcactttaattaaagttccaaacccagaacttcaatcaaagtacccttagaaaccgcctctcccagcccttgtcgcgctcttacttttcagagacggcgttacttgcattcttcgttactttcatatcatgaatactgatgtaaccaagtttttgaactaagctgtcttgaaccttgcttgaatccatgtagttcaggaacttcttagttgctttgtttggttgacccttagtgtacatatgttcatatgaccagatcttccatttattggtggttacgttggcatccgttggctttacattgttaactgataatgccttgagcttgctgttaacgtatgagaaggccaagtaactgatcgttcctggtgtgcttgaaacaatcttttgaacagttccgtttgaatcttgttcttgggccttaactgctttggcaccctcaaggacggctgattcaaatgtggcacgcgtacctgaaccttgcgcacggttcacaacggtaatcttttcgttcttgccgccaacctgcttccagttagtatacttaccagtgaaaatgccttttaattgtgccatggtcaaattgctgacattgacatctttgttaacaactggtgtcattccaacaacggcaacttgatgatcaactaattcttttgctttaatcccatcttgttgttcagcgaagatatctgagttaccaatttgtaccgcgccggtttgaacttgactcaaaccagttccggaaccgccaccctgaacagaaatgttaacgcctttatttgctttttgataattgcttgctgcttgttcaactaatggctgcaaagcagttgaaccaaccgccgtgatcttgacattcgaatcagctgagcttttctttgacttagagctgctggacgaaccacaccccgcaagtaaaactccgacagctgctactgctacgatagttgaaaaaaaggatctttttttcataattcgatttcctcctaatgaaaacccaagtttttttagtactcatttaagtacattgttaatataacaacagcatgtaaatatcgagtttcgtttatgtaaaagtaacgtaaaaccggccatttttatcaaaaagtatggcataacttaagatgtaaacaatttaactaatatggaggaagaccggatgccattggaaatcttattgatcagccagaacttaaagctggcggataagcttgagaaactacttgccgcctttcaaattaataccagaatctcatttgaaccccttgatcatctgcttcaacaagtttccggagtcgtctgggacttagacacaactgaactgccggaaaacgattcggaactgcagattctccgcagtcaaattgccgggccaatcttgctgctggataaacagccacggtccgtggaaacgatttgttcctattttttggattatcatttggatgattacatttgtggtgaatcagccagtgaaatcgtcgcgaggattgttcaaaaaatttgggtctatcaaaataaagacaatctccagctgacacagcagagtcaggaatctgaaagtctggtggtcggtcacttgaagattgatttgagtaaatttgaagttaataatggtcgcaaaaagctcaatttaagtccgattgaatataaattgcttctattctttgtcagcaattccaacaccgttctcagccgaacccagattgcctcggcagtatggggtaacaccaccggggcgaccttgcgaattattgacacccatatcagtaacctgcgcaaaaagatcgaaatcgaaccaaaaaatccccagatgctaacgaccatcaggggattcgggtatttatttaagaataaaggcaaccagcaatctcaggtcccgtaaacgttgatcagacatcaaaagaggttgtgacaaatcggaaaatgttgttttagcctcgatttgcgtttaaatgttttctaacaaagctacgcaccaataagcagcttctggccgtataaggggattccccaaacatccaagttatggatatttggggaatccccttatactttggaagataacggcttagtggcccacgctcttcctatacacttttgcttgatgtttcaactcgcgctgacacagttcgacaaagtcgtcgccataggcatttctaatctcgttttcccattccccatcatttccctgctcatcaagcattggctggatccattggttggtgggtaagagtttaagcaatgaatgtttggtaaattgtgagaataagagattttcgccaaaatatgtcgctaattgatgctgaaaggctggtacatcaactggtagtaacagattattagcgttgttccggtcgcccagcaacagttggcaatcgaggaagtcgctctttaaatcaaacagcttatctttatgtgccttggcgatgtctggaaccattctgatgaaccaaattagtttatgatgctcaagagcaatcagtagatttaacacagcgatgtctttggaacttagcgtaaactttgcgttttggacggccactgggtgaagactgttggacacagcattaaataaatcaccaaatgtccccggctcttcccacaatacctcaatctggtgggcgttctgcagccaaagccgatgagtggcaatccgaagtgtcagccagaaaacttgatcatgatcgtcataccccttaatcagccagtatgaactggccgtggagcgggcatagttgctggcggccagttccaagccatcgggcagcgccgctcgaacagtctcaatcagccattcacggtaggagggtttatcagtaaattcatatgtctgttcacgtggacgtggcttagccattgagatccctccctttacatttaaaattcgtctcaatactagtttacgcttttttgaaaaagggaacaaaaagaacaccagtacttgattcgcactgatgctcagtttgaaataaatctgcatttaaattgtttcacatgaaacattatgctttaacagtcttaattgccaagaaatctttgacttggtcactcggaattgatttgataaccggtccaccaattgtgtgaatgtagatcagactcaaatggccgtcacgatttttcttatcatttttaatcttttcaaatacttggtcagaatccaataaatctgaagtaaccggcaatccaaccgcttctaaacgttcccggagttcttgagtgatgccggtcaaggccaagcccttgtcttcaaaaatctgctgcatggcaatcatgccaatgctgacggcttccccgtggcgaagaccgccgtcagaaagtgcctcaacggcatgcccaatcgtatggccgtaattaagcaattggcggaggccaccctctttttcatcacccatgacaatgtctgctttgtattgaatcgaatggatgctcaattcttcagcgttggctaaaatgtcttcaggtgagttgattgatttgactaagttccacaaatcaccatcggataaggccgccaccttgacgatttcgccgtaaccttcgactagatcgcgctttttcaaggtctttaaggtatctggatcgataattaccaaatccggttggtaaaatgagccgatgatgttcttggtggtatccaagtcaacggccgttttaccacccactgaactatcaacttgggccaacaatgacgtcggcatctgaatcagactaatgccacgcatgtaggtcgctgccagaaaaccggctaggtcaccggtcacaccgccacccaaggcaatgacaccatcatcgcggttgaaactgtcagcggccatttgccgggcaaggtcagctaaaacgtctacggattttgattcttcaccagcgggaaattggtactcgtgaacagtgaagccaacagcttctagagcctcagcgacttgggcctggtaaaggggcgcaacgttgctgtcactcaccagggcaattttgcgcttgctccaaacactggacaccaactgaccggtgcacccaaggattccgcgggcaatttcgacattgtatgaacgatctggtaaatcaactttaatgattttcataatttaacctcacttttttcttcgacaggggtcgtaatcactttccggattgcaaatgcctgctgagccatcgcacggtattcgtctggcttgagtgcttgagcgccatctgagaaagcgtgggcaggatcatcatgaatttcaacaactaaaccactggcaccaaccgcaactccggccaatgcctcgggagtcacaaattctgtgtggccggcggcatggcttgggtctacgatgactgggtagtgagtcagtttttgaagcactggaactgcgccaacgtctaaggtattacgggtgtatttgttatcaaatgtccgaatccctcgttcagtaatgatgatgttatggttgccaccggcggcgatgtactcagctgcatttaagatatcatcaatcgtagcagacattccccgttttagcattactggagtctgagtcttgccaactgccttcaaaagtgagaaattctgcatgtttcgggcgccaatttggaaaatatcggtgtattgttcaaccattgcgacgtgatcttgatccatgacttcagttaacacgtccatgtcgtaagcgtcagcggcagccctgagaaatttcaaaccatcttcgccaagaccttggaatgagtaaggagaggttcgaggtttaaaagcaccgccccgaaggattgtggccccaccactcttggcgactttagccatcttcatgacatgttcggcagactcaactgagcaagggcctgccatcatggtaaagttatcgccaccaatttgactgtgcggtgtcacaacaacggtgtcttccgggtgaaacagacggctgccttgaacagcggcgggaacgttgtcaataattaagtcaatggcattcttctcttcagcatttaagtcatcttcacttacgccttggattgccacgcggttgttatgaacaaatacctcgttggtttcggtaaagcggctcttgatctcgtcaataatgtcttcgtgcccgtttttaagtacaataatcataatattatctccatttctgtgtttgacgtgtttttgaataaaataaaactcccacagtgtgtacaacactgcgggagtcagaattttgggtaaaaaaattggtcccgcagtatatttggtaaataactgtgtgaccgaagtaagtaatcatgatgaaatactattggccgcacaagatgtgagtgagtgcccacatcctgtccggtgtgaacactaaacgaaccaatagtaataaaatcgattaatttttgaattaatttttatcatgattagaatctcctaagaaagttaaattttaattgcatagagcatataatgaattccaagatgtgtcaaccccaaagtttaaattatgaattttcttgacatcttctcataaagagcgtaattttaatggcaattaaataccgtcctaaataaaccattgaagtggagatcaagattgttgtgcacgtcaagagagtcgctattgctgagaatgcggccgaacgcaagcagttaaatggaccaccgagggttcttccgaaagtgatcgagtacgaagaaacgtgttggcatacgtcagttgtcggagggatgttagtcccttgctaagcgtagttgacggaaaagagtgactctactgaatggtggactgtctttttcgatcaattaaacaaaggtggcaccgcggaatgatccgtccttaatgtgaaaacatttggggcggattttttatttagagcgcgacgagggccgggagaggcggtttctaagggtactttgattgaagttcctgggcttggaactttaattaaagtgcacttagaagttagcctctggcccgtcgccaagtaggctaggcagggtttcacccggccgtcggagcgtattttcaaagcagagggagcacacaaaaacctaacaaatgtacttctgcacaggggacgaaacatatgccaatcaaaatatgacgcaatccggcaaataccaaaaaatggaggaacctttcatgaaaatatcaagaaaacgatggcaaatccaactttagcatttagcaaaacacactaaagcaatggaggacaccatcatgaatctagaccaacttaaacaatatacaaaggatttttcagctataccaatttcaattaatttcgcaatgccggactttgaccctattgccgtgacgcaacgattcgatcagccagacgcaccgtgtttcttactaactggaaaacccaagcaacaagaagacgggtattcatttatcggattgaacccaactctgaccattacttatcgaaacggggtcttaacccgctcagatgagcaaggcaatgtttcacatgaaacaaccgatttaaagcccgtcctggaacggattctggcagataatagaatgccaaaattaaaacacatgccgccattttcaggcgggctcgtcggttacttcagttacgactacgctcgctatgcgactaccgcagatttaccagccgtcagtgacccaatgaaactcaatgatgtcgacctgctgctcattaatcgggtcattgcttataatcacacgaccaaaatggtcacgttaattcaagtgatccctgccgatcagcttacgacgcaatatgaatcggtgatgagttccctaactgatttgaaggacgaaattatgcaggttcacaagcaacagccactcccaccatttacaatgacgccattcaaattgcagttctctttatgcgaattcgaggaaaaggtcgcagaagcaaaacatcacattgtcgatggcgacatcttccaagtccagctctccaatccgcaacattccaaaatgaccggttcgctgtttgctgccacgccaactttattcaaagaaagcccatccccgtatcaattttattttcgccataatgactttgaaaccattggtgcttcaccagaaactatgattaccaaacgggacaacacgttattcacctacccgttggctggaactaggcgaagggggaaaaatcagcttgaagacgatgcttttgccgacgaactacagcacaatcccaaagaattatcagaacataatatgctgattgatttaggaagaaatgacctggggagcatcagtcaattcgggtcggtcaaagtgaccgcttatcgaaacctgctgaagttctcgaacgtgatgcacatgggatccgtggttgaaagtaaagttgatccagacgtttcgtcaattgatatcattcattcattactacccgctggaaccctatctggtgcgcccaaaatatccgcgatgcagattattggcgaactggaaaacaacaaacacggtctttatggtggctgcctaggctatctgggttttgatggtgacctcgatatgtgtattgggattcgattagcatatcggaaaggtgatgatttagtcgtccgcagtgccgccgggattgtcgccgatagcatccccaagcatgaataccaggagtttaacaataaagccagagcaattgtgacggcactgcaggaaacggcagccaaaggaggcgtttgcgatgcattatctaatcgataactatgacagtttcacatacaacctataccaattgattggtacccagacctctgaagaaatcaaggttgtgaaaaacgatgccatcaccgttgaaaatttaatgaaagcaaatcctgaaagcatcattttctcacccggacccggccgcccagaagatgctggtaacatgccggcgatcttagacgcattcctcggcaaggtcccgatttttggcgtttgccttggacatcaagccatcgcagaagctttgggggccaaagtagtgcacgtccccaagttaatgcatgggaaaccctcaaatatccaaatttccttagacgatccactcttcgcggactgcccacgtcattttgaagcagccaggtatcattcactcatcgttgatccaacaacggttcccgatagcttggatgtcaccgcggtaactgatgacggagaaatcatggcgatcagcaatccagccaagatggtctatggcgttcaattccatccagaatcaatcatgactgatccagaagtgggaaaacagattatcaacaattttctaacaatcgtcaagatcgctaaagtatcgactacagctcgttaaaccgaaaaaagggattgcggcaaaactaatcattttgccgcaatccctttagttttcatatattctattgaacttgtctgagcacttgcgagcggctgagcatcttgaatattgctcggacacagacagcaccgaagaagaacaccgagatcagacggactgagaacaacgccaagatcattggcaggtgataatgaacataacccaaacggaacagttcatatccaaaggaaaccacggtggtcgtaactgctgaggtagttagtaccggccagccccagttcttgtatccccacagtgtgaacccaagctcacttccgattccttggacaattccagaaataagtgcactagcaccaaaggttccgccaaaaatgacctctgcagcggcacctaatacttcaccaataattgccgctcccggcacccttaccaagtaaatcgacaatggtccggccataatccaaaggccaaacagtgcctcgtttgagaatggtccaatggcaactgccaggaaattatacagataatctgtcccgacaaagatggcaccaaaaacgattgcaacaatggctaacagaatcacatcctgtaagcgaaatttctttttcatgatttttctccttttgaatgacaccaatcataaatgaatgcggccataattttggtatacgttaataattgctgaaaactaagactttcattatcactatgagcttgtttcatggttcccggtccaaaatcaaccgctggaatatggtagtagccaaaccaaccgctatctgatacagacggtgacatccccaaggttggttgtttgccggccacttcggcaaagttgctctcaagtgcctgcatccctggatggtcggggtctagctccagtgacgggaacacctcgcctttatcgactaatagcgaatcgccgccccaagtaaaggtgggcagattatcccgcagccaaggatcgacttttgctgcagcaaggacttgatcctcgatttcatgggttatatcatcaacattttcattcgggtaaaaatgcacggtgatccataatttcgtgacgctcggaatgtaagccggatgcagacccccttcaatataagccgggttaattgtatcgattcccggggcaaacccaggataacgcttggtgatcccccagtactgttccaatttctccaaagcctgaatcacgaccatcattttctcaatcatattagcggctttcaggccaccaccagtagtaatcattgctgctcggttcccatcgtggtaaatgtggggactcttgagtgtaatccagccggtcacaacgcctccctgaccttgaaaattcaagttgctggtatcgccaaccactgcaaaatcagccgtttcaccatttttcagtaaagttttggttccggcttctccagcctcttcaccaacgacagattggaaccgcaaatctccaggcaggtcaattccaagctgcttgagaagtgaaaaaatatacacaaagctggaaatgccgcccttcatgtcactgacaccccgcccgtagagtagatcaccctcgtggactaatttgaacggatcggtgtgccaactctgacgatcaacggtagccacatcaacatggccattcaacagcaaactatgatagttggctgcatcagtccccgctttctcagccgagagcagctcatcgccatcataaaaggcttctcgcttagtcttaaatccaattttggttaatttatcatcaagaaaacgttgaattgccactgtgttgcgggcaggtggtgacatcgtttcaaatgaaattagccggtccaataacactaacagttgatcttggtgcgcatcaactgcctgaagtaacgcttgcttatctgtcaacttcgactccctccaattatctgatcatctatggtttggaaacaaaaaaaaccccctttcttcaaagcctcgaagaaagagggaacagattaaaagttgaatcgactttatatctattagctcacacaaaaaagtttcgttcttccttcgacagtcctaactgcatcaggttcaatgggtatttatctcagccgtttagggcaccccagactactttattcaatttgccgcaaattacgtggctggttttatgatataacgaattgacgaaatgtcaaagttaattttttgatgttgtgaggtcaaggcccgtgagcctacttgctgatgggctgatcccggccatttaagcaaagaaacgagtcattccaaaaacaggaataactcgtttcttcacttaaactctgggatcaaaacgcctcgcgtcccactcccacaatcgtttcatttgaccaaaatgaaaactttattctcgaaaattcagttgattatgatgttgccagaccgcctgtccagtgactggcagcgctgctggtatataccttaattgagtatgttccggaaccgacccacaggctaccgctcaatgtgccagtggatgaactaatcgttttgtatagttcaccatctttgtagatactgattgaaaatggatcagcactggaggcgccactatccgttgacgttttaacattgtagtgcaaagtattaatgagattggttgccttgacggtcacattgtagccagaattgtcattagtgtactgactgcctgtctcacgaggttgttgggacagatttttaccgccgacctgcttagcggccttggcattgtcctgtttatggccttgctgttgtcgttgaggttgaactgtatcggcattggcaacaacgctgctcagaaatgttggggcaaccattgcggctgcagccccaaatgtcactaaatattttctaattttcatggatgataacttcctttcaatttaacgtttgttggtttgatctggaacctatttcagttgccctcccttcatacttgatgttgctagaatatcggggcaagcttaattgggacttaaattagttaaaattgagaaggaagccgcataatctttagaaatccttgggacttttgtaaaatttggacagcaaaaaaggtcaatcaatgaacgtaaatcgttcaccaattgaccctgccaacttcttcaatgaatctgatcaacctattcaaccttaaagttcgacttgaatataaacccgcaattagggcacctgttcaagccgtaactgatggacattggtcgatgacactttggacagttgccctgcatcggccggcgaatcttagttggtttcggttctttctcatctgcctgatcactcatattgacctccactaaaatatcattactgatcgataatctttagaaactttgccggcattgaatccaccaaccaaacgccactttcggttggataaaataacagtcctgaagccgcggcttttcttgcttcaatttcaaaaatcacaggatgaggatcacgccgtttccccacctgaatcgccatttggggatttgcggataaatggacaaaatcccgatccatcttttttaatccttcatcgacaatgaatctggcagccgcatgagtcgttccgtggtacagcttctctggaggttcaacgggtggcgtcagtggatcaacgggaatgctgtggccgtatagcgccctaatcgtgtgaccttcaatcgcataacgttgtttgtcactatctttcataatttctcgaatgattttctcactgattggcgtcccaaagtgctggttaaatttttggatgagggtttgtaagtccactcgtccatatcgatccaactggatgccaattttgtccggatggtgtctgaggacgtacgacaggcgtttgctcaacctggttaattgatgatccattttactgactccaatcgtttcaatattatctttattataatcccaattgtgggcaaaccacaaaaaacgcccggtactaaggcccgggcgttgctacaaatcatattcatattagaggggatcttacttcttgggggagacgtaagataatcaagttttatactttggaggagtaaattcacttgtaaaccaatttatctttcaaaattgattgtctttatattatggttgccaacttaactcagccttaaataagtgtgacaaaattgtgaagttgcagaaagggcggaataggggtgttgtttatcaagatttcttatataattggatacagaaaacatttgaaaggattcaacatgaaaaccatttattttgtgcgtcatggtcaaacgttactcaatcaatttcgccgaatgcagggctgggtggactcaccattgactcaaaagggcgagtcccaggcaaaagcaactggtgaaaaacttgcagatgtccattttgatttggcaatcagttccgatatgatgcgggcaattcatactttagacattattttggcaaataatcagtcctcagctggcgtttctcgagaagtgtccctggacgttcgagaaatttacttcggttcgtttgaaggaatcgacagtatccaaacctggaacatgattggcggaccgctgggacatcgtaatcaagaggacttgatcgaagaatatggcctcctcaaaatgcgtgatttcatgcatgccgctgatccatttcacgaagccgagacttctgctcatctcgagagtcgaatcaacagtgcagtcgaacatattcaatctgaattagtagacggccaaaatgccttagttgtttcacatggaacttttctgagaaacctggcgactttgtatactgatgatgcaacaagtgttaagcagccccgtaacggtagcattacccagctggatgtgaccgacacgccgcatattatttcctacaatgaataaaaaatctcaccaaaagattgcgtaattaatcttttagtgagatttttaagttatcgttaatagcctagactgttcacgttggttcgtttggtcttgttggtttcccagaagaaggtcttggcaacgccggtaatcttcttctttggaacaaagccccaataccgaccgtcatttgagacgcttcgatgatcaccaaggacgaaatactcacccttgggaaccttggtggcattggtatttttgtcccagctcttggataatgatttcaaattccaattgccggttccagtcgtccgttcgctcatgctaatgaacttctggggaacaacttttccattcacatagatattgccgttcttactggagaccgtatcaccaggtaggccgatcacccgcttaacatagtctgttttaggcttggtagccgttggatcttcaccatgggcatcaaacacgataacgctcagatgcttaatcttggcatgccgccaaacaatcaagcgctctttattaacgagattgggttccatcgaaggaccatcaacccgggcaaacgtgaagacaaactggcgaatcaatagggcaaccagcagcccaaccaagatggggatcacccagctcataatttctttaaatactttcatcttaagctcctttgtgaacaacacaattagctatgcatactatccataacggttagcttacacaatcgatattaattttatcacatttccccgccagaacaactttttcgcgcttaattaacagaaccctaatttattgctcatattgcaatcaaactgtatcataatttgtatgactccgcttgtgaaatagaggtaacaacatgaacacaaacctaaaactaggaaataaaatttggctggtctttattctgggaacgatcagtgcaaccggaccgctgtcaatcgatctgtatttaccggcccttcccgaaatgacccgtgacctatccgcccagccttcactcattcaactgagcctaagtgcctgtctcatcgggttagccctggggcagctgatttctggaccattaagtgacaaatatgggcgcaagaagccgttgatgatcgggtttttcatctttggtctggtatccttgatgatcgcctacagcagttcagtttatctgctgattggcttaaggttcattcagggtctggctggggcaagtgggcaggtgctctcccgggcaatcgcttcagatatgttctcagggcctctgctaaccaaattttactcgatgctatcagcggtcaatgggatcttcccggtcatctcaccagtcattggcggctttatgatccgctatgtcgagtggcagggaattttcatcctgttagcagtcattggatttgtcttagtcctggcactctggctgggaattaaggaaaccttacctcaagagaaacgaatttctggcagtccggggaaatcaattggtcaaatgtttaagttattgaaaaactcgcgctttgtccgcctagtgctggcaactggattggtctccggtggtttattcagctatatttctgcttcatcatttgtgttccagaacttcttccacatgtcagttcaaaacttcagcctgctctacgcgttgaatggcatcgggatcgccattggctcagtcattccaggggccttggcgggacactttagtgaagctggtcaaaccaaagttattttgacatccacctttataacttctgttctactaacattgagcgccttattcttgaacaatctcctgctggtgattatcttagtgttcttaacggttactcaatttggaatgttatttacattaaccacttcaattatcatgaacctcacattacataacaatggcggcctgtccgcgatgttgggcttgtcgcaaaatgcaattggcggggtcatgtcaccgttggtcggattgatggggactgggacctatctgccaatgtcagtggcaattatgggatgtatggggttgagtttatttcttttcagtactattcataatagtcaacgctcactcagttaataaaaacggctgggagcaaaatttgctctcagccgtttttattgtgctgttaactaaatgatcatatttaagaaccggcagccaaagtggtagagcggttcattagactttaaaactactcagccagcttactaatcttcccctgttgaatataaacgctcaaaatcgcgatatcggcagggttcacaccactaattcgtgatgcttgggcaattgtctcaggatgaattttctgcagcttctgacgggcttcggtagcgatgccatcaattgcatcgtaatcaatccggtctggaatctttttggcttccatccgcttcatcttttcaacactttgctcggctttcttgatatagccggcatatttggtctgaatttcaatttgctcgatcacgtgacgatcaggctttgtctctgcttggggaatgaaccgcatcaatgtctcgtaatcgacatatggccggcgcagaaagattgatgccagtaccccgtcttgcagcggtttgtcaccgtgttcttggacaaattggttcacctcatctgatggcttgatccgaatagtgttcaaacgatcaaattcagcttcaatggcctttttcttagctaagaacttagcgtagcgctcgtcagaaattaagccaatttcgtggcctttttctgtcagacgcatgtcggcattgtcagtccgcagcaagagacgatattctgcacggctggttaacaaacggtatggttctttagtccctttggtaaccaaatcatcaatcatgacgccgatgtatgcttcatttcgttttaagacaaatggccctttgccaagtgcgcgacgaccagcgttgatgccggcaattagcccttgaccggcagcttcttcatagcctgacgttccgttagtctgaccagctgtaaagaggtttttgacgactttagtttccaaagtcggcttcaattgatagggcgcaacgacatcatattcgattgcgtagcctggacgcatcatctgggcattttccataccaacgattgaatgaatcatcttttgctgaacctcttcgggcatcgaagttgacaagccatcgacataccattcctcagtttttctgccttcaggctccaaaaatagttggtggcggctcttgtcagcgaaccgaaccactttgtcctcaatggatgggcaataacggggaccgacaccttcaatcactccggtaaacattggtgcccgatcaagattatcgcggataatcttgtgggtcgtttcattcgtgtaggtcaaccagcaagatagttggtccttgactgccaggtagttctcatcagaagattcaaaactaaagtggtgcggtttctcatcgccaggttgttcctctgtcttggagtagtcaatcgttgtcccgtcaactcgcggtggggttccggtcttgaaacgttccaaatcaaagccgagggcttccaagttacctgaaagtttttcagccggctgtgagttgttaggtccagaagcgtacatcaactcgccaatgataatttttccacgagcagctgttccggcagcaatgacaaccgccttggcataacactcagcgccagtattggtgataacccctttacaaacaccgtcttcaacaatcaaggaatcaacaattccctgacgcaaagtcaaattgggttctttttcaatcgtatgtttcatctcggcgtgataggcatgtttgtcggcttgtgcacgcaacgcttggacagctgggcctttaccggtgttcaacatccgcatttggatgtatgtcttatcaatattcttgcccatttcgccgcccaaagcatcaacttcgcggacaactgtccctttggcagggccaccaacggatggattacatggcataaatgcgaccatatccaaattaatggtcagcagtagcgtcttgttgcccattctggcagcagccaaagccgcttcacagcctgcatgaccggcgccgacgacaatgacatcataatcttggccgcgatatttttgtttaacatcgctaactcgtaaacttttcactgtttttcctccaaatgtttcacgtgaaacaggttattttcctaaacagaattgactgaataactgatcaattaactcatcttggtaactgtcgccggtaatctcacctaagaaatcccagcagcgggtcatgtcgatttgaaccaaatcaaccggcatgccatcatccaatcctttgacaacgtcttccaaagcctgtttggcttgatttaacagaccgatgtggcgagcattggtgaccataatgtcgttttgactgctttcaattccttcatcaaagaacatcttggcaatcaattcttccagctgcgtcaacccgtctgccttaatcgctgaagtcgaaataacgttctggccgtcagctaaagacttaatttggtcttgatcaattttggttggtaaatcagtcttattgaggatgataatccgttgtttgtcttgagtggcactcaataactttttgtcctcatcggttaatggctcactggcgttaagcaccagcagcaccaaatcggcactattaatggcttttctggaacgatcaacaccgattttttcaactttgtcagtcgtatcgcgaattccggccgtatcaaccaattttaacggcacgccgcggacgttgacatattcttcaaggacatctctggtagtaccgggcacatcagtcacgattgccttgtcttcatgaagtaaattgttcaacaaactggacttaccgacgttgggccgaccaataatcgaagtggccaaaccttctcgtaagatcttgccttgtttggcagtcttcagcagttgcacaattcgcgcatggacatcggtcgccttttcccgtaacaatttactggtcatggtttcaacatcatcgtactcaggatagtcaatgttgacttctacttgggcaagcacgtcgagaatatcttggcgtaaatgtttaatcaaatgcgatagattaccatccaattgattaatcgcggctttcattgagcggtcggttttggcttcaatcagatccatgacggcttcagactgtgacaaatcaattcgcccattgagaaatgcccgtttggtaaattccccaggctcggccatcctagcaccgtgactcagtgccaactgaagaattcgattggtggcaacaatcccaccatgacagttaatttcaacaatatcctcttcagtataagtgtgaggggctctcatcacggagagcattacttcatcgacctcttcgttggtatccggatcaatgatgtggccataattaatggtgttgctggcaactttatcaaggtctttaccacgatagagcttttttgcaacatcaagtgcttcttcaccactaatgcggataatcgaaatcccgccctcaccaggtggtgttgaaatcgctgcaatcgtatcaaattctgttgttgttaaaaccatgattaagcttccctccacgaataattgaatagtgttctaatttaaccacaaaacttatctaaaagcacaaaaaaagcgccactccatgccaaaaaagatagcatggataaagcactttgactactttacctagttaagataagaatgattacctacataatattttaaagcaatgcatttgtcaattgattttgagaactattttggtgcaacgacaatgacacgatgaggttctttgccggttgaatacgtcatcacgtgatcattgtcagccaaagcattatgaatttgtttgcgttcaaatgccggcattgggttcaagtagactggcttgccgttggcaatggcattccgagcagtcttatcggccagttgaaccagcgactcgcttcttctggaacggtagtttgcagtatccaactcaacggtaacgttgttggcacccagtcgattaataaaaatctgtgacaagttttggagcgcattaatcgtgcggccatgacggccgattaagcggctctcctggtcagtatcaatgtcaatatagattgaatgccgattctttaaatccagcttcaatttgaacgagaagcccattgcttctaaaacatcgttcaaatagttggcaagtttttgggaaacttcttcaatgtcaacggcgttttcagtttcttcctcatggtgttttgattctgaaaccggctgattagttgatttattaagatttgtctgttgtttagtgttagttttactgacaagttcaacctgtgcaagtttgcgaccgaaacctaaaaatccattcttaggttgttgaataacggtaacttcaacttggtccgaagtgagtgatagtgcggttaaaccctgttctacggcgtcttggatggtttttccagagtaaattgtcataatgaactccctttatttgaattaactggttaataatagcataaaaacgcgcattattaaacggtttgttgcgaaaaacggaaactaaacgcaaactttaaatgatttgtcacatttcaaagcatcaaactaccatctcactgcaaagtcgatataatggggtgtagtagcttttttaagaaagatggtttcgtctgaatcgacatcaatctatagtgacggctgctttaggttttcgatttgggaagtgataaaatggcaaacacaaatcaatatgacgccggccgaaacattcaaatcgaccgtcagcaccggcttagcaagcttcaggaagcctcgcagatcacctgggtcaacctcagtgcctactcggccatcatggttgccgaactgatcattgggtatttggcacaaattaccgttttgattgccgatgggctgaataacctgaccggtgtttgtggggcagctattttaatcattggcctgaaaatgtccaagcgcccaccggactccaatcatgtgatgggtcattggcagtatgaaaatattgccgcacttttatctgcgacgatcatgtttgcagtcagtatccaaattttcgttgacggcgtttttgctgtccagcgattcctggctggtcacaccattcgaccgaatgactggtcactgggtgtcagcatcattgcagccataatcattggtatcttagcgcggttcaataaaaccaagggcatccaacttaaaaatcaagcactcacagcttctgggcaagaccttaaaagtgatgcctggaccagctttggaacatttctttccattggcggtgcctacctgggggctcaatggttggatggagtggcaactttgattgtcggctgcctgattctccactcatcaattagtatttttagaacaaccattatgagattgagtgaaggttttgatccaaaagatattcaacgttatagtgagaccattagtgccatccctggggtcctcggaattgaagggattgagccacggtggctcggagatcaaattgtcatgaaaatcggcatctatctggatgatgacaccgatttaaaaacggcttatgcaatcggtgaaaaagttgaacacaatttaatggaaaaatacgacattctcgatgccgacgtgatgagctatccagtcagccaaaaagacaatcctcattcggcagattaatcaaaacagtttgacaaataaaaaaatcagcgctatattcagttttaattaaatgataatttgttaaacaaaacgaatcggtgagtagtttgaggttgtctatcagagagttggcgttgatggaagccaatattcaacttaaatgaagatggccgatgattggttgttgtgagtcaataacgagcagcagacggatgagtccccgttagcagacacaccatcgactttcgatggttatcaaggtttgacgagtaatcgtcaaataaatcagaatggtaaagtgttattcgcttctgcagcattggctgcagaagcgttttttcatttaatgaataaaaaattataaatttggggtggcaatcatggcaaaattagcaattgtaactggcgcaggacaaggaatcggagagggtatcgctcatcgactggcgaaagatgggtttgcgattgcggtcgcagacatcaacggggaaacagctgataaggtaaccgcagatttggtgaatgatggttacactgccaaatcgtatcatatcgacgtggctgaccgtgaacgggtctttgaattagtgcaaaaagcggttgccgatcttggcgaacttgccgtgtacgtcaataatgccggggttgcttttatcgatgaaattgttgattccgcggaaaaagacatccggcgattattggatgtcaatttattagggacttactggggaacccaggccgcagccgaacaattcaaaaaacagggtcacggtggtcgaatcgttaacgcggcctcccttgccggagttgaggcatctgctctgcaaagcgcttattcgatttcaaagtttggcgttcgcggcattacccaagcagcttcaaaggaattggcaaaggaccaaatcaccgttaacgcttacgatccaggaattgtcagaacacctctaagagacggcatcgacaaacggaccgctgaaatcaaaggaatctctgtcgctgaacaacaaaaaaactgcctcagtgaaatctcactgggcagagaagcgacaccagaagacgttgccaaagttgtttcgtggtttgcatccccagatgccgcttatatcaccggccaatcaattcttgtggatggtggcatgaggtatcaataggataatcgaaaacgagtgtaatttaacaggacagccatgagcacaatctcatcgcgctgtctttttgtttgaactctgtccgttaagccattttaataacaatctttccaacggaccggccggctgcggagtaatccacagcagattggatatcgaaaaacggcaccacccgatcaatgaccggctgaagggtcccgtgttcgaccattttggttatcttggccaattgggtcccactaggtttcatgaataaaaactcatagccaacctgaaattggcgctgcagtcgcctaatttttgctgtagccagggaaaacgccagttgtttccacattggcaggccagcctgctgggcgaatgcccgatttggcagacccgaaattgaaaccactttgccgccgggtttcacgacttgaaacgcgttagctaattgtgaaccacccagtgtatcaaacacgtcatcgtaatcaaacaagacatcttcaaatgccgtttgatgatagtcgatgacctgatcggctcccaactgcctgaccaaacctgtattctttgcgctggtggtcgttgccacaaaagctcccaatgacttggccagctgaatcgcaactgtcccaatcccaccggaccccgcctgaatcaagactttatctccaggcttaacgtgcatcaagtcaattaacgcttggtaactggtcagcgaaaccagcggcagtgctgcggattccaccagtgataagttggccggtttcaaggcaatatcaccctgatccacagccaaataatcggcaaaagttccgatccgattcttctgcacccgaccatatacctcatcaccaaccttgaagtctttcaccaatgttcccgtctgaacaactgtcccagaaaaatcactccctaatctcaatggcatcgaatatttcaacagcattttaagtttgccatcgcgggtctttaaatcaattgggttaatacttgccgcagcaactttcactaacacgtcatgatccccaattgttggaatcggcacgtccgcgatctctaattgctgctgcccaaaatgctggatctgggcagctttcatcatttttgtcattattactagctccactttattggtttaaatttttgaacgaatagtgtccaaatcataaatcacaatttgctgggcgtcaagcaagactgtttaatgccaattcattgacggctgacaaataaaatggtttaatggtttaaaaatatgaaccgaaaggaacttacgatggctgatttacaccaaattcaaactgaattcgccaatatcagcagtttcttaactgctttaggggaccaaacacggcaagcaattatcatttctctgctaaaaaccaattcttgtgaggggctgcaagttactgagcttaccagtgtcaccggcttatcgagaccggcagtttcccaccatttgaaaattttgaaagatgcccatttagttgccgtcagaagtgaaggaaccaagaacttctactacttgtcccatgacatcaaggagattaatgaactaaaaacccttctggaccatgtcacagcaatcattcatcaaacggagaccaaatcatgaaaaaagtattgattgttttaacgaatgttacccgttatcaaggcaccaacgatcccaccggtttatggttgggggaagcaactgaatttgccgaaacaattcagaaggctgggattgacgtcgactatgtcagtccaaagggcggctttgtgccacttgatccacgcagtatgaaatacactaatgagtcgatcatgaaattctatgaaactgaggattttcaaaaacgggcgttgaccaactcactgcggccaaatgaaattaatcccgacgattatttggcaatctactacactggcggccacggagtgatgtgggattttccaaatgaccgagccctccagcaaatcgcatggtcaatttacgacaatggcggatacgtcacatccgtttgtcacggagttgcagggttgctcaatatcaaagacgatgcgggtcgctatttaattgccggcaagtcaatcacgggtttcacaactgcagaagaaattattgccggtaaaaaatcagtggtaccctttctgaataaacaagcagttgaaaagcgcggtggtaaattcaaaaagaagcgggcttacaaggagtatgccattcaagacggtcgcttgattactggccaaaatccattctcaccacgggctgtcgctcggctattacttgaaaacgtgcattaaataaatatattaaagcggggccaaggcatcagtgtattcgactgataccttgaccccgctttaagtttggacgctaaatcaaacgtccggatctcattagttgatgagctgaatcagcttcccaatccgaaaaccagtctgctcaatcaattgaggagcttggtgaatcgcttcttgaacggtcagcggacgagtcgtcgtggaaacaatcaagtcaaatccttgatcgtataaaggctggatatcagccgccaaactcccggcaacggcaattaccggaactttggctgaatcagccagtttggcaacccccatcggcaatttgccgctgagggtttgtgagtcaatccgaccctcaccggtaatgaccaaatcagcatcacaaagcatcgcctttaagtccaccaacttcatgatttcctcaattcctgacgttaacttaccctttagaaaggccaggacgccaaatcccaaaccgccggctgctccagctcctggtacctgtgaaaggtccttccccacagtagcagcagtcagtcgcgccagtcgttgcagccgggcatcaaaatccgcaatctgttcatcttgaatccctttttgtggcccaaatatccgtgtagcacccaattggccggtcagtggattctcgacatcagaaagaccgatcatttgaactacggatattcggtgatcaatctgggtcaaatcaactttggccaggtctttgagtccaccaattccacgggagatctcatgaccgtttcgatcgtaaaaatgaccacccaaagcctgagccatgccaacgccaccatcgttggttgaacttccgccaagtcccagaaggattttgctgacgccgtgatccagcgctacttcaatgagttccccaacaccataagtcgaccgaacagcaacatctgtcgtttggccttgcgtgtatccagccgctgcagccatttcgatcactgccgtttgatcatcaatcagaccccatttagcgtcgatttgactgccggtaggtccagataccctcgtcgatattaaacggcccttagtcgcgtcgacaatggccgttacggtaccttcacccccatcagccagcggtacttttttgattttaagactgggattggccactgtaagtccccgttgcaaattctccgccacttcctgtgagctggcactgcctttaaatgaatcggtcgcaattacaattgttttcatcgtcaacttcctttaactaactgttgaccttagtgtacctgaatatggatcgttcaacaaaaaagcagcgtgatcaaatgatcacgctgcttgctaattatttacgtttactcttcttggcacgtttaatggcttttttaattgcccgttgtttctcacgctcttcgcgttgtttattttcacgttcgcgacggatcttccaaggattttggataaccagggtttgacctacttggaacgcgttggtgatcacccaataaagtgacagggctgatggcaggctaatagccataatcaaaatgaagaatggcattccgaccgtcatcatcgtggtcattgaattagattcaggctgacctttcattgccagccacgaagaaatgaaggtgaacagggcagctaggatcggcaagacaaagtatggatccggatgaccaagctgcagccagaagaacgttccacttctcaaaatgtgggttcgccaaattgcttggtacaaggcgaacagaattggcatctgaacgatcaatggcaggcagccggcaagcgggttaatgcctgcttcggcatacagcttcttttgctctgcttgaagcttctgaacagtttctgcatctcttgatgaatattttttctgcaatgccttcagctgcggttggacttcttgagtcttacgcatacttctggtttggtaaatcatcaatggcagaatcacgatccggacaagaatggtgaagataatgattcccattccgtagttgtcgctaaagaatttagacagccagatgatggcccgcgagaagttcaaaacaacccagccatcccaaatgcccgtactgtgattggttattggtgcgttactacatgcggaaagtactaccgtcaaacttactaatgatagtaatactagtaatttctttattctctttttcaacttttttcctcactatcatagttgggatcgattagtttagctaacttgagcacatgaattaaacttgccttgacatcactcatcgacatctggtcagcagccggacgggcaatgacaataaagtccacgtcctgacgaagataaggctttaattccaacaaggactgacgaattcttcgcttgacccaatttctatgtaccgcattaccgatcttcttaccaacagaaataccgacgcgaaaatgtaattgattgggtttatccaaagaatagacaacaaattgacgatttgcaacagagttatgagtctcaaagacttcttgaaattcactctctttttttactcgatacgattttcgcatgatccatctccacagacttttgaaaaataaatgaaaaagaccactgaatggtcagtggtctatgcagacaatgattttctacctttttgacgtcggcgagccaacactttacgaccattgctggtactcatacgtttacgaaagccatgaacgcgagcgcgatgacgtttctttggttgataagttctcttcataatgaattcctcctttaactgtaaaagtcgcgtttaagcatttaattacaattatgttcaaatgcatttcccaaatatattaacataatttgttcattaatggaatagtcttttgaatgatcgcacatttcaaaaaatatttaaaatttgtttcatgaacaattagtgtggataaccgcagaaataatcatagctgattttagagatttgcacaaggttatccacaagctcacaccgtgttccaaaagttatccacaggatgtggattctatcaacttttttgtgaataaagccgttgttgtcagctttagttatccacagttgcctgttcattacaccacatttcaaggaccttatccacttatccacaagtgagttatccatttcatccacccctgtgaaacaattatgcacaggctgtttttgcctgtggaaaacttttctggggaatgctaaaattaatttgcatttcgttacacgactaaaaacagagggggaattcgtagtgttagataaggattcattatggcaaaagttaagcgaacaatttcgcagcaacaccactgatcttacatatgacacctggatcaaaccagtcaagccgatcagctttgatggatccacactcactttatctttaccttctgaattgcatcgggattattggaaagaacaattggcaccaaacttgatagagtatgcttttgtgatcactaaaggcaatatcgagccaaagtttattctggattcggacgttaataaagaagcccaagaaaagcctgtggataacaatgtcagccaagatcaggacggcgatgagttttcatttagtaaggaaaatcatcttaatcccaattacacgtttgataactttattatcggcaagggcaatcaaatggcccatgccgctgctttaattgtgtctgaagaacccggcaaactttataatccactgttcttttatggtggcgtcggtttgggtaagacccatttgatgcaggctatcggcaacaagcgccttgaagatcatcctgagaccaacgtcaagtatgtcaccagtgaagccttcaccaacgatttcatcaacgccattcagaccaaccgcaccgaagaatttcgccgcgaataccgggacgtcgacattttaatggttgatgatattcagttctttgcccaaaaagaaggaacccaagaagagttcttccatacttttaacgatctctacaataacgataaacaaatcgtcctcacatccgatcgggttcctcaagagatccccaagctccaagaacgcttggtatcaaggttcgcttggggtctaccagtcgatatcaccccgccggatctagaaaccagaattgccattctcaaaaataaggccaagttggataacctggtcattccaaacgacaccttgtcctatattgccggccaaattgattccaacgtgcgtgaacttgaaggcgctttgtcgcgggttcaagcctattccaaattaaaagatgagccgattacgaccgacctggtttatgaagcgcttcgtggcctcaaattgagccaagataaccgccagctttcaatcgtcgatatccaaaataaagtcgccagctacttccacatttccattaacgatttaaagggcaaaaagcgcatgaagtccattgtgatgcctagacaaatcgccatgtacctttccagggaaatgaccagtaactcgctgccaaaaatcggcaaggaatttggcggcaaggatcacacgaccgttattcacgcttgcgataaaattgccgaaatcatcaaacttgatgccgacttaagaaaagaaatcgcggatatcaaaagtgccctgaactaaaatggtataatcgattgtggataaatcatcgagaagtcaataagttgtgcacagtcttatccacaggttaatcgttagggacaggccacttgtgaaaagttatccacaatatccacatgccctactgttacttctcttttcttttattaattaatatataattacactttccgggaggtcgattaaagtatgaaattttccattggtcgaacagcattcacaaaaggattaaacaccgtttcaagagcaatctctaccaaaactaccattcctattctgacaggactcaaaattgtagcaggtcctgacggtctggtactaaccggtagtgacgctgacatttccattgaaaccacgttaaaagccgatgatccagacaatatgttagtcattgaatccgaaggtgccattgtgttgcctgccagattcttcactgaaattgtcaagaaattgcctaaagacaccattactctagaagttggtgaaaacttccagacgatgattacttcaggtcaatcatcatttaccatcaatggtttggatgccaataactatccacaccttcctgaaattcaaactaacgactcaattcctttggctgctgatcttttcaaacagattattagtcaaacggttgtcgcagtttccaatcaggagagtcggccaattttaacaggtgttcactttgtcatttccgataaccacgttatggcggtcgcaactgacagccatcgcttgagtcaacggaaagttactcttgaaaccccgatcaatggttcatatgatttcgtcattcctggaaagagtttgactgaattatccaagatgatcgatgatggacaagatgaagtgtctttatcggttaccgaaaaccaagccctgtttgtcatcggcaacaccctgttttattcacgactgcttgaaggaaactatcctgacaccactcggttaattccagattcacatgacactcggatctcatttgaagcacctgaattactagctgcaattgaacgggcctctctgctttcacatgaatccagaaataacgtggttaaaatcacgattgatcctgacaaaaagacagttactatttacggtaattctcctgatgtcggaaatgttgaagaagaccttgaaccgaagtcattagaaggtaatgaactggagatttcctttaatcctgattacatgaaagacgcattacggtcattcacccaggcaacaattaacattgatttcacgtctgctctgcggccgtttactctcacaccaaccgaggacagtgacagttttgttcagctgattacgccgatcagaacgttctaattcaatatcgattcaccaacaacttccacacgctgggagttgtttttttctgcccaaaatgagttgcttgctatcgatttctttcaaaaatgctgcaatcacatttacataatgtttgaatcctaaaaaatgatcgtcatttcattagaagtccatataggcaccttttagcagtttttgccattttgatgcaaaaatatcaaaaatcttcaaaacggctcataatgcccaagaatcgtcattgacgtgtacttttagtaaacaaagaggtataatagaagaagtaaaaaggtgggtgaaattgtgaaaaaagatgttttcattgatagtccttatatcactcttggacaattactcaaagaagaatcgattattgccagtggcggccaagccaaatggtttttaagagagacaacagttaatgtcaatgacgagcctgacaatcgccgtggtcggaagctgtatgacggtgatcatgtcgaagttccagacgttggcttattttttattcgctcaaagcagggaaatgaatgaagctaaccgaaattgaactgcataattttcgtaattatgttgatcaaacgctcgaattttccgatgggatcaacgtctttcttggtgaaaacgcccaaggtaagactaatttattggaagccatctatgttttggcactcacccgcagtcaccgaaccaataacgaaaaagaattgatcaactggaacagtcagacggcccaaattaaaggtcgcctgcaaaagcggcttggaacggtacccattgaactggatttgggttcaaaagggaagcgggcaaaggttaaccatttggaacaagctaaattgtccacctacatcggtcagttgaacgtcattttattcgcccccgaagacttatccatcgttaaaggagcaccacaagttcgccggcggttcatggacatggaatttgcccagatgagcaatcgctacttgtacaattccactcaatacaaaaagatactgaaacagcgaaatcggtatttgaaagatttgcattataaacgtcaaaaggatcgggtatatctcgatgtgctatccgatcagttatctgcttatggtgcagaaatcatttatcaaagacttcagctacttaaacagctggaaaagtttgcccaaaacgttcattctgaaatttcacaaggtaaagaacagttgacctttgactatcacaccacagtagaggctgaccagttaggatcagtcgagtcgatttatcagagtttactgaagcattttgctgcgattaaagacaaagaaattttgcgtgccaccacgttgattggacctcagcgtgatgatctgcattttgtgattaacggcaaagaagttcagtcatttggatcccaaggtcagcagcggacaaccgcgctttcggtcaaactagccgaaattgacctgatgaaggaacaaacagatgaatatccaattctattattggacgatgtcctttctgaacttgatgatttcaggcaaacgcacttattaactgcaattcaagataaggttcaaacatttttaaccaccaccagtttaagtggcgttcagcaggagttactaaccaatccacgtatttttcggattagtgaaggtaatgttactttggcaaaatagtgaaggagaatcaaaatggccgacgaaaaagaaaccaaaaaagaattagcgcatgaatatgatgccagccaaattcaagttcttgaaggactggaagccgttcgaaaacgtcccgggatgtacattggaacaaccagttcacaaggacttcatcatttggtctgggaaattgttgataatgggattgatgaagcgcttgctggatttgccaccaaaattaccgttaccgttgaaaaagacaacagcatcaccgttactgatgacggtcgtggaattccagttgatattcaaaaaaagacgggcaagcctgctctagaaaccgttttcacgattcttcatgccggtggtaaatttggcggcggcggatacaaagtttctggtggtctgcatggtgtgggtgcttcagttgttaacgccctgtcctctgaactggacgttgaagttacccgtgacggcaaagtttactacatggacttcagtcgtggtcacgtcaagaccaagatgaaagtcgtccgtgaagtttcggatgatctccatggtactaaggttcatttcctgccggatcctgatatcttccgggagaccactacttatgatattaaagtcttaacagcccgactacgcgagttggcatttttgaacaagggattacggattgttgttcgtgacctgcgtccggaaaagccgaccgaacaagactttatgtatgaaggcgggatcaaacattacgttgaatacttggataacagtaaagaaaccttgttggatgaaccaatttacgttgaaggtgtcatgaacggaattaccgttgaagtggcgattcaatatactaacgattatcacaatacattaatgaccttcactaataatattcatacctatgaaggcgggactcacgaagaaggctttaagcgagccttgactcgcgtcattaacgattatgcccgcaagaacaagctgttaaaagacaacgaaccaaacctttccggtgaagatgtccgtgaaggcacgacggctgttgtcagcatcaagcatccagacccacagtttgagggccagacgaagaccaagctggggaattcagatgctcgaacggtgactgaccgcattttcagtgatcatttcaccaagttcttgatggaaaatccaaaaatggccagaaaaattgttgatcgtgggatgctggcctcaaaagctcgttcggcagctaaacgcgcccgtgaagttacccggaaaaagagtggcttggaaatcagcaacctgcctggtaagttagccgataacaccagtaaggatcctaaaatttctgaactgtttatcgtcgagggtgattcagccggcggatcagctaagcagggtcgatcacgtctgacccaggcaattctgccaattcgtggaaaaatattaaacgttgaaaaagcaagtatggaccgaattttagccaacgaagaaattcgttcattatttactgccatgggaaccgggtttggtgaggactttgatttatcaaagattaattaccataagctgatcatcatgaccgatgccgatgttgatggtgcccatattcaaacgctgttgttaacgttgatttaccgttacatgcggccattaattgatgccggttttgtctacgttgcccagccaccgttgtatcaagtccgtcaagggaagatgtcacgttacattgattccgatgatgatttgaatgcattcttaggaaccctgcagccatcaccaaaacccgtgattcaacgatacaaaggtttaggagaaatggacgctgaacaattatgggacaccacaatgaatcccgaaaaccgtcatctgttgagagttgaatcctccgatgcagccgaagcagataaggtcttctcgatgttaatgggcgacaaggtggaaccacgacgcgagtttattgaagacaacgcaacgtttgtggaaaatcttgatgtttaaagttgcttaataactaagcagaaaatgtttcacatgaaacatgccaccgaaacccatgaatggaggtaaataatttggcgaataaagataaccatgatgaaccaattgctggtcgagtgaccaacgttgatctatctaaaaaaatgcgaacgtcatttcttgactacgccatgagtgtcattgttgcccgtgcgctgcccgatgttcgtgatggtttaaagccggttcatcgtcgtattttgtatgatatgcatgaattgggtgtgacacccgataagccttataagaaatcagccagaattgtcggcgatgttttaggtaagtaccatccccatggagataccgccgtgtatgagtcaatggttcgaatggctcaggactttagttaccgttacatgttagttgatggtcacggaaactttggttcagttgatggtgatggcgctgcagcgatgcgttataccgaagcccggttaagcaagattgcgatggaaatgctgcgtgatatcaacaaagataccatcgatttccagcccaactatgatgggactgaacgtgaaccaagcgttttgccgtcacgattcccgaacctgttagtcaacggtgcgtcaggaattgccgtagggatggcaactaatattccacctcacaatttgtccgaagtcatcagtgccattcatgttttgatgaagaaccctgatgccactacagcagatttgatggaggctttgccaggacctgattttccaaccggcggcgttgtcatgggtaaatccggtattcggaaagcctatgaaaccggtaagggaaccattattgtccgcgccaaagttgaaattgaaggggaagccggcggcaaacagcgaatcattgccaccgaattaccttacatggtcaacaaggccaagttaatcgaacggattgctgaattagcccgcgataagcggattgaaggcatcactgatattaacgatgagtctgaccgtgaaggaatgcgggttgtgattgatgttcgtcgggatgcaagtgccgaagtcatcttgaacaatttgtacaaattaaccctgatgcagacttcatttagtttcaacatgttggcaattgtcaaaggcacgccgaagattttgagtttgaaagaaattttgaactattatctcgagcaccaagttgaagttattcaacgacggaccaagtatgagctgaacaaggctcaggccagggctcacattctcgaagggttaaggattgcccttgaccacattgatgaaattatcaaaattatccgtggttcacagacaggtgacgttgccaagaaccaattaatcgaaggctttggtctggatgacaagcaggctcaagcgattttggacatgcgtctggttcggttaaccggtttggaacgcgaaaagattgataaagaatacaatcaattgatgaaggacattgaagaatacaaagcgattcttgccagtcgtgaacgggtcaatgaaatcatttatcaagaattattggagatccaaaacaaatttggcgatccacgacgaactgaactcttggtgggtgaagttctgagtcttgaagatgaagatttaatcgaagaagaagacgtgatcatttctctaacgcataacggatacatcaaacggttaccaacttctgagtttaaagcccaaaatcgtggtggtcgtggtgttcaaggaatgggtgttcataacgatgatttcgtagaacatttagtttcaacttcaacccacgatgtgctgttgttcttcaccgatgccggtaaggtttatcggatgaagggttacgaaattcccgaatatggtcgttctgccaagggaattccagtgattaacctattgaacattggcaataacgaaaaaattcaggcagtgattaacgtttctgataagaacaacgatattgaaaaggatcttttctttgtcactttgatgggaaccgttaagcgcaccccagtgtctgactttgccaacatccgtagtaatggtctgaaagccattaacctcaaggatgatgatcaggttagcaacgttctgattgccagtgaggatcaaaacattatcatcggaactcaccgtggctacgcggtcagctttaatgctgccgacgttcgttcgatgggacgatcagctaccggtgtccggggtgttagattacgtgagaacgattatgtggtcggttctgatatcttgaaacctgacagtgaggtctttatcatttctgaaaatggctatggtaaacgcactccagctgctgaatacccaattaagggccggggcggtaaaggaattaagactgccaacatcactgaaaagaatgggccgcttgccggtttgacaacggttaacggtgaggaagacatcatgctgatcacagaccagggtgtcatgattcgattcagtgttgaggacgtttcgcaaacaggtcgggcaactctcggtgttcacttgatcagaatgaccgatggcgctaaagttgcaaccatggctaaggttgagaagcaggatgattcagaggatgacacaaaagatcagtcatctgattcagaacaagcaagtgatgattccagtaccaatgccgatcaaaactcagattcagataattaatattcagctaattaaaaagtcgatgagatttaattctcaccgacttttttgtttcacgtgaaacataagcatgaattctcctaagaaaatggggtaaaaaagtcgagctaattctttaacttacttttcgtaagtgatatgctttttgtaagaattaaaatacgactacctggaggtaatttattcatgactgttgttaatggttacaaacaaaacgataacgaagaaaaaattaatattttaaacttggaagagttggaagaacgagctaagcaaatcattccaactggcggttttggatacatcgtcggtggttcagaaaacaactggactttaaaagccaaccgtaaagcctttacccacaagcaaattgttccgcgtgctttgagtaatattgaaaatccatcacttgacactaacgtttttggaattccgctaaagacgccaattatgatggcaccaactgccgctcagggattggcccactcacaaggtgaaaaggatactgcaaaaggtgtcgctgccgttggtggtttgatggcccaaagtacctactcatcagtgtctatttcagatactgctgcagcggggaatggtgcaccccaattcttccaactttatatgagtaaagattgggacttcaactactcattgcttgacgaagctaaaaaggctggcgtcaaaggcattatcttgactgttgatgccaccgttgatggttatcgtgaagacgacatcaagaataacttccaattcccaattccaatggcaaacttgactaaatttagtgaaggcgacggtaaaggcaagggaattgctgaaatctatgccgcagctgctcaaaagattgggcccgatgacgttaagaagattgctgactacactgatttgccagtgattgttaaaggaattgaatcaccagaagatgccctttacgcaatcggtgccggggctgccggtgtctatgtatccaaccatggtggccgtcaattaaacggtggaccagcatcattcgatgttttggaagatgttgccaaagctgttaacggccgtgttccgatcatctttgattccggtgttcgccgtggatctgatgcattcaaggcacttgcttcaggtgcagacttggtagccatgggccgaccagttatctatggcttggctttaggtggtgctgaaggtgttcaagctgtctttgaacatcttggtgacgaattgaagaccacgatgcaattggccggaaccaagaccattgccgatgttaagaagacccaacttctaagtatcaactattaatttgtgtgcaacgtcctatcatccgtatcctctaacagaaatgtttaggcatttgcttctgttctcatgatgggaaataatattagaggatacccatgagtgctgcacagtattagaacattccccgtgttcttttccccaaaaatatgtaataaaacagcgttcctcattattgagggacgctgtttttggatcagattttaggttaattaatatttttgcgtggtcggccggttgtttggcctttatccagaatttctgggtgctcgttacgtgcataagcgtatgcatgaggatcctggccgttttgatatcgacttgagcgggtgttggtttgagaacttctgaagtagtaaaatgctgaaaccccaacgatgattaatagtaaaagtgtcattgaattcctcgtttctttatttttgttaaatcatgggacacgtgcgaaaaagcgtttccaaacttcaaattgaatttggaattgatactagtttacttccaaaatcaaaagagtcaagtatctgcttgaccgccgtggatgatttactggttagacccaagtgtagcaaggggttcctaattattaaggaattatttaattcctgatcgtgaattattttctccaaaagaataatccaggtggtttctatcgtatataataagtgtatcgtgaatcacaattaggcaattgatatttaggtccacacgtggtattattttatattgtgagtatctgggtaaaaacagaaactctccttgctctcgggaagagggccataagtccataaggaggtgcaaatcatggaagaaaagaaatacgaaattacttacatcatccgtcctgatattgaagaatctgcaaaatctgcattgatcgaacgattcgacaagatcttgactgacaatggtgctaaggtactaagttcaaaagactggtcaaagcgtcgttttgcttacgaaatcggtggcttcaacgaaggaacctatcacgttgtaactttaacaactgattcagacgcatcactcaacgaatttgatcgtctttcaaaaatcaatggcgatatcttacgtcatatgatcgttgttcgtgacgactaataattgattctaatatgagaggagcaaattcagcatgcttaatcgtgcagttcttacgggtcgcctaacccgcgatgttgatttacgatacactcaaagcggaaccgctgtcggttcgttctcacttgccgttgatcggcaatttaccaatcaacagggggaacgagaggctgatttcattaactgcgtaatctggcgtaaatccgctgaaaactttgccaacttcgttcataaggggtcgcttgttggaattgatggtcgtattcagaccagaaattacgaaaacgcacagggacaacgtgtttatgtgaccgaagttgtagtagagaattttgcgctgcttgagccccgttctgcaaggaacaactcaaatggtcagcaaaatggcaatgctcctcaacaaaataacggtaatgccaatacatttgataatcattcaaatgccggtaccggtaatagtggcaattccaacaataatggcgggaataatcctactaacaatggtggaaataacggtaataacgggaacaataatcccaatgatccgttcgctaactctggggactcgattgacatttccgatgatgatttaccattctaatgaattggtaaagtaaattttcgaggaggaaaaactatggcatatcaaagacgtggcggcggtcgtcgtcgtcgtaaagttgattttattgctgcaaatcacattgaatacatcgactacaaagatatcgatttattgaagcgatttgtttcagaacgtggaaagattcttccacgtcgtgttactggaaccagcgcaaagaaccaacgtgctttaacaattgctattaaacgtgcacgtatcatgggcttgatgcctttcgttgcggccgactaataatgatttatcgaagtcatcctttcggggatggcttttttatttgctcacaagaaaagccttcccagaaactgaaccaggaaggcttgtatcgacatcaattagttttcgttagtaacgggcttggcgttgtcaacttgttgatcaggtcctaatttctttaaaccgaccccggtgaatccactcaatagtgagaagactgggcaaagtaggctgaagaatacaaatggcaggtattggatagttgggacactcaaggtgttggcaatgaagacaccgccaacgccccatggaaccaagtagtttaaaacggtaccgccatcttcaagaacccgcccaagggctcggctggccaggccaccgttattgaacgtctttttgaaggctcgtccaggtaagataatcgaaagaaattgttcaccaacgaagatattcaccccaatgcaggctcccagggccgctgtaactagtttggccggattattcaacctggtagccagtggtgacataatcgccctgataaggccaaaatggactaatagaccaccaagcgataacgtcagaacaatgagcgcaactgtcggcatcatgctgacgatgccgccccgtgaaagtaataagttgacctcactgttagaagtctttgcgataaagccgttggtgatgatcgtgctggctttggtgacgtttaatccagggttattgacaaacatcatccctgctgaaacaaagatgttcagtagcatggttggaatggccgccattttaaagccggcgcagacaaacaccaagatgatcggaatcaaggcgacaattgaaatgtgaaaatcgttgttcaatgcggcaaccgttgtattgatcttattcatatcagcatggttgtgacccattccaagaagagcaaaggcaatggtggaaatcgtggcagctggaatcgtcgaccaaaggatggttttcatgtgatcaaataagtcggtgtcgaccacggctgctgccaagttgttggtttcggaaagtggtgaacatttatcaccgaagaccccgccggaaataatcgcaccagcgaccagggccggattgaagttcatggtgacaccgatgccgaagaaagcaatcccgacagttgagacaaccgtgaaacaactaccaacggcggcaccaaccagtgaacagaccagaaagacagtcggtaagaaccattgggcactgatggctttaaagccgatgaccatcaacgttggaattgttccagcggcgatccaggtactgatcatcgcaccgattaagataaagatgacaatggggatgatgcctttatcaatcccatccttaatcccggcattgatctcatcccaactaaacccagtcacttttgcccaaaagattgtgacggtaattgctaataatactggaacttgtggagacaatcccaaaccgattaccccggttcccataatggctaatgcaacaactaatactaaaatcgcttcacgcaaactcactctactatttctcatattgccaacctctttttattttcaaatttttgtctactttaaattcagttgactcaaatatcgtggtaaaccgccattcgttgctcttctcatagaaaatcccccttaagtcaataaaaaatcgtccctactgcatataaatgcaatagggacgattttaaccgtggtaccacccaacttgtgtatcaaaaatacaccgctcactagaagataatggattctagttattgaccattgtcgtgatattacggtatttcgccaccttaccctgattggttcgcagcaaccaccaacttcctgacacccagataaggcactacttcatgtaattcgactttaattattaaagagagtataaaacttgatgagaggaattgcaagaaatgtttccatgatcgattgctgggaatgacgaagctcataatcccccaaatgcacattgtcgttaaataatcttagcaattcttccccattcgcctaagattatcgaaaaaattcttattttcacctttttaaataacaaaatgtaaccaaacctaacatcaaatgcctatttatgataatataaatgcattctcattagaactttttaatctaattcttatgttgctcttatttaggaggatgcctatgaagtcaaaaattcaagagaaccaagatggaaccatgcgtgcgttaagtaatcgtcacgttcagatgattgcgattggtggaacgattggtaccgggttgttcctgggatctgggagcaccatcagtaagacgggtccctcagtcatgctgatctatttggtacttggcctgtttttctttttcatgatgcgtggaattggtgaaatgttctattccgatccgtcgcaacatacattcgtttcatttatttcccgttatctgggtccaacagttggtcattttaccggctggacatactggattgggttggtattcgtttgtatgggtgaaatcagtgccactgcaacatatgttaaattctggttccctcaggttccggcttggattattgaagttgttttcttaggagttttagctggaattaatttaattgctgcacggttgtttggagaagctgaattctggtttgcaatgatcaaaatcgttgccattctggcattaatctttactggaatctttatgatgttcagccactcggtgacgccacttggccatgccaccattggtaacattttccacaattttcaactatttccccatggcggtgtgagttttatcgctgcgttcccaatggtcttcttcgcattcatgggaattgaattcgtcagtatcacaattggtgaagctaaaaatccgcaaacggtcatcaaaaaggccgttaatgaaactttgattcggatcttaatcttctatattggggcattgactgtgattatggggatcatcccatggtcatctattacccctgacagcagtccctttgttcaagtattgaaactcgccggattaccagcagcggccgctgtgattaactttgttgttttaacttccgccgcatcatccttaaacagttgtatcttctcagccggccgacatttctatcagttggcaacagaagttcccgaagacagctggatgcgaaaaacgtttgctaaaatttccaacaatggtgttcctgcccgagcaattatcttctcggcagcactggtcttgattacgccactgatcagtttgactaacagtttggcgtcggtatttaccatcgtaactggaatttccagtgatatgtacatcattgtgtacaccttggcaatgctggctcacagaaagtaccgtcaatcagctgacttcctgccaaatggcttcttgatgccggcatacaagattatgagtccgctgacaatcgcatttttcgtggtcatctttggttcattgttctttgttccagaagacattattggtgctgttggtgcaattgtctggacggttgttttcggtgccgcaacttatatccatcaaagacgattggttcccgataccgaccagtaattgtctaacaattcaatgaaatgaatttgcatgtctcttccaataaatatcatatgacgactctgaaaaattcccgacagtgatgctggggatttttctttgcttcatcattgagatgagaacccaccagaaataataaagcaggccgatttatggtaaaataagagcattaagctattatgaagaggaattaacatgaaaaattggttcacaaacaaccgtggtgaactgccatcatttgttcataaccgacgcctcagaagaatcatgatgttcatttcattaatcgtgatctacggcatcgttatttcatttttatataatatcgtggcttccctcattctcattgtgatcagtgttgtcggcctgatttttaccatcgtcatgatgaacgaaatcagttccgataccaaccgctatattaccgacttgtcatacagaattcatcgtggggaacaggaatcgctgctcgaaatgccgatcggcgtcatgatcttaaatgacgacgaacaggtggagtgggcgaacccctatatggtgaagtattttaaggatgagaatttgttgggtcgaaagatcgacgacatcgatcatgacctccagcagttaatcaccaagtacgccgaatcagatgaattccacacgatcacttggcgggaccataagtttaccatgctgatccaaaaggaatataactcggtctatttgatggatattacccggtatgccaacctggaagaacggtacaacgaagagcagatctccgttggtcaaattttcctggataactatgatgaaatcacccaatcaatgaccgaccaggaaatctctaatttaagcaactatgtgactaacgaattggcaacttggtcccaaaaatatgggatgtatctcaagcaaatcgatgatgaccacttcttcctgctggcctactcaaagtcgctaaccgcaattgaaaatgacaagttcaacatcttggacactgtccgagagacgacttccaagcaaaacttcccactgacgttgagtatcgggattgcttacggcgaagatgacctgaataatttggccgaccaagctcaaagcaaccttgatttggcgttaggtcgtggcggtgaccaggtcgttgttaaatcattggatggtaccgcgcggttctatggcggcaagaccaatccaatggagaagcggacccgggttcgggcacggatgatttctcaagctttaaacgaattgatgagtgcctcagatcaggtctttgttcaaggccacaccagaccggacatggactccttgggtgcttgtctggggatcagacgaattgcccaaatgaataataagaaatgctggatcgttcttgataaggagaaggtccactcagatattcaacgattattggaagccaccaagaagtacccggaaattgccgattcaatcatcaccccttcagaggcgattgccaaagcaactgacagcagcatgctgattatggttgatcattccaagccttcaatcagcatttcagaagacttatacaagcgaatgtcagccaaagtggtcattattgaccaccatcgccggggtgaagagttccctgagaacccaatgctggtatacatcgaaccatacgcatcatcaacttgtgagctgatcacggaaatgtttgaatatcagccacatgaagaagaaccaatcaaccggattgaagccaccgcaatgctaaccgggatctttattgatactcagcgcttttcaatgcggactggtaccagaacctttgatgctgccagttacctgcgttctgcgggagccgattctgatgaaatgcagcaatttatgaaggaaaatattgatagttacctgcaacgcaaccatctaatttccaaagttgaattcttccacaagaatatggctttgattgttggcgaagaagaccaggtttatgatccggtcacggcggcccaggcctgtgattcacttttgacaatgtctggggttgacgcatcattcatcatcaccaaacgctccgacggccaaattggcgtttctgctagaagtaccggtgccgttaacgttcaagtcattatggagcaaatgggcggcggtggccacttatccagtggtgccacccaggtttccgacaagtcggttgccgatgtgaaaaaaatgctgcttgaaacgatcaagaatatcgatgataatgaataaaggtatttaaatttttgaggatagtaggagtgatctgttatgaaagttatttttctgcaagacgtccgtggtaaaggtaagcgcggggaagttaaagaagttcctgacggctatgctcaaaactttctgattaagaatggaaaggcaaaggcagccactaaagcggcaatgagccagttaaagggccaacaaaaggccgaagaaaagcgtgaggaagaagagctggaggaatccaagcagttaaaggccaagcttgaagacgacaagacagtcgttgaattgaaggccaaagctggaacggacggccgtctctttggttcaatcccaagcaagcaaattgccacagcactggaaaaacaatacggcgtcaagctcgataaacgcaagattgaattaccggaaccaattaaagttgccggctacaccaacgtgccggttaaattgcatgttgatgtgaccgctaagattcgggtacatgtttccgagaaatagagcgcgaacaacctttatccaggtaaatgtaacagagactcctcacaaaaggaccaccttgtgggtgagtctcttttcttctccaatctgaccagatttaaggggagtgtgctacaatttaactattgtatttaacgtgaacgaatttgaggaataaacatgagcaatgagtttgtaaacgaattaccaccacaaaatatcgatgcggaaaaggccgtccttggatcgatttttctgagtaccgatgctttggttgagtccatggagttcttagagcccgatgacttttataagcacgctcaccaaattatctatcaggatatggtcactttaaacgaccgcgatgaagcaattgatgtggtgacaatcaccaacattttaactgaacaaaataacttggacgacgttggcggcatggaatacatcgccgatctggctggttccgtcccaacggctgccaacgtggcttactacgcaaaaatcgtcaaggataaggctattttgcgccggctgatccagactgccaccaacatcgttactaacagctataataccgatgacgatgtcaccacggtcttggatgatgctgaacgagacattatgaatgtggcagaaaatcggactcagtctggttttaaaccgatcaaagaagtcttaaataacgcctttaacgaaattgaccgcttgtcccaagaaggggatgcggtcaccggcctttcaaccggttatccggaactcgacaagatcacaacaggtttgcacagcgatgagctgatcattttagctgcccgaccggccgttggtaaaacggcctttgccttgaatctggcccaaaatgtcgggaccaaaacagataaaactgttgccatttttagtttggaaatgagtgccgaatcgttggttaaccggatgctgtgtgcggagggtagtattgatgccaaccatttgcggaccggtcaactaactgaagatgagtggcagaatctggtggttgccatgggcagtttgtctcgggccaacatttatatggacgatacggcggggatcaagatgtctgaaatccgcgctaaatgtcgacggctggcgaaggaaaccggtaacttgggcttagtggttgtcgattatctgcagctgattgaaggcagtaacgccgaaaaccggcaacaggaagtttccggcatttcccgtcaattgaagaaattggccaaggaactccatgtcccagtgattgcgctatctcagctttctcgtggggtggagcaacgccaggataagcggcccgtcttatccgatatccgtgaatcaggttcaatcgaacaggatgccgatatcgtcgcctttctttaccgtgatgattattatcgtgatgaagacgatgatagtgatgattccggctctgagggtgaagacgacgaaaataatgtcggagaagttgaggtcattattgaaaagaaccgatccggccctcgtggaaccgtcaaattgttattcgtgaagtcgtataataagttttcgtcgatttcctatgctcagcaacagtaaaatttaccttgatatcattaaagcggcctttggagagttttccattggccgtattttaataccgttatatttgttgaaaatggacttgttaagattaatttgattttataaacaactataataaaaccccttaaattagatttctccaattaaaggggtttagtttagacatttaacttatcctgattacatttgttaaaacttggtcggaataaccgcagccaaaccgcgtcgttctttgccgcgataaccaatccagactgccagtgacccgattaccaggccaccaagtgcaacccaccagagggtctgctggaaggcacctgtgttgccaagattagccatgatgttataactgctgtagatgttttggtacattggcgtcgtttgacttaagaacttgtagaaactggtcatggccgcccgtgggagcgttccgccaccagccatgatttgaaggacgaacagtggtaattgaatcagcaaacttggtaggccgccaaatagaagtgccaagccgctggtaagttcgaaggctgcaaaatcgtacaagacattttgccaaagcaaagcgttgaaaaccccaccgtcaaagctgacgaggcaccgcagcgcaccaacggtcaataatgctaaaacaaccgcggtgataacgccggtgacttgaaggccaaggaaggttttccacttgccggcgatgaagcgaaccgacatgaaggtcatcgtaatgatgattgaagcgatcatcaggcccaaatattggcccatcgagataaacatcggtgccatctggtgctgcatatttacctgcttggtacccatggtatcggtcgatgatttagccgtaatgttaaatggtgctgccatcttagtggcccgagccatgacttgcttttggatcttgggttgtacttttgcttgaacctgtttttggatctgtttttgattaacagcctgaccttttgaggccgtcatggctttttgcatggcggtcttcatcccagtagccattgcggttttcatcatcttaggcgcaagttgtttggcatacatgccgacaagtgactgttgggtcaactgggcgttaactgtactttggatccgggagatcagtccctgattaacattggtttggaccatactgttggcgttgttgacgacaaaattaacggttggtcgtttgccggcacgaacgtccttattaaatccatcgggaatcacaaccgccagagatgctttgcgaagttcgattcggtgtttggttcggcttaggctactcgaagtcgaaatatgcttgaagggcaggttgtccttcaaaccgtcggcaaccttatccgagatctgttggttatcttgattgacaatgacgattggtaagttttgagtattggttggcatgtgcttgaaagccggtagaatgcagaatacaaacgaaactgcaataaaactggcgactaacattcccagccaactaaatttatttgaaaaccattttgacattttagttgttcctccttaaaataacgaatgaatgctcattcatttttgtaacttagcaacaataatctttttctaaacaaatgtcaaacacatttgaaaagtcattccaagtccgctaaactaaaaacgaaatgaggtgcgagctgtggctgatgcagagaatgattttcaacaattatataaagagacgctcaagaaaatggacggcctgacagataagcagaaacggattctccaggcggccctcgaattattttccacccaaggctttagtgaaacctcaagtgcccaaattgctgatcgggcaggcgtggccgtcggttcggtctatcagcgtttccacaataaacaggctttattggtggcggtactggccccactcttaaacgatgtgttgcccaaagccgttgacgagtttggcaatacggctttcagcaagtcttacgatgaggtcgagccctttgtcagagcaatcgttcctgatcggctgagatttatcgatcagaactacgctgccttgaagctacttgccggacaggtgattgttgaagatgaggggattatttcacagcttacagaggcctttagcagtcacatatcatccaacgtgataccgaatatcaaacatctgcaaaagaccggcaagatggctcggttcccggagcgttatgttattcaattcctgttttcgtctgtcatcggctattttggcaaacgaattctcggcattccggtgaacattgaagatgaaattaagtatatgaccgtttttttgacgaatggactaacagatcataacgtcaaatagctgcccatcatcctgtgaagggatgcagtggacagctatttttaggcaaaaaaataacaaccacggctacgagtagctgcgtgatcgttatttaatggtatgtaattgatgggcagtcaggggctcgaaccctggacccacggattaagagtccgttgctctaccaactgagctaactgcccattactaaccgacttaaatataatagcatatgctcaaaatatttgcaacacggaaaagggtatttatttgaccaatatcggtctgtgttataatagcaacatgttggcgtgtgcaaattttagaaaataacaatattaaaatccatgttaggagaaattgttaatggcaaaaaagatactggttgtcgatgacgaaaaaccaatcgtcgacattgaaaaatttaatttaactaaagaaggctacgaagtctcagtagcttatgatggtgaagaagcattgcagcaagtcaaagacgttgatccggatttaattatcttggatttgatgttacccaaagttgatggccttgaagttgccagggaagtccgtaagactaaggacaccccaatcattatggtgactgccaaagattccgagctggataaggttcttggtttggagcttggggctgatgattatgtgaccaagccattctcgaaccgagaattggtcgcccgtgtgaaggctaacttacgtcgtcaggggaccaatagcagttccaataacgaagaagacgaaaataaagacatcaagatcggtgatttggtgattcatccagaggcttactcagtttccaaacggggtgaaaacattgaattgacccaccgtgaatttgaattgttgcattatctggcccaacacattggccaagtcatgacccgggagcatttactgcagaccgtttggggctatgactattttggtgatgtgagaaccgttgatgtaactgtccgccgcctgcgcgaaaaagtcgaggatagtccgagtcatccaacctggctggtaacccgtcgtggggtaggttattacctgcgcaacccagaaagtgatcaagcataatctcaatgaaatcaatgcataaggggtattaactggttgtgaataatcgaattaaattttaccaatcaatcaaatttaagatcgcactggttttcgccctgatcctcctggtaacgctggaaatcgttggtgcggtctttgtcaggcagctggagcatcaaaatttggcaacctttaagaaccaaattcagctgcagacctacgtcaccaattcattgacgactcaattgtcgagtgccgatgaaacaaaagccaacggtcggatcaagactattttgaatgattccgatagtggtaataccgcgcaaattcaagtcattgataataaagggacaattcgcggtaccaatcagattaacaaccaggcgatcgttggccaaaagaccaccgatgacaacgtcaagaacgcaatctacaacgggaaaaaatttgaaaaaacaacctatgattcttcaactggtgcgcgttattacaccatgatttcaccgttgattaagagctccaacaataatagtacggtcgtcggggtggtatacacccgggcgaacctcgacagcgtctatgacagtattaacagcattacgctgatttatctgttcgccgcgtcgattgccattattttggggttattaatctcgattgttatttcgcgagcgattacgcgaccgattgaagaaatgaagaagcagaccatcagaattgcccgtggggactattccggccaagttcacgtttatggaaacgatgagctgggtcaacttgccagtgcggtcaacaacctatctgtcagggttgaagagtcccatgagtcaactgagtctgaacggcgacgcttggattcggtcctggcaaacatgactgatggtgttttggcgaccgatcggcgtgggaacgtgattatcattaatgaaacggccgccagtttcttggatcttgatgaaaatcaagccatgggcaagtcgattttggacgtgttggatattcgcaaagactacagtctgcgggacttgcttgaaaaaccggatgagttaatccttgatttttcaagtgaagatcacagtctggttttgcacgctcatttttcactgattcaacgggaatccggctttattagcgggctggtctgcgtgcttcgtgatatcaccgagcagcagcgaatcgatcaagatcgcaaacagtttgtgtccaacgtttctcatgaattgcgaaccccattgaccagtgtccgttcgtatattgaagcactgtccgatggtgcttggaaggatccgaagctggcaccgaagttcttaaaagtcactcaggatgaaactgatcgaatgattcgtatgattaatgacctgttaacattgtcacggatggattccgggacgcagaagatggaagtggaactggtcaatatcaatgaattgttcaattatgttttgaaccgatttgacatgattcttaaaaaagaagatcatccagaaaagacctatacgatcaaacgctactttaccaagcgggatctgtgggttgacctggacaccgaccgctttacccaagtgttggataatttgatgaataacgctatcaaatattcaccggatggcggcgtgattacttgtcggctctatgaaaccagaaataaggtcattttaagtgtcagcgaccaagggttgggaattccccgaaaggatattccgcatatctttgaccggttctatagagttgataaggcccgttcccgtcagcagggcggtagcggtttgggcttggcgatttccaaggaaactgtcgaggccttgcatggccaaatttgggccgagagtgtggaaggcaagggatcaacgttctatattgctttgccatacgaaccggtagaagaggaggacttgtgggatgaggtttagtaaatacttaataccccttgcgctcaccattgcggtggttgccagtctaacgctctcagtggttctctggaccaatccggctaattatcggaccaataagcaaacggcgcaaagcccgcagacgcagcagatgattaagcccaaacggtacgtctactcaccggttcaggcgattcatacgaatgcggacgggacccaacagattatggtcaacaagttagtgaacaccgtgactgagattaagaaaacgatgcatcattatcaaaatccgcggatgaaaactttaagcaaaaattcgcaagttgactattttcgaatcgctaaccaaacggattcgattatgctgaactattcagacacggtttcgatgcgaacatttaacgcaattgtcagcaatcgattccggaagctgccgaacatcaaaattaaccgagttgttttgccaaccaacaattcaaccaaactgtatcttctctatgataaaaacttcacggtgtatgaagtcgatgttaaaaagcacagtttaaaatctttgaacaaagttctgcagatggacatgcggacacaaccggccagcttcaagttattaaataatcggccaactgtctacgttaccagctctgtgcagatgcagccttataagtatttgattgaccgtcaatctgacgattactatgttagccgactgctgaatactcaggattcaaccagcattaacgttaagcggcgaaagaatatgacgatctacggtgatcaaagttccctgcaattaacgtttaattccaggaatcggatggcagaattttctgactttcggccaaatcataaccgccgcagtttgacgtcaacgattaacgattcctacaagaatatcactaagctagggctgccaatggataatgtccgtttcttcagctatgatccaaagagccggacggtgatgtatcggacctatgttgaaggtttcccaatttttcgagccagtggctttggcactgtctcgacgcggacactgaactccagtgctcagcggatccaattctcattggataatcccgaggtgccgctgccaagtaacaaggggtacgtttcgctgccgtcaactgaaacaatgctgaagcggctggtcaatcgtgggtacaatttaaaggatcttcaaaaagtccgtctgggttatacttggaagaaggattccacgtctccattattgattgacctgaatccagattggtacatctattacaagaatcaatggcgctcttacaccgcacttatgaaccaatactaggaaaggagggagcctggtgaactttcgaagaattgagatcatctttttggtgacctttatcgcaattgacatcttcttgtttgggatgttcaaaaagaacatggacatgcaggccgacaacgtgtcgcaaggcgactcggattcagtgatcgtcaaggaaatgcgtaacgaccagattaaagttggcaacttgtccaagaagaacgaaactgcctattatatttctggtgaacaaagcgacgttttgcgtaaccagatgggacaattggttaaccagactccccaatttgttggtcatgagctggaaagtgaacttaagcagcccatcacggttgataagaataatccacgcaaatcaattgataaattgctgacggattccacgtttgtgttgtttggtgaccagtacgtttacagcaaaaacctttcaaccagtcggaatatcgtttacaatcaaaaggcgatgggaagttcgatttactcctctgaagcccagatcagatttacgctgaattccaattatcagattgtcagttatactcagtcgtatctgcagggaatcaagagcctgcgcgaaagttcggaaaccatttcggaaacccgggcgttaatttggttgtatcagtataatgagattccgaataacactacggttgcatgggccagccttgggtataccaagttattgtcaatcgatggcgatcgagtctttattccaacttggattatcgcgattagaccacaaaattccacccaagttcagttgaaacggatcaacgcgtttacgggtggcattatcaaacaaactgatgagaatttaaagaatagtcaaacatcaatgaattaaagttaggaagaagaacggttatgaataatgatgatatgaaaatcagcgtcctcgccagtggcagtggcggtaacgtgacttacatcgaaacgccggaccacaaagttttgtgtgatgccggattgagcggtaagaagattgaagcgctcatgaattcgattggtcgagacctcagtgacgtcgactcacttttcgtgacccatgagcattccgatcaccgactgggtgccggtgtcttggcacgcaaatatgggattcaagtctatgccaacgaaggcacctggaatgccatggcaccaagaattggcaaggtcgctgacgatcaaaagaacatcattgccccggacagtgtgatggatatgggcgatcttgatgttgaaagcttttcggtgtcccacgacgctgcagagccacaattctatgtttttcatcataataacaagtcgtttgttatcctaactgataccggttatgtttctgatcgcatggaaggcgtcatcaaagatgccgatggttatcttttggaatgtaaccatgatattgaaatgctggaaaatggcgattatccttggatgaccaaaaagcggattttgggtgatcaaggacatttgtccaatgaagatggcgccaacaccatgttggatgtcatcggtcatcggactaaaaaggtcttcctaggtcaccgcagcctgcataataacatgaagacgcttgcccacttgacggtggcttccatcttggaagaccacgatatgggtgtcggtgaggactttaagctgtatgatacatctcaggaccacgcttcacctttaatgattatttaaaaatcctttagatatttctaaacttttaaacacactttcgtcatgaaaaaagtatattataggtaatataaaataataagggggcacactaattggcacaaaataacggatttggaaaattcattgcgaccgctgtgatcgctggcgcacttggcggcgggattacttacggcggagtttcttattttaacaacaataataatggaactggaacagagctggtttctggtacgaacaagaatggcaataccaaggtcagcaacgtaaaagttaatctcaatactcaggcagaaaaagcgtttaacgcaactaagagcactgttgtttccgttattaatttacagaaacaaagttcaagcgacgacaccttatctggaattttgggtcaaattcaaggtggttcttccagcaaaaagaagagcagcggcgaacttgaagcctcaagcgaaggatccggtgtgatctataagaagagcggcaatactgcttacatcgttaccaacaaccacgtggttgccggtgccaatgccctcgagattattctcagcgatggctcgaaggtttccgcttcggttgtcggtaaggatgccgtttctgatttggccgttatcaagattaactctgacaaggtcaagaaagtcgcaacttttggcgactctgataacatcaaggttgccgaaccggttctcgcaatcgggtcaccactgggctcacagtacgcaacttcagtaactcagggaattatttccgctaagaaacgggaagtaccgcaaacttcagagagtggccaacaaattggtaacgcaacggttattcagaccgatgctgcgatcaaccctgggaactctggtgggccactgattaactttgccggccaagtggtcgggatcaattccatgaaattagcttctgatcagcagggtaccagtgttgaaggaatgggctttgcgatcccaagtaatgaagtggttatgattatcaaccagttgatcaagaacggccaagttatccgtccggcactgggaatcggctacaccgatctgtccaacatttccgagcagcagcaacgctctattttgaagctgcctaagagtgttactcaaggggcggttgtccttaacgtgaacgctaattcacctgctaagcgggctggattggccaaatacgatgtgattaccgagctggatggcactaagattactcaacaaagtcaattgcgtgatattctgtataagcacaagattggcgataagatctcagttacctattatcataaaggtgacaagaagactggctcaattactttgaacgaaaaagcaaccagtaaagttttaagcgaagcaagtaaataatccttaattataagtattggtaacctccgttttctcataagcggaggttattttttgccttaaaatgaattgccgatcgttacttacttaacataagtgtaatacttaatattcatgtaatgttaataaattcacatttgagatacaataatgatgtagcacaaattgatcaaaggggatatcgacatgaaaattcatattaagggatcaatcctggtttccatggctgctctgggagtctttgctgcagttgggatatcgcagtcttcaactgtttcagcaaaatctcgggtccgggttacgtcgaacgtaaaattgaagggtaccggagcctcgcgcaacgttacctttaccggtaaagcagcattgtggaccaaggcttcagcactaaaaggagccaagagggtcgcaaccaccattacactgcgggaccttgccaaatctacccgatcaagcaagaatgttcgcgcttatcgggttgccagaaccaaccggggaaaagtgtattataaggtggttacttttgacggtaaggatcgcggttggatctatggcggtaagagtcggtcaagctttgctggcggggtgaaatcttatctgacattccagcagaactcactcactgatgatatgagcaacgggacgttccaattcgcaaacccgggaaccgcaaacaataatcagacagttacatataagcagccagcttggacgcaatataaggttggccgtcaggtaactgattcaagaccttatgcaaatgtcagttaccaaattgaccaaacagggatgagaacccgtgaaggtgaccaatgggttcacatttctgccaccaataacggcaactccggcgcggatggctggattttgtattcaggattgaagaagacaaccaacatcaattcaccaattgctgataacgctattcgaattaagttagttgattcggcgacaggttcgtcattgacctcggttgatttcacaaagactggggtaactaaaggcgctaccatcggcgcaaatgtgaatggcacttggaagctggattcaaatgattccagttcaattcagtcacagattgcctccgcactttcaccacttggctatccaggatttaccttgactcaaggccaaatcgcggccattgcccagggaacctttggatccagcgtgacgatttcagttgtgaaaccaacgattaacaaggcagtccggattgttttgacagatccgagcggaaacgtgattaattatgttgattacacgactgctaacgctgccaatggtcaaccggtgggtgtgcaggatggctcaacttggaaattggcggcaaccgatacggctgctattcaagctaagttagttgatgcgttaaagggtaccggttttgcattaagcgccaacaacacattgaccactgaccaacaagctcaaattgctcaaacgacattcggtaaccaggtttccattaagaccgttgccgttaacccaatcaaagacaatgaagttcaattgtcgtttgttgatcaggccggtaaggctgttggttcaacaaccttgacgaaaggcacaaatgacaaaacggctttggacacgattaagactgttagtgttgctgacccaacatcaccttatgctgctaccttgaagaaggcttatgctgctcttttggccaaggctggtattaagggctacaccactgatggtttgagcaaggatcaacttgctgcgaacttagctgccattaaagcggctgcatatggtcaggatgttaagttggttgtcgctaagctgccagcgaaggcattggtttccagtgcactgttctttgataaatctgataccaaggacgtaactcaggatcttgcatactttgaaaatgcaaacggtaaacgtgatagtgacgcaaactttagcaaagcattggctggagacgcgaatatcaatggttatgccggcgatgtggttacggttgcaaacctcaatgctgctgttaaggatcagggattgaatacaatttactacgcagcaaagaatgacggtttcctctggggagctggaactcatttagcggctagtgactacagtggaacgaatggaacgttatttgcagacggtatgagtggtaagacaatttatgtattcaaattaacctttaccgctaaacctgataatcctgatacgtcgattggtaacagactagattctaataagcctctattcgacaagcaggggaatgcaactattggtgatacaggcaatcaagtggtactgaagtatgatgaagtcaaggctggtaaacagattacccttgatagcaacaatatgaaagccaaaacactcgcagagttgtttggtgaataagcacaaaagttgatcagaggacttcaattctcaagttgggattgaagttcttttgtgtctgtagccacatggcttcttatttaagagccctaagtggaacacagaggataacaccctcctccgtctgaaacacgtgataagactcatatttagggctaatatcctccgggatcggcagcacccattccccgtcgtgattgactagtttgactgtcattggtgattctccaatctttaaagtggatttgtttgggataattcaggtataataattgaattgattcgatttgtccgcaaacattggaccgcatcactgtttacgaacggccttaccaaatatatggaacttgtaccgtacacatggtataaatacgaacgacgaaccaagttttatttaaaaaattcatcggatgtaaagatttgataaactatccacattttggctgtggataactctgtggacaatccacaagattctgttatccactgatagaataacgttgaatagttatcccccaaaaactaaaagttatccacagaaattgtggataactttttttgatataaaaaggagatttgttcgttgagataatgactgatataatagggtttgcggtgacagattgcgaacacacgttgtccacagttctgtggataacatttttgacccttgacaatttttaaaataatgcgggtcactgaaaagttgataaggtgcataaacctgtggataactctgtggacaacttgttaataagcccgcttttttacacaggataactataaatttggaggcaattacatagtgaacatcaaattggtcgttgttggaaaattaaaagagaagtattttaagcaggggattgcggaatacgcgaagcggttatcgcgtttttgcaagtttcagattgtggaagttcccgatgagaaggcgccagagtcactcagccaagcagaaatggatgaagtgatggataaagaaggtgcgcgaattttagataaaataaaggaccgcgagtacgtgtatgcactcgcaatcctaggtaaggagcggacttcagaagcgttcgcgaaggaaattgccgacctgacaacctatggtcattcggacatcacctttgttattggtggatcacttgggttatcgaaacacgttctcgatcgtgccgacacccagatttcctttggccggttcacattgccccaccagttgatgaggttggtgttgactgagcagatttaccgagcatttatgattaatgagggtagtccataccataagtgaccgtcaattaccgagtaaattaaaaccagctggtaaccctatttgggattgtcagctggctttcttcatggtttatgatggtatcagatttagagctgcaataacttttccgcattcccatgcgcaaacaattccttctcctcatccgttagaggactgctctcaatgaaactgccagaattttccggtttgatataaggatagtctatcgagtatagcagatgctcaatcccaacttcgtccttcacgaatttcaattgtggttcggtcaaaataccgcttggggtgacatacacgtggtcgcgataaatctttgaaatgggttcgctcaggttggtttccggatacatgacctgatccattcgctcaagggcaaacgaggcaaactcgccccagtgaccggagatcaatttcagattcgggtacttctcgaaaacaccacttagtaaaagcctgacggtctggatgccgacatcagtatgccaaccatagccggcagttcccaaaataccggaaaccttgtcatcccacggaccgttggagtaatagtagtcgataatctgtgaatctgggaatgatggatgcagatagactggcacattgaggttggctgcggcctcaaaaatgggtaggtagaatggatcatcaaagaatggatgagcctgagaagttggtctcactagcatggctcccttgaagccgagctcttcaacactgcgtttcagttctgccgcagcgtcagtgggatgggaaacagggagcgacgcaaaggcacggaagcgatcgggcgccgcagcaacagcttttgccagctcatcattcgccaactttgtcagttcaaccgcaaacttcggatctgaattttgcgggttctgattgccatatgacagaatttgcattgaaatctggtgttgatccatccattgaatccgactgccggtaacgtcttccaattctgcttctggaggcagtgagcgctgcatataatcgtgcatttccggactgacgtttccgattggtcgttttggtaagacctcggccattttctgacctaacttttgtgatgaaaaatgttcttctaatgtaataactttcatgtgatgtttgcctccttagctaagtagcttgccctttttcaaaaagcggttattcaagaaccagtaatgtttcgggtcccccagcaatgcagtataaggaaccggtgtgccgcctttttcaatgattttctcatccaggtacgctttgagaatccaaggttcctccaaccgggtggggttcaagtccaaaatatcttgaacatgttccggcgtggtatccagatcttgggccacttgttcgattgggacttctgccagtttgaagttggcgttaatttgcttcttggtgtcgatttcttgttgtggtgtgagtgacatgtgattactcctttagttgttggtaaatttgagtgagctggtcataaatcgcatccggtgcaagtaaagctgcatcgactttctcatcgaggacgtcgaacgcacccttgaccgccgtgacggtctcgttgccgtttggagtcagggtcagctgtttttcgcggtcattatccggattgaattttttctcgatcaagtttctggtttccagtccttttaataaattagaaacactggcagcgctgcgtcttaaaataattgtgatcgcccgttgatttgtccctgggtgatcgccaatgtaccgcagcgtgtgggcttgatcgacatttaaattgagttcgtgcaactgctgattaatcaaaccttcttccagcttggcaatttgatgaatgagcgatgatactgaatttcgatctttcaaaacatgacctcctcacttagatttatagtctaccaccaatagttgtaaatgcaactgttttaaccaaaactatgtattaaaaaatcccccctttgattgggaggaattcagattgtttgtttaattaaccgattgaattgatttcccagctaaaaagtccaaaatgttattggcacaaatctcagccattgaatcacgcgcctcaacggttgcgttgccgatatgcggcgtcaagatgacgttattcattgacttcagttcaggggtcacggttggttcgtgctcatagacatccaaagccgcaccggcgatctcatggttctctagtgccgatgccagagccgcttcgtcaacaattgggcctcgggctccgttaattaagaacgcggatgacttcatttgcttgaaggccttggcgtctagttggtgatgattttcttcggtcagtggtgcatgaatcgtgataaagtcactggtttgaagcagatcggtgaattcagcaaaccggatgtttaatcgattttcctcatctcgtggcaatctaaattgttctggctgccagtagtgaacgttcattgaaaaggcttgcgctttcttggcaacatcctggccaatgtggcccattccaatcactcctaatgtttttcccgccagttcatgccctagaaagaatagtggggaccatcccgaaaatccttggttgtgcatcaaacggtcgccctcgacaatccgatggctgatggctagaattaagccgagggtcacttctgcgactgaatttgttgaaacaaccggtgtgttggtcaccaagatgtggtgggtactagcggctttagtgtcgatattattgaaaccagcgccaaaattggcaattaattttaacttggttgcagcgctgatgattgattcgtcgaccttggtggataatgttgtaatcagaaaatcactatcttttacggcattctccaactcttcgtgagtgattaagccctgctcactgtcgtgaatggtaacggatagaccagcactttgtaatttcttaacagctttacttggaatttgatcagcgataaatacttttgtcatgattatcctcctcatatattaatctaactacatcatgtggctaggttgaacaacctgcaataccgcacttttttgtaactgatgaaaggagttggttcaaatgactgatagcgttagagaagcagtccaagaaaaattagcgaatggcattttcaactgtcccaaggaattaactttgtcgatgatcagtggcaaatggaaaattaacatcctgtatcatctcgggacagatggaccctattatttctatgagcttcaaaaattattgcctgcagcatcaagaaaagagattacggcaaagctcaaagaattagtcgaagatggtttggtcaatcgtaagccactgaagactgttccggtcaaggttcaatattcaattaccccgctgggaaaatcattgatgccgattattgacgccatgttgaaatggggccaacagcggctcgacgacttgcagttgggacaagttgaatttggcttgggtaaagtcaaacatgaataattgttaatttttcaaaatgcaaactccaaaatagacctgatcacgagcactcgttatactaatgattgcaattagtaaagcgtaatggtatacgcgaatattttggaggtgtcaattatgaacaataatagtcaaaagccagccaagccatggtataagaaatggtgggtttgggtattggttgtttttggattggtgattgcagtcaatgcagtttccggtgaagaagacgattcagccagtaaccagtcaattaccacagcgactcaggacagttcttccagtaatggcgatgggacgctcaaaagtaattacaatgtcggtgaagtggccaactataaggggtataaattcaagatcaataaagtgaccttctataatggcaatgaatttgatacgcccaaggatggtaatcggtatgtgatctgtaatgtaaccattaagaatgatactgatgagaagcagccatataattcatttgacttcaaattaaatgctaatgggaactccaccaacatgatggaagtcgtgacgaatgaaaaatatactaacaatacgttaaacagtggcgacctggatcccggcgcgagtgtgaccggtaacctgattggtcaggcaaaacaggatgccgacttgaagttggaatatcaaccgtcaatctgggatgataagaccgtcaaagttgatatcaacgaatcagcgtaagttatggggcatttcttttactccatttgctcaatcatatacaataatggtgtaagcgttttatgaataaaagggaggctttttcatgacagatcgtctaaagaataaggtcgcaattgtgaccggtgccggatcaggtatgggcgctgcaatggccaagttgtttactgctgagggcgccagcgttgtcgccgctgatttgaataaagatcgggttgacgaagtggttgcggcgatcgccaaagatggtggcaaagcagtctcaatcaagacagatgtttccaacgaagacgatattcaggcaatgtttaagttggcaaaaagtgaatttggtcaactcgatattgttgtcaataatgccggcatcatggataatatggcgccagttggcaatttgactgatgacatgtggaagaaagtctttgccgttaacactgacagcgtcatgtactcaactcgtgaagcaatcaaggaattcctgccgaagaagcagggagtcattttgaacattgcgtcagttggtggaacgaatggcggccgtgccggagttgcatacacggcctcaaaacacgcggttgttggtttaaccaagaatacggcttacatgtaccaaaatgacggcattcgagtcaatgcgattgcccccggtggcatcaagacaaatattgctgagtcaatgggcaagaatgttgataaatttggttatgagcgtcaatcccaagggatgggtgcatcacctgaacccggaactgcagccgaaatcgcaaacaccgctttgttcctggtttccgatgaggctcgttatgtaaatggtgctgtcttgccggtagatggcggttggactgcctactaaaattaaataagtttgaaccgtggaagtgattccgcggtttttgtttgccatgaagtgcactccagggtatagggtagaaacattatataaatagaaagaggctaccatgacaaaatcattgattatttatttttcactgtcaggcacaaccaaaaccgcagcggaaaccattcaaaaatatacgcattcagacatcatcagactggaacccaagacaccttacccagctggttacgacaagtattccaaagttggtatgcagcaaatgcgagacaaagcagatgttgccatccagactgaaatacccgatctacaccaatacgattatatttttattggttatccgacttgggatgggcaggtgccgcggatttttaatacgttgtttaaggaaaatgatttctcagacaatcgcttggtgccattttcgactagtgtgtcaacgccgtttgaggatacccttggttcgttgaaggcggccgttggggatggggttgcgattgttggtgggtttagatattctggggagacacaagtaagggattatttaaagaataataattttaaataggcttattttttgatactatgaagacattggttagcacactaacactttggaggtatcaaaatggctaaatttgaatcccgcattttgtcgattcctgattatgtacccgcagatatcattcgaattagaaaacttgtttcagctgataagaccaaaatggcattgttcatgaatgtctcattgcggacttacaaaaaatgggaaaccggtcaaagtcatccaagcaaacccgctcgccgtttactgcagatacttgagaagaatccccaattaattgataattggttttaaatcagcatttgatgaccatgtatagaagaataatagctgaaggagtcgcgaaaaaacgcggctctttttcatattctcacatcgccacgttgcatactgaatattcatgcataatatcaccatatattgacataaagtttaaaaggtttatgattgagtatattaaaattcaatgaggaaacggggaaacattatgagtatttctgttattaaacgatcgttattatcgcttggtattctagcaacaacagttttgctggcggcatgtggctccaagagctccgatcaagggtcgactaagctggcatcaaatcaaaagatcagcttatccacgacagctgaaattaccagcttggatttgtcaaaaatctacgataaaacgtcgtttattcaaattgatgaaacttttgaaggcttgtatcgttatgatgcaaacggaaatgtggaacctgcgctggcaaccaagacaaaaatttctaaagatggaaaaacatacacgattaacattcgtcacaatgccaagtggagtaatggcgatcccgtgaccgcaaaagattttgtctattcttggcaacgggcggtcaatcctaaaacggccagtcaatacacttacctctttgataatgtgaagaatgccgatgcaattgtgaatggtaaactttcaccaaataagttaggtgtgaaagcaaatggaaaatatcaactaaaagttcaacttgctcgtccaacgacctacttcaaaatggtaatggctcgtgagacgctttacccacttgatcaaaaagttgtcaaaaaatacggtaagaagtacggaacatccgctaaatataccgtgtacaacggcccattcaaaaacgttggctggactggaaccaatgattcctggaagctggttaaaaataatcagtattgggataaaaaagcagtcaagctttcccagatcaattacacagttgccaaatcgccaagcacagcatataacctatttcaatctggcaaacttgatttaatcagtcttgttggtgaacaagccaaacaacttgggaagagtaaagatgctgttaaacggccactagccgcaaccgagtatctgcaatacaaccaacgtaaaggcgtcttcaagaatcgcaacttacggttggctttctctttagctttgaatcgaagccaattaattaacaaagtgatgcaaaatggatcaattgtttcgaaaggatttgtgcccgccgatttcgccaagaaccctaaaaccggtgaggattttgccaaggaagcgtatgttcctggaacagttgatcatgatgcgactaaggcaaagcaatactacaaaaaggccttatcacaattgggtaagaagaatttaactatcaagctcttgtccgctgatgacgatcaaaccaaagatgtcattgagtttattcaaagtgaacttcaagaaacgttaccaggtctcaaggttgaatcaagcagtattccatttgcctcgatgcttgcaagagcttcagctggaaactttgaagttaactttacgggttggtctgctgattttgctgacccaatttcatttctttcccaatttacatcaaacaacccagaaaataatggcaagtggagcagccaagcatttgatcaagcgatcaaagattccaataacaaggatgcgaataacgccaccaagagatggcaagatttaatcaatgctgaaaagattttggccactgatcagggaattacgccgatttatcaagcgaatggaattgacctggttaaccctaagttgaagggggttgtctatgatcgaattaatggacattatgactacagaacagcttatttaaccaaataatttgaaaaaggggtaatatcttggataagaagtcagcactaaatttaattgaacatttatccaatgcaaatggaccaagtggctttgaggacgaagtaaaagattatgtcgttcaaacagcctccagctttagctcggttcacgcggatcacatgaacaacgtctatttgaaaaataatcaaaattcaccttccaaaggcaaaactttgatgctagattcacacttggatgccgtcggtttgattgttcaagccgtcaagccaaatggaaccattaaatttgttccgctcggtggttgggtaccggccaatttaactgcagaaaaaatgcgcatccgaaaccaagacggagaatggatcaccggtttggttgccaccaagccaccgcatttcatgacagaagcagaaaagaagaaaccaattgatattgccaacctagtgattgatgttggaacgaacagcgctgaagagaccaaagaggtcttgaagattgatacgggttgtcccattgcgcctgacactgagtgggagtacttcaaaactcaagatgtcatgatgggcaaggcgtttgataatcggattggtactgcatgcttgatgacggcaatgtctgacctggctgaggaaaacttggatgttaacttggtcggtgcgattgcatctcaagaagaagtcggttgtcggggcgcaaaagtgactgttaaaaaggttcatccagacattgcaatctgtcttgagggatgcccagccgatgacacgtttacaccagaatggctgatccaaaccgggttaaaacgtggtccaatgctgcgtgatatggatacatcctttattgctaatccgcattttcaacagttggctgtagatcaagcccaccagaacggtattccatttacccgcgctgttcggactggtggtggaattgatggctctgaattgcttgagttccaaggggcacccaccatttgtattgggattcctgttcgttatgaacatactaactatggatttgtggcatattctgacttcgaaaacaccgttaaattactgaaggcaattattttgagcctcaatgataaggtcattgacggtctataaatcaaggagctggtagatttggataaacaatatgtaattggattgcccgcagagactcgaatcattaataatcttgcaagaaataccgtcaacgatgacgaagtcgctggtgtcatcaaacacggtggagtcccggttctgattcccacccgcaatccagaaatcatggagcactacgttgacctgattgacggcttgctgctgccgggtgggccggatgttgcgccgaagttctatggtgaagagccggttcaaaacctcggcgacaccgatgccttcttggatgccagcgaaatcgcgttagtcaaattagcggttgccaaacgcaaaccaatttttgggatctgccggggcgtccaagtgctaaacgttgcccttggtggtaccctttaccaagatttgtacagccaacggaatcatccaaccctccagcattaccaaaaggcgccgatgccacaggggacgcataccatttccaccactccggattcctatttggccaaaattatcggccagggtgactcgactttggttaacagccaccaccatgaagccgttaaggcggttgctggccaactcaatatttctgcattggcaaaggatggcgtgattgagggcgttgaaagccaagatgacgacttgattattggtgttcaatggcatccagaagcgatgtttaggaccgatgagaagcaggacgcgttgtttgcggatttcatggcgcgagtggaaaaattcgcaaaccagaaagctgtacatgattcggtttccactgagaatgaataacaaactaaaggatctttgataggccagcgccaactggtttaccaaagatcctttgttattcatagtgttcagttgtcgaattgtacgttagcgtaaccggctgattattcaggttaaccgtgatttcccggtaaggttggaaaccatggtgaacaagttcgacgctgacctgaccgtggtcaacgttcacgagataatcgttgaattcgccgtgctgatacttgaagtccaggccgttatcctgatagtgatgatagctgccggaatccccatagacgttgaatgccattgtcgaatcaggggtttcagagatatgatcaacttcggctccccatggcaaaatggttccttgcttgataaacatcggcagcttatctaacggcgcatcaacgacaatgtcttgttggccgtcatattcccggtggttccaaaaatcaatccatttcccagccggaagataaaccagtcgtttggtctgcgatggttggacgatcggtgcgactaagattgcatcgccaaccagatactgatcgttgatgtttcggactcgtgggtcatcttcataattcaaaaccagtggccgcatgagtggcaggccgttcttagattctttggcaaataggtcgtatagataagggatgaatcggtagcgcagctttagaaatttacgataaattgataaggtgggttcaccaaaggcccatggttcctgggcacgggttcccattgcactgtggtttcgcagcaggggactgaagatggctgcctcaatccagcgggtcaaaagttccggcgtcgcgtctgaaccaaagccggcaatatcggtgccggcaaaagtgaacccactgattcccagattacacaattggggaatcaggagttgcaagtggggccaaatgctatgattgtcgccggtccagacagttgaatatttttgcgtacccgaataagcggcccgggtaatgacaaatggccgtctaccggttgcacgtttcaccccatcataggtcgccttggccatattgtggccgtagacgttatgcattttcttatgagtcgacggctggtcgtggtcgctgaaaacaatgtcttggggaatttctccttgaaatgaagcgggttcgttcatgtcgttccagatcccagcaacccccatgtcagtcagaaattgatcatttttgccccaccatttttgaacggctcggcggccaaaatccgggaagacggcatcccccggccaaacttggttgacgtagacattgcccgccggatctttgacgaaataatcattcttgatgccttgatcataaatgttgtagccgggatccttcttgacgccaggatcgataatggcaacaatttttgtgccggtggctttcaaatccgtcacaaacttctgagggttgccttgataagcctcgtcattccaagtgaacacccggtagccgcgcatataatcaatgtccaagtgaatcacgtcaaatggtaaatcgtatttgtgcatcgaatccacgatatcttggaccatcttctggctggcagagtagccccagcgtgattgttggtatcccaatgtccatttttgaggcaagggggttcggccggttaagtaggtataattggtaacgatatctttgagagttttaccgccaattaggtagtaattgaggttgccggcttcagctgagtagaaataatagttgggattttctttgccaaaatcaaaatgactccggtagggattgtcgaagaagaggccgtagggatgcccagctttgaggccgattatcactggaatcgatttgtataatctagtgaaattttctagatggggagctggattatcggtattccagtcatcatactcatagccccgtttgttcagataaccggtcttgtctccgagcccgtagatctgttcatcaggtgccaaatccttcacaacttgaaagtagtcgggattattttgatcgtcggcaccgggaacgttgtggccctcttcttggacgaactttttatgttcctcgtcaatcccccgatcaagcggagtccgactgccacggtagtcagtgaccagtggattgctgttggcatcataggcatcaatatgcatggccgcatcgaccttgatggtcaaggcagtggtcgtgatttcataatgatcaggttgttgcttaactgtgtatgtcgttgtggtttccttgtcgccttcaatcgcgtatgaggcaccatgatcaccgcgattttcggagacccgaatgatctctggggtgataatagtcaattgaatttgacgatttgaattgttaaatgtaatggtttgatgatctgtttgataggttggtaacttgggcaagtttgtcagtcctttcgtttagattatcgtagcatacgcggcctaagagatacaatactgttcgaaaagaccagcccgcctgatttggtgagctggtcttggttcttaatgatggtcgtcatcatgatcgtggaggccaatataataaccgtccatataaccggagtcgtagttgtcttcgtcacttcggacatagccgccgccaagcggagtgttccaatgatcaatgatccagacgacaaatataatgaaacccgcgagcattaccagagcagattttacttcttcgaaggtggaatcacgcaagccatatggtgcataataatttttttggatagatttattgaggacgtcaaccgtattcatcacgttggcggcagagacatccatgtaatccagctgcaagcccataaacaaattttgaaagtcataaatgttgtccataaaactttgggatgcaatcggcatcacgtgatacggaaggttcggatcaatgagaatgatattgacatctccttcaatcactatttcatcttgatcgtaggctgtttgagattgataatttaataattttttggcaaagtaatccccaaatggattggcggccatcgcaaatcgggaaactgttgggcccttttttctgatattgacgaggtatcgttcaaattttggatcctgcagctcggcgagggttttattcgttgaaataatccaaatttgctgaccctcgtattttttcatcaggtggcgattgatttgtttaatttggctgatctgcttctgatttaaaatgtgaagttcgtcagaaatgactggtcgagggttgccatccgctgagtttgcatctgctcggacggaggtgttgaacacgaaaatgagcaacagcacgacaggcaaaaggatcgaacgggtaagatagtgcaaccgcgggttcatgattatggtcctccttggattttatgctgagtatagcaccattatttttgtgggcggtcaaggtaactcttttcattttgttgtaataagtactagggttctttcatcttttgccataaaattgaaatgttgattcacgcgtttattcaaattggagggatccgtcatggaactgacaaccgcgaaaaattatttgttattaactgaaagaatcggtaagaagccaatgctgcgaacgcgatttactgcccaggcgtattttgttctggcagcgttatttgacttggtcgaccaaagaattttggacattggggagactatttcaatcaaagatgaccaagagtttgccgaactaccggattatctgagtattttcaaatcagaactgactgatgaaattaagcaagggcatgacctgcagacacaattggcaattatcaccagttgggatattgccaaccagctttatgagggccttggcgccggtctgctggcggatcagttggttgagaagaagtcggtcaagaataatttggacacccacgtcatctatctgccaaaggacgctgctcgaaagcaggttcaggattatctgcgcaatcagattaccggtgcgaaggtcagtcacgacgcagttaatttggtgctgatcctgtcggagttggatgctttgaaatgggtgtttaccgacaaagaggagttggctaacttgacggcggcctttcagcagaaggtcgccggggatgcgttttacatcaaagaaaaagccctggccaaagtagcccaggacgtgattactaagaagaagttttggtatgattcttggctgagttgaagaataatgatattgagtattttacgattaaacattttaagttgactatgatggatcatttcggatagaataacagtaagataacttgagaaggagtaacgctgggttcccgaacgggagtaggctttttagcttagaattcctatgcgcctggagttatctttttttaatctcactctttagtatactgataattctctgagggttgtcctttatttctttttcgattaggttgattgctttttgagagtaggtgtattgattattatttccaagaacatgcttatacgcatagtcaatatttgttttgatttcgtaaaactttatgaacaaatccaaatcacttttattaaaagctacacgaattccgtggctaatcgtaacctgaaaattgattttcttccttgatatccatttgtttatttgatttacaacttcactataactaaaaggatgggtattcttaggatcttgaagtttattaataatagctgctttagtttcgctatctttcgccacggaaacaataaaatctgcatttttcttgtttttggtaatataaatattatggttaataggaattccaaagtgagtgctttcagtatgaattgtttcctcatttaactccatctgatcccttaatatttgttccgctatgctggttggatactttttcttgatggctttggagtcaagcgagtcgatattaactgaaagtgatagaaaatgttggtcaagtcgttcagtaatatcaatatgaaaaaagtcgttaagcttatttacataattgatcacacacgcttggaataacggtgcatacatctgttcatattcttctgttacaaaatggattgaggtgttgcgaagtgacacaattttttcgagatttcttctcagtggttctcttttatcggtgaatacttttttgatacattccgatatagagtacgactgacttctcttggtcgctttagttgaataaaaaattgcctctaatgagtctgccgattttattaaataggacttaagaagaagttcccatgcattacagatataaaaactgaatccttccactctatatttgactgtaggacgattgtagagctctaaaccgagcgtaaatgcttcctgactcttctctagtagggttaaaaaagttttattgtcttttgcgttcaatttgtattcctcacactgtttattgattttttcagatttactattcaaattatacagtattctttccagcaattgccggtaaagttgattggtaaaagtagaatgtccttcttgtgtctgtaggcattcatgacccgaaacacagtactttcagtgcttatattgctagcaaagggttctataaaagagccagattcataatatgaagtgtaatatttctaaaatttaacttgaagtgcccagcgtatagtttgagactaattctcaaactatacgctgggcatttttctcaatggggatttgatgacccatcgttgttatcagactttttgattgtcaatattataaggctctaaataagtttatcttgatgaatcatttccactttactcgttccttaccaacatctgatcccttatcataattcccaacatcctccatattggctcgaaaatcaaagttgccaaattgaccattctcccaagggtcatgatttttgcttttttcgtagatcagttccttgctcgttttgtggaatgcgtattcgcaaatgattctcttctttttcaccatgttaagcattaagcacctcctagatattgtgagtattgagtatatttactttaactaatggtaaaattcattacttagttcttttcctgtcaattcgccgactatgttggtaaatttgataccgaatggacataaaatagatcatcacaagtccgccaactccccagattaggtagttgtggaatgcgataattaagacaatgagtatgacagcaccgatccatgtgctgatgacgtccaaaatttcttgcacgagtaatcccctagcccttgattagcttaattatagccgtttcttgggtgtttgttgaagtataggtatctcagaaatcatactcataaattcaagatgtttgacatgaagtatcaacactatacaactgacacctggcgatatgttagtcataacaggttgtatcatgctgggctattttatagatactaatataatcacttcatttgaattcaaaaacgacggaacccaatttgggattcgtcgttttgttcataatgatattgattaaaattctcgttttccatgcagataaacctgcttatcagtctgctgaaccgccagtacatcttccaacgggttttcagtcaggacttggaaatcggcaaatttaccttcttccaaggtgccatattcatcactaatgttacataaagctgcagaattgattgaggaacactgatatgcctcaaaagggggcattccaagtttggttgtcagcagttccatttccttgggtgtctgatcaaagccattgaagggtgtcccggcatcagtaccacatgtgatcttaacacccagtcgaaaagctcttgagatgttggcataagtatcatccaaagcatcagctgcttttttgacttcccatgcgggcaaagtgtgtttgccgaattctgggattgcccattcagcgatcaatgtgggggttagaaatgtcccttgattaatcatttggttggcttctcgttcggtgacgtaaaaaccgtgttcaatggaatccacgcctgcatctaaggcattttggataccagggtttccttcagcgtgagccgcaactctttgtcctttatggtgggcttcaagcaccgcagtccgcatttctgtgaccgagagttgaggatcagccatgaaatctcctggtgtcataacgccacctgtcgccattaatttgatcaattgggagccattcttgaggccagtgcgaacggccttacgaatctcatccgatgagtcgaccagataagttgagtggggatggtccccgtggccgccggtcattgaaaatgttcttcccgacggcatgatctcgggagtgtgttttagcattcccttgttccgcattctctttaacttaatgtcgatatcataactattgccgcaaccacggataaacgtcacgccggattttagaaatgtctgaaggttctggtatgcatcgacagcagtttctgtttccgagcggtttctgccaccatcaaaagtagccgggttactggtaatgtgggtatgcacgttgatgaatcctggcatgacatatttgtcgcataggtcaatcgaacggtctgcttttggaaaatcagcggttcctcgagcaataattttgccgctttgatcgtcagttatgaaccaggcattggattggatttgatcggttagaccgtcaaatagttgtaaatttttaaataaggtgcttgtcatttgcttgttgcctcctcaaagattagtggttaataacagttaaaattctcgttttccatgaagaaaaatctgtttgtcatcttgttggagggctttaacatcagccaatggatcggcgttgagtacttggaaatcagcatatttatccttttccaaagtgccgtattcatcttggatttggcagagtgttgctgcattgatcgaagaacattgataagcttcaaaaggagttatccctagcttttcagtcatcagctcaagctcttttggcgttgtatcgaacccgttgtatggggttccggcatcggttcccaaagtgaatttaacgcccaatttgaaggccttggataaattccgataggcatcttcgcaggcatcatcagcctttttgacttcccaatccggtaacttacccttgccgtattctggaatcgcccataaagcgataatggttggcgtcaggtactggccgtgatgaatcattttcttggcttcttcctcgttgatataaaagccatgttcaatggaatccacaccggcgtcaatggcgttttgaatcccgggatttccctcagcgtgggcagcaacaatttttcccttatggtgagcctcatcgataccagctttcatttcttccacagaaagttggggatcagccataaaatcaccgggggtcataaccccacctgttgccatcattttgatattttgagccccaatcttcaatccctgccgaaccgcttttctcatctcatctggagaatcaactcggtggccgaagtggggactatccccgtggccgccggtcattgaataggccatcccggatggcatcatctcaggtgttttcttgagcgatccttgttctcgaagccgattcaacttaatgtcaacatcgtagctggttccacattcgcggataaaggtgacgcctgatttcagcatggtctgcaggttttggtaggctgtgacggctgcctcggtttcagaatcacccgggttaccatcaaaggttcgtgggttgctggtaatgtgggtgtggacattgatcaatcctggcatgacgtatttaccatccagatcaattgagttgttgtcctttggggcgcttccagttccttgatcggtaattttcccggtttggtcatcaatcgtgaaccatgcatctgattgaatttgattatttttcccatcgaataaattaaaattaaaaaatgttgtcattaaaaatgcttcctttcagtatttttctacaaaatgtcattatttccagtaagcatacttgtactgggcttcatttaaaatcgagtaggtcagtccgccgaccttactgctgatcaatttgttttcggctggctgatacagcggaattgcgcctttgacactcatgaggtatttatctgcagctgctagtttgtcgtaacgcgcttgtccggtggcagcgttggcttcattgagcatgttgtcataggtcttgttgctccagttggtaaagttaactgaattgccggtctgtagtaagtctaaaaagtcataagcatcaagccagttggtggaccacccggtcaaattgagttggaacttgccgttgaaatctcgatcaacgtgttgggcatgtggcaacgatgttaatgtaattttcagccctttgaagttcttttctgccgctgcttgaatatattggccaacgtgtttgtcttcatcaagatcgtccgtcagtaagttcaacgtgattgatttcttaccggtttctttcagatacttattccagtaggccttggcttttgctttgtctgtcggtagtaaattaccaattgaggtagccatatctttgccggtcgccggatctttttgatcgccaattggaatcatgctcttagcaggcgccgaaccgtcttggagaacatcatctgtaatggtctgattgtcgatgatgtatgaaaatgcctgccgaagattttctgaattggttggtttgtatttattgttgaagtacaaataattcatacgtccagtcagatgtttatgaagatttggattcttggcatttgctttaacatactggccactaacattggtctcttgaatttttccactttgaaataaattgatggctgtattttgatctttggtaaccgtgacgttgattctgttaatcttgacattcttggcgtcccaataatgcggattcttgacataatgccaagatgagttgctgccagtccaaccagtgagtttgtaaggtccattggccattgtttttgaagcgttggttccgtattcttggccatatttcttaacggtcgctgtgtttagtggatagaactttgaggcaactaaatcattgaaccacggcacccgcttcgtgagttgaatctggagtttgtgtttaccgatggcttttgcacccagcttatcggctgacatcttgcctgcttgaattgctgcatagttcttaaaagcgtcgtacagactggcgtattgggcctttgtcttaggatcgacggttcttctaaacgagttaacaaagtcttgggcggtcactgtttgaccatttgcccacttggcgttctttttgagattaaatgtgtaggtggttccattattggttggcttgacaattttggttgccactcctggggtcagtttgtttgccttgttgtacgtataaaggccttcataggtttggaaaatcaattgagcactattggtatcggttgatttattaggatcagcagtcagcggttcgtcaggcaacgtaacgtttaatggcttgttgctcttactcgctgcctgcttattcccacaagctgccaatgatataccggcaattagaattgccccaaaagaaattaatttgtgtttcatagaatccctccaaaatttgttggattagaaatggtgaacgaaaaagcgccccttcagaaattaatctgaaagggcgctttcgcacggtaccaccttagttcgctattaaatagcctcaagtgagcggctggttctcttggaatcagcgattcactgcacgaataacgggtgcatccggtaattgcctactaaacttcagcccacagctcaaaagctacttcccagcgaaatcttctgacctgttttcacttaccaggctcactgcacagaaaattaaagtggtactctctttatcattgccattatattctaatcaatatttaatgtttctaacattaacatgtgaggtgattttagtcaaacataattttcaaaaaggtggtcagatatgctgatgccatggcttgtgcaagtttactttcttgtttttaatatttttaaatgagactttatatgagggaattagattgttgaacatcgttttcgtaagccgacatcagcagcaccagtgaatgccgtcgaccattgacgggatgtcccttgctcagcttgaattcccgaattaccaagcctatttcgttgcatttcacaagcaacctgccataattaaagtgtattcgatgtaaccgtttccattagcataagggggatattatcatggcaatcaaaaaggttactgttgctggtagtggggtcttaggcagtcagattgcgtttcaaagtgcttttaaagggtttgacgtgactgtttatgatattagtcaagaagctgttgataaagctgaggaacgaattaaaggtctgcgccacgcttatcggcacgatattgcggcgaccgatgaagaatttaatgccgggattagtcgattgaaatttacggatgatttagcggcggcagttaaagatgctgatctggtcatcgaagcgattccggaaaatcctgacatcaagcatgaattctatcaaaaattgagcaagttggcaccaagcaatgcgattttcactagtaactcatctacgctggtaccaagcatgtttgccgctgataccggtcggccaaagcagtttttgaacatgcatttttccaaccaggtttggctgaacaacaccgctgaaattatgggatcaccggaaactgatccggcaatctatcaagaaatcgttcagtacgcccgagacattgggatggtaccgattcagctgaaaaaagagcagcccggctacattctgaactcactgttaatgccgttgaacgcggcagcgggggcattgtggctgaaagggatcgctgatccaaagatgattgatcgaacctggatggccgcaaccggcgcaccatggggaccatttggcatcctggacgcggttgggattcgaactgcctacaacatcactttggcagcctccaaaaaggatccagctgtgatgccgcttgctgatgctttcaagaagatgctggatgaaggcaagcttggcgttgagtcaggcgaaggcttctacaagtatcctgatcctgagtataagaccaaggaattccttgaaggttagccttttgttgaatgaacaacaggtctaaatcgttgattaaccagcgatctagacctgttttttgattgccgacaatttttgaaaaaataagtgcagttagttgtaaacgtttacaaacgtgctaaactttgggcgttgagataacttgttggttctactttagaaaggatcgattacaatgaccaaagtgttagcagttctgtatccagatccagtggatggtttcccaccaaaatatgtgcgggatgacattccaaagattacccactatccagatggctcgacggttccgacacctgaggggattgacttcaagccgggtgagttattgggcagtgtgtctggtggcttgggactgaagaaatatttggaatctaaaggtgttgaatttgtggtcacttcagacaaggaaggccccgattcagtatttgaaaaggagcttccaaccgctgacgttgtgatttcccaaccattctggccagcttatctgacggctgatttaattgataaagccaagaacttaaaattagcgatcactgccgggattggttcagatcacgttgatttgaacgctgccaatgagcacaatattaccgttgccgaagtcacttatagcaacagtgtcagtgtggctgaagctgaagtcatgcagttattggcattagttcgaaacttcattccggctcacgacattgttaaagccggtggctggaacatcgctgacgccgtttcacgggcctatgatttggaaggcatgaccgtcggcgtgattggcgctggtcgaattggccgggccgtactggaacgattaaaaccatttggggttaaattagtctacaaccagcgtcatcaattacctgatgaagttgaaaatgagctgggactgacctattttcctgacgttcatgaaatggtcaaagtcgttgatgccgttgtcttagctgcaccactgcacgctcagacctaccacctgtttaacgacgaggtactcgctactatgaaacgtggggcttacatcgttaacaacagtcgtggtgaagaagttgatcgagacgcgattgtgcgggccctgaattctggtcaaattggcggctactctggggatgtttggtacccacagccggcaccaaaggatcacccatggcggactatgccgaacgaagccatgaccccacatatgtccggaacaactttgtctgcccaagcacgatacgcagccggcgctcgggaaattctcgaagacttcttagaggacaaaccgatccgtcctgaatacctgattgcccaaggcggtagtttagctggaacgggtgctaagtcttacactgttaagaaaggtgaggagacgcccggcagcggggaagctgagaagtaggcttgctcatataatgctcaagtaaaataaaaaggttctgcaatatctgtcgttaatagatgtttatctattgctggtggcaggtgttgtagagcctttttgcttgtggtgagcaattagagattgattgttaaccttctgcttcatggatatcatcttggatattgtccagcgaaaagtcatggtccatataatcacgattatcgactggcaggtgttgctccaacgtatcgaacaactggtaagccacgtgacccttatccaggtggaagtccagcagatgaccgccaaatgttttgtcagcggataagaaatggttgtggaatccagcaactgcagcgccgtcaaataaggttggcgaatagtagctgatcagcgtcccttcaacttgatcacgagtaaagatactttggttcttagccgtttgagccaatgtttgaaatggcggcgttgatttcttgactgcccgggtcttgacggctgagaaacttccagtgatcttgatcgagaagaacgtgttgctggcctgggtgagtgagatgagctgttcttccaaatcagcttgagaaagattttccaattccgccaaaggtgagtagttggcgaaatggctgttcgcaaatggcatgttgaaggcatccgagaccacattcacgttgccgtcactatccacttggtagggcgtcccgtctaaaatgatcaattcaccgtcaaggccttcgccggtgccaatcccagtgtcaccatgttgcagtaagtcacccattgtcagggtgcctgctagcaagccggggaccagtaatgccaaagtgccgtgctgatacaaagttgttaattttgtcatcattatcctcctttagtttaagatgtctggtaatagagctgatttgagttcaatgttgtcactgtagtcaactggaatgtcgatgataaccggtccatcagcctgctgtgcctgatcaagggcattggccaattcctcggagttggtagcccgcaatcccttggcaccaaagctttcagcgtatttcacgtaatcaaccggcccgaatttcacgccggcattcttaccatacttggcttcttcttggaatttcaccatgtcatagtaaccgtcattccaaatgagctgaacgatgtttaacttcagtcggactgcggtctcaagttcctgaccggagaacaggaagccgccatcaccggaaacggagatgactttttcggctggtcgcaccaatttggccgcaatggcccacggcagtgacacacccagagtctgcataccgttgctgaacagtaaatgacgcgggcgataaattcggaagtgacgcgccatccaaatataatgactgccgatatccaccgtcaccgtggtctcgtcgtcgactttttcctgcagcgtattgacgatgtccagcggatgcatggtaccgggcttggcagtcgttgcagtggtgctttgaccatcaaattctgatcgcagtttggcgagttgatcgactgccgtttttggaaggtgatagcttgctggcagagcatcggttagggctgacagggtgcccgcaatgtctgattcgatcaccatatctggttggtagtcgacggtcaactctggggccaccgtatcaatgttgataatttggtcgttgtgttctacgttccagttgcgggcctcgtattccaccggatcataaccgattgcgataaccaaatcactttgcttaagcagggtgtcgccaatttgatttctgaacaggccaacccggccaaagtaatccgcttcaaattcgtgagaaatggcgccggcaccttggtaggtttcaactactggtagcgaaacttttgccagcagttggtgcaaggcctctgtgacggctggagaagacgcccgcatgccggccagaatgactgggagtttggcctttttgagtaaatcgataatctggttgagggttttggcggatgtctgagtttgctcgggttctttcaattgttgcatttccagccgggtgacttcgccgcttaacacgtctgctggcagggaaagaaaggaagccccgggcttgcctgaaatggctgtgctgtaggcgttggtgaaggcttcagaaaggttgttggaatcttggacttcaacgctgcttttggaagcgacgctcatcaattctttgctggggatgctttggtgggtgtaacgggcaaggtcgtcgcgggggacctgtccgcccaaagcaaccaccggatcaccttcagcggttgccgtcattaaggctgtcaccaagttggaaaccccggggccggaagtggtggcaaccactcccggtttacctgtcaaacggccgatgccagccgcaatgaaggcggcgttttgttcgtgacgtgtgacgatcaattttggtgcgttgggctggtcgctgtactggagatcttcgaataactgatcgactttggcaccggggatgccgaatacatattgaacctgttgattaatcatggattgaattaaagcttgtgaaccacgttttttatttgccataaggaggacacctcttcatttttatgttgacaattcaacttacatttaaagataaagggcatgtgttgaattgtcaacaagaaaatgataatcttacggtaggatttgacgattggaaaggaaaataattttgaaagatattggctaccttgcacaggatatttcaattttgcaccggcagtattacaaggataccggtaagttgtttaaggagcagcagctgaacccaacggctgcctgtattttactgacgattaatgacaatgccgagattaatcagaaccaggtggccaagtcgttagtgatcgataaaggcctggcgacgcgagagattaaaaagatgcaggccctgggttatttgacgaaaacggccgggagcggcaaatcaattatcttgagtctaacggctgccggccagcaggtgattcccaccattcaggcaatccggaaaaactggtgggaggaacggttcgcagacactgggattcagcccgatagcccgttggtgagtgcgattgagaaggttgttgactcgattgtggatgagagtttggagtaggattgtagcaccaaaaaatggttcattggaaaggtttgaggagatcctcagtagcctttgcaatgaaccattattatgatgaaccgttaatcaatgattgaatttcgaattttgagctcactttcaacaagcactgttttttctacaatcggttggtcggagatgaggtcaatcaatagttcagcagatttttgtcccattttctttggattctgctgaatggtggtgatctccggctgcattaattgcgcccaatcccaatcatcaaatgctgttacaccaatatcttttgggattagaatatggaattttgataacaactttatgacacgcattagaacagttcctttgagggcatagacaaccgctttggtcttcaaggaatcagtttttctcatgatctgattataaatcaaatcatcagaggtattttcagttatttcgatactgtctacgatgacatcggtgcccttggcggcctcttgaacggcgtggtaacgatccatccgcacttcattatcagctagcggttcactgatggtgacaattcgtttatatcccatacgaattatcaagtccgacaatgcctttgaatagccatagttgtcggtagttacttctggccagatttgcggcgttgtttttcgatcaacaataaccgttggtgtatcggtatctttaataaattggtaactggcactgttattatgaatcggttgcaggataatgccatcgacttgaagatccaaaagccgttggagctgatcatgttcccgatcaccagagttgtccgagttcatcaataatatttgatagccatgctgctcgaagattttatcggctcccttaaataaaatcgaggagaaaatattttcaatatcagcgacgaccattccaattaaatgcgtggtttggttctttaatgactgtgcttgacgattgatgtgatagccagtgtcattgattacatgctgaactttaacccgagtttcatcagacattttttcaaagtgaccgttcaagtatcgcgagacggttgcagtggaaactccagccatttttgctatttcactgattgttaaacgctttttcacattaatcacctcacacttccgtcacttaattgtacctgataatttgatgttagggaatagttcatggatcttggatcactggttatcttgggtacagatgatacagacaggttctgcaacattgtgattgactgatagaagtgtcaaatttccgtgcttggggttccgttgaaagatggcgagtgagtcactcttttgattacccacaattacatatttttctgactgatcaagacagaactcacgagggaagttgccttcactggagatgttttgaatcatctccaattgataattagtttcatcaacaccaaagacagacactgaattatgtccacgatttgatacgtacaggtccttttcatctttagaaaggtacattgccccacaaccgttttctccaacccagttatcaggcaacgtcgaaatagactgtatctgatcgaaggtaccggtcttcggatggtatttcaagagaattacctggtttgccaactcacccagtacataggcatatacgccattcctggtaaacgtaatcttttttggtccaaatcccggccgggtatgaaacgttgtggctttttgaaggacatgaccatcagatgaaaggtcaaaagtcaagatttcgtcggtacctaaatcaatcacacagagacgacgcccgtccggcgttatctgtgcatagtgcagatgcgaggtgttttgttgaggtaggaccccgtggcctaagttatgaatttcatcgaccaggctcagatccccgttgctcatgattttaaaaatctggacgaaaccgttattataattgctggcgaaaacaagttttcgcttttcatcgattgtaatgttgacgggagatgaagcattaaataagtgatcagcgagcttgttgaactgaccaccggaaagatcataggcggaaacaccacccttatcgccatcttggttaacggcgtagattacattggtatctgaaagtgccaaatatgtcggggccccaatttctgtagataaatgaactgtccctattttgccagaatctgtatcaaattcagcttggtaaataccctttgaaattcgtgatgaataagtgccaaaaattaattcttctttcaaaatcagttcctcctaagcaaaatgtatcctacttaaacataatggcagccaacaataaattcagaacgctggtaatccagccaaacggaacgccggtcatcaaaaactgcttaacatctagtttctcgtgttcgacaacccataaattccatgattgggtgatgcatgttgagatggcaatagatacgccaggtattaagatggcagcaaaggcaaaatattggttgaagaatccggtggcagcaaggactgcggcggtggccgaaccagcgccccacaccatcaatgggccacggaacaaagccagtggggctaagattccaaaagcaattgccagcacgatgggactgtggggaacaatgctttgcaggatatcgctgaatctgccggtaacctttaccgctgcggcgctgaacatggttaagaatagtaacataataattaatcccgaaatatctgaaatagcctgggaaatagttttgttgatcagctccattgctgatttgtaggttttgagttttccggtaatcaacaggaccaaaaagattgacagcattaatgcagggattggttcccattgaaaggccaagttcataaataccggcataattggcaggatataggcaatttttggtacgttggaaattgcttttttgctgtcatcagcagagacctctttggtgtcatttttgtgaattgattttgcatggatcaagatgaaaataatgacaattactaattgtacagacatcgcactgaaaccataaataaggtatttggcgccgtaaacaaccttagggaagaacaactgtaattgcttgatgataacgatgttgacgtacattggggcgccgatagacatgacaaacgccgtaattgcgacgttctttgatagtcctaatgaccgcaggattggtaggagaatcacctcaatagcgataactgctccgacaccgtaggaactggtaaaaatgaaagcagtaacaaggcaaatcagaattgtcgcgatgattggtcgtttgtagctgactttgacggtctgttcactaatggcactggcaattcctgtatccaccagcacccgtccaaaccaggacccaaaaataatgaccataatggtcgatccatagttaagagcaggctgtgagaaaacgttggtaattgcgtctttataagagataccaccaatgactgtccaaaggattgccatcattaggaatccaatcatgatgtttccgcccttcatgacaaaagcaatgaaaccaacaaatgtcagtaaaagaagaacaccgataataatatttatcattttgatccacactccacacatttatttgtctaggtaaacgattaactgaaatcgattacatattaacccgtaacattgtgaattgtcaaacaaaattttaaattctcgacccctcctttaatgctggttctaaataaatgctataaataaagggattcaaatatattttagttagggttgacttttataattacgtagattagtatgatgttgtcaaagggtaatcgattacatgaaacctacaaacggaggtccaatttgatgaattctaacagattagtattaaacaccttggttgcgcaggcagctcatgatgcgggttcaaatcaggagcagctggtggaagacttgttgagcagcgggattaataatattgagttgagaagagagtatgggaatgccactattaatgagcttgatcaattgtccgaattaggaaaacgtgatcgactgacctacttttattcagttccggataacttatttgttaatcagcagctcaatgtaaagttattgcaatatgttgctgaagcgcagcgcttaggagcgggatatatcaaaatgacattgggagactacaatgacgcaaagcctgattgtattgatgaattgttaactgttattccaaccagtattcagctaaatattgagaatgatcagaccaccagcaacagtgatactggcaagctggtattattcttcaaacaatttgaccggcgtgatcgaaaggtcggatttgttaacgacttgggtaattggatttttacgaaccaggatgctttgactgccacaaatactctattgccatatacccgattcattcacttgaaaggttttgtgttgaatcaggatggaaatcctgagacggtgtcgtttgtccaaggaaaattagattggtgggaaattctcaggatctttccaactgatttaccaattgctcttgaatatccggcagacgcagacatgttgaacagtgatatttcaaagttacttaataactaaggttaatgaaagagggtataaaaatgggtaaagaagttgcattcaatacagataagtttcgtctcgacggcaaggttgccattattaccggtggtgcatcgggattggggtacaactataccaaggcaatgttgatctctggggcaaagattgtgattgccagctatgacgaaaggggctgggaagaaacaactgaattcgccaagagtgttaatggtgaagttaagttcatcaaagttgatgtgactgcggatggagcccctgtaaagattgtcagtgaggcactttcggactttggccaaattgacattcttgtcaataatgctggcatgcagcgccgcgagaattggaaagacttcaaagattcagattggaacgcggtcatcaatctgaatctgaatgctttgtatttcttatcccacgcggttgctaaagttatggcaaatcaaggttctgggaagattatcaacatcggttcgatgcagtcgtttagagctggaaagtttattttcccatacactgccagtaagcatggggtcgttggtttgaccaaggcatatgctgacgcattggctcctgataatattcaggttaatgcgattgcgccgggatacattgacaccccaatgactaaggcccttcaagaagataaaagtcgaaacaccgaaattttggctcatattccggctggacactgggcggatccatctgaactaatgggaaccgttgtctttttggctagtgcggcatccaattatattactggcgttacgatcccggttgacggtggatatttactgagataaatataaggagaatagattatgggaaaaaatgttgcaataccacaaggcttatcgcaagctgggaaagactatttgatcaaccatggaatggatcttgttgagttgccggataccaaagcagaaacaatcatctcacaagcaccaaatgtcgacggaatcgtgctgatgactgaaccatttccgaatgaaactattaagcaaatgcctaatctgaaagtcattgcccgccatggggtcggctttgataatgttgatcccaacgacatgggagaaaacaatgtctgggtcacgattacacccaacgctaatgcagccacagttgccgagacaaccttggcagagattctggacatctcaaagaacttaacggcgatttctgatagtatgcgaaaaggtgtttttggttataagtcatcccacatggggtttgacctggcagggaaaacactcggaattatgggttatggccggattgggaaaatggttgccaaaaaagtcagatcattggacatggatattttaatctatgatccgttcgtcaaattcgctgaatacggtaagatcgtcgacaaagggacattgattgccaactcggatgtcatcacgctccatatggctgttactccagaaaatgagcaggggattgatagggatgccttcaggaaaatgaagaaatctgcggttctgattaacttgggccgtgggcaattggtgaaccaaaacgatttgttagaagccttgaaaacccatgaaattcgtggtgcggcattggatgtgttcaacgaagaaccacttcccctgacaagtgaattttacaagttggataacgttcttttaactccccatattgcctccaatacaacagagtgtatggcaagaatggccgttgattccgcaagtgaagttgttcgagtactttctggtgaacagccaaagtggccggttaattcagttgagtgatagtccttgataatagccgtggaaattaattgaagttaatagatgatctgaaatggaggaagcgatagttataatgaaaaatagtctgattccccaaatcaccttaaatgatggatacacaatggatgcaatccaatttggcactttcaaaatacgtggtggtgagggtctgcaggagacacttgctgctattaaggatggctatcgcagtttggatactgccacaaattatgataatgaaaggatggtcggtgaagcaattcgtcattcgggcattccccgggccgatttcttcataacttcaaagttacccggaaaatatcatcaatatgatgaagcaaccaaagcaatccaagaatcactgtatcgtctcggactcgattatctgggtttgtatttaattcattggccgctgccaaagcgtgatcactatgtagaagcttttcaagcgatgattgatgctcagaagcgtggcttaattcgttcaatcggcgtttcgaatttcgagccggagcatctggaccgtttggttaacgaaacggggattaccccagctgttaaccaaatcgaggtgcacccttactggaacaatgcgcggatgctgaaagctgaccaggaacgggggattgtcacagaagcatggagcccattgggacgaggaagcgcagctttgcaagaaccaattatccaggacctggcaaagaagtatggtaaaaatagcggtcaaatcattctgaagtggcacactcaaaggggcattatcccagtcccacggtcaagtaatttgattcatcagcacgccaacaaggatctctttgattttgagttaacagaggaagaagttaaggcaatcaatggattaaccaaggcagctggccgtgttgacgggcaggatcctaatgtatatgaagagtttgattagtgattggaactaataccgtttagggtgggaaatgtctccaccataccttggaaagtatctggattattcagtagcttgaattacaaatacaatttgtaaatgcaggagtgatttcaatggagaaggacgttagaacgcacattgatccggaaaagtttgcctatcaagcgctgacgacaattcattttcatgaaacggatgattacgaacggcaaaacaaggagcgattagctgtttttctgatgctaaaatatttggctgatgactttaatgatttggaaagcaaggcctttgatatcagcagtaacaacgacgaacagttgtcgaagctgggatttgacgacttgctgtcacggatcaatcagttgaataagtattgatggatgggcacaaattaataacgggttaatttggatgtaggctgattcctgagacaattgtctttattaattagcgttgtacttgacttgacaatttaagttaaaataaatcaaatcacgcctactgagaagaatagcatttctcagtaggcgtgatttttaatccatataaggacactatttatctttgtcaacggcagtttaaaaatgtaggtttgggggtgacgtttacacccctcttctatattttacgggtgccgtcttaattgtattagtgtttttttacggctattgtggttagcaactgcttaacagcagccttatgattgctcgggttataaagaatatcagaagaatacgttgtatctacatccatatcttcaattggcaagtattgaatcatgggatttacaatttgctcacgtttcataaatggacttggataaaatccaattccaaaattgaaggcaaccagcatgtctcgttgctccagtgtattaactcgtctaattttttcactatcaattttatttggaaacttttctaggaagatagttttaagatatgaggattcaaccggactataatataaaatttccatgttagaaatctggttaaacttgattgctgtctgtctacttagcgggttggatttactgataccaaatactagtttcccactggcgatgctttttgaatgtaaattagagttttctaaaaagagtgttttaccgtagtttggtgtgactgctagatctagtgtcccatcactgatgtgtgtcgctagtcgttggccattttcctctttaaaggcaaatctaacttgaggatgatcttttacaaatggcaaaaacagattttgcagaatcatcccttgattagtagaagaatagccaatctttaacgtacggttacgtttgcttttttctaattggatcttagtaattccactgttgtagctgtttacaatatcttgagcagttactaggaactctttaccagcacttgttagttcagaattgttagttcccgactaaataatttaatgcctatttctgcttcaatttgattgatttgcttagaaactgcccgtggtgataaatataatttgtccgcagcggctttgaaacttccgtattcaactactttaagaaatgttgttaatttagcaatttccattcatttctcccccagtaaaagaacagttggttcatctcatgtccatttggtcactgttcataagtgtatgttatcgatacaatgtattcgaaaacgttttcgtaatacacatcgatgtattctcacttgctcactgtttaatatgtaatcagcgtttaagcactaatttatatacactggttactttagcacagcttatgacttgttgatagatcaacataaaaaaaggtttaatactgcaattaaaccaagtgcctgataccatccaacttttaagcgctcaactgtgtgaggttggaatagtatatttttttaatgctgattgctcaacaaaacacattcaaataatggaggtacattaaattgggcacttcatatgttgcttttatcggatttgtgatgatgtttatcatcatttatttgctactaaagcaaaaagtaagcaccatgtttgccttttcagttattccaattgttagtgcgttcttagttggtatgacacccactaaccttggtaatgccttggaaaagggattgggaatgacaacacctgtttcacttatcatgttgttctcactgccatatttcatgatgatggctgatacaggtttgttcaacgaactggttagaaagattgtccgtcatgtcaagataacaccacctgtactgacttgtttaacgattgttgttgcaatgattgtcgggatggatgtaagcatcacctcaatatacatcattgcaattccattgttattgccattctatcgaaaattacacatgagcccaatgctgttgatgtttctgacaactttgggagttatcaatacattcgatgttccttggagcgctagaatgttgcgggcagcctcactggtaccaaacgtaaagggtggttcaattgcgttattttcaaagatgctgcctacacagatagttttcacaattgttctgtttgcattagcaatagttcttggcattcgtattcaacataaaaataagaataacggcgagatcaatgacgatgagttggaagatacctcacaatcaacagatagtattcaggatgaccctgaattggctcgtcccaagatgttttggattaatattatctttaccattttcttggttgtttgcttagttatgttcccaacaattccatcgtattacatttttgcgttcggtttagttgttgcgtttgcttacaattacccagacttaaaaatgcagagtaagctattgaagaagtattcccgctcgttgatgcccgttatgccaactatcttactttcaggagttgttgtgggggtaatggaatatagcggcatgatgaaagcaatggtcaatatcttgttgaagattattccatctcaattgggaccgtggctctacattattattgcgttagtcggcgtacctctgatgttcctgtttaccaacgatacttggtactatgtaatgctgccaattgtcatttcaatcatgaaagcatacaacattccaggtgaaatcgttgttgtaacactgtttatgaacatgggagctatgttaacacctattgctcaaccgcagatttacattggtgccaatatgactggtgatgtgattacgattccgcagttcatcaagaagagtttcttgccaatttggggattgagtattgtttggaccctcattggattaatgatgggtgcatttagataaaacctaaaatatgtcttgcgtaagtaactagaagtttaaaaaggagagtattaaaatgagtattccaaaaattgttaaaatggatgtttatccggtggctggctatgacagtatgttattaaacttaagtggggcacacggcccatatttcacacgaaatatcgttgtcttaactactgatgaggatcaagtaggtgttggtgaggtgcctggtggtcaggcaatcacgagtactctagagaaatctaaagaacttatcgttggcaaaagtattggagagtacaaacaaatcctccaaaatatgcggaaaaaattcagctaccttgatgcaggcggccgtggacaacaaacttttgacctacggacgactattcatgcagttactgcgattgagactgcttttcttgatttgttaggcaagcatttccatgtacccgttgctgaattacttggtgatggtcaacaaagggaaaatgttggtgttcttggatacctgtttttcgtgggcgattcaagcaagactgaccttccatatcttaaaaacgatgataactctgatgattggggtaaaattcgtcgtggaccaatcatggatgccgcttcattagttaaatcggctaaagcggcttataaacgttatggatttaagacatttaaacttaagggtggagtttttgatggtgaaactgaagttcaatgcatgaaagctctgcataaagcttttccagaagctaagcttgatcttgatccaaatggtggttggtcccttaaagaagcacttaaatatgcggatgaattaaaggatgttcttcattacatcgaagacccagcaggggctgaagacggattttcaggtcgagaaatcttatctgaattccagaaaaaaactcatatgccaacggctactaacatggtcgataccgactggcggcaaatgtcccatgcgattgcattgaatgcggtatcaattccattggcggatccacatttctggactatggaaggctctgtgagagttgcccaattgtgtgacgaatttggcttaaattggggtatccattcaaataaccactttgatatttcacttgcaatggctgtaaatgctgctgccgccgctcctggttctgtatacgacattgatactcactggatttggcaagatggtcaaaacttaactaagaatccttatcaaattaaagatggccaagttaaggtaccatcttcaaatgaaggtcttggcgttgatattgatttagatgcaatcaaaaaagctaaccaactctatgtagaaaagcatcttggagcccgtgacgattctaaaggaatgcaatatctgattccgggatggaaatttgatcctaaacgtccagcattggtgcgataagataacatgtttttataataacgcgttgtgctagttatgaaatattggttagtaatggccaagttttaacccgcttttgccagcggcgagttgttcatgaactcgaatcgtgtgccacagtaacagcgcttctaagcggctttccaaaccggacatggttcgaattcccgggtgttcaaagtggcccactgtatctaaattattaaaattggtttcaatatgccgacgttgatttttcaaaaatccggtatcgaccgttgtctgggcagccatattcttgcgcaacggcgtccaaagatgaatgctaaaggtggtggccaaccgatcttttaatggttggcttaaatagccgccatcggctaagacccgtcgcgcgggcgcggttaataagagttcttccgcggcttttcgatcatcaagggccgccggcgtcagttcccaggccagaaagtagccttgattggccatcacggcatgtaacttaaaaccataataataggtctgtttagtggcattatagcctttgttggcgaagccgtttaaaaccttggcctgattacttcgacgagcagaggccaaagtaatcggcgcactatcgatgatttcataggtaacgggtgggacccactgtttcaataaagtgacccgcatgaacttcataattaatgctagatctcgacaacgccggttataccgggagcgttcagggaccgtaatcccccagctaaccaatttttgatgaaagtaggtttcggacccgtcccgttcttcgatccgcattaacatgcaggccaggataatgacatcatcggctttcagttggcggtaatttggccgaaaacgaatagccggattaatggtttcataaattggttcaataatttcgataaaatgttgaaatttagcttgaattggattggtttttacgataactttgaggaggcctcgcataacagttccttctttctggttttgtcacctaagaagttaccgcatatgcggggcttttggttgcttaaagctcaaaaaactaattcaattgttacaaatgtgacacaactagcacaacgcgttataatacgatttcactaagaaagtaggctgaaataggtatgataagtccaaggattacgtcattagaggtagtgccagttgctggtcatgatagtatgctactcactctgagtggggcccatgcgccattattcacacgaaatatcattattcttcatgatgatgctggtcatgaaggaattggtgaaattcatggtggggatgcaattagtaagatgcttgagagttatcaggacattgttgtggggcaagcacttgttaactaccgaaagatcttaatggatgtaagagaaaacgggtggcgccctaacaacaactccggtcaaggattacaacagttggatctaaagaacctgaagtttgttgtgcatgctgaggccgctttagaatgtgctttgctggatctttacggaaagtttgtaaacctaccaatgtgtgacattattggtcaagggcgacaaagagattctgtggagatgctcggctacttattttacatcgccgactctgcaaaaacgcatttgccatatgtacaaaatgatgatgactcagacgactgggggaaactccgacgtaaaccggctgtgacaccggatgctgttgtgcgagaagcaaaagcagctcagaaacgttatgggttccactcctttaagcttaaaggcggtgtattggatggcgaaactgagatggcaacggttgatgcattacacgacgcctttcctaattgtcgaattaacattgatcctaatggtgcatggtcgttggatgaggcgattaaactgacaaatgatcaccgggattccttaacctacattgaagatcctacgggaccagaaaacggcttttccggtagggaaatcatgagcttttataagaatgcaaccaatatgccagtagcaactaatatgattgcaactgactggaaacagatctatccatccctgatgatgaagtccgtagacattattttggcagatccacacttttggggcattaatggtagcttgcgagttgccagcatcatgaatgattggggcttaacctggggatcacactcaaataatcattttgatattacattggccttatttgcgcaggctagtgcagccgcccctggaaagatcacagccattgatacccattggatttggcaagatgatcagcagttatgtgacgatgctatgaatattcatgacggtaagattacaattcctaataagccgggtttgggaattaatttgaaccatgagaaattagaaatggcgcatcaactgtatctgaccatgcaaaatcatgatcgagatgattctatggctatgcagtatctcattccaaattggcaatatgaccctaatcaacctacattggttagatagattaggaaagggacaaataatgaaaaaagtattaattagtgaaaaaattgacgatgacgctgttcagcttttgcagaaaaatggctttgatgttgaaatatcaccagccgtggacgaagctacgctaacagaacacataaaaggggcctttggcttaataatgcgttcaagtaagcttcctgaaggtgttgttgattcggcagatcagcttaggattatttcgagaactggaacgggcattgataatgtgaatattgatgatgcgacaaaaaatcatgttttagttgcccgggttaatggcgcaaatgcatattctgttgcggaatatgttattactacaatgttagccatgagtcgaagaatctataaatcagatagattattcaaggcaggtcagattgtttcaacgcatggtgaatccttaccagggttagctgtcaaatatgacttgaacggacacgaaattcgtgggaaaaggctgggaatccttggccttgggagaattggtaaaatcattgctaagcttggggatgctttaggtatggacatcattggctacgatccctatgtgaaggccagtgatgtaaagttaacaactgatctcaacgatatttataattcgtgcgactttatctcagtaaatatgccgttaacgaaggaaaccaagaatcttatcgctgctaaagagcttggccaaatgaaagattcagcatttatcgttaatgcaggccgaggcggaatcattaacgaaactgatctggctgatgcattgaataatggtgttgttgctggggcagctcttgatgtatttacagaagagccccctcgtagtgatagtccattattaactgcaaagaacatccttttgacagctcatattggtggaactacttatgaagccagtaaagctgttgcgattggcgctgcgcaagcagtaattgattattctacaggcaaaaagccacagttcacagtaaattataaggatcttaagaattaaacctgttaagtaccaatactcatttttactgtattcgacaaaacatgaggattcaatttatgaatcctcacgtttttttgcattgatttgacttgaaatatattctggtacctttggatgaacacgtcctttatattccgatggtgtggtttttaagtactttttaaacaatcgaaagagggatgaactattttggtatccaaccgtttcactaatttcacttaggtttaggttggtttttagcataaggttttgtgcggcggataggcgtcgcctttcaataagctcattaaaggtttttccagtgttagctttaatcttatttcctaggtaatttgtattgtatcgaaatacagcgctcacattgcttaatgtggttgtggcgaagtttttctcaatgtatttcaatatgggtagcaaatcgtcactcgaagaatctgcaaaattgatcgacttgtaggtgatgagactgggaagtcctaaaattaaggccgagaaaatgaagcgtagtgactccgatctatgtcgtgcatgattgattcccgttgcaatcagtgcatttatcaaattgagggaagtctcggcgttttttaggtcaaacagcataaagttattatgcagcgagtttactcgggttccattatagatgagttgagtaatttcattggttgattgaggaattgaattaaagatttcctcatagggtgaatcagtttttacaataatgttgattaaaatatcgttctcatttgtgtaatcaattctttggacgacatccttgtccatgactaaaagttccttttcatgtaatacagtcttggtgtcattaatgtactgagtacacattccggagtacatataattaaattcgatgaaactatgagtatgagccggtacgtacgaaaaacgattgtttttggtaacatcaatgtcgctgtcccaaaagaaatcccactggggcattcttgggataggatcgtgtatatagtccagatccatatagtttacatttccaccaaaatgattttgtaatttttcaactttagtcattctgaatagttgtgatttaagcgattcaatgggcttcataagtatcttttcccccctgtacaaagtggaatacaatttgtaatctgtgattatgcatgataaatcgagtgattaagatattgtagcataatctggtagcgcttacaattatcactgtaaattgaaggagggaaccaatatgaataataatacagttgattcaagctttaaaaagtatcgaccgctcgcagttgctgctggaattgggtcgatattaggttcggggattatcgttgggttatcggctaccattaccgtttggcaaactggtctaggcttaacgaatacgcaagttggcatcatatctggtgctttaacgtttgcgattgcaattggttcaatgattgctggtcaaattacaaaaacatttggattaattcgttcatttaactggttaaatttattatatgcaattggtgcattggtttgcgttttttcaaacggatacacgatgcttttatttggagtcattataacaggcttagcttctggagcagatttacctattagcttaacagtggtctcgcacgattcaccaaatgaaaagacacagtctcagttagtttcatcaactcagattttttggcaaattggaatatttatgtcatatgtttgtgcatttattgtttcaaaaatggcaggtgcaagtggtgccagagttgttttcactattttagccatttttgcattaattacatggctttggaggactttctcaagtaaattcagggctttccatcaagaaggtgaaaaacgccgaattaaacacgatcaagaagctaaccttactgacaaagtatctgttaagaatgtcttcactggatccaatcgaagtaaatttctgggctttttcttagcaattatgattttctatatttgctggaatttgctagctaacacctttggtcaatttcaaacatttgtgttggttcaggcacatgcaactcaaagctttgcgactgcagcgggattaattcttaacttggtttcactgtgtgcaactattacttttgcatccgtttccggtggtaaatatcgaaacaagttcttcattgttggggctttagttcaggcactagcaatgttgggcttggctttaagtagccacgcactatggccaatcgttatcgccattgggtgctacagtatcggtaataatgttgctggagaggcaatgtacaaggtttggacacaagaatcatttcctgttgagatccgcgcttccgtacaagggtttatcaatggattttcaagattcctatgtggtttatttgcaattgtcaccccagctttagttgttccatctgctatccgaaataccatgtttggttttactgggttagtaattgtatttttcattgccggtttagtaatgatgtatctccaaagaaaacacaatattattccgggtgttgaagagaatgagaggggcgaagacgatggcgttcacatttcaaatcaatgatgaagttcagtttaatcacgatgaacgattacttaataaggcaaagcaatataagcctgttattcatcaggatattgtatttccaaagtccattgttgaattagtacccgactctcaaaaacttgaaggatggggagttcaagatactcaagatattgaaggcctaccaaatattaagctgaaaagaaatcagaagattacgcttgattttggtagtcaccaagttggcaaatttagtatcgatatcaattcagttggctcgccgatggatgcaccactttttatcaaattgaaatttgcggaaatgcctgcagaattgaagcataaaagcgaggactaccacggttggctgagtaagtcttggattcaagaagaatacattcatcttgatgtattaccaacgcatctggaattatctcgtcgttatagctttagatacgttgagatcacagttattgatacttcgccaaagtggcaggctgtcttgtcaaatccacaagtagaaagtgaaacaagtgcctcgaatgaacaattgtccgttccatcgatcaaagatcccgaaatgaaaagtatttatcaagttggattgaaaactttgcaggattgtatgcaagatatttttgaagatggcccaaaacgtgatcggcgcctgtggattggtgatcttagacttcaagcactggcaaattacgcaacgtttaaggatgtggggttggttaagcgatgtctatatctatttggggcaatgacagctaaagatggccggattcccgcaaatgtgtttactcaaccccaagatatacctgatgacacttttctcttcgactatagtttatttttcatttcaattttggatgattttcaacgatttaaacaagatcaagaattactatcggatttatatccatttgcaaaaaagcagatggatgttgctttggagaaagtgcagctcaatggtgagctcattcttgatgacagttaccctgtatttatcgactggtccaacgactttgataaaaatactgccggtcaagcagtgttaatttacactctacggcaatttatccatttagcaaaaatgatgaatgataatgttgatggatactcacaaaagctacatgaacttatttcatatagtcagtttaatttgtttgatgctgagaaagggctctttgtttcaggacctcagcatgaagtaaacattgcttcccaagtttggatggtccttgctcgtgtgttggatgatcgtcagaacaaacaagttatgattcatacaattaatgaattatttccgattacagggattgcaacaccttatatgtaccatcacattactcaagcattatttgaagcaggcatgaacgatgaggctattaagctaatgaaagattattggggacaaatgatctcactaggtgccgatacttattgggaagcatttgagccagctaaacctgaatattcaccttatggaagtccaattttaaatagttattgtcatgcatggagctgtacaccagtttatctgattcagaagtacctgattggggaggaataaccatgggtaatgaaaagatttctttaagtagagataatgtattgctgattatcgtggccggaattgcatcatatctcgacgcggctctacttgtaagtctaggagttgcattaccaatttgggcagactatttgcatttgaatagttggattgttggtttactaagcaccactttaacaattgctgttgctgtcgggtcgtttgctggtggttggctatctgacaagtttggcagggttacggtgtttaattatgacattctgtttgtagcaattggctctgcaattgtggctttttcaagagacgtaccgttactattagttggtgttattgtggctggcctggcttcgggggctgatttgcctacatcattggctgtgatttctgaacgaatggataagcggacgtatggacgtgcaattgcatctacgcagattttttggacggtaggaatcttactttcacaattcattggtatgttgagtgccaatgctggcatgggaagtccgatgaccctgttcggctggattggattggttgcgttcgtaaattggtgtgttcgagtgttttctaaaaatttccgtcagattgaagaagggttggccgaggttgttgaggaaaagatggagtcagttggggaagtaaaaaagcgctacaagctgcgagaattattacggaatagtagttaccttcttccacttattttcctaacaaccttttatctgttctggaatttacccgccaatacttggggatcatttgttaattattttattgtaacggttgataaccgtagccaactatattcaacagtgattgccttagtggctaatgtcttttgcctacttgtgaatgtgatttacctgaagatttctgattccaagtatcgatataaagccatgtatgtcggaattgcgactgccctaattgcatttctttcggcagggatatttagtgaccattggcaggtctttacctttgcatatattttctattcaggaagtacggttctctgtggtgaagctttatacaaaatttggagtcagacattctatcctgtggatgctagagcaaccctgacaggcttctcatatggatttgttaggataattaccgccatgttttctttgattacgccgacgttgatggggtattcacccaaaatcctcttatggatcatggtcggctgcacgctagtttttggaacctgtgcattgatcatcgttcatttggttaagcggtttaaagtgtcagatccaaccaccatcggtcacgctctgtctaatgagagttagcattgttgatcaacttattgaaaggagagatatttatggattcaacagcacactggatttggtatcctggggatttttcgattcaccaaggaatgctacaaaattttgctcgggaagagcggggaatgggttggccggcatattggtatattgatgactgtaatcggaatataaacttttcacgtacctacgatttggataatccaacagactttacagtgtatgctcgcggtataggttatgttgatattaatgggaaaaagtttcggttgggagagactttgaggtgtgaatccggcaaaaatgtaattactatttttgtcggcaatccaactgggcttccctgcgtgtatatcgacggactggtggttaaatcagacaaaggttggcaagcaagtaactttgtttcagaactacctgcaggtaatgatccactgtttacaagcaaagatcagaatcccaatgttatcgaatatcaaaaagctgagttaaatccgactaaagtcaaagaaattgataatggtgttcttttcgattttggtagagctgtgaatggtagcttaaaggtgaaacttcatcaaattgatgaagtaaccatttgctatggggaatcacgcactgaagctttggatgtggatatgtgctactacaagcaggaaagcgttgatgagacaacccatattcgaaaacgtgcgtttcgatttgtgtttatacccaacgcaaagaaagacaacatcaatttaatcgccatccatgaatatattcctaagcagaatatttccgacttccaaactgataaccctctgattaacaagatctggaatgtttcaaccgaaactttaaatttgtgtagtgacctgttctttatcgacggaatcaagcgtgatcggtggatttgggcaggggatgcataccaggctaacttcatcaaccaatactcattttttaacgaggaagttgatcgacggacgttgcttgcgttaagaggccaagataatattaagcaacatataaacacaattgtcgattattccatgctttgggtgattggtgttttgaatcattatgaaatgactggtgatcgtgaattcttaaagattgtttatccaaagatggaaagtatggttcggtattttatcaatcagacgaataaacaaggttttatctatggtcgagaaaacgactggatttttgttgattggtctgaaatcgacaaagatgggactgtagcggctgaacaagcattgttaattgaagtttataaaaccatggttacgtgtggttcggtccttaatcgtccgattgagtactatcaaacattacatgaccaacttttagagaactttcttcaacacttctggaatgaaaagaaaggtgcatttattgatagctacgaatctggtaagaatcacgttactcgtcatgccaatatctttgcgatcttatttgacttagtggatgatgataaaaaagaatcaattctcaaaaatgttttattaaatgataaaatcacccggattactaccccttacttcaaattctttgagcaagacgctctctgcaagatgaaccgtcaagacattgtctatacaaccatcttggattactggggtggcatgcttgccaatgatgcagtcacattttgggaggagtatgatccaacgaaatctggtaaggacatgtactcaatgtatggtgatccatacggtaaaagcttatgtcacgcttggggcgccagtccaatttatcttctaggaagatactttgttggtttgtaccccactcgtcctggatatcgagagttccatgtcgagccagaattggatcagtttaataaatttcatgctattttgcccattaagaatggtaaagttatcgttgataaaaatggagatacgctctctgtgctcgcttcaaagggtggcggaacgttggtcttaggcaagaatgaatatgccttgattcctaataaaaagttaacagtatcattgaatcatgcgaaagtggatgctgggtaattgatgatcatatagtcatttacgcatacgtaaaaggatctactttaatattttcccgagatgaaattgtgagtctggaatatgttggtagacttttttgaataagctgttgttactgaagtaaagctaaatgtagcataatcaccccaccacctacgattcagcgaatgtatggtggattgttagaattagattagcaattactcacgggtatcgtttgcatagttattcgctaaattctgagttctcatgtaaaattatgagcaactgactgtatagtaaatacgattttgaaaggctggttctttaagccattaagcgaatttatagtaataaatatttacaaggagaaattgtgggttgaacttagtgaacatttgaactattttaagataagcatcaataattatattttaggaaggatatgttaacgaatgacgaaacattactcgtttttaaataattttaaatttaaaaatggacttgaaatcaaaaatcgagttgttattccaccgatgaccgaagtctccagttttgaggacggttcaatctctacagatgaattgagatacttgcaaatgcgtgctggaggcgtagggttatttatttctcctgtggccaacgtatcagaaaatggtaagggattcgagggagagttatcgataacaagtgatcgctttatcccgggccttgcaaaagttgcttctgcgatgaaatttaatggatcaaaagctatacttcaaatttttcatgctggtagaatgtctaattctaaagtacttcgtggtgttcagccagtgagtgcaagcgctgttgctgccgaacgccccaatgctgaaactcctagagaattatcaaatgaagaaatcgagggcatcatcaatgattttggtgaagcaacccggcgtgctattgaagctggttttgatggtattgaattgcatggggctaatacgtacttactgcaacagttcttctccccacattctaatcgtcgtacggataattggggtggttccttggagaagcgaatgaactttccacttgcagttatcaaaagggttcatgaagccgtcgttaagtatgccaaccatccatttgttgtgggatatcgaatttccccagaagaaattgaaaatccaggaattcgaatgagtgataccttgaagtttgttaacgttttggcagatcaaccaattgattatcttcatgtttcaatgggttatgcgtggagaacttcattgaataataaggaggacactcaaccactgattttgaaaattaaagaccaactgaatggtcgattaccattaatctgtgttggatcagttgaaacaccagatgaagcagctgaagtgactgataaaggtattgatatggttgccattggaagggaaattttacgtgaaccgaagtgggttcaaaaagttgaaacggatgatgaagatagtattcgttataccatttccgaacaggacttagacgacttaggaattacacctccaatgtggaacttcttaattttcaggcttaaatcagcaatgcacatttctaatcagcctgattatgatccggaacaatttaaaaataaacttgcaccccacgaaggtgcttaaaagttaccaattatcatattaatttttggagtggcctatcgccactctttttttgtgtttatatcaaccttctcacgattgatttattatgagcatatagcgctttcatagtttccagttaaaattatatacaaaattgatggtaaccgatttctcaatcggattggcagctatattcctttggcaccaaccaataattggctttgaaataatgcttgactaagttttggaaaacgtttaccatagatgttggttagaagtgatagattgaacaatgtgaatcattctaaaatcaattctgacgtcaatacatgttggttgttgctattattctattaattcttggaggaatcgattatgactttaattttgaatacatggatttttgaatcagatgtacaaaaaggtgctaaacaagcggacttggttgatcgggtagcaaaacttggtgccaatggtattgaagttcgtcgtgaatatttcaaagatttggatgttgagcttcctgatgttgcaaaacatgctagagaacataatctcattgttaattacagtgtgcccgatgtaatatttgaaccagatgggtctgttaaccctaaactcgccgattattttgaagaaggcgaaacgatggggatttcaaagattaagtttaataccggtaactttgataaattcaccggtgatctcaaaacggaattgggtaagtttccaattgacaagattgagatgaatgtagaaaacgatcaaactccagtttcaggtactgtaaatgcaatcaaaacatttttggatgctgcttatgctgccggattaacgcagttgggatacgtatatgatttgggtaactgggcgtttactcatggtgatgctaccgaagcagcaaagacactggctccatatacacactacattcacttgaagaatgctatcgataacaatggtaagctcaccacttcagatgacttggataaagggatgtttgactggcgacaattattaaccttgttaccttctaacgttcagtttgctttggaatatccaatgacctcagatgctcaaatttccgatcaaattaagttgtttaataaagaagtaggtgaatagcgctatgacatcaacaataatttcaattctacttttagtcacgtttgcagcctttattgtatacattgttaaaggcggtaacttgatgatcgggttcttcgtaatggccatattatggtcagtaattggattagttccattcaatacagctattcaaaaggtttttgctgagcctgcattaaattatgggccgaccattatttacattgtgtttggttcatggtttggtcgtgtgttggtggatagtggaattgcacctgcaatttcagagcaaactaataaagttggtaagaagaaacccttaattgctgcaatcttggttgtttttgtaacatcctttatctttgttagtgcttacggtgttggatcggttattgcaattggtgttattcttcttccaattctgttgtcagtcggattgccacgagatcttgccctatcagcttttgcacttgcaattggggcaccaatgtacattaacgtggttttgtttaaccaaattaaagcctttttcccaaaagcaatttatggtgggaaatacttacaatttgggatggttgctactgcagttcaaattatcgcagttgttattttcttaattattcatcgcaaacggattgacgcttctaaagccgaagaaaaccttcaaatcattggtgctgctggtgccgatgagaaacaaattgaaagtgttccgaagatcgcctatgttgtaccgattattccagttttaatgaatatgctattccactgggacgcaatcccggcattaactttagcaaccttaattgccattgtattgactggtcgagcaaagaactttaagaagtttgttgattttctgaatagcactattaagcaatcaattagtgatattgctggattaattatgtttttaatggctttgattatgttttcaggagccgcatcaattaatgcgccacgttttaagccaatttttgaggcgattttaccgaatagtcatttaactttagctattatgcttggtgtacttgcaccacttgcacttttccgtgggccattgcatgtatggggtgccggagccgcaaccgctgctgttctgtcaggaaccggattgtttagtgatgcattcttgctaccattactgtatgtaccgactctgatggctgtttcaactgatattactcaatcatggaacgtttggggactcgattacatgaaggttgattccaagagcttcttgaagttgggaatacctgtaatgtgggccgtatcaataattaatgagttgttagtttactacttctttggttaagacgttgttgaaacttagtaataaaagaaatgaggaattcaaatgagtgaagttattacagttggagaaccattatgcacatttgcttcaaaggaccctgatgtatcccttgctgatgctatgaattggcataaaatcatgggtggtgcagaattgaacgttgctattggtgttaaacgcttgggacattcggttgaatatatttctcgagtaggagaggatccttttggtgaatttgtcatcaaaacaattaaaagtcacaatgttggaactaagtatgtttctcaagatccggtatattggactggccatcaactgaaacaattggttactaaaggtgatcctgatacctataattatcgtaaggggtcagctgcatctcacttaaccagcgaaatcatggatcaagttgatctgaatggagttaaaattgctcacatgtccggaatttttccggctatctcagatactgctgaaaaatcattccgttcgttactctcaagacttgttgacaacaatattttaactacgtttgatcctaacttgcgtccctcattatggagtagtcaagagaaaatgattagtacaatcaatgaattggctggttcagcgaacattgttttgcctggtttggctgaaggtaagattttgatgggatcagatgatcctgaagaaattgctgatttctatttgaagggcaaacgaacagatactgtgtgtgttaaaattggtcctgctggcgcctatgttaagaccaaagatgggcaaagttacactgtgaatggtttcaaagtcgataatgttgttgacactgttggtgccggcgatggctttgcacttggtgttattacagctttacttgaaggaaaatctttaaagtcagctgtcttgagaggaaatgctgttggcgcattgcaagtgcaaacacctggagataacgacgggtacccaacacctaaagagttaaaagagttttacttacaagaaggagttagcgaagattaatgaaattacaagcagcgattgatagagtgtctcttggggacgcggttaccctagctcatagactggatggtattgccgatgtgatcgagtttggcacttctctggtgaaggattatggtcttgtgatgatcaaagaaaatcctttgcatttgaagaagagtaagcttctgcttgacttgaagactattgatgaaggcccatatgagttcaggagaggtttcgaagcacatggtgatattttaactgtgatggctggttcatcatatgacacgattagtaaaacttacgatatcacccaagatgttcataaggaaatgttaatcgacttgcttgaagtggacactgccaagattaaaactatttctggttttaagaacgcaatttatggattgcatcattcaagagatgcagaaagtaattttgacgcaattagtgctactaagaagtttcatgaagatttcccggatatcaagcgaattgctgttgctggtgggattgatgtggaacaggcaaaaggtttgtctcagcagggcattgctgacactgtgattgttgggagtaagatagttggtgaagaagatcctgtaaaagcagccaaacaatttaaggaggcaatgaagaaataatggcattaattgagcaagttatgcatgaagttgatgaagtcatgtcactggttgatgaaagtcaaattgatgacgccgagaaagtgattcaaaaagaccagagaattttcgtcttaggtgccggtcgttctggattgatggctaaaggatttgcaatgagattgatgcacattggctacaccgtttttgtcattggtgaaactattactccatcaattcaagctggagatgtgctggtttctgtttctggatccggaaagacaggcatggttgttgaacctacagaaaaggcaaagactaatggtgtcaaagttgttgctatcactagtaattcagagtccccattggctaaactgggtgatgcagttatcgtagttccaggagctactaaagccggagacggcgttcaatctattcaactattgagtacgttatttgatcaaagtgttcatattacattagatgttttgtgtttgaaactaagtcggcgtgaccacatttctaatgaaacggctaaagcgacacatagtaatatggaataggaggaagccagatgttacaaaaggttgaagcgattaccaaagttgcaaattcaggggttgtcgcagttgttcgtggacaatccaaagaagaatcgttaaagacggctattgcgtgtatcgagggtggtataagtggtattgagctggcttttacggctccacatgcagacgaaaccattgccgagcttaactcaaggtatactgaggacgaggcatttgtgggtgcggggacagttttagaccccgcaactgcaagagttgctatcattgcgggtgctaaatttattgtgagcccatccttcaataaggacgttgcaatgttatgcaatttgtatgccattccatatatccctggatgcatgactccaacggacattcaagaagcattgtcatatggatcagatattattaagctgttcccaggatcggtagttggtcaaaatatggtctctgaattacacggaccatttccacaagctagtttaatggtaaccggtggggtttctcttgacaatatgcaagagtggtttgataaaggtgcgacagtacttggtgctggaggaaatttggtcggacccgcaaaaacgggtaactttgatcaagttaaaaagaatgcacaagcatatcgtaagcaaattgatataataaagtcttcaaagtagaattgatatcagttgaggccatgacttttatgatgggaatgccattatttagagtctggtctctttttttattatttggtatgctaacaatatgtatttcaaaaataatttacactaatgaaaatgaggaagagagaatgactgataaaggtaagtctaaaacaagtgatacagtaacaatgaaggatgtagcggcacttgcaaatgtctctatagcaactgtgtcaagatttttaaatggcgatttatctcgtatgtctacaaacacggctaaaacggttaagagcgcaattgataaactaaattatgttcctaattctgcagctcgacaaatggttaccaagtcgagtggtttgattgcaataattgtggccaatattgacgactttttttctaccgaattgttcaagggaattagtgccatgttggaaagcaagggatatgtgggagtcctttttgattctaattcggacgttacgcgagaaaaagaactgatgacaattgttagtacccatacttttgatggcctaattattcaaccgtttagttctgtgaaggttatttctgacacgattcgtagaaatatacctattgtcattgttgatcgagaaattgaacaatccccttggacgcaagtcgtaacaaataattatgaagcagcaaggaacgcagctaagtactttcgtaatgaaggatttactcatgcaattgttgtaacatcgaatttgaatcttgccacaaacaggcgagaacgttatcgcggaattctgtcagaaattgataatacgaccctggttgaggtatctgaatcatcctacaaccataaaaaagtttctcaattacttgagaagttgttgaaagattctaaagagaaaacacttatttttgcacttaaggaacggtggataactgaatttgttcctagtctattttataaaggttatattgataataagagagttgccataactggatttgcagacactagtttagctaagtacattgatccgcatacaaaactaatcgctcagaacccgtatcttatgggtgccagcgctgcggaagttatgacagataagctgacgaatatgaatgtaagaattgacaatacaatcgttgttccagcaaaatttgaataggtttaacaacctagagcatgctggaagtactgtagcgcatccaattagtagactgaactaattggatgccgtttttatattcgggggcgattaattataatcttatgtgaacggtcataaatatcaatagaatgcaagattacagcaacagcagttgttaatcatagaaatgaatagaaaattaatgttgacacagaatcatctgaagcatagtatgaaagatacattaaagattaattaaaaaatgctaatgaaaggggatgcgctcgaatgactgttgaatctattattattttaattattagcgtcttagtaatctggatcaaacagtcgtttgatgaatcgtgctaaggctttttggcctttcatgaagagcaaattctcctgcgactgggtaatttaacctagtcgctttttatttatatttttttgttaatcaggagaggatgattttatgagaaaagtatttacatatggattagtggttaccagtgcaattttattgtcagcttgttcatctaaaggatccactagcaataagcaaaaaacactgaatgtaacgatgattcaagaaccttcaacagcagatccaaataaaggaacagatgtttactctgcgagtctggttcatcaaacgctcgagggcctttatgatgtgactaatacagggaaagttgttccgggtgttgctaccaaggtggtcaagcctactaaccatgggaagatgtatacttttacgcttaagaaaaatgcaaagtggcagaatggcaaaccagttactgctgaagattttgtaacatcatttgataggcaagtggatccaaagaccaaatctcagtatgcaagcaggtttcaagctttcaaaaattttgctgatgttcaaaaagggtccaagaagccgacggcactgggagtaaaggctttgggtcaacgcaagctcagagtcactttaaccacaccagatcctgaatttaatttccgggcagctactgagtattatcctttgaatacagcagctgttaaaaaatatggtcaacagtatggcacaagttccgtgaaaacattgtcgaatggcgcgttttcattacaaggatgggacccatcaaaggatgcttggacttacaaaaaaaacaagtatttctgggatgcaaagagtgtgaagttacctaaagttcatgtacaagttgtgaaggaaccttcaacagctcaaaatttatttgctagtggaaaaattcaagaaactctaattactggagagtttgtcaaacaagacgccaaacgttatccaaaaaatattgtttacactaaaaaagggcaaatgagatttttgagttttagtgcaaaaaataaaacaacgagtaaccggaattttagacttgctgtaagttacgccttaaaccgaaagcaactgactgataatgttttgcaggatggatctacccccgcaaagtcaatggtgcccgaaggtgatggaactgatccaacaaatggtaaggactttaacaaagaattagcaaccaatttgaagtacgataaacagctggcccagtcatattggaagaaagctcagcaacagttaggaaagaaaacactttctgttcaacttctcacagaagatgatagtgaccagaagaagcttggagaatacgttcaaagtgctgttgaaaagaccttgaaaggcgttacggttgaacttacatcagtgcctcaacaacaacaacttaccagaatgtttggggggaattatcaaattactgcaacaggatggagcaccgactatccagatccttctgattacttaaaccttatgaccaaggcaaatactgttaactttacacattggacaaatgcttcatatgaaaatgtgatggctaaagtaaacgatacttctaagtactcaggtaaagaacgctggaacttgatggtaaaggctggaaacatcgcaatgcagcaacaaccagatgttgcaacatatcaagatacagatgttcatctggtttcgtcaaaagtaggagggctcaaatattcattactaacagactcattgtatcgttacgcttattggaaatagggaggataaaatatgtcacaaatgttgacggaagaagatttctataaattaaaaatgctgagtcagccagttgagactgacaactattactttgtcactcaaacttatatggataagcagtctaacgggtatcgttcaaacatattgggatttgacaaaggaggtaaatttgttggtaactttgataatgataattatgcttcgaagtcaccagttggtgcaaaagactacctgttttttctttcacaaagcaatgctgattcagagtttcaattatttcaagttaaatatacaggtggaacagcccaacaagttacgcatcttgcacattctgttgagcaagtaattgctgtacccggaacaaatacggtattctttaaaacgagggagactaaggaggttccgaagaagccttatgaaaagtatccaagtgttagacatgttttccgggtgaatcacaaggctgacgggttcggattctatccaactgatggtttatacgttttgtactcttataatacggacgaccaacgtcttgaaaaggtgtattctgccaagcaggattttagtttaactgatgttgcatccgacggtgttcgtgtagcagtgataacagataataaacctgataatgatttggattatgggcgtggtgtttatgtgcttgatacatctaaccagcatgttgacaatatcacagcaaataatccagaatgggtgtttacccatgcaaagttctccccggatggatctaaaatgcttctggtgggtcgatctgataagtatgatgcaaatacacaattttctgtttatggttatgactttaacaatcagaaatttctcgattatgttaatgagatggaagaagagaccgctgatttcttgtttacagacttcacacagaatcttagcgacgaagacgctttttgggttaataatggtgcctttgtgtttagaactgcttatcatggcagaacaaagatgtttctttttcaaaatgggaaagtaagctcattctataatgaggctgagagaatcacagactggtcagttttcaataaccatttgattgtaacgtattcaactggaatattaccagtaatgatggcgacattaagcttagatggataccaagctgatgtatttaatcctaatgagcgttttgatcaagagcatgagtatgtgaagccggaaagatttgtctacaaagctagcgatggtcttgcaattgaaggatggttaatggaacctgccaagcctaaagaatccaatcctttggtactttacattcacggcgggccgcactacgcttatggagaaaatttcttcttcgagatgcaggtgcacgcagcgaatggatatggaattctcttattaaatccaaggggtagcaaaacctatgggcaagcgttttgtcaggaaaatgttggtcattatggcgagaaagattttaccgatttaatggaaggaatggactacgtgttagctcatcacccagaatttgataaaaatctacagtattgtgcaggtggctcatatggtggatttatgacaacttgggtggttggacataccaataggtttgctggtgctgttgctcaaaggccggtaactgactggattagcttttctggcacaagcgatattggatttatgtttactcctcaagagcttaaaactgatcgatatgatatagagacactttggaagtattctcccctcgcatatgctaagaaagttaaaacccccacattggtcatgcagggggaatgggatacgagaacacctatcggccaaggcgaggagttcttcagcgccctcgttgagaatggcacggaagcagagatgtcccgatatcctcaatcttggcatggtgtgtcccgaaatggattaccaaatctaagagttgaacgaattaaagaaactagaagctggtgggataagcaccagtaatacattcttcaggtagaagcctttgacttctaccttttttatgaaaagaaaaaaagaccgtcatctttgtgatgacgatccgatggttcttaatttattcgattaaatcaatttcaagaatatcgaagcaatgataacagaagcaactgaaacggttgcaaacccaccaactaacatttttggcatcatgttatgaagtaaatagcgttcctcatccttagttccagcaactgtgtgagcaacttcagacgttagaatgtaatcagctgggaatccaaataacgacgtcagagagcaagcataggccatttgccaggacattccaaatggcttagcaagtacgcgtgaagctaggaacattcctagaagacctaaagcaatcaagacaataatttgaaggataatacttcccatgatctgaggagttgtaacacttaattgtgcaaaaacgtaagcaagtaaaccatacattaaccaattaaatacacctgcttcgttcaaagcattgtcttccaagaaaccgaattggtgagcaataacaccaaagatcagacaaacaacgtttgggttaatagcattgttgattaagcctgcacaccatgtactaaagagcgctaccatggctacacgagccaaagtaaaagctggtgtttcatattctggtttcaaattaaaaacgttttgtgatttgaatgctgaaggctgttcatcttcggcaagttcagtcacctcaggtcctaatttacttccgccggccttaaattctttgattaaccggccaccctcttgacggagcattaatgaagttagaggatatccaaccactgagtgaataacaaacatggaaactggaagagctaccagagctgtaaccccttgagccttcaatccattggtcattagcaatgcagaaaccaaaccaccggtgagtggtggaactgcagcaacaaccgtcttccaattaaagatcaaactcccaattgttaaacataaaagcattgttccacagacacctaataaagcaatacaaacagctttccattgggcaaccaactcttttaagctcatcaaagtaccaagatgaaccaacaacatggcaacacagattgacacaaattcattgccatacgacgcttgagttacaacgtccttgggtaaaatagtccaaaaaccaatcacgaataatacagcggagacaaagactgaaggaataaaagcatgagacattgttgaaacccattcaccaatgaacatgaataccattacaacaagaaatgcgatgataaagttcatatgtataccactcctaacaaatttattgatatatgtatcctattactcattgaattgttagtcaattctaattttaatgaaagctttataaatgccgaaggacaagggctcaattgaatccgctttaaaatgggtggttgactattattcaaatgagaattaatgttatattaattagaaaaaggagtggatatatttgagcaaaactacatatacaaatttcaatttgttcgatgggaaaagtaacgaagttaagaaatccgcatggttggttgttgatgagaccacagggaagattgaccaggttggaacaggtgatgctccttccaccgatcagcaggtagacctaaatgggaaatatgtcatgccaggaatggtcaattgtcatacacatatctgcatggatcccacagcaggagatggtggaacaggtgctaatgtagttgatgcaactgttcatgccgttcaacatttgcatgacctgttgaagtctggtgttacttatattcgtgaatgtggtagtacttttgatattgatattgctttaaacgagttacgtaaaaagggtgttttgaaaaaagtacccgagatcttgccttcgggaagaccatactcaatgactggtggtcatggagactttccaaactttggtcatttagttgattctcctgatgaaatgcgcaaggctgttcggacaggacttaagaaaggcacaatggctgttaaggttatggcaactggtggtgttatgacacctggtgacttcatggcggatccacagctgagtgttgaagaaatgaaagttgctgcagatgaggcccatcacaagggtcggattattgctgcccatgctgaaggaaaccccggcatcatgaatgcaataaaagctggtgttgactcaattgaacatggtttctatgtaaatgatgaagaaattgatttgatgcttaagcaaggtacttatttgaccccaacgtttgtcgccgactgggcaattcctgaatatggtgaaggaaagatgccagattgggaaattaagaaggctgctgatgccttggatgatttgtataagaacatcatgcatgcatggaagcgtggtgttccgattacacttggaacagacgcaggaacgccattcaatgatttcacaatgactccggttgaattccaattaatggttgaacaaggtgctactaattttgattcacttgaaacaagctacacctcagccaaattaatgaagatcgataaagaatatggaacccttgagcctaacaaatatgctgacttcttggtattggataatgatccattagccgatgtgaaggcggttcaacaagaagacaaagctgtttacaagaaaggtgttcaggtttactaatactaaaaagatggctcttgccatctttttgtgattaaggagaataatatgtcgacaatttattacaatgcaagcatctttgatggaaaaaatgaagagataacaagggatgcctggtttgaagtcaccgatggaagaattgctcaaataggtactggaaagccatctaagaaggctgagaagaatattgatttaaaaggtaaatatgtcaccccaggattaatcaatgcccacacgcatatgatgatgaatccagtcactaataagcttgaatacctttcagaaactgaagtcaccgcgacggcaattcaaaatctaagagacttattggaatctggagtcacttatattcgggactgtggctgtgcttttaacaccgatatcaagcttcgtaactttgccaaagaacatgaccttgaagctcccggaattattgcatctggccgaccaatgtcaatgacgggtgggcatggagactttaaagaaggcgctgatggtgaaattgactggtcgtatttgacagactcacctgatgaaatgcgaaagtcagtcagaactgcacttaagattggcgcagacaatattaaagtgatggcaactggaggcgttatgtctgctggagacaacattgacgacactgcgctcactcctgctgaaatgagggttgcggttgaagaagctcatcacaagggtaaaaaagttgctgcacatgctcaggggaatagtggtatccaaaatgcactcgatgcaggtgtggattccattgaacatggtatttatgttgatgaaaagcaagcggattacatggttaaaaacaatgtatatcttgttccaacattgaacgctgctgcaagtatcagcaaatatggacgtgacaaacttccatcgtatatgattcgaaaaaacgatcaggttaaatccgactttttcaagaatgtttccatggcatttaagaaaggtgtcaaagtgatcgtcggaaccgatgcgggaacaccatttaatagtttcaagacaggtacttgggaagaaatgcaattattggtgaacgaaattggtgcaaccccaactcaggctttattaagtgcgactcagtatgcagctgatttgattggaatctcagacaattatggcactttagagccaggaaaatttgcagactttttggttcttgatcaagatccaactcagagcattgatgcaattacacaggataataaattggtatttcagcacggaaagcaaattaaataggcggtgattgaatgcaacaagaagaagttgaacaatatgctttagacaatttagacaatgtaacggactatttacgaatcccaagtatatctgcacaaaacaaggggattaacgaaaccaatgagtggattatgaaacagtttaaggacttgggagctgccaaagttgaaaagtggactgatcaaggtggcaatcctgttgttttcgctgaatttaacgggaaatctgataagactgtcttgttttacaaccattatgatgttcagccacctgagccacttgatgaatggaaaacgaaaccatttgagccgacagttgttggagacaaactagttgcccgtggagtttgtgatgataagggtgaattaatgtcacggttaacggtggttaagtacttcaacgaacatggtggtattccggtgaacttgaagttttttgttgaaggcgaagaagaaattggtagttcagatgttgataaatatgtgcgagcccacgcagaccaacttcaagctgatgtttgtatctgggaaggcgggggaaaagacgaaagtgaaaacttccagattgtctgtggcgcaaaggggattgccagttttaatttacatgttaaaactgctgcagcagaccttcattcatcgttagccagttatgctgataacgcggcttggcgactcgttcaggcattggcctcacttcgaacaccggataatcgggttgctgttgatggattttatgatgatatagaaaaactgaccccatctgaggaaaaggctactcaaagtatggcctttgatgccgataaggtccgtgctaactacgggttaactcgtccctttgtgtataatgatcctcgcgaagagctggttaatggtgctacgatgaccatcaatgggctgaacgctggttatacaggagatggcgtcaaaacgatcattccaaaggaagcctccgcaaaacttgactgtcgacttgctccaaatcaagatccgcaaaagatcgcaggcttaattagtaagcaactggaaaagaatggatatggtgatgttaagcttgactatttattaggtgaagacgcattccgaagcaatttggatcatccatttgttaaactaaataagaaagtcgcagatgaagtttatacttctgaaaaagttcgcttaatccctaatatgcccggtgggggtccaatgaaacaatttgcagacagtgttcatgcaccaattgtgatggtcggcatccactactccggcagtcatccgcactccccaaatgaaaatattcgtttggctgattataagcagggaacttactttttggcacggctgttagaagaatattgatttgaattggcatttgacaaatgtagtttgatgagtaaactagtaagtattctaattgatgtatcatttaaaactcattttacatcagtcggatttaatgtactgttacttgccaaccgttctcagctgggacaaaaaggaatttcaggtacatctaacaagttaattgaaatgtgaaaaatatttttgaaatgatgatgagaagagtaattaacaatttgatttctcagagaacgtcggatgctgaaaagacgtaattggattgctaatgaagatgagctcggagtttaaatacgtgaaagcgatatttacgtttggatgcgttacaatcccagacttaatagcattatttgttattgagttggtaagatgactactgtgaagtagtcataaacgaaggtggcatcacgtattcatacgtccttgtggtatttattactgcaaggacttttattttgcatatttttatatttgaaagagggaaaaattattatgaaaaaatcaattaagtatttaatctgggttgtcgttgttatagcgatcgttgtcattggctacttcagttttggccgtggtaatgcctcacagtctaagaccgttactattggtgtaattacaggaaccaaaaaagatcaagcaatttgggattcggtatctaaaaccgccaaggataagtatcacatcaacatcaaactgaaaaactttacggactattcacagcccaataaagcacttagcagtcataacattgacttgaatgcttttcagagtatgaactttctaattcaatggaatcaagcccataagagtcatttgacttccatcggtaaaacactgattacaccacttcgaatttattccaaaaaatatacgagtgtaaaccaaattaagtcaggatcacaaattgcaattgccaatgatgcagcaaacgaggccagggcactggaacttttgcagtctgctggtttgatcaagcttgattcgtctgccctaccaacggttaattcaattaccagcaatcccaagaagctaagaataaagacggttgatgccaatcaaaccgcccgtgcattaccagatgttggtgcttcagttatcaatggtggcttcgcggtaactgctggtattccagagaaatattcaatcttcaaggaaccattgcagaagcagtatgtcaacgtaatcgttgctaataacaaagataaaaacaaaaagttgtataaagaggttattaaggcctatcaatcggctgcaactaagaaggaaatcacaaaacaatatggcgatttaattttgccagcttgggatttgaaatttagcaagtagtgcaaggagggcaaagatgtcagacagcattattgatattaataaggtgagtgtgagtttcctacagaaaggcaatcgcttagacgccgtgaaagacgtctcattaagcattaaccgtggcgatatatatggaatcgttgggtattctggtgccgggaagtctactttatcaagaacgattaacttacttcagaaaccaaccagtgggacggtcgttgttgataacaaaactttttttgacagcagtaagagtcgcaagccaattattagcgcgaaagaattgcgaattgaacgtcaaaaaattggcatgattttccagcattttaatctgctgaatgaacaaaccgttgttcaaaatgttgaatttgctttaaagcacagtaagttaaaagaaaagcaagttcagcaacgggcacaaaagctactgggattggttggattaagcgaatatgcgaacacctacccagctcagctgtcagggggacaacagcaacgagtggcaattgctcgtgccctggccaatgatccgaaaatcttgatttctgacgaatcaacttccgcccttgatccacaaaatactaatcaaatattagatttgctaaagcatctcaatttacaacttggacttactgttattttgattacgcatgagattgatgctgtcaaacgaatcgcaaataaagcagctgttatggatgctggccaaattattgagtctggtagtattgttgatgtttttgtccatcctcaaaaacaactgaccaaaacactgattggcttcaacgagggtcccaaaaaggcaattagtattctaaacagcaatggtctaaaactcaattctaatgaacagtacatcaaattgacctattttggcaatgaggtaagtgaaccagttgtgattagcctttataaggatctcgatgtcacagcaaatatcatttatagcgacgttgatatcttgggggatacactggttggaacaatgtttatcattattgaaggtaagtcggaaaatgtcgaagaagcaatagactatcttcggcaaagagatattagtatagagaagttggatcgaagcgaggtgaatagctgatgagtacgtggtttgcaaaaacgtttcctaatgttgtttatcaaggctggaatggaagtgatggctggtttaccgctattattcagacgctttatatgacattttggcccgcaatttttggtggcgtcctgggaattatctttggcttaggactcgtcttaacagaagatggcgggattttggaaaataaggtcgcttttaatgtttttgataaggtcgtctcattcctcagggcgttcccatttattattttgctagcatttatcgcgccagtaacccaaaaaattgttggcacccaaattggcacaacagcgtcactggttccgctgtccattggtgtatttccattttatgcccgtcaggttcaggttgccttgaagagtgtggataagggtgtcattgaagctgcagaatctgttggggcaactttgccggatattatctttgacgtgtatttgcgagaagctcgatcagaaatggtacgaatcagtactgtaacgttgattagtttaattggattaactgcaatggccggcgcaatcggagcaggcggcttaggaaatatggctatttcctttgggtataatcgatttgccaatgacacgacttttgttgcgacgctgctagtcatgattttggttcttttagtgcaattcacgggagactttttagcgcgaatcctaaatcataaacagtaagttaaatacaatgcggaggtaaaaaattatcatggaaaaagaagagcagttacagattctcaaagatttgattcaaattaagtcagtcaatagtaatgaggtggaagttgctgagtatattgggaaactatttcagaaacaccatattagttacaagattgacaaatttggagaagatcgtgccaatttggttgcggagattggctctggtaaaatggatgaagtattgggatttaccgggcatcaagatacagtaagtgtggaagaccccagtgcgtggaaacatgatccattcaaggctgagatagatggcgataaactatttggtcgtggtgctgcagacatgaaaagtggcttggctgctcaggtcattacattgatcgatcttgttgacgaaggcatcgaaattgacggcaagattcgatttattgccactgcaggagaagaatatggaacccccggcgctaatcggttaaatgaacagggagtggcaaatgatttgtctgccctagttgttggggagccaactaacggtcaggtgatctatgcacattctggcagtttgaactaccaaattaagagtattggaaaagcagttcacagttcaagacctgctgagggtattaatgcgataacaggtttatctaaatatattgatgccgaggcaacattatttaatgatgctcccaaagacaagatcttgggccaattgcagcatagcattaccctgatcaaaggtggagaacaagttaatatcatccctgactatgctgagttgtatggaaatattcggccaacggaaagctttgataatgaccaggtaattagcacaattaagaatgaagttgctaagattaataaagataccgagtttcacttggaatttcatttggttcacaatttcaggccagttgaaactgaaccagataatccgtttattacccttgttgatcaggccgctaaggataactaccaagatcgtgatgttgaactgcaaacaattaatgccgcaacggacgctagcgtctttatcacaagtaatcctaagttgccggtcgtaattttgggcgcggatgaaagtggtgttgctcatcagaccgatgaatatacaactctgacaagttactacgaaacggttgaaacttatgagtcgatcgcaaaaacatactttaaacagtaatgcagattactataagacaagtaaatgtgtgtagataattttttcaagacaacaagagcagatcaatgtgctgatgaacattgatctgttcttgcttttgtctgttcaccaatggggggattcctcctggtaaagattggattaagtcattcaaaataccccatatacgttgtatgagcctctatcatatctgagttcactaaagttaaaatttattggcataacaatcctttttcccaataaattttccgacatatgtataacctatactcccaagaagataaagattcaatcaaacattatctattaactcacacgaaataaagaaagcgctttcgtataatagatattgaagcttatttcacaatgcattatatgaaggagtgaacataatggacgacaatgtaacgactgttggtgcaaaatcaaaggctaacgatcctgttaatgtctcaaggagatactggtggcgggttgtggcactgtgctttgttggttggattctaatttatgccgacagaacaattcttaatccggttcaggagcaaattggtgctcagttccatatcggtaacacgcaacttggattggttaatagtattttcttcttaacctatgcgatttgccaaattccatttggagttttgggggataagatcggccgccggttagttattatgggtggttttgttctacttggggttatgacatttttcagtgggtttgcattttcttttgggatttttctagtattcagagcccttgcaggtgcaagccaaggaacatattatggaccacaatatgctctgtcaacggaagctatccccaccaaggatttaactttaggaactgcaattattaatagtgggatggcctttggaacctccgggggttatcttctttcgagttatatggtccttcaaaaggggatgtcatggaccagtccgttctgggtaatggcactaccgaccatcattgtcggtattctcttttatgttatcttaaaagaaaaggtaatccggccagaagatcagaaaaatgagcaaaaaactgaagaagcggttgaggctgaaaaagagaaggtaacgctaaaggacttatttaaaaatcgtaacttggtactggcatttattctctgcttctgttcgatttatgctaattttgtaattttgacttggttgccacaattcttgcaggttgaacgaggatttcaaggtagtagtgtaggattcatttcctcacttgttccatgggcctctattcctggtgcccttctctttgccagaatttatgataagttgaagaagaccaaaatgatgattggattcttagttcctatttcattgattgctgtgtttggaattgcgtttgtcaccaataaatcattgctaatcgtgttactaattgtgtatggattaactggtaaactagccattgatccgatcctgatcgcttttgtaactaagaattcaccacgtggttcgctgtcaactgcgcttagcgcctacaactttattggcatgtcaggttcaatccttgcaccttatctaactggttggatttcagaccagtttgggtcgatgcagattggtttctacctagcagctgtccttctgctggttggtgttatcctatttacattcaccagtgacaagaaaaatgcgatccatgcttaactgaatacaaaatgaatcccggtgattgttagatcactgggatttttattttatcttgttagattatttagccattcaattacgcctttataaattgttaaggattcaggtgtgactgttcgatcgaaatcatgatcttttgaagtgacggggatcagcttagcgtctggcagtttagcttttaacataattgagttaatgaaggggacgtcaggatcggaattggattggcacatgtaagtaggcggaaattgtgttttaagtgtgtttggactaatttttagttctgtctcattcctcttaaagatcatttcctgccaatttgcggtttgacgggcgtaaacataaattaaaaagcgctcttcataagaactgtgactgatgggggaattgttcactaattgttttacttcagctttgtttacggttggataacttgaatatagtgcattgggctttagtaaatttgatgctaaaagactttcgaacccataaaaatcgatgaatgcctctggaaattctggcaacccaccagccattagttgcatggaaagataagcaccagcggatctgccaaataaaacataatgattatttggcagattaaggtcgtcaaaatgattgagaaaatacttcacaccagctctcaaagattcaatgattgcagagaatggactttctggtgctaggagataatccaatgtaaataccgagtatccagattttagaaaaagatcaatatatgcttgcggcaggtcatcccggttgccgaaaattaacccgccaccatgaatatatataatcgtgggcttgtctgaattttctggtgttttccaaaaagatccctgaatttgggttctatcggttgtcttatacgttacagtttgcaattttatctatcccttctaattattttcttcatccaaaacattaagcactcggataccaacatttaatctaaaaatttcatcgacatcagagaagttaatgttggttcgttcttgaattttgtttaatcgataactcatcgttttggggtgaatgaataaggcgtcggcacttgccttggcgttttgattatgatccagatacgtttttaaagttgtatatagttctggcttatcttgatagagtttcaataagtcttccgttacaaacgactttaacttggttggatcatcgacttggaataagaagcggtagaaacccaggtcattataattaaagatttgatcggacttgttcaagtggccggcgatttggagtgtctttaaggcttgtgatgcatgacttggaaaatcctttgggtgacaattctcgcttaagccaatttggaagttcattgacgggtgagaggcatccaatgtctgaagaactttcctcaagttagattgcaacttagcggttggctcgtcatcgataattaaaatgattcgattttgtcgaacacggtacacagcatcaggccaaaacgtcttaaattgtgcaacgacgctatttgcatcacggggattatctcgaaaatagtcagtttgaatttcaccatttaccaagacttggattactgtgactcggtaatccttatcttccatgagtttgaaatgtttcaaagtggcttgatattcttcctcacttgtaattttgccattaatcaagtcatcaataatatcattggcgtaagttctaagtccctgctccagggccgcttgcttgataacttccatttgcgtaaagtttacagcgttctcaatagccataaaatcaatgtcttggagtctcttttcctgcagtactcctaaataaagatcatcttgactattggcaattttaaccattaaaaatttatacccctccgggagacttacttcaaaatattgatagttggtatattcagtttttggaagaagcttccgacttgaaaaatcaatggattggataggatattgagcctgcttactatggacgatatcaacaccgttactgtcctcaatcttaaaaatataagtaggattttcaaccaaagttgagagaagggtaacgatcgattgataagaactattttgaatagctaatttgatgaattgttgattaattgttttgtagcggttcaacatccggtttcgttcattgaataatagctgcatggtctccagcataatatcactgtacttaacgtcttgtgggatttcaattaatgggatgtcaaactggttgctatcttcgataatttgttggggaatgtcgttgataaatctcgatgttttgacgatcaagccactacaattgtgcttgtttagagattgcataaaatcatgaattgaatccgttgacaacttatcgaatccatatagagaagaaagtagaacttcatttggtgtgatccagcgttcaacgtcaggagcttcagtgatcatgatattgtcgactgttttattgatacctgcatttccagcgaccaatttggcgctggtaagggaatctatttgttggatatctttcagagtaactgccatatattttcctccttttaaaacgtttaccaacataaacaatactactacatagataaaaatcaattgaaagaaagtgatttctattatctgcgtaggatataataacgcttacaaagttatctttgtgagtaaatgtattatccttctcagaccagtatgataagagcgtaagttaaattgctaagcggcaaaggaggaaaacgatttgctatatacagtaattagaaaaaatagttatcaggattcaattaatctgatgctattaacacaaaatattagttccatgcctggtgttaaagaagtccaggtgatgatgggaacagacgccaataaagatatctttaatgaagctggattgttgacagacgaggctaagcacgcggaaccaaacgatatgatgattgtccttgatgctgacaaaaaagatgttatggatgatgtcttaaaacagattgataaattcttaagtgacctatcagttaaaagtgacgatgaagcaactgattcgaagaccgttacgaactgggatgatgcgatgaaagctgttccagatgccaacttggccgtgatttccgtcccaggtatttatgctgctgacgaaattgataatgctttggaccacaatctgaatgcgtttgttttcagtgataacgtttcgctatcagacgaggcacgcttaaaacagaaggctcataaaaagggactattggtaatgggtcctgactgtggaactggcattgtcagcaatgttcctttggcatttaccaatgttgttcgttccggtaatattggcttggttggtgcatctggaactggtattcaagaagttaccagcatgattgaacgtttgggtggcggagttacccatgcgattggaacaggtggtcgcgacttatccgataaagttggtgccattacgatggaagacgctattgcaggattagctcatcacgatcctacagaagtgattggtattatttctaagccgcctgcaaaagaggttcgtgacgatgttgtcagtttactgcatagtattgacaaaccagttgttgccatcttcttaggtgaaaagcctgatcatcacgaagattcagtttatctggcacacactctggaagaaacctccagaattctgatggatttggcagaagataaaaaagttaaagacaattattatcctgcagagccactggttaaagccgatcctcaactggatggtaagcatatcatcggattgtattctggcggtacgttggcttatgaggccggcatgatggtttctgaagcactcaatcttggtggcattatctctgatgaaggttatgttctccgtgcaaaggggaatgaggtgcttgatctaggtgatgatatctatacccaaggacgtcctcatccaatgattgatccacgaatccgagttgaaaagattaatgaatatgcaaatgattcagacaccggtgttattttactcgacgatgttcttggttacggaactgatgatacaatggcgcgaagtttggctgatgctgtgacaactgcttcaagaaagcatccacgagttaaatttgttgcaacagttgttggtacccgtgaagatcctcaagattatgatgctgctcgaaagacacttcaaagtgccgggattattgttcttgacagtaatgcacaagctgttcgatatgctttgaacctagttggtaaagatgttaatgagccagctaagaaagtaattccatatactggagcaactcatgaagttccaatgccaagtgaatcagtacttgacctgctttacacaaagccacgagttgttaatgttggggttgcagagttcttagacccagtcatcaagtttggtgggactggtgttcaatacaactggaagccgattgctggtggtaaccagaagatgattaagatcatcaagaaagttaaagcacttcaagatcggaatgccgaaaatgcaactattgtagatgcgtataagaaggctgccccattcctagttgatgttgttcctgcaggtactgttatctcagaattgaagggtcacacattgttacacgcaggacctccaattgaatatgatgaaatgaccgaaccaatgcaaggcggttgtatcggagctgttctttttgaaggatgggctgatgacgaaacaggcgctcgtaaattgctggaaagtggcgacgtaaagttcttatgcaaccatgatgtcaacgccgttggtccgatgggcggaattacatcagctcatatggccgttctcgtgattaagaatgccttaaaggacaactatgcatattgcacaatgaatgaaggaattggtaaagtacttcggttcggtgcgtataatgatgaagttattaatagattgaaatggatggcggatgttctggcgcctaccttgagcaaggcactcaagaaaattgatggcggactcaacgttaacgtgatgatggcaaaagctattaccatgggtgatgaattccatcagaggaacattgccgcatcactggtatttttgaaggaagttgctcctttaatcgtttcgctggatattccagaaaaggaaaagcaagatgttatccagttcttggctgacactgatcagttcttcctcagcattatgatggcaactgggaagtccgttgttgatgctgcaaggacctacaaacatggaacagtcgttacaacgatgactcgtaatggaaaagactttggtattcgcatcagtggcttaggcaaccagtggttcacagcacctgttaatacaccaaagggtctattctttactggatttactcaagatgatgccaatccagatattggtgatagtgcaattgctgaaaccgtcggatttggtggtatggctatgattgctgcaccaggtgttacacgatttgttggtgctggtggatttaaggatgctcaacggattagcaacgaaatggctaagattactttggatcgaaaccctaacttcaccattccaacctgggattaccagggaactgcaattggaattgatattgtgaaggttgttgaaacgggtattacaccaattatcaatacagggattgccagcaaggttgccggtgttggtcaagttggtgccgggacagtccatgcaccactagcctgctttgaaaaggcactggttgcgtatgctgatagtatgggactgttggatgacgatgaacaagcagcgattgaaaaagatttagttaaggaataagtgataattatgaaccttaatcataatcaagcaactggagagaagagcaatatgctccctctccatttgtttaataagaatcatggcattgttagtacagtgtttcagcatagttttaatattaagtttcctgaactgttattccacgttggtggcatttcagaatccttatcggccactggaattacaattagtgatgaattagtagatcgattattgaaagatgttgacgttggtaatcgagttctttacaagaatgaacaattattcatatacacaaactcagatattaaaactatttcactctcagacttaacggaagttgatctgcgaattccgcaggtgacttttgatcagactcccttggaacaaattatttctgcatttaaaataatcgactttgctgaggactggggactgagtgataaatattcaccacaaaaagtagttaatatgatccatcaaagccaaacagatactgaacgtgcgaaaacgctgaattttctttatggccgcgggcgaggattaacacccagtggggatgacattatcgttggttgtttgagcatcttagcagcgatgggttacccacaactcacgcaatggcaggaagtcattcataaaagattggaattgggtgggacgactgatgtgtcagaatcgtacattggtgctgcacttgatggatatacttcaaagaagatggttgcgtttttaaaggtcatccaagtgggtgctattgaacaaatagaaccggcaatactaggtatccaagactttggtcatacgtcgggaacagacacattactggggatgtatacagcatttacaatgctctaatatagcatcctggaacaaagacagatattgaataaacacaggaggaatgtaaaatggcaaaaatcgtcgtcgcattgggtggtaacgcaatcctttcaaaggacgcatcggcccaggcacaaatgaaagctgtcaaagaaacggcaaaagaattggttaactttatcaaaaacggtgatcaactcatcattactcatggtaatggaccacaagtaggaaatctgttattgcagcagtcagctgctgatacaccagaaaatcctgcaatgcctctagacacctgtggggcaatgactcaagggagcattgggtactggttccaaaatgcaatgcgtgaggaattactgaatgcagggattgataaggatgtgatggcagtcgtcactcagacgattgttgctgaagatgatcccgcttttcaaaatccttcgaaaccaatcggacctttctacacagaatcagagttagatgacattaaagccattcaccctgaatggcaattaatcgaagatgcaggccgtggatatcgtcgagtggtaccgtcacctaagccattggagattaatgaatatcgtgctatcaaaatgattgttgaagctgggattgtcccgattgtttctggtggtggcggtatcccagttgtcaaaaaaggtaatcagttgattggaactgaagctgtgattgataaagactttagtgcatctaagatcgcacaattgattgatgcagataagctcatcattctcacatctgctggtggagtcttttataactatggtaaacccgacgctgttgagctgaaagaagtaggaattgatgaaattcaaaaacacattgatgccaatgagtttgccaaaggtagtatgatgcctaaagttgaggcggctaccgactttgttcgtaatacaggaaatcatgcagtcattggcgcacttgaagatgttaaacgaattattgccggtgaagaaggaactaccattgttagcgaagatattgctatggttgccaaataatccaaaagataaagatagcgtaaggttcgaatccctcggcaggattcgaaccttttcttgtttacagatttctggataaaaaaatagcccccgaaagaattctcgaggacttcgctgtttatttatatttcactatgttgcttattattgacctgggttgattttgacttagaacgcttttcagggaaccatgcatacatcatctttttgaataaatctgaaccaaagtctaagaagtaaaccccgagtaacatgcatgcagcgagttctactacaaagagtggccaattggtaatagttttgtttaatgaaatttccataaatgttccccaacctaatagccaagctggaattcttgtaaacggtaggattgttccttgaaggatgatggcgataaatgccatgattccgaatactgatgaagtccaaagtaacatgttcatattaggtatttggaagaggttaaaagcaattaggccccatatgatccccattccgaagctaagtgagacgttgattgaggtgtttttctttgatccgtaacctgcatagaatgctgaggtaataaaagcaactggcgccatccaaaattcaagtgaaccggaaagtaacccataaaaaaatgtaaagattccaattccaagtgctgtataaagtgcttctttgctgagtgataagcctgtcttcataacgatagagctcctttcaaaccaacctacataattaagacataacttgctaatctttaagtactttgtgacaagtcaatcatacttgataaagtaaacgtttacattagcccctatggataaaaataaatcgctggattatacctgaagcccaatgtaaccagagaaaaaacgtgtagaatataatttgtaagcgcttaccaataatatgcgcaaataatatggctgctgtgggtaaatgagctgacgaggtgtaattataatggatctattattgaagaatgtgcgtatcaatgatgatgaagagttaatgaatgtcgcaattaagaatggaaagattgaaaagatttcttcctcagcgattgatgaacatgctactaaaacaattgatggtgaaggacatgtgttaattccagggctggttgaatctcatattcatttggacaaagcattgatttctaaccgagttcacaatcagtctggaacgttaaaggaagcaattgctgtcactgcaaaggctaaaccgacgtttacgaaggaagatatttaccagcgtgccaaaaaagccttggagatggaaattgcccatggggtgaccagtatgcgaactcacgcagaattttctccagatactgggtttgatggcttcaagaccattcttcgattaaaagaagaatataaggacatgattgatattcaagttgttgcctttccccaagatggcattttcaagttacccggaatgacagaaatgatggatgaagcaatgcaaatgggtgctgacgttgttggcgggattccttatgttgacccagatcctaaacaacacattgattttatcttccaacttgccaaaaaatacaacaaagatattgattttcatcaagacttctttgatgatgcagataatattaccgttgattatattgcacaaaaaacaattgatgaagggatgcaaggtcgagtttccgttggtcatgaaacagcccttgccgcacttccgcctgatgacttgaaaccaattgttgagttaatgcatgaagctcagattaatgtgatgtctttacctgaaactgatttgcatttagggggcagaactgacacgtacaatgttcgccgatgtgtgacaccgatccgtaagctacgtgatggtggcgtgaacgtttcgctgtccactaataatattaggaaccccttcacacctttcggtaatggggacatcatgcaggttggatttttggcagttcctgtcgctcatcttggtgggttatctgacttgccaaccgtactagacatgttgacttacaatcctgcgaaagcattacggcttagcggatatggactcgctgttggggataatgcagacttggttttacttgatactaagaaaaagaacgatgcggttattgatattcctgaccgactttacgttatcaagaatggtcgggttacggttcaaactgaaaagaaggtttctttgtatcgacgcacagaagatatcctggcaagtcaacgataacatgatattgagtagcagaagagaagttaaacttaaagcaggttctcgtttttatgagattacaaataatttattgacatctcatgtcgcttgggtgtttaatgatgatgttttcaaaactaaatagtggtctggggtgctgatcaaattcggctgagaaatacccatggaacctgaatcagttagtactgacgtaggaagaccgtttagtcaacttgtaatggattttgcctgactaaggaccactcttttttgaggaggtccttttttaatggcttgaattgtcaaattaagtgcaacactacattaaagaatatttcagaaggtgttccccatccaagatatttacgggggcgattattcatttgttcggcgtacgtttgtatttgcttgtcggtaattgaatcaatgtcagttcctttgggtagatactcgcgaagtaggccattggtgttttcattggttccacgttgccaaggagaatgcggatcaggaaagtaaaaggacgtcccgaactcttcagttaggcattgaactttggcaaattccttactcctgtctggggtgatcgtcaacgatctgccaggccataacctcatcaactgacttaaagtattggtaacggcacttgaagttcttttagcagccttgccaatcaggagatagcgagactttcgatcaaccagggttacgacacaggctttaccactctttcccaaaactgtatcgccctcccaatgtccaatctctaagcgattgtcagcttctcgtggtcggtcgtgaatcttgttgggaatgggaattttgccccgcttttcttgataagttttattgtgacgagacttaccatgatgtctcaagtggcgaacggcgctagaactgcccgacttgaacagattatcaaataaacccttcaagatcccacggtagatagttgcggtactgatttgaacggcatgcttttccactgccaagcgattggagatttcttccggcgaccaccggtcctcacaaaaatgttctctgaccacctcaaatacctgcgaaacacttaagagcgatggccttccacaattacgtttgcgttgctggtacttagcttgagcctttgatggtgaataacgaccaccatctgaatttcgcttcaattctcgagaaaccgttgaacaacttttctggatctccttggcgatcgcacacagtgagtttccatggctccgcattaagaatattgtttctcgttcatctatggtaatatgctggtagtggttcatggctagtttcctttcatgattgttctcgcaaacatcattttacaggaatttggccatgagccattctttatttaattagtgttgcacttaaagtgtaaattcaagcttaaaagttaaaagctggactaagtcaaaattgaattaaactttggcttagtccagctttgctatagttattcggccttcgaattcgataggtaatcccttagatgctatacttaaacaagaaaattctttactaaagaggttaagctgaactatttcatcgataatattttgtccaggttaaaggtcattgaaaatgagtgttttgttattttcaaatggctcaacgacggcgtttgtttagtgtattccccacgtacgtaggggtgatcctgaatgattaaatttccgaatgcatacttggatagtattccccacgtacgtaggggtgatccctgtatgtgctacagtcaccctttgcgcattacgtattccccacgtacgtaggggtgatcctacatggtaggaaaagtcttagcggcacacgttgtattccccacgtacgtaggggtgatcccagtctggaggactaaacaatgaaaataaccatgtattccccacgtacgtaggggtgatcctagcgataactctgctccaaaccctttggcgttgtattccccacgtacgtaggggtgatcctcaagttctggtttagaactttaggaggtgagcgtattccccacgtacgtaggggtgatcccatcactttcggcgttggcattcatggcggtaggtattccccacgtacgtaggggtgatccaccagataccggtggcacgatgattcctcacgatggtattccccacgtacgtaggggtgatcccgaacgttttacccgctcggacagctccgtaatgtattccccacgtacgtaggggtgatcctaatctgatttcgctgcccgcctcagtaaccctgtattccccacgtacgtaggggtgatcctccttcttggtaatctctttgtattgctcaggagtattccccacgtacgtaggggtgatccttcttgaatctgttcatcccgcttggaatctttggtattccccacgtacgtaggggtgatcctcacggtgatagatttaccacgtgattggagctgtaatccccacgcacgtagggatgatccacaattacccccttattacctaccgtacgggggtcaagcatttagtgagcttataaatgaagtccactagtagaaaaggaggcaagtgtactattttacttgtctcctttttgtaaccgcgaaagttcccagggaaagttgatagccaatcctaacaggtggcccatctccggaaaaagctaacaataataatgcctgtgatgtcactcacacactcaaagaaagcgctataatgaaattgaattttatgccataatttgaatcactgtttgcaatcaactcggtagctaagattgtttctcaaagttcaattgaccatccataagtgataataagaaacaatataacccaccactaggaggcccacccaatgccaaccctatcaacaaaagccacaaccctctgggccaaaaagcgcccaaccgaaaacggcaaacaactatggctgccgctcattatccatctaatcgatacccaaaacgtcattaactacctcttcaaccaatggctctccccaaatcaacggagaattctagccggcaatttatccgacgaggatattcataagctgatcaaatttgccggtttcacgcacgatatcggcaaggcgacccctgcttttcaaactaaaccatcgtggggacacgatgatttacttgatgacgagttgatagagaaattaatccggaatggttttccagaactgaacgacattcacctgccatcaagatccgcatcaccccatgcccgggcaggtgaagcaattcttgataaatatgaagtacccgattccattggggccattatcggcggccaccacggtaagcccgaattttctcggcaaaaggatgacattaatgtgcacacatccaactactatcaatgtgaaaaggacccagtcattcaagccaattggatagaagttcaaaaagaattgatggactatgccctagaatcatccggctaccaaactgtcagccagattcccaccatcactcaaccacaagcggtcatcctggaaggcttattaatcatggccgattggttggcttccagtgaatacttgttggatgacgaagagacagttttatttccattaattgaaatcaatcaaacttatgcggacgttgacacaaccaatcggtttcatcaagcaatggccaactggaacttgaacggtgaatggcagccgcaaccagttgacacaaccacggatccgtatgaagcgcggtggggatttcatgcccggccggttcaagcagcgatgacagatgccattgaaaagacaatcgatccggggatggtgattgttgaagccggcatgggtttgggtaaaactgagattgccctgcttgcggcggaacaacttgcttacataaaaggacaggacggcatcttcatgggcttgcctacccaggcgacatctaatgcaatgtttgaccgcgtcagtgattggttgacgacgattgccaaatctcagggagagagctttccaatcaaattaattcatgggaaagcgcaatttaaccgtgattacacaagtttgcccaaggcttccaacgttggcgatccgaatgcggtggtcgttaacagttggttcagtgggaaaaagtcgatcttgacaaaattcaccgtcgggacgattgataacttattatcgatgggattaaagcagaagcatctttttttaaagcatctggggttcagtggtaaagtggtcatcatcgatgaggtgcatgcctatgacgcctacatgaaccagtacctctacaaagcaattacctggttgggcgcctatcacgttcccattgtgattttatcggcaaccttgccaaaagaaaaaagaaatgcgctcttgaaagcgtatttaaagggtaagtacggcattaagtaccagcaaactttccaagcgccagccggttggcaagagcagcaggcttatccgctgctgagcattttagatggcaatcagcttaaacaagttacccattttccgggccagagcagtcagccctcgactaaactccaagtctaccggctgaatttggatgatgctgacctcattcaagccgttctgaaaaagatcagtggtggtgggattgccggtatcgttgtgaacacggtcaaacgagctcaggcactcgccaaacttgttccagaggacgtcaaaatgatgctattccactcggctttcgtcgccactgatcgggaatctcaagaggaagcactccaaaaaacgattggcaagggtgcgacgcggcctgcaaaaatgattgtcattgggactcaagtgttggagcagtcgttggatatcgactttgacgtattgtatacagatattgccccgattgatctgattttacagcgggcagggcggcttcatcggcacaatatccctcggcccaaggcgcttgaatcaccgcaggtttatatcatggggattaatggtccgggcgattatggggatgccaatgagagtatttacccaaagtatttattgatgaaatctgactattttctggaagcaacggtgatgctaccaaatgacatttccaaattagttcagaaagtttatgaccgcacaactgacgctgagattcctcaagagaaaatgccgggaattgcgaacgcccgtgccgagtttgataagcatttggaccaagaaaaaagcaaagccaaggcctttcaaattgcggcgcctcagtatgctggtcatccaacgattcacaagtggctaaagcgcagccagtccggcatcgataccaatgagcagaaggccaatgcggcagtccgtgacatcagagaaacgctggaagtcattttggtacagcacaccagcaaaggtgaccgcttgatagacggtcggcggcttgcggatgttagctcacaaaacattgctcagcaggttattcgcctgccggcagcgactaccttagacattgatgcggcaatcaacactttggagtcactcaccagcacctattatcccgaatggcagcaggatatttggctgaaaggggccttggccctgccattagacacacatttgtccgccaagcttggcgattggaatctgagttactcatcaaagtttggattaagttattcaaaggaggacgatcatggctgataaacggtttaacttaacgaccgatccatggatcaaagtacttgataaaacaactaatcgggagcgaaccgtttctttgattgaattgttcaaaaatgcacaagacttttctcaactatctggagagatgcgctcgcaggatttggcgattttgcgcttcctgctggcaattttaacgaccgtttattctcggtatgatgccaatggtcgtgggtatgactggttagatgttaatcctgacacgatgcaggccgagatgaatgatgatctggaagacagtgaaatcaacgtttacctttatgaaacgtgggctcacttataccggtcaaatcatttcaccaatattgtgactaagtatctgaaacgttacgcggacaagtttgatatgtttggcgaccagccattttaccaagtaactgaaactcagtacaaccgactcgtgcccaagaagaaacaaatttctggcagcgaggggccggggacggttgctgtcaaacagatcaaccggttaatttcagaaagtggcaatacacccagcattttcacaccaaagtccgatgagtttaaaaatgacattcaagtggatgaactggttcgctggttgattatgtatcaaaacttcaccggcgtcactgacaagaccaagattgaaacggccgataagttctcggcgtccgctggctggctgtataagctgaatccggtgtttgccgacggagagacgctttttcaaacgttgatgttgaatctggtattgcgaagtgatgagcatgcatcagtgattcaacaaccagtctgggaatatgacacgattgatgcttatgtaaacgagcgaaaaaagcaggtgcaaccaactaatattgctgccttatacacaacctggtcgcgactgctacacattgactggagtgagcggggccaaccgactattttcagcgccgaactgccaatgtttgacagcgacgaggctttcattgaaccaatgaccacctggcgggaagacaagaagaccggccgctatcgtccagcagttaaaacccttagatctttgggaacggcgatgtggcgcaactttggcgaatatgtgaaggttgatccaagcgattcaggtcatgaggccgggattgttgactggttaagtgatttgagaaatcaagatgacagtgacgaccaaattatcaggggatccttgctaaccttagcatcggttggcttggtcagtgatggcaatgcgacttcgcaagcgccggtggctgaagtctatgacgatatgcatatcaatgccgatgttttgtttgatcccgatgaagaccaagcgctgcactggccgcatcgaattgaagaaatgattcagttgactcaaattattggatcggattattggcactttgcggcggatgttgcgcgaattcgtaacttggaagttcgaccgtttgccaatcaactgagtgctcaattttatgaaggtctcaataagccgtttaaagactggttggcagatttaaccaaccaagacgatcgagatgaaaagagcgaggagtggcggaagttcctgcgcaaatatgtccttgatgcagctggcaatgtcatgcaaaccagttcgtccagagatattggcggctttatggatgtcagcggcattattgacaagaacaagggcctcgtgaatattttcaccgtcaataatcgactgaaatatcgagttcaggttcatatgaatcagaattaaacaatggaaggtggtcattaatcaatggaacgcacaatcaaccagattacgtatgaaattattcaagagctgtacgggcacggcaatcctaataaagccgtccttgccagcatcagaagtgctgcttcaatgacgagcccgcgggcgcaaaaagtgtggccaatcatgatggataagttggaaaaatcaatgctgagtaaaaatgggcagccgacccatgcggaaaccgcaatttatgcggccttgcggctctatgcgattcatcagcaaagcagtcgggatgcatttgtctacggatcgtctggtagagatgcctcggcagatggcctgacatttttccaggcgctggcgaatttgcgaagaaatagtgacactcgcgaagcattggatcggcgggtgcaggcgctttttggaacgacgaatgttaatagtgtcatcaattcaatgactcatttgattgatattttgaaggccactaatccgactcaaaaaattgattatcccaagttggctaatgacctgtattggttccagaaaagctatcaggacgccacccagacccgtttgaaatggggacaacagtattatcaattcatcaaaccaacaactgaaggagagaaaaaataatgactaatcaaaacttatacgttgacatcaatgtgctgcagacggttccctcatcaaatatcaaccgtgatgataccggtgcccccaagaccgcgatttatggtggcgtcagtcgtgcccgagtatcctctcaaagctggaagcacgccattcgggaatcatttaaagccaatgatataaccaccggaattagaaccaaagaagctgttcaactgctggcggacaaactcaatgaaattgataccagcttagatgaagacgcagccttggttaaagcggcagatatcttcaaggctgccggcattaaagtcagcaaagacaatgaaactggcgcgctattattaatcagtccaggtcagattgaaaaattggctcaatacgccactgaccacgatgagttggataagaaagaggttaaaaccctgctaaagagtgataattcattagatttggcgctctttggtcgaatggttgccgataatccggaattaaacgttgaaggctctgcccaggttgctcatgccatttcaacccatgaagttgtgccggagtttgactactataccgcattggatgacctgcaatcagatgatacctctggtgccgcaatgcttgggacgattgaatataattcctcgacgctttatcgatatgccaacttaaacgtcaatgaattggctcacaacttgggcgagtctagtgcggttcagggagcagcggattttattaaatcatttctgctatcgatgccaaccggtaaacagaatacatttgctaataagaccttacccaattacgttatgatcaccgttcggacggatacgccagttaacttggtcaccgcatttgaagacgcggttgcttccaagcatggctatgtggcagagtcggtcaagaagttggaagatgaatatcaatcgaccttgagattcgttgatcaaccagtttcaacaattgttctcagtgacagtaaatatcactcaaagcttgatgatcaggctgccaatttgtctgaattgttgaaacgggtcaccgaggttttaacgaaggcggtgcaggatgaagacactactaattagattaacgtcacctttgcagtcgtatggaaatgaggccactttttccagaagaaccagtggcgactatccgtcgaagagtgctgtaattggtatgattgccgctgcctttggctatcatcgagacgattctcgaattactcatctgaataacttgagttttgccgttcgggttgaccagccggggacgacactgacggatttccaaacggtggagtggaagaagaataccagaaagattacttatcggaattaccttcaggacgccgttttcgtcgttggcgtgggtagtaacaacgatcaacagattgataacatcaaagaggcattaagacggccgcagtttcagctgtttttagggcgcagatcgaacgtccctgcaggggtgctcaaaatgacggttgtcccgaatgctgatccggtaaaagcactgcaacggttggagtggcaagcttcacgctggcaccagagaagatatttgcggcgtgagcagaaacagtatgccgaaaatgttgaattgatcgcagatgctaatttattgcctgaacaaagaagcgcgatggtcaaggaccgggtcgtctcgtttgaccaacggcaccggcaacatggctaccgggcatttgccactaagacgcttaaccgtgttaagctgaatgattcatacatccaaagacctgacactgatgtcgctcacaaccaggtggaaaccagccacgacgcattcgatgcggtctagaaaggagctcatatgtacttatcaagagttgaaattgacttaaataaccgccaaaagatcaaagaactgacccaccttggcgcctatcacaactgggttgaacagagctttccggatgagattgctgaacacacacgactgcggcatttatggcgaattgatcgactggccggtaaaagctacttattggttttgagccaagaggcccctgatttagaattgctgggggcttatggtgtcgagaacactgcgatgaccaaaccctatgatccatttctggaccggattaaggaaggcgagatcatgcagtttagattgaccgccaaccccgtccgtgccattagccagcccggaaggaagcaaccaagaatggttccccacattaccgtcgagcagcaacgaaaatggttgacggaccgggctgaaggccttggctttgaaattgttaagacggtttcagccgattcaatggattcagagggaaccgaaaactttgacatcgtgagccgagactggccaattttgagaaggggtcaccgaaccctccggcttagtcgagtgacttatgagggcttgctacgggtgaatgatttggatcaatttaaacagacgttgatgaatggggttggccgcgagaaggcctttggtatggggttgatgacggtgattccgagaggctagcggatgaagaggaaatttggcgcaaaaaagcccgagctgacagaattaagccgggtacgtgatcggattacgtttttgtatttggaacatgccaagcttaatcgccaagatagtgcaattattgtgactgatagtcgaggaacagtttttgttcccgcggcaattgtcagtgtcctgatgctcggacctggtgtggacgtcagtcatcgggcgatggaactaattggcgacgcgggtttgggagtggcttgggttggcgaacaaggtgtccgcgaatatgcacatggccgaccgttgaaccactcatcaaagttgctggaagctcaagccagactggtttccaatccgaaaactcgggttgcggttgcccgaaagatgtatcaaaagagattcccaaatgacgacgtgtccggtctgtcaatgcaggcattaagaggcaaggaaggcagccgggttcgtcaggtgtatcgcacgcagtcgcagaaaaccaacgtgccatggtctcgccgagagtataatcccgataattttgaggccggtaccccgattaataaagcgttaaccgccgcccatcaagcgttatatgggttgagctacagtgtgattgtcgccatgggggcatccgctggattggggtttgttcataccggtcacgatttgtcgtttgtttatgactttgcggatttgtataaagctgaaatttcaatcccggtggcatttcaggttgctgctgaatttggcgatgataaagacatcggtgctcgaacccggttggccatgcgggatgccttcgctgatgggaaattgcttgtgcgcatggtcgacgatttaacgagtttactgggggttactgaaaccagtattggtgcaggcgtcatcaatctctgggacgacaagctgggcttgcagaagtttggcgttcaataccatgaattcaaaggagatggcgactcatgatcgtcattactttgactaaagtgcctcagtcgttacgaggtgatttgaccaagtggtatcaagaagtccagaccggggtttatgttggtaacgttagtgctcgaatccgggatttgctgtgggagcgggtcatcaaagggattggtaccggtgaagccaccatggtttatagcaccaataatgaactgggttatcaaattaaaactaccaggagacagtatcaagttgttgattttgatgggattccgttgatgatgcgcttgaatgcggagacaactcccgtgaaacacgggtttagcaatgcatcgaagtttcacaaagcgaaagtgatggcccacaaagtcgcgaacaaggaccaccattctgccgttcacccattggtcgccattgatattgaaaccaccggattggatgttaccaaggatcgtattatttctattgcggctgtcaaacacagcggagatggggatcctatcagcttccagcaactgattcaaattgatcagccggttccccatcagataaccgagttgacggggattttgtcagaaatgctgactgaacaaggcgttagcttggagtcggcactggcatcgctacgtgattttattcaacaatttccggttgttgggtataatttgcattttgatgcatcatttctttctatggctttcaggaagcttgaccagcctgatttaagcaatcagatggttgatttgatgccggtggttaaaaaggttaaccaatttctggataattatcgcctggaaaccgtgcttgcagaatatcacatcaaaaattctgacccccatcgtgcgttagccgatgcgaaggcaactttgtccttagcgttgaagttgattgaaaatggcgatttgacgatttgagaatggctttaggacgcggtttgtttagtgtattccccacgtgtgtaggggtaatccgactataccgaatcgttcatgaaaaatcaacaagtattccccacgtgtgtaggggtaatcctatccacgccttacacctctacttctttggtttgtattccccacgtgtgtaggggtaatccttacgaacccaaatcgtcaaagcatctggcatggtattccccacgtgtgtaggggtaatccccaaacgcggaagtcttcaacgctagtgaatcggtattccccacgtgtgtaggggtaatcccatgtatcagcacattgatgggttaagtggttagtattccccacgtgtgtaggggtaatcctagtgagcgcgattgtagacttcatccaatcttgtagtccccacgtgtataggggtaatccttagtcatcgtttgcgtgtaagttgatgtcgccgtagtccccacgtgtataggggtaatcccatacctgcccgccgtttcctggaacggaccaagtagtccccacgtgtgtaggggtaatcctcggattgagcttgtcaaagaacaacaggtcaagtagtccccacgtgtgtaggggtaatcctgtggtcttcactgatgccaatgatatttaccggtattccccacgtatgtaggggtaatcctccttacgagaccccgctcgctgctcagtatgtgtattccccacgtatgtaggggggacctccaatccaaaccaaacaaaaaacgacttcaccaaccaaaggcaaagccgtttttcaacatcctcaaagatccttatttcaaatacatcgcccgcaacttagcaatatcggtattcgaaaccctgaggcccttattcaagaaattatccatcgtgccataatgcttcttcaccgccgagtaagtggcgttgatgtaagcaggtttgacatcttctagtgccttcactgtctggagttccttttgagaggcgccactcttcttcaactgagcataatgtttttcataaacccccttggttgccaaatagtcgtcgacaatcgtcagcttcttgacgccgagtgctgacaagatgaaaatcgttccggcacctgcccggtccttgccggctgaacaatgatacaagactgcggagttccctttattattcaaaagagtggtgaataggttgtgataagcggttcgagcttgtttggtagtgacaaaatttgtatagccctgttccattgttttgtccgtaatcgtctgatttgacgaagtattcacatttttaaagactggatccttgatgaagtcgacccctgccatggtgggatctggcgcggctttcatttccatgggagttcttaggtcgacgtcgtacttgagattgcaagttctggtaagtttctgctggtcggcctttgtcaaattggctaaactagctgaccgaatgatgcggccacttttgatcgtttttccatcagtggttcgatacccgcccaagtctcggacgttcatggcgcctttcaaatcaatttcatgcactttgactccctgggttgccacgacctgggcatttgctggagcaaccgattggatggctgcgcccgtagcggagaagacggccagtgccagggatgcaatcagaacagattttttcaatgtgatttcctccaaacttttttgattcagtgtttagtttacgggaggcgtgtaatgattttgtttgcataaggtaatgatttggtaaatgatgcttagcagattttttgctggataccagaggatcgtgaaataaaatggttgatggagctgtacactattgggataattaaaacggcagaatcggctgatttgtttcatgcgactaaataattaaggtcagatgctttcgtatttgcaagtcattgaaaatgagtgttttgtcattttcaaatggcttaatggcggcgtttctttagtgtattccccacgtacgtaggggtgatcccgaccgttaccaagtttgccacattggcgggatgtattccccacgtacgtaggggtgatcccttgccgatccacaaccgatgtaaattcatcaagtattccccacgtacgtaggggtgatcctagacaggtgcaactagagccgccgcaaaaatagtattccccacgtacgtaggggtgatcctcttccaagtgaggcggtaaggagcattttatggtattcctcacgtacgtaggggtgatccttacggtggcgatcacattgacccatacggctagtattccccacatgcgtaggggtgaaccttcacggtgtccagatttttgccggaactcccagtattccccacatgcgtagggggggtgatcctgctcgcgcgggacccggcttccctggacccttgtattccctacgtatgtgggggtgatcctgcgactaacgaacttcaaatgatggattcttagtattccccacatgtgtgggggctcctttcttgcaaaaaactattttcacaaacgcgttgggttggctccaaaaaggtggaacacattcagaaaagttcaagacaaaaattagcctctgatggcgcaacagttgtaacccgccgctcaagtccggcaataattctgccgaaactcaaaaatagcacctaaccagttggctttcaccaactagtcaggtgctattagtattttgcgtaaccatcaaccaatttcaaaacagatacaataatttgaaaatgccatatagatttcgtttctaacgataattgtctaacatcttaaacttatggttgtcttggaaatatgctccaacctttagcaacaatttatcattacccttagccgcctcaaattgaattcccagcggcattttctgcttgctaacatatgttggtaaactgattgccggctctcctgaaaggttggcaagctgagtgaatggtgtcttggtcaatccatgaagccaagcatcataaattgtttgaatttgctggttgtgatcaagattaccaatgtctctcagtttatcaacgtattgaggaagataagcaggatcagtattctttggagctgtaacggctgtggtaggtgttaaataaagtggatattttttgtgaaacgcagtcatttgccggttgaccagattcaattcattttgaacagttgtatcggcattagcaggttgcttctggtcagcttgataaagtgcccaagtcattggcgaaacgtcatcaaaagtcatgttcttgcctgtgacgctcttaatgagattattggcactggttcccgttccggtggattcgagatagtagatgtgcatcaatttaacgccatcaacgggagaattggcttttacaactttaaagccttttgatcttaagaatgaaacggcttgttttactgcgttgacagcatctttgctgacgggtgtgttaaccggcgatttagttgaataagcaattggaattttcttgatattctttggaacggatttcagcatcgcatcccctgagtgatcagacgttgctaacatgccattaaatagcgtttgcatatcctgaatgtttttggcatcggcaaaattaactgaagatggtgttgtatcgtcaccttcgatcacaccttgagttggtttcaaaccaatcacgccggtccatgatgcgggaattcgaagtgatccaccagcatcatttccggtagcgacaggaacaatgtcgtctgcaacgctggcaacagccccaccagatgatccaccagtattatcagcgtggttccacggattgtgagcaaccccattcagagctgagttggtaatgttaattaagccaagctccgggaagttggtctggccaatcacgataaagcccatcgattgcaaacgctgaacaaatgaactagtggtggttgccttttgatctgctagaggaactaatcctcgcgtatttgatgaaccaacgatcggctgtcctaaccctttaatcaacaatggaacgccataaaatggctgacccgtatccttcaagttggcagcttctttcattgcttgatcttctcgcaaggaaatcactgcatttaactgtggattgtcagctttaatctttgcgacagcgtgttcaatcaattgctgtggtgtaactttaccactgcgaaccatttttgccagctgagtcgcggatgaatggtaatatgtctgatccgaaatgttaggcgcagatatagtggttgaagtgattgacgagtcggctttcacgctaactgtgttagttgatgcaagcccaaacaagatcaaagacgttcctaacaagatcgttcgtcgtaaatacttcataaaattaacccgagtttccatggttgcctccctcaaacaaatttgttgtaccaaagaatatgctaagcgctttcaatgggatgtcaatgctatttaggggtcagcttctgattcaggttattgacttcaagtcaaccaatcattaggctaattaaggaatcacttgtttggagagttaaatttaagtaattttgcaaatacgatgctttaagccggttcagttggattggggggagtgtgtaaggatgcgttccaaaattggcatggtgatttatgattggcttattgtaattttggctttgttctcaatacttttggtggttttggattttacaaaaacgattaatttggatgctagcccatggttctttattgataatggcattctgttgatttttacgtttgactacttttcgcgtttgttcgccagcaaaaacaagtgggaatttttcaaacacaatatttttgatttgttggccattttgccgttttattcggtgtttagtttcttccgatttgcgcgagtgttccgtataatgagattagtcagagcgtttaggtttgtgcgattgattggttttgttggtaaagttcaaaagtattcgtccaaatttctaaaaaccaatggcttcatttatctgctttgggttagtttggcagtgttaatcatttcagcaacattgtattctcttgcggagaacgtttcgtggggtgaatcgttgtggtgggcagtcgcaaccgcaacgactgtcggttatggtgatatttcgccacatacccttgtgggaaagattgctgcggtgatgctgatgatggtgggaattgggattattggctcgcttacgagtgcgatgacaacgttctttaccaatcgagacaacgtggataattcgtccaagatttatcggaagcttgagatgattgagtcggagaatagggatttgaagaagcaattggataagcttgagaggaaattggataagtgattgaatcgcaactcaaagtgatgggaaatgagtgatttttcattttaaaacggcttggttgcggcgtttgtttagtgtattccccacgtgtgtaggggtgatcctacttcgagttaccagccttacggataccgtcagtattccccacgtgtgtaggggtgatcccaagcatatcaagtcttctcgcgggaacgcggggtattctccacatgtgtaggggtgatcctgatttgattcaatcatttcgttatcagatttggtattccccacacgtgtagggggtgatccttctccgcagggtgtgctttgcttcatcagtatcacagtaagtgtggattgattctaagtatctagaaatgtcgaggttcagtacgactaaataaatagtattgcactgactcattaacttgggtcatacctaatgctataaatattgataggagaactagcatgacaacaccaaaagagattttagttgacggtttacaagaatttgccaagaaagttggcgggaagagtcgcaatggtaaagagctttttattaccagaactgctgttacggatcagctcacaccagacggtaagcagtatacatttatttctttaattcgaaatgatcaacaagctagtggtccgtattctgggatttccttaaaagtaaatccgggtattaatcattatcgaatttctttagatatcggtagtgagggttttggagatgactaccaacttgtggctacccctggtacaagaagaaggtttgttgaactccaatctgtgatcaacgaatattctaaggagaataggaagcaaatttcgtgcttctgtgctctcaattttacagataatagcaataagcaacagttaaaaaatcttgaaaagcaattttctgatgataatatcaattctcatccacaagacttatttgttgtctatgttgataaaccaacgattgacaatggcattcatgaagatgaagatttttggaaaatatataaggctatggtcggcacgtattcagaaattcgaaattggccaaataaaggtgaacggtcaacaatcaataaatttaagaatgcgtttaacttacaggcttcttattccaatgaggatctcgcccaagtaaagaacttgctatcgcgtgaacactacgtcgttattcagggagcaccaggagtagggaagacttatctgacatctcaacttgcacaggagtacaacccccagaatataatttttactcaatttcacgctgaaacaacatattctgactttataggtgggtacaaaccagtgcagcttaatacgggattatcataccaataccaagaaggaccactacttaaggcaattcgacaatccattgcccatcctgaaaacaatgtcttattaattattgatgaaattaatcgggctaatttgagtaatgtgttgggggagtcattctacctcttcgaaaaatctgaattaaagaataggtcggttattcatctaggagaaccagcgaatgatgtggacacggctcgaaagccattatctgtaaagcagttaccaaaaaacttgtatgtagttgctacgatgaatactgcggatcggtctcttgctgttatcgactttgccctgagacgacgttttgcctggtacaccatcgttccacataaattggttaaatcagaactgcgaaacaatgaggactttcattctgacgagttcgatcgtattcatgatatttttcaagaatatgcgacatctcaggaactgatgatggaaccggggcaatcgtatttcattactgaaaaaggccagtccatcaaagaacgtattcagtatgaactattgcccttaattcgtgagtacctggataacggctacttagctaatgccgctgatgaatttaatcaattttttattgatacaattagtacatcgatttatttataggaggtggctcatgggcttagatacaaatgttccgattattgagctcaagactttttccgatacggaatatacgttacccaaaagtatgcgtggagatccacgttatcctaatgagagcaatgataagtttcttcagttgaaccaacatgcttttgaatttctaaatattgaagcgcatggaaagaacgggaagattcattttagaacaaatgaactggtaggtgccatccctataagaatgccaaataacggttcaggaactcctcagactgatttagttgtgaaaccacgctaccaatcgaatcaatctggtagttggtacgaatggatgtctgggttggcagaattttctaatcatacgttgattacagaacagaactcattattcccgctaactcgacttgaaggtagtccctcacccaaatatctgttagcaaaagaaatcattttaaagatcttaccagttctaagagaaaattcttggcggaaatttgatagtttgcaaaaagttgctaatcgacctgttggaaatgttgattgggaccaatacgctattaattcggtggatcctcaaaaacgattgatatttgaaacaagaataaattcaatatctgaagataatcgagaatttaggaatgcactggcttatttcaatgctgcagttcaagatttgcgttcatttgagacaccattgtctgtaaaagttcctttacaaagtttcatcgatcaaattcaaaaccggataatttctttaggaatcagaccgtcctgttctttatgtaatcagaaatttgctatacttcatcaagatccaacgtcgatacagaaactgaaacgagcaattaataattatattgacaacgagtcgaaacaagtgtttgcttggagaattgatttctccaaaatatatgaggattatgttcaaaaaattgtccagcttggcttggaatcagtaaagaataatgatcgaatttcaagattggcaattcctggctattcacaccaggtgacaaggctcatgccaggatatttggaacctgatataattgctgaatttggtggcagtaaaattgttattgatgcaaactacaaatcctacttttttgatcgccaattgaaagtcaaagaatcacaacgagaacgaatgcgttcagatgtccaccagattgttgcatatacgagtctattcaactcaaagatagcgatgttggttgcacccgtgatcgatcaggatattcggtttgatttaattcagtatggtgacgtttatgttgccgttattggattgccgctggaatggagacgtagtggagagtatgcaagacaaattcgaaaatttgttaggggtattcttgaacaaatgtaactgacggatacgtgtggtttctattggaacaatgtgtgttgactgttttacttgaaatatcatcttctaagtattttcaacatttctgaccaatatgtgctttttagagaactttgcgtttgagcctattccaaatatcgttgtgagaggttagattttttaccttttttgtaatttaatgggtaactagctcaactagacatggtatacttagttataaaattatgcattcttaatcaagtgagaatgcttttttgttggattaactggaagactatctaaaataaatggttctcaaactttgctatgggccatgacgtgaacgttttttgcccatttagaagttttactttgaagtctcacgatcttatgatattctattttaggtaataatttggtactctttttatataatgggatgttctgcgtgacgatttatagattaattttgaaattaccttgaggggaggtgattcacatggagagtaacagtcaaattcactcaaatggtcatgctgcatttttatctattggttgggtatcggctgttgttagcctatttatcccatttattggtgttttagcaattatttttggtattttagatattgttaaaagtaaatcaaagactgctgggattgtgctattagtatttgccattatcttcttataccttggtttaacagggtttggatacggcttttcatcatcgtacggttcataattatagaatctcagtctagttatgttacaagtgcattcctcaccggtgttcaagataggttcaactcctatcggggaagttatcaataatttattggagggaaacatagtgaaaagtaaaggaattaaaaaggcgggaattgcactaattattggattgtcattggggatcggtggagctacagctccttgtgtggttggcaatacaacaaatatcattgttgctagtgcgtcatcttcccggagtgctgcattgtctagcgcttatttttatgcacgatctgagcatatgtccaaacgggcaatttatcaccaattaatttcaaaatatggtgatggattttctaaacatgcagcaagttatgctgttcgtcatcttcatggaattagttggaaccataatgcactaaaatctgcacgcttttatcgacacaatgaacatatgtcaaataatgcaatttatcatcaactgatatcatcatatggggatatgttcacgcgatctcaagcacgctatgccgtacgccatctataaatattttatagatgaaaatcacgactccaaaacatgaaatctaacagttatttcttttttgattttctacgtagttttatgctatataattaagttaatttaaaatgattttagcatgaaacaacaaggggatttcaatatggaatataatcagttgattaaggagttaactgccttcagagatagtcgtggctggaaccagtatcatacactaccggcattggcgcgagctgtcggaatcgaatctggtgagctaaacgaactattcttatgggatatggaaaatgataacaaattctctgagaaacaaaaacatgacatggaacttgagctagccgacatactgacatattgctactatatgtgtgataagttgggtgttcagccgaatgacattgttcaggaaaagttagatataaacaagaagcgtcattggaaatttgatgagtaacattgaaggtgtttgtgatgagtgatattggctatccgataatcgaaaaaatcaaatatgattcccaagctgcaactaatctggaagacgccatcgatggagataagctcaagcgtaaattacttattgagtatccaacggtctatgtaatctgctcacccataaagtccggcggatttaaagtttatgttggggaaactaacgatatcgagcgaaggacagaacagcatttaaatgaagatcccaaagttagggatgattggcgagagctttcacacgctaaagatgcagaaatgtttgttatcggacatgatcacttcaataaatcgttaacactagatattgaaaatcaaatgatgctttttatgcttggtgttccaaacgttaagcacctgaataaccggcgtgaaaatgagcaaaacgaatactacacgtctgacgaaaaggacaaaattttctcccgaatttggcgtaaactccgtggattcaatcaagatctatttccagttgaaaggattattcgtgactctgccatttttaaggcatcaccatttcataatttaacaactgaacaaaaaaacgcccgggatctgatcattgatcgtgtaattgacgctttgctatcaaagaaaacgggtcagctgatcttagttgaaggtgaagcgggatctggaaagacagttctgttaagcaccatcttttatctgatcagtacgttaaaggatgacggtagtccacttcgccaaggattcgacaatctgaagaactatgttctggtcaatcacgatgagcaattgaaggtatacgaagacatcatcaataagctgaatttaaattataaaaatgatgatgttgtcagtaaaccgactcactttattaatacccatgacgaaagtgatcctgctgatgttgtgctggttgatgaagctcatttattatggactcagggaaagcaggcttatcgaggtaaaaatcagcttgatgatattcttaagcgagccagaattacagttgctatatttgaccgcaaccagattttgaaaaccgaggaatatttggaaccgcaacaaattcagactatagaagaaaaagcaatggaacaaaacaatttgattatgttgagtaatcaattgcggatccatgctaacaagcaaacgattgaatggatcagagacattactgataaaaaaatcatcaaaaaaatccccagggatagtacatatgacctgaggatgtttgacgatgcaaaagaaatgtatgatgcgatccgagagaaagctttgggagaccaaaaatccgggttgtctcgaatcttagccacctttgattggaaatacaacagtaagagaaaacctgaggatggcgattactggatggtgactgctggggatttgtcgttgccgtggaatttgcagcttaagcaaaagggacgctcactgaaaaagctggcgtgggctgagcagccacaaaccattgatgaagtcggttcaacgtatactattcagggcttcgatttaaattattgtggtgtcatcattggaccatccgttaagtatcggaatgggcatgttgtttttgacccagatgccagtgagaatactaatgccattcgaaaccgcacattgcaagatggtaagaaacgtaaagttgccagtcagctgttgcctaatgagttgaatgttttgttgactcgtggagttaatgggctttatatttatgctgtggatgatgagttgagaaatatattgttgagatcacaataatagtgtacttcgggtgatgatcgagtagacgctaaagggaggggaaccttttgcttggcattaataacaattttgtaataactggagattggggaagttcatctgacaatcttaatgtttcgggaacattaacctttaaaagtggaaaagtcacattggtaacagtacaacgactatcccttaataaagattcaacaccaagtattttcggtattggacatataaaagttgagggaataaatactgatgatattgtgatgatctctttgctgggagttgtagagtctaagaattatagtaaaactaagttctttcctcataatacggcaatacagtcttctaattatgaatacaccgcactcagtatgtttacaggcgatgtgtttgtttcaaaggatatagtcatcagaaccgtcaaagagtacccaactaatttttctgcgtggatgcacagcttacaagactttgaacaaagtaaagaagactcaggggttctacaagtctcggctaaggagaatcagggctatgttatcaagtctaaagatggcaaaaaaacttattcttttcgccgttcactagttccaacacaacagaatcaggtgaaccagattaatcggactattcaaataacagatttttttcaagtagatgatagtagtggaatgtcgttagaggaatcaatgacgataggacccatggtatccagttggtatcagttaattacaaataaagatgaaaacatttattgtaactgctttactactgtgactggtgaaaacatcactttctttaatctttccaagagcgtatcaattcaacaaagagattactctcgagaaacgaccgttttgagaagaacaaggcagtggaaggaaaatatgctttgctcactagttaattggattcgcagttatgaggtattagccccaatagcaatggctatttacccacctcaaactctgtctgttgattttcgaattcaaacagagtgtgtggcgatcgaaacaattgttgataattattataaggagataaagaaagcatattataagaaaaaagtgtcttactttatggaacaggtggatgattttgttactgtcgatgcatttaaaacttttccagtagcagagaatgtggattctttggcagacaaaataaagcagtatcgaaatccactatcccataattatttgcaggccggaataaaaccattggaagaaaaggtgttattattcaacgttttaaaagctatgataagggactggacgttgaatataatccaaattgaccaaaaaagtattaaaacggattttcaaatattttcttccatcccaggacgcgttattaaagccctttaggggattgatgatacatgtaacttctatttgatctcagaaggatttcatataatcactctaagtcattcctaatgcagtcaatgatcatttacccaacatttaccccaaataaacaaaaaatttaccctcccaatgtatcctaaccatgtaggaaccccgcgttccgcacaccacatacattgggagggtaatctcatgctcacaaaacactcgttgttaatgaaactcatgctcggctcagtcaccgtcatcttgtccagtaccgcgatactgaccactcacaagcctgttcaggcgaagtcgcaatcgtctgccaaaattgaaaaactgctcgcacctcacaaagccgactacggttactacgttgaccaatacctactaaatcgcaaagaaaacgataccccagacaccaatccatccacggcgctattcaccaacaccttcgccaagttctacaagggggacggcaccaaactcaacccccagattctccaagaaaatatcgacaaatcaatcaaaatttctgaaaatgttaccccagcagaagaacttcgctcctacatcaccgatcgccaggacagcccctacgatgtaatccgcggtctgggaccatacgctgaggcgttcatcgaaaattccaacgccaagacattattctacaatctaccaaccagcgaactgccggctgacaccaaagacgatccgggatccggcattacttgggctgatgacagttccaagctgggctcgatggtcaacttagtggacaccaccgcgctttggtactactcctcatccgggaacgccaagcagttctacaaatacatccggccattccggcaggatccgcgggtgcaggtcaatccctatttgaaagcggcctttgatgccaccccgcaaaacgattacgatttcccaagtggccacaccacccaggcctgggaaaccggcttatcgatggcctacgcctttcccgagcgcttccagcaactggttacccgctcgtctgaagtcggctacgatcgcatcctagtgggccgacactcgccgctggcagtcatgggcggccgcattctcggtaccgcggtggcggcagccgttttgaataatccgcagaataaacagattgctgacaaggcgtaccaaaacgctcaaagtgtcctgctgaaatcaaacgtcaccaagtccaaggatgactataagaactaccaaaccaatttgaagaacttcgagtaccggatgacctatggctacaagccgatttcttcgatgaaggaaaagatgcgggtgcctaagggtgctgaagtcctgatccaaacccgtttcccatacctcaacgcaacccaacgccgtgaagtgctctatacgaccggattcaaatccggctacccgatgggccaggatactgaaggctggggtcgtttggatctgtttaaggccggcgccggatttggcagtctgcttggcaacactgtggttaacatgaatgcgaaacgagggggattcaatgttagtgatacttggcgcaatcatatttctggtcgtggtgcactgattaagaaaggcactgggagcctgactttggagggcgcgaacagctatcaaggtgggacgtttatcaagggtggcacaattgtcgctgccaatcagcgggcacttggttctggcagttttaaattatccaatggcactctgcggctgtccgccaaaacggttaatgtgaagggcaattacacccagcgtgagcgtggcgcacttcagcttgctggcaatcaggcattgaacgtcaaaggcaacggccatctttccggaaaattagtcattaacttgaagtcccggctgactaagaatcatgttttgatgaagttccatacccgttccggcaagtataagcatgttaccatcactggtcagtacagtcactatcatgttaagtacacatcaaacagtattgtgcttgttaagtaattttcacaactgatagattggcacattagtcgataggatgtgtctaattgcaacccacatcaccctttaaagttgacaaaactgagaacaaatagctgattccaaaatgtggcgtttcaggccacgtccagatactgccagtgtttcttttgatcgaatggaacaaccacgccgactaaccaaaataagacggtgattaaacaaacagatatcaatgagtaacaggcaaggactcgcggcagccgaacgattggcgtgcaggtccttgtttttgcaatttatgctatttggggaacatgtcggtaagataaatcatccgtctcattttaggagttcctcaatgacaaacctttctcggtggattaatagtagccgataataaatactcattttcaataatgaatttcagtgtacagttgcagcacgtggcacaagacttatgtaagacaatgcggtgatgagagataaattctcaccaccgcattgttttaaaaaatgaaatcaatcacgattgaatcttgctgatgtttcatttagctgcggaattttcttaactttccgatcccaagtaatcctaacagcgagagcccaagaagcgctaaccagttggcactgtgtgtgtcaccagtttgtggtagcattgcggctcccttaacgtttaaatcttgttgaacggctggcttaactgtggcatcagtcgtactgttagcgtacttgaatgttttaccacgctcacctgatagtgcctgcaagctggtcatgccacgtgacgctgagttagggttgaccttgaggtaaagtagcccttcctttttaccagactgagttttcttgtctgatgagctggtggcttccttctcgtcgtccttggcaggtaatccttgtggttgctccacaatgtcgtcaggacttggaatttcggtaactggtggttgtggggtgggggtttccggcgtaggtgttggtgtcggagttggtgtttctggcgtttctggagtcacaccaggagttccgccaccgttgttaccaccgccaccaccacctggaggagtaaccgttttttctaccttaacaccgtagcgttcgttgactgcgtatgtgtaaaggggcgcttcagatttggcgtagctttcattcatcccgtaaatgtatgaggttttggcaggggtgatcttgacaccatattgggtgttttcagcgtaatagcgtgtacttccgccaccttgtggcttataaaaaactgtatctggatggaaattttgattgtcatgagccgattttacaatataaggcgtgttgttaaatgtcatgaagtcggagccatctttaacggcggatttgatagcagcctcttctaacttacttccaccttttttcaataatgctttggtttcagcaacggcggccgcagcattatattcattttgttcttccggtgataattcgactagatcacctgattcagaatcgtatttatagacatatccatcgctgccaatgaacactgtgtgaatctcagttgcattcgcatcacttggcttcacgtaatccttttgttctgccgtttcatgggtaaaggatgaagcaccatttggaatcctatcttcatcatcttctgtgatcactttatacttattccaagtggtgagttgggatccttcagcaatggatgcttcatagtccctttggaaatctgttaaatcttcatcagttgtgtatccaacctgaagtgcgccagcgcggatggcttcatcgatatcgcttgaatcgacggggatgtcaaatgcatcactatctggattatacgaaaagtaagacggttcaccagttccattatcaaattgggcgacataaactggaacagcttggttaggcttgttgccatcattcttgaagtaatactgtacaatcattgccacgccgttgtccttaataacttctggtatgttccgtggatcatttgtatcgtttcggacaatcttatatgagagaacgttgtcatccccatcttcgacggccttcaagaaggcagcagtgctatcttcaccaagcagagttgtttgtacgactccggcatcatctgctttattaatttcatcaattaggggatcattgttctcaagtaatctatatttacccgttccttcgggatcatttgcgttgtccggttcgaataaataatgttcgatcgttgtttcccgcgtttgtgggttaatggtaacctgacgataaatgatgttccggcgatcatcttgaccagttgcgtttttccataaaacaaatgtttctttgacttcttcagccttattttgcttggttgagttggtatcagcctttgcggtctttacggccttcttatcttgcttaggtgtttgagaagttgttctttgtttatgctttgatgtggcggttgtccctttagaacttgaatgattagttgtttgggtatctgtctgggttgcttgcgctgtttgtgcagcagtctgttgagttgccgccgatgtctgttccgtcacaccctggttagtcgtttgttgtgcctgaggggcctgttgggtttgagcagtgacagtcggttgctgagtcgttgtctgtgttgtctggtcagtggttgcttgcggtgtctgagtcacagttgctgattcagtggccgatgttgtcggcgttaccgtttcttccgtggcttgtgtgtccattttcccagtgccataggcttgtggtgtcgatggatccgttgctgtctgctcagcctgagttggggcttggaacgtaacttggcctgaatcggtgttagccgaagttgttgctggttgttgagtcgtgggggttgttgcagtggttggtacctggtcgtcagcgtgaaccttcgactggtcgaggccggtagtggttgaaacacccaccagcacacctgcagctaataaaagctggcgcttcaattgcttgtttgaatgtttaatcataaatgaatcctccaaaatatatataagatttaggtacggggatcacattagcaaatagttatgaataaagtttgaataaagatagaattaaaatctgatttgtaaatgtgcaagcaccacgtagtccaaattcttgagcaataaagccggcatggctgccaatccacgggcaacatgaagcttcacatccggttcaggaagcttgaatatgttaccatcaccggtaagtacggccaatatcatattaagtacacgcaaaatggtgttgaactagttaaatcctggctataaattaagctggtacatctggggggattcaggtgtaccagctttttggttgggtcacacagaatggccatttccgattccccacttatagattgaatgattgttgactttctcacaaaaaaatctaccaaatgtttggatgaacccacaaacatctcatagtgattatgtcataggattgttggtgaaagatagttgaggagtaatgacagtatgttcaatgtttgaaggggagttgatcatatgaatcggatgacgaaaacactattgtctgttggcgcgattttatttggtgtgacctgtttggccggcttttcaaccactacgcaagctgcgacagttagtccaccgacgacctcactggcccagccacaagctctggctgatgaaaatggcggccagctcggcgatgtgacttggaagattgaaggggacacgctgacactgagcggcggcaccctgcccaatttgggtaattctgattatgattacccgtggtcgcattccggtaccccgtcatcggtcaccaaagtggtgattgaaggtggcttgaccttggaaggggactccgggcagggtctcttcaaggatctgacccacgtcacctcaattgagggcttggacaagttggtgacaaccaacaccaccagcatgcagaacatgtttcttcgtgactatgccttaaccagcattgatctatccgcttttcacactgaaaatgtgactaacatgagcgacatgtttggcgaggatcatgccttgaccagtttggacgtttctcaatttgaaacgggtaaagttgagtcgatggacggcatgttcgatggcgataacaatttaacatccttggacgtttccaactttgataccagccaagtaacagatatgggctatatgtttgatgaggactatgaactaaccacgcttgacttgtcgaactttgatactcgtaaggttgaccagatggacttcatgtttgcccaagaccacaagctgaccagcatttgttttggtaaattatttgataccgccaacgttgtggggatgacttctatgtttgaggaagaccgtgctctaaaagccgttgacgtttctcattttgacaccgcaaaagtcgaaaatatggatagtatgtttctcgacgacgcgtccctgtcatcactcgacctatccagctttgacacagatcaagtcgaagaatacggcttagatgatatgctgaccggcgccaccaacctgactcgattggttctcggaccccaagttgaattacgagacggtgttggtctcgaagctgccaaagatgacagtgattggcaagccgtcgctaaaggcaccattgagcaaccgtctggtcaaacctttgatcctgacagtctggtagaaaaatatgcagccgccggggttcccaaagaactgtatgttcccgaagatggtttcaaagatcaatccaaggtgaccgtcacaccaagtatcaccttgtcactcggggacaaatttgatgcgaccgagcacttcatctctgccattacacctgaaggccgttcggttacgaaatactgtgatgcggctgctgaagggctggtcattgatggcggtaacatcgacacctcaaagctgggcacttacacggttacctaccacttctatgggagtgatcaaaaggcaacgatgaccgtcacgatccctgccgctggtggtggcggtggcggcagcgtcactccaccagcaccgatcaccccggcaccacaaccgacgccaacaccgagtccagcgccgacgccgactgaacccactaagccgacaacaccgaatatcccgaactatgcggcaaccaagaaggcggcagtctatgccctcaagaccatttacctctaccaaaatccaactttcaagaaggcgcagcgaatggcccgttatccaaagcagaagcggattaatcgcccaatgtttgtcgtgatcgattacgcacggtcaaatggtggcgcacttcgctacaaagttcgtgacgtcaaccaccacagcaagaccgatggcaaaatcggctacatcacagccaagtggtcccatgttcgtccggtatactaccgttcaatgccaaagggcaacgtgattaccgttatttccaagaagggtgttcacgcctacaagaacaagaatttaactggacgggttaagtcatacaagaaaggcacgcacctgaaagttaagagcttagttaagcacaatttgaccacccgttatgtattgagtaatgggtaccatgtcaccgccaataagaaattggtgattcaggggaagtattaattaatatatgttaaatagacagatccaatgcggatctgcctattttgggactaattttaggaataccagcttattgactgtcgatttactaaatccatttgtctttgaaccgccaactcgatacaatatctgtaacaggtgatcgcacaatttaccacagttcatgactctcactacgcgaagggacattcagtaatgaataaagatgatcaaaaggaactgattacaaagattaataaaatgcaaccggaggaaatcaagaacttcgttttgcgactagcttctctggatgataatttggccggggttattttgaccgtattaaacgatgaaccaattgaggcttctcatccagatcgagaagcaccgcttgccaatggcagtagctttaccgaagtggaccaagaggccgtcgaaagagatattcgccgtatccgcggattagtttccaattcaattcgggaaactgttggcaacacggattatctaacaccaaagaagactgaagagttgactgagttttttaatcacttggttaagagatttcaggatgggtataagtctggtgagatgccgattgaacttacggtaccgttattgctaatgctctaccaaaatcagattcagttattacctaaagtggttggtcgcagggatacctttgaggatggttgcaatggtgtgctctctgctctggaggaagtgattggtaacggcaactcactgagcgcgaataagaaaaatcggttgatgcagcaagtcatcaagctgtttaagaaaaatatctttcaaggttttccacaagaaagatatgatttgttctacgcgactttgccattggtaaccgaggagaccgcaccaaagatgcttacggtttccaataagcttaaaaagcaagccagcatattggatatgatatatcttgagtcaaatcagattattctgaaactccgaattgcgctcatattggggcacaaagacgaggcccagcaaattattgacgacaacattaccaatgacaatgtgcgattagaatatgtctcaatccttgaagcacagaaaaaatatgccaaggcagaagaagtcattcaagatgcgttgacgaacaatgtgggtgatcgcagaatgtggcgatttcaacttggccaaatctatgaactgacaaatcaaattaacaagttaaagcaattgttgaaggatgacttgatgtcaggaaatatccaggtatataaagaatataaggacttgctggttaagaacaatgaatggaaacatgagtatccacagttattaaccgagctagaggacaatcttggtcgatacgattattgcgaaatccttcttcaagaaaaagagtacactaaactgattgatcaacttaaaaaatacaatagcatggtcatgatcaggaagtatgctccagagatttatcaatctgccaagattcccgtgaccgacttatatttaaaatcagtcgtcattcctcagtctaataagaagacggtaaccgggccagcccaactggcaagtgatattagcaagttcctaaactttagcggcgaccttaagacaactaagaaatgggttcaccaacttagagcccgacttggtgataacgagaaattccgggatgcatttgacaagatggacgattcaattagtagatattccccacattcggggcgatcattatcagactaaaataccactcacccgtaagttaagcatactttgatcacccgttatgtattgagtaatgggtaccatgtcaccgctaataagaaattggtgattcaggggaagtattaatcgtatgtcaaaaaggcagatcctagtcgggtctgcctttttgtgtgttcattgaactggtttaaagatcagtctgcggctaacagttatgtctaatttggtatgacagcccctcatcaaaattcaagtgttccgttatacggccaacgttgtgaagaatgacgacgataatccggtggagattaattcaatttccaaccagtatcagaaaatcagcgattatgacaaagcgtactaacaatattcaagaagaggcatacccccaaggtaatcacataaaccttggaggtatgccttttctcgaatttcaaatgtgaacaaactaagctttcacgaaatcaggattctggtattccggatttggataatgatagaagccttcgccggtggcaacccccagcttgttggctttgaccagttcattgagtttatcggcaatcttttgataagtctcgtccttggtattctcatagaatcccatttcgatgttgacggccgtgttgagccccatgatatcaagaaatccaaacggaccgcggtcgactcccatgctgaccatccagttcttatcgattgaaattgggtctgagaacccatttgcccacagagatagtgcggcattaatcattggcaggaaaattgaattcatgatgtacccagagatttcttttctgatcaaaatcgggatcatgtgaatttgtttggcaaaattttcggcatcatcaatggtcgactgaggggtgtcaggggcccacattatttcagcaacattgtgaatccaaattaaattagcaaagtgcattgccataaatcgttgcttgtttggcacaaaatcaatcaattgacttggaactagtgtcgatgaattcgtcaacaatagcgcatcgtcggcgataaacggtgccagattcttgtaggtcgattccttaatatcgagtcgttccgggacggcttcgataatgacgctggcaccagtgacggcagactttaaatcagtggtgagtgatagattactgttggcggtgtcaatttgggcatcggtggcgttgatgtcctgttgatactgttttggataactggcaactttttgcttggcactatcgacggcttcatctgaaatgtcatagatgacggttgggaaccctgaaaaagcggattgataagcaatctgacttccgagaaccccgccgcccagaatgacgactttattaacgttcataatatccatcctttcttaatgcacacatattgtatgccggaatggaagcggttacaataatatatttttaaatttttgagtgggactagtcagaaacgacaaaaaataaccaacggcatgatcccgatagaatatcaaaatcatgccgttgaagaaactgcagaacagttttaaatatttaattgtctactcgaccgggagtatttctgctccaaattaattggtttcatcggcaaatttatcataaagttgagtgaagttaatggtacctaatccacttgcctggttgtaaatcttgccgggttgaccggtgtagtacaaattattgttgttatcagcgtcatcgaggacgttaaacgggctgtcggattcctgagcaaatttgtaaatttgcggattccagaaaccgattggggtttggcggccgctgttcatcacagcgttggcaccagccatctgtggtgaggtgtaactggttccgccgccaatcagccattttgtgcttgggatgcgaagaacctttttaccctttagcactggattttttccggtgacgtaggtcgcatacccggtttgcaaatcagcgttgccggcaacgtcaggaatgttgcgtgagttgccggttccaaaaatgatgtggggatgtttggtgagagtgaacttgccgtttttatacgttagaaggttttccgctctaaacgtattcacaccggaaaccccttgttgataacgaggggtcgggttcaaggctgagaagccgccgccaccgccgccaaatatacccatttgcttttcctgggcggtttgggcgtaggtgtctccccaagctcgttccttggaaacggtaatgaccttattattcagaatcttctggtatggcaaggtggttccgcccactaagacctgataaggggaagttgacaaaccgtggttttccttggcactcggttgactaaccgggccatagtcaccactggcctgaaagacggtaatgccttgcgctgcggcctgttcatacattaagttaaacgcgtccgaagtttgtttgaccgttgcacttggatcgccccagtcggcggtcacttcaggagcagccgagaagcttgatgaaagctgcttgtcctggttgtcggaaatggccgacatcgtaccggtgtagatcgctgaagggtcagatgtatttggattggtgtcatcgccaatgtagagatcaatatctgcctttggggcaaccgatgaggctgattccacatcgaccgtcgtttcggtctgcgggctgccgaggagatagttgacgctcttttggacctcggcctttggattgacgaggtagtggtggtgaatttgactcacattagcgtcaatgccggattgcttccagtaagttgccacgtcaccgtcatgaatgtcgctaacagtgataatgccgatccgctgaccttgaccctgaaggcccttttgatacaggggatttagttggtaggctttggcaaactttccggcaccgtacttcagtgaaaaggtgtttgctgaaacgttggtgttcggctgctgactggaaatcggcaaatcggccattaatgcatgggaagcagctgcttttttggttgttttcttagcagtcgtctttttagtcggcttttgcgcatagagcccaattacggcaaccaccttactcgacaaattgccaggcagcttatagctggtagtggcttcgtaacccttcttggccggtttgacatactttgcgttaaaagccttttgcatgtttttcggcgtggcagtcagcttcattgccaagttgccgggatacgcgtaactgcgaatatgatatttgttgagatagtctttaaatgactgtatatagctggtggattggccaaatttgtcggcaaattcactcggcgttaagtaatgatgatggttgggacttgttggatcgaccgtgtcgtaaacgtagttgctcaaatcagcctcgctggtactgggcttgaacgtcacgttgacgacggtccgtttaacggttgccgcctgactcgcagatccgatggccgcactagctcccaaaaccatcaggccgcttaaagcggtaatgacaaaactttttcccctcaatataatcactcttttcttgtgttatctggcttcaattataccaatctaattgtgagattacttgaatttaggctggtttcaggggttagttaaccacttttgccagccagtacccaaaacgtgcgatgatggtaaaacatattaatatcataaacagcgcaaatcaaaaggcttggcgagtcaacacactcaccaagccttgatttgccccttaagactcactaaatttaaacttcgcaggatcccacatccgcgaatgcccaacccgatcatacccatagtgaaaattgatgtaagggtaggggtcatccggctggacgtccttgccgatcatcagcagctgggattggatgaagctttgcacactgtggccaatgatcgtcttgtttgcattgctgagttgctggaaattgtcattgactttaacaataaagccgcgccgcttatcataaacaattccgccaacaaatagtgaccaagcataggcatcctcgccattttcggcctccttttggtcttgaatcaactcatcatccagactttggttaaattcatcccgttcttttgcggacaaagcggcgtacggatcttcgtcgtcatctgattccgatgacgcgggttcctcggcttccgtcgattcatccaacgactcctctgacgcactggattcagtcgctgagtcggcttgctgactggtttgagtcgaactggaattatctgactgggttccgcccgtggccatcccaatcacaaataacacacagaaagcaatccccaggtgcttccagccaaacggtgcaggctcttgcttctgccgtttttggtataaataaattgctgcaatgataaggccgatgtagcccaatcctaatagtacttgaagaaattccataaaatacctccgaataaagtgacgaataattgcaaatttaattgctgccagctaggccataccatatagatacggcacaaagctcgtttatcgtcattatctctaagaatttcttaaaattacagtttaaactctggatctgggcaaaaatccgcccccggcgacgacccgattcattaacagtgttacaatttctttggcgaaccaatcaatttgaacaaggaagatgaaaatatgaataccaaaaataaattaaaggcaaccttactaatcgctgccggagcgctcttgctgggcatttcgacgacccagccgaccagcgccagtgccacagcatcatccactaccagcaccactaaatcaacgtccacccgttacgatgcccaaattatcacaccaaagtcacttgcaagcggctaccaaatttattccaacgtccctggggtcaagaacaccaccggaacgccaacgactacaacagacagcagcaagtacaacaaccaatacgtccgcgtgatgcagacgcaaaaggccaagtcggttacatatgcacaaatccgcctcaatggtaaaatcttgggttggatcaacgccaatgcacttaagcagacttcgtttaaggcaatcgcccaagccaccatgcaaaagtacaacgccgtcggcagcgtcctggtttctcacaacaagagcctgcaacccactttggttaacaacggctatgccaatatgctccacagcaccaagaataccagcgatgggtcggttctctatccactggcctcgcttcaaaacaccatgactgcagcaatgatccaacaattgatcaacaccaagaagttgactgccaccacgactttgagcaagtacttcccacaagtcgcccacagcaagacgatcactatccagcaactgctgacgatgacttccggcatcaaagggacgatcaaggcgcctgatgatcaggtcaccgaagatcaagcctacaccaacgccattaaggctttgaagtccaccaacaaacacagtttcagctacagtgacatcaactacgttctgttagctggcgtcatcgccaaagtcaccggcaagtcgtacaccaagaatctccaatcacggattttgaacaagctgggcatgaagaatacctatgcgattaacgaaacccaaccggatttgacggcgattaaggcggtcagctacagcagttctaacggcaatgactaccagaactcccagtcggtttcctacccggctctttcagcgctgcccggcgccggcaacgttttgacgacgccaaatgactactacaagtttgttattggcctgcaaaacggcaaagtgctgactgccaaggggtatcagcagctaaccagttacagcaccaagtattccggtgggatgtacgttgatcaaaaagggatgaagtccaataacggaacttatcccggcagcggatttaacaccggctacactgcctcagacggcaaccagcacgtcgcagtggtcttcttgaaccagtcaccactgaagaacaacatgacggcttcggcatttcttgccaagatgaacattgtcgctacttattactaaaatgttaatcattaacgcccttgattgagagcatccaaatgcttggaactcccgatcaggggcgttttgttatccattcgtttccggaattgttatgcggaggcgataacttaattattaagatttaagaagaaaaaccatgccaaaaccatcaccgaaaattaaagaaattctcaagaaactaaaacttagctaaagggcggctgaatttcctgcgaaatcgttgccatttatttcggtttgttcataatggacttaattaaatgttactggaatattacaaacggtttacagccgtgtttccggtttttaaaggggggtgagcccatgaaacgggggcgcacgtacttatacataacactgattatcctggcggttgttggtactgtgggcggggccatgtactggcgggctaacaaccaggagcttcgaacgcaacaagcggccaaacgtgccaatcgccgcaggcaggagcagcagctcagctcaacggctaagaagcgggaggcaagcacacaaaagtcggcgccaagacagattcagcacaaaacgacccagcagaccaagcagattaccagttacctgaagcggaatcactttgtcggctcggcgattattgtcaaaaataaccacattctctaccagcagggcttcggttatgccaattacaaatcagacatcccaaatacacccagctcggaatttcaaattctatccattcaaaaatcactgacagcggtaatggcaatgaagctgatcactcagggcaagttgtcattgaacaccaagctgtcgaagtactatccaaagattgccaattcccggaacatcaccatccgcaatctaatggatatggattccggtttgacgatgagtgaggccggttcggtccgcacactgaatgaagaaaacgtcattaagtacgcggttaaccacatcgtcactcgatcaccaaagtataaggactggtaccaaccggtcaacttcgtcgtattagcggggattatttccaaaattacccacaagtcatacggcaaatatttcgatcaattgtttaccaaaccgctgaacctcaagggaaccggcttcgttcagcattggggcactcgaccgaaccggacgcttgggtaccactggttggcggctaaccaactgaagcaaaattacagcaggcagtatcacgaagccaaagcatcgatgcaaaatgaattgggcaccggccaggttttcatgaccccatttgacctcttcaaggttgagcaggcgatcctcaaaggaaagattattccgaaagccagtgtggccattttgcatcagccgggtctcaatgccccgtatggcggcggtatttataaccagcaaaacgggattcgctcccatggcattggctacggatatgaatcgtcattgttcatcactcgcaatggcaaatccggtgtcgttttactcagcaacgactaccggccggccaatcagattcaaaacttagccgccaggttatttgacgacctggcaacgtaaaaattgaaaggtcactttgattgaaagcgctgtaaaacaagatattatatgggtgacgaaacgttacccatttaacaagggggatgatcatatgccagtacgacaatggttgcaaaagccgtgggtgcgctttacgatcacgacgctcatctacttttcgatcatgttggttcttttttacctctacgactatagcggcattaatcaagcgaaatttatctataacgacttctaagggggaacaaccagatgattgaaacgctcatttcaacaatcgattcacatgcacaaaaccagggggataaggttgcttacgcctacgatggcgagaaacacacgtatcaagaactcaaagattactcggatgctttagccgagcggattgactcgatggcactaccgctgaaccagccaatcatcgtctttggcggcaaggcctttacgatgatcgtgtcatttttggcggcggttaaatccggtcacccatacattccggtggacattaattcacctaaggaacgtttggaaatgattaatcaaattgccaaaccggtagcagtcatcgcgactgagccactgccggagaaactgccggatattccagaaattgatcaggaacagctcgaccacatttgcctggaaaaagttgattatcgactgacccatccggttcatggggatcaaacctactacatcattttcacctcaggaactactggtgttccaaagggtgtcgaaatcagttacaacaacctggccggctttgtcgactggatggtgagtgatgctttcgacttgccaaaggatctgcagatgcttcagcagccggcctactcatttgatttgtcggtcatgagcctgtatccaacacttttccaaggcggtacgcttcacgtcttatccaagaagaccaccgacaattttatcgtcttattcacggccctgcggacgatgccgattaatacctgggtttcaaccccatcattcgtcgacatttgcctgttggaatcaacttttgatcaggcccattatccgaagctacatgattttctcttctgcggcgaggaattaacccacaagaccgcggccgcccttaacaaacggttcccggatgctcatattttcaatacatatgggccaaccgaatcaacggtggcaattaccgaaattgaaattaccaatgacattttgaaccactatgagcggctgccaatcggctaccttaaacctggtatgaatgcccaggtggtcaacgaaaatggtgcacaggtaaccgatggccagaaaggtgagttggtcatttacgggcagaacgtttccaagggctacatcaacaaccctgagaaaaatgctcaggccttctttaaaatcggcgaccagcaggcttatcgaaccggcgatattgtcaccatggctgcagatggcttactgcgctactttggccggaaagacttccagattaagctcaatggcttccggattgaactggaggacgtttccgcactggttagcaaagaagaacacgtcaagcaggcagtggtggtgcccaagtacaactcacagcacactgtgtcgatgctgattgcctacgttgtaccgcaggaaaatgatttcaagaataacttggaacttaccgcggcgattaagaaaaacttggggcaggatatgatggcctacatgattccacaaaagattgtttatcaaaaatcactgccgttgagctctaacgggaaggtcgacattaaagcagtgattgccgaggtcaacagtcaatgagatggtacattccatacggcaacccaacctacttcatctggctggcgctggcgattatcccgttaatgattgggttgttgtatgggcaccggttccgcggctaccagacgattatctcgctgttcttcctgattttgacttttggtgggcccaactggaaaaccgggatttcactgattggttacctgatttatcagctgatcctcgtgtggctgtactcaacgtaccggcagaaaaaggacacgcccaataagggatggatctttgtcaccgcagtggtcctggcgatcgtgcctttggtgatcgttaagctcacgccgctgtttacgcctggtcgccaatcgattatcggctttatgggaatttcttacattacctttaaagtcgtgcagaccatcatggaaacccgtgatgggatgattaaggaattccatccggtgttgtttggccagtttctattgttcttcccgaccatttcgtcaggaccaatcgaccgttaccgccgatttgaagctgattatgccaaggtgccggagcagagtgcctacctggatatgattcaaaagggtgtccgctacgttttccaaggctttgtctacaaattcgtcctggcctactactttggctcggtcctaatgccccaaattcaaatgcgggcgttgatggctcacggcttttcctggaacatcgtcgcttacatgtatgcttacagtatggatttattctttgatttcgctggttacagtttgttcgccgtcggcatcagttatctgatgggtatcaagacgccgatgaacttcaatcagccgtttaaatcaaagaatatcaaggacttctggaatcgttggcacatgactctgtcgttttggttccgtgattacattttcatgcggttggtcttcttctgcatgaagcatcacatctttaagagtcgaaccaccactgccaacgtgtgctacgtgattaacatgctgatcatggggttctggcacggcgagacctggtactacatcacttatggtctctaccatgggtttgcgatggtgattaacgacacttggctgcggttcaagaagaagcatcaggaccacattccacataacaagttcacagaagcctttgcgatttttctgacatttaacgttgtttgtttcagtttcctgattttctcaggattcttgaacacattgttctttgcaccgaaaccattttaattaagaggagttgttcataatggatgataaacaaacggtacttgatattttaaaagacttaactggtgaagatttttctgacaatttggatgaagatttatactcaagtgcgttgctggactcaatggggacggtgcagttactgctggatctccaagataaattgggcgttcaagcccccgtttcagaatttgatcgaaacgagtggaacacgcctgctaaaattattgcgaaagttgaagcagccaaatgagtgttaaaaagcggctcttcatgatatttgggccgatttttgctgcagcactgttgatgctggccgtgtttttatcgccgctgtggtcggggttcagctatgtgaatcccacagtcgtcgacaacgccgccgcatcgctttcgccgcaggttttaaaaggccagctgattaaacgtaacgcacttgaacatgattatgtcccattctttggttcatcagagtggtcgcggtttgacccgtttcatccttctgttctggcggccaagtacaaacgaagttatcggccgttcttgcttggtgcccggggcagtcagtcactgacgcatttctttgtcatgcagtcggtcaatccccagttaaaaaataaaaaggccgtcgttttcgtatccccccagtggttcacgcccaagggagaagaccccaatgccttttcgttctattactcaactttgcaaacgaccaattggattaagcagcagaacggatccaaaatggatcgctatgccgcttatcggctcttgcagatgccttccggtaattccgacaaggtgattgccggcgcgttggcccggatcgctgccggtctaaaaccgacaacttctcaaatgttgtatgtcaatttgcgcaaccgcattttgctgaatgaagatcaaatcttctcgcgatatcggattccgctgaacaacgaggaaaccatcgataagaacgaggagctgcttccagctcaatacaactatcaaaagttggatcagctggccggcaaaattggtgccgaaaaaacgtcttcaaatgatttccaaatttccaacagcttttggaatcgccgattgaagacccacgtgaagaaactcaagggattccagtccaatatgagcttcttaaagtcgcctgaatatggtgatttccaattgatgctcaaccaatttgccaacgaccataccaaggtgttattcatcattccgccgattaacgcgaaatggcagaagtacaccggtttgtcggcaaaaatgctggatcagttcagcaataaaattacttatcagctgcggtcacaaggatttacccacattgacaatctcagccatgacggcaacgttccttactttatgaccgacacaatccaccctggctggcggggctggctgaaaatggatcaggcaattcggccgtttttgacgaagaaggtcaaaacgccgcattaccgaattgacaactactattactctaaagattggcaaaacgaaagtggaagtgacaacgattttgatgaataagtttaaaagcaggaccgtcatgttattcttggcgggcctgttgtctgttgggggcttgatggccggaaacaaggcttttgctgcctataatgcggtgatggcaaccagcaataagcattacgatgcccaaattgtgaatcaaacgactgttaagcgcggctataatttatacaccgacggcccttacaataccaacgccacgaccaagacggccgatggcaatggttataaatataacaatgcctatgtccgggtcctgcagaccaagaccaccaagactggtacttacgtgttattgaggtactacaaccagaagctgggctggatgaatattcacgggatcaagtcggtgagtttcaatacgattgccagtaacatgatgaagcaatataacgtggttggaacagctgtcttggcttctgccggcagcaacaataccgccgttgtcagcaatggctatgccaatgcgttgagaaacgtggttaacaccagcaacggaacggttgtctatccgctggcttcgctgcaaaaggcgatgactggcgccattattcagcagttgatcagtgccggccagctgacgccgacaacgccgttaagtaagtactatccgaccgtgccatatagcagtcagattacaattgccgaaatgctgtcgatgacgtctggcattgataacactgatgtgacgccaagcagccaattgacggaaaatcaggcgtacgccagcatgattcagcgcctgaagtcgaccggtcagaatacttataattacagtgatgccaatttcgtgctgttggccggtattatttccaaggtgaccggcaaaagctatgcccagaatctacagagccggatttttaacgcggttgggatgaagaataccatcatcgtgggcagtaagcagcccagcaccaaatcaacggtggcggtcggctacaccaatcaaggtaaatacaattaccaggatgccgacgcggtttcttatgcccgactctcggcaattcccggtgccggcaacctgttaagtaccccgagtgatttttataaatttgtccagggcctgcaaaacgggcagatcttgtcagccagtcagttccagcaattgaccagctacggcaactactattccggcggcctgtacgtcaacaaggacggcctgaaatataataatggctcctttggcggctcaagtttccacaccagctactacgcgcgagatgacaactaccacatggcactggtgtttatgaaccagtatccgctggtggggggcattagtgcgaaggcctttacgcagaagatgtatgatgtggcgacttattattaaacaatttcataataaaagaatcggtgatgatttggtcaccgattcttttttttaatgagtaattaaaatgttaagcgagtcctgacgaatgacttggaaatgatataatcaagaaaaaatggagatgtcaaaatgcctattgtagttctcaaagacttttatcaaccgaacgatttaattcaaattgtgaccgccgcaattcatgccaacaacgctgactgccatgccatcattgagccaaacatcatcgtttcgtcttcaaatgttgtcagtaatccaaggcgatatgaagatctcatgcactttaccgtcagaccctttaaccagaaattaaaagggatttatagtttttataaagagcggggtaatgtttatctagaaaaactacccgacaattctgtcatgggactgtctccaatttacttaggagaaggtaaagaaagcacagttcccaagcaattaatggcggctctcgaaaaaaagattgaatcattctgttatgagaacggcgtggccaatgtcgatcgttatccttttgatcagttaaaattggcagaagtgactttgcgaattgtatcggaagatacttatcaagttcccggttttactttcgatattcaagcattgcctgaggttgaggttgaataatccgactaccactcaatctcctcaaccggttccggcgaatcattcaactcatcattcttaacctggccatcaccaatttcgatgatgtggtcggccattggtttaatcatgccattgtgggtaacgatgatgacattcttgtccgttttgtggctgaaatcttggagtaacttgaggatgcttttaccagttttataatccagtgccccagttggctcgtcacagaggagcagctcggggttcttggcgatcgcccgggcaatggcaactcgctgctgctcgccgccggatagttgggccgggaaattgttggttcgtttggccaggccaacgtctttcatgacctcgggtacgtccagtgagtctggtgaaatttgggatgccaactcgacgttttccaaagcggtgaggttggggattaggttgtagaactggaagacaaatccgactgatagccgtcgataggttgttagctgttttggcgaataggtcgcgatattgcgatcgttgacgattacgtctcctttagtgggcgtatccattccgcctaaaatgttgagcagcgtggatttccccgctcccgaggcgccgacaataattgtgagttcgccctttttaatttcaaaattaatgtcgtcgttggcgcggacttcctgctcgccgctgccgtaaattttggatacgtgtttgacgtcgatatatgccatgattgcctcccgaattgtttctttatcgattatgatacttgtggtttgcagggaaagcaaccatgattgagattgaaaaaatcctctcgtgaaggaacattgcgagaggattttgcttacttcttcaatttatcaatgacttccttaagtgattcctcaaaagtcggtagcggatgtcccaaagcttctgggaggtcgttggaagtttcttccaggtcaccatttcgaatcaagcgctgcatgccaacgattgaagcggcagctgctggactgtatcctgtggccacaaggcgcttacggtattcatcatcggaaactgacatcacttcgaagtcgttatcggtgactaattgtagggcgcgggccaaatcggcatagtcgtgttgcggtccggaaaattcatacaccgttttcggctcatcggtcattagaactttggcagctgcttcggcgtactcccgttccagtgcccagccaacccggccgtttccggcagaatagacgaagggtcggttgttaatggctgcgggaatctgcaggcgctcattttccagataccagttgtttcgtaagaacgagtaaccaattcccgattgacggatagcctgttcagtattcttgtggtcaacggcaagtggcgatttggccgtgtctgcatgtgggaagctggtgtaggcgatgaaccggacaccggcttttttggcggcattaatcacattttggtgttgttgaatacggctgactgcctgacctggaattgaggaaattaacagcagtttatcgataccggccagtgatttttccagcacctcctgcgaatcataggaccctggtcgagcttcaatacccggcaacagtttctcagccttctcagtgttccgtgccagtgcgatgatgtctcggttatcaacgttttcagctaacactttaatgacagtttgaccaaatttccccgtggcccctgtaacggcgtatttcatattggcgatcccctttcaaatcataatctgaacgactaaattatcctgtttaattgatgttaccaaggattggaggggcttacaagaatttgaacttggagaaattttcaataaaatccgattattcatgaaaattttcatgatgttcgatatactaaaatgaggtttttaactggaggacatgatgaaaaataatggctggtatcgattagggcaggttagtgcggtattctgcggtggcgcgctgggtgggatttcccgatatgaaattggaaactggatccatagtgccaatgggttgcttggaaccagcgttgtaaatttgctggggtgctttttactgacatttacaatctatggcctagatttgcggttcgatttacctgagtggcagattcttgggctcggaacgggattcgttggagctttcaccactttttcaacgtttactctgcagtttgtgcaggggatttccaataatcccttgggctcactgatcttcttactggtcaatctcattggtggcatgctttgtgtcccccttggctacttagcggctaccagagttgggaggcgtcagcgatgacaacgatgatctgggtaggactcggcgccggattgggggctgcttgccgctatgggataaccgttctgggcaaattagtatcgccgacgattccctacgcaacaattttaattaatgtgattggctcgtttctggctggatggttgactggaagtcagctaccgggaacttgggcgctatttttactgactggggtttgcggtggcttcaccacattttcaacgttttccgtcgatacgtttgtgcttgttcgcaatcgtcggtatctgcttgccggttggtattggtgcgggaccgttgtcttaggcgtgttggccgtggtttccggtttgtggttgagtatgcattcttagtgaacgtattttataatgagttgtacataaaagaggtgttttccattaataaacaaattttgcgcaacgacttacaaattatcgtaggggcgttggtctacgcaattgccattaatgattttctgattccacatcagatcggtgagggtggcgtcactggtttgacgaccattggctattacgcgttgaacattcccccggcggtgacgaattttgtcttgaacggaatcttaatgctggttggtttccgatttttggacaaaaagaccatctggtattccttgtgggccgtggcttggatatccatctttttgaaattacccagattgctgaattatcacacctcacaaactattattccagcaattgccggtggtgtcctaatggggatttcgatgtggattatattccgtggtgaaggcacgattgccggcagcaccattttggccaagatcatgaatcgttattttggcatgaaaaatgggtcggcaatgttgatgtttgatttatgcgttgcaattccatcggtgttggtgattggttttcaaaatatgattttgacggtgattgaactgtatatctctgcggtggttctcaatggtttgctgtcccgatttggggctcgaaaagccgtgaccattctttccaatcaaacggatgaaattacctcagagctctccagccagctccatcagggaattactctcattagtgccaagggatattatcaccaggaaatccggccgatgatttacgtgatttgtactgataagcaagtcgcccagattgtcccgctggtttccagtgttgatccagacgcgtttgtggtggttgagaatgtccatagcgtcaagggcgaggctttggagaaaatattataggagaagttccagattttgatcacaaatcgggaacttttttaatactcagtaaaatttaatttgaaaaatttgtgcaaacatgctgtgttgtcaaacgctttcatattcgttacactattatttgttgagctatatccgattaatccaataattttcgtggtgggggattattgattaataatcatattactaggcaggaccagtgaaaaatctgatctattttgtgttgtacttctcagaagggggaaaattatggacgcacaagtcgaaaaaccaaagaagcatttcaagctgaaaatgcccggtgcctttgtcattctgttcattttgacaatcgttgccgtggctgccacctggatggttcctgccggtagttattcaaaattatcgtacacgaattcatctttgcaggtaactgacccacacggtaaagtcaccacggttcccagcacccaaaaagaattagacaagctgggcgtcaaaattaacattaagcaatttacagatggcggcatcactgcgccggtatcaattccaaatacttaccagcgactcaaacagcggccggcaagcattgcggctgtcccgaccagcatggtcaaagggaccattgaagccgtcgatattatggtcttcatcctggttctgggaggcttgatcggagtcgtcaaagccagtggcgcctttgaatccggtctgctggccctgaccaagaagaccaaagggcatgagttcttgttgatcttcttcgttgccatcctgatggttctgggtggaaccctttgtgggatcgaagaagaagcggttgccttttatccaattctggtaccgattttcattgccatggggtacgattcgatcgtgtctgttggcgcaatcttcctagcgagttcgattggaacctgtttttcaaccatcaacccgttttccgtggtgattgcgtctaacgctgccggcatcgactttacccaaggtctgccggagcgggtcattggtttggtgattgctgccagttttgtcgtgacttatctgcactggtacagcaagaaggtcaaagctgatccaaagttttcctattcatatgatgaccgtgatgaatttaatgcaatgtgggaaattgccccaactggggaagatgccaaatccaaatttacaatgcgcaaaaaactgatcttgatattattcgttgttactttcccactgatggtttggggcgtgatgtctcaaggctggtggttcccaaccatggcggcttcgttcctgtcatttgcaattatcatcatgttcctaacggcaaccggtaaaaatgggcttggagaaacgggtgtcgttgatgctttcgtgaaaggtgcttccagcttggttggcgtttcgctgattattggcttggcacggggaatcaaccttgtgctgaataacgggaagatttctgacaccatgctccagtattcatcaaccttggttgcccatatgaacggcccaatgtttattgttgtgatgctgatcatcttcttcctgttaggattcatcgtcccatcttcatcaggcttggccgtgctgtcgatgccgattctggcaccgttggccgatacggttcacattccacgttacgtcgtggtaaccgcctatcagttcgggcagtatgcaatgctgttcctggccccaaccgggttggtgatggcaaccttgcaaatgctgaacatgaagtattcacactggctgcgtttcgtgtggccggtggttgtcttcgtcctcgtgtttggtggtgcattgctggtgactgaagttttgattaattaatatttaatacgtgaattcaaagtgcctccccgtcaggattgatggagaggcatttgcgctaattattaaacaacttccaacaaatccagtgacaaaccagctataataattaataatctgcacagtcacaaatcatgaggaggttcatcatgggaaaatatattatcagttcaaagcttagaaaagttggtgctcaagtcgacacaaaaacaggcattcatcaatttatcgttgatgaaccaattgccggtcacggaacagatgccggtcccaacccggtccaatatctgttatcggcggtcggcagctgtttagccattactgccaacgatatcgcccgaaagcacccggaaattcaaattaagaagtttgaaaccaagacgactggcgagaccactcagtatcaagatgggcgatccgcggtcactaaaattgtcgttcagattcatgccgaaacgaatttggacgaggctggacataaggcgtttatgcattcagtcgtcaaggactgtacggttcatgaaacgttaaagcacgcggttccgattgagttgcaattcatctaggaggggtactatgggaaagatccgaaaggtgtcgttaagtattggaattgtcatggttgcggtatttttggcggcttgtggcaagcagtcttcccaaaataatgcgcagaacaagtcgattaccttaatgcagacatctgatttaacgtcgttggacaataccaatcaggccatgctgccggagtttaacaccctaaccaacatttctgaggggctctaccggcttaacagcaaggatcaaccagtcccagcgatggccaccaagattgttaaaccaactgataacggtaaaaagtatgtctttcatatccgttcgaatgccaagtggagtaatggtgatcctgtaaaggcggaagattttgaatattcatggaaacggtctttgaaccctgcgaataacccggtttacacttatgtctttagtggaatcaaaaatgctgatgcgattatcaatcataagaagtcgtacaaaacgcttggaattaaggcaaccggcgacaaaactcttgaaattactttggatcatccgatggcctatttcaacaagttagtcgcaatgccggtcttcatgccgcaggataaatcgtttgtccaaaaggtcggtgttaaaaagtacgggactaacgccaaaaatacgatttccaacggcgccttcaagattaccaactggaccggcaccaacgatgcttatcgattggtaaagaacccgtattactgggataagtcggcgattaagttagaccaaatcaactataagaccgttaaggattccaatacggcccacaatttatttgaggatgggaagttggacgatgccaccatttccggggttaccgccaagtccctgcagaagaataaggacttgaagcgggtacctaaggcctggacttattatctgcaggttaaccaacggaaagggcgaccacttgctaaccaaaagttacgacaagccatttcattggcgatcaaccgaaaagaactgaccaataaggtcttggcggatgggtcactgccagccagcagttttgtcagcccaggaacagccgttgacccaacgactggtaaggatttcagtcaagagactagttttagtgtcgcgcccaacatcaagcaagccagaagtttgctggcagccggtaagaaggaagccgggattactggtgatttgaagctttccattgttggtgatggtcaagatgtaaccaagaatgttgctcagtatatccagggacagttagattctaagctccctggtgtcaaggttagtatcgccaaccttcctgacaaagctcagcaggcccgccgaagtgaaggcaagtttgaccttgctcagtggtactggttagccgattttggtgatccgatcaattacttgggaatcttgacttctaataatacgatgaatccgggcaagtttagcgatgccacgtacgattcactgattgaaaaagccaagacagccgctaatcagactgattactggaaatatctcagacaagctgagaagcgattgatgaaccaaaacggcatcattccgctgtattatgtaagagaaagccatttggtcaacccgaaactcagcggggttgagtatcatgtcgctgggttcccagattatacgcgggcaacgattacgaagtaagttgctgaaaaattgataatcgattttaaaagtaggagtgctagctcgattcagacacaatctgcattgagacaacatttctgaacagaaccccttgaattggatttttccagttcaaggggttctatttatcaaatatattttaaattcatgcgtaattccggtcagagaaccattgccagaaggctctctttgccgaatatatggtgattctagttaaatacatagaccttactttcataaggacgtaattccgtaccttgatcattatcgtaattgctgatgacgagtttgtcggctttaccctgaccataatctcgcgtcaccgtgtcggcagtgaagttactgattactagcaacgtcttgccttgataatgacgccggtaagcaaagacctctgcgtcatcaggatcaatctcatcatagcttccgaacttaaccaagtcggaatcatgacggagctgaatcagcttttgatagtggtaaaagacggaatctttatcgtccaccacagctttagcattgatttctttataggttgggttcaaagcaaaccatggttttgcatctgagaagccggcatttttgccatcgtcccacggcattggcgtacgagcattatctcgagaaatgttagctaaatatttcagcatggttggcccatcgactagattcttttcttcaaccaactcgtgataggcattgattgattcgagatcttcgtactgatcaatgctggtgtagtgtacattggccataccgagttcttcaccttcaaagacaaatggtgttccttgcatcatgtgaagggtcgtgcccagcattttggcggcgcgaacccggtactttggatcatcgttggcgaagcgcgaaaccgctcgcggttgatcatggttgttccagtagagactattccaaccctttccatctaaggctttttgccaacgggatagggcattcttcaactctggtagcttgaccggctgatcgttccatttacccaagcgtttgtctggattgggttccaaggcaacgtgctggaattgaaagaccatgttcagttcatggctatcgaggccagtgtagttgatggcatcttcgggctttgaactcggcatttcaccaaccgtcatgacatcgtagtgggaaagtaccttttggttcatttcgtggagatagtcgtttaacttaggaccatcggcaaccagaccttccgtgagcgggtaggtgccgggctcaggtgcgtccggcaggccttcaggtttggaaatcaggttgatgacgtccattctgaagccatcaattcctttatccaaccaaaatcgcatgatgttccaaacggattcccgaacggctgggttttcccaattcaaatcaggttggccaggggcaaacaagtgcaggtagtactggccacgttctggaacgtatgtccaagcactgccaccaaaggctgcgtgccagttgtttggctcatgaccgtcaactggatcgtgccacatatagtagtcagcgtacttgttatccttggattgtttgctttcttggaaccagcggtgttgatcggaagtgtggttaaccacgaggtccatcagtaacttcaatccgtgggcatgaacttctttcaacagttcatcgaaatcagccatcgtgccatattccggtaagattttctcgtaatcggcaatgtcgtagccgttatctttgagaggtgattgataaattgggttcaaccaaaggacgtcaacgccaagcttctttaaatagggcaggcgtttgatgatcccatgaagatcaccaatcccatcattgttgctgtcttgaaaactttgtggataaatctggtaaattacgtcgttttgccaccattttttggtcatattgcattctcttctttctcgtgattatagtttaaccggtttacttagttttgagtggataaagccaactgaaaatgcagcgattactaatgaaaccccgccaaccaagaacattgctggcattgagtgcccaaccattgggaagatgaagaagctgcaaagagatgctgcaatttgtggtaagcagattgaacaattgaagagtcccaggtaagctccttcattttcaccgttcaaagcctctgttaagagtgagaatggttgggtgttcatggtgatataagtgatcccaatcagacagaacggcaaaatgagcagccatttgatgtggatgaagaagatcatgatgaagccaagggcaccagcaagtaggccaaagacataccatgcttttcgatgttctggctttgtccgtgcttgaaccagcaaaccaaagataaccgaagcaacggcctggatgcaggtaaggacgccataccaattaccagcggcttgataaccggctgatgaagggttggatgtgtgccaaacattgagggaaatggcaccagcagcgtaggtccaagaatagagaatggcaaaccaggtaaaaaattggacaattgagatttcccagaagactcggggggcttttttagttaattcccaaagactaggctgcttcttttgcttggttaagtcaatattgtgatataaagcatattcttcaggattgtattcgtgaactttggcaatcgtgtaaaacgaggtcaataacagaacggctgcggccaggtagtaggctaatttaacggtaattggcacttcacctttttgagcgacgtttgaaaggccaatgaatgcaaggaaaaatggaaccaagctggcaagaactccaccaagattggagaaggactgctgccaagaccaagccatatctttttggtcttcgttgaccatgtcaccgatgatcatcttgaagggctgcatacaaacgttggatgaaaggtccataaatagtgtggcaatagcggcaaaccacagtgcggccgccgaaccgtaaccgaatccgaatgaaccggcgttaggaagtaataccaaaacaattgctgcgacgggtgcgccaataaataaatacggcatgcgtcttccaaaacgggtccaagtgcggtcagagtatttaccgattaagggttgaataaccattccggctaacggtggcaagataaagaaaaatcctaagttattcgggttagcgccaatagtttgaaaaattcgccccatttgtgattgttgaagcgagaatgccatgttaaccccgaaaaaaccaaatgtcattgcaaaaatcgtacttactttcaaacttggcaaatgggatgcaaaacttttaggttcagttttaacgtcaccatttccagcttttacttttgcgtccatagtaattcctcctaaaaagtgagcggatccaggcggttagggatcggagtgtaagtctcttcggcagaaagctcagttctggaattttttgtcgaaaacacttatatgtagatcgctgcttggataagctatctccgtgaacgcttttgcaacttggccaatagatatatattgcaagaaaacgtttacagcgattataatagcacccaaagaaaacgtttgcaaaccctttatatcaataacacaaacgattgtgttttactaaaaattaaagtgacgtttactgtgctaaaatggggtgagcattgtaaaacgcttaacgttaatgatcccagtaaagctttacaacgtacataatagagaggtggcgtaatcatggcagtcacaattaaagatattgccaaacaggcaggtgtctctactgccactgtttcaagggtgttgtctgaccagacagcattttactcagaaaagacagcaaaaaaggtaaaaaaaacagccaaaaaacttggctatcaaaaaaaatcggctgccgttgaactggttacccgtcgcagcaaggtgatcgcagtcattctcagctcaaccaaatcaaacttttctgatcagattatcaatggtattcagcaagaggcccgccggcatgatttgaacgtgattatcgtatttgccggcgaaaatgattcccagatggagcgaaaagcattggaaaccgtgatcgagcggtcagtaatggggattttgctggtcgccgttaaccttaatccggctaacgaggacttgttactgaatgccaatattccgtttctgttcctgtcaatcaccattaaaaatcggggattgccgttcattacctccgacgattttcagatcggctatcaagccaccaagtatttgattgataaggatcattccaagattggatttgccgctgcagatttagactctgtgaccggtcagttgaggttggatggttatcgtcatgccttggcagacaatgggttacctttgaattcaggttgggttttgggcggtgactttgcctatgaagatggcgttaatgccatgaaacaatatggccgtgagccggaagtgaccgcggtgatcgcatcgagtgacttggccgcaatcggcgtgatgaatcaggcgcgggattatggattaaaaataccggctgacctagctgtgatgagcattgatggtacgaaactttgtggcatcgtgcggccacaattaaccagtgtcactcaggagttcttggagatgggagttcgggggatgcagcagattatcagtccgctagcaaaagctgccaagtcatcctttaccccatttaaaattattccaaggcagagtgtctaggaccgccatacaaagaagcaacccgaaactcagcggggttgattatcatgtcgttgggttcccagattatacgcgggcaacgattgcgaagtaaattattttaaaagtttgtaacaaaataagaagcctcagttcaatgcggacgtgtgtctgaatcgaactggggcttcttattttgtccataaaggcttgaatgctggatttcaattttatgcgaatagaaattcttagcattaccgattaggcgatattctttgaacctcgccgtcgaatgaggatccagccacctgccaagatgatcagtgaaataacgacggccacgacaaacaaatgttggtaagcttgctgggcaatttggtaaaaggtggctaatttgtcggagtgcgatccggctgcttttgctaataaaatccgatagtattcctcaagcggtgtgctcagcgacagacgactaaatccgctttggatgatggtcgcataaatggttggcgcaattgtcaggcccacttgacggctgacagacaacgttccaaacgcaatcccattatcggcttggtcggcgaattgggccatcaaaacggaaagctgggcgcccatcagcatgccgaatccaaagccagccaacgttgaggtagctaagaaccaaccggctgctgaaagaccaccggaaacgatgactgtttttgttgctccgagtcgggatactaaagtcccaccaatgcctgcgcctaagatggaccccaaaccaataccactcatccaaataccactgttattggccgaaatgccgtaaacttgttcgacaaagctgggaatgaagacgaaaattgcaatcaacatgccagatagcagtcccatcaacagggttagtaaaaatcctttattggccaaaagatggtagggcaagaaagggtcaaatcgtggcgcaatccgtttttcgaccaacacaaatcccacaaacaagccaatcccaaccaatcctgcaccccaaacctgaggggttaacaaacttacgagaaggtggccgctttgtaagttagtaatggctaacatgatgctaaagatacctaaactcaggatcgtcaggccctttaagtctagtgatttcacatgggatccaatggtttctggaatcaccagccagccggcgacgatcacaaagatggcgatctgcagattaatcagaaacaaccaattccagcgcccagtcaaatttaaaatcaaactacccaaattaggaccaacaaccgatgctatgccgttaactgcacccaaggctcctaacagtccgccctgggctttcttggggtaagttgataggacatgacttgaagcaatcacgaagattcccccgccaccgacagattgaatcatccgcgccactaaaaacgtcatgttggactcaaagcaaccaataatgatcctagttcaaaaatagcaatttcaattaaaaacaattttcgtctgccaaatttatcagctaattttccaataatcggggtcgcaattgccattccaagcgtataaagcgtgatcccccatgttccttgtacttcgctaatatgaagtgaataattaatacttgataatgcactggcaataatcccattatccaaggcagacatgaagacccctaagattaaaatgcccattgcaaactttgagtgttgctttcctgttcccatttttctgatcctccacattaggtcctattccattaattatcgtaagtgacattgtgtcacttaactattgatgaaattataacacactaatgacaccgtgtcattagtgtgagttgggaactatttcaagcagcggatggcattcatattgaatgaattgatgaagtatgaacaaaatattttagaagtgaggtaaggtgattatgtcagactggttgtgtgacggaagaatccccaagtgacaatgtttctctatattcctcggcatctggattttcatgaaaatcgacagtgacatcttgatattgttttaattctttttcaatttcttcaattggtattttaaagtattcctttcgattattaaccttatttactcgattgttagcaaattgattgtgcaatttggactctaaggcataggcgttttcactaaaaattaaagcatgtacatcaaatttgaacggtactgaggcactactaagttcattaattcggtctaatggctcgagacgccgtgttacacctattttaacaatatcctttccaaatgaaccaatgttggaaatgatatagacgtatccggcagtggcatttgattcccgataatctatgccactctttttctcgcggaggccatctagcttttgctgaagattttgtatttctgcccttaacccttcctcatcagtattttctaggggcattctgttttctaattcttgaattgcttgactatagtgttgaatttctttatcaaccttttttcgttcctgtttaatttcttgttggagttttttctcttcacgttctttttctctttgttcacggagtaagtctttttcctcctgctttttttgagcatactcgaatgccaaatttaattcctcatatttcagttttaggtaactaggttgcatttgtacattaacaacttcatacatcttattgtgttgcaagaatgatttttcgattctttttgctaccctttcataatttgaataagtgactttattaattgcatctgtgcattcattattaaaacttctaaaaatagctttaatattattctttgtcattttctttccttgggataatttgccatttactgtccacatggtatcaaaacttaccgcagttcgattcttaatggcttgcttttgctgatctcgtattgcattgagtgcctctttgtatcccaacgatgttgcaaattcatagtggggtgtatacaacccaaaactactcatttctttgctagcctctagttctccaacttcagcctgtaagttttccacctcttgctgtaactgtgcaacccgatttttcagatcttctgcctgtggggtaaggctttgtattatgccagatttttcatcaattaacgattcgagctcaacaggtttcatctgctgaactgaaagtttaattttgagtgacttctgtaagccctcgttttgtgaagttaagttatcattggttatcttaagttcgttaatttgttgtttgaattccttaattttaaacaagtcagaaattgccatgtatttatcctccagtaatgtgagattatttattcaaagttaattttagtgtatcaggtggataaggagacagctaggataaactctgtgtattcgcctgagtaagcacttccattcgattgttaaaccggatatactacagatatagtgagtatttgagcaaacagaaggaggtcatcttatgaaaattgcaacagcagttgcccagcaacagggcacaaaattgacagttgaatcggcagagttggatgaacctaaggcaaatgaagtgttagtcgaaatcaaagcatccggaatttgtcataccgatgctgctggcagggactttgccaccaccccgtatccagttgcattgggacatgaaggagcagggatcgtcaaagaagttggcagcagtgttaccactgtcaaacctggagatcacgttgtcttgtcattttcttattgcggtcattgcgaaaactgtttaactgggcatccagctaactgcatccacttgaatgaacttaattttggcggtcacaattttgatggcacccaccgtattcatagtgaagatggcaagaatatttctacattttttggccaatcctcattctccacgtactcagttgtcgacgagcatggtgtgaccaaggtaccaagtgatgtcgatattaatttgcttggcccattgggatgtggatttcaaactggagctgggacggttttaaattatttgaagcccgaattcggcagctctattgctatttttgggactggagcagttggattgtctgcaatgatggccgctaaaattattggaatggatcatattattgcgattgatattcacgataatcggttggaactggcgaagaagcttggggcaactgaaaccattaatagtcagaaacataatccggaagaggttattaaaacactcttgcaagctggcattgagtacagcattgatacaaccggtgttcctgctgttattaagcaggccgttcatgtattaaagccatccggaacttgtgctttactgggtatggctggtgatgtcactttcaatatccaagaagaagtaatgggtgaatcgaaacgagtcgttggggttatcgaaggcgacgccatcccacaattatttattcccaaactggtcaactactacaaaaagggcttattcccatttgacagactggtaaaatattataagtttgccgatatcaatcaagccttcgaggactcagccgacggcagtgtcatcaaacctatcgtaaaaattagcaactaaaaaagtagaaacgctggctcaatgtggattgaaatccatatcgaaccagcgtttctatttttgcagaagattatctttcccaaccacacaaccgatagccatggctgcgggcccaatgcttggtcacgtggcgcttgtaaccggcgttactcaggccacggcaagtctttgagtagtgatatcgtttgccgtggtttggcgcgatccaaacataggtggttctggccgaaacttcttggggcggaattgacattaatccgccgcccatcgtgaatgctgcaacaactgtcaaagttgctttcttaagctttaacatgatgtttcccccgaaatataaaatatgtgaataatagcacaaaaatagtttaccataaattatcaggtattaatatcacaatattaatatttctataaggaaaatcgctaattatcctggataattttgccaattcgttcctgcaagtccggcacgacgtccgtcaaaaaccagggatgctgcttcatccagccatagtttaatggtgagggatggaccaaaggaaaatagtccggcaaatagtcttcgaagtggcaaactgtttcagttaagtttctttggcgccgatttcctaaataatatttttgagcatattggccaattaataatttcagtttgatattcggcatctctgccaatagcggttggtgccacttttcggcgaagccttttcgcggtggcaaatccccgtgggcgcctttcccgggatagtaaaagtccagcggcatgacggcaattttgcctgaatgataaaattctgtcttgcttaatcccatccagtcccgcagccggtcgccactcgggtcatcccaaaagaccatcgatgcttgggccttgcgactgggtgcctgactgataatcaagatttctgcttggggatcaacgtggaacaacggctgaatgccttgttcggtgaacgactgattttgtgggtcgtcttgaatctgcttaaatagttccgcaactgtggccatgagatcacctcgttctgacttttaccttcattttccaccaaataattatcctgtcaaagcaaattcaccattaacaaggaccaatggcgtaaaataaccttagctaaaagaatccgaagggggaaagggcaaatgggccaaaagacaatctattttctctgcactggtaattcctgcagaagccaaatggcggaaggttttggcaaacaatatttgggtgaccactatcgggtattgtcagctggaatggaaaagcacggcgtcaatccactggccgttcaagtcatggccgaagtgggcgttgatatttctgggcaaacctccaagctgattgacccgacaattttaaaccacgctgacttggtggtcacgctgtgcagtgatgccgagaaacgttgtccgataacgccaccgcaagtcgctcgtcaacattggccattccctgatccggccgtggcaactggcagttccagtgaacgattacaggccttccgagaagttcgcgatgggatcaaggcgcggattattgcctttgacaatcttgaggccggccaaaaaaatcattagtttaggcactgttatatcagccgttcacgccaccgaccccaaaaatgtccttgcaatctgcataatcgatgctaatattagtattaaattaaaacattaagcgatgatgagaagagtagcaagtatcctttggtaaagagagccgcgttaggtgagaggcggtcaaagtcaatcttgtgaagatgagctcagagcattaggcacgtgcaagcgatgcctacgttaagacacgttacgatctcagacttaattaaccaatttggttaacgagttgtgaaggtggccgattgtgaaatcgaccataaaactgggtggcaccacgtgtttacgtccctgcagtatttaactgcaggggcgtttttttgttgggataaatgaaatccagttatttgtctccggagtgctcttacgtcatccaaggaggacgaacaatgttagcagcagaaaaaattgaggttaataaagacggcactagacgaggattatccaacctggccgtacaaatgattgcttttggcggttcaattggtaccggcctgtttcttggcgccggtagtacgattcatcgaaccggtccatcgatcatcctggtctatctggtcattggcatctttttctttttgatgatgagggcgattggtgagatgatgtattctgatcctgagcagcatacctttgtgtcgtttattggcaaatacgtcaacgaacgcttgggcaaatttgcggcatggagctactggctggaactcatcctagccggaatggccgaacttacagccatttcaacctatgtcaaatattggttccccgatgtcccggcaccgttaatccaagtcgcattcctggtgatcttgagtggggtcaatttggcgatggtcagttcctttggcaggtctgaaacctttctatcaggaatcaaagtcattgcgatcttagccctgattgtcatcggcgtctatctggtctttacccatcatcaaaatcccgccggcacccacgcctcttggggcaacctgaccgatggtttcacgatgtttccaaacgggattcatcaatttatcatggcttttccaatggtcttcttcgcctttcagggaatggagtttgtcggcatcacgaccgcagaaactaagaatcctcggcgggtattgcccaaagcagttaaccaaatcatcgctagaattttactcttctacattggttcattaatcattatcatggcgatcaccccatggaagacgttgaatcccaatcaaagtccgttcgtccaaatctttaatttagccgggatccccggtgcctcggcagtaatcaacctggtagtaatcgctgcggcaatgtcgactttaaacagtgccattttttccaccggccgacatttgtatcagctggctcaggagtcccactctaaggaaatgaagccgttccaaaaggtttccaagagcggcatcccaattgtcagcgtcctcttttcggcggggatgatgcttttggcacccgtaattagttcctttaactcgcttggtgcagccttttcattcattgcctcagtttccagcgatatttatattctggtgtgcatgctgacaatggtggcccactggaagtatcgtcattccaaggactttcggccggatggctttaagatgcccaaatatcgttggtctaatcccttaacaattgcctttttcattgccattttcgccagcctgttcttcagtcatgattcactgttgccggcagtcggcgctgtgatctgggccttggtattctatgcggtcttgcggcggcggaataccgagaatttgggcgttgaagacagtagtgactgattttgaatagaccggcgattcagcttcctgtatgatggacttaacatacaaggaggatgaaatcgtgaaaaatgtttactttgaccatgacggtaacgtcgatgatttggtgtcgttattactcttattgcaaatgcccgaagttaatttgattggcgtgggggtgattgatgctgacggctacattgaaggatcggttccagcttcacgaaaaattatcacccgattcggcaacggcgctcaggtgtcagttgcggcttccaactctcgcgctgttcatcaatttcctaaagaatggcggctcagctcgttttccttcgatgctttcccgctgctcaacgaacacggcggaccaaccacgccgttggctgagaaaccagctcacttggatatgattgacaagcttaagcaggctgacggcaaaactgacttggtgatgaccgggccattgactgatttggcaagggcgcttgaagtcgaccctacgattgttgataacatccagcggctatactggatgggtggcacgatgcggacagagggcaatgttttggagcccaaacatgacgggaccgctgaatggaacgcttattgggatcctgaagccgttaagacagtctttgatgccgacatcgatatccaaatggtcggactggaaagcaccaaccaagtgccattaaaagccgacgtccagcagcattgggccagcttacggcgttacccaatgatggacctgatcggtcaaggctatgcgttggtatcatcttatgaagctaactcaacctactacctgtgggatgtgttgacgacggtggccagccaataccctgacttgattcagtcaaaggacattcatggtgatgtcttgaccacgggtgccggagcgggtcgcacgtttgagactgataacggccggctgattaacctcgtcactgaagttgacggccaggccttttatgacaaatttgatgaattactgactcagggtcattaaaaattgaaaatgtgaatcgatgaacaatcgcctccaatatggtagactcagcgtagagaacgttgacttatcaatttggaggcgattttatgtcgacacttaaaatgaaggacattaaggtaattgccaatattggcgcgggaaccatggggcatgctacggcattacagtttgcgatgaacggttatccagttaatctcctggatatgaatcaagcggctttaaaacatgggatggaattgattgaacacgatctagccacttttgaagaaaacgggctgattaaaggcaaccagaaggcggatattttggcgcggattgtgccgaccaccgattattctgacgccttggcagatgcagatttcgtgattgaatcagttgtggaaaagttagccgtgaaaaagaccgtttggcagaaagttgaacactatgtttccgaagatgccagtatggcgaccaacacttcgggacttagtccaactgccattcaagctgatctaaagcggccggagaacttggtggtgactcatttctggaacccggcacagttaatgccgttggtcgaagttgttccaggtgagcagacgtcagaagcgaccgtcaagaccgcaacggccttaatgaaccacatcggtaaacacgctgtcgctctgaagaaggaatcgctggggtttgttggcaatcgaattcagatggcggttttgcgggaagccttcaagattgtcgacgatggcattgccagtccggaagcggttgatgacatcatcaaatacagtttgggccgtcgttggagtctggtcgggccaatcgccagtgcagacttgggcggtttggatatctttgaaaatatcagcagttacctctacgatgatttagccaataataccggcaccgacccagtcttgaagaaactggtggacgccgggaacctgggattgaagtctggccagggattctacaattgggaaggcgatatgggtaaggaagccattgcccatcgagatcaggccttattgcaattattggtggaggatcaaaagaagcgctaagagatgttacacgtgaaacaaccaagtgacaggggaaatggttgaaccctgccatgcttgaatcttcaaaatacctaagaaccaaaaatggcatctatttctatgatttagaaataggtgcctacttaatgctatctaacttgactttcattttcattgtcctttagtaactgagttccaaaagagtcggttgctttcactggtttgcagattgccggcatcttgaaccttcttggcaaatacacgttccaacatcttcttcaaagttttcttcatattacatgccctccctgtgttcaatctaagagtcattaatggtgtgatatcaaggattcaattcagttgattgagacacttttctttgactccacctttagtatagggcataaaatattacatttgaaatgttttgctcatgaatttgtaaaataattcatgaaagtgcaatgtatgcgtttacattagcccaagcgattcattgaaaaattttacgattcaggacaggggaatccttttaacatccttgtcagtttgtgggcagcctgcgatcggcaaagaaaaaagcacaacgccatcagcgctgtgccaagtgcccccacacttgtgatgaactaaatgctctaaacttgattcgatacatatctcttggatgatccccaataacgtttgagcgatactccccggctgatagctgttaagccatcgcttgtgatccgtgggacgagtgatgattactgaatacctgccctgttcacagggttattgtacgataatgtgaagaaatatacaagaagaatttgaattgacagcccatggttagcaaaagtaacgctcaatccctactggtgactaaatgcccagtttccaagaagtgataatttccataatcgccatcacgaccatggttgcgccaaagatctgcagtaataccagaattgtgccaaacggattaaatgccagcaggatgccaactaggatcagtaacacaccatacaacacaaatggcattggcgaaacattgacgtattgacgatgattgagcgccgtgaagacgttggaaatgcccgtgacgatcaggacaatccccaagataaatggcaaaaatgacaagagtggttctgccaataagaagacgatcacggcaacgattaactgagtaatgccgaccgccagactatagtcgaccacttcgttatttcgccgctgccgccaagcagagattaaattgatcaccccaaagacaatgaagaaagccgcaattaaattaatggcgatattcaacgtgtcgtgtgggtcaaacaggaacagcaggccgaagactatgtaagcgatacttttcagccaaatataatttctaatctgattaatgaatgaatacatctgaattccccctcaagactcatattacctatataatactagtaataagtttaaaacgacagtctcgaggtgcgtgatgcaatatcctaatgttcatttggccaaattcattgatcgacccaaccgattcatttctcattgtcggctgatcgaaactggtgaagtcgtgaccgttcacgtgaaaaataccggccggacaacgattctccaacctggggtgacgacggcgctggtgcataatgacaatcccaaccgcaagacagcctacgatctggtggccgccaagaagtacgatcgccaatggatcaacattgattctcaggcgccgaataaagtggttaaatcagggttaatcagcaactacattcaactgccgggaatcgaatcgattgcgaccgttaacccggagacgacctatttggactcccggttggatttttccggaaccggcgatttgggccaacgattcttcctggaagtcaaaggggtgaccttggccaatcaagggattgctgcattcccggatgcgcccaccacccgtggattaaagcacgtgttgaccctggaaagggcggctcaggctggatatttcgcttatttattatttgtcatccaaatgaaaaatattcataaaatgactattgaccgcgatatttttaatgacttagcgttggcaattgcaaaggcccaaaacaatggcgttcacgtcctggcctatgactgtcaggtcgaaccgggatccttaacgttggaccagccaattctatttgatttggatcagccatttgtcagtgatgggctgccgtcatcaattggtcatatttgaaagattgacagttcttggttcaaattcccttgaatgtctccacagtcgtgttattatgataggcgcattagtgcgagtgctgcattgttgatcgcacatacttgatttatttggaaggaagcaattttacacacaatggtaagtaaaacattgatcttcggccaccgaggctatccccatatgttccccgagaattctttgaagggctttgcgtacgcgattgatcacggcatcgatggtttggaatttgatgtccatttaactaaggataacgttccagtgattatgcatgatgaaaaaatcgatcgaaccacggatggaaccggcgagattcgctcatataccttaaagcagcttcgtgagttccatttgagtgatggtgagacggttccaatgctcaaagagttattgacgctggcaaatggccaaccggttcatttgaacttggagttcaagaccaacgaaatccactatgacaatattgaacagatcgtgctggacatggtgaagcaatacgacttggtctatccggtcatctactcatcatttaacctcgactccctcaaaattgcttacaaacttgatccgactcagcaatattgctacctgtcggaagaagatattaaaaatccccgtgagttgatggcaaaggaacacttggtgggcttgcacttgagccactatgtcccaatgcgtcacgtgaaggaacgaatctggactgttgatgaccccaaagtgcaaaagcatttgtttgggctcaacgttgccggtattttcaccaataactttgaaggtgctgaaaaaattaaagcaaacgtcactgcttaatctgatcatttcaactgcatttccatgacactgagtgttgtggggatgcttttttattgtcttggatccgtgagccaactgttcagaaaatcactgttttcgtgctaaaatcgattcatagagcaccatgaggacactgagggggatggatgagatgagtaaatggattcgtagatttttagttggttttgtggccttattttcactggctttgtttaattcagcagccgcttcgaccgtcgatgccttcgggacgatttttgaaaatatgattatggcgaaccgaatgaaaccgacggccctgaaagccaattcgaccgcgagcttcgatattgtcatgaagccacaggactcgaccgcttattatcaaaaggcgttggatgtcaatgatccaaccaaggctgattttaaggattatctcagcacttcggatattcgccagcagtttggccagcctgatgccgtcatcaatgggtgggttgccttgtttaaaaagaatcatctgaccactcacgtttaccaggacggattggtgttgaatgtgcaggggaagaccaaggatgtgaatcgcctgttcaaaacgaatttgagcgatgccacctatcactcggacccactacagtttggcaaatccaaacccagcattcccgccaacctgcaagactccgttctggcagtgatgggaatggccgatcataacaagaaattctggttcccggattctgacgttacctttaagagtacccctaaagcgactaaagcactggctgataaaaatgccggctataccagtcattttacgaaaacctatggcgttgatcagctttacgaccaaggcctaacaggcaagggccagacgattggcctggtttcttttggcaatgtccaaaccggtgacctcacgcacttttggcggcatgaacatgtaaatgcatccaagtcccggttccaaatggtgaaagttcttggtgataattatcggaaagatattaaatcgaccagcgacggagaagccacgatggatgctgaatatgccggatctgtggcgcctgaagccaacattaaaatgtttaatagtggctcagtaattccaacgttaatcaatctcatcaatacttacttaacggcctatgacgatggcagtgtcgaccagatttccagcagttgggggatggggcccaacaactacttccagattttggagaaaatgaatttattgccatcccaatacgttgaggtgttgaatctggtgcttgctcaatcggcactgcaggggatttccaattttgtcgcttccggtgacagcggtgccttgaactacaccgtggtcggcattcatggaaatgatgttttgttggatcggaaaattagtgacgctgatccgtataccactagtacttggatcacctcggccggcggaaccagcttaccgtttaagcagtccgttgctccaaacggcaaatcaattggcacaatctccaaccaaaagcaacgagcttggggcagcgattattggtggccgttccttcaggttaacgatgattacctgctgacaatgcctgaattcttcaacgacattagtgatggcggtggcggcgggttcagtcacgtctaccagacgccggcctatcaagaaggcgttcccggtgtgaatacctttaatgcccgcgagtatctgtcgcaattaagtggcccagtctataacgcaccactagtttccggaactgatgatggtcgaaactacccagatatctcagcgaatgcagatgcgactaccggttacttcacgtatcaaaagacgagcacctctaatggctgggagataagcgggggaaccagcattgtttcaccacagtttgcgggggtggcagcgttgattaacagtcaaactgaccatgcgcgaatgggattctggaatccacagctgtatcaactggcaaccaaatcggattcaccactgcaaccactgaacgacactgagaataattcaaatctgtattatactggccaacccaataccgtctataatcaggcaagcgggttgggaaccgttgattttgcaaagttgatggatgtttacaagtgatgtaattgatagtgatataaaaagtgcaaaccgaaaacgcggtttgcacttttttgtgctctaagacggtgacggatgaagctctattcttcgtcagggctatatttcaaaatatctccaggttggcagtccaacgctttacagagtttctcaagggtactgaatcggattgctttagccttacccgtttttaagatggaaacattggtgggagtaatgcccactttcttggctagttcaccagtcgaaatatttctttcggccatgacaacattaagggtaattttgatcaattagatttcccccttccttaaacggtgaggtcgttttcttgcttaatattcattgccattctaaacaacgtgtagattaatgcgacaaacaccaacataaccgcatcatccagcaaattttcccaggtactattgaatataccattgttgactcggcccaagaatgactgggtcatttgatttccgatggcaagaaacacatctgagcagattgccataatttgggaatgaacgattctgcgcagcattgccaaattatcagccacaaagtattgttttttccccaagttgtgactgattcgaataaatgctgaaagggcaaacagggcagagaggatggctaagaagatcccaatcgccattaagatcgagtatggaagaattggaaaatgggcgacagcgctgtgagctacttgggtgtgtccaggaacaatcaagaaatcgccgttgtcggcaatcattttcataatattggcatgggtgaagccgttatacaagtaaacaaacggcgtaatgaaactgaagcagacaacaacgaaggcgatctgcatcaggacggaaacggcaccaatactgcgatctaataattttgacatggatatcagcctctctcttttaatctggattaattaactgtatcgaatatatcatatcgataaacgaatatcaatatctatttttcgataaaatatatttgaaattcatttgaatttattcgatggtcaatatatgaatgtcaaaaaattggctggcaggttggactttgagtggctaatatatggttataccacaatcaatttggtcttatacaaaagcaaaatgaaatttttacattcattatcatttttttactttcaatttacattaacgaaactggcaatttacattgaaccctcacaataaatcttgtaacgaaataaatgattttgaggtgagataattgtcaattactttaagaaatgtccgcaaagattatgatgcgcagacagaagtcctaaaagatatttcggtgaaagtcgaaactggcgagttcttcgtcatcgttggcccatccggatgtggtaaaagtacactacttagaatgatcgccggattaacaccgattaccgccggcgaagtaagtatcaatgacaaggtcgttaatgacttgccgccaaaggctcggaaattaacgatggtctttcaaaattatgccctgttcccatttatgaatgtccgagataacgttgcttttggtttgaaggcccgcaagatggaccaagcagatattaagcagcgggtcgacgaagccttaaaaatggttaacttaactgaactcgcgaaccgcaaaccccgtgagctatccggtggtcaacgacagcgagtggcattagcccgggcggttgccagtgatgccaagatttgtctgatggatgaaccactatccaacttggatgcccaactaagaattaagatgcgccaagaaatttatgccctgcaacgcaaactgggtctgacactgatttatgtcacccatgatcaagttgaagcaatgaccatggccgaccacatcatggtcctgaatgacaaacacgttcaacagattggaacgccaagtgagatttatcaaaacccggcaaatgattttgttgccaagttcttcggtaccccacagattaacattctgaatgcccagcgttcgcaaaacgataaccatgttttgaatgtttcttctgatttggaaattgctttggatgaagaagttcccgctgaaaatgtgaagattgggattcgtcctgacgatatgaaggctgaagcggctgaaagcgttgaagccaacgccaccgttaagaacaccgaattcttaggggacgaaactattatctacgccaccttgaatagtggcgaagacattcacgtcgttgtccctggccaggtcaattaccgtattttccagccaatcaaagtttccgcagattccaacctgatgttttttgatacagaaggcaagcggatgaacctttcaaaggaggcctatgttcatgcttaaatctccagcacaaagcacaccgacaagcccggtttcggttgagaaaaccaaaagcaagcttgccgaacaggaagccaagttcacattaaatgccaaggataagtattttgcctgggcatttctgggaccgtcacttttgatcttgggcgttttcattttctacccaatggttaagacactttatctgagtttgttcctcaccaacacggttggtaagccaacggttttcgttgggatttccaattacatcaacttattgacttcagctgattatctatccagccttggggtcacgttattctacgttttcgcggtgaccattatcacgatcgctttgggattggttctcgcaaacctggctagcaaacggctgccgggaattggcctttttcgaacactattttcggcaactatgggagtttccgtttccgttgccgccatcttctggctatttatttttaacccatcaactggattcctttctctgattagcacctggatgcatctaccacaaattccttggctgactgatccaactgctgcaatgtgggcggtcatcatcaccaccgtttggatgaacctgggctttaccttcttgattttgctaggtgccatgtcatctgtaccaacgactttgtacgaagccgccaacattgaaggcgcctcatcaagatttcagttcttccacatcacaatcccatccatttcgccaaccctgttctttgtttccatcattactttgatcgaatcatttaagagctttgggttgattgacctgatgactaaaggtgggccgaccaacgctactaacatgttggtttatcgaatttacaaggatgcgttctacagcggtaactacgcgcaagccagcgccgaatcgatcatcttaacgatcatcattgcgctgttcacgctcctgcaatttaaagttttggaaaagcgggtgaattactaatggatcttgtgaccaagccaaaattgtcccggcgaatttgggactacgctttattaacgattctcgcagtgattgttctggcaccgtttctgattggtttgtggaccagttttctgccaaccatgcagatcgcgcagggaaacttcttaagcaccaaggtttccttccagaattacattgatgcctttacccagacgccaattctcagatacctgggaaatagtttggtaatttccacggcaaccatgattgcccaactgatcttttgttcgatgagtgcctacgcctttgtgttcctgaaattcaaagggcgcaaattcctctttggcctgttcttggcaaccatgatgctgccatttgaagccgaaattattcccaacttccagaccgttaaggccatgggactgctcaacagctactccgttatggtgattccatttctgacatcggcattcggagtctttatgctccgtcaatcatttatgcagatgccgattgaacttaaagaagccgccgatattgaaggcttgggccacttccagttctattggaaaatggtcctgccttataaccgaattccactgatgactttaggtgcctacagtttcctgggcgcttggaaccaatatctgtggccaatgttgacaactttcagcaatgatttccgaccagtccagaacggattgcgccaacttcagtcagaagaaacctttaacgactggggcatgattcaagccacagctgcaatcgttgtgattcccacgctgattgtgctgttcatcggtcagcattacttcaaatctggtgtgaatgaaggtgcggttaaataatgaaaagagtaacagcatttctcaaaacatacgcactgccaatctttgcgatcttcgcaattgtcttggggatcgcctttgtgaatggctccaagaatgccagcagtgccaaagccggacgaattccagtcgtcttctggcacgaaatgggcggtccagctgagcaagctttggataagatggttgatgatttcaacaagtctcaagacaaatacgaagtcattcctcaataccaaggtgcttacgatgaggccgttcaaaagattattcaaagtcatggaaccagcgcctcgcctgccttgttccagtcctttgatatttcaactgcccagatgatgcacagtaagtacaccaccccggttcagaaattcatcgatgaagacaactatgacgccagcgacatttcaccggttgcccgttcgttctattctaataagggtactcagctggcgatgccgtttaacacttctcaaccagtgttgtactataacgcttcgttgttcaagaagtatggcgttactccgccatccaagtcaccaagctatagtgacgtgacccgggcagccaaggaactttatgccaaatcccatcacaaggtgaagggcatgaccatggaaatctatggttggttaatggaagaagcccttgccaatgcccacacatcattgattaacaatggtgatggtcacactggcaatccaaccaagattgatttgaataaccccacaactaagaagttcctgacctggatcagaaccaacatcaagtccggtgacttcgtcaattacggctccggagccagtgctgaaaccaatgaaattgccgccttcctggcaaacaaattagggatcttcgttcaatcatctgcctatatcggccagttgaccaccggtaccaagaacaagctgggaatttcctacttcccacatccggatggtgtgaaggccaatggtgttggaattggtggggctgcgctttggatctcgaatgataaacccgctaagacccaacgcggtgcctgggaattcattaaattcgctgaaacagctaagaatcaagccaactggcaaaaggcaaccggctacttggcattaaacaagaattctcaaaagaccaagactttacaagatttgtacaaaaagattccggctgcccgagttcctggtgaacagttagccagtgccaaacccaacaataccaactccggtattttgatggaaggcatgcagctgacccgtgaattggaagaaactgcgatggaaggcgtttacaatggtcagaatatcaacagtgcgctaaacactgccaacaaggccatgaatgccaacttgaagacgactaacaaagcagatggcaggtagtttggatttactttccattaaggttcacaactgaatcttaaagggaaagtcgttaagagagttgaagaattgaaaggaagttacccattttgagtactaaaacattaatttttgggcatcgcggttacccgttcaaatttccagagaattcactaaaaggatttcagtacgccattgatcatggcattgacggcttagagtttgatgttcacctgacaaaggacaatgtgccggtcatcatgcatgacgaaaaaattaatcgaacaactgatggtaaaggtttaatcaactcatacaccctcaaggagctccaacagttccacatgccagacggcgaaaccatcccaactttgaaaaatcttttggcgttggcggttcatcgtccggttcacctgaatttggaatttaagaccaacaagatccactacccgaagattgaacagattgtccttgatttggtcaagcaatacgacctgatgtatccagttatctactcctcatttaacctggactcactcaaaattgcttaccaaatcgaccccaaccagcagtattgcctgttatcggatcacgtcattaagaaccctaagtcattaatcgttaaggagcatttggctggactgcatctcagtcattaccaaccattagccaacgttgacgaacggatttggactgtcgacgatccgcgaacgcaagaaaaattattggcggatcatgtcgccggcattatcactgataattttgaacaggcggtcagaattaagaatcgcgctgtcgcaatctagcattaatgtcgacaaaaagagcattcggattaggtttccgaatgctctttttgtgttatttggtgacatacaaacctttgtatccattactcataccggctggattccacacaaatccgtggatgttggttcgccagagctgagtggtggctggctgatacagtggaatgacgccttggtctttcatcaagactttttcggcgtttaccaaatccgcatatcgcttggtgcggttatttgcatcagtggttttggatgcttcaatgtagcgatcatattgtgaattagcccagtgaccattattggttgggttattcttagtcattaagtccaagaagttgattggatcagcgaaatcggcaccccaagaggaaaccaccagatcaaaatcaccgctggttgaccgtgacagcttgctcttagttggcacattgtggatggtgatactcaatcccggtaacttgttgaactggctttgcaggtactgggtggtcttcttagattgatcagtatcatcacttagtagtgagaggtgcagtttcttcactccagtctgcttgaggccggctgcccagagtttcttggcttggctttggttgtaggcaacccctgatttttcataggcatcactggcaaaatcggcaccagttttaggattctggaagaagttagtggagacgaatccctttggtgcggttgacccatcacggagaacttgggtagccagggattgtttattgataatttgggataaggcttggcgaattttgacgttctttaaggccttgacccgcttttgattcatttcaaggtagatcgttgagccgccgacaaactttttgaactctggccggttcttgtaggacggcacttcttcaccggacagtgtcacaacatccagcttgttttgctggtaaagcgaaagtccggtgcttggcgttttgacaacttggaacttaagcttgtcgagtttaacggcctgcttgtcccaataattaggattgcgcttcatcgtccaggtatcactggttccattccagtcggcaagctcaaacggtccgttgtatgccgttgtggtgctgctggtaccgtaactgctgccgaacttcttcaccgcggattcctgttgtgggaagaaggttggaaaggcgagcagtaatttgaaatatggaactggatggctcaggtgaaccactaaagtcgatttgttgggggctgatacgcccaacttatttggcgatagcttatttttttgaatggcactgtagttcttgaccccttcaaacaagtaagaatacccggaagcagtctttgggttgaccactcgacgccagccatacacgaagtcatgagcgaccactggttgaccgttattccatttatcattggttcgcagcttgaaagtatatttcagaccatcttttgaaaccttggtgctggtggccagggcgttttcaactttggattttggaccaagccgatagattccctcgccaatttggtaaagtggtgtcaaactaccgctgtcagaagctttggcagtgtccagtgtcgaaatctccgaatcggtactgatattgacagtttggtccttggccatctggttgctggactttttggcactttggttgccgcatcctgccagcaccaaaatgagtgccagtgcgccggtaattgttagtaaatgttgattgattttcacgttttacccctcttttttgacatgaaaactgccagcacattgatacttgctggtcagttgatgatgcatgaattgagttacttggaatttgttagtgccaaggttgactatattaacatggaatgtggtggggtggcaaatgtggtgtgggaaaattttacctagcggaaacgtgttttcaacaactgaggctaacttctaagggtactttggctaaaaccccaagaccagggactttaatcagagtacccttagaaaacgcctcacccgttgctcaaaacactctgagtgaaaacgtgttccgacacccctgacccctaccacataaggcaaagctaccaacaatgaacacaatccgttcattattgatagctttaccttatgctccggggccacccggggtttgtcacactctaatcaaattcctcatacacattcggatcctgcccatccactctgccatccggcttagtgagagcgttgatttttttcatttcatcctcagtcagttggaaatcaaagaggtctttgttcgccctctgatggattaagctgcttgaacggggcactgggatgatgcctctttgggtatgccactttaagataatttggccggtattcttatcgtactttttggctaactcttgaattaatggttctttcaaagcggcacttcctctgcccaatgggctccaggcttcggttacgatgccgcgttgttggtcctcttttaacatgcgttcgttattccaatagggatggacttcaatctggttcaccgctggggtgacgccagtttcgttaatcaatctgtccagatgttccggttcaaagttggaaacaccgattgaacggatcagaccacgttttttagcatcaatcattgcttgaaatgcttctacgtagtgattacgcttcggcagcggccagtggatcaaatataagtcgaggtaatccaaccccaaacggtagagagattcctggattgccttggttgcttcgtcatattgatgatactttcccggcagcttggaagtcacaaagaactctgaacgggggatcccggaacggcgaatcgcctcgccgaccatgccctcgttatcataattggtggcggtatctaaaccgcgataaccgtcctggatggcagcgagtgtctgctggagaccttcgccaccgcgaatttgaaaagttccaaactgaatcgtggccatcttgtagccgtcgtttaaagtgatttctggaattgcgttatttgtcaatattcgtacctccatgtttaatccttgcgcgacaatttatagttacgaaaaaaggagaactatttttttgtttgctgatcattatttttgggttgagtttttggatgcggcttggttggctgttggtcgacttttttgatcgtgatgtaccagccgacctgcatcgatttgttggggttaatgtattccacgctaaagtcataaaatttggcgtggggacttttttcgatgagcatattttttacctgcagggcatctgcccgactttcaaaccgcagattgctattggtgctgtacccactgtgcttattagggtcattataggtctggttaaaaaagtccaggtattctttggagtcgttcaaggtatcacgtccttccttcttccattgtacccaacatgctgctcaatttcattgtccgtggctaattaagtggaaaacctaaaacttttcagttgatatggggaattttgatcaggattgaattgtgtttcacataggaaacctctaaaatatacatatatggcgaggaggggatcgtcttggtgaaaaatggtttgttattggtgaatttgggctcaccagtgtcgcccagtaatgcagatgtgaaagcttatttgaaagaatttttgagtgatcaaaatgttgtaacgctgccgaagtggttttggcagcctattttgcgtggcatgattctaccgatgcgcacttggcggtcggcaaccttttatcagcacatgtggaccaaagccggttcaccgctgacggcttacacagaaatcatgaagcaaaaggttcaacaggacttgcctgattgggacgttcagtatgctatgaattatgggcaacccaggattgtcgatgttttgcacgagatgaaagatcgcggtgatcgtgacatcgttgtcttgccgctgtttccggattacacacaaagcacccacgatactattattgaaaaagttcagtcgtcgggagtcgcgactcatattattaagaacttttatgatgagccggtgtatcagcaaattttagcccggcaaattgacgaggcctacccaaagaaacagtatgatgcggtgattttcagctaccatggcattccaatgtcgatggtcaaaaaaggtgacccatacgaaggtgagtgtctcgccacgactcaaggtgtgatgaaatacgttaaacaggttccgagtgacaaagtcaaaacggtttttcaatctaaatttggaccgatgccgtggctcaaaccttatttgaaaaattatttgatggagttggccgcaatgggtaaacgcaatgtgttactggtgacgccatcatttgttgaagactgtttggaaaccatcgaagaaaataatgttcaaaactatcagaccttcaaggcaagcggcggcaacgtctttgactcagtcaaaccgatgaatggcagtgatgatttttgccaattcttagccgacctcagtgttaaacaacttcggggaggcggggccgatgagccaagagcaaacgcataaaagccttgatgaaattaatcaaagtgttgaagttcccagcgtttatgaaacttcatttgtgcaaaagtttctcgcatacagtggccctggagcgttagtcgccgtcggatacatggatcccggaaattggctgacgtcactttctgggggcagccaatatcggtattcacttctgtcagtattattgatgtcgattttggtggcaatgttcatgcagacattgtcgatcaaattgggcgtcgttgcccggctggatctcgctcaggcaattgcccaaaaggtgcctaaagccggtcgctacacgttgtggatcatcaatgagttggcgatgatggcaactgacatgactggcgtcgtcggcacggccatcgcattaaaattattatttggtttaccattgttatatgggattttgttcacgatattcgatgtattgttagtgctattatttttaagatttggaatcagaagaatcgaatttattgtgttaacggccattttgattgttggggtcatttttggcgttgaggtgtcacgggcaacgcccaatctggcacaaattgctggtggcctgctgccgacacccaagattttgactaatcatgaaatgctgattatgagcttggggattgttggggcgacgatcatgccgcataacgtttatctgcactcttcactcgctcagagtcgccggtatgattaccataatcccgcccaggttaatgaagccttgagatttgccaaatgggattccaatgttcatttggtggccgcctttttgattaatgccttgttgttagtccttggcggaacgctatttttccacacgaacgggcatttgtcggcctttcaggatgtttacaacggattgaagaattcggcaatcgttggcaacctggccagcccgttgatgagtaccttgtttgcgtttgcgttattgatcactgggatgatttcttcaatcaccagtacgttatccgggcaaattgtgatggaaggctatcttcatattcgtctgccactttgggagcgtcggttactgacccggtttgttaccctgattccgattttagccatcgggtttctggttggctttaacgatcacgactttgaacagattattgtctatgcacaaattgcgttatcgattgccttgccattcacactgttcccgatggtggccttgaccagtaaccatgatttgatggggattcacaccaaccagcggtatgtgacgatgattggctacctgctgacgacgatcattactgttttgaatttgcagtttgtgattgcggctttttaatcaatgtatttagaatatttaagagataagggggagttggattgaaaatacttggcattttggggtctcatagaaatgacggtgcgacagacatgatgctggaaaccgtgctgtctgcggttaaagcgcctaataccactgacatgatctatttggaagactatccatttaagccggatcagggagatcacaaagatccggtgctggatgaacttgaagcaaagatgctggaaagcgatgtttgggtgattgcagccccgacttattggggtggcttggcagggaagatgaaagacttctttgactgcatgcgccaacgcctggtccgctttgatcatgagggtggcactcatccggaccgtttcaagaataagcactacttaagcatcaccgattgttataccggaaccttcgagaactgggtaaccggcgtcaccgaccaaagttttcgaaccattgacaaagtgatgtcggcagccggtgtgattaaaattcacgaactagtgttgaccaacacttggggaatgaaggcattacccgagaacaaaaaacaggcctgcctcaaatggggtgcccgcctgaatactgaacaaaagagagatgatagtacattgaaacgatatattgagttattctttatggttgctgtgatggcgttattgacgatgggaattcaagttggtttgcgtttggtttccactgctgatttctggtggcgctacgcttcgtttgtcgtcattttctatgtgttgttgggatgcattcttcatttctttacggttgtgaaacatcgccgacgataatctaacttgatactaacatgagagtccgacgcacgcgttttgatctcatagtttaacgtaaacaggccatcattcctagttttggaatgatggcctgattgtgtttcagccgatcgtttcacgtttattctcgataacagtcggattcaacaagtctaagattagatagcagcttcagcaattattgtaactttttcttcactttattcagttcctcagcaagcgcaggcctggatggatactcatcgattaagccatcgatccatttgatagcggtttgcacgctgccgaatgcggtatagttcttgattcttcggcccattcgtcgataggcttgtctgccgggatgcttttcgttaagaacaacgttttggtaatacagcttgttgacgacatctgggtagttggagtacaggtccttgctgtaggtttcagtgagctcgggatgctgcatgactagttgcatgagcttatcgaattcacgttccttgtctaaaatgaaggcatagttttccggtgtcagtttcttcgccgctttagccaggaaagtcggatattgggcatcccaactcttatcctgttgtcgcaatttcttgagtggttcgtatgcatcagggtagtttgcgaacagacggttctcgagaaccgcttcttgtttttgctgctgatcggtagcgtcataaattttgatgagatattgctcccaaattcgccgccacccctggtcctgttttgaagcctcaaggcacagttcttccgctcgaacatagtttttgttttgaatcgcattttggatttccacttcgcgaatttgcggaatggttttatgctcgtccataaacttctcggcatcggactgctctccaagttgaatcaggatccgagcatgaagcactttatcgtaaatttcagactgagtcgtttcaaatccttcgtcggctgctttgataactgcccgagatgcggattgagcaagcttggcagactttggcgtgatcagcgggagggcattatacaatacctgatagcgttgttcgggccagccggcaaatatttttcgcttaaaaacgcgaaccacgtccttaatgacgatttctttttgtgattccaaaatctcaggggcgatattggtgctcaaatttttcattgatccaaagactcgatcgaacgtgtcggttagggcgccggaactgctgtcggcatcactgagcattttcgcagccgtttccacaaccaacagcaagccattcattgcatgatgataatggccttgtctgaaccggagcatgtacttattgatcacatcatccaagacattgcaaacaacaatgcagccttggtaatcaataaagccgtaagatttgtttttacggactgtactttgaatcagtttcttggtttgcaccaactcagcatccgtgtcgagatcgccaaattgggcggtcacgtctctgaaaaatgtgggatcgaactgcgcctgattaattatgaattgccgaagcccctcaggagaggcttcgttgacggctttgattaaggattgtttttctccggaattcataattgtttcacgctcctctgacgatatcggaataattcaaatcgatattaccatagattatgagcgactgctaccgctttcagtaactaagtactaaatcttaatggacaaggtttgcaggctgaaagattacttcagtccacgggtgtttaaaaggtaccattgtgtggtattatctatatgggagctaaatcccaaattaatgaaaaacattttgcaatcactaggatctggtcggggagaaatctctggccttttttgtttggtttccggtttgcgtgttgcaataccttccattcaagatatataattaaaataatattagaactatctcattttcatataatattcacgagggagatattgccatgaaaaatgttaagaagtggttggtgatcgggacgattagtctgtcgacattggcattcgcagcctgttcgaacaacaaatcatccgagtctcaatccaagcctatttccatgccgacaacctatagtgcgactggaaaggcaaccaaaacaggcaatgatagtacgctgaacgctgctgaagtcgttgacgcaccgtttaccgggattacgcttgccgtgctccaggataacgttgaggattctgatgtctattcgccaggtggtggcgatcagttgtttaagagcaacaaagattttaagattgtgaagggcggcctcgcgaacttgaagctggaccgatcaaataacacggctacgattaccattcggaaaaatgccaagtggtcaaacggcagcccagtaattgccaaagatgttgagtacgcttatgaaatcatcggcaatcaaaatactggcgctgaacagtactcgtctgacatggcaaccattaaaggcatggctgcttatcacactggtaaggcgaaacagatttcagggattacctatcctgatggacaaaacggcaagcaagtggtgatccactacacccatttatcccctgcgatgcaatacgctggtaattcattcttatgggggactgtggttccttatcaacatatcaagaacgtcaagatttccaagttatcgtcctcaccggcagtccgcaagcacccaattttcgttggcccttacaaactgcaaaaccaggttcaaggtgagtcgactgcttgggtacccaataaatattactggggaccgcagccaaagattaagcacgtcaatatccaagttgtttcctcaagcaatgctgcagcggcgtttaaggcgaaaaagttcgactttgctttgggcggcctgcctgccagtcaatataaatcagttaagaatatcaaaggctacaccctggcaggggcacctggtttaagttatggttactttggcttcaacgttggccactttgacaccaaaaccaacaagaatgtcatggataagcacagcaaaatgggtaacaagaacctgcgaaaggcgatgctgtatgcagttgacctggacaaggttaacaagaaattgttgagtggggttcaatggcggccaaataccttgattccaccaattttcaagaaatatcatgataataaagcagccgggttcccatatgatatggcaaaggctaaaaaactattgaaagacgccggttacaagaagaagggcaagtggtacgtacagcccaacggcaagaaattgaccattcacttcggcgcgatgcaggggtccgctgccagcaacgaaatttctcgatatgaagttcaacagtggcggaaattaggtctgaacgttcaaatgaccaacggccgaccacttgagattaacagcttctattcaattctgggcaagccaaagcaaaagcagatcgacgtgttcgttggcggttggcagttaacctatgagccgacaccaacccagttctatggcgaagatgccacttataacatgggacactttgtgaccaagaagaacaccaagctgctcaacagcttgaatagtaataaagcttggaatcagaagtatcggatcaagcaatttaagaagtggcaggtttatatgaacaaagaagccgcttatgcccctcaaagcaccttgctgagtttcacgccggttaaccaccgactaaagaactttaagcaggccgcctacaataactacctcttcccaactttctgggatcaattggaattgacttcgaagactcctaaatagttctgtataaaagtagcgtcatgggatttagcttccatggcgctacttttatgtgctggataaatcaaatgcaaaattcactcacaaaaagagaaaccggaaaccaataacgcaaacctaatgtgaaattaggggggcgcaacaaatgcttgctggtaaagatagtaaagttttgtatattggatgtagaatcaaaatactttccaagcgaggtgccgcatgataacacaaaataaacctaattgggtcaacaatcccagaaagtggatttggatgctagtgggatttattattatcgagaaatttttggagaatggcatattagttccagtactcctaaaactgccctttggagatcttaccagcaatattttgtacaaagggatcgaagtgttgctagttttggggttaaatatctggctaatcaaacagaagttgtatttctccgttaatgttaccttaaagacaactctctttttcctttttggtattgtctacattagcctgtttatctcatcaggaccggtgaaacttttgcctccaattatactgtggacgttgttgacggcgatttctgaagaactgctctttagggggagtgatttttggggatttattcaaacgcctcactcagcgtcatctgacgaagtggaacgttgcaattgcaattggtttatcaagcctgctgttcagtttgcaacatttgagcaatttggcaaatcagtcattgatggatacagtttgtcagatggttgaaacgtttgggatggggattttgctggcagcgatttatgtgagaaccggatcattgatcacgacgatttttgcccattttctaattgactttccgattttgtatttaagtcagatcagcactggttttgcttctactgcaaatatgtctgggaatgtttcagtggtcggatcgattattgtcgcaattgtttatgccctggttggaatagttgtcatccgatcaaaaatagccgataacaaattaccggcaattacacatactatagaaaatctaccaaattaaaagtcgcgatcccgatagtcgtcccaatccggcatctttgaatggttctccttggcggttcgaatgtcatgataaaatctgaccttgcgcttgatgtgacgttcgttctttttcaaaagtgccagttgttcaaggacgcgttgatagtggttatccaaaatctcacaggttttgtccaagtccgcatcgtcgtcttgggcggcaaacagttcctgcaattctttgagggtcatcccagtatccttaaagcagcaaatcgcccccaggcggttgagatgctcctgcgtgtatgcccgtcgccctttgatccgaggaatgtcataaagcagccccaagtcttcgtagtagcgcagggtggtcgtcggcaagtgatacattttagatacttcggtgatcgaataagttttcacggttgcggttttcaaattgttgacctcccaagtcgaaataagtttacttcaagtatactcgaagtgttacatttaagctaaacaatttaggagatggcgaaatgtatcaagcatccaaagatcgttacgataaaatggtttataaccgggttggcaaaagtggcctcaagattcctgccttgagccttggactctggcataacttcggtagtgtcgattcctttgaaaatcaaaaggcgattatccatcaagcatttgacctggggattacttattttgatttggccaacaattatggcccggaacctgggagtgccgaagagaacttcggtcggattatggcagaagatatgaagccttatcgagatgaaatgatcattgccagcaaggccggctattacatgtggccgggtccttacggtgaatggggatcacggaagaatattattgccagtgccaatcagagtttgaagcggatgggattggattatgtggatatcttctattctcaccgatttgacccggacacgccactggaagaaaccgcccttgccttagatgagttggttcatgaaggtaaagcgctctatattgggatttccaattatgacggcaaacaaactgcagagattaccaagatctttaatgatttgaacacgccgtttgtgattcatcaaccccgctataacatgtttgaccggcacatcgaaaatgatctcttcccggtattgaagaaggaacataaggccgcggtcagctttagttcgctggcccaaggtttactgacggacaaatatttgaatgggattccagctgattcacgggctcacaaatctaccagtccatttcttcatgaagaacaggttgaagagacgattaagacggttaagaaattgaatcaagttgcagctgatcgtggccaaactttggctgagatggctttggcttggaatctgcgtgagccggaaattgccagtgtattgattggagccagtcgaccggaacaattacttgataacgtgaaggcactggacaatcttgaattttctagtgaagagcttaagaaaattgatgatattttggcgacccaaaagccgattaaataaataagagtggaacgcgaggcgttttgcttaaatggccgggatcagccgatcgttgcacgtttaaacttcataccattggaactcaagagaggccgagatataactgacaatcagttgtatcccggcctcattttgatatacaaattaacttcccattgatggttgacttgaagtgtaaactgctcgatacttcagaacaatattggctttcttttgggtgccaaccgatgaccacttacccttggtcttttggtagacaaattttggtgaagtgccattcagttgaacaaagaactgaccgtcacctgatttgcgtacccggtagacttttgttttgctggttggtgaaagggtcgtttctggatcggtcttgttataagcgacaatactttgtcgaatcatatctttatattgattggtttgatggcttttcatgataatcccgacgatgccggcaatcacaatcagcaccatcagtgacagcatgatccacatgatgttggctcgtttggcgttttgagctttttccttctcattcattctatatcaccccatctatttccattggaatcgaaaaaccttacatgttaaatgtatcacacaaatggcctcttgagaaaaatgtggggggatttcttcaacagaacgtcgaaaagtatttccaactttgtgttaaataaaaatcatttcaaattgtgatcagttggatgattggcaggttgatgtcaaggtgtacaataatcacattattgtaattggaaggaatgacttgatgaacattctgttactgattatcgttggctttatcatcggcactgttgtgattacccttggcggtggtggggccgccttttaccttggaattctcacgacggtctttggcctggggccagcgagtgcggccgccacttcattggtgacctcgtttccatcattgttaatcggctcgtactcttattttcgactacacaaaattaaattacggattgcctggaggatgatcatttttgccgtcccggctgtggttgtgggatccttgatctcgccatatatcccggtcaaaatttattcgtatattatcggcggcattttggcgattttagggcttcagacgttgtttagcagacaaaaggatcaccaaaatcctaataaatggttggcaccagtctatggtgtcatcagtggtctaatggttggtgtcggcggactcagtggtggtgggccggtggttgccggactgctcgtgatgggatcggacatggtcaccgcagccgccacttcttcattagtcctggtcgtgatgaccgcaactgggttaatctttcacctttctgctggtaacgttgactggtcggtgggcctcggactgatgtttggggcaattctgggatcgtttttagctccggtactgttgggcaggctcgatcctcagaagttcaccagatatgtgaaaccgattctgggagttctgttggttgtgatgggtgtctttacggcattaaaatgaagtccataaagctcctgaattaaatcgtggtggatgaaaattgtgaatacaagcaaacacaaacctggtttgcaattggtttgcgaacaaaagccaattcaattacattcagatttcccttgatcatcaccttacgtcatcagctataacagaatcaggaggtgaaaccgatgtcgaaatatacaacaggagagcttgccaggttgggtggtgtttcgatcagaaccatccaatattatgatcaaaaaggaatcttgaatccgacaaccatttcagatggcggccgtcgcttatacacggacaaagagttgaaaaccttgcgattgattttattgttgaaatcaatgggcctctctctgacgacgattaaagacctgttatcagaagataattcaactcaagtcctgtcgttgatgcttaaggaacaggaaaagaaaattcagcatgagatgacaatgaccgcggatcagctggaaatgattcgcaaggttcaagacagcctggctgattatgcgctaatttcccaacctgaccttgacggcatcgaaaatatgatggaaagtaaaccaaaattaaccaagtttcgctggtggatgttaacttggggactgatgatggacgcactggaaatcttagcaattgccgtttggatcatcactggtaattgggtaccagccgcaatcatcttcccagtcgtgattgtaatggctatttggattatccgggagtattacaacaaagttgagtatatctgcccaaattgtcaccagcatttcaaaccgagctggcgtgactttacattttccaagcatactgccaagacgcggaaactgacgtgtcccaattgcggttaccgtggcttttgcgtcgaggtttacgatgtgaagcaaacgagtagatagtaaaaacacctgaccagaaatcggtcgggtgctttttggattattcatgttccaaaatctgattcatcgcgctgtcggcactactcttatacattgtgccgaatttattggtgtgaaccatcaagtaatacagccgatagaagttcagccgttcattggcgcccggatccaaagggtagactgcgttataagcggcgtagaagtccgcgtcaaagccaccaaagacggtggtaatccccaggtcaaattcccgatcaccatagaaagaagcgggatcaatcaatgccggacgaccgtccgccaagaacatgtagttgccgccccacaaatcgccgtgaagcagggatggctcgctttcatgtttcgacaactgatcgagaatcacttcgcgaacccgtttgtacttttcatcgtcacttggattccataaatgctttttcatcaaagcatcgcggagccggtccaatcggtggttgacgaacaattcactccaagagtcggtccaactgttatcgaagctttcatcgttgctgacatagggcaggtcaaagccaaattttccattcttgctataatgctgatgcaagttggcaaccagttcacctaagtcactctgactgccggaacctgattccaaaaagttcagcagcaaataagcatcgccgttaatttgaccattgcccaacactcggggagccaagacgttggcttcctcgaaagctttgagcccagcaatctcgccagcgtaaaagtcggcagtcgtctggggctgaaccagtaggaaatatgtgtcatcttttgtttctaatcgaaatgcctgattaacatcgccaccaccaaccgggactgctttggtaatccctttgatgggcagttgcgatagccattgatcatccattgaatcatcacctctgggttcattgtaactgaaaattgaattttatgtaggctggaattgcgatgggggtcaaatcgggttaccattaaatcaaatcatatcgtcgattaagcaaatttgctggaaaggagccgcaaatgaattacttacaagttgccaagccgttggtgttacccaacggtcagcaggtcaaaaatcgattctttaaatcggccatgagtgaaacgatggctaaccaagatcatcagccagatgatcgttatgcaaccttgtatcgagcatgggcaatgggtggttctggaattgtggtaactggtaacgtcatggtcgattcaaccgccttggcagaacccggcaacgtggtcgttgaggatgagcggagcttggcaacccttcaaaagtgggctcaagcgggaacgacaaaccacacccagttgtggatgcagctcaatcatcccggtaaacagtcacccaagtttttgtcggctcaaccggctggacccagtgccattccggtgcatggccctaatcagaaatattttaatccgccacgtgaattgaggaattctgaagtacatgagattattgccaaatacattcgaaccgcagagattgcccaagaagccggcttctccggtgtccaaattcatggcgcatacggttatttggttaatcagttcttgtctcgcaaaggcaaccagcggacagatgaatttggcggctcactggagaaccgaatgcgatttctcgcagatatctataaagggattcgcgaatcatgtgggccccagttttcgattgggctaaagctcagcgtgcttgaccttgatttggaaggattcaccgaacacgactcaattgccgtgatccaaaaaatggccacccttggcatcgacctgattgaaatctctggtgatgattacgaagattcggcggttggtttttccggctatgcccatatgatccatcaacttacagatgtccccattgtgctcagtggtgggtttagaagaatttccacgatggaagaggcgctgggaacccacgacgccgacatgatcggaatgtgtacaccaatggcggtaatgccggacctgcctaatcaaattttagctggcagctaccaaccagttccactgccactaacgatggggagtcgaaagttggatgagaagtattcgccaacattcattaccgcatattgtgaacaacaggcgcgtcggctggcagaggggaaacgaccacagctatacacgagtgcctggcgcgccttggcggcaagtattcaaatgcacgggccaaatgggctaacacctcgccgggctcaataaataattgaagattggaagaaattcatgtcacaaccatttgaaccaaattcattagatgaactaaaagatcagtatgacgttgttgtcatcggctcgggtagtgctgggcttaccagcgctattcgggcaaccgaactcggattgaaaccagtgatttttgaaaaaatgccgaatgttggcggtgatactaaacgggcctcgtcggggatgaacgctgcggcaacctttgttcagacggagcatgggattgaagatagcgttggcgccttttattacgagacgttgcgtggcggtcatggccaaaacgatccagcgttattgaagtattttaccgagcatggtgcccgggcaatcgagtggctttataaacagggtgtacagttggatgatctgacaattaccggcggcatgagtgtaccacgggcgcatcgaccaagctcaactcaaccaattggtggttacctgattaatggtctgctaagccaagttcaggcaaaacgaattccactgttcaccaacgctaaagtgattgaaatcctgcacaacgaccgagtttccggtgtgcaaatttcaacaccagacggtccgcaaaccgttcacgccaaagcggtgattattgccgctggcgggtttggtgccaacaagtcactcattgcaaagtatcgccccgatctgactaaatacaagacaaccaaccagcctggaaataccggtgatggcatgttgctggcagagcatttgggtgcccagctggttgatatggatcgaattcaaattcaccccaccgttcaacaggatacggaccacgtctatttaatcggtgaaacggtccggggcgaaggcgcaatcctagtcgatcaaaacggaaagcggtttgtgaatgaaatggaaacccgcgacaaagtcaccaacgcaatcgagaagttaggcggcactggtgcatacctcatctttgatgccaaggttcgcaaacgtgccaaggcaattgacttctatgatcatgttggcctggttaagacaggcgatgatttagccaaacttggtaaactgattggtgttgatggtgagatattatcgcaaaccgtagcgaagtggaacgaagcggtttccgatcgaatggacattaactttggcagaacgaccggccgccacatccttgaaactcccccatattatgcgattcacattgccccggcgattcattatacaatgggcggattgaagactaacgatcaaactcaagtgcttaaggcggacggccaaccgattccaggattatatgcggccggagaggtggttggtggcctacatggtgataatcgaattggtggcaactccattgcggaaaccgtcgtatttggtttgcaggcagctcagcaggtacgcgattatatctttgagatgtgataggcgggtgcagcaggaaacacgactaatggtaaagtgtttacagcaagacattggactagtatttcaatccataatcaatagtattattcatacggaggcatgttgctgatgagccaaggtaaaagagaatcaggctattcaaaatggtttaggatgttgaatcatttgattggaccagttatcacaattgggattatttctggaataatcattattatttctgacaatgcttatgcatatgttgttgatgtcattgtgtcagtgtttacatttatctggttatcaacgttcatagttgaatcggtaattaaaatatttggaaagaaataagtaagttaaaattgaaaatgagctgcactcaaagaaattatcgctttaactttggggcagctcattttgacatatgcggacttggcatccatgaaagaaagtatttctgatcatgctggctgattaattaaaataatccattaatctcatcaaattctgctgagctcagttgtacatccaacgctttggcattactgtcgacttgctctggcaatcttgcgccgggaatcaccacgctaatatctggattagcaatgtaccaagccaaaatcgtttgagcaatcgttgcctgatgattttcggcgatggttttgatttgatctaaactatccatgatctgattgaattttgatggagagaacctgctgaacttgtctgcatcgtttcgactgtatttgccagttagtaaacctgaagccagtggaaaataggggacaaaggaaatttggtgtgcctttagatacgggaagatttctgattctgcatcccggtgaaccaggctgtaattgttctccacgacatcgacttgattgtcttgattggcctccttgatctggtccagattaaaattagaaatcccgattgcccgaatcttaccggccttttttgcctgggccagcgcgtcaactgcttcggcctttggggtcttgtcatccggaaaatgaatgtaaaagatgtcgatgtaatcggtttgcagccgttccaacgattcatcaatcgatttggtcaagaacttaggatcgttattaggcttcaagtcgttattgggatcctgcgctgccttcgatgcgatgacaaattttgaacgatcgaaatcttgaatgacattgccaataatgtcttcagacttgcccaatccatacataaatgcggtatccaataaggtaatcccatcgttcagggccgctttaataaccgcctcgccatccgaatccttcaggccgtcaaataaattatggccgccgaccttgttggttcccagacctaaggggccgctgacaacttcgctcttaccaattttaactgagttattcaaagtcaattcctccttacatatcaataatgctctgccataaaaatagggctgaaattaaaatatttcaacccaagtgtctatttacgataattgattattcgtcgtaaggccctttgccaaggtaggcgttaatcatccaaatattcttgtcaatgtcttctttaaagccattcagcatatcttgagttggaaaatctttttcctcgtcagtgacctcaatgcccttttgatattgatcacgcaaatacctgaattgatcaaccagccgctgcatgaagtcacgcatggttaattggtcccaggtcaccttttcgtctggtaagccggtgttatcaatgaattcatgagtggttgcgaacggcgaaccgttgattgcgatcagtcgctcggcaacgttgtccagttgatcagctaattgatcattataatcatccatcagcgggtgcaggcgaaagaagttttcaccccgcatgtaccagtgggtttgttggatgttggtctgcagctggctgagatctgcgactaattgattcaattgtgcgcgtgtctttggaaaatcatacttgtctgccatcagattacctcccagaataattttgaattcgcttacacagtcagtgtactcgattccgggagacggtcgcaaggaagttgccttttagttttcgaaaggcttagtggtcttttggtccactaacagtcggggcctgtggttggtcaggctccgtcgtttccggtgattcttccagtttggaatgcttggaggtttccagcatccggacgtagaccaggaagctgataaatgccgctgctgatacataatagaagaaccagtcttcatgaccgatgtgcttgagccacagggcaatgtattcaacacttccaccaaagatcgcaacggtcagcccataaggaaaaccaaccccgagtgcccgaatttcagtcgggaataattccgctttgacgatggcattaattgaagtgtagccactgacgatcagaaggccaccaagcatcagtaaaaacgatgccactgggctatcgaaggatttgagtccgagaaagatcggcacggtcaaaattgtcccaccaatcccgaaccagtagagtaacggctttcggccaattttatctgaaaggtggccaaacaatggttgggcagccataaaaatcaacagggcaacaaagttgatcatcgtgaccagttttggtgccagccccaatgaattgatcatgtatttctgcatataggtcgtgtaggtgtagaaagcaattgtcccaccaaaggttaattcaacgacggtcaacacttgattgggatattttgccaactcacgcaaggatcctctggtggcctttgttttctcagtctgtttaaattgatttgtttcgtccattgaaagtcgcaggtataaaacgataacggcaccaaccgcaccaacggcgaagggaatccgccagccaaatgcccgcagttgtgcatccgaaagcattgactgcagaatgatttgaacgattaaggcgatcagttgaccgctgattaaagttacatactgaaacgatgcgtaatagccacgccgtccagaggttgccatttctgacagataagtggcagaaatgccgtactcgccgccaagtgataatccttggaccaaacgaatgcagaccaacagcaacggcgcaaaaacgccgattgaactgtaggtcgggataatggcaatcaacagcgatccggtggccatgatgctgacggagagcgttaaggtggcccggcggccttttttatcggcatatttgcccatgataaagctgccgaacggtcgcatcaggaagccaaccgcaaaaatagcagctgcactcagcagttcgacggtttgatcaccgtctggaaaaaatgatccggcaaaataaatggcaaaggatgcataaatataccaatcgaaccattcaatcatattgcctaaagaacctttaatgatattgcttgtaacccgtttttggctgtatcgttgcatgttgggacctcctttaattcagaaccgaattagaaattaattagatatattctaattaattacctagtataggttaataattaatgggatgcaagatatcatgttaggttatataacatgttaccaaaacaaaaatgactgtcacctgtgaaccaattgtgggttcaattccatggggcagtcatttgagcttgattcaattagacaattgcttccagccgcaggagatgatcaatctcataagttggcttcaatcggatggtattgggctgatgggttgggttgaaccagactgaatcgaggccatataaattggcccctttaatatcggaggtcagcgaatcaccaatcaccagtgactggtcttttgaaaagccctgaatgttgtgtgcaacatagtcaaaaaagccaggattaggtttttggacgccgacagtttcggacgcgaaaacattagtaaagtagggtgccagaccagactcgttgagccgccgatgttgagttttggcgatcccattggtcacgacataaatatcgtgacttgcactgaggtcggccagcaattgcttggcttgcggcatcgggctgtgaccttcggctagaaaactgcgataccgttgttcataggcttttccgtcaacaacttggccgtaatggtcgaagaaacgacggaatcgagtatccagcagcgtttggcgactgatttcgcctaattcatattgctgccaaagctgctcattaaattgatggtagtcggcatagacctcagtcgtcagtggctggccgatggtttggaataactttttgagggcgtcgtgctcagctgcctggaaattcagcaacgtgtcatcaacgtcaaagagtaatgtcgaatatttcatgaaaggagacctcacgtcatttttgttaaattctatcacaatcagacggtaattttgctgatattcacaaacttgtcagaattgttggcttactcttcctgcgaagtgctaccattaaaggaaaggtcttttacattacacacaggggagtcttaacatggcaaatcatatcacgctatatcagcacggaacgctggcattacttgttcccgggcttttaaagggaaccattacaatgggggaactgttaaaacatggcgataccggcattgggaccggtgaaggcttggatggggaactgattattcttgacggcaagccatatcacgtccacgccaccggggatgtcacactagcccccaagtcgtttaccatgccgtttgccaatgcccattttgcccgctacacgccactggccgaactggaaaacgttgatcaggctgatttgaacaaacaattggtctcgttaagtcgagctgccaacacttttttctccattaaaataaccggcacttttgccaacatccaaaccagagcggcggttaaatctcagccgccgtacaatactttggctgaaaccgctgaaaatcagagcgtctttacccgggatcagattaatggaacgttgattggctattacgcgccgcaactgttcgagggcgcagcagtgggcggctttcatcaccacttcatttccgatgaccgcaagtttggtggccacgtcttgaatttccaccttgtaaagggtgatgtcagctaccagttatttgatacctttgaacaacacctgcccgtcagtgacaaggactacatgcagcacgatttttcaaaggacgacatcgccggcagcattcaaaagtctgaatagtgggactgttaattacaattattccgattatcgttatcataatttaacactttataaccttttagtaaacgtaatactaatattagtaaaacttttgcattcgccgtaaacactggggtgagtgcatttttgtttggcctaaattacaaatttatatgataaccagttttagtacttgatttatacggatgaatccgttaacataacaaactatggacgctggttattttttgatagcggtccatatgtaatactgtaaatgaatgtaagcgttacgactgtacgtataagagagaatgtcacacaacaaagaatgtgttggatttgtctgatttgttatgtaaccccttccattcttttgggttggggaatcacgactaatcaagcgttggcttaaagtgtaaaggagaatgatgatggaaaaggctgttgcaacagaaaagaaaatctcaagcggatttatttatttctttggttcattcggtgggattctgtttggatatgatattggggttatgacgggggcactcccatttttacaaactgattggggactgcaaaataatgcgacgatcactggctggattacgtcagctgtaatgttgggtgccatctttggtggtgcgattgccgggcagctgtccgataagatgggtcgaagaaagatgatcctgctttcagctctgattttcatggccggatcattgttatctgccatctcaccgcatgacggtcaattctacctgattgctgttcgcgtcttcttaggccttgccgttggggcatcttcagctctggtgccggcctatatgtcagaaatggcgccggccaaaatgcgggggcgtttgaccgggattaaccagacgatgattgtgtctgggatgttgctatcttacgtgatggatttcgtattgaaagacttgcctgagaactgggcatggcgttcaatgcttggcctggctgccttgcctgccttgatcttgttctttggcgtattgaagctgcctgaatcaccacgtttcttagttaaaaacggtcgccctgacgatgctcgcagagtgttgagctacatccgggaaaacgataccgaaattgatgacgaattagagcaaattcaagatactgcttcacaagaaaagaaaatttcaaaatcaaccagctgggcaactgtcttcagttcaaaataccgttacctggcaatcgctggtatcggcgtggctgccttccaacagttccaaggagccaatgcaatcttctattacattccattgattgttgaaaaggcgacaggaactgcagctaactcagctttgatgtggccaattattcaaggaattatcctggtaatcggatcactggtattcttgggaatcgctgacaaatttaagcgtcggaccttactaattcttggtggaacggtcatgggattatcattcctcctgccaactgccattaagttcctggtaccaaacgccagtccattactgattgtcttcttcctgagtatttacgttgccgcatattcatttacttgggcacccttaacttgggttctgattggtgaagtcttcccactggcaattcgtggccgggcatcaggagccgcttcatctgccaactgggttggttcattcgctgttggactgctcttcccgatcatgaccgccagcatgccacaggacgccgtattcgctatttttggtgtcatctgtctgttgggtgtctggttcatccattcacgggtaccggaaaccaagggccgcagtttggaagatattgaagaagaaaacattaataaataatctgatgatcgattccggacaaattctgggatagcaccctataaaaattaaaagcgtctgacacgaatttttctacttgtgtcagacgtttttgattttgatagttacttctatatgatagggcaacaaaactctttacgaacccttattgcagcagctctttaataatcgcttcaccaacaccagtcgctgagttgggattttggccggtaatcagccggtcgtcgaccaccacattcggctcaaaagcggtccccttcacgaagttggcacctgctttgtccaattcatcttccaacaggaactcaacgtcattcgtgagaccgtttaaggcttcttcatcattggtgaaggcagtcagcttgcgaccatgcacaaagcgtttgccatcttctgtccgcatgggcagcaggccacacacgccgacgcaattggctgagataattccgccgttggcataaattgtttcggccagccccgccaattcggtgttctgtgggaaatcggtcatcgttccgtggccgccaacaaaataaattacttggtagtccttgggattgacgtcggccggggtgagtgactgggctaaatgctgatttcggaaggtgtcgtccagataatattcccaatccgtggcgtccatgtcatcggttcccaagctcagaggatcgagcgggacataaccgcccttgggactgacataatcgacatcgatgccgttatcggccatcactttgttgaaatgggtcgcttccttcagccagattccggtggcccgttgaatcttcttgaatttggggttgtttgtcacaaccattaaagctttcgtcataagcagcgttacctcgatttttcgttctgattagacttgtcgatttcatttcctcacccccatcataacagataattcatgaggatgatgagaaatggggtgttgtataagttttaacacatatgttatccttaaggccaaccattcatgaaaatgagtggccctttacttgtagaattgtgtttgagtataaatactaggaggaacacatggcagactcaatattaaatgtcgagcatcttaacaagaactttggccgtaagcaggttctcaaagatgtgtcgttttcagtacaaaccggacatattgtgggcttggttggtcccaacggtgccggtaaatcaaccattatgaaagccgtcttaggactctttaattactcaagcggcaagatcaccattgatggcgatccggtttcacccaccagtcatcgagcgatggataaggttggcgccttaattgaataccccgggatttacccattcctgacaggttatcagcacctgcagttattttcaaaggaatcgacttcaaaagatcagattatggacatcgttgacaagatgaagatggattcatacataaaccgcaaggccaagacctactctttaggtatgaaacaaaagcttgggattgctttggcattagtcgaccgccccaaactggttattttggatgagccgatgaatggtctggatccccaagccaacaaagacttgcggaccattattttggatttggccaaacaaggaaccacattcctgatctccagtcatatcttaagtgagttggaaaaattggtcgatgacctggttgtcattgataagggacagatcgtttacactgagagcatggccaacctggaaaatggcggtaagaagttattggttcttaagacctcagatgacgcccatgctaaaactattttgagccaaaacggctaccagcttgatgacggcgataagctcagcattgtcgaaactgactcaaccaagatggctgacgtgatcaaattactgtccgataacgatatcgacattgaagatgtccaacacgttcacagtgatttggaaacatcactcttaaatctgctcaaaaacgacaaagtaaaggagtcatagcatgataacgttagtcaaacaagaaatctttaaactgcttcataagaaaagcacctacgcggtctcagctacattattgattctgatgactgtttttggtgtattgacccgaaactatcccaagtactggggcgatcccaaaggattatttgtcgaaatgtttaccgggatcaactggatcgtcttattcatgattgcggcctgcagttcaatcattgcgatggaatttcagtacggcacgattaaagaattgttgtatcgcaagtattatcgtgggcaaatcctggtcagcaagtggattaccatgttgctgtactcgatttatttctacgctttgagctttgtctggtcgatgcttttgaaagttgttttgtttaacgataaattcaaactttcagatacctatcaatcaggtcactccgttatcgaagcgcaatggctcggcattatcggctcctttctaacgatctggctggttcttagtctagtgcttttattagcgaacgtcttcaagagtaccgcagcagcgatttcaatcgggattatcggttactttgctttgagcatggtttccggggtcatgttcttattgatgcacaaatgggaatggcttaaatggaacccattgaacatgatgaacctgccacaacagcttttgtccagttcggtgcataaaatgaccttgttgtcgacaccggaaatggtggttggcagtctggtatacacggcaattttcatggcaatcagctacgttgtcttcaagcgccggagtgtctaaattaaaattgaacgtttcaaagatggaatcggctaacagctggttccatttttttgtgcaaagattcatgtttccaaaaaggtgtcattttaataacaatctcattatttgttaagagtgtctaacgtttgctcagaatgaaagcctgtgaatagcaaaatctgtgatgtttggtactatgtatctgattaaatgttacagatatatttcaagattgcatgacggggggattgcatatggtacataagagttggctgctattgccactgacggtattgttgatgggatgcagcgcgcacaagacgaccaccgctcagacgacttcgagcacggcgagtgaacaggatggcaaatataacggagtgaccttagacgttgcccgacgccactaccaagttgggacgttgcaaaagttcattcaattagtgggggatcataacggtcggtttattcagctgcacttaagcgatgaccggaattttgcgattgaaaatgactacgttggtcagtccttgaagaatgcccagaaggttgatggggtttggcataacaaaaagacccaccagttcttttacagcaaggccgaaatcaagtatttggtcaacgacgccgaacagcaccacgtgacgctgatcccggaaatcgacaccccagcgcatgtgactgccttggtgaagctcatgaaggccaatggcaaggcacaactggccaagcaagtcagttggtactccaagagttaccgcgacgagattcacctcaatcaaaccggcattgatttcaccaaaaagctggacgacgaggttggcgccttgtttgccgggcaggccaatccccgctttcatttaggcggcgatgaattttccgataagctaaccagcaacgcggcttacgtcaaatatctaaacgccaccagcgccaatgtggaaaaaatgggcttcacaccggaagcttggaacgacggctttttaaacagcagtttgagcaaactcaataaaaatatccaagtaacttactggaactggaccgcagatcaaaccggcaagttagctgctgagcgccacaaatactgggcctcgatgccaaaattgatcagccgcggtttcaaagttttcaactataacgactactatctgtatttcaatttatccaaaaccaacatgtccaagaaaaacgtcgcttatatgattaaggatatgaagcaatactggaaaccgacgttatggcacaacgatgttgataccaagttgaagtccaaacgggggattgtcggcagcagcgtatcactatgggcagactcagcgggatcggtcaatgatcagcaggtatatgccgctagtgagcagttcatcaaaacctttttggccttggccgaaagtagatagaatggggggatattatgagtaccttgagtgattttgtcattttatatccagtaattgtgtcgacaatttggatcgtggggtcaatttttttctccattcaagaacggcgggtgccactgaataacgaccatcaaggacaaccagctgacctggtttcaattttgattccagcccacaatgagcaggacaccctggctcaagtggtcgagtcggtctcaaagatcacttaccaacggattgagctgattttaatgaacgacggcagtcaagacaataccctggcggtgatgactcagcttcaggaacggtatggtcatcagtttccggtcaaaattgtcgatatcaaggtcaataagggtaaagccaacgccctcaatgaaggggccaaggtggctcaaggggaattcttgttgtgcctggatgcggattgctacgtcgatcaaaatgttctcgaaccgatgctggcgcgattctatgatgacccgaaagtcggcgcagtcgccggcaagccaatcgtccgcaatcggaccagtattctaggtcggctgcagttgctggaatatgtgggcgtgatcgatattatcaaacgcggccaggctttcgttattggtcacatcacaacggtttccggtgtggtggtggcttatcgaaaacaggcgattattgatgccggctggtggaatatcgatgccattactgaggatattgatattacttggcgcctttatcaccatggctggcaggtccgttactgcccggagtcggtcgcatggatcttggttccggaacgaataatcgatttgattcaccaacgaaggcgctgggcccgcggaggcttcgaagtgctgtttcgcaaccgggggatgtttatcaccggtcgcttgagtgaacagtggctgctgatggacatggtgctcagtgatttgtgggccatcagctgctcatttgtgacgctgttttaccttttcacgattatgttcacaggtgacatcatcatggacggcgtgattttatttctcctattgctcattagtttgattcaattcttgattggttatgccgattccagagagtccgatttcatcaaatggcaggacctgtcactattgccgctgtatgtgattttttattggttcatcaacttggtcagttgcctaactgccctgggatcgttcttcctggatccgagtcatgttggcagttggcgtagtccggatcgggggctttaatcatgaaaaagaagactaacaacctgattattcggaaacgatcctcaattcttaaattgttggaacggttcatctttttggtggctttgtgggccatgacagtttacgtgatctacgtcaacgtttgcttcctattgaacgcatactcggacacgctggtttctgattacctctttttgaacctgtcctactttgcctatgcccgatttgccatcctggtcgtggtgatggtcatcttgatgacaatttttggttggctgcgaattaagaaacttgagcggagggcgaaaaatcatgagcaaaacaagtcgtaagtggattttaagcgggtttattctggtctttttggtacttttggcagtcagtgttcgacacaatattgcctatcagctgggcaatcggcctgattttgcgatttccaaacgtgaccagcgaatcaaaaatggcatcatggtgttctcctaccaccggattttggcaccgaatgacattgtccggttcgatgaaaaagtgtcgccgaacacacagtttcacgattttaacgtcaacctgccttcctttaaaaagcagatgtattatttgaaatcccatcacatcaaagtcatttcaatcaaacaaatgattgctatggctcacagcaagcgacccattcgcggtaagtacgtggtaattacctttgatgatgttgaccgaacgtcgatcgacaatgcgtttccgatcctcgaaaaattacattacccgtttacccagtcgattattaccggcaacaccggttggtacaagcagggaactaaattggcaacttggccggcaattcaaaggctgcaaaaacaggccggtagtttagtgacctttggtgttcacaccaatcggatgcattatttggttgaccacgggatcccggtgttcaacattccggcgaactacactcgctttaagcgtgattatgcggtcagccaggatgtcttgaaggaaaaggtcggctataagtcaccaatttttacttatccatacggtagtggcgactctcagattcaaaagtttctcgctaaccgccccggcctaaaagtcattttgaccttgaacgatggcttggtgaccaaccatagtaacttaaaactcaccccaagaattattgtgaataattacagttggccgagcatcaccaaatggattaacaattgaacgaaactttgagataaaatgaagataacgataaagggggatgcacaatgacgttttacacgtacgactatcttcaaggttctcaaagtagctggcagtacgccagaatcattattttaagcgtgctggcagtcatttttattggctttttggtccattaccttcgtaatcgaatggacagcaaatacaaagatttaaccattatcgtcgggacgctgctgctgcttattttagcgatccaatacgacgactttagtgcgattcagtccgcttctgcgcagacaggccagattacgcagacggttaagcagattgccaagcggcttcatgtgggaaccaaaagcgtcagtatcaattcgaccacccaaaatgccaacctgatggctaaaacccccagcggttattaccgggtcgactataacgctgacgggagtcagtttgtgttggaaaaggttgagttagatggttcgagccacatcaaagttcaggaggcaaactaatatgtttacatattcagacgttgcacttaaattaatcgtcggtttcttatttatcaccatcttgattaacctgaccggcaagggaaatctggcaccgacatcagcaatggatcagctgcaaaactacgtccttggtggcattatcggcggtgtgatttataatccggccatcacgatggcgcaatttttagtgattctgttgctgtgggcactgttaatcatggtgactagatacttgaaaacccatattcactggtttggtaaatttatcgagggtgagccaatcacactggtgcgtaatggtcagctcttggtcgagaattgtattagagccaatctctccggtaaagatgttgacttcaagctgcgaactgccggcgtttacgatattcaagacgtgaaacgggccattttggaacaaaacggtcagctgacggttttgaataaaggggagggtagtattcgctacccggtaatcgtggacggccaggtggatccggacgtcttagatcttatgggtcgagaccagcagtggcttgaagatgagctggccaagcaaggtttcgacaatatccgcgatgtgtactgggcaacttatcgtgaaaatgtgttgaaagtcgcggctttccctgaaaaatgataatggtggaactaacacggccgtgtaagaataaacgcgattttaccatacgattattgaaatacacggcaatcaagaatcaaaggcataattatacaatcgattgatctttcattgacttctcagagaattgttatattattaacaataacttttaccgaatcattggcaggttttaaatctgaattttccggaggtcaccattatggaattagacagtatcaacccttatgtgttaaaagtcatgccgtccgcaatgcggaaatttgatcatgacattagttccgatccaaagattatcaaattaactttgggcgagcccaacttcaacgttcccgaccatattaagcaggccgcgatcgacgcgattaaccacaacgaatctcattatccttactattggggttaccaaccgcttcgtgaagcagcatcaacttattatcaagctaagttcggctatcactattccgctgatcaaattttggtgacggttggggcgactgaggccgttgcttctgcagtgaagaccttatttaagcctggtgatgccgtgattattcctacgccggcctatccgctgtataacgctttgacgaccttaaacgagttgaatacgattctagtggacaccagcgatgatgactttattttgacaccgactaaagtcgagcaggcaattgccgaccaccctgactgggatgttaaaggcctgatcttaaacgacccgaataatccgactggagttgcatacaccgaagaacaaattaacgcgttggcgcctgttttaaagaaaaatggcatttgggtcatcagtgatgaaatctatggcgagctgacatacgggcagaagcattattccatttcaaaagttctgccggatcaaacggtcgtgattaacgggttatccaagtcgcatgccatgaccggttatcgattgggattggtatttggccccagcggtttcatcgatgaaattgccaaagttcaccagtacaccgtgaccgcggctgcgtcaatcgttcaatacgcagcgattgatgcgttgacacacggtcaggatgattccaaaccaatgctcaaggaataccagaagcgtcgagattttgtcgccaaggagatggctgaagccggttttggcgtcgttcatcctggcggggcgttctatgttttcgctaagattccagcagatctgcagatgaacagttgggactttgttaatacactggcaaaggaataccacattggcttgatgccaggagatccgtttggcgataacgaatacgttcggattagttacgccgccagtgatgaggccttggctgctgctatgaaggctgttaagcagttggtggcggatgattcagcgcaaacaactgaataaaatttgctggccgacggtttaataataatttagatttaaatggtactcaaaaaggtcgcaacgtaatttttgctaattatgttgcgacctttttgatttttattcaagattcaattatgcgcgcttacgatccttaatggtaaatgaaagcaggaaagccactgcagccacgatcaacgtaaaccacagaccaacgtggaccccattggtaaaggcaacttgatggctgacatgaccagcagccgtgtttccaaatgccaacaaactggtagcgatggcggttgccatggccccgataatttgctggaaggtgttcatgatggtgctgccgtccccggaagtttgttcatccaaggcgcccaggccaaatgtttgggcgggagacatggcgagcggcacacctaacataatgatgatgtgagctaagatgacgtaccacattggcgaagttgagctggctagcagtaatagtaccaggccgacgatggtcacgccaaagcccagcgttgtcagcagtttggtgctaaccgtatctgagaagcgcccagcgatcgcggagacaatcgcgttgacgattccccctggtagcatcacaattccggtcatagcgacgggaattgccaaaccattttgccagaacattggcagtaagtacattgatgaaagaataatggcgaagtccaacatcactaaaacagatccaaccgtaaattgatgcttttggaacacgcggaaattcagaattggggtttcagattttaattggcgacggatgtaccatgccaagagaaggattgaaacaatcaaggttccaatgacttggggtgatccccaaccggaatcactcgccaagctgacaccggcgacaagaccaccaaaaccgatcgctgacaaaacgattgagaaccagtcgattttgggcttggtgatgtcacccacgtttggcaggtacttgaaggccaaaataaaggcgatcaccagaaatggtacaaacaaccaaaaaatccagtgccatgaaagcaggccgaggatcattccggccaaagttgggccgacagcgggcgcaaacatgatgacaagtccaatcatccccatggccgaacccagcttatagggtggaaagattaaagtcgctaccgtgaacatcaagggcagaattaaaccggtggcaatcccctgaatcattcggccgaccagtaaaatggcaaaattcggtgccagtgctgaaatgaccgcaccgacgataaaatcacatagggcgaataagattaatgagcgggtcgaaaaaatccgctgaagcaatgaagacatcggcaagacaatcccgattaccagcatgtagccggtcaccagccactgcatggtgccgatgctgacatgaagttcggcaatcaaacttggtaacgcgatgttgagggaagtttcactcaacatccccacaaagccgccaatcagcatgcccaacattgctaagaatggccgggcaaccggtttggctgcgtgtttttgttttggttcgacagacgcttggtctgcatttaacgatttttccataatgtttctcctaattcttaaaacttttatatcacgacaattgattacactaccataaataaaagctgctcgtaagttttattttcaaaaaatttcataaaacatgaaaacttggtttaacagtggttactgggaacgcttacgaaaaaagtgaaaatatgtagataacggtcacacatttatgccggttttctactacaatataggcagatgcgtagacggatttggcaaacgcatttcgctgaaattattaacggggagcgattgaatatgaaacatacagtgttaatcctgaccggaatcggtgtcgtggttgccggtgcctgccttttgaagtcgatggggtggtttgaagatgactctcacctgtacgatgagtacgaagcgaaataatttgtttggaggaattcttaatgacaaaaaataaagcaattatgatcggtgccggcttggctaacatggcggctgcggtatatttgattcaagagggtaactggaagggcgaccagattactttttactcgattgacgaccatggttcaaatgacggttcacctgccagcgaggctgccggagaatattggaacaaagttcacccaatggaaaacaccaaaggcttcattgcccgtggtgggcggatgctcaactatcgaacatacgttgatctgatggacttattaagccgagtgccttccgcaactgaaccggggatgaccgctgccgaagatacccgtgattttgatgccaagcatcgcacgtttgacaaagcgcgtctgatggaaggcggcaagggcattatcaatggtggcaagatgggcttcaataataaggaccgactgaaattaaccgaattgatcatgatgccggattctaaagaagaacaacttgataacgtcacgatcgctgattacttcaaggatgatccacacatgtttaccaccaacttctggtacatgtgggagacgacctttgcctttcgggtacaaagctcagcgcaggaactacggcgttatatgcaccaaatgatttacgagtttactcaaatcgagcacttggtcggcgtcaaccgaactcggtacaatcaatacgagagtattatgctgccgctgatcaattacttgaaagatcaaggcgtcaacattattttgaatcgaagagtaacgaattttgaatttaaggatacgccaatgcaagacgagattacggtaactgccttgcggatgacgaatacggaaaccggcgaggaagaagacgtgccggttgatgatgacactgccgtgatcttcaccaacggttcaattaccgattcagctacccttggtgatttcaatacaccagctgaagaaaatatggattatggtgctgcggccagcctttggaagaaggccaccaaccggttctataatttggggaatccggacaaattctttaacgatcgtaatgccagtgagtgggtcagcttcactttgacgacaaaagatcatgttttgttgaatgaaattactcggattaccactcaagttccaggcaatgctctgaattcattcatttccacttcaccaattaccccaatgggcaataaggatgtcaacatgtcgattgtcgtgcaccaccagccgcatttcaccacccaaaaggccaatgaatcggttatttggggctacttcctgtatccacgacggaaaggtgagtttgtggacaaacagtacatcaagatgactggtaaggaaatggttgaagagctgctgggtcaattatccaaggttgatccgggacccggtaacattatggataagaagcaggaaatcatggacagcgtgattaactgcatcccagcatatatgccgtatgcatccgctttgttcaacaaccgtgccaagacggatcgaccaaaggtgattccagaacactcaaccaatttagctttcactggtgaatttgtggagcagccgtatcaaatggtcttcaccgagcagagtgctgtccgatcgggagaaatcgcggcttaccactttgccggagtgccaatggctaagctggtgaagaaccctcgttatgacaaggatattaagactttggccaaggctacgcggaagatgttcgagtaatctggcctatacgtcggttgaatgagtcttaaaagcaacgtttaagccacatacttaaacgttgcttttttgtctttgaaaactatcccagtaaatgaggataaccatgatgagttgtacaccttcgacgcaccaaaaactgctgagaagagtcacctgacattgattccatattatgcttgggcaaatcgtgacgaaaagcaaatgaacgtctggatccaacaagcaagaatctaattgccaggattatatgagtggagttgaattaaccacgttagatatttgaacaaaacaaagaatcctcctgtaaattgttctcattggtttacaggaggattcttcattacataaattgactaccggcgccgtcatccggtgtgtttggttttagactgatgtatttcttacggtattcggatggcgacatgccatagctttttttgaaggccattgagaagtaatagacgttctggtagccgaccttcgtggcaatcgtactaatttggtcagaagtcaatagcagatacttggttgcttcttccaaacgatattttgtcagtagattattgggggtgatgccgaatgttttcttcatatataaagaaacagaattcggatggatatgaaattccttgcccaactcttcataggtaatcttttcgtcaaaatgatcttcgatgtagcgctggatcttgttggcaatcatcgtggttggcgattcttgcggtgtttgaacctgaatctgctggagcaggtccaaaaataattgctgggccttccagaactcaattgaattttgggtggtgtcagagtggttttcattggacttacggctgttggcaaagatctttttgatcattgagatcaccgtatcttcattcggaatcggctgttgcttctccaaaaataaggtaatcgctgaggtatagtaatgaattgccggcacggggatgactggtcgcatctgctttggttccggggcttggacgtaattgccggctgtcgcaaagtgaatccagtagtattcggtggtttcatccatcggtttccatgaatagtgatggtgctgtggttggagaatgaacatctcaccggcactcacggtgtattcggtattatcttctgcgataaataattttccgcgcttcatgaacatcatgacaaagaattggaaattcttccggttgggatgccgctcaccagggctaaaaaccacgtggccgctttgaatataggtcggtgtcgggatacatgaaatcgataggaattgcttaaccatagaataacctccagtgcaaaatcgaattgtttgctgatcacaatttggattttataaatctttcttttgttattataaaaatagttcagaaagcataaaaagtcaattggaaatcagctttttatttcacaaagaaatcggctaatgactacttttacgcgaattcttgcttgttcagcaaattataaaagcgcttttataaatatgttttattttataaacacttgatagatttttagattcaattgatgccgtttacacggtattctatacatcgtaagcggttacagaatcagatgatttgctgatcacattaaataaatttgttttcagaaaggacaattcaaaatgaaaccggtatcatattacgacattaaatatttgccagattcgactttgaaagaaacgttcgaaagaaacattaactggatgctttccctcaccccagaccaattgctatacaactacttgctgttgctactttcttagccttcaccgcaccaaacctgcatagtaccgctaagctctggtatgccgggttcacttatatcttggccgctggtgttatttacactggtattcaaacaccaattactgctattcttcctagtttgaccactaatggccaggaacgtatcaatgccaacacattccgtatgtgtggtggtgccattggtattcgataaggtggtgatgcattcattcagaaaattgcagtatttcacaattcggacattatttctgacataatgctttcacgaaccccattcgtgttccgagttatccactaataaatcaagaggctcaaatcgttgaataaacggtttgggcctcttttgttgaatatatatttgataaatataataaaatgtgaagacttctaataaaatttctgctaagatattacctaatgatgtaaatgacggttgtgagtctacaaccggtttacaggatgtatttgtcacacaagctaatatagaaagtgggaataattttgaccaacgttaagtcatatattgaatcaatcaaagatcaaattgatcgtcgagatccgaaccaaaccgaatttcaggaagctgtatttactgtcctggatagcctggcgccaattttagaggcccatccagaatatgtgaagagcaatctgctcgcgcaattagtcgagccggaacgggcaattcaattccgggttccttggcagtcagacgatggccaattcaatgtcaatcgtgggtttcgggttcaatttaactccgccattggtccttacaaaggcggtttgaggttacatcccagtgttaacttgagcgtggtcaaatttcttggcttcgaacaaattttgaaaaatagtttaactggtttgcccatcggtggtgccaagggtggcagtgattttgaccccaaaggcaaatctgattctgagatcatgcgcttctgtcaaagctttatgactgaattacaacgccacattgggcctgacctggatgttcctgcaggcgatattggtgttggcggccgtgaaatcggctacttatttggtacttataaacggctgaatggttaccaaaatggtgtgttgactggtaaaggattgacgtttggtggcagtctcgcccgtactgaggcgaccggctttggcctgctgtattacactaacgcgatgctaaaggcacagggcgacactttaaccggcaagaagatcaagatttcaggggccggcaatgttgccacctatgcgattcaaaaagccacggaactcggggctaaagtcatcaccgtttctgattccaacggctacatctatgaccccaaaggaattgactacaaagttgttcagcagattaaagaagttgaacgcggccggatccgtgaatatgccgaccgggtggcatccgctgaataccacggtggatctgtctgggactttgacgttgactatgatattgccttaccatgcgcaactcaaaatgaaatcaacaaggatcaggcaaaattgatcgtcaaagatggtgtcaaatacgtctgtgagggtgccaacatgccgagttacccggatgcgattgccatttatcgggacggcgatattctgtatggcccggccaaagcagccgatgccggcggcgtggcggtatccgctttggaaatgagccaaaacagtgaacagctggcttggagctttgaaacggtcgataaccggcttcaagacatcatggaagatatttttgccaagtccgaagctgctgacaaaaaatatcatttggataaggactatcaagctggcgccaatattgctggatttgagaaggtcgctgaagccatgatggcacaaggattagtataaacacttaacaagatggaactgaatttttggtggaaatacctttgatgagcacttattgaaagcatcaaagatccatcaatctctcagttccaactttttgtataaaatatacaaaatatgaataatatctatttgaataattagacaaatactcatcattcccttaaaatcaacccgcaagcggctttaagcttaatgatatgtgaggtattgcgacatctaaattgagccaacctcttcccatagtgctgataaaatgctatattttataaaagccatttttgaggagtgagtattttgaaaaagattagaagattattaattatatttgtgtcggcgttctcgtttttattcctaatgaataatgttgcatccgcacaatcgaaagaacactacacaattggtgttggaccgacctttgtgccgtttgaaattcaagccaagaatggatcctacaatacggctcaccccgggctcgatattgaaatccttcgggcagccgccaagaaggagaacttcacctatacgttgaaagtcatgaactttgcggcagccattcaagccttggaaggcaatcaagttgacggcgtgattgccgctatgatggcgacgccggaacgagctgagaagattgatttttcaaaaccatattataacgtcgggctcgcattggcagtgccaaaggggagttcgattaaaggatataatgatttgaaaggcaagaccgttgctgttaagacaggatcaacctctgagcagtatgccgaaagtattcaaaagaaatatggttttcacattacccggttcaacgatagtaacaccgagttgagtaacgtcttggttggaaactcggctgcggcgattgattccacggccacgttgttatactcaatcaaaaacaagatgaagctccagttagttgggaaggctgccaataaaaatccggttgccttcggggttaagaagggtcacaatcaggaattactgaaacgctttaatgccggtttggcagctatcaaaaaggatggcacctacgacaagatcgtcaaattctacaccggtgagcacagtaaatctgcgattccagtgcaatccagttctgatcggacgtactttggcttgttgaaaagtaacgccacctcgtttggcaacgggattaagatgaccctggagatcacgattgttgccattttcttcgcgacgatcattgggatcatcctcggtatcttgggcgccacgccaaacaagttcctccgaggattgtcttccacttacgcctttgtcttcaagagtattccagtcatggttttggcattcttcgtgtacatcgggattcccaacctgacaggtgagaaaattccactgtttattgccggggttatcaccatcgttatggaaaacagtgcctatacggcttcctttgtccggggcggaattgaggcagtcgaaggcggtcagatggaagcggcccgctccaacgggatgtcctatttccaagccatgagatacattgtcctcccgcaagccttgcgaattatggccccatcatttatcaatcaattcatcatcgcgttaaaagggacctcggttctgtcggcgatcggggtggctgaactcactcagcaaggaaccatcattatttccagaaacatggaaggtttcaaagtttggttgctggtatcgttgatgtacctggcaatgattgggttgttgagttacctgtccaatctcgtgaagaaacattatcaattggcaagttaaagcgaatctaacttaatagcagcaagaaatgagcaggaccaccggcaaatctggtgatcctgctcattttgtttcttttagttcaagtattgttggccaatttctttgtatgtgtcaatcatattgtagtaagtatccagatcaatatattcatcgtgctggtggctggtcgtattccccggcccaagaaccaccacatccatcttttggttcactcgagtgtattcagaggcatccgttcccagtgacaccccgatcgttggcaggtccagagattcatgcaagtggtgggcgccggctttttgggcgatgtcgataatcgctgatccgggatgattgatcaccggccgtttactggtaatatcgattgtcaggttataccctggctgttgatttaaatgatcaatcagctgatggagcttcttgatgatcgtttgattatcgaactcagggatcgtccgaattttaacttttaagctggcaatgtcaggaatactgttgatttgtttaccaccggcaataattgtcggagcgtacacggtatcgcccagaattggatcagtggcttgaatgctttgatagaactgcttttccttgaggtagtaattcaccagcatatcgatggcgttgattcccatctttggcattgatgagtgggccgccttaccatgggcaacgacctcatacatcagccagcctttatgggcaaagaagataaaatgctgttcaggcgccttttggtcatgactgacctgatggagcttggctgccaattctggcgtgaatttagcaccaccgctatcgacataggcatcgaggcgttctttagagactccactgggctcaccgatcactacggcgtcgagatcatctacgtagcctttatcagccaataattttgacccgagctcaccgacttcctcacccatggtgacataaagcctcaagatgccattgtggacgctttttgactccaccaggctgatgaaggcgattgtcaggccagctagaccgcctttcatatcggcagctccacggccatataaccggttatcacggacattgggttcaaaaggtggcgttgtccaagttgataaggccccttcatggacaacgtcggcatggccggagaagcccagaaccgggccaggattacccgtgtcaaattcggcaatcaagttatctcgatcttcggcgtatttgataaaagttgagcttatcccgtgtttggccagtaggtcgtgaatataggcggttaccagatgctcattgccattgacggtgcgaaaggaaatcagatcttttaaaatccgcagcttttcattattatccatattgtattattccaccttatctttctgattaaaatgagctaacagtgccaatgcagcctgctcgtggaacttcgctgcgtacttgaggccctcggggttggcaataaagtccgggtgatgtaagttagcctggcccttgctacccatgaatgcgtaacagccgggaattaattgctcatactcggcaaaatcatcatcggcgttggaagggatggcatcggtgactttcatgaattggcttgcctggtttgcgatgaggtttgtgattgcttcactgttgtccaccggagcgggtccctgatcccatgtaatggttgctgtttggccataagcgctggcggtggcattcacaatctcgtaaaagcgccgtttggcaagtttgcggtcggcttcggaaaaggtccggatggttcctttaaagccggcactttccggaatgacattgttgacatggccgccggaaatcgcaccgactgtcaggactagccgatcagaaggcgagatgttccggctgacaatcgtctgcagggtcataatcgtgtttgcgacagcgacgattgggtcacggccggtttgcggcattgcggcatgggagccaactccggtgatggtcacgtcaaaattgtcgttggaggccatcaacttgccgattttcatgccaacggtccccactggaatggttggcatgttgtggattccagagattgccaggacatctttaaggatccccgcatgaatcatttcccgtgcgccaacgtggcgttcttcgccgggttcaaagattaagcggacattgccggataactgcgattctcgttcttttagtaacttcgctgcccctaagagtgccgcaatatgaaaatcatgtccgcaagcatgcgctgcgccggagatttctgatttataaggtaaatcagtttcttcttggagcggtagggcatcaatatctgcacgcaacgcaattgttggaccatcacctggaccaatttgggcgacaaggccgctttgaatagggaagtccagaatggaaatcgccattttatggagttcagcagtaatcttggccgtcgtccatttctcttgatcacaaagttcggggtggcgatgaaattgtttaaattgctcgatcatatagcgatcgagttcgtctgtaacgggcgctgtttcaaccatcctaatcactcctaatcattctttaatatatatttaataatactttaagagtttaagaaaagatagtcaagcaaggcttaaaatgtttcgtgaaacgacttaggcagattaagcttattcaataaatgggccggagaccttttgtattggcggctgatatgatacatttaagtgaaacaatgcaaggaggaacacacaatgggactattaattacaggaattatcatcatcgttctaatcgtgatcgttgtcgccttatacaacggcctggttagccaacggaacctggttgacgaagctgccagccagattgacgttcagcttcagcgacggggagacttgctgcccaacttgctggaaaccgttaaaggttatgccaagcacgaacaggaaaccttcgaaaaagtgaccgcaatgagatcacaaattcaagaccccaacgccagtctgggcgataaggttaaagccgataatgaattaaccggggcgttgaaccatttgtttgcggtttccgaaaactatccggaattaaaagcaaaccaaaatttcttggcattgcaggaagaactgaccaataccgagaataagattgccttttcacggcagaactacaatagcaacgtcatggcatataacaacaaactgcaaaccttcccaagtaatttggttgccaaattcggaaccttcccggctcgttcttatctggaagttcctgaacaatccaaagaagtaccacaaatgaaattttaaaggggcctgactgataatggataccataaatcagcaagttcagcagaatcgacgacgaacctggtcagtcatggctttctttgttgttttaattgccgttattggctttctaattgggttggtgtttgcggttgccacccaagatgaaagtattgattggctgattccgacttacacgatggtcggctttctcattggggcgaccatctattcgttctttgtctacatgagtgtgaccaacattttgatgaaatctgccaatgcgcatcaactccaagaatcagacgacccggaattgtttaacattgtcagtgacttggtgatggttgcccacatcccaatgccggcaatctatttgacggatgatccttctccaaatgcctttgcaaccggaagagatccgcaacacgctgcggttgcggttactaaaggtttgcgggaaatgatgaaccgtgaagagttggaaggggttttggcgcacgaaatctcgcatatcaaaaactacgatatccgagtatcatcgattaccgttgccttaaccacgtttattgccggggccgggacagttctgattgtttccggaatcagcttaatcagaggtggccgttggttcagctggttcggcagtgacagcgacgatgatgccaaatccagttgggcaattgcggttggaattttagtttttggactcatcatgtggctcggcggctggatcatccgcgcagtcggagtgccagttgcccaaatcctccaattctccgtatcacgtgaacgggaatcattggccgatgtttccggggttaatttgacccgggatccgcaaggcttaattaatgcattaaccttgttaaaaaatgacaccacaccaaccaacaatccgactgccaagagtgccgcgctttacattaatgagccggtcaccagacaagggaagacaccctttttggccaagatgtttgatacccatccaccgttggatgagcggattgctagacttaaacggctgctgggtgaacaataactaattcaaattatgtatgcaaatgggcaaccgactcgtgttttgacacgtctcggttgcccattttatattttagattatgccacttgtgcactaggcgtaattttggttcgattgagcaatactgaactggtaacgactgacagggaactcaaggccattgccaaaccagccaattcgggactcaaggtcattccgataaagtagaatactccagcagcaactggaattcccaatacgttatagacaaaggcccagaataggttcaacttgatccggttaaatgtcttcttgctgagttccaatgccttgtaaacatcgcggagatcatttttgactaagacaattccgccggactcaatggcaatgtcggttcctgatcccatggcaatgccgacatcagcggtactcaaggctggagcatcgttaataccgtcaccgacaaacgccactttgccggtgctttgaaattgcttgacctggtcggccttgtcggctggcagcacgtcggcaacgacttgatcgatgccaacttggctggcgattgcctgtgaaactgcctgattgtcaccggtcagcatgactgtctttagtccttgtgatttaagcgctgagatggcatcctttgaagttggcttgggagcatcttgaatggcgataaggccaacaatttggtgattttggccaacaaagacgacagttttggcttgtgcctgtaaagttgccatttgttgtttaaatgtgtcactgacttcaacgtcattcaacaacttggcattgccgacaaaggcactttttccatccaccacggctcggacgcccttgccttcaatggccgagaagttttcagcaggtgagtaatcaatgccgctatccttggcattcttgagaattgcggttgccaatggatgttcggatgaagcttccaaacttgccgcaatctttaagacttgggtggtgtcaccaacaatgtctgtgacctggggcttaccaaccgtaatcgttccggtcttatcaaaaatgaccgttttaacatcgttgacagcctctaaaacttcaccatttttaatcaggattcccattcgcgcactgcggccggtgccgaccattaaggcggtcggggtggccaaaccaagtgcacatgggcaggcaatgacgaccactgagactgcaaagatcagggcgttggcaacgctggcaccaatgaaaacgtaccagattaagaaggttgaaatggcgattatcaataccagtggaacaaagatttccgagactttatcggttaatccttgaattggcgcatggctattctgagcttttttgaccaattcgacgatctgagccagcatggtgtttttgcccactttggctgctttaaaagtgaacgttccggttccattgaccgtggcgccaacaactgaatcaccggcctttttttcaaccggcatactttcgccagtaatcattgattcgtcaatcgtcgatgatccactgacgatttggccgtcaacagcaatcttttcacctggtcgaactttgatgagatcgccgacgacaatctctgagattgggactctgacgatcttgccatcgcggataacttcggcatccttcgcctgcaaattgaccaatttttcaaccgcattggaggcgttgttgcgcatccgctcttcaaagacctgtccaagcagaacaaaggtggtcacgaatgctgcgctttcaaagaacaccggctgatgagttgccatggcgtaaatgctgtaaacgtatgccgtggtcgttccgatcgctaccaaggtgtccatattggagtgatgctttttaaacgatgcccaggcactattgatgaatgggccggctgcgacgatcattacgattgtggtcaggacaagcattgtccattcaccacccgggatcatccagccgaagggcttgagaatcatctcggccaacattggcagcgaaaaaattagcgcaatccaaaatcgttttgtgatagtcattagataacctcaactttccctttgaacatgtccatgccacagctaaaaccaaattcgccagcctggtccgttggcacttgaaccgtcttggtgacgttgactgggagttcttcagaaaagccaagttcattggaatggacaacatccaagcacccctggtcattaatccgtttgaaattgatttcggctggcacaccctgcttcaatttgatgacagatggctgatagcccccggcgacggttacgttaactgtttgtttattttcattcatgattgattcctccatttacttaatcactaatttaccgtgaaacatatccattccgcaggcccattggaactctccggattggctggtatcgatttcaaccgattctttttggttctgcggcaacgcttggttgattccaaaatccgaaaagacgactcgatccaaacaggatgacgaatccgttcgggtaaagttcagagtcgcgggaacgccttgcttcaacacaaccacttccggtgaatagccacctttgacctcaacatcgacgacttgctgatcatcgttaaccttggcgttggcttgagcaacttggtgcttgccgaagaaccaccagccgataaaaccaatcaaggctaatccagcaattaaaacaactattttcaaaaacccatctcctattcgtctaaaatctacatgtgtaaactttaattgtctatatcttatcgtcaaaggttacacttgtcaacgtgaaaaatggaaattctttcaaaccttgactgcaagtggattctccaaggccgtgtcaggcattccaaaaaaagtttccaaattttggttgacaattaaaattacgtgagttagattataggcacattaaaatttggttgaaaaaatgcagcgatgaggagagtagattcgtctaaccatttcagggagtcccgttaactgagaagggatgatggttatcgaattgaaagtagcctctaagcagtagatgcgaagcgatgagtatcttcggtgtgcaccccttaaagtgccagtgtatcgtcagcaatggccgtacatgatgagacgatttgtgtgagcagatcgtgaatttaggtggtaacacgcgaaagcgcccttaatcttagagataagattaggggtgcttttttcagtcaaaaataaaataaaaaattggagtgtggtttttatgaagtttgcaatgattggtgcaggagcaatgggattacgatatggtattttactgcaagaggctggcaacgatgtcacatttatcgatacatggcagccacatatcgacaagattcgtgaacagggtggcgtatatgtgatgcgtgatcataaggaccgccacttgactaagattaagttagaaaccccagagacctttgatggccatccggacatgtttatcttctttaccaaacaaatgcagctgcaagattatcttgatcgctgttcacatttcttccacgaagatcaatacgccttcactgcgatgaatgggatgggccacattgaaaaactacagaagtacttcgctgatgacaaaatcattggcggaaccgcattaattgcgaccgtgcttcccggtcccggcgaagttgacttcatgggtaagcggggtgccggcaagatgaacatgtgcccactcaacgaaaagccggacgcaatgtgccaggcactcttcgacgagcttcaaaaagccaagatgaatccaaccttaacggatgacttcaccggaactttgatgaccaaggttatctttaactcagttattaacaccatttgtacgatgtttgaattgccaatgggtgaatttggcaacttcaaaggagcttatcaaatgggccggcaattgattgatgaagcctatgacatttgtgcccgagccgatatcaaattagtttccagccgtgacgaagaaatggctgcccttgaccataacacccgaatcgatatgccgcttcattacccatcaatgtatcaggatatgattaaggaccggccaactgaagttgattacattaacggctacattgccgaacttggccgtaagtaccattatgaagccagcacccatttgtttgttacccaagctgttcacctggcagaatttcatcgtcagaatttggccaagcaacgtgccatcaaggctaagcaggaggccccagcagctcagacagcatagtagccgaggggatgaacctgataattggcagccatccgctcaagcgtcttaaagagatcagcttgttgatcacgggttccagagacttcgagataaaatgaatagacgcctaactgcgttttggtcggcaaggacattaatgccaccagatttaattggctggccgcaaagtagccgagaatgtcgtagagggttcccgggtgatcgttgaaagccggcgtgacaaatagtggtgccttgaactggtcagtcactaatgtttgctgggcaagcctatccaggtgcgcccgtcttgatttgaacacaatgaaccgcgtgctgttatcgtcttggtcggcgacattatccatcattaacggtacggataaatcggccatctgcgattgggggatgatcgccgcgtcacccggctggccggactggaacttctccagtgaaatcatgtttgatgatgtggtgataatttgcacgttggggatggttgacaataatttctggcactgaccttctgtcttgaattgaacataaagtcgtttaatttgctgtaaatcagcaacgtttgccaccagtccaaaatcaaccggaatggtgacttcgccgatttccgtgacgtcggcggtctgcaggcgttgaagggttgcggacacataaccgtcaagctggttttctaatggcaataaaccaatgttgtcgccggaaacggcttggtagacttgatcgaaagtgggatgatagtcaaaagtcacgttggttaatggctgggttttaagataagctttcgcggctgcgtcggcaaaggtgccggctggcccgaggactgaaaatttcatgatataaccaccttgtcgttggaattgagataatgctgttattatctcacactggatttcgaaataatgataaaaatgaaagaaaactcttttgatatctgtggaagcggaaaatttcctgatattggaagagtttttgtttttgttaaacaaaagtaaagttgtttgacttcattccaacgagtaactactattaatattaacgtttaagggggattaacaaaaatcaatgaaattagcaaacatcaaaccatcaaaatttaaaacactgattttaccgctgacggctattactgccggcagtttttgggttagtctcaaactctttgacatcgcgtttaagcgggtcgattatgttcctgaaacttcgaaagaaaaacagcagtacgccgatctctactatcaatatgtggattggttccatcaaatgccctctgaagaatggtatttgaaccgcaatgatcccgacaagcggatggtggcgacttacattcctgctgaaggtatttccaagaagacagttattatcgcccatgggtataaggggaaccgggaaacaatggccaattacgccaaaatgtttcacgaaatgggctttaatgtcctgacgcccgatgaccgtgggcatggtgagagtgccggaaaatacatcagttttggctggctggatcgtctggattacctgaagtggatcgatcaagtgattgaccacgtcggcgaagacggtaaaatcttactcttcggcgtcagcatgggcggagccacggtggaaatgctgtcgggtgaacgcttgcccactcaagtcaaagccatcattgccgattgcggctactcaagcattaaggaagaactcacttatctgttgaagaaacagtatcatctcccggaatatccggttgaaccaatggtcagtgagatcaacaaacgggctgccggatttggtctcgatagtgcttcatcggtcaaacagctggccaagaacaaacggccaattctatttatccatggtggcaaagacacttatgtgccagcccacatggcctacgagaactaccaagccacccacgcacccaagcaaatctggattgtcccgaatgctacgcatgccgagagtttctggtatgatccggtggcttataagcggcgggttcaggaatttctgagaacttatttttaatcattgaaacaaactgaaaaagtgttggacatctgaaaatgcccaacactttttctatttataatgacgtcatttatcgttttcaagtttacattaaaccaactggttatacttacgaaaagtaagtctaaatgctggcattccattttcagcatgcctatacttaataattgaaccaaagatatattggtgtttcaccattacatgatatctaaatgaaggagattttgttgatgactaagatgattgcaggacaagctttagttaaagtacttgaagactggggcgtggaccacgtctatggaattcccggcggctcaattaatcatactgtcgaaggactctaccttgaaaaagataaaatgaagtatattcaagtccgtcatgaagaggttggcgccattgctgcttctgctgatgccaaattcaccggaaaaatcggtgtcgcatttggttcagccggccctggtgcaacacacttgttcaacggattatatgatgccaaaatggaccatgttccggtgttggcgttagttggccaagtaccacagccaacaatgaataccaattacttccaggaaatggatgaaaccccgatgttcagcgacgtctccgtttataacaaacaagtcacaaccgctgatcagattccttacgttgttaaccaagcgatcaaggaagcttatcgccaaaagggtgttgccgtggttatcttgccagaagacttaacctctcaagaaattgattacacaccaactcgcacgccattaacggttgctgacgatttcaaacagagcgtggatccgaaagctgtcgacgacactttgaagatgattaaagaagccaagcacccattgatttatgcaggccgtggcttgttgggtgctcgtgataccttaaccaagttctctgagcagtttaacattccggtgatgaacagtgtgccagctaccggtgttattagcactgaccatcctaactttgtcggaacgactggccgtctgggcaccaagtcaggatttgaggcgattcaaaacgccgatttgatcttattcttagcttcagagtatccatttgccaactattggccacaagataccaagatgatccaggtcaataataacccttacgatattggtaaacgaatcgacgttgattacgccgttatcgctgacgccaagagttacttacaagcaatgattgatactggtgagagtcggccaaaagatgcttggctcgaagccaaccaagagaataagcagaactgggacaaatggctcgagcaattggctgatgatgacagcgatggtttgaacgccgaatcagttaccaagaagattgccgagttggctggtcctaacgatacctatgccgtcgatactggaaatgtttcagagtggggtgtccgtggcctgccaatgaacaagaaccaacgcttcgcaatttccggattgtttgcaaccatgggctttggccttcctggcggtcttgctggtgctttgagcgttccagatgcacaagcttggtcactctctggtgatggtggttttgccatggtcgccccagatattttgactgaagttcgctacaagctgccagtgatcaacgtggtcttctcaaatgaccgcttcggcttcatctggtacgaacaaatgcagaccaagcagcacttctacggtgttgacttgaacgatgctgactgggccaaagttgctgaaggcttgggtgcaattggcttcactgtcaagagcattaaggatctcgatgaggtctttgccaagattaaggatctgcaggcttctggcaatcaaaagccaatcgttatcgatgccaagatcaagcaggacgatccggtcgcaactgcctttatgccgttggatgctcaaaagtacggtgaagagaccgctgaaggatttgcaaagcaatatcacattgatcgcaagcaacaaccatcattggaagaattactgcgttcaaaggaaaagtagtcgatatatgagttcgtatgaaagtggtcaaatctttacaatgatttggccgcttttttacgtttgcttcgagacaatcagaattaaaagaaactgaaccgttgccggacctgttgatgagttcataatgttacaaaatgattacaaagactaggcagagattgatatacgagtttgtgaattttacattaatgaaacattgttatatcagcctattcatgactaataagattgtgcataatcaaatggtaaccgctaacttaatatttggtaaaggtgaaaatgttacatcaacatttcattgacatcatcctgtaacgtggcataatgagtttaatcttttagggaggtagcatgattatgaaaaaatttgcaacaatcattaccgtagcttcactggcattaccacttgcttttgcagccccattggccgtatcagccgcaacaacaccaaccacgactgcagccaagaccaaaggtaccacttacactattgctaagaacggtgttaagaacttcaaggcgcgggcatatcacattaagaagaacattaccttatataagggcttcttctatgccgatgctggcaaggtaaccttcacacctaaaggtaaattgaccaaaccaatgacatatagtgtcacccgttcggtcacagtcgctgcaactaagacatccaaggctaagacattcttatatgttaagggctatggttacgttctttcatcacaaattaccaaaggacgttacatgtcagctgactaattgaatttgaataaatgattaagcttcatccttctataatctggtcaagagcaattgtgttcttggcctttttatatggggtataattgagaaaattgatattgaagaggcgattgcaatgactgcaactttaactttaattaccggtgctgataaggggatcggctttgaaacggcgatggcgttagctaaactcggccaacatgtcttattgggatcccgccatcaggatcaagggcaacaagccgttgataaaatccggcaggcaggttatgatgccgaactggtgattttggatgttaccaaacaaagtgatattgaccgagcaaaggcaacaattgatgaaaaatacggctacctggatgttttgattaataacgctgggattgcattggataatcacgaaaacgccgaaactttgtccacgaatgtgatccggactgagtttgatgttaatttctttggcaccgtcagcatgatccaggcgtttattccgctgttaaagaaatccaagtctgccaagattatcaacgtttctagcaatatgggctcgctggggctggcgtcagatccgaattcgcgcttctataacgttagttccctgggctatcagtcatccaaagctgcggtgaacttcgccacgattacatttgccaaagagctcaaggatacccacatcaccgttaattctgttaatccgggatggactgcaacttcttttggcggccgtgatgtcagccagccggtgccacaagggatgcagtcggtccaccagggcgcccagcagattattaagctcgccagtgatcctgccaatgaactgaatgggacgtttactgagaatgaggggacgcttccctggtaagttgattctattcaaaaaacaacaacggcaccaactcgatctgctcgggctggtgccgttgtgcgatggtcattcattattcactttggctaataattttttaataaaggcaatgtagattaaaaatttgtcattggtcagtcggtaatccagaccagttcgtttgtagatcatctccagccgataacgaacggtgttgggatgcgtaatcagagcttgactggtctttttgacggattcgttttgtctgaaaaattcccggatggtttcaaacatctcgtggttctccaataactggtccatctcttccgggtacagacggctgtcttgaactctcgagagctttttcaccaagtcccacaggctgacgtcccggtaaaagatgggtcgtcgtgaccagtccaaggtcttagcgatgttgatgccgaagctggcctcaatataggagcgatgaatttttttggccgggtgggcattggagacgccttcgtagacggtaaaacgaggaatgcggacattactaatcagccgtttaaaaggaatgcggtcatcgggcggcaattccatttgttcgtggtcaaagaaggaaatcgcggtcgcaccatcagctgattcaacgataaagtaggttttgattcgtttttcctgttggactcggtcaaaaaacgcccggatttgattcatcaggttaaactggacagcgattcgttcacttggtttgggtatttccgataacgagattctggcgactctcactttgagactgtataggtcaacgttcttcaaactggagatgaagtcgaagtctttatccgaagcggaattggtttttaataaatagtccagatccaaatcggccatcttattgatccggcggccctcaaatagaatggcgttaatgtcattcatgatttgaatgtaggtggtattttcccgaatttgaaatagcgggaagtctaagtgcgtacagtaatcgattaacgtctgggggatgtctgattcctcattgtctgcgtaaggtttaatcatcaagcagctggcttgtttttccactaactggtgaatcaacgttttggctgtctcaatcttttcgggcatcatccgagaactggtaatcacgatttggccggcctgtgcccagccgtcagccgtgccgctgtccataatggtaatcgcgttgaccttgcgattggccaacggtacctggttgacttgaacaatgtacttttgctctttattggcgattttctgcaaatcaatcacaaagctcacctccaaaatccgacggtttcattaccattatagtaacgcttttttaaatcttagtacatatgaattgccaaaatgatagctgttttgttattgaatggtttgtcgagagcagttttggacatttgtgctaaaaaaccgctaattttttggaggatggcacaaaccttttaggctgtcgggatgatacactcatccttgaaagatgacatccttcaacatccttcaaaatggaaagaacgagtgtttattagaaggtgtacgccatgtatttacttgatgtgattcaatattgtcgatgtcccccaattggggaatcacccttccattgccatcatgacgcttggagttaagatccccttcagagtgttactagacttacgagtggcagaagctgttagatgatgcagtaatatcaactgagagtgatatttaaccactaacatcggcagattagtggttcatcattgacggcaacatgcaccttgatggcagcaaaaagcacgttggtaaccagcattcagtgttggtcatcagcgtgcttttgtttattataaattaaagttcaacgccgttaacaatgtaatccggcttatcacccttgtccattgcgacggtattcttagcaacaatctcagccatcgcgtcacgtgcttctacggttgcgttaccaatatgtggtgttaagatgacgttcttcaatgctttaaagccatcgtcaacttttggttcggcttcataaacatccagaccggcaccggcaatttcaccgttttgcaaagcggttaataatgcggcttcgtcaattagcggtccacgggcggcattgatcagcattgcgctgtccttcatttccttgaactgctcggcacctagaagatggtgggtttctggagttgccggggcgtgcagggtaatgacgtcggcgttcttgacgatttcatcaacggtggcaaatttagcacctaatttttcttcggttgctgaatcaagttgatgacgttggttgtagaggatcttcatatcaaatgcgtgcattcgtttggcaaccgcctgaccaatttggcccatgccgataattcccaaagtcttgcctgagagttcgtggcccaagaagaacagtggtgcccagccagtgaagcccttggtccgcatgagttggtcaccttcaacgactcggtgggccaaactaatcatcaaagcacaagtgacttccgccgttgaagtggtcgaaacctttggtgtgttggtcactggaatgccctttgatttggcataatcagtgtcgatgttattaaatccggcaccatagttggcaatcagcttgaggtttggggcggcgtcgattacatcagaatcaactttcgtggaaagtggtgtgatcaagaagtccttgtcagcaactcgcttgctgagctcatccttggtaatcagattttgactgtcatcaaatacatcaatgtctaatccggcatccttgagaatattcaaggcgtgctctggaattcgacctgcaattaatactttcgacataaactcactccctaacaaatatttcatacaactccattatagggcatatcagggctgtatgaaaccgcttttatgagtaatgctatcaactgattaactgaatgacagtgacaatttggtagggaaaacccatgttgttttaagctaaaatagatcttagaacgactattcgttaaaccattgttatatgcattaatcctttgatcggtttcgctgaaaaaaccaggtaacaattgaaccaattaggataacgacgcctataactaagaaaataaggttcataaccttatcaactatatcagcagtccccttataaagggtgtatccgctatctgcgacgatccaaatgccgattaatacgctaagtaatagcccaaccaccggaacaactccagctttcattttctttttcatacgtaactcctttcaagttgtctcaggaatcagcctacatccataatgctgtccatattttttattaacgtgggcaataaagtggatcggaatatctggtatatttccttttaaaaatgatatgttcgtttttattgcctttggggctaaattaaaatgtgttgctgcgtgaattagacccagtgcagtggtaccatttttgtctgtttgtgcatatttacgaattgttgatattgatactcgtgacccataatacttcaatatcatcgccagagctgcagccccacagtcggtttcatctaattgactgacataataatgattccacatcatatttttcctccatgaatgccatgctcaaatttttaatcgacaattaaaaattaagtaagatattttctaatagacatattgtaacattattttggtgattttatataaaatattgtacctaataaataatattatacctaaaaatattaatgtggtatataatgtttatgattagacaatggactctggaggactagttatgaatgtttcacagaaaatacaatattgcagaacactaagaaatcttacacaagatgaagtcggaaatttgttgcacgtatcgagaaagacaatttcaggctgggaaacaggaaggagttctccagatattctcagcttagtcaaactttgcaatctttttgacatttctcttgatgatttgctatgtgacgaacatatgattgatcgtgattaccatggatagggttatagttaatggccaacaacaagaaagcttcaccaacgagatagaaatgtcattcttgctatgtattttaaaaatttgtagattgctcctaggttgcacagaaactcgttaaatatcatctttacaaattactattgacattgtactaatggatgtctacaatatttattaaacaattagaaaacgctgtgagaaagttgagtagcgtcaagacaacctgaagcgagcttcgtttggtgagaggaagcaggaggattgacgcgaaaatcccttttgagcgatgtaccgaagaacaagagtaacgtgcattggtgacacccattatcgtgttagcgtatcgcttttttggccgtacgtgaaaggcagttgtagcgatataactgcaaatataaggtggtacagtgcagtaggcgcccttaattcagcattagctggataaggggcgcctttttagttgctcaaaattcggaccgttttctagtgaatcttgataggaaaagagttggtgaaaatgaaatctcagattgatattagtcagattaggaatcaaattcaggacttaaataatttattcactaaaggagatcttcatttatgcaggaattacatgacttaaatccaagcccattacggaaacgcgattatttcgtcgtcagctcaatgttatttggcctcttttttggagccggaaatttaattttcccaattcatttgggccagttggccgggggggcactggttactcgccgcgggcgctttttggtgactgcggtcttgctgccgctgttgtcggtactggcaatcagtgtgactcactctgaaggggtctatgacgttggaaaaccccttgggcccgtatttgccttgacattcatggtattgattcatgcaaccatcggcccattatttggaaccccacggacagccacggtgccatttaccgtcggggtgcagccactcttgccgtcgtcgatggcccatgttggcctgttagtctttttcgccgtcttctttggcttagcttttctggtttcttataaggaatctaacgtcatgacgtcagttggaaaagtgctcaatccagtctttttattgctattattcagtgtttttgcattaggatttgccaatccgatgggcgttgccggcaaacaagccgtcaccgctgcttacaagggcgattccttcttcaatggtttcctgcaagggtataacaccatggatgccttggccggtttggcatttggggttaccgtcgttacggctgttcgccagttgggaaagaccaagcccagcagtaatgccaaagtgactgctaaagccggtgtcttcgcaacgggggccattggcttgatctacctcgggttgatctggttgggtgccacgacactttccacgtataaggcatctgccgacggtggtgtggccttcaaccaattggtaacttattacctgggtggtctgggtcatgctctgctggccactttgttaaccgtcacttgtttgacgactgccgttggactggtggctgcctttgcacaagattttcataatcatttctctaaggtcagctatcgtggctggttaggctttatgtgtgttgcatcatttgccaccgccaactttggccttgatacgattatccagtggtcgacaccaatgctgatgttcttgtacccattcgcaatggttttgatcttgctgtccgtcttctcaccgttgttcaaccgtgatccactggtttatgcgctggtcgttggcttcaccacggtcccagccttgctggacatggttgccgctttccccccagttgtcagccaaagtgcctttggccaagccttgggtgctttccagcagcacgtattgccatttgccaatttggggatggactgggtcgttccggctgctgccggtgccgtcttgggacttggcctgcattttctccggccggttctgggcagagccaaagcaccttcatctgaagaaaataatgattaatacagtcgataatgttttagccgataaaaaaatcgttgaaccagcaaccagtaatagccagttcaacgatttttgtgatttaacagctgattattgtaaattagtaaatgcgccattttcctgaagtaatttcacaaatccaggaacagtatcttgacggttccaatcacgctgcagttcgcagactaattgcgggatcgtaatcaggtgagcgccggcttgttcaactcggcgcagggcagtttcgtgcgcgatcgttgacgtgccgccgactgcgtcgacaactgggtagacatcaaagccttcagcgatggcatcgatggttggaaacgtcagacaagcttcggtccataaggctaaaataataatctttttccggccggttgccttgattgcatcattgtaatccttgtcttcccaagcattgatggaagaacggtcgtaggaagggatgtcgcccactaaatctttcaatggtttaacggtatctgaattgcgttgattatgggcatttacggtcgaaagcacaattggcagtttaaatagtttggctgcttccacaaccatttctgcgtttttcagtaagtccgcatggcgcattgaaccaattgaaccaatttgcactggttggtaatcaatgattgttaaaacggcattgtcaggtgatagcaagcggtcgtctgcgcctcgtttgtcaaaacttgtcatagtatcttcctcctcaaaattaaatccataagtcctctagaattcgctttcatgatacaacgatcagggagtcgatactactaattacaccttgaccccaaagccttgggaaaggattcaattgttgaaaaatttacattgaagactaacatggaaattggaagaaaaacgtagtaaataatttcaaagcggcgacaaatgaaatggttaaaaaagtctttttagcaatggtgacaatcttagtttcagttctaatgcttgggtcggtcaattctcaggccagttccaaagtgaataactacatagcaagtcacaatatttcgcacaatcaggtctccagtaagatttggggcggctttccacactataaataccgccatggtaaaaataagcctgagggcgtggtcgttcatgaaaccgggaactcccactccacgatttttggcgaaattgcgtatatgaagaagaattaccgaaacgcctttgtccacacttttgtcgatgacgaccacattattaacattgccagcaccaagtatctctgttggggcgtcggctatcccggcaatgcccgctttgttcaatttgaacaggtcgaaatgcacagtaagaaatcatttgccggtgaggtggaaaacgctgcttactatacggcctatattttgcacaaatatcaccttaagcccaatgacgcggtatacgacggccacggcaccgtctggtctcatggtgcggttgcccattatcttggcgggtctgaccatactgatccgaagggttattatgccaatcgcggcaaaaaatacttccaccaatcttataccatggcacaattttatcagctggtgttgaccaactatcacaacctttaatttggtgaaatatcaaaaaaacctttacaggtggaatcttttagattattatcaaaagagtaatcgttactatttgcaagggagaggatatctcatgttacataaattttcgggcttcaaggcctggctgttagtcgtagtagcagttgctttaggcattggcctaaccggttgtgcaagcaactcagccagcaatggcaaaatcaagattaccgctacgactgatttctatggcgaggtcgcaaaggcagttgtcggcagtaagggggacgtgacttccatcattaccaaccccaacgtggatcctcacgattatcaggcatcgacaaaggtggccaaggaaacggttggctcaaagattgttattgccaacgggattgggtacgatggctggatgaataatttggttaaggacagtagcaaggttgactatatcaaagtcggtgaagacttgatgggtaagcagaacggcgacaatccacatttgtggtataatccggcaaccatgcctaagttagccaacacgattgcgacaaagcttggtaaactgcagcccaagaacaaggcctactttaagaagaatgctcagaagtacatcgcttcattgaagccggtcaatgataaaattgcccagttgaagcaactcgccgcaacaaagaagaacaaagaagtctacgtcagtgagccggtatttgactacgcccttgaagcaaccggctttaaggttggcgacacccagttcgaaaatgacactgaaaaaggcgtcgatccatcaccgcagacaattcgcacgatgcaaaacggcatcaagaaccacaagatcgccttcttcgttttcaacaaacaggttgacagcaagactgtcaataatctggtggccttagctaagcagaacaaggtgccggtattaccggtcactgaaacattgccagctaataagacttacgtcagttggatggattcacaatatacccagttaattaatattttgaaatagttcgtatcaaaaaagccgagaagtcagaattgatttctcggcttttttgtatttaattttaaatttttcgatcggcgattaattcaaataaccgcgccaaatccagccaccgtgattgccgacggtactgcgaacgtgatagtaaattgcatagttgccggtgttcttcttgtacaacttttcatgcgcatcggttacccaagtcacgttggggagttctgaattgtagccataccgggtgccaaggtgcttggagtatctggcacccttagtggttgtgtagtagtgcttgcccatattggcgcgccaaactaatttgacggatgccgaacgagctgccgaatactgcttaccggatgggccaggaatcttgacgatttccccatcatttttagaactggaaccagagttgcttggttttgtcgcactgctggaactggatgcactggaagcactcgaggcactacttgagttcgcgttggtgttggttgaagcagccgctgaaccggagttcaagtagaagctgttgtttaattggctaacatccaaattctggttgatatttgggaaccggtagtcggaagcccattgccaggcattggctgaagggtacttcgacccggttggtgttgccggatagtcggcaatccagccctggttggaggcgttggtgtcaacctttacgcccaaccaacttgccatggtatataaatcggtcttgttatagccgccctgattcaaagctgaatcaaaagctgccaaattggcatcgttattcgctttggaaattccacctaattctgaagattcaaagtcagctaccatcacgacatctttcgaactggtaactgattgaacggcattcatgaagttttgggcttcctgagcggcttgatcagtcgtcgtaaagtgaacaaaatgatagaaattaatacttaaccctgcctgctgggcatactggacctgttgagaaagatacggattgatatatccggttccctcagatgctttaattgtgaccgctttaaccccattttgagctaatgtttgataatcggcggcagttaaatttccctgccaactggaaacatcaaccatgttagcgccaggttgggtactggacggcgtcaaagccgcgtgggcagtggcgttcgtcccaaataaaattcccccggcgaagagccctaagataacggctcctcttttgaaacttttcctcataatcactcaactcccatctatgtatatacacatcactgtgatactaacatgaatgagggcctttcggaagaatgtttacttattgtttccacttcgtcgatcaagtgaaaagctccagtaaattgcgagtaacaaaacggctgcgattgaaatagttgtaatattattggccatcgcatgggtgctgacctgccaggcaacgtaaattaacgcgagttggaaaacccacgataggatggactggccggcaaattttttggtaaaaaatttcatgagataattcctcctattattctggaatgtcaccattctcagggatgtaatcaattgaatcggcaattcgcttgggaattggaatctgtggatcaacgtggggattgttaagatgaatcaggttgtaggacttgcgatactctgtcggcgataagccggttgcgctcttgaaacgccgcatgaagacctttggatcgttgaagtaagagttgtcggcgatttgtttaatcgacatatcggttcgaatgagcagtagagtcgccacttcgattttgacgtgattcaagtactgcagggttgtcataccggtgcagtgcttgaacagcctggttaaataatctggattgaggtgactgcggtcggcaatctctgcgacggttaaatcactggacatgttagcccgaatccattctttgagactgttaatccgcgagctgtcttcattggcatcgggacgattgaagtatgacttgtacagctgaattaaaagtgcagaaaccagatagtcccgttcttcaatgaatgatagttcattgtggattgatagaatctgatgaatcagaatagttgcctcttcataatcggctaatttgaaatactgcggtagaaaaatttgccgcttcttgctggtactggctttaactttttcagtcatgtcgtcttcatcggcagtgagcgtatcttctttgtgctgggagaaaaagtgaacccagtagaagtcgacgtcacctggggaatcttgataaccataaaaagtggtaaacggcgggacaatcaagacttcgtgggtgttgagggtataccgccgatcgccaatctgtagataaatcggtcccttaatacagaggattaattcataatcacccttatgatacatgcgtcgatggtgccagcctttatgagctaaaaattcaccacctttataatagagcagcgttttttccattgtgaacgttgagaataacatttcaagccaacctcctaacggtgtcggaaatcgtcaccaaatgtacgcaaaaatagttttacggcaatgtcggaaacggtcaccaaatgtacaaaacagtgtcactattggcctcgtgacgctatcacggaacccaatattttctcaactggtcggatatcatcacttcttttgccattatagacctttttttattatttggaaacgcttactataagacttgtaaaaacaagttatgttttgaacattgatttttcagaaaggaagttgaggccaatggttcaaattgacgatcgactaagaagctcaccagtttcttaattgggttagtttcagtgtttcagcaatcatttttatccgcccaacaatgagcgggttaccaaaattaatttatttggaggaattatcatgagctcaaatgcaaacgtagattcaaatacggcaagtgctcaagcattgcttaacgacacgttaccttggcacagaaagattacctatggttttactgatatgtctggtaacttactgtactgtattatcagttcttacatgctttacttcttcaccaacgtcttcggtctctctgttggaacggccggtgttttacttctgatcggccgtgtctttgatgccattggtgctcctgtcatgggtatcttggttgaccacacccacagtaaatatggtaagagtcgtccttggttcttgtggatgtcattgccatttgccatctttgtctggttactgtttaccaccccggcattgagcggcactttaaaagttgtttacgccggtgttatgtacatcttagccgacttatcatacaccgcaatgtcgacaccaatcacttcggttttgcctaacttaacttcaagtaccgacggccggatgcaagccaactcaattcgtttggttcttggtaacgttggtaacttcttcgctgttactttcatcattccattcgctggtttactcggcggtgggaacgagcaaaaaggttggtcattagctgttggtgtttactcaatcgttgccttccttctcttaatcatcgccttcttcgatatgcgtgaaaagaatattgaaaacgaaaaagtgattaccattaaagaaagtttgaaagccactaaaggcaactggccttgggtcttgattgttgttgccaacttggcttactggactgcatttatcgttcgtaacgcttcaatgccttactacttccagtacaacatgggcagcaagggtctgatttcattcttcaacggtttcacaattatccaagttatcggaatggcttcagttccattcttcgttaaatttatgcacaagtggggcaccacaatcttcttcctgttgatgaccatggttggtcaagcatgggttggtttagctggatcaaacgtcacttccgctctgatcggctggtgtgtcgcatgtatcggttcaggtagtgcctgcacaatgttcttcgccatggtcggtgataccgttgactttggtgaatggaagactggtatccgtgctaacggattcttaactgccatcggtgcttcattctgtatccaaatgggttcaggatttggttcattcattgcttcaatgcttctcaaaggtttcggtttcaacgctgccaatgcaactcaatcaagctcaagtcttggtggaatcagctttaccttcgtctgggttccaattatcatttacgcaatcagtgttatcttgatgattatgtatcgtaaatgggaaaaccacgaaccagttgttaaggctgaccttgcaaagcggaacgccgaagctgaaaagaacgctgaagctgcacaagcttaattgtgagattgattttaaactttaggaggaacgcatagtatgcaagtttataccacaccaaaattaaataaggtcaaggttacttcggatttctggaaacgctaccgtgaactcgtcgttaaagaagtcttaccatatcaatggaaggttatgaacgacgaagccgacatttccatttctgaagatccccaaaacaatggccaagacaagaacagtcatgcgattgccaacttgaagatcgctgccggtcaaatgaaaggccaccactatggttttccattccaagacaccgatgtctacaagtggttggaagcggccgcatactcattcgggtatcatccaaatccagacctcaagaagattaccgataatctgattgatttgatcgctgacgcccaagatgacgacggctatctgtcaacctacttccaaatcgacgccccagaacgtaaattcaagcgactccaacagtcacacgaactttacacaatgggtcactacatcgaagcaggagttgcctatcatcatgagactggcaacgaaaaagctttggacattgctaaacggatggctgactgcatcgaccgcaactttggccttgaagaaggcaagattcccggctacgatggtcaccctgaaatcgaattagcgctgtcacgtttatatgaagaaaccggtgagaaacgttaccttgacttggcccactatttcttgaaccaacggggacaagatccggcattctttgaaaagcagattcaagctgatggcgacagtcctgaccgtgacctcatcccagggatgcgtgatttcacgcgtgagtactatttggccgcagaaccgatcaaggatcaaaaagttcctcatggccacgctgttcgagttgtctacctgtgcaccggaatggcttacgttgcccgttacactggcgacaaagatttgttagctgcctgtgatcgcttctggaacgacattgttaaacgccagatgtatatcactggtaatattggtcaaaccacgactggtgaagcctttacctacgactatgacctgcccaatgatactgattacggcgagacttgtgcttcagttgggatgtccttctttgcccgtcaaatgctgaacatccacgccaaaggtgaatacgccgacgtgctggaaaaggaattgttcaacggtgcattaagcggcatggcacttgatggcaagcacttcttctatgtcaacccattggaagcagatccagttgcttcaaagggtaatcctgggaagtcccatgttttgactcaccgggctgattggttcggttgcgcctgctgtcctgccaatcttgcacgtttgatcgcctcagttgatgagtatctctacactgtgaatggtgatacgatcttgtcacatcagtttatctctaacgatgctgaatttgatgacggtctgaagatttcgcaaacgaaccacttcccatggagcggcgacattcattatgaaatcgccaaccccgacgccaaatcattcaagctgggcattcggattcctagctggtccgctaacttcgacttgactgttgacggtaagtcaaccaccttgcctgttgaagatggcttcatctacatcgatgttgatgccaagtcgttaaccattgatttgaagctcgatatggacgtcaagatcatgcgcgccagcaacagagtcagtgatgactttggcaaggttgccgttcaacgtggaccaatcgtttacgcagctgaagaagccgacaaccaagcaccactggcttcatatgaagttgcaacagacgctaagaccgactaccacttcgatgagaaattgttagatggtgtcggagttgtcaaggttgctgctcaacgacaaaagttggattccaaggatgcacctttgtatgttgacgccagtcagccggttgagtcagaatcagttgacctgaagatggtgccatactacgcatgggctaaccgtgagaatggtcaaatgcgagtttggttaaataaataaatcatttaaagttagcgttttcaacctctttcataattggttaaaatgctgtatagtatgacgagatcctgatgttatttctgacatgacatcacaacgaaccccattcgtataaggatcgagcccctccaagcaatcctgcttggaggggctttttgtgtattggcaggtaaaacagctggcattttggggttgaataatgaccttttttggctggaatccggggcattttcaaaagattttcattcttaacgcttacatcatgaaaatgtttcaaaaatctatatactgaattttcataatggcctataataaattcgaaagcagcaaggttggcttgctgccgggggttcgagtgcttaggaggctattaaaacatgaacaaaaagtctggaatgatgtcgttttcgattctgatgctgtcattattaccaatgtcaacgggggcgacggcttccacaattcccggattaatgaaacaatttccagcggtttcatcggaaacggccgagctgactgtcaccatcccatcattcacgatggccgtggtgattatcctcagcagcttgattgtcaaacgaattggcaccaaaaaattagttctggcaggaactgcattaaccgcatttggagcaggcctttcaatgttttcaccaagcgtttcagtcttgttgattgccagagcgattatgggagctggaattggagcttttaacaccctttgtatcagtttgattgatcgcctgtacagcggtcagcagcgtgaacggatgctgggttttcagaacacttttcaaggtttgggggctgccggcggtgcactgggagttggtctgatattgatgtactgatgtacagtaactggcggatggcgtttggaatttatttgatcagcgtcgtcttgtttatcctgtatcttttctacgtacctgaagttcgttatgataacgatgatccccaaactgtcggtcaagctgacgagaaagtctcttggatgtccaagttgcagtttggttattattggatcgtcatgttcatcctgatggtattctacatgaccgttaatgtgaaaatgccaacctacattttaaacaatcatttcggcgccttatctgttggctccacggcggttgttgtgatgtcgatcggcacgattattggcggcctgatttatggctttattgaatcgattgccaaaaacgccactttggtcatggcgattgccattgaagccgtgggtgtcttcatgatcagtacggccggctcagcgttggactgcttcatcggtgcttttgccgttggttttagctttggcctgtttattccattcatcttttccaaaggattgtcgtttgttcccaaaaaatatggcaatgacgcgacgactattttgatgatcagtaccaatggtgccaacttcctctgcccatatgtcagcaagttcatcaacatcggcggtactgaccgcagtttgtttatgatggcgggcgtgattgcctcaattctgggaatcatcgagttggtcaaattattagccaatcggccgcgaagaactgttcccgaagcttaatgtttttgtgaattttactaatctaaatgtatttctgaacctctgtatgatattattcatacagaggttctttctatattatgagccatgctgagtgttacacttgagatggctttaatacaaggatcgagtgttaaaaaatcaattcggaatatgagtgtaatgggtgataagatgacaacaattaaagatgtcgctaacgaagcgggtgtttcgatatcgacagtttcacgaattttgaacttcgacgatacgctttctgtgggggaagacacgcgtagaagagtgttggaagttgctgaaaagctgcagtacaagaagcggaatcggcatgtacccaaaggcggtaaaaagattggtattattcaatggcattctgataaagaagagctgactgatctttactacctgcaaattcaatacggcattgagaataaggcggccagcttaggtgccggtgttgagaagctgacgtttgattcaattgataagagtcgggtgaagggcctcagcgggatgattgccgttggtaagtttgataagaccgaagtcatgagtttgaaatcatacgatatcccactggtctttatcggtgagaactatttagcttacgattgtgacagtatccgtagtgatttcgagtcaccggtccgtaagatcattgaccggtttattgagcacggtatcaaggatatcgggatgattgccggtaaggaaacgaccgtgactgaaaagcagggcgttcgcgatcctcgagtgtcgacatttgattcgtatttgtcagaaaagggtttgttcaatgatgccttcgttttccaaggaccatttggcccggattcagggtttgagctgatgaacactgcaatcaaacagttgggcgacaagctgccccatggattcttgattggcagtgattcaatggccgttggtgtcttgcgagccctccagcagcagaatatcagcgtcccagatcgggtcagcttaatcagctttaacgatgttgcaattgccaagtataccagcccggcattgacgacggtccatgttcacaccgaattgatgggtgagcgggcaattgaaatgctgacggaccggattaaagaaccaaagaaggtcccagagctgacggtgattgcgacggaattgatggagagggagagcagtttatagaagagagtggagcaagaggcgcattgatcccagaatgtaagaccgttaagcgattattcccggttttggaatgattgcttaacggccttacatggccgggatcagccgattgttgcacgtttcggcaaggtaaaagtggtgctgatgcaagagtggagcaagaggcgttttgatcccagaatgtaaggtaattaagtgattattcccggttttggaatgattgcttaacggtcttacatggccgggatcagccgattgctacacgttttagcaaaataacagtggagcacaaacaggtagggtcaaaagcgaataacttttgcccagcctgttttttagtaaatttaaagattaatatctatgataacgtagaatccaagtcatcaaaggaaaaagcaagcctcattctctaggatgattttctcaatagcgacggggattctcgtccccctcagaatagttttactaaaatctattgactatacccgataatatagtaaaattaaagcaacagcacaaaagaaagcgcttgcgaaagtgataaacaattaccacttttaaaccctaggaggatgaaacgatggaaaaaggtttactttatccagttaccaatcaatttagacaagatcaaaagttagacggcttatgggattttaagtttgacccacaagctcaaggtgaggccaagggatggacaaccggttttgatgatccaattaagatgccggtcccagccagctttaatgatttctttaccgacaaagattcccgtgagtataccggggatttctggtacgccaagaagttcttcgtaccaacctatatggacggccagaccattcagttgcggtttggagcagcaacccaccgagcaactgtttatgtaaatggccaagaaattcgctcacacgaaggtggctttctgcctttcactgcagatattaccgatgcagtgaaattaggtcaagaaaatattgtgactttgaagatgaacaatgaacttcatcgagatgcattgccagccggtgatacagccactttgaagaacggcaagaagatggctaagcctttctttgatttctataactattcgggcttaaaccggagtgttcatttattagccgttccgaagaaccatatttatgattactcaacaacctatgatgtcagtgaggatcaggcaaccgttcattatagtgtccaagcaactgacggcagcaatttcaaagtcagcctgagcgatggggatggcaaggtggtcgcaaccgctgaaggacagactggtgatttggtggttaagaatccgacattatggcaggttcgcgacgcctatttgtacaccatcaaatttgagttattggatgctggcaaggctgttgatgaatacagtgatgaaattggtttgcgaaccatcgaaatcaagggtcacgaaatcttagtcaaccacaaatctgtctacttgcgcggctttggtcgtcacgaagacagcatttacgccggtcgggcatttgatttgaatgttgaacgacgtgatatgaatctgatgaaatggattggagccaactcatttagaagttcgcactatccatacgatgaacaagtctataaattcgccgatcgtgaagggattttgattaccgatgaagtgcctgctgttgggttcaagatggctgcagccagtttcctcggcggtttaaaccaatcattctttgacggtgactggattgatgaattgtacaagaagcatattgatcaggtcaaggacatgatcaagcgtgataagaaccatccaagtgtcctggcatggagcttatgcaacgaaccggatacttcaactgactcggcggtgccatactttaccaagttgtttaatgattcaaaggatttggatcctgaacaacgaccaagaacctttacccttaacgaggacgacacctttgaaaaatccaagtgtttgaaattccctgacttctacctcctgaaccgttatccaggctggtaccacaagtggggatacgaaatctcagatggtgaagctggtttgcgggctgaattggatgaatggaagaattctgacatcgataagccgattgtcttctcagaatatggtgccgatactgaaccaggactgcacaagttgccatcgattatgtggagcgaggagtatcaaatcgaattgctggatatgttcgatcgggtatttgactcctacgactttatccggggtgaacaaccttggaacctggccgacttccagaccgtggaaggcaacatgcgggttaacggtaacaagaaggggatctttacccgggatcgtcaaccaaaagccgcagccttttatttgaagaagcgttggacttcattaccactggattataaagcaggtaaatagcattgcaggagaggtcggaacaatacttaacgagtactggtgttccggcctcgttgtttaaaagcaaatagggtgactgaaaaggagtgttaacatgaaccagacaagttttgtcattgacggggagcaactggatctaaatgccaaagatgccaatacatttaaaggctttggctacttgagctgtaacaattcttcccgactgctgctggattataaatgggaacatcgagacagttatgatcagattttgcagattctctttggtggtaagcatccattaatgcggatgttgaaagttgaaatgggcgatgatgccaacacgtcttctggaactgaaccggcaacgatgcgctcggcttcggaaaccgcaaacgttaaccgtggggctggtttccagttgatcgccgatgccaagaaaatccaaccaaccttgaaaacagccattttgcgctggggtgagcctggttggctgagaaaagattggttcgacgccaagtcggctgatccggatggtgatgtcccggaaactgcctatgagccgatgtatcggtggtataagcagacaatcatttcggcctatcagacatatggttacctgatcgattatattgatcccgaccggaacgaaaccaagcatccgatggtcaaatggatcaagtggtttgcggatcgattggcaaacgatcagtccgggtttccgaatgactttccgattagtcggtatcagcaaatcaaaattattgctgccgatcagaactatgaacgtgattttggcgatatgatgattgctgatgcggacttgcgtgaacgagtcgaagcacttggctttcactacaacactgatgatggcgaaaaacagccgtttacaaagttagcagacgattaccatcatgaagtttggtacagtgaaggaattgcgccgatgacgatgggtaagtaccgagttcgcgccagcaatggtgacggaatcggcggacgtcaaagcggcttggatgttgctaaccgactgattaagagctacgtgaaatctcgtcgaagtttgtatattttccaaccggcagtttccgcttattataccggggtcaattacagtcacaaagagctgatcaatgcctgccgaccgtggtcaggttactacgaagtcgataatgtcgggctgcagtgcatgaagcactttactgattttgccaaagcaggttgggaagacgaaggtgcttggcgatatttaaccagtgcttgtgacagtcaagtcggtggaaccgaaaacctggatcataatcggcaggcccccagctacatgaccttgatggcgccagacaaagccaactactctgttatttttgataatgatagtcctgaagcgcgcacctaccagattcagctgaaaaatcttccggcttgtgaagacaaaccggttgccgtttggcaaagcgttggtcccgagcatactggagatgcatatgacagtcggatgaaacagttacgccaaaccgtttcgccaacggacggtttgctcaaaattattgttgcaccccattcgattgcaaccgccaccacattggatttggctgacgatccggaagtggtctatcatcgcttggaaagcccccatgaagaccacacccttggtatcaaatctgacgatggcgttttgtatgaagacgattttagttactcgggctacccagaaaattatttatcttctcgagggaatacgccgcggttcactgctgatcaaggcggcgcctttgaagtggtccggaccgacgaagacaacgtcatgcagcagatgatcaccgagaagcagcgggcccttgactgggaatattcatttgctcccaacttaacatttggcgacgatcattggacggattacgaggttgccgtgtcaatgaaatttgacgatcaaactcaacaaaattcgccaaccggaaactactttgggatcggtttgcgggaaatgaccgacgtcaagggtcgccttgaaagtgccccgtatgtctttaaagtagccattgatggtggatgtgagttggttaaggatgaccgaattgttgctttggaacacgttgacggcttggatgtttcggcaactcatcaagtcacgtttgcagcggaaggtaatcatttaacggcgacatttgatgggcagctggttttcgattataccgataccgacaatccacattacagtggccgcgtcaaaattgggagcgggtattatcatacccagattaagcaactaacagttacccagggcaaacagccacatttgattgaacacagggtggatgatcttgattcagctgttcaatatacaggcaaatgggatcatgtttgcggtttgggcaacaccaaatggaatcgaacactgtcgacagcaagtgccgaccaagataatgtgccaggctttaaatttgacttcaacggatccggattctcactcattggggtccaagacgttgccagtcatctgaaggtgacggtggatggagccgttcgcaattggaatctggcaccacaagttggtgctgatcggacagagaatatcgttgttcatgggttgtctgccggtaaacatcatgtctccatcgaagttgttggtggtcgttacacactagatgcggtggatttcttaaaataatccagaaaaaagcgaactgaaatttcagttcgctttttgtatcccttaatattgacgaattttaggtggcgtgtaggtggtcatgaacgtataaatttcatccagtgaatcggagaacagcaccttcttgcggtcagctgccgataagaaaccttcgctggtcatcttatcaaacattttggccaacaggtcatagtaaccattcacgttataaaacacgcaggggttgggattatcccccagccgagcccacgagaaggcctgggtgatttcttcaagcgttccgatgcccccaggaagggcgatacagccattggagatgttcatcatctcagctttgcgggcagacatgttgtcggtgaccgtcaaatctgataattctcttaaacgcggtgactcagctcctcgagcaaccaactgcttggtggtgacaccgtgaactttcccgccttcagccaatacttgatcggacaacacgcccatcaacccgacgccaccgccgccgtaaatcaattcaagatcgtggctgaccaaccaagatgccagttttttagcggcggtgacgtatacgggattcgtgccggttgcggccccgcagtacacagctatccttttcatatccagtctcctttgaaaatagtctagtcttattctaccagtttttctgaaaacaatttttgaaaatcgacataggggactataattaaattaccatttcacgaaataatttaaggaggttaccatggaaacctatattttagatgattcagacgacatgtggcagcattttgccaaactgattggcgacgtctcatggcctgcaggtaaatatttagccaatgaaatgctcggcggacgggtgtctgattgggaacgggttatcgttctaatggatgacgaccagttggtgggcttttgtgcggtcgttcgggaagatatcgttaaaggaaccggctattcaccattcattggctttgtctttgtcagcgaggattatcgcggcagacacctcagccaacagttagtcaaattggccgagaaccaaatcaaacaaattgggtttcataaggcatacattgtcaccaaacacgttggactgtacgaaaaattggggtacgaacaaatcgatacttccgtcgaccaattgggaagaaagatgaggattctagcaaagcaattataatttgattgaggagagaaagaactaatgagagaagagaccacagtaccaaaccgccagaaagtcattttgggtgctcttctgatatttttagtgggtgcaaatatgcggacggcgattacgattgtgccaccaattttgaccaatattcaaaattcgtttaagatgccggaatggtttctggggagcttaaccacaattcctttgatctgctttggattattatcaccgacggttacatattttattaagcgcttcgggattctgccggtaacgatggtggatctgggcttgctgacaatcggcaacttcatccgggtttattcctttaccagcttactgtttgggacaatcttgattggttgtgggattgcgatgttgaatgtcctcgcaccaaccctggtttcctatttgtttccgatgcagattgggacttataccgggatgtatgttttcgcactgtcactatcgagttcgatttctgccggctttagcgccgtggtcagtcacttgattacttggcaggtgatgattcaattcatttcgattattccagtgatcacaattatcgtggcgatcatgttgagaacttcaggcaaacgcaagacatcggccaaaaagccatcaacaccacttaatccagaagtcaaagtgagcgtttggaaacggccgcttgcctgggcattgggtggcttcatgggtttgcagtcacttcttttttactcaattctaacctggctgccaccaatcctgatggcatcagggattaatcagaatacggcgggatacttgttggggctgctccagttggttgcactgccgatttcctttgtcgttccaagaattatcagctcggttgccaaacagtcaacgatgattgggacgatttctggtttgtttatcgtcgggttgggatcattgatgatggctgaaaccagtttctggtttgcggtccttgcctgtgtccttctgggattgtcaaccaatatggcgttcagcgaggcaatgaccttgttctcgctgaagacaagaaccccgaacgaaacagcctcagtctctggaatgggtcaatcatttggttacctattggcagcgacgggtccaatgatttgcggctggatgcatggcctgactacaaactggtttgcggttttgattttcctactggctgtgaccgttgtcatgacttttgtgggattgttggttgaccgtgaggagtatgtgttttaaaaatcagtgtgggcaaataagcgcctagcttccagagtgtaagggggagtcgtcaaatatccagactctggatgtttgacgactcccccttacacggccggaagctgcttatttgcccacgattccactaggtaatagttggagaccagggcttggatgtttggtgaacgcctttatacggccagaagctgcttatcgtcccactattccactaggcaatagtagggaccagaccttggatgtttgacgactcccccttatacggccggaagctgcttatttgcccactattccactaggtaatagtaaaaaagcacaaagtaaacaccaaaataacattccacaatcaccatcattaaaaataaattaaaaaatgagttgactctcagaaataatctgttacgataatcactaatatatttaacgaagatcgaatgagtaatcagtggagttagcccagagagctgtcgcgtcggtgaaagatagcctaacgagattgatgaatatggttcgtgagttgcagtagccgagcacttgtaaggctacgatgttgggcacattatcgtctacagtttgaaaactgactgagaaagcatgcgtgagtgtgctttgaaatagggtggtaccgcgatacgttcgcccctatggcagctttaacaattgaccggtttgttaacgcaaaccggttttatttttcgaaattttgaggaggcggatgctgatgaagaagatagtcgtttcagtagtgggattggtgagtgttttggtgttaagtgcctgtggcaagtcgacgtccagtaaggatgcgaccagccggacctttcgaacgacagcccagacaaatgtcatcacggtcgatcctaatcgggcaactgatgttgggagttatttggcaatttcgcaagttgtcgagggcttgtataaacaaaataatcaaggaaagattgttccgtcggtggcaaccaaaattgttcagccaactaatggcgggaaaacctacaccttcaacttgcggcatgatgccaaatggaacgatggcagtcgggtcactgccggcgactttgtggcctcgttcagacgacaagttgaccccaagaccaagtctcaacgtgccggtcatttgagcgacattcagaattatgaagcggttaattccggcaaagcggcgccatctaaattaggcgtcaaggccattagtaagtataaactgcagctcaagttgagccacccggttccgtactacaactacgtgatcgccacccaactttatccgattaatcagcgggcgctcgccaaatggggcagtaaatacggtcaggattcaaagcacgcggcttccgacggtgcttatgaaatcaagaactggaattcttccaaagatacctggaacttggtcaagaacaaagactactacgatgcgaacaaagtcgacttaaccagaattcatttccaggttgtgaaaacaccacaaaccagcatgcggttgttccaggcaaaggatattgatgaaactcagatttccggcagtttggttgctgatgccaagaaacaatttaagaatgaaacggtggtttcaaaatatggtcagttagcctttatcccttggaacaattaccgtaagacgacgcggaatctcaatttgcggcgggcactaagctacgctattaatcgacaatccttggcaaagaacgtcttaaaggacggatcactgccggcccaatcagtggttccggagggtgaagttaaagatgccagtggcaaagatttcaatgccggcgttaccccaaagttgacgtataatctcactaaagcccgccactattttaaattggctcaagaagagttgggaaaagaaaccatcaatgttcaattgttaaccgcggacaccgatgcctataaagccgtcgcagaatatattcaatcacaggccaaaaaagtatcgcccaactttaatttgacggtgcgctcaattccactgcagcaagagatttccgatttcagtaatcacaagtttgacgccggcacgctcgggtggtcgacagacttcccagatccaattgattatctgaacttggctgccaaagccggggtaatcaactttaccaagtggaccaacgataagtatcaaaaactgattgatcagattaatgacacgacgcaccaaactgcagcacaacgagtaaaactgcagcagcaggctgcctcgttgttaaacgaacttcagggcgtcacaccgctgtaccagtatgcttcggttcatttgagaaccaagaatatcaaaggcttggattatccattaattggttatcagaagtatgagtatgcaagctggaagaagtagtagaggagatctgattttatgacgattaaaattggcattgccagtaatcatttgattcatccaactgaacgattcggaacaaattttgtcgattatattcaacgagactatgtcactgggctgagacatgccggcacgttgccattggtcctgcccttgggtgatccgaaagatgctgaagattatattgccggagtcgacgggttgctgttgtcaggcggccaaggggtgacgccgattctgtacggcgaagagccgctggctgaagttgctgaaacggatatttaccgggatcaatttgaaattgcattgattaaagctgctcagaaagctgacaaaccggtgctggggatctgccgtggcatgcaggtgattaacgtcgcgttaggcggcaatctgtaccaggacatctataaacaagccggggcaacggagaaacacaatcagtatccaacgtcttgggagattcccactcaccacgtgacaaccactgacgactcgtggcttcaccaaatcttgggtgagcggtttgcggttaattcctttcaccatcaaggcattcatgaaccgggtgacaatttgaaagtcgttgccaaaagtgatgatcaggttgttgaagggatcgaatcaaacgatggtcgaattatcggtgttgaatttcacccggagatgatgcgggtagtgcatccggaattccagcggatttttgattattttgctaaattggcaacagagaatcagtagagatagcaaaggctgaagcccagtgattgtactggtgcttcagcctttttttcgcctacttaacaatgatagagttgatgatgttacggcaactttgagccccacttctatctagaccaaacgtgcagcaatcggctgatcccggccatttaagccaacaaaccaatcattccaagtcccggaataattggtttgttggcttaaattctgggatcaaatcgccttttgctccactctactcttaaatttccgccgccggattggtcgtatacgttgcccatgcctgaacagcgaccgtgcccaggattaggacggcgccgatggtttccggcacgccaaagctgacgccaagaaaaatgatcgaaagtgtggtagccgatagcggttcgaatgaccccaatacactggcagtcgtcggttgaatgtatcgcaggctttgaaggtaaaataggtatgcaaacatcgtgccgaagatcaccacaaaggagacgctgccgtacgttgtccaagaaaaggccggcatgtcgtcccagatccggtaataaaggctaaaagcggttcccccgattagcattgaccaaccaacgatgggaatcgagccgtattctttcaggaggtttcgcggtaataaggtatagagggtagaactaaccgctgcccccacaccccacacaaagccgcctaaaggcattgccaaggtggttagctgtccgtgggttaccagaagaactgtcccacacagcgccataatgaccgagaagacgtcgattcgccgcggaaaacgccgggtccagagagccaaataaataataatcattgctggtgccaaaaattgaaggatggtggcagtggcggcattaccggcctcaatcgccatgaaatatgtatattgtgaagcagccattccaataaagctaaagaagattaagcttagtgaatcccttttgtggtgccaaacccgcatttcttgtcgatgattgccaatcaaaccatacagaccaatagaatacctgaaatcagcattcggacagaaaccaaccagtgtgagcttacatggatatcgtcaaataaaaattgggcaagtgttcccgagattccccacagtaaaggtcccaacattgccagtacaatgccgcggatacttccatttttcacctgattcacctcccatacataatgaaccaattatattacaaagataaccgatttagaataaccctttgtaaaataaagtgaattgcgttagagtatcattaatatttaatgatagaacaatacataagaggaggcctgcgcatgtttgataaaattggccagattattttcaacaacgaaattgtcgcaaatgccagcgactttaatatgggcattgaagtcgaaacgattcggattgattcggctggaagattgacgaaggaaccgtaccccaaagcgcttggcaatcaacgaaagaaccatttcatcaaaacagacgtttaccagattcaaagtgagattatcacgccgactgcccgcaagtccctggatgcgatgcattatttgatggcacttaatgatacgctgcgaaatgctttggagcctaacgaattattatggccgttgagcatgccgcccgtgttgccccaagataagagcaccattccaatcgctgatgttgaccccgaacagaaggcctattacgaaaaatggatcaaaacccgtagcgatacccaggggattcctgtcggggtccatttgaacgtcagcattaatgacgacgtgctcaaaacggtttggcaggcagttgacgatcagtatgattcatacgccgattttgtaaattatatttatatcaagatcgcccaaggctttgattactaccggtggttaatcacttatttgtttggcaatagtccaattgctgaaaagaatttctttaaaccggacgaggatcagccgcagcatgaagagcgtagtattcgttcatcgaactatggattgacgtctgatgtgacccacaattatcgcagtgtgccggattacgtcaagaatatcgagtcaaatattgccagcggcgccttgttcagtgaagcggaataccattcaagcgttcgtctgaaaaccatgcatggcgacctaactgatatgattaagaacgggaccgaatacattgagttacgaatgctggatcttgacccgacgaccgccttgggtgtgcggacatccgccatccgctttttcagaatcctgctaagttatttcatgatgatgccgactcttgaaagcgatgagaagatcaacctcaagttggaacaggggcgggcaatgaacgaagtggttgcccttgaaagcccatcccaacagacaatttatcatcatgaggcgcaaactttcttggatcaactccaattgtttggcgcccagattcagtggggccctgaataccaggaagtcttggatacgatgcaggatcgactcgacaacccgaacctgaccccggctgcaacgctgtgcgatcatgaggttgacggctcactgatgtcatacggtctggcaatggccaaccgttatcaaaatcgcgcccatgagaatcctaatccatttaccggctttgaggaacagcccgatatgacggccaacgaactcaggcagcgtctgtttggtgtcatggggaaaccggaaaattataagaacggctgattcgttgacatgcggctgacgaatcactaaaatacttgataattaattgaagcctctaccaggtttagacgaagcgaagctgtgatgtcctacaagttttttcttgtaggatatttttgaaaataaaggatggtgggcaaatgaaacaagcaaaagaagtttctgatttcattaattcgacggttgggttggaggtggaaacccaccggataaataaaagcggtcagttgagtcacaagtcatatcctaaaggcctgctaaacgagcgtcagcaccattttatcaagaatgactttttggaaacgcagtctgaattgattaccccgccaaccaaaaccaccttgaaggggttgaaatacctgggcgtgtatcatcaggcactgcgaagtgagttggctggtaaagagtacctctggccatacagcatgccgccgaaattaaaagcggaccattctgatattgtgatcgcccaaaccgaccccaagagctatgagtaccgccagcaggtggccaagatccgaaaaattgaacgaactgccgagaccggagttcacgtcaatatcgggttgacgaagaaggccatcaaggacttaactgctcaggatgccaatgtgagcaccgatgatctgtatctccaggcagcggttggctttatgcgctaccgctggctgttgacgtacctgtttggcgcaacaccggtggcctttaccaattattttgctccagataccgatgcgcctaccagtccggtcagatcactgcgcaactctcattttggctttggaaatgggtttatttccagttatcaaagtgtccagcagtacgttgacggcatcttgaaggccgtggatgatcaaaagctgattgcccagcgtgagtattatgggacggtgcggttaaagcgcagcgataatgtttctgccctcctaaccaagggaattgcctacctggagctgagaatttacgatttagatccttttgaaccgttgggggtgtctgaagatgccgttgacttggtccgtttgatgtttgcttattttgtcagtcatcgtccatttgatttgcggacggcggacgaagatattgccaaggcagaccagaagaatgatgtcgttgctttggaaaatccattgaagattagtcaatatcatgatgaggcggcggaatttatcggtaaactggaaaagttcagcgctcaagctgttatcccattcaatgctcaacatctgtgtttcaaattaatggaaatgattgacgacccggtgttgacgccgagtgggcgaatggttaattggctcggtgaagactcgaaaaaggtgtttgatgaactgttaaaatttgccaagggctaccaggatgatttgattcataacccggcaatcggcttcgaatcattgagtgccgcggaccagaaggaaattttggcgaccttgaagcagggaattccagtgagaattaaataagagtggagcaagaggcgttttgatcccagaatgtaaggagattaagcgattattccgggacttggaataattgcttaattggcttacatggccgggatcagccgattgctgcacgtttcggcaaggtagaagtggtgtacaaaggttgcgggctaagcggaggaagcagcctgaaagcccattccatccaaacagaaattgcccacacaaaaaggtcggaacaataggctaaaccacctacgttccgacctttcaatatgcattgatcaattaataaaaactaggtttgctccactcagttcccggctcacccaagcctaagctttctcgatggtaatccgcttttccggttaacaggtcggtgacaaactgagcaacggcttgtcgggtgacttgcgcttccttgaagggttcaccctttttagtaacgtgaacctgcgtattgccggcttgattatacagccaggtgatccgcaaaatcacatagtccaaatcactggcttcgacaatgtcggccgacttctttcgatcagatttccaaataattccggtgtgttttcgataccaggcttgaaacttgccggtaacttcctggtataagtcaggaatgttggcggaaatgaaccgagtgaccttggcttcgtcgagaaccttcacaatgccgccggtgatttccggtccggcaacaaagctcagatacactgcatcaacgccacttaagttggctttgattttatcaaactcggtgaagtcgccatcgacaaacgtcacgcggggactctttttggctgccaagcgagatgagacgttatgaccatacaagaccaaatcaaaatcggtttgagttaacaggtcatcggtcaccatttgaccaatctggccggctgctcctaaaatcattactttcaaaattttacctccattgggttacttatcgtcgttgttccagcgaccgccgccacccagacgttcaaccatctttggatcacggtgatcaaagaatgccgattccttcatatccaggttttggatgagctgcatttcttcatcggtcaattcgaagtcaaagatgttgatattttcaatcatccgctctttgtgaactgacttggccagtgtgacaacgccacgttggtacagccagcgcagaacaacttggccaacccctttatgatgattttgggcaatttctgataagacatcgttggtaaataagccgtgcttgccttctgcaaacggtgcccaggcctctggctggatgcctaatttcttcatccagtcgagttcatcctgctgctggaaccagggatttaattcaacttggttgacctgcggggtgacctcgttatgctgggcaaggtcgacaaatcggtcggcattaaaattggagatcccaatggctcgaatcttgccttctttttgcagctcttccatggctcgccatgagccgtaaacgtctccgtatggttggtggatcaagtaaaggtccaaataatccagcttcaatttggttaacgcctgctcaaactctttcttagtcgcgtcatagccggtatcactgacccaaactttggtggtcacaaacagctggtcacgagggatgccggattctttgatggcgtcgccgacttcggcctcgttgccataagcctgagcagtatcaatgagtcgatacccagccgagagagcatcggcaacagcttgtttagttccaccgttttcgatttggaaaacgccgaatccggctgctgggatttcaatgccgttatttaatttaaatgttggtgtattcatgatgattattctcctttatgattgtctttcaaatatggcttctgccagagtttctccgcgttgtcggcggtcatttcaccggcatcgaatttggctaaatgctcatcgaaggtgtcaattttatatttcaacagggcttgcgtgtcctgcatttctttgagcttttcgtttaaaatcgtcaactgttcatgcagaatatccttttgagcttgccggacggccccacctttgcgggccagggtagcaaactcaatcaaagattcaattgacaggccggcgcttcttaaacttttcgccaggaaaatccaattcaagtcattggtttggtagacacgataaccgttgtgatcgcgtttaaccggggaatgacgccaatccgctcgtaatagcgaagcgtatcggtagaaaccccaagtagttccgagactttcttactgttcatgatctcaatacctccgttcctcaactgacaaatacaatataaaccgtggagtggactccatagcaagcaaaaaaactttaaatatcaatttaatttatttcagatctggttatttgatttttgaaagactaaactgagtttcaaaggagtgatgaatgaatgtgtacaagtgtgacttttctatctgaaacgggcgacaactttttagctcgaaccatggattttgcttttgaattagatggccgaccaatcgtgatcccccgaaagcagcattttgacagtgatgccgcagaggctggatacgatacgacctatggttttgtcggtgccggcagaaacttgggccattatattttggttgacggtgtcaatgagaagggcttaagcgcagctgcactgtatttcagtggcgaagcaacctacgccaaaacggctaagactaaccgggtcaacctggctccccacgaagttttgaattggctgttgggcaatgccagtgactgtgaagatctgggccgcaaagtcgaccagctgaacatcatcgatgcaccagtcaagattcttggcaaggccaccccgcttcactggatcatttctgatcgctcgggtgcctgctatgttttggaaatgctggcagatggcgttcattatcaaaagaaccccgttggcgtcatgaccaacagtccagactttggctggcatctaaaaaacctcagcaactacaccgagttgaaaccatcaccacatcctgcccgctcgtataacgggtatgaaattacgtcatttggccccggaagtggggcgctggggatgcctggtgactatacttctgtttcgagatttattcgcaccgtatttatgcgggaatatgccgatcaggtaccaactgatcaaactgtcaacgaactcagccacattttgaactcggttgaaattcccaagggtgttaagttgaagcaggatggcagcgaagactacacccagtatcgcggctatatggatatgaaaaattgtgcttactatatgcagccttacgataatcaaacgatctacaaggtgtccttgtcggaggaacttctgaacaagaaggcaccgagtgaatttccaattaagcaccaacaagtatacgaaacgcttcggtgaggtatcctcactgaaagcggcttgtggacacatgagttgttaaaatccaagaaaaaaacgctcgatcatccctttactggaatggtcgagcgtttttgaatgccaaggaaacctattttcgggtcttgtcagcaaccttttgactgcggttaatgaagtccttgaacagcttccgcgagtcttcataatgcttgtaaatgttttctggatgccactggactgctaatatctgatcattatctactgattcaatcgcttcaatcacttggtcatcggctctggcggtcaccttcaaatacggagcgacgtctttaacggcctggtgatgacgtgaattgacatatgggcgctggccaataatgtcattcaagcggctgtgtggatcaactgtgacgtgatgagatggcatgttgcctggggcttcctgggaatgtttcaaagtcgcgtgtaagtcctgggacaaatcttgataaagggttccgcccaggccaacgttaatcagctgcatccctcggcaaattcccatgatggctttgccggcagtcacggactgtttcaataattcaatttcaaataagtcgcgtttgagataagtcatgcccagcttctggaatggttcttcaccatagaaagtcggatcaacatcagcgccgccaaggaaacagacgccgtcaaacagtgtcatataatcgcgcacgtcttcgggattgacacttgggaaaatgacaggtacgccaccggatttaacgatggcttcgattgctggccggggcgcgaacgcggcgtttcgttcattaatgacgttggttgcctcggcgagcgtgtcagcaggtaatgcgattcttgggcgcaataaaatccctcctcaataattagtttcagtctatttgtgttattgtactccaaactaataaatttacgtgatattttgattgttgtcaatgtaatttgagcttatttgtctacttttgatttgtcgggttcccaactgcccttgaataattcctgctttaattcattggctgacagcttggctttattttcaaatcctttaaatgggcgaatcgactggagtgccgattgttggtagcgcttggcccgtttaatcgcatattcttccaaagaaccatttttcaaatgagtgattaatttcgcgcttggcgtggtgagtggattttcgacgcggtcttggaggtcttcaagttcttcttggtattcaggtccaagctggattctatccgcgtacatttccaaactttggagaaacgctctggcattggcttgatatttggaaacatcattgggatgttcttcggagacttcttcgttcatcttatccgaacgggcgatgaccttctcaacttcctcaggattcattgccggcgacatgatgaaatagctggccagtaaacggataaaccgtaacgtattggtccgaatccccacagaactgctggggtcaaggtcgagcattctcaattcaaggtagctaaccccggtcttcggtaactcccgtaaatgggtattgcccttaaagcggacggcaccatggaattcgtaatctgaaatcagcttgccgtcagcgacgcctttttcaattcggtcaacataacgctgaacgttcgtatagtcgccgctaaatggattgccaaagccgtgtgaactctggcggatactacgaatcggtgcttttggtcctttacccggatcaaaatagttggcttcagcgacagggctggcaccaaatagatatgtaatgacccaacgataccgcagaaagccttgggcaatcttggcgtataagtagttttgcagctcaactttggaattgaaacgatcgctcatgttagccagaactaaatcaaacacatggggatcgatactcaagttgatgtgcgcgccacaaggcgttccttgagaaaatccgtgacgtttcagccattcttttaagtaggcttccttcttgggtcccattttagcaaggggaatcttgctcttgtcttttggcagccgcggcggcatcgataacggccacaacagctcacctggcgacagggccgaccgcaaggcgttgttaatgctgaacaagtagtgcatggcgtccagggcgtgagcggcaggtggggtcacgacctcagacatggtttccagaaaatcattggtaatccagggattggtttgttcgtcaccggccccggctgggtagggttcttggcttaaattgccattttcatcaactcgctgcatctcaatttcaattcccatggtaaagtctgaagttttcgcaacggcttcgttatcaaatattaactgaccaatttcactgaacatggcatacctcctagttgaattaaaatttgatgataattgatgacaaaatactaacactatcgcggactataagcaatgctaatggtgttatgtcacggagatttgtgctaaaattattttatttaattaatttctaatttagaggtggaatcatgagtatctttgtcaaactgggctggtatttcaaaagggaatggaaaatctacctggttggtttatttggcctgctgctgacggcgttggtcggaattattccgccacggattatcggtaatctggtcgattcgattcataacggtaaattaacagctaaatatctcatgtttttgctgattgttttgacgattgtctcctttgcccaatacggagcccgttatatgtggcggaccgcgatttggggtgaagctgcgaaattggaaaaagtgctccggaatcggttgtttttccactacaccagtatggatcatgaattcttccaacgctatcgaaccggtgacctcatggcgcacgctaccaacgacctgtccgcgattcaacgggtggccggtggtggaattttgcagttcgccgattccatgattaccggcggcacgaccttgatcgcaatggtcacgttgattgattggcgattaaccctgatcgccattttgccgtttccgctattggcggtgatggcgcgatatttggggactaagattcacattgcttttcgagattctcaagctgccttttcacggctgaataataaggccgaggaaagtattaccggcatcaaggtcattaagggccttggccagcaaaaagaagacatgcaggattttgacaaccaggttgccaggacgattaatatcaaccggcgggtcaattttctggattctttgtttgacccgatgaccaccatgatcatcgcgctgtcctatgtgattacgattgtttacggtggctatttggtcaccaatgggacaattacaattgggtcgttggtttcgtttgtttcctatctggccatgatgatctggccgatgtttgccgtcggtatgctgtttaacacgttggaacgtgggaatgccagttatgatcgggtcatggacctgattaaccagcaaagcaaggtaattgacgatcccaatggtgtgacgactacaccgaagggcgaaatcgattatgacgttaagcgtttctcatatcccggtgataaacgactggccctgcaaaatattgattttaaagtgccggctggcaaaacggtcggtttggtcggcaaggttggttccgggaagagtacgattttacggctgattttgcgtcaatttgataattatgaagggtcgattaagtttggtggcattgacatcaagcaatataagatggacgctttaattcctgcaatcggctacgtgcctcaagatacattcctgttctcacagagtattcgggaaaacatccgctttgcccgtcctgacgctacccaagctgaagtggaacaagctgccaagaaaagtgatttgtatgaccagattcaagcgatgccagatggttatgacacggctgttggtgaggaaggcatttcactttcaggtggtcaacgccagcggctttcaattgcccgcgcgctgttaatcaacccggaactattaatcttggatgatgcgttatctgcagttgatgcggaaacggaaacccaaattctcgaaaatctgcacgctgaacgttctgataagacgacgatcatttctgcccaccggttgagttcagtgatgaatgccgatgagattttggtgatcgatgacggcaaaattgttgagcgcggcacgcacgatcaattaatgacccgcggtggttggtaccacgaaatgtttgagcgtcaggaactggaaaccaaagtgaagggaggcaacagctgatggctgattcatcaaagcatcaatctgcctggtcgaaatccattccagttaagcagcagatgcacattattgggcggctgttcaagtacgctgccccctataaatggtatttctacttttcagtcctgtttgcgattgcggttgccgttgtcaatattctcttgccaagaatcattcaaacctttatggacagccacttggtcgttggtcatcctgattttgcgatgatgtggttctttgccggtttgtacttctttggcatgttggcaaaggctgtgatgcaatttacccagacctatctgtatgaaatgggtgctgagtatatgctcgaaaataccagacggaaactgtttgcgaaactgcacaccttggggatgcggtactttgaccagacccccagcggttccattctttcaaggttaaccaacgataccatggcctttgcaaacttctgggccctgttcagtagtttggtggtcaccatttcggccatggtttcctcatttgtcgcgatgtatttggcagacgccaaaattgccatgtggctgttggtgttcatgccgttcttgttcgtgacagtctggtactatcagcgatacagtacccgggtctaccgtcggatgcgtgaacggttgagccttttgaacgctaaattagctgaaggcattaccgggatcagtgtggttcagcaatttcgtcaggaaaagcggatcaatcacgaatttagtgacaccaatgaccagtattacaatacgcgccgagcgatgattcgcatcaactcgttgttgttaaacccaatcatcaacttgttctatgctttgggtaccgtgctggtattagggatgtttggtatccgtgggctgcatggctatgtgcctgccggaataatttatgcgtttgtgacttatctttccaacttctataatccaatgtccgaaatgatggatcgcctaagtgacttccaagatggggtcgttgccgggtccagagtcctgcggattatggatgatcagacgtacgaaccgcagcagcacgcggatcccgatgccacaattacccgaggaaaaatcgaattcaaacacgtcaccttttcttatgatggcgaaaatgatgtcctacatgatatttcctttgtggccgagccggggcaaaccattgccctagtgggtgaaaccgggagtgggaagacgtcaatgattaacatcttgatgcgcttctatgaatttggtgaaggggaaattctgattgatgaccgtgatattcgtgattacaccattcaagaactccgcaagaaaatggggttggtgctccaggaacctttcatgttttacggaaccgttgcttctaacattcgaatgttcaaccaagaagtcaccgatgaagaagttcatgaagcggcacgatttgttcaagccgatcaatttattgaagacttgcctgatcaatatgactcacgggtgatcgagcggggggccagttattccagtgggcaacggcagttgatttcctttgcccggactttggtgactgatccgaagattttgattctggatgaggcaaccgccaatatcgataccgagaccgaacagattattcaaaccgggttggccaagctccaagaagggcggacgaccattgcgattgcccatcgcctttcgaccatccaaaacgctgacttaatcttagttctggaggccggccggattgttgaacggggaacgaatgacgagctgttggagaaacatggtttctattacgatatgattcaacttcagaattccgcccatttggattagggtggtttgcgaattttgactgaaaaaatggttgatagcaaattttactttgctatcaaccatttttatattacggtattaaattattgaatctcaatattgccactgtcttcatgactatcagcagcctttggcaatgtgatggtcaagacaccatcattgacttgagctgagatgttgtcacgatcgacaccaggcaattcgtaagttctggacatgacaccatgactacgttcgctggcaacgacccggccttgttcgtccttcttctcagaatcacgttcttggtcgatgctcaatgccaagtcaccatgttgatatgccagatggatgttcttcttatcaatacctgggacatcaaccttcatgatgtagttcttatcattttcggtgatgtcagtctttaaatcaccatttaccatgtagtcgttgtctgcatcagttggactgaagaaacgacgtgccaaagtatcaaagaaaggatccattgcgaaacggttcattaattcatttgccataataccaatctcctttgttgattattaataagattaattaataagcgtcaaaggtggtgaaacggggtctcggaatcacgttcccccaaaagaagctttactgaagtttcaaaagctgactacctgaatccctaaccaaccactccaaaatattcgtcaaaattactgaatatcaatgttgccggtttgatcttcgctttcagtgacttttggtaatgtcacatttaaaacaccattgtcaatgtgggctgaaatgttgtcgcggtcaacaccaggtaattgataactacgtgacataacgccgtgactgcgttcgctggcaattaccttgccgttttcatctttttgctcagatgaatgttcctggttaatattaattgagagaacgccatcttgatagttcaagtgaatgttgttcttatcgatgccgggaacatcaatctttaatgaatagtctttatcggtttcgttaatatcggtcttcaagttgccgaagttctcataatccttgtcgaaatcagaagggctgaagaagtggtgagccattcgatcaaagaacggatccaaatcgaaacgattcattaattcatttgccataatatctatctccttaatttcaaaatgattattcaagataacggggaacaacacgtcacttttttgttcctcctttacctttcaactactatgataatcagttttaaaatgaataccagtatttagcactctaatgttgagagtgctaaaattttctcttgaatggacaatatttgcatctaacaaagctcgcctatgcgcgttatcattgggatgtgctatgctgaagtgagaaatcaatgaagctgggtgaatggtcatgatcgatcgttttttcaacaaaaagtttatttggaagatgatttgggtgggcattgggacaattctggcctgcctgttatttctgtcggtcggattttctacccaactctcaccagcattagtcgatcaaaatgacacccccacccagcaggtcgatacaacgactacgccggcgtacagtccggaaacgaatttccactggtcaaccaagacagttgcctactttattactaagcagacgaacggccattaccgagatgtttggatgcgggcagtcaaagcctggaatgcggtcggggtcgttgatctgataccagcagacgatgcggatcgtgctgacgtcatccttagtgtcaaacaatcctatcatgaaggcggcggtacggttgagaatatcactggtggggtggttggctacaccagtgaggaatttggtcacgtggacgggatcccgctattcgtccatcaaaataaaagttatctgattattgattccctgaagcaagcccactacgattctgtcaatgaacaggcaagcgtggcaatgcatgagctggggcatgacttggggttggagcacagcgacagtccccattcgattatgcagcaggcggcaccgacttatttggatagtattccagaagttgatgccaagcatttggcacagttgtatgctggggtgccgcgggggtgaaagtagccgtattacctattatggtgatgtttaccatgcaaaaaaagagcggctcagaaagtcgctccaattaatagaactctaagtattgaactcaccaaacttacactgccagcaataccccgacagagtagtgaatgatcatggtgatgatcccaacaataatatttcgaataatagctgttttaaccaaaccattccccaatcgggcacttagataacctgtgagtccaaccgagaggcagacggccagaatagttgccggccactggaaggcaactggtgtcagcgtcatggcacacaaggggaagataccaccggcagaggcggaaaagagtgatgagaacgctgcgtcccaaggattcatgtagtgtcccaacttgagaccgtatttgacattgacaatggtttccaaaggatttttgctcattaagtctttggcgatcttatcggcagtttctttggtgacaccctgatcaacgtaataatcggataccacgttgagctggtcttgataattggtcttcaataatgctttttctttcgtcaccacagattgttcagtatctttttgggtactaacggacgcatattcgcctgatgccatcgagaaggcacaagccaacaggtcggataatccagcaatgaagatcgtaaactgattggttgtcgcaacggcaacactgaacagcaccccaacaacggttaagatcccgtcgttggagcccaacacaccggcgcgtagggtattgagcttttcgtccattgtctgcccatcttttttctttttggaacgaacacttaccatgttcttcgcctcatttctctaaaatgtgatgttcaagatccaattaaagtcccaattgtgtaggtgactaacatggtcaaaatcccggaaataatgtttcgaatcatgccccgacctttgttggcgttgcctaattgagcggcagtgtaaccagtgatcgccaatgcaattacgacggcaatgaaggttgccggaatgcgaatggtctttgggaacaaagtaatcgctaaaagtggtaaaattgaccctgtcggaaatgaaatcattgaagcgattgctgctgataatgggttggtgtattcaccaacgttgaagccatatttttggcgaaccgttgtcttaaccgggtctttcgccatcatttcagaagtcgcttgggccgctaaattggcagagatgccgtcacccatcagtttgtgcttgacggtgttgaattcattatcgtaagcggaacttaaggccgctttttggagactgatggcgtgtcgttgagaatctttttgggtattaacagatacccactcgcccatggccattgagacggtcccggctagcatcccggaaataccggaaataaaaatagcaaaattatttgatgtcgccccggcaacaccgataacgattccggcaaccgaaacgatgccgtcattggcccccatcaccgaagcccgcagaacattaatcttttgtgaaagcgatcttttcttcgccatatgctcacctacttcatagtttataatcattattatctaacaaaaattattctagtcctttattgtttaaaagtaaattaaaagtattgtgttagctaacgacgttatcatgtcacttgacacatatgctgtgaagaaccaatttagaatcactatcaaatagttagccattaatcttaagaaggagatgccactcgtgaccaacccgattcttgaacaattaactcagcaccgtagtattcgtgaatttgaagatcgaccgctgagcccgcaccaagtcactgaattagtgaatgcggcccaacatgcttcaaccagcaccttttctcaacagtattcgatcgtcagtgtaactgatccagccaagctccacgcgattgctgacgtcactggccatcgttggatggtaaatggcggtcactatttcgtgatggttgcagatcagtatcgaaatctaaagattgccaaagcacatggtatcgatccatacatgttgcattcaacagataaatttctggcaagtgtctttgacacggcaattgccacggaaaacatcatggtggctgcagaaagcatgggcctcggcgggaccattatgggcagcgtcttgaacaatcccagaaaaatgattgaattattaaatttacctgagatgacatttccattattggggattgcactggggtatccaaaagacaaaccagaattgaaacccaggttgccaaaagcatcaatgcatttcgaaaaccaatatgatctggatgcaaactttgaccaggaactcaccgattatgatcagctaattcgcgagtattatcagtctcgcagcaccaatggtcgatcggaaaccttcagtcatcacattgtttctgaactcagcgggaatcggaatctgcggtcggatttgtttgcgatgatccaagcccaagggctgatgacccactaaacaattattagtaaaaatagttgacttttgagatgtttaacattacattattaggtaattgattgacagtcatttgaatttcacaatgttgaagagaagagtacgttgttgggctgcacaaagcgaccgctgatagtgaaagagcgggcagacattgaccgaaagtgcgctcggagttgtggcatttaattaaagatgcattcgaaatgaggcgttttgtttttgacaagacgcaaaaaagggtggaaccacggtaattcgtccctgatgatcagctgatgctggttgtcagggacgtttttgtgttcaaatgactgcaaaataacttgtgaggagatgattgacaatgagcagctgggccgttatccaacagagcttaccgatgtttgagaaggggtttcaactcaccctgtggctttctttcgtcgggattattggatccattattgttggcataattgtgagcctgcttcaatatttcaaagtacccgttttgcaccaagtggcatcgatttacgttgaagtttcgagaaacacaccgttattgattcagctatttttcctgtattacgcgtttccagtgatcggcattaagtttggtgccgagttgtgtggcattatcggattgatatttctcggcggcagttatatggccgaaggctttaccggtggcttcaacggcgtttccaaaggccagctggagtctggtaaggcaatcgggttgagtcgttggcagcttgccagatacattgtcttcccgcaaggattctcactgagtgttccggcgatggcagctaatgtcatctttttgatcaaggaaacttcgatctttacggtgattgccattccggaattgactaacactgcgttggatttgattgggatgtattaccggtccaacgaatatttattcgttttggttgtcggctatgcgatcattttaattccactatcaatcattttgactttactagaaaagagggttcgctatggatcattcgggaattagtgttttattcgaaggaaccaattttgagcggttactcggcggcctctgggtaacggttaaaattgcggcagtggctttgattgtcggcctcatcttgggaattatcctgggtgttttgaggacctttaagaatcggccattgcgagtggttttgagactgtatcttgaattcttcaggattgtcccaaccgtcgtgctgctatttttgttctattacatcttgccacgccaattgaattttaatctccctggcgatcaattggccaccttggtatttgccttgtgggtggctgctgaaatgagcgatattgttcgcggcgccttaatctcagtgccacagcaccaacgcgaatccggtaaagcaattgggctcaatcgttatcagctctatcgttacgtattgattccccaagcaatcagtttggaaatcccggcgaccatcaatttggccacccgggtaatcaagacgacttctcttttgatgctgatttctgtgatggatgtgattaatattggccaacaaattattgaagccaataatcacactcatccaaccggcgttttctgggtttacggattgatatttctattctatttcctgatcgattatccactatcctggtgggccaagcgattagagaagaagagattggagcgggcaaatggctgagcagattttacaagttgaacatttagaaaagtattatcaaaagaaacacgtcttacacgatattaattttcatgtcgataagggcgaggtcgtcacgttattaggaccgtcaggatctgggaagagtaccttgattcgctgcctcaatggcctggaggaataccagcaggggacaatcacttttgaggggaagcagattaatccgaccgagaaaaattggcagcagatccgccaaaagatcgggatggtctttcagagttatgacctatttccaaatttgaccgtcatggacaacatcctacttggacctaccaaggtgcaaaaacaggacaagttcgctgctaaaaaggaaggtctggagttgttggaacgagtcggtctcgaggattatgccaacgcatatccccggcaactgtccggcggccaaaagcagcgggtcgcgattgttcgcgcccttgccttgcatccggattttatgttatttgatgaagtgactgcttcactggatcccgagatggtccgaggaattctcaacatcatccaagacttggctgatgttgatcacatgaccatgatcgtggtgactcatgagatgaactttgcccagcagattgctgacagagtgattttcctggaagatggccatattttggaacaaacaccttcaaaacagtttttcagcgcaccacaaaccaaacgcgcacaagcatttttggatagtatggatttctaatattgaggaggaacaatttcatgaagaaaagatcatttaccagaattatcgctatcgtcagtgtcttcgctgctttattactggtcttaaccggctgcggtaacagcaagaagtcaagttcgcaaagcaataacccaagttccgttcagcaaattaagaaaaacggtacgattagaattgcggtcttcggtgacttacctccttacggttgggtcaacaaagacggcaagcgcgttggttacgacgtaacattagcccaccaggttgctaaagacctcggagttaaagttaagtttgtccaagtcaatgccaacaaccgagttgatgctttgaactccaacaaagttgatctggttctggccaacttcacggtcaccccagaacggaaacaggttatcgattttaccaaaccatacatgaaagtttccgttggtgtggtttcacctaagaacaaggcgatcaccaaggccagccagttgaagggtaagaatgtgattgtgaccaagggaacgactgccgaaaactatttcacgtccaagcagcctgatgttaaactgttaaaatttgattctaagacgcagcagtttaacgccttgaagaacggccgtggggttgcccttgccgatgacaactcatacctgtacgcctggtccaaggataacccaaactacacggttggcatcaagagtatcgggcctaagtcctacattgctccggctgtgaagaagggcaacaaatcacttcttgattggaccaataaggaaattaataagttgaccaaggagagtttctttgtgaaagattacaatacccaattgaagccttacttcggtaaagaagtgaaaccttcagatattgttctgccagttaaataatcattgattaggcagccaaaaaagcttttggctgctttttctaacattaaaaaataattagagttgacgaactgattctaatatgttttaataagttcaacatttcaagaaaggaattatctctatgaatactcaacttcaacaattgaatgcctattattacggctatgcatggtttaagtagcgctcgtcagatgcgggcgcacaacgcgttcgcgtctaacctgggcaaagtcgtaactttgttgctgccagctagacgctagagtctagctggatgggtataatttcttaagcgagtgaataagaaatcagccagctggattctaatatccagctggctttttgtttacttacatacttgggagagtgatatcatgacagaattaatgacaaaatctaataaacgcagattatcaatggccttatacctcaactacctggttcacggcattgggttgattattttaacccagaatatgcaggctttgggtggcttttggaacgtgccgattgcgacggtttcctacgttatttcagggattggaatcgggaaattaattgcttacttcatcttcggttacctctcagaccgttttggccgggaaaagttggtcttaaccgggactctgagctacatggtattctttatcgggattccgtttacccacaatatcgcgattgcctacctgtttgcaattattgccggagtagccaattcggcgctggattcgggaacttacccgacatttgtggaaatgggcggtaattcaagtgcctcgaatgttttcattaaagcatttatgagtgtaggtgaattcatcctaccgctgtttattgctactttggaagctcatcaattatggtttggttggtcattcattggcgccttgctggtgttagtcgtcaacttattcattcttcgcggcgcacacttcccagatcggaaccaggttgacgaagaattcagcgaggagcaccaatcactttccaaagttcggcgagtgattgcgacgattgcccttgcgttgtacggttacacaaccatggcaatcatgattttatttacccaatggattagtctattcgcaaccaacgaccttggttacagttcattgatttcccacggtctgttgtcgctgtacagtatcggttcaatcagtggtgtggtcgtgatgtttatcctgttaaaattgaatttcaccgaaacgaaactgttagtggtgaccaatacaatttcgttaatcgcaattctcacggtgacccacgcctcaacggtcattgtcaccgccgttgcctgcttcgtattcggcttcactgcagcaggtggggtgatgcaaattgccctgaacgttttgttgaaaatgtttccgaagcataagggtgtgattaccggaacttactttacgtttggcagtatcgcaacctttacgattccgattgtgaccggaattttgtcgaaaaccagtcttcaatctgtgatgaattttgatgtgatgattggcttggttggaacggttttagtggtcgtgacggccttggccatcagtactgggaacgtcttcgcccatgccggccagtcgatgatgacccttcttcatatgggaccggcaccagttagtcagggacgctcaaaagacgaatagtatgttaatcaaaaaggaaaccgcaactttgcggtttccttttattgtgtttcaaatcgtttcatttctgttcgcagatcgtcaatcgcaatctgtccgggggctgatgcatcaccaaccgtcgcaaagctcataactgatccaaacaatggcgcggtgattcgagagattcttcccagactgcccatggaaattgcaatgattggaatttccaacttgtctgattcggttgcagtggcccgcatcattgtgaggacgtccttgaatttattgggcatggcagcaatcttggcaatatcagcgttttggttctgcatctgctccaggagattgataatctccagttccggcggggtgccttggaattcatgggcactcaagattaccttgatgttgtgttggtgcgctaagtaaatcaggttactaattgcctcttcgctgaaatgcagctcgacatccaacatgtccgtcaattcattggcaatcaaccgtttatatagggtcacataagctgcttcatcaaggtcggcttcaccgccttcgccagcagttcgaaaggtggttaagagaattgtgtcgcccaaaatttgccgtaatttggcataagtggcttgataaatggcgggatccaaaccagcttgatcatagtcgatgcgccattcaatgacgtccgggtgagcagatactgctgcttgggcctgcgcaagaatatcatcgacggtccgaccggtgatcggcaccgctattttggtggtcccggttacaaatgacgttcggcgaactgttagctttccactcatctcatcaacctctcttttctgtattaaaatcttgtcccaattctaacaagcggtgaccgcaacttcaatctaaaaaagcctcccaaatatcgggaagcttctaatttcagttaaaatccgcggaaatctcctctgccaaagtactgcaggttagccaacaatggtttttgcatcagcgtcggcaaggtcacaaatgtgtagccccgtttcttcagcgatcgaataatctggggaacagcggcaactgacgtcgggtgaatatcatgcattaaaataattgagccaggatgagtcgttgccagaacatgactgacagttttcggtgtatttagatatgcccagtctctggagtcaacgttccaacggacaattggccggtcaaacaagttcccaatccgactgttaacggcgccgtatggtggccggatataggtgggaattgttcccgtggccttataaatcgctgcatcggtcaaggcaatctggtgaattgctttggcactggagagagtggttaaatcaggatggttccaagagtggttaccgatttggttgccatatttgagaaccagccggctgatacttggatagcggataacactgctgccaacctcaaagaaggttgcgtggacgttatagtgctttaaagttttgagtaatttcggcgttagggtcggatccggaccgtcatcaaaggttaaagcaacgactttcttgggtgtttttggtttgacaaagtcatattgcgatggcatgtagcaattgagaataatgccggttaacttactcaatggaatggcgacgtctttgacaccatatgaatttttaaccagatgaatggttaaagccgttttgctcaaggtaaagttatgggctgttaatcgcttgggtaacggcaggtaaatcaagttttgaacctgcttgccggacagcttgtgatcttcagccagttgggcgcgcgtcaattggcggatggtgcccagacggtggagactgttattggtgattttgccataggttaatgtagtcgctgcatgtgcttgtgggactgaatgattgctgatgctgaatgtcaataacgatgcagctgcgatactgaacgttaataatgcgcgtttgttgatcatgatgatcaccccaaattactttcaaattttatttcaatttcattttcacattgcctttgtgggaagtcaatcaaacttatttttgaaattttttcgatgcgattaatccttgatgacacggtgatgtgacaatcaaaacgatcaattcaccagtgttgattttaagaataggtgttgacaatttttccagaattcgttattgtacatgatattagatatcgatgagaaagtgcttagagaaattgaaaagtcggtattaagaaattccaagagagcgtcgttatctgtgaaggcgtaatttcttaatcacttaaagtcaattttgagcacggtggttcgtcaagagtcactagggtgcgcccaatacagcgccaacgtataccgagtcgaccggtcgtacgtgagaggtggaatgattttccacaatgaaggtggtaccgcgcaaaagcgtccttttagaagtttaacttctgattggacgctttttgtgtttcatggacacaagcgcggctgtatggtcatcgatatcaatacaaaattattggaggaattgcgatgtttaaggatattagatttacagccattatcagtgttgtcattgggttcatggctgtcttattaagcggctgtgcgtcgacagcagtcggcggcggtgcaggaagtgccgaaaaagccttaaaaataacaatcccaggggagccattgacgattgacccaaccaagtcgattgaaactaatggcggtgcggttatcgatcaggtcagcgaaggcatttatcgcagggatgcgaataacaaaattgctgccggagtggttgataaagttgtcaaaccaactgataacggcacaaagtacacgtttaatatcaagaaggatgctaaatggcaagatggttcaccaatcaagtcggaagattttgtcaattcgattgaccggcaggctgatccgaaaaccaagtcccagcagacgacatccattcaatacatcgaaaactttgctgctgttaacagcggtaaggccgatccaagtaagctggggattcatgcagttaacgaccgaacatttacggttaaattgaccaagccggtgccattcatgaattatgaatttacgaacttctatccgattcaaacggcggccattaaaaaatatggcagtcattacggcactaattcagagacgactgtggccaatggtgcctacaccatcactggctggaacggtagcaatgattcctggaaatatgaaaagaataagaactattgggatgccaaaaacgtcaaaattccagaagttgatgtgacagttgttaaagacaataacaccgcgcaaaacatgtttaacggcggacaaattgatttgaccagcttgactggacaatacgttaaacaaaataagaacaacaaaaatttggtggtaactgaaacaggccgaaacaattacatttacttcaatgataagaagaaagccacttccaatgaaaacttgagaaaggccatcagcatggtcatcgatcaggatcaattggcaaaggatgtcctccaagatggctcgattggcgcaaacaacatcgtcccaaagaattacgccaaggatccgaaaaccggtgaggatttcacctcggaaatgggcgatcaagcaccaactgataccactaaggccaagcaatattgggcaaaggctcaaaaagaaattggcaaagacaagatttcccttgatttcctggtggatgatactgacacagaaaagaaactcgcagaatatgttcaaggagccgtttcagacaatctgaagggcctgaccatcaatattgaatccgttccgcatgccacccatgtaacgcgtgatttctcaactgatttcgatatttgtacggttggctggggacctgactatccggatgcccaaaacttcttggacggtatgcgcagcaataacaccattaacttctcgaaattcaaagatcaacagtatgatgacttgatgaataaagtggatgacacaactaagtacgatgccaaccagcgttgggactttgaaaagcaggcagataagcgcttgatgtcaatcgccgcggtagcgccaacgtatcaagcatcgcaggcccatttgatcagcagcaaggtcggcggtttgaagtgggatgcaatgtcgggccagtccgggaagttgcagtatgcgtattggaagtagagagagcgcgacgagacccgggtggtcccggagtgtaagacgaaaattttaatgatgaacggtctttgttcatcgttgaaatttttgacttacacggtagggaccagggtcgtcggagcgtattttcaaagccgaagggagcacacaagaagctaacaaacgtgcatttcgcctgaaatctgggcgactaactgacaaatggaagttagcgcttgggtcgtcggagcgtattttcaaagccgaagggagcacgcaagaagctaacaaacgtgcttttgccccaaaactcacagcttggctaatctaaccccatctccacaaaagtaaaaagaaatctccaaccaaaaaatcccacttaaggaggcggttgccatggcatatcagttaacgaaatctaaagatgtcccatctcagttagtctgcaaccaagcattttacatcgaaaggaagatttattatgacaaaaatcaattatacgaatgttgcaatttacaaccatgagaagcagaactttatcgctaaccaacacatggtcgtcgatacggataccggcaagattgttgaagttggcaatggcagttccacaaaccaagttgtcgatgaagtttccgatatgcacggcaggtacgtgatgccgggaatcatgaacgctcatacccatatcaccagtattccaacctattggtggaacgatggcaaagagcagcgccattccgattcacgggaatttaataccatgtttgccgtgagaaatatggcggatgcaatcgatcacgggattacttacattagaaatgttggtgcggcttttgacattgatatcgaagtcaaaaaaatgcaggaaaaaggctggatcagagggccgaaggtgatgacttccggcaaggcattttcaattaccggcggtcatggatccggtggcggttatgaagttgacggcgttgacgaggttcgtaaaggcgttcgccaagctatgaagaatggtgtcgacaacattaaaatgatggtgactggtggcgtccttaaaaatggggaaacgcctgatgatatccagttcacgcctgaagaggccagaacagcagtcgtcgaagcccaccacaaggggaagactgctgcagctcatgcccaagggaacgctggtgttaaagaggcagttgcagccgggtttgataccgtcgagcacgcatttgatatcgatgatgagacgatcgcaatgatgaaagaacacggcacggtggtggttccaaccatgaacgcgatgtacgccatctacaaatatggaaaagacacggttcctgattgggctcgcaaaaaggtgattgtcaacatcaagaagcattttgccagcatcaccaaagctgttcagtccgggattccgatcgcaatgggtactgatgccgggacgccatataatggcttcagaaacgaaagtgcctacgagatggaattatatgttgagaaggcgggcatgacccctgctcaagcgatcgattcggccactatcaattgtgccagagccatgcacgttgatgatgagtacggccaaattgttgccggcaactacgccgattttatttctatggcagaaaatcccattaatgatattagtgtcattcagcacgacaaagacgtctatcaaaacggcacccgcgtccacaaacaggctgtcctcactgccactgagcggcaatcagccccaagtaaagtcagtgctgctatctaaaagtggcatcatctgctggaattaaaatccaatgagtgaatgattagggttgacgaataatttctaatatgttttaattaatacaacttttacgagaggaattgataaccatgacaaagcaattcactgaaacttcagcctattattttgactatgcctactttaagtagtgtccgcttcggggcggacgcaaatttgagcgttcgcgtccaagtggtgcagagtcaatgctttgttgagcccactagacgtaatagtctggctgggtgagttatcattctttacgaatttagtaaaccagctggataccatatctagctggtttttttaatggcaattaggggtgttaatcatgacaaataaaattgaaacagcaactgagagtgataatcaggcaattcgggcggcccgtgaacagatcaaccaactggatcaagggattgttgacctgctgaagcagcgatttcagacgtcggcactgatcggtatgattaaggaaaatgctcaacttccggtgcttgacggggatcgcgaaaaacaggttttggatcaggttgctcaactggactcggatcctggtacccgcaagtatctgcaaaagatattccaagaaattttgaagaactcacgtgattaccaacatgaattaatgcaaaaggagactaaatgatgaattacttaacagctggagaatctcacggcccacaattgaccggtatcattgaaggcattccttcggggctgcatttggatgttgatgcgattaacgaccaactcaagaaacggcaaggcggctacggtcggggcaatcgccaaaaaattgaacatgatgaagtcaccattaccggcggggttcgccacggaattaccctcggttcgccgattgccctagtggtgaataatcgtgatcatgcccattggagtcaaatcatggatccggttagccccgaaacgccggagaacacattgagaaaagttgaacgtcctcgtcccggccacgctgatttggtcggcgggataaaatatcgtcacggggatctgcgaaacgtcttggagcgctcgtcagctcgggaaacggcaatccgggtggcaatcggtgccgtctgcaagcaatttttacaacagttgggaattgatattgttggttatgttgaacagattggccaaatttccaccgatgaaaatcctgaacttaatgtggctaaaattgaagcagaaattagtcaaaacgacttgcgaatcattgatcagaccaaggttagcccgattcatgatctgattgatcaaactaaacgtgacggtgacaccctgggtgggattatccgcgtggttgccaccaacgtgccggctggactggggagttacatcagctgggataccaaattagatggcaagttggctgctgccgtgatgggcgtcaatgccatgaaaggcgttgaaatcggcgatggcttcaaggctgcgaccagcttcggcagtcaagtgatggatgaaattgattggaatcaggaccagggattcttcaggaataccgatcatctcggtggctttgaaggcgggatgactaacggaatgccaatcatcgttaaagcggcaatgaagccaatcccaaccttgtacaaaccactgcaaagcgttgacatccagaccaaagaggttaagaaagccaatgtggagcgatcggacacaacggcaattgttccagcatcaatcgtcatcgaaagtgtggttgccattgaattggctaaggctctcaccgataaatttgatggtgacaatttacaacgactacaagaacagcttgaccaatatcgcgatgaactgaaaaaattctaggaggtttctatggaaaaagttaaaacgcaatcaactaaacagctccaaggaagtctccaaaacggccttcaaggtgaattggccgtccccggcgacaagagtatttcccatcgaggcattatgtttggcgccattagtgaagggacaacgattttgcaccattttctaactgcagaagattgcctttccacgcttaaggcgtttcaacaacttggtgtgccgatcacccgagatggggacacagtcacgattcaaggcgttggtctccacggactccaccaggcggaacaaccgcttgatatgggcaattccggtacgaccacacggttgatcatggggctgcttgccggccaaaactttccaagtgaattaaccggtgacgcttcgttatccaggcggccaatgcgacgggtgagtgaacccttggcagagatgggggctaacattgaggtgaccgatggccatcttcctgctgtgattaacggggaacaattacacggagtcgactatcacctgaaagtggccagtgcccaagtcaaaagtgccctcattttggcggctctgcaagccgatgggatctcgatcctagttgagaagcagccgaccagaaatcacacggaaaagatgctgcgggcatttggggctgagattgaaactgaatcggatgacgtgacgattaccgtctatcctgaaccccacatgaaagggattaccctgaatgttcctggtgacatgtcgtcggcagcgtttttcatggttgccgccagcttagtgccaggttccaaagttaccttgagaaatgttggcatgaacgacaccagaaccggtctatattcaattttgaaacgaatgggcggcaggatcagcctatcaaacgaacaaagtacgggcgaaccgacagcggatttgacggtggaagctgccgagttaaaaccaatcgaaattggggcggatgaaattccagcagtgattgatgagttgccattagtcgcgttactggcagccaaggccaacgggatcagtaaaattactggtgccggggagctgcgggtcaaagaaaccgaccggatttcagccatcgtcactgaattccggaagctgggaattgatattcaagaactcgatgacggcttcatcattgacggcagaaaaccatggcaggttttggattcgaaattagacagtcatggggatcaccggattggcatggtgatggcagtggcagcgctgctggttgatcagccgttaactctcaccggtgcagacagtattaacatttcttatccggagttctttgatgatttggcaactttgattgagaggtgaccgttgatgacaaccgttttgattagtgggctggggctgattggcagttcaattgcccgaattatcaagaatggggatacaactgttgagatcatcggcagtgatcccgatgatgattccgcccagtttttgttggatcatcaaataatcgatcagcgagctgacttcgcccaggcagccacacaagcagacttgattattctggcgggtccggtatcggttattttgaggcagattgatgagttggcccaattaaaattaaaggagcaggtcttggtgacagatgtcggcagtaccaagcaatcgattatgacagaagccaagcgcctgacgcataagggagttgcttttctcggtggccatcccatggctggttcacatttgaccggtagccggaacggctcaattgatttatttaacggttcaaaatacttcctggtaaccagttcacaaaccaaacagcaacttcgcgactttgaacagctgctggattcggcaaatgttgattggacggagataacagcggaaacccatgacaaactggttagcgaactgagccatctgcctcatgtggttgcggcaaccctggttaacagcgtcgcggacggcttggcccatgatccagtgggcttaaaagcggctgccggcggcttcaagagtatgactcgaattgctgcgtcggatccaaaaatgtggacggcgattatgatgagcaattcccaagcgattgcgcaggaattggccacttttcaaaccgcgttaagtcattttgaagaagcgattcaagaccaagacgaagctgcgatttatgccgctttcgccaaagcagaacaaatcagaaagtccttggacgattaaggagaaagcctatgaaactcatattggttggatttatgggaagcggcaaaaccaccgtcggcaacttattggcacagaaactcggcttgccatatcacgatctggatgatgtcatcgtggaaacggccggcaagtcaattaaacaaatatttgccgatgacggagagccggcgtttcggcagctggaacatgatgctttgaaagcgtctttggcagatgatgggatcttgggaaccggtggcggcacgccgattcaagctgccaattttgagctgttaaaggccagtgacgtcccagtcgtgcttctagacgtgatgccggaaacaatcattgcccgattgaagaatgataccgaccggccgctagctcaacagcttggcctgcatgggttggtggatttgaaaggtcaacgggacactttataccaacaggtgagtgattttcgaatcgccaccgatgatttgacgccccttgaagtcgttgacgccattagccaagaggggtttttgaagatgtcgtttgggaggaattaaaatgatcgatggacacacaaaattatttggcttattagcccatccggctgctcacagcttgtcaccgttgattcacaataccagtttccaagtgacagggatcaacgggatctatttggcctttgacgtgacgtctgccgggctcgccgacagcttggcggcgatgcgggcgatgcacattggcggttttaatttatcaatgccgctcaagaccgacgttctgccgttacttgacgaaattaccccgcgagctgagcgcctatctgccgttaatacggtcattaaccgcgatggtcgattgattggtgacagtacggatggtcagggatgggtagatgctctcaagcaggatgatattaccatcgatgaaaaggtcgtgaccgttttaggtgccggtggtgccgggcgggcgattatttccgctgccgttgatgctggtgcaaagcaagtatacgtttttaagcggactaacgatctgtttgatgccagaaaagaacagctggaaggctggtcggatgtcgtcactgtcctgccttatgaggatgaaggtctaattgccgaagcgtttgatgaaagccaaattattgccaatgcgaccaacgttgggatggccggcgatcaatcgctgccagttagtcagtccgtgatgaaccatttgacaccacgacatattgtgtccgacgccatttactttccactcgaaacaccgttcattcatgcagctaagcaacgcgggagtcgtacatataatgggattgggatgctggtgaatcaagcggccggttcttttttggagtggacaggacagcgaatgccgattattccagtgattgaagccgttcatcaggccgtcttacaacggtcgaagaattaaggggctaaatgaccgacaagcattctgttttcggttatacttaatgaagtgtcaaaattaaatattagataacattaggggagccaatcggctgagacggaacatcttcggacccttcgaacctgatctggtttgcgccagcgtagggaagtgttaaaagaagccaaaagcctccttttgttatctaacgaaaggaggctttttatgcaaagaaatacgacttataaaatggtgctaacggcgattctatctgcgatcggcgtggtcggcggcagtatgtttgagttcactgtcggcgttgccaaagtggccccgatgcagcatttgatcaacttgatttccggtgtcctggttggtccatggtgggcagtcacccaggcatttatcacttcattaattcgtaatttattgggaaccggaactatcctggcatttccaggcagtatgatcggtgcgttctgtgtcggctggcttttccagaaaaccaatcgactgattattgcggcatttggtgaattgatcggtactggcatcattggtgcaatcgttgcttatccgattgccagttggatgatgggaaccaccggtgcgatttacctgttcattcccagtttcttcttgagtgccttggtcggtgttatctttggctatatcattctcaagagtatttggaaacggatcattgtaccgcaacaggacaaattggggattggccgcaagactaatcgggattaaacgtttcccggtagtggaatttgccagggatgatatttctgacgtgccaatcccgtgggaacttgacgagggtctcggcgtgcaggactgctgcgtaccccaattcaactttgggcagccaaatgctggtgagcgatggtgtcaggtatgaagcaaattccaggtcatcaaaactgataattttgacgttttttccaggaaccacgtggtgtttggctaagcccttcatcaccccaattgagagtgggtcggaggcgaccagcaggccgtcgagctgattgccatattcattcagcaggtcatcagtggcatccattgattgcttggtagtccagtccgtcaatttcacgattggctgatgatggttgatcgaacaccatgttttataggtgagggtccgtgcgtcatcaatgatacgaccctggctgccgtccaaattcacttcatgacgggaaccgccgataaaaccaattgtttgggcatgcggtgtcatttcgttcaaggctttatccgttagctgagctaaattcgtatcaaccgtatcgacaacgtcatcgacatcactgccgccatcaaccagaacgacgttgggattaaatgatttaatggcgttgatggcggatttggaaagactgccaacaatgatgacggcatcgtaagccgcaaaatcgtttggctcaacgccttcatccaacctgaccacccgcttgatactgatattctgagatttagcagcttcatagacccctctacggacaaaccgccagtactcatcacgcgtttcttctttcagactgagggtagtgatcagcgcaaagttcaactgatttttgtccggtttgggggctagggagtatttataacccagcttatcagcaacttctctcactttgtcgcgcgtttcttttgccacatattcgcttttatccggactcagcgcgcgcgagacggtcccgggtgagacctgcgccagtcgggaaatgtctttgattgtcgccatccatcttcactcctcaattgaattgtattacctctagttaaacacaattaaatgttttaataaatctttggtttgttttaataaaatttattgacaatttaactgtaaacgtttacattctagatagcaattattttttaaaatttatttttatgggggattaatttatggcaagtaataccaacattactactggtcgtagaatcacatctcgattatcgtactcatttggtgcgttcggtcatgatatgttctacgcaacgctgtcgacctactttattatgtttgtcacctctcacttgtttgataaaagtgccggtggacaaaatgatcgaatgatcttttggatcaccacgattatttcactgttacgatttgttgaattagccattgatccatttattggaaacacgattgataataccgaaaccaagtggggccattttaaaccttggatcctcgctggtgggacggttggttccattacattagctattttattcactaacatgggtggtttgaaccaatccaacccattgttgtacctgttaatctttggtgttttgtacatcaccatggatatcttctattcatttaaagacgttggtttctggtcaatgattccagcgatctcatttgattctgcagaacgtgaaaaaacggcgacgtttgcccgggttggttccaacattggtgccaacattgttggggttatcgtaatgccgctggttgtgttcttctcaatcaatgccaaccatggtcaaggtgacctgcgaggctggttcatgtttggtgccatcattggtttgatttcctggctgtcagctgttgttgttgccatgggaaccaaggaaaacgattcattattgcgtaagaatgctgaaaagacccggatgcgtgatgtgttcaaagtgttagcccgtaacgaccagttaatgtggttatcattgacttatggtctgtacacctcaggaattgccattaccaactcacttgaactttactacttcacttatatcatgggtaaaccaggcgaattctctgtgttggcttcattgaacatggtaatcggaattatttcagtgttactgttcccaccgttggcacagaaatacagccgtcggaacgttttcttcctatctattagcattatgatcgtttcaatcatcttattcacatttgccggcacatcattaccactggttctgctcgccgcaattctcttctatattccacaaccactgattttcttggttgttttgatgatcttgagtgattcagttgaatatggccagttaaaatttgggcaccgtgatgaatcattaaccttagctgttcgtccactgcttgataaactaggtggggcactttccaactgggttgttgggattgctgccgttcttgcaggaatgactgctggtgcgactgccagcgacattacaactcatggacaaattattttcaagctgttcatgttcggtattcctgccttactgattttgagtggaaccttcatcttctttaagaaagtaaccttggatgaaaaagaacatgccaagattgttgatgaacttgaaaagacttggaacgagcatttggaaactaacggagaggaatcaatggccgacatcgttaaagaagttgccaaagatacgacctataaagcgccgattagtggaacaatgattgccctttcagatgtgtccgatcaaaactttgcctctgggaacatgggtaaaggatttgccatcaaaccatctgatggtaaggtctttgcaccatttgacggaacggttgaagcaaccttcccaacccgtcatgccatcggacttcgttcagataacggtatcctgacactgattcatattggaatcggcaccgttgaaatgcgtggaaccggatttgttcaatacgttcaaaagggtcagcacgttactgaaggccaagaattgcttgaattctgggacccagcaattaagaaggccggctatgatgacacagttatggtggttatcaataactggaaagatatcaaagacttcaactacacagttgagtccggggatgttaaccacggtgatgatttactgacattgtccaaacctgaagaatcatcagacgatagtgatcagaagtaacgcttaacaaaaactgaaaagggattgataaacgtggcaattagaattgaagatcagaatctgctgtttcatttacagacggaccataccagctatatttttcacgtgatggaaaatggtgaactcggccagatctattatggcaaacgggttcactcaaagccttcatacgataatttggcaactagagagtggcataatgccgccgctgtttggcgacttgaccataaggatgtccagccgcaggttcttaaacaagagtatgccagcttggggaagggtgatttccgttacccagcctaccaagtcgcgcaagcaaatggcagccgcattactgaatttaagtatgagagttacgagttggtggacggtaaacaacgcttggccgggctgccatcggcatttgatgatacggatgacgacgcccagacgttgacgattgcactacgggataaattgttgggattagtgatgcatttgaactacacgatttttccccatcaagatgtcattatccgcagtgcagagttccagaatcagggcaatgaaaagctcaggttaaattcggcagccagcgctcagcttgatttaccagacgccgactacgatttcatccaattctctggtgcctgggcccgcgaacgccatatgattcgaacacatttacgttccggtgttcaaagtgttggcagcctccgcggtacttccagtcatcaacaaaatccctttgtgatgctggcacgtccgaatactgatgatgcacagggttcagtctttggttttaatctgatttattctgggaacttttccgaccaggttcaagttgatcagtatgatgccagccgggttcttgtggggatcaacccagaagaattcgcttggaatctgaagccgggcgacaaattccagactcccgaagccgttctcagttatacggatgccgggatgaaccagttaagccagcaaatgggcgccttctaccaagatcacctggttaacccacgatttgcccacgagcagcggccaacgttgattaataattgggaagctaccttcatggactttgatgaagacaagttattaagcttcgcaaccaccgccaagaagctgggactggaaatgtttgtcctggatgacggctggtttggtcaccgaaacaatgacgacagctcattaggtgattggtttgtcaacgagccgaagttcccgagtgggtttggcacgtttacccaaaagattcatgacttgggattgaagtttggcctgtggtttgagccggaaatgatttcaatcgatagtgaattgtataagcaacatcccgattggttaatcaatgcacccggacgccacgcatctccagagcgccagcagttcgtgctcgatatgactcggtccgaagtcgtcgactatctcttcgatgccatgagcaagatcattgagatgaccaagctggattatatcaaatgggatatgaaccgcaatattaccgagacttacagcagtcagctcagtgctgacgaccaattagaagtgccgcaccgatacattctcggcgtgtaccagctctatgatcgtttggtcaaagcttatccggatgtcctgtttgaatcatgctcgtctggtggcggtcgcttcgacttggggatgatgtactatgctcctcaagcttggaccagtgatgacaccgatgcagttgagcggatgctgattcaatttggcacatcttatggttacccgcaaacgatgatgggcgcccatgtctcagccgtgccaaatgatcaagtcggccggatcacttctttgaagacccgtgccaatgtggcctacttcggtgattttggctatgagctggatatcaccaagatgtctccagaagaacagcagcaggtcaaagaacagactgccttctacaaggaacaccgccaactcttccagtttggaaaattctatcgaatcgataacccatttgccaatggcggtaatgtcatgagctgggaagtcgtcagcgatgatcaacagcacgcaatcgctgcgcgttaccaaattttgaatcgaccaaacaccggttacatccgcttgtatctcaaaggactcgaccctgacaccaagtacacggttaatggtggcagcgaacagttctacggcgatgagttgatgaacgctggattgtttgtaagtgacattctccatgaaacgcacggaactgatcagtcagcggactttaattcaaagctgtttgtgattgatgccgtcaaataatcaattgaataaccaaaaagtgccagctggaaaactgatgatcatcagtttctaactggcacttttatgtttttaaagttattcccaaacatccaacttatgcgacttgaagtaatattccttatcatgatcgttaatcggccgggcgacccgacatggattaccataggcgacgacattatccgggatatctttggtcaccacgctgccggcaccgatgacggtattgctgccaatggtgactcctggtaagatttggacaccggagccgatccagacgttatcttttaaagtgattgggaaattatattggtaactattttgcctcagaatcggcaagaccggatgcccagcagtggtcatcaccacgttggggccgatcatacaatgattgccaatggtgatatcatcatcgtccaccaaggttaagttgaaattgatgtacacatcgctgcctaaatgaaggtggtgagcgccccagttagcgtgcatgggcggttcaatgtagcagttttcgccaacttccgcgcacatttcagccagtaactgactgcgtttgtcagtttctcttggggatgtcatgttaaatgaatacaatttctccaggtattcctgttgtcggtccatcaattccggaacgtccgggtgatacagcagatgtttggcttttcgctcgagattattcatggtggaatccctcctttaatgattcaagcttatcatttttggccatatgacaggggagatgtgtcgaagatatttttgtacagttcggcggttttgaaattcttactttcttattctggtataaaagttgtagtatagaaagagtgacttttataagaaagaggagaatatcttgtctaaacgcgatatcatgattgtgacttgtgcactattgctgtcaaacgcaatgagtggactggacaacacaaccatcaatactgctttaccagcaattatatccgatctccacggaattgaattaatggggtggatcgtcgccgttttcctgttgggaaccgcggtcagtacacctttatggagtaaattgggggaacacattggcaacaagcgcagctaccagttagcagccaccttatttgtggttggctcatttctacaagggatggcgccaaatattgtcttcttgattctcgcccgaaccttgatggggattggcaatgggggaacggtttcgctgccatacattatctatgccagaatgtacaagaatccccgcaaacgaatgcaggtgttgggatttgtttctgctagttatagcatggccacgattatcggcccactagtgggtggttatatcgttgatacatttagttggcactgggtcttttatctgaacgtgccgattggcctgatctcaattgtcttggtccaaatctattataaagtcagtcatgaaacccggcagacccaagcagttgactatcggggagccatcatgatgaccattggattggtcggtttgcttgccggaattgaaatgatcggtaatgccaacttaattttggtactggccgtgattggattttccattattgtcctgattgtcatggggattttggaagaaaacgttgatgatccgattattccaagtcgattgttcaaaaacctgccgttgatgattgactttgttctgttcacattaatctggggagcgtttattgcctttctgatttatagtccaatgtgggcgcaagggttattggcaacctcggccctgattggtggtgccacgcaaattcccggtgcctttaccgattttatcgggtcggaagtcgttgcccccatccggaactttttgtctccgcaacgggtgatcgccatggggatcgttatgttaatgatttcctttatcatcatggtgatctccggggttcaaacgccttactgggtactgttgatcgccggtgcctttgaaggattcggcaacggtgcctgctttaatgaactccaggttaaagtccagcaggatgccaacccgacggatatcccaattgcgacttcgtttagtttcttgattcggatgctcagtcagacattcacggcttcaatctttggaatcattatgaacaatgctttacgtgacggtgtcagtaaggctggcggttcgatttccatgaaaatgatgaacgaattaagcgatgcctccagtagcggttccttgccgctgcacttactgccgcaaatgagattgattttgtataatggtcttcacaacattatgtggctgtcgttgattttgatgattgtttccctgcttattaacatttgggcacagaaattggaacatgataaatttgttaaacgggctgccaaagcatcataaaaagtctccatcaaaaaccaatttgaaaactggttttcgatgaagactttttttattgtgactatttcttagcagtcaatgacgtatctttaaaggttgatagtgaaacatttgcggttgccaagctattgccggtaaccgtttcggccttgaagctgacccgatcgccttcagcgatgaactgcagcaatgggttgaagttcttggcgctggtatcaatcttataaacttgattgttgttcttcaaaatgaacagtaaactgttatccgttcgaacaactcggttgatggttccgctcacggtcttaccggctggaaccgatgctgcaaccccggtctttgcttcgactcgttgttcgaagattgccaaggtgctttgggcatcgtcgccaattgcgtaagtgccgctttggttattaccatcggccaggagataaacgtatttcataaatgagttattatcccgatcaagcatggagacaacccaagtgggatccccattgattcggtacagtaacggtaatgttccgcgataattctggggattgatatcctgttgcgcgtaagagattgcccgctcaggtgtcataacgttaccatgctcacggtagtaatgcagggtgttggtccgtgcatcaacgaaagtatatccaagaatggaactctgatgttcgttgacactggtcataccggtgaagtaatagacacgacctttgtaagcgtaaggcgtcaacttgtcgccgccttcagttccggcggtagttggcttcataacgccactgtggccaccaaagctggtagcgttccagaagccgtgccgataacggccaaacattgagacttcctgactgacaaattcaggggtgaccgcaatatcaacgaacttcggcacctgcttaggtgagtagactttcactttaccggtaatcgtgttcagaacggcgactttatagtgtttaaagtcataattccggttcaagtatgaaattggtttggcaagtgttcgaacatagtaaggcgtgccgttatcgtcaatttccaattgagccgttgcgccaaccattgagtagcccaaactgtgggcactgatccgccggtcggcatcgttattgaaataggcacttggggtgtatttcatcggcttggcgacaaattttggatcggcattcttgtcggtagcgttggttctaaagtaaccaggcacttttaagtaatgaagataacgccagaaaccaccggagaattcgacaggggcaacataaatcatcttgcccttatacatctgaacccgcatgtgattcaaatcataaacgttggagttcttaaaactattcaatgagttattcatatcggtcgaaatcgtttgtggtgcgtttaccacaggcgtttcggcactgttcttgatcacgggcattggcgcgttcttggtatcatcgttcatatccgtttggattgattgaacggctggtcgtggattcatcttggtgaccagggatgtaatgctacctaggatgatgaagacgatcaccgcaagaacggcgaccatggcaattttacccaaccagccaaatgcgccggtgaatcgctgaacaatttggccaacaatcccgtcgccggcttccgttgttcgagcaacagcagcgtgtggtgaatacaggaagcggcggagcgcagcgaccacaatcattccgaagatgaaccacatcaaccatccatcgatcaaagacggatacgcaagatccggcaggttgaagtaggtgttaatgtaactgacgatgaacaatagcacaatggctagcgttccgtacgttcgaccccggcggtctgcgataaccagcagccagataaatggaattaacaaacctgacagcttaaccagggtgatgagtgcaaaataactaagcatgaaatttctcccttcaatactgttaacgagtttgagtattaagactattataccttactcaagaggcaacacctaaccgctttcaaacggttaattcaggtacccgcttgcaccacaggatcacaaatgcgttcgagccgatgtgagttccaaccaccggtccgatctggccaacttgaaaactggctttgggatatttgggcttcagggatgcacaccatttttgaacagctggcaggttattggtgccggtgaccatcacgtgaagcggataagcgacttgctgatactgggtgttgaattcttcatccaagtgcttcagggccttcttcatcgtccgaatctttccaattgcttcgatttgatgctggtcgttcaaagttaatagcggtttaactctcagtaagccacctgcaaatgcggcggcgttggtgagccgcccgccggtaactaagttcttgaggtcatcgacgacaaaatattcatcgatagttgcccggacatcatccagattttggagaattgtgctcattgattcgccttgattggccatcattgaagcgtatttcacaagatatcccaacggttcaatcgtgatgtgtgaatcatagacttcaacctgggcgttggtatagccccggactacagtgcgcagattgttgacaaagcccgtgatgccagcagtcaaatgaatacttagaatttggtcatagccttgattggccagctgatcatacacttttaacatttccatcggtgtcggcggtgcagttgtgggcaactttttggccttcgccagtgcggaatagaattcatcattggtaatatcaattccctcacgataggtggtaccgttcatgttaacgacgatcggaacgacagtcacgttgccaagccgttggacttcttcatcagaaaggctggccgtgctgtcggttacgattgcgattttactcattgtttcatctcccgatcttagtgatgttaaattgattatagcatacactccagcatgccatgccgcatctgagggtacggtaagccaggaaccgtaaagtttgatgaattatgaaaggattctcatcaaaatagcaaatcaatatgagaagattacccagccaccaaaatttcaattgccgatcgttcatcattttactgatcatattgtctatcgctcattaagcaatgcccttaaggattgcgaccgcttacttcaaaagcggtctatgtacacaaatggcgcccaacaatttcttttctaaaatgggtgttgacatctccacgtaatgatgtttaaatgatagcaatttcatttttatcattattttctcacgcaattataattatagaaaaaagcgaggtaatgccaatggatacagaagcaaataagccagttgataaactgacagtcaaagattacgtatacttagtttcagcaggggtttcaaacgccgtcctagtgatgttaggggtcggattattaacccagaccattgccaacttcgtgaattggccacaattacatcaagtcggggcaattgcccaatggttactggcacctgcatttggtgccgctgttgcatctcaattaaaaaccaacacactggtcctgtttagttccatgattgcctcaactgttggtgccaacgccgtttatttcatttcatccggcgttcacgcagcaaccgccactggtaaccagatggcacaagcagccggaaccggtgtcttcacaactggtcaacctattagtgccgttgccgccgggttaatcgctgccttagttggtaagtatttaaccggtaaaacgccacttgatatgatgttagtaccacttgcctcaaccttagttggttcaatcgccggcttgggacttgcaagtgtcaccacgccagcccttaactggttgagtgcttttatcgctcaatcaatgcaggttaacccaatcctcggttcaatggccgttgctttggcatggtcactcttcttgatgacaccggcatcctcagctgcccttgcagttgccgttatgcttgatccactttcatcaggtgccgcactcattggaacgaccgctcaattcgttggcttcacggtcatctcatggcgtcaaaacaaccttggtgccaacattgcccaaggcttcatcacaccaaaggttcagttcccgaacttgttggccaacccacggctcgcaattccttcaatgactgccgctgtggtggccgctccgattgcgacaatgttcttcggcttcaaggtgccttacacattaggcggcctgggattaaactcatttatcgccccacttaacctggcatcaaccaacatgaacatgttcgttgcatacctggcaatgggaatcgttgttccagccgtgatctcaatcgtgctttacagagttcttctcggcatgcactgggttaaggatcaacaactgcatcttgaaattgtttaagctattactacctatattactaatataaaatcaataacaaatagaagccccggagctggattgctctggggcttctattttgttgatcatactgattatgtttagtgaacgattgctgttactttggaaactgaggtagctgtgtaatgctggtaatgagcagcgggatactttggctccccatttatacctgtgattttataaccaatcttgacagtcttccaattcttttcaggtgtaatgaagacccaaatagcttttgacaggtcattgttttccgattttttaacaaatttgtgaaggaaggtatttaaaatatttttttgatttcgctgttatatcgcatatatagaagaaaaaatctaacaaaattcaacatgccgttacccattgaacaaagctattgtaatatattcgtaaagtgctataaccagaaatgggtacgagaaatgttacccaggtaaaacaaattatttggggggattaagaatgaaagccaataagtttgcaaaaacaatgttgttagcgttttccataacgggagttttgctggggggagcggttggtgcacatgcggccactgccggcacaaatagtcaaccgattgctcaaacctcagttgtgtcggctgcacagggggcatggaaaccagtatactcaagtatgcttggtaaaccttataagcataaggtaatcaaatatagtcccactggatggggagatttcgaaggtggagatcgaaaagcttactttagttcagataagcatattcagtatcggtacattaaaaagtcgcgaactatgatttatcggtataacaatcatgataaagcgcttaggtctaagtacaattatcaaaagattgtgctgcgtcatggccataagacacctgaatattcgtactactataagttgggtaagcagaaatgggtttacacagtgacatataagttctggttggtcaaaccggttaaatactaatcaggttagtcgcattcgagattgttggattgtggatgagtattattcacaatcatccattaaatgaaaggtcgatgatgaacttgttaggtaccagacaacatcagattactttaaagcggttgttaatgttagcattcttttctctattggttttagtccctacctcagcgtctgccagtaccaactggaaacacttggatatgaattcattaggaactgccacaaagatgaaagttcttaaatacaattcacttaattggggtgagtattatgatgatcagagtgatttgtttaaagatactaagcatgtgcagtataagtacgccaaacgcacccgaacgctcatcatgcggtatcggaatccccagcagtttcttttaaaaactaagtataattatcggaagctgatttatcgacatggtcataaaaatccaattgtgacccattactttaaagtgggacacgaaaagtggaaatttgcaacgaccattcattattggctaaagaagccaatccgatattagttatcaacggaacctcgaagctgatacttcagggctttcgttgctatgttttacctttcagtatcgttttaattatgtccccaaattgcttaattttaaacaatttggggacataattaaaatagcttgtctttaagaatcggtggcgtagctatttaaatctaacctgacgtgtgaatatccactgatttttaggaaattgggtgataatacaaaagcaccaactatattgaaatagttagcgctcgcctgtgatttaattcaactcagtgagatgcattggcttaagacattaatcaaaaaagccaaaaatatctttaacggcagtcatagcttgtgctaattctgccgcattgacatgatcaacaatcttgccggatccggcgatgtagtcataacccaaaagaccggttaaaataacatggccttctatcttatgagaagaaagtgtaatctgaaaaggtgccttaattttagttgcatgggtaattggaaagccgataatcatacctgtccgttgattatatgctttatcactgacaaccagtaacggtctaaaagtattactgggatctggattatggccaccatattcaaggcctgcatgtggttcactatcaatccagatgagatctccttgctgcgggatgtctttagtcattccaaatatcctctcgtccaaccggcgtgccattgtccccaatgttttcttcttccattgcttttcgaagatcgtagttcgagtctgcactataaatgttgtgtcgaactggtaacaaactgatcacgccgttttcatccttgattggttcaaactcaacgttttcccctatgttaaacgaagcaggaattgtcaccataattgaattgccttgacgccgcgtttttacagtcattattatcaccctttctacacgtaattatatatgtaattacatttaagctcaagcaatttgtattgattaaaattagaacgatctatttgttttgtacgttgaaaacatagactgggaggcttacacttataagcatgcgaagtacctataataggaagaaaagatgaaagtaatcaagagcatcttcagctggatcctgccaatcgcaattggattggcactggcgttactactcaaagcctatattatttcaccagtcagagtggatggtgattcgatgatgcccaacctgcagaacaacgagcacgtggtcattttaaaagccaagcccatcaaacgcttgtcagtggtggtgtttaatgcttacaaattggcaccggatacgcaaccgaacactgaatttgtcaaacgggtcattggcattccgggtgacaggattacctatactaagacggggcatttatatgtgaatggtaagtacatcaagcagccgttcatctcccgtcagcagcagaccactggtactttgagcaacgtcgacgataatggttttaatttatcgattctttccaagaagtggcgcagaggtggacagactgccgtggttcccaggggtcagtattttgtgatgggtgataatcggaatatttcctatgacagccgttactggggatttgtgccaaagtcgcatatggaaggggttgtttatacgttcccgtgggatgccaatcgtcaggaaattaataactatggataaaacaatgtccttcaccagttttagatctggtgaaggacatttttaggttctacaatacctgttcgcaattaaattgtaaccgtaacgttttcagtgatctggcgaatagatggcgttctaaaaaaattctttgagaacgcctgaaatagtttggattggattgaagtcaatatttgaaatatattttaagatccttgaccaagaacccatttgaattacttaccatttaattcacgaacctgatcaattaagccaagaaactcattagctgcctggcggtaatcctcaatcttatccccgtatttctcattaaagccttccaaaccaccggcaacaaatgcatattcataatcatatactttgtcataggctgccgtgaattttgtcagcaggtcgtgatgcttgccatctagttgcaaggccatttgaacgacccgaacatcggtgtagccaagttcaaactgaattgcccacgcccgaatgaagtcgtgctgcgcctcaatgtgggcaaagtggtgctgggtgttccaagttaatctgtctaatgatttaataacgtctaacatgtctgtacctcccctaaagttaacaacatgattcacgttaattgaaccgcgtttggtggggaagggcaagtgatttgactttatcattttaacgataagaattttaaattcaagggcaaaaaaatcctccaaaaataagcccttttcacactttattataaaatatattccgataaaaacattgaaatataatgaaagagtgatattacagatatgtaatctagattacgtatcttatgaaacagggggaattattatgttgttgaagcgttggattaggtttgtatatgtaacggttgcagtaatgggattcgtatttgttgcaggtactatttgtgtaaatgctagcgataatgttaaccagggtacaaatgatgaacaagttggcgcagttgcaactaaagtaggaaatactcaaaaagtaggcattacttctggtacaacgagcgataattctgtggatgaaaataggcagaacagtgccttagcacagcgccctaaggcaactgcaagcaatccttctaataaaaagattgtaacgaaccgtttacagatgactaagcctaagaaagcaaaattacaaaagaataaggcttcaaaaaagtcagttactgtcacaactgcaattccatggtcaaaagctaagaagcttgataaagctgaagcaaggagggaagcaaaagtagcagaaattgataagttgaaggcggaacttaataagctaaaaaaagaacaggccgcgaataataaagtgccagctacaaatcagactactggccaggaaacaaatggaaatgttacaagtaataattcatcgaattctacaagcacacaaagtacacaggacaccagtggatctggtcagtcagcggcaacctcacagcagacagatcagttaacgccgtctcagcaagctgatcaagacgcccaggatgcgaatacgcagttacagccatcgttgacaagagcccagattacctattatcaaaccgcgtccgtatctaatgttgttggtcagggtgtatcaattgtgaatgcaattgcagaagtaatatctgcattacgtagtttaatataataaacaagatttagggggatatcgatgacattatgaacaaggtaaaatttaacaatacacgctgcttaagaatgttgttgatggtactattggtaccgacattgggtatgctagttactgagagcggggtacatgctgatcaaagcatgtctgattctcaaacagcaagttctaatgagaataataataataacaataataacagcaacaataataatggaggaataattatccctggcgggggctcaattaataatggaaggaatagtggaggaatcgtaaatactggatctacgattggatctggaacagtaagtaataatccttctaccttaaatacaccaagtagtcagcaagttgttaattcgaactcgaaccgtagcaacgttaattctggattaacgaatggaaacggttctagtattgcttctcaaaattctaatcagcctcttaacggatctggaatgagtggatagccaggggagggtggattaacacctaatgaccatgtccctcctgtagctcatttaagcaagcctaaagttattagagatgggcatgccaagtatcaatggaggcgtgtatactcaacgactaaaaaagaaaaaggcacgattgatgtatcgagaaaagtgtctaatggtatgactggatcagtcggaatgagtaaaaaggccattggcatgaagttaggatttaatgtgtcaaagtcaacgacagtcaccgtccatattccctataagacaagtggaaaaggtcgagaagtcgttgaatatacagtcaggaaaattcgatacaaaataactaggactaagactataaccactgggataaatggctatgtaacttcacggaagaagttagtcgcttatgtttataaatacgatggtattattggacgagttgtaaaggattaaaggagctaagcgaaatgaaatatcttcaaacttctgcagtgtttctcagttttggactgctaacagttttcttcatgcaaattattcaagaaatttcagatacattcacgataggtggcgggcccactgatgcgccaatcaactactgggcaagcagcatgatccttgttccattagcctttggagctttgttcattatcacgttcgcattgggcatgtaccaaatttatcaagagaaaaaacaaagtaaaaagtgaagaaacacaaacaagcacccttggagaattgagtctccgagggtgcttgtcattttttaagcgattatttaatcaattgtggttgaaacacacccattactgtatcctgagcagtaaataccggaacttggtgactgagggcattggcgaccaattgtttttgatcgacggtttcgtcctctgaactcagagcaaaggcgaggttgcttggccattccattccttcgtggtaggtttgaatgccaaagccgctgccctttagttgctcgactaagctggcgttgttggcatcaaatgctgacaggagcacatcaccagtcaggtgattggtatcaatgtggtagctgtcaaacagcgcattgtgtaaggcttcctgcaggttgtggccggcgccgatatcttcgccggttgacttcatttctggactcaacgcggttggggcacctggcagtttggcaaatgagaagactggcgccttcacataaaccttggctggttctgggtgtaagcccggcttcaaaccaatttcagctagtgatttgcccaaaatgagctgagttgccaattgtgccaaatgtagtttgacaatcttactcatgaacggcacggttctggatgcccgtgggttgacttcgatgacgtacacttcgtcagcgacgatgaattgaatgttcatcatgccaaccgcatgaacctgcttaccaatcttggtagcgatagcaacgatcttttctttctggtcgtcagtcaacgtctgtggtggatacatggcaatcgagtcgcctgaatgaatgccggcaccttcgagatgctccatgattccaggaacaaagacgtcattgccgtcgctcaggatatcaacttcacactcagttccagggatgtactgatcgattaagattggttcaccatgactgttcttgagcgccgggatgaggtattcgtttagctcgtcatcattatggacaacggccatccctttaccaccaagaacgaagcttggacgtaccaataccgggtaacccaggtggttggcaatttctaatgcttcaggggcatcggtagcggtagcaccctttggatgagcaatgttttggtcaattaagaggtcttcaaattgatgacgatcttcagtttgctcaatgccgtggagggaagtgccaaggatggaaacgccatgcttagtcaagccttcggtcaagttgatggcggtttgaccaccaaattcaacgatgaccccaatcggctgttccaaattgatgatgttcatgacgctgtcaatggtgagcggttcaaagtaaagcttgtcggaaatggagaaatcagttgaaaccgtttctggattattgttaataataatggcattgtaacccgctgcttgaatcgctttgacacagtggacagtggcgtagtcaaattcaactccttggccaattcggattgggccggcaccgataacgacgatactattccccagtggcttgctttcgttttcgttaccaactgtactatagtagtaaggcgttgtgctttcgaattctgcggcacaggtatcgaccatcttataaaccagatgttgatctgacattttgtctaatttggtcaactcatcatcggttgcgtgatgaatggcttggatcatggtgttgttgaagcctaatttacgggcttttaagacttcatcagcgcttaagaggccatcggtcatctgctgttgcatcttgatgatgttttccagtttcgataagaagtacatatcgatttgagttgaacgattaatctgttgaatggtagcacccttaccaatggcggcaaagatttcaaataatcgataatcagttggtgtcttaatcttttccagcaggtcgcccattgacatgtttcgagtataagccggaatcaggtcagtttgcgcttgttggtcgagttccaatgattgaacggcctttaacagtgattcttcaatggtactgccgattgccatgacttctccggtggctttcatttgggttcccagtttgcggtctgcgtttgtgaatttgtcaaacgcaaagcgtgggatcttagcaacgacgtaatcgagagccggttcgaacatcgcaaacgtggtttgcgttattgggttcatgatttcgtccaggttcaaaccaatggcgattttggctgcaattttggcgattgggtagccagttgcttttgaggccaaagcggatgaacggctgacccgtgggttgacttcgatgacgtagtaagcttcactgtttggatcttgggccaattgaacgttgcacccgccttcgattttgagggcgttcacgatggtcaacgacgcgtcacgcagacgttgatattctttgtcggtcagtgtctgcgttggtgcaaagacaattgaatcaccagtgtggataccgactggatcgaagttttccattccagtcacgatgattgaactgccgtggtgatcccgcatcacttcaaattcgatttctttgaagccagcgatactcttttcaactaaacattcagttgagggtgacatggtgaggccacggttcaaaatggtggtcatttcatcatcgttatgggcaattccgccgcctgttccacccaaagtataggcaggacgaataatgacaggatagtcgatcttgtgagcgaagtccaatccatcttggaggtcgtaaaccgttttggaatcaggaattggctggtgaagctcttccatcaagtctttgaatttctcacgatcttcagcttcgttgatggtttgcaaactggttcctaacaattcgattcccagttcatccaggataccgtccttgctaagttcaactgcgaggttcagaccggtttggccgcccaaagttggcaagatagcgtctggatgttctttgttgataatcttcttcaggcttggaacggttaatggctccaagtagaccttgtcagcaatttcatcatcagtcatgattgtggcagggttggagttgaccaagattactgagtaaccttcttcacggaggctgaggcaggcttggctgccggcatagtcaaattctgcggcttggccaatcacgattggacctgagccgataatcaatacttttttaatatcttctctttttggcattaatgaacccctccgtttacgtgcatcatttcgataaagtcgtcaaataatttggtggcatcgtgtggacctggtgcggcttctgggtggtattgaactgagaataccgggcggccgggatagcgcaggccctcacacgttttgtcgttgacttcaagcgcagttacttccagtggggtgtctttaacggagtcgacgtccactgcgtaaccatggttttgtgaggtgatgcaaatgtcaccagtgatcaggttcttaaccggatgattaatcccacgatgaccaaacgtcattttgtaagtggtggcgccgttggccagtgccagaagttgatggccgagacagattccaaacagcgggaagttgtcctggagcttttgaatcaccggcacaaagtctgagtaatcggttggatctccaggaccattggataacaagatgccggttggatgtaagttggcaatatcttcaaacgttgattcaggtgtaacgacggtcacatcaacgcctgggcgctggagtgacttgacgatgttatctttgacaccaaagtcaacaacgacaacatgttcaacatctttggcgtcgcctgcggacaatgtggctgatttgataatggatgccgagcggtcagcttttggttgatcaacgattgggtgattggtaaggctggccttcattgtgccatagcggcgaataatcttggttaactgtcgggtatcaatcccgctgattgctggaaccttcgactgctttaggaaagcatcgaggctgataacgctttggtaatgaaatacttgatcggtcatttctttgacaacgactgctgctgcttgaacggtgtccgattggttggtgcccagtgagatgccatagttaccaatcaacggataggtgaaactgatgatttgatgtttgtacgatggatcggtcaatgtttcctggtagccggtcatgctggtggtaaagacgagttcaccatcaatttcggcgcccaagtcaccacacgcttccccgacgaagacatcgccgttttctagagttagatactttttcatgtccgaacctcctcaatttgttcctaacaatgctgcggtatttacagttaacgcttttgaatatttaagatagaagtatttagggcaaatgtcaagggaaaatatgcaatatttgccgatattcggataaatatgtacaaataaaatacaatatgtatatttattaaatatgtcccaatgtcttgaaatcgcgtccttatagataagttagtcgtcactttttaatatattcgatttgttggataaataaacattttcaaaattaatttaacaactagacttgttttttctctcaaaatagaatatgattctaagtaatcaaacagaacctttaacattaaccccgtgaggttaagaaggtatggcgaatcttgaggagactcagggctaactcaaacctctttaccgaacgcggtaaagaggttttttgttacatatctactaattcttattgacgatttaactgttcccgtgagagcaaaacgtcctggaatgtggttcccgacacataaggagcgctttgcgaacacggcaaggcgcttttaattttaggaggaaatcacaatgatgcagattactaaaccggtaagttttgaaaatgttgtaagtatggaagacctttcagccgaagatgttttatcatttatccatgaagcacaggatttcaaagccggcaagcagattgagctaaagcggccggtatacgccgctaaccttttctttgaaagcagcacaagaacccacaccagttttgaaatggcagaacgcaaattaggccttcaagttgtcaactttgatccttcaaacagttctttgagcaagggtgaatcaatgagtgacactgttaagaccttccaagcaattggcgttgacttggttgccatccgtgataagaagaatgaatactacaaagatttaattgctgatccaaacgtccatgtcggtattgccaacggtggtgacggctcaggtcaacatccatcacaatcattgcttgacatgatgactatatatgaagagtttggtcacttcgaaggtttgaaagttgccattgttggtgacttaacccactcgcgagttgcccgttccaacatggaagtcttaaccatgcttggcgcccacgtctactttggcggaccaaagaagtggtacaccgaagaatttgccaagtatggcgaatggatgccaatcgatgatttggttgaagaaatggacgttatgatgttcctccgtgttcaacacgaacgaattgctgacgacgaaaatggcgccttctccgctgaaaagtaccatgctcaatatggtttaactgcagaacgtgaatcaagaatgccacaacattcaatcatcatgcatccagctcccgttaaccgcggtgttgaaattgccgacgaattggttgaatgcgacaaatcccgcatctttgaacaaatgcacaatggtgtgtttgtcagaatggcaatcatgaccagcatgcttcgcaaccgtgacctcattaaggaagaatattaatagcgaggagaatttcgactgatgaaacgcatcattgcaaacggacaaatactggatcgtggccaattagttaaacgcgatattttaattgagaatggtagggtagctaagattgctgaagacatttcaactgatggagtggatgaagtaatcgatgccaaagggaactttgtctcggccggcctaatcgacgtccacgtccattatcgccagccgggtcaggaacaaaaagagaccgttaagactggcagtctggcagctgctcatggtggcttcaccactgtttgtgcgatgcccaatgtcaccccggcacctgactcagttaataatatggaagctttaattaaattgaaccacactgacggtgctgttcacattaagcaatatgcggcaattaccaccaaccgtggtggtgatgagttagttgatttcaaggcgttaaaggatgccggtgcctttgcttttagcaacgacggcaatggcattcaaaagagcagtaccatgtatgaagcgatgcagcaggctgccaagctggacatggccattgttgaacacgttcaagacgacgctttgacatatggcggtgttttgaacggcggggctgctaaacgtctgggaatgaaagaaatgccctgggtcagtgaaacagcccaagttgcccgagatgtcattcttgccgaagcaaccggcgttcattatcatgtctgccacgcatcatccaaacataccgtcaacgttatccgggctgccaaacaagctgggattaacgttaccgcggaagtttcaccgcaccatctgcttttgtcggacgccaacattaaagaagacaacgcgatgtacaaaatgaatccacctttgcgcggagaggatgatcgccaagcattgatcgaaggcttgcttgatggcaccattgatatgattgccaccgatcacgcccctcataccaaggcggataaggatcaatcaatcgccacagctgcctttggtattaccggcagtgagacagcattcagtatgctatacaccagatttgtgaagaccggtcggttcacgttagcccagttggttaattggctgaccaagcagccggcatccgtcttcaaaatgagaggcgctggctcactggcagtcggccagcctgctgacattgccatctttgatttgaaacacgaacatgaaatcaaagaaagcgactatttgtcaaaaggcaagaattcaccatttactggcgaagctgtctatggcgatacggtcatgaccttggttgatggcgacattgcctacaagagatcgtaaattaatcacataaaaacatattggtatcaataagaataaaaagctgcagttcaccgagactcctaactcgatggactgcagcttttgtattatttgagaaacatcgtgtaatagccgattgctgaaaccgcttgggcggtgttgactttaccttcgcggatccaatcgacgatttgttgaagtggcactaattcactgttgacgaactcgtcttgatcaaagtggcgttccacgcgttcgctgggatcaaatttaatcaacatcaggtcggcaaattggtccatgaagccttccgaagaggtgattcgggtcatcttagtgactgactgggccacgtagccggtttcttcccgtaattcgcgggcagccgcctgttcgctggtttcgcctgggttcacaatgccagctggcaaggaaaccgaatcactgttaacgccagcccggtattcactgctcatcacgacttgatcagccggtgaaattgccaggatggtgatggtcgggtcggttttaatcagatcgcgctcaattttgagaccgtccggtgtctggatgtgtagttgatcgacggcaaagacgcgaccagtgtagatgtttttctggtcgaggatcttgccggggtggtgccatgttttaaacaaacaattatctccttttgatgacttttctttcatatcggtcaggaaggctgatgtgaaaagccgattcattacagcaattattttatcatcatttagacgcccatcaaggctgaaggagcactcaactggtcatcttaatcccaacaatgcttaccagcagcagaatcacaaaaccccaagtaatcggggaaatcttgtcgccaaacaggataatgccggcgatcactgttccgacggcaccaatccccgtccataccggatacgcaatgctcagcggtaatgttttggtggcatgtgctaacaggaagaaactgatcagcatgccgacaatggtgacaatcgatggcatcaagttggtaaacccgtggctatatttcatcgccgttgcccaaactacctcaaagatgcctgcaataatcaaaaatacccaattcataaaaatcctcctaaagaaaaagggtacccctcacaattccttctatgacctaacggaattgtaaaaagtacctaaagttgctgcccggtggcagtcgaatatcaagttgttattagtgtagcacatttgaaatcgaaagggaatttacttctttatgccaaacttctcttccaatgctttcgttagtaactgggaaaagtttaggtttgattcaattcctttttcattcaaataatttggaatgttgacggttttcttgacaggatgggaatcatgttggcgacgataagcactgatattcacatctaccaaagtggccaattcatttggcttagtgtctggaagactataaactgattttggcacagaacctccgtcttcaatcagatctaatacttttagaccaataaaatctcggcccatttcaatggagttttcaatggatgtaccttgtgtatatccgcctaaatttggaatactaacaatatacggaaccgatttatcgttgggatcttttataataatgattggatagactactttgacatctttcataatgacctccaaatattgatttaacgtaattgatgcttccttattagatctcgagcaagccattcattaatatttggatgccgtggaataacttccttttctttaccgtttgtccaaatatcatgatttccaccatggcgatataaataccaaccatgccgttcgaagagctgcaacaaacgcttccgcttcatcgaagataatcctcaactttctgtatattttatacgtgcattgtacgtagatcaagtaatttgtatttcctcaaagcacttttttgaaggtgacaaatttgatgacttacataattaattacgtataaatgcaagaaaggattttaaaacaaaaaatggatgacatccgccatccacaaaatgcaacgattcaactacttctgcagcactcgtaccctaaacaccgcgtcaatctttgaaagacggtcaaccaattggtgttcttcctcgttgttcaagttatccaaatcaacgattgtgtaggcaacgtcttttctggccgcgttactcatactttcaatgttaattcccgcgtctgccaacaaggtcgcaatttggccgaccatgttcgggatgtttttatggatcaacgttaagcgataaggggtgttaaacggcacttggaggttgggcaggttcaccgaattttcaatgtttccagtctccaaatacgtcatgattgtgttggcgccttgagtggcgccgttggcttcagcttcgagtgtcgatccgccgatatgtggagtgaccaccacatcgtctcggttcaacaggatattttcaccaaagtcggtatagtatgtccgaattttgcgggcgtccagatagtccacggccgcctcgttgtcgacgattccgtcgcgggaatagttaaataatttgacgccatccttcataatggccatttgttcagcgccgatcagtccggtcgtctcctcattcttaggaacgtgaacggtgacgtaatcagcttgctggagcgcttctcccaacgtggttgcccgggtgatggttgtcgaaatgtgccaagcggcatcggctgatagatatgggtcatagccaattaccttcatgcctaaggcgctggcggcattggcaaccaaggagccgacgtggccaaccccgatcactgccaaggttcggccggtcaattcggttcctttgaacttggtcttgtctttttcagttcgcagcgaaatgtccgcgccactattgtgggcagcgtaatcggctgcagcaaataagtttcgcgatgaggccaccaataacgcgataatcagttctttaacggcgttggcattgctgccgggggtgttgaagactgcggttccgttggcagtggccttgtctaacgggatgttattaaacccggcaccggctctggcaatgaccttcaatttcttgggaaattcctgatcatgaaggttaaccgatcgaatcagataggcatcggcgtcatcggttttgttaatttggtagttgtcggagaagcggtctaatccagcctgtgcaattgcattgtaagtttttacttgatacatatgagttctccctaatgttgtttttcaaagttgtgtaagaaatcaaccagtgcctggacgcctgccagcggcatcgcgttatacagacttgctcgcagaccaccaacacttcggtgacccttgagattcatcaaaccggcttccgtggctgctgtaatcgcctgggtatctagatcggcatcaccagtggtaaatggaatgttggtcaacgaacggtcagaggccttgatgtggttggcaaataattttgagtcgtctaagaagtcgtaaagcagggatgctttttgccggtttaccttctcaattcctgcaattccgccctgatccttcagccatttcaataccaatccggtggcataaatgttgaaaacgggtggggtgttatacatcgagttctttttgacgaataaattgtaattgagaatgcttggaatatggtcgactggctgaaccaaatcatctcggacgatgaccagggtaacgcctgcggggccgaggttcttttggacgccaccgaagattaagccaaagtcattgacgttgtactgttctgccatgaaattggaagataaatcaccaaccaaggtgacatcgccgtgttcaggcagctgatgataagccgttccctcaatggtgttgttcgttgtgatgtgtaaataatcatagtcattggcggagattcgctggttcagttgtggcagtgcttgataatgctgatttttggttgaagccaacacatcaacttggtagccgaggttggctgcttcatcaccagcccgggtagcccaatggccactatccagtaaggcaatcttcttatgcttggttgccagattcattggaacggcggcaaattgacccgtgccacccccttgaaagaagaggatgtgatagttatcaggaacgtccatcaagtctctgacatcctgttctgctgcattgataatgtcgtcaaacattttggaacgatgggaaatttccataatactcattccactgccgttgattgaaggcagttcagcttgaatctgtttgataaccggatcaggaagcgttgccggacccgccgcaaaattgtataccgtcatgaccaaaaactcctttatataaaattaaaaagctcccacaggtttgctgtgagagcttctaactgacgtttttagcggtctcacagtgatgaaaaagatttcatctatgcaaggccctttgttgaatcgcacgtatcaaaagatggcctacatagatgtgactgtagaccaggaggatgatgtagttgtcgttaaatcagctaattgcatgttcatgtgaacaacctccatttcttataactaaaatctaacagaactcacagataaaagcaacacccattttgaagaaagtgtcacggaactgtttgcatgtgcttgaagatcatggtaaattcaatggataattaatttattgggaggaacgcgcatgactgatttttactttgttcgccatggccagacggctgccaacgccgccggattaaagcagggcaccattaactcggaaattacctacctatcggaaaccggaaagcaacaggtggaaagtttgcggaaaggtttcgatatttcgtttgcggatagaatcattgccagcccactgcagcgggcaaaagacacggcggccatcttaaatcagagcgcgaacttaccggtaacctatgacaaccgactcctcgaaatttcatacggcgactgggatggtgagaagaacactgatttgatgagcaaatatcccgaattttttgacttcaccctaaacgacgttcttcctgcgtatgccgatgtggcacatggtgaaactttcgatcacgtcatcgatcgcgtcgctgaattgatgcaggaaactgcaactaattatcctaatgacaagattatcctggtcactcacgggtttacgattaaagcggctgtgttggcagccatcggtcgtcccaaggacatgatggtgattgaggagccggataacaccagtgtgacccggatcactttgcagaccacaactcactcgtattatctgcggtattacaaccgggttgtcaattctcagttttaaagtgattgacaaatgaaagtcaattggttatattaaatggcatcaagtaacgaaagaggaggaagccattcatgcaaatgtcagctgctaatatgatgtgttgttcaatgtgtcaagctcaacttagcgctgatcgtggcttctttggtaaacgattggatttttgggacaagctgtgagctgatagttgacggcccattttctcaagaattaccaatgccaagagtgtctcatttcagcgtcaaagctggagtggggcattctttttgtataccagaggatctcttttgttgaataaataatcttaaaggtggcggttgcagtgtgtagtcagatgttgattgaagtgaaaaggacaaactaaattctttggaggaatcattcatgcgaaaactcagatcacttttattattagccttgagcgccattctggtagtgactttggcggcttgtggcaaaaccgcaaccaaatccaacagccaaaaacagacactgaatctcagcacgacggccccgttggatacgatcgacatttcaaaatccaccgggtatggccagaccgggaacgtgtttgaaagcttttatcgcttggggaaagacggcaaaccaactgctggcttggctaagagcggtaaggtttccaaagatggtaagacgtggacctttaccttgcgcaacgctaaatggagcaatggcgacccaatcactgcccaggattttgtctactcgtggcgccgaaccctgaaaccaagcaccaaatcgacttacgcctatttattcagcggaattaaaaacgccgatcaggttaacgccggcaagctctcaccaaataaaatcggtatcaaagcactgaataacaagacggttcaaattcaacttgagaagccaatcgcctactttaaggtcctgatggcctatccattatttggaccgcaaaaccagaaaattgttgataaatacggcaaaaaatatggtaccaactccaagtacatggtgtactccggaccattcaaaattcaaaactggaacggcaccggcaataagtggcagtttgttaagaataaccgttactgggataaacaggccgttaagcttcacaagattaactataccgtggtcagcagcccgacgactggccttgagttgtatcagcaaaacaagctggatttgacgccgctttctaatgaacaagtcaaacattacaaaggcaacaaggaatttcagcagtatccatattcattcatcggttacttgaagtacaacttcaaagacgctaaccaaaccaaacgcaaagccatgagcaacaaggacattcgtctcgcaatttcactggccattgatcgccaacagctgaccaaaaaggttcttggtgatgggtcagacacaccaactggctttgtggcctctggattggctaagaatccgaagactggcgaagactttgccaaagaacagactgttccaaatacggtggattacaacgtcaagttagccaagcagcattggcaaaaaggtttgaaagcccttggtaccaagaaggttaccctgacaatcactgcttccaacgatgatccaaccagcaacccgattacacagtacatgaagtctgaattgcaacgggacttgcctggatttaagctcgatattcgaaatgtgccgagccaagttgccaatcaagaagtcttaaagggtgactttgacctgtcattatccggttggggtgcagatttcaacgatccaatttccttcctgcagatcccggaaaccggcaccgcatacaacagcggcaagtacagcaacccggcatatgataagctgattaaacaagctcaaaatcaggatgccaataacgctgataaacgctggaatgatttggttaaggcagctaaattgtttaatgctgatcaggggatgacgccactgtaccagcaagtcacctcgtatctgcaaaagcccgacttaaagggtgttattcataacactgccggtactcaatggagttacaagtacgcttatatgaagtaaatgaccgagactcaactgccttgcgtcgaacgattgtcatctcattaacttaaattaaaatgagaatccattgaccattgagagcgatatcatggtacacttttctcaactaaaacttttgaggtgattaaggatgacaagaaaaattggtgttatcggaatgggccacgttggctcaacagcagcgcattacattgtcgcaaacggcttcgcggatgatttggtattgatcgatatcaatgaagataaagtgaaggctgacgcaattgattttgaagatgcaatgtccaacctgcccgtccacaccaacattactgtgaatgattattctgcactgcaggatgccgatgtcattatttctgcattgggaaatatcaaacttcaggacaatccgaatgacgatcggtttgccgagctgccattcaccagcaaggcagtcaaatcggtggcacaaaagattaaagactccggcttcaatgggatcattgtcgccattaccaatccggtagatgtcatcacttcgatttaccagcaaattaccggtctaccgaagaaacacgtgattggcactgggactttgctggattcctcacgaatgaagcgggcggtggctgacgaacttaatttagatccacggtcagttaccggatttaatttgggcgaacatgggaactcccaattcactgcttggtcaacagttcgggtactgagtcatccaattactgagattgctaaagaacgcggtctggaccttgatgcgctggacaaagctgccagagaaggtgggttcaacgtcttccacggtaaaaagtacaccaactatggtgtcgccaccgcggctgttcgtttagccaacacggtgatgagcgatgcccatactgaactggcagtttccaactaccgtgaagagctcggcacctacttgtcatatccagcggttgttggtcgtgatggaattattgaacaggttcaactgcagttgactgacgatgaaaagaagaagctgcagatttcagctgattatattaagacgaagtttaaggaatctatggaaaactagaacagattgggactaaaggcgctttgatcccagaatataacgcaatcgggccgtcattccggaatttggaatgatggcccgattgcgttatatggccgggatcagccgtttgtaccaagttttatcaatataaaattggtgattgcagttgcaataaaaatcaccgtaacaactagtggtccaatctctgtttcgggacaaaaaaataacctccagcaattaagaactgaaggcttgaagcaatttatctaactcgaattgttaatatacttacattataacgcgacgaattcgacttgtcaacgttgcctgcaaaagatattcgagtttgactgggtggcagattcagcctaaaattgagccaataaatcacgattggagcaatcaattttggcaaactacgaaacagtgtttcatccagacggttacaattctcctgagtaccgcagcttaaattattcctatcagaataaaatggctgaattattctcccaccgacggattgattatccggccaaagaacttcaatttgaaattgaaaccgtcaaaatctccagcaccatgactcagcagcaatacctcaaacttcagagcttggtggaatcatttcccgaaactcaacgcagtggggatgcccccgtcattggcaaggacgattaccagagtattattttgtatcatgactaccgattatttgattcgacccagtatgttgtccgcagtccgctgggatttggctataccgtcagcaagttgatcacgattacgagtgagccggcgggaggtcctcatcaccaggtgaaggtgactttggcaattaacccgaatcgcttcgttggtgttcccgaagaacctttgcttcgtctggtcatcgaagaggtgttgccgctgatggtgatcccacagatttctgaaatggatttaacattggatatgccgctaatcatgaacaactttcatgttcagatgggtggccaagctgggacaaaacagcagattacccaacggcttaatgatcatcaagaatatgaattgagccgaattgcctatgtggatcctcagcagaccagaaaactggtcgtggcagacaagtttcaatccctgttggacaatcaattgctggtggcggatactgactacatctctgcccgggaggccgaatactatcgggaccaagttggagaacggcagtttttaacccggattgaattggcggtcaccacccctaatgccgtcatgcggtacatgaagaatcacgagtggctgatgcgggacatttccatcgagtatcgtgataatagcggcatctcaagatttgcgggtaccgattacgcgaccaacgggaaggacttccgccgctcatttaaccggatgctgacgtatcggctgaaggaagttcagccaagagcacgcaaactgccatatctgactgatgcgatttggcagaataccttgaaataaaatttgaataaatctcattaaatgaaaattcactgttgaactgacatctcaaagtggtatgctgttaccattaaaaatttttgaggtgattgaatgacaagaaaaattggtgttattggaatgggaagtgtgggctctacggtcgctcactatatcgtgtccggcggctttgcagacgacttggtactgatcgatgtaaatgagaaaaaggttaaagccgacgccttagacttcgaagatgccatggccaacttaccgaatcatacgaacattgccgtgaacgattatgatgaattggccgacgccgatattgtgatttctgcgattggcaaactccagctgcagcgcgacaatcccagcaatgatcgcttcattgagtatccatatactcaaaaagcagccgcatcagttgccggtaagatcaaggattcaggctttaatgggattttaattgtgattaccaacccggttgacgcgatcacgtcaatttatcaggcggtcactggtttgcccaagaagcatgtcattggaaccgggacgctgttggattcgtcacggatgaaacgggctgttgccaagaaattacatatcgatccgcgttccgttgccggttataatttgggagaacatgggaattctcagttcaccgcttggtcaaccgtgcgggtcttaggcaaaccaattactgaattagctgacaaagaaggccttgatcttgataaaattgatgaagatgcccgaatgggtggcttcgtcgttttccgtggtaaaggatacaccaactacgcgattgccagtggtgccgttcgcctggccaacgttgtgttaaatgatgcgcgaactgaactgccggtatccaattatcgtgaagaactcggttcatatttgtcatacccagccattgttggtcgggatggcattatccaacaactccaacttgacttaacagatgaagaattagcgaaactgcaaaattgtgccaatatcattaaagagaagttcgaagaatcaaaagccaaggactttgcgactgaatagggacttttcacatagaacaattttcatccacattcatatttgaggatcgtcacgcctcatagtaatggccaggtcaaaatcagcaacttttgacctggctttttgtatcccaggaggtcactggattaccaattcatgatttttagcgctcttttacatgtttctcccacttttggtatatattaagattaatcgagggggaaaaatgatgaaaaaagaacgggtggaagcttttacggatgccgttttggcaattattttgacgattatgattttggagttcaagaccccggaatcgtttgcgattagtgccattttagatcaagtgccatacctgatttcctacgcaattgggtatttgttcatcggcgttgcttggtacaatcaccattacatgttcgccaagaccaattggatcacgcaaaatgtgtattgggcgaacaacttgtggatgtttaccacgtcctttgtccctgtggcgacggcttgggtcgggcgcgggttaaatgaacaggggccggaaatcttttacttcattgtctttttagcatggtcgagtgcttactattacctgtccaaccgattaatcaaggccaacgaaaaagaccactgaccgaaggcagcggaggcgattcgatcaatggtcatctatcgatatatgagcaactggaagttagtggccgctcaacttattttgtcaattgccgttttgaaattcatgccggcgcttcaaatggtcattgtcacgttaatgattatttttatcggtgcccggtttaacgcggacagcgatcggctctttcgctagtgggcaatcagggtgtagatgaagtagccgagaaagccgacgcacaagctgagcgagccaaaaatcatgatctgaacagaacagacaaaagtcttggttttaatttgttcatggttgaaaatcagggactgcttgatgatcagcggaactgccagcagaatggagaacagtgctaatgggaagacgccgacgtacatggcgtaaaataccaggaggacagctaaaacgttggcggtattaaacattaacagggaattcttcttgccgatatagtggacgatcgtccaacggtggttgacctcgtcttcttgatcatcgcaaatgttattggctaacataatgttggcaatccagaagaacaacggtgacgaagccagcagaatctggccaagcagtgaggcattccaagtgaagagctgataggaattcacgtagaccgagatcagggtaatcatgacccccatagcgaagccggacgccacttcaccatacggcgtgctggagatgggatgcggtccggatgaatacataattccgatggcaaaacagatcaatcccatccacaacagcggcaggccgattttgaataccaggaagatgccaatcaaagctgatggcacaaccataatgacgatcataaaacgaatgaggtttaaagagatgtggtcccgaccgatgatgttggtaccggttttccattcctcagcggttgaatgcatgtagtcgttatagttgtccaaggtgtccacggtcatattgaacagaatcatggcaatgaaaaaaagcgtagcgtaaagcccattcaccgagtcgagcaggtaccagctgaaaaacagtccggtaaaaaacggaaagatgctggcagctttggctcgcaactcgacgagctgggaaaaagttgataaactcatgatgacctccaagataaatttaaaataatttcaaaaacatagtctaattataccaaaggagcgggaaaatgacgctgacgaacaaaacgccggaaacaaaagttgaatcattatttgatcaaattgctgacaactatgatgggatgaactcgctgattagtttggggaatcataagcactggcgaaaattggttatgcagcagctcaacgttgaaccggggagctttgcgattgatgtttgctgcgggaccggggattggacaattgctttggccaaggcagtcgggccctccggacaagttgttggcctcgactttagtgaagagatgctgaaacttgctgacaagaaggttcgtgcagccggcctgcaggatcgggtaaccttggttaaaggggatgcgatgcagctgccatatgatgacaaccactttgacgtcgccacgattggctttggtctcagaaatgttccggatgctgaccaggtactccatgaaatgagccgggtggtgcacgcccgggggcaggttgcctgcctggaaacatccaagccaaccaatccggttatcaaattcggctggcgggtctactttgatttggtcccattaatggcaaaagtggccgtcgataaatatcaggagtacgcctatttacaaaaaaccactgccgaatttgtctcggcacaacagttggtggaaatgtttcaaaacgccggcctggttgacgttcactatcgaccattcactttcggggccgctgcttttcactggggaatgaagccctgacaaaatttcccttgattcacaagattaaaaacgttatcatgtgtttaacatattctaaggagtttttaattatgatagataatttaaacatccaaatgaatagttgccgatattacttttggtttttccgagtgtgatctgtggataagccaaaagcatttcgtaatgcatactaaaggccgcacagatcactgagttgactgtgcgggatgataccattggtgggtcctcacagtcagttcgttgactttgaggacccactttttaggaggagaacacaatgagtaaattatcagataagatgaacaaacgggtagctgcgttaacgcccgccgcaattttgactttcaaccagaagatttcagcgattccagacatcgtcaaattaaccttgggtgagcctgatttcaacactccggaacacgttaagcaggccgctattaaggcaattgacgataacgaaagtcactacaccaactcccgggggacagaaggactccgtcaggcagctgcgaacttcttgaacacgaaatacggtctgaattacgatcctgacaaacaagttatcatgactgaaggggcaactggtgccatctactcggcattgactgccatgatcaaccctggcgacaccgtgatcgtcccaacaccaattttcccactttacgtgccgatcttaatgctggccggtgccaaaccaatttttgtggacacctcggataatggctttgtgctgtcaccggaaaaattgtctgcagcgattgaggctaataaagatactgttaaggcggtgatcctcaatttccctaacaacccaaccggggttacctaccacaaagacgatttacagaaattggcggacgtcatttccaagcacgacattatttgtttaagtgatgaaatttacagtgagttgacctacgacggcacccatgtttcgatggggtcgatcctgccggaacaaacccttgtcatgaacggtgtttccaagtctcacgccatgactggctggagagtcgggatgatctgcgggcctaaagatatcatcaatgaaatcgccaaggtcagtgaatttacgatcacgtcactgaccaccaacgcccaggctgccgccgaagaagccttcaagaacggcatggacgatgccctgccaatgaagaaggagtacatgacgcgccgcgacttactagttgctggtttggaaaaagccggcttcagctgtcctaatcccaatggcgccttctacgttttcgccaagattccagctggtttaaatcaaaacagtgaggcattctgctatgacttggccaaggaagccaaagttgccttaattccaggctcgtacttcctgccaggcggcgaaggctacgttcgaatcagttacgcagccagtgaggaaaatattcaagaggccgttagccgcattcaaaaatacgttgataaacagtcagtcaaataaagggagcttgagttattttgaaaattttaatgtacaacgtccgaccagacgaacaaaaaccactggatggctgggttaagcaaaacggtgtccaggtagataccaactcggtaccgttaaacgctgacacggttgaccttgccaaaggttacgatggcattgtgattcagcagcacggatcagtctcagatccgacaatttacgagaaactccattcatttgggatcaagcagattaccttgcggatcaccgggtatgaaatcattgatttggaccaggctaagcaaaacgacttggtcgttactaacgtgccggcttactcaccacggtctgtgagcgaactggtcctggccgatgtcatgagcctgcttcgacacatcggtgaggtaggcgaacgcgaaaagcacggcgacttcagttggaagggtgtcgaagcacgtgaaattcatactttaacggttggcattatcggtgccggcaaaatcggcagcgcggttgcccggatttttagagcgctgggtgctacggtgattgccgccgacccgattcatcgaccagaactcaacgacacgttgacatacgttgatcacgaaacggtcttcaaaacggctgatatcgtgaccatgcacaccccattgactgacgagaccaaccagatgattaacgccgacgtcttcaagcagatgaagccgtccgcgatttttatcaatgcttcccggggccaagtggtggataccggcgccttggtgaacgccttggaaaaccaggaaatttccgccgccgcaattgatacctttgaaggcgagaatacgattgtcggccaagacttatccggcaagcagattgaaaacgataatttaaagaagttactggcaatgcctaacgtcaacgtgacgccacacattggtttctataccgaagtggcagtccaaaatatggttgagattgccttgaatgacgttgtgatgattttgaaagggcaaaagagccctcatgaggtaggcgaatagatgaatttaccagcagaaccatcagcacggctgaacggtcgtgaactcattatgaatacgttaaacgggctgtcggttgggatcattgttgcattggtccccggcgccttgcttaatcaattgttgaaggctttgctgccagtgtttccacaagctgctttcttcttgactttgactggaatggcggccgttttaatggcaccgattagtgcggtctgtgtcgggatgatggcgggctttggctttgccggcttgatcggaccaatcgctgcagttaatggttatggcaatgccaatctgatgaatattgtcttggttagcttacttttctttgtgattccgattacgcttggatatgttagcaattacttattcaactccaagctgagttattttgacgcccaagattttgagttggattatttataaggagtcgagaatttgggaactgaatttgccgtgctagtcctattaatctttgttggcggtgcgatttactactattacttcagtaaacaagagccttcaatgattgtggggtatcggacaaaacaaagccgcagcacaactgcaaagtggcgggcctcacagaagtggttctaccaaggggcaatcacttgtgccgcggttgttgtggtggttaatctagtaacgccattttcgattggtgtgaatttggttgttttgttagtttatttatttgtgattagttatttcatcgagcgtcgcttgcgtgagatgggagattagaatgaaaaaggcccgctgagttggcgggcttttttgtgttttagttatttgtttgttggggttagtggttttagttggggggatttgttgttttggtgattcctgtttatctagcggaaacgtgctccgatgaccctgacccctaacatgcaaaacaaggattgtatcgatgaacaaaatgcgttcatcaatacaatccttgctttacataccggggtcaacccgggtctcgtcgcactctaaatttggccccaagcatccgccgcaatcgttgggaacaatgtgaccaatcgttccagctgtgcgggttcgaatttgaacacaattgccggcaataatgcgttaatggcatcttctgcctggtcgctgatttcagtggcaccaaccaaatggttctgcttgtcataaaccagtgtgttatcgccaatttcttccttggtcacttgacggtaccagtcgtctggtaaatggttttcctttgttgtgaagccttcttttttggcatcctcaactgatacgccgactttggcaattcttggtgaggtaaagacgactgatggaattgccgggtaatcgatgggatccgtcgtgtcgccagcgaaagtatgcatcaagtaggtcgactcaaaaatcgccgttggggtgagctttggttgatccttgtcgatgacgtcgcctgaagcatagatgttatcaacattggtttggagatgatcgttgaccttaatacctttttcgctgtaatcaacaccaactttatccagtccaatgtcgtccacattaggcatccggccagtcgcgtccaagatccagttggtctttatttgaccgcccttatagttgacgataaagttatggtcgtcctgctcgaagttggcaacttcagtattattgacaaaatctacgccacgagatttcaaatcggcaacaatttgcttaacgtatggttgatagaatttccgcaaaactttgtcaccgtgggtaatcacagttaccttggcaccagccgcgttggcaatcgttgcgaattccagactgatgtagccggcaccgataattgtgatgttggctggcaggtgagtgaggttcatgaagtcagcactatcgtgagccagttctgttccaggaatgtccaaacgatgtggatgttggccggttgagatgacgatgttttcagcggttttggcttcaccgtcgaccattaccgtatgagcatcttggaatgtgccgtgacccttgataatgtcgatgttgacggatttcatcaagccgccgatcatgtccggcaagccttcgatgacttcttgcttatgtttttcattggcggtccagttaattgccaaactgccattgagaatcccctgaagtctctcagtttgacgtgtcaacgccactggtgcatccaacgtaatcttggcgttacagccacggttgggacaggtgccgccaattaagccggattcgatgacgccgactttcttgccgcgggcggccagcggaatcgcaccgtcaaaggttccatgtccactaccgatgtataagacgtcataatcataatttgccataaaaaatgcctcccatatagtctgctcggaaacgattacatcttgaactactaaaagcgtaacctgtaaacaaattgcgtgcaacgaattggtttgaaaatttacgcacagtcaaaaatgtctatgtacgacatcgaccaaaatggctatacttgaagcaaataaagggagctgatgatatgcgcagaaaagatcgggaagtcacagatattgacgaaattaagcaaattttgcaggattcccatgtgattcacagcggttttcggacggctgattatccttacgtggtccccactaattttggctacgaatttgacgatgataaccatttgacgttatacattcacggtgcaccggtgggccgcaagcgtgaattgattaaggaagacggtcggatgggctttgagattgatgatggcggccagttaatggtgcccaaagatcccaagcaaaacaccccgagcttcgcttatcgcagcgtgatgggctatggggatgccgaattggttgatgatccagcggtcaaaaagcacgccctgcaagttgtcttggcacacgagactgggcagcagttgggtgagtttactgtttcagataagacgatcgcctacgttggtatcatcaagatcactgttaaagaattcaccgccaaagcccacggtggcgatgatccggattttgaataggaatacgacgaggctggtagcagtgggggataaaataatagcagaacactaaaaagccggagcacaactaacaagtagttatgttccggttatttattctttacggtgatcgtgtttttgagcctcatgtttccaaaaccatccgggaattgaaatcaagacacccatcccaaatggaatcaagctgtaaatcaatgccgcagtggaatgatcaccactccaccacatgaagtagcatatcccaaggatggagacgatcaaacccgccaagggcactgtgattatgaggtattgaatcattcggtcgcgaagctgctgcatactcatttggattaccttcttttaatcttagattaacactaaccagtcacaaagcaagttacgaagtccgggtcaaataatgattccgggtgacgatgtaatcaattacacctgcgatcaaaagcgtgaccagacaacagccaacaaatcccatcagtgtaaaatcgccgttaatttgaattggtgtaaaagggctgttttcatggaacagtttggaatagagcagcaccgcgttttgtttgaagtcaaatgatcctaatacagggatgccggaaaagtacccaaacatcaaaatacctgccagccaaggtcgcttgagcaataaggtgaggtagtagctgacgatcacagcaatcaatgataagccaaataccgataagaactgcaacggggcttgtgccagataagattggccgtccgcgagataccgtatcaacgccagtttatttgggatgtggataaaattgttaaagcccaactggaagatgaacgaggtcagacaaatgaagatcaggctcaaaaaagtgagcatgctcaaactaatcagtttggagaggacgacattttgaatgctgttcatgctggccttgattttgacctgattatttttgagctcccgataggcaaaagaaattgtgtagatcaccatggtaattggaaagacaatgaacattgacgaccccagaatatgatcaaagctgttcctgggggccatctcgaccagatcctgcttgaccttttctccagcatctttgaggtctgtgaccacttcggctttttccccgttgctaaacgtgattggccctccggctaatatctgatcaacgtcaaccccagcgcgtttatcacgctgctggatccaaatcagactactggcgtcatttttgtaagcagtgtactgcgcccaagatattgagaaacagagaattgtcaaaacaaataacactaaatagatcgcatcagaatggagctgttgatccagttctttttgggttagggatctgagctttttcaattgtgcacgtcaattcctttcggtgaatgatgaatgcggtaagcaatacccttagcataggcattttggccagtgaagacaacggcaaaccggaaatgttcagacttatttcacacaaaattcacaaaaaattcaataatttaccaatggcatatacattcagcaactttcgttctatcataatggtaacggttccagaactagcaattatgaaagaaggatcttgtatgttctttattgatacgtctagaaatggcaaacctgtctatgatccgattgtgaaccaatctttggataactacttagtaaatgatttgaagttgccgggccacggcctgattatgtacgttaaccaacccgctgtgattgtcggggttaaccaaaatgcctacgctgaagtcaacatgccctatttgaaagaaaagggcattaaattggttcgccggacatctggtggcggcgccgtgtatcacgattacggcaacattatttttgaaaatattgtgattaatgatgaccaacattttggcgatttcaaatacttcgcccaaccaatcatcgatgccctgcatgacatgggcgctaccgatgctgaaatgcgtgggagaaatgatatggtgatcggaaatcaaaagttctccgggatgacaatgttcaaggttggcaagtcctacgctgccggcggcaccctgatgtttgatttggatatggatgtggccactgaagttttaacccctgaaaaggataaattggaatccaagggcgttaagtcggttgaaagccgggtaaccaacgttaagccattcttgaagccagaatttcaaaagttggatattgaaggcttcaagaaggccctgctgttgagattgtttaatgccaagtcattggacgatattgaaacatatcacttgaacgatcacgattggtcaattatcgatgagcgtttgaaagggaaatacgataccgacgagtggaactatgggaagaatcccggctttgattactatgtttccaagcattatgatatcggcacggtcagcttcaactattcattgaacggcaaccaaatttccgatatcaagatctatggtgactttattaccggcggcgatatttccgtgattgaaaaggcactgaaaggcgttgatctcagcaaggatgcgttagttgatgctttgaatcaagtggatattaaggctaatttgggtgacatttctgccgcggagttggcggacttgctgctggagaagacgcggattaattagatatcggctttgttttggagttctagttttgagctagggctcttttttattgatttgatcgttgttggaacgacttgttaccgacatatgtcagcctgcaagctaatccgttgaccttacccggccattcgtggaataatataacgtcataagtaatgcgacaagttaccgggggtgaacacatgaatcaagcaccaaatcagcatgacgacagcggggaacagaacggtgtgagcatgatggggatgttcaaattcgtttttggtacggttctcaaacggccgtggattttgattgtcaacgttgtcgttttgaccattctgtcattgatggactttttattgccacaattcaatcagtacatcattgaccacgttattccaaataaaagtacggcgcagctggccgtggtcgtcggtctgctactgttgacagttacgatttcagggatttttacctacgtttctacctactacatgggcgtcatgagccaaggggccatcaccaacctgcgaaatcagctatatcaatatttgatcaggttggatacccacttttttgaatccagcaaaacaggtgacttgatggtgcgattaacgtccgatattaacaacctgcaaaacctgatttcaccaaatatgttgtctctgattggcagcctgttcacgtttgtcggggtgctcggcttcattttcttcgttaactgggaaatggctttggcagtcagcctgacatttccaatgattttcgtggtggttcgcattttcagaacccgaattcgaaattcatatcaaaaggcccgtcagtctcaagctttgatgaccaatcaattgcagaacacactgactcaaatccagttgattaagagctacaccactgaagatctggaatccagtcgtttcgacaaattagccaacatgaacaaaaataacatcattgaggctactcggaatcaggcgatcttttcgccgttggtgaccttcattgagtatctggggaccgcgattgtcttattcttgggaacattgtttgtttttaaaaatcagttaaccgttgggcaattggtcgcctatctcagttatgttggtatcctgcaaagcccaatcagtgccttttccagattgttgaaccaattccagcagtcactggtttcttatggccgaattgttagtatcatgggcttgaagccggcgatcgttgacgaggacgatgcagtgggattcccacagattaagtctggagttcaatttaagcatgtcactttttcatacgcatctgatgagcccaagtcaccacacaaagctgcgattcagaatgtgaccttcgatattccgtttggtaaacaaaccgccttggttggtcactcgggagccggcaaatcaacgattaccgatttgctcgatcgattgtacgatgtcgatagcggtgacattttgttcgatggcattccaatcaaacatatcaagctcaagtcactgcggcaaaacatcgcgattgtgtcacaggatatcttcatcattgacggcacgattgctgataatatccgttatgggacgcctggtgcaactgaggatcagctgtgggacgtcgccaaattagccgatattgatgcctttattaaaggattgcctgagcaaatgaaggcccaagtcggtgagcggggaatccgtttatccggtggtcagaagcagcggatcgccattgccagggccctgctgaaggatgcccagattgttgttctagatgaagccactgcttcgctggataatgagtcggaaaagaccatccagcatgccttggaaaacctgatggagcaacggacctcactggttatcgcccatagattgtcgaccatccacaacgccgatcaaattttggtggtggataacggcaagattgttgagcggggaacccatgatcagttgatgaatgagaatgggtattataagcagttgtatgaggcgcagtttgaataagagcgcgacgagggctgggtggcccggtttccaagaggactttgcttgaagcccccggttttggggcttcaagcaaagtcctcttggaagttagggtcaagcccgtcggagcgtgttttaaaggccgaagggagcacacaagaagctaataaacgtgctttgggttcagacccgggagtcgcagtttctaaagaagcccccgaccagcatagacgctgagtcgggggcttcttgaatacaatagcgaaagtaatggaccggtcaaagctttagcgtgtggttgaacccttctttcagattttaacgatatcctgaaaaggatacaatgtcgagaacatgctcatttatgctagacagttgtgagcataaaaaaagaaaaccccgcttcagttttaaaactgactcgggtttttcgtgactccaataacaaaagcaatagacgagctaaagccttagcgaacggtcgaaccgtcctttccttgctaataatatataagaatttcagcctcttgtcaaacattcatcaactattaattagtttggaaaatagttgataaaacttaattagtacaggctcatgagtataataatttgcatgcttgctagcccttttcagtaatttttgcccttcttttctggttaattcctgtgaccctacacttgaaaatcgtctatgtaaggaatacaagctaacgaggtcatttactttcatatcggttactaaagatgcatcaattcccatcttcgttgcaaacatgacaaccgttgtatttcgatgttttactttttcttcagcggaaaacagattaaccataatggcattattatgtgctgatgcatttcgaatatgctttgcatacttcaacaatatatgtgcaagcttaacatctttgtttctggagcggtgatagtaaaagtctacaaacctggaaaggacaccaaatgttgcgacttccaaaaacatccagatggaggggtgatttcggtgctttacatacatatcgtgcaagtaatcatttcgctttaagtatttcatagtttgatcataacctcgctgattaaatgtactgaagtccttcaccactgaatagccatcttcttctggatccttggttataagatcaattatccgagttttaattccatgttcaatgtccaatgagatcccaagtaagtatcgccgaagttgcatatcgatcgacgccaagtcggttaaatatgcaaaatctaaattttcatatttaccatcaatctgatgaaaattctttcgataggatgtcaacttgaaataataatttttagtcgccagcatttggattgcatcaggctctgatactaattcgaatctaattcccttgcccttcatgtgtttgatcatttgtagatatgtgtactttggttttatttagttcacctcccagcttattgaaattgtctgatcagcctgtcctactatgtatatacgataaattgagcgaggatatctatatagtttgtgaagtattggggcgatttagtgatcaaatcccaaaccagttttgttttcggacattttagtttacactaatcataaatacagaaaacgggtgacaatcaatgaagacaatttatgattacaaagaaaccgaaatgagcggtaagacgattgacttgagcgaattcaaaaataaagtcgttgtgattgtgaatactgccagcaagtgtggcctggcgcctcagttggagggcctggaagaattatataagaaatataagaatgagggcttggtcgtgttaggactgccttccaatcaattccaccaagagttgggaagtgatcaagaggccgatgattattgccggattcattatggtgtcaccttcccgatgactcgacgggttgccgttaatggggatggtgaggatccactgtttacccatcttaaagaagagtccggtcatggcaagattaaatggaactacactaaattcctggttggcaaagacggcaccctgattcatcgatatgcgccaattaccaagccggagtccatggaagaggctatttatacggccctcaatcaaaaaaatgtcttgtaagaaggtggaaagttgaatacgacctatttcaaagccaccattcgagagattacttatgcgtgggggaagtttatttcgatcgtcctaatcattttgttgggatcactgctgtatgtcgggattcgggcgactggtccggatttggacaattccgccgatcagtatttcgctcatcaaaatctcggggatttgacggtgacgtcaaccttgggattaaacaaccgagatctcaacttgattcgcgccgaccccaaggttcagactgccgaacccagccatatggtgacggtgaagaaatcgccgaatcaagtggtccaggtgtattcctatgccaaatcggcaaaattaaatcaactcaaattggcatctgggcatttaccccagaaagccgatcagattgtcttggaccaaaaagctaaggactacaagatcggcgaccgttaccgtttgccggcaaccgatggactcaccactaaaacttttaaagtggtcggattcgtcaactcaccgttatttgtcagttcaaccgaccgcggcaccaccaatgttggcagcggccaggtgaattattttgcctatgcgccggccgcggcctttaaccagaaagcgtacgcggccattgccgtgcgctttaacaacacggctcatttaacggctgggaccagcaagtacaaccagcaggtggatcacgataaagccaggctggaaagcaaactcaagcaacgcccagctcaacggcgggcagagatgattgccccgcagctaaagaagattgaccagcaacttgctcaacttcagaaacagcgccggaagctggcggctgtgccaagtgcctatcaaacagcaaccaccaaagcagccgctgccaaagttgctgccggcgtcaaacaactgacccaggccaaacggcaattacaaaagacgccccaagcgacttatctgtacaacgaccgaaccgccaacgtcggctaccaggattattttgatgagtccaaaagtatcgcggccatcgccgtcatttttccgggcttcttcttatttattgccgttttgatcacctttacgaccatttccagaatgattgaaaagaaccgccgagaaatcggtctcatgcgggcgctgggctacaccaaggacttcatttctatgaaatatgtcatttattcaattcttgcgggaattctgggatcaattgccggcggcgttttgggaaccttgaccctgcccaaatttattttcagcatgctcagcaataacaacctgactcactacgtcggcgtgattccctgggcatttatcatcgaggcgctcgtggccgggttgatcgccacccttggcagcgcggcagtggttctaatcattaatttacgtgaaaaaccgaccgagctgatgcgcgagcgggctcccaaagccggtaaacggattcttctcgagcgaatcaaaccgctgtggaaccggatgaatttcaaccaaaaggtcagttatcggaatctgttcagatataagacgcggatgattatgactatcgtcgggattgcaggttgtacaggcctgatgctggctggatttggcattcgggacagcgtcaacgatctgattcccgatcagttcaatcaagttcagcactaccaggggattgtcacgctgtccgatgctgataaacaggtgcatgatccaaacatcaaagcacagactgcggcgatggttcaatcgattaccgtctcaccaaccaaaggcaccaagcgaaatgcgacggtcaccatggtggcccccaagacaccgacgaaattgaacgattatgtttcattgaccagcactcaaaccggtcagtctgaaaaattaactaatcagggtgtcatcatcaccgaaaaattggccactgatatgcacgcaaaaaaaggcagcctgctttcagccaagctgggcaataagctgctgaaagttaaggttgccggggttaccaagaattacgcgggccattatctgtacatgacccccaagtatttcaatcaagtttcaacgacgacctattcatcgacttcacgcctgttgaagctcaagagtgagagtgccagccaacgacagaagacctcacggaacctgctgaaacaaagcggcgttatgaatgtgacttatccaaggtacgccagcagttcactgggcaccgttggtttaagctcagtcgtgctgatttttatcgctctgtcggctgcattaggactggtcgtgttatacaacctgaccaatgtcaacatctccgagcggatgcgtgaattgtcgacgatcaaggtattgggcttttacgataatgaggtcacggcctacgttgccagagaaaatgttgtgctgaccctggcagggatcgtctttggctggggcatcgggttaatcctccatcattttattatgatcaaggctcagaccggagcgattttgtttccgctgaccgttcattatccagggtacatctggtcagcggtcttaacggcctgcttcagcttagcagttggcgtgattacccattacaaactcaaacatattgatatgttggattccctggcagcttcggaatgatggatgccagtgtctaaataatgtccacacacaaactgccacaaaggtttttgcttttgtggcagtttttggtgttccagtaccaacctcagtttcaaatggatgttcagcagttaacccggttatgacgcacgtccccataaaaatttgaccaacaacttatcaacctgcgggttatcgtggagcttgctgtgctgcgcctgtgggccgacgattcgcttttcctggtaggatttgacttgtggtaccagatacctcaatgatttcgaggaggcattgctgacgtcgccgtccgagtgggtgccgtcgtttttgtcgccataaatattgagaatttcaagtgttttcaattgcttgtcgtggcgcaatcccagcaactcacggtaatgaccgttgatttttgttggctcaccatccgccttcaatttcatccggttgggggcatcatccattcccaggatgccgttgaaatgcccggcgatgtcgacttgcttctcgagcttgggcagcttggtgttgccggcgttgtccagtaaataaaagacgattgccatgttgccaacggaatggccgaccatgttcatcttcttaatgccgtagcgttgttgcagcttaacgaccacatttttcgcccattttccctgggtatgatagttggggtttcgtgaattcaaatagttcacttcaacgatcgggtggaagtcatctggtttgaaagtcccaaccaaggtgactttgccgctatttgaaacgtctgcgcgaatgaccgacttggtaacgccggttttgaccgctgcgttagccatgtgcgtttcagcgtggtaactgctgccgaagccgtggaaaaatagggttggggttgcctggctggcaccctgaattttgggtgtgcctgtggctgatgtggtgcaggcgctgagtaagccaattagtaggaataagccactcagtaaggccaaacgtcgtttcttcattgtttgcctccgttattgggaaagattctttttgccaatcattataagcggattgccgccaatgagaagcaactagcagtttgtctttccgcatttttgtgagattttgacaaaaaattcggaattcattctgaagaatgtgaacgatccccgttatcattacaaatgaagcatgaaagccatttacttttgttaaacggaaggctaatataggttgtgaactaattttacgaaatcttaatattcattcatttctgagggggaattgcatgaagttgactaggaccctggcttgttgtgggctttttttggcgttgacgatgattttctttgccgacccaagcactgcacaagccaagtttcatatttatcaccagcgctcgtccgccctgcacaagggatcgctgcgcaatctgaataacaaaaaggttcattatgtcaaagtgccaaagaagtattaccacgttgccaacactgatgttgagcacacgattaaatccgaacgcggcaagaaggtcagctttcatacccgttacattttgccgctgcctggtaagaacggccagcattggggaaatccacaatcgattgcgatgaatggtaaggggtatatgtacattgtctactgcccaactgatctacataacaaggggcgaattgttcgatttaacatcaagaagctggatgcgatgggcattcggctgcatccaaaagaactgcgggatgcttatcacaagcggcatggcaaatactccaagacccaacagaaaattcacaagtatattaaggcagggccgatatttaccactggtcatggtcaatccttggcatataactggaagaaccacggtttatatatgtggcgggatgtcgaaaaggcgcctcgggttccgatcaataattggggctatatccaacacatcaaggcttcgacgttgcggccggacttcgcgatccgctttcatctgcacagccacggaacatcggtacccggtggccacgatctaacctttgaccactccggtaacgcctacttctggtcatttcctggctggggcgcctacattttcaaaggcaaaattcaccacaaatcggttcactttcgattgacccatcaagtgctgaaacatttgccggggacccgaattcaaagcatgggctataacccggttcgaaagcgcctgttgatgctgtctgatgcatcgattgccagtttccctgcgaaacggctggatggccacggccatttgaccaacggcagctttgagtggacccagtttggccccaagcgtgaatttgagggaatcgcctatgatggcagttcccgaggcaatctattagtgaaccattgtccggaagttctacaggccgatcgatcgtattagtttttatccgaaattgaaaaaattgactagtattttcacaattgagcggtacacttatgttatatcaatataactaaatatctggaggggtatgtatgaaattgggaaagttatcggtggggatcgccacagcgattctattgagtacgtcgttggtgggcacggttgatgcagcgacatatgtgcaaaaaagtaacgtcatcagccaatattcaggcgccagcttacgcattttgaataatagcaaagtccagtttgtcaaagccaacgggaactatggctggtcaaggaaccccagcggtagtgagaccatcaagagtgtccatggtacaaaatggacattgaagaccaaatatctcctcccaagtacgcatatggcattggggaaatccagtcgtgatttgaccaatcctcaagctgctgcgtttggcgggaaatatctgttcgtgctgtatgcaccgcaccaatttcatgggaagggctttgtggtcagatataaccgcagtaccctggatcatatgagtttggccaaggctcaagattctctgcttaaaaagactgccggtatgaaagttggcccaatgtttgatgtcggtcacggccaatcgctggcttacaataagaagcagcattcaatttggatgtggcgggatcgggctgacatgaagccgactgcctggtcaaccattcaacgaatcagcatgtcgtcgctgaagccaaatcgtgccattaagttccacatgaataaccgtggtgcaatggtgccggccggccatgacctaacgtttgacaactcaggtaacgcttattggtgggggatttccggcggccacgttaaaatttacaagggcaagctgggcagccgttcgattcatgttcgtttagccaagcagctgttgagaaagcagaccggaactcaccagcaatctatggggtataatccgcacaacggccgactgtacctggtttccgatgactcaattcaaaccctgccggctcgtaaattaaacggccgtggcagtttgcgtccaagtgacatcaaatacactcgctttaattctcaccgcgagtttgaaagcatgatttttgactcgaccgggcacgccatgctgctatcgaaccgtaatccggaactattacgttcaacaaccagatattaataccattaaaatccgtcagatcaaggctgctgccttggtgacggattttttgaggctttatgttgacacggtgtcaccgatggggtatactcagttcataaattgatgacacggtgtcatacgcaaaggagaacaattatggtatcaacaacctttaccaatctaagtgatgagaagcagaccaaaattcgaaaagccttactcaaggaatttacagatcaaccactggcaaccgctcaagttgccccgatcgtcaagactgctgggattgcccggggggccttttataagtattttgatgatctaaccgacgcttacaaatatttatacggcgtggcgatgcgcgatattcacagtgatgtgaacaacgaggtgggaactgaatttgacccgcagttttatttggatcaagtcgaggcgttcatcaaaggtgctcgcgatagtcagtatctgggattgatcaagatgcacctaatgaaaaatgaatcactgatttcgcaaggatcaattgaccccaacacggttagttcccgggaatgggcgacgatgatcctcagtcatgaggccattaagcaaatcatgattgagccgcaaaatgaatcagtagtcatgaaaaagttttctgaaacattgaacttgttagccgggaaggggaatgcataatgtatttggcactaaaagaaattcgacacgaaaagttgaggtatggcctaattattgccatggtggccttgattgcatacttaatttttatcctgacgggtttggcattcggattggctggggaaaacactcaggcgatcaattcctgggatgccaagagcgtggtcttgaataaggattccaatattaatctgtctcagtcgacgattaccaatgcccaagccaaggacgacaaactatcggataaggaatcagtgattggatcgacgccggtggttgccaaacacaaaggtcaagaaaagatttctgcccaatttgtcggcatcaagaagagtgagttcatctataaggggttgaaaatttctgcaggacataaggcccgcaacaaccatcaagtggtggttgatgaaaagttcaagaccgatggctacaaactcggggacaaggtgacgttgaactctgtgagtgacaaatatgaaattgtcgggttcactaagaacgctaagttaaacattgccccagtgatttatggtagtctgccaacgtggaaacatttgcgggggatggaccgggttccgattgccggcagtgcgattgtgtcaaagaatgctaagtacagtgctcacaatagccagttgaagacgtattcgatgaacgaattcattaataagttgcccggctattctgcgcaaaacacgacttttggtttcatgatcggctttttgatgattatttcattagtgatcattgccgtgttcctgtacattttgaccatgcaggctctgccaacctacgcagtattgcgggcccaggggattccagcgagagctttggtgacgacaattaccagccagtcattgatcttgatggcctcgggaattatcatcggtggcctcttggcggctctgacgggatcgttaattccggtcggtgtgccgatggcatttgatattccggtgctcacctggatttccattggcttgatgattatgggcgtcattggtgcggcaattccggcgcaaaagatcgcaaccgttgaccctgtcagtgttattggaggttagttatgtcagtgattgaattaaaaaacattaataagtactttggatccggtattagcaaggtccacgttttgaaggatgtcaattttgcggctgatcggggacagttgatcctagtggttggtccctctggatcagggaaaagtaccttcttgaccattgcgggtggcctgcagacgccatcctccggttcagtggaagttgaaggtcaagcagttgagtcactcacaaaagcgcagcgagatcagctgcggttaaatcaaatcggctttgtccttcaatcatataatctggtgccgtacctgaaagtcaaagaacaatttgagtttgtggataaaatcaagcatgagggtaatttagatcagaaagaattagcagatttgcttgatcagctgggcatttctcagttggtcaaccagttccccggcgaactgtctgggggccaaactcaaagagtggcgattgccagagcactgtatgccaatccggatattgtgttggccgatgaaccaacagctgcccttgatagtgaaaaggttgccgaggtcggccgactgttcaaaaatctcgcagaaaccaggaataaggcggtggtcgtggtcacccatgatctccggttgctggattttgcggataagacttatgagattttggatgggaagattagtcttaaggataaggagcatgtcacggatcggtaaactacatgttatagctcaaagaatacctgctttatacctatcattttcgttgactaccagccggaaaatgtggcaaaaaggacgctacagtaaaagcaaataatcataaaaaagtgaacccctgcctgggttccctttttcatatttggtgattgccaactaccgggtttgtccaatgaccttttggtaggagaacaattgacaacaaaatagcatggtagttaccaaagaagttaagacttttgagcgacgttggtcaaagtaaccgtactaaaactagtgagtcgattgccattatgaatcgcaactcgccacgtttgcaagtgcccgccggcatgcaacggggtggcggttgccaccagcttgccatcaaaaaccggcagcaaatgctgagtagtgatgtcgacgcccactgcgtaatggctgttatccaatcgttcgttggcaccgattgaagccgccgtttcggccaacaccgagttgatgccgccgtgaagaattccgtatggctgtttgaccgaatcggtaacttctagtgatataataacctcagcttggctgacagagacagttttgataccaagcaattcaattaagttagacaaagtattcacactccaattttgaaaggatcgagattatgacttcagttaaatgggaatcggtaaaagattaccaggaaattatttttgaacgggccgataaaatcgcaaagattacgatgaaccggccggaaaaaatgaatgcttttacaccactgaccatccaggagatgattgatgcattcaatatctgtcgtgatgatagcacaatcggcgtgattatcctaaccggcgctggcgacaaagccttttcttctggcggtgatcagggggttcgggggaatggcggctatgttggttcagaccacattgcccggctaaatgtgctggatcttcagcatttaattcgaatcatccccaaacccgtgattgccatggttaaaggttggtcagttggcggcggcaacattcttcagctggtatgtgatttgacgattgcagctgacaacgctcaatttgggcagacaggcccgaaagtcggcagctttgatgctggctacggatccggttatttggcccgggtgattggccataaacgagccaaagaagtctggttcttaaaccatttctacagtgcacaagaggcttatgaaatgaactggatcaataaagtggtcccactttcagaggttgagtcggccacattggattggtgtaacgaaattctccagaaatcgccaaccgcgcttcgattcatcaaggcagccatgaatgctgataccgatggtttggctggccttcagcagttgggtggggatgccacgatgctcttttacaccactgatgagggcaaagagggccgggacgccttcaatcaaaaacgacagcctgattttgatcaatttcctaagtttccataggaaggttgatgaaagtggataattggattttaaagcaggcggaaactgcccctggtcggctcgcggtcgatgacggcaacacccagctaacgtttctggaactcaagcagcaggtttctcaactggctggacaattgaaggctgcctccgtgttggatggcgatcgagttgggattatgaccaagaattctttactaggctatctgatggccatggcggtcttaggatccggtaagacaatcgtttggattaattggcgtttgtctgatgatgaaatccatcgccaattatcagatagtgaaccagcggcctgtctggtggcggatgatctttttcgagaaagttttgaccaacggtttattacctttagcacgataactgatcaagcggcggttcagatcacattagttcccgaatttcgctctcaagaggtggccagcattatgtatacgtctgggacgactggtagacccaaaggtgtgatgcagacctttggcaatcacctcgcctcagcaaccgcctcagcttttaaccttggggtcatgccgggtgacgagtggctttgctccgtcccaatttttcatatcagcggtttttcgattatgatgcgtggcttgatatatggaatggcagtccgcttggtcggccacttcaatgctgaattgattgactacgtattgaaacatgaacccatttcgacgatttcggttgtcccgtacatgttaaagcaattattaaaatatcgaacggctgataacacaccatatcaggccaattttcagcgcatgctgctgggtggtgggccaattgatcgccaaacccttcagcaatgtcgtcaactccaagtcccggtggttcagtcatatgggatgacggaaacctgttcacaaatcattgccttgaactcagcggatgctgacaagcgaattggctcggttggcaagccactgtttctgactcagttaacgttaagtcaagttaatcaggaagtgctgatcaaaacgccggcattgactccgggttacttgaaccgacaggctgcttttcaagataagctaaatgacaccggctggtatcgaaccggtgatgttggtcattttgatgatgatggctttttatacattgatggcagactggatgatatgattatttctggtggcgaaaatatctttccggatgaggttgaagccgtttatgtcaatcggtcagacatcggcgagattgccgtggttggccaagatgatgccaaatggggtcaagtgcccgttgcgtttgtggtcagcgatgcgcccttagatcaggtagacctgatcacttatggcagacagaagttagcccactacaaggtaccaacgagatttattagaattgacaaacttcccaccaatgtcagcggtaaggtgcagcgattcaagctgaaacagttgttataaaatgaaacgttaacaagctcgcaatcatgagtaaatcattttactcaggttgcgggcttgttttggcttaaaagtgagttaaaccggtttacatcagcctcgtgtaacatgttaacaaaggtggaacaaactccatcgttgttctgacggcgtctagaaggcctcagactatatattttagcgcttacatccgttatattaagagcgtaaagaaatcctcgagaatttctgagatccaaacgacaaacaaaattataggagatgccaattatgaaacgagactttattgataccaacacatacacccgagaagaaatccaatacctgatcaacttaggtttacaaattaaacgcgacattaagaatggaaactatcccgacttattatcacatcggacactgggaatgatttttgaagaatcatctacacgaacccgagtatcatttgaaactgcaatgactcaacttggcggtcacgctcagtacctcgcaccaggtcaaattcatttaggttcagctgaaagtgaatcacttggcgacaccgcaattgttctttcccgcttggttgatatcctgatggccagagttgccaaacattcgacagttgaaaaattagctgaaactgccacggttccagttcttaacggaatgagtgattacaaccatccaactcaagaaatcggcgacatcatcaccatggcagagcatttaccagcaggtaagaaactcagcgactgcaaggttgtcttcgtcggtgacgccactcaggtttgtgtatcattaatgttcattgcttctaagatgggcatgaaattcgttcaattcggaccaaagggttatcaaatcaagccggaaaccttggaaatcggcaagaagaatgccgaagtatcaggtggtagcgttgaaatcaccgaagatgccgacgcagcgatgaaagatgccgattttgtttacaccgacgtttggtatggtttgtacgaagccccactttcatacgatgaaagaatgaagatcttctatcctaagtaccaagttaatgacgatttaatggctaaaggcaccagccacacaatgttcatgcattgcttaccagccaaccgcggcgaagaagttactgacagcgtgatcgactcaccacactcaattgcctgggatgaagccgaaaaccgtttgactgcaatgcgcgctttgctggtctacttgatggcaccacggatgaactacaccgaaaaacaattggatgatttgaacgatcctaaattgaagtcgatgatcttaaacttagttgacgacacgactcattaatgagctgacgcaacggatgtgcaggtgaaagaaatgcaaaaagagaaaaaatttagactatttgatgccgtgctgatgtcggtggtcgttgttctggtggttgaatcagttgctccggcagccgcaatcggcccgtcgcaattcttctggtggggaatcctgttggtattcttcttcctgccatacgggttgatttctgccgaactagggacgacctatgacgaagacggcgggatttatgactgggtgagaaaagcctttggccgccgttggggtggtcgggcagcttggctgtactggatcaacttcccaatttggatggccagcctggccgttctgtttaccggcgttattggccaagtcttcccgactcatttcgggacgtggaccaacgtcttaatccagttggtcttcatcgggattgtcactttgatttcctcatatccagttgccgacagtaaatggattttgaatctggctgcgattgccaaagtgattatcatggtcagcctgggtgctttgggcatttacgttgccatgaccaaaggcgttgccagcaacttcaccgttaagacgatgctgccgcaaatggacgttaaaagtcttggctacatctcagtgatcctatttaacttccttggttttgaagtggttacttccatggccagtgaaatgcctaatccaaagaaacaaattccccaagccattatctggggcggtatcttaatcgctgtcttctatgtctttgccgcatttggtatgggcgtggcaattccaagcagcgaattgtcaacttccagtggtttgatggaaagtatcctacttttgatcggtgggaataattggttcgtcatcctgatcgcgttactgtttatgtatacgttagctgccaacctgatttcctggtcagccggggtgaactacgttgcctcatacgctgccaagaaccacgatttgccaaaggtatttggcattgaaagcaaaaagaccgggatgccaaccggcgccaatctgttgaacggtgggattgcagccgttctggtggtcatttccccactcattcctaatcaaaacattttctgggcattcttctcactgaacgtcgttgccttgttgggctcatacctactgatgttcccatcattctggaaactccgcaaaattgatcctgatactgagcggccattcaaagttcccggcaaccatttgatgattaacttgatgacttggattccggtggcattgcttgccatcacgacgattctgtcagcattcccactcaacggcagtgccgaagagcttaacaccaagattccaattttaattggaacgatcatcacaatcttacttggtgaggtctgcatcagagccgctgaaaagaatcatccgttgaagaaaaaagtcaaggcgagcagtcaccacacagaagaagccttaagtaaaaactaatttctgaatctaatgcaagaggagcaaatacgatgaaaactttacaatcatcacctaaaaaagatggatacagaatgcccggcgagtttgaacatcacaagggtgtctacattctttggccagagcggccggataactggcgcaatggtgccaaaccagctcagcatacgtttgtgaacgtggcgaaagcgatttcccagttcgagcacgtaacggttggggtttcagatgcccaatatgccaatgcccgtcatatgctgccagacgaggttgaagtggttgaaatttccagtgacgattcctggatccgagactgcggcccaacgtttgtcgtcaatgacgatggcgacctccgcggtgtcgattggacatttaacgcttggggcggcttggttgacggcctgtacttcccatgggacaaagacgaccgggttgcacaaaaagtgactgaaatggagcatgccgaccgttaccgtttggacgacttcattttggaaggcggctcaattcatgtggatggtgagggaacgctgatcaccactgaagaatgcctgctttcaaagggacgcaattctcagttatccaaagaacaaattgaaaacgtcttgaaggaatatctcaatttggacaaagtcatttggctcaaacgcgggatctacctggatgaaaccaatggtcacgtggacaacattgccaacttcgttaaacctggtgtcgttgcccttgcctggaccgatgaccaaaacgatccgcaatatgagatttccaaagaaaactacgacattttaagcaacgcaaccgatgccaaaggccgcaagattcaagttgaaaagctttatgtacccaagccggtaactattaccaaagaagaaagcgaaggcgttgatgccgttgacggcagtctgccacgtcgtgaaggtgaccgcttggctgccagctacgtcaactattacacagccaatggcggaattgtcttcccaacctttgacgatccaaacgatgctaaagcgcaagaaactctgcagcgcttgtacccagaccgcaagattgtcggcgttcctgcccgagaaatcttactcggtggcggtaacattcactgcatcactcaacaagtgccagctggcagataggaggaatcgcaatggccaaaattgtcgtcgcattaggtggaaatgccatcctctcaaaggatgcttccgctcaagcgcaaatgaaggcagttaaaaagactgccaaagagttggttaaatttatcaagaacggtgatcagttgatcatcactcacggaaatggtccccaagtcggcaacttattgcttcagcaaaatgccgccgacagtgaagccaatccggcaatgccgctggacacctgtggtgccatgacccagggcagcattggctactggttccaaaatgccatgaaggaagagctcctgaataacggcatcgataaagatgttatggcaattgtcacccagacgatcgttgatgaagacgatccagcctttgaaaatccttccaagccgattggtcctttctataaggaaacggatttgcctgagatcaagtcactgcaccctgactgggaaatcattgaagattccggtcgcggctaccgacgggtggttccatcaccgaaaccgctagaaattaacgagtacgcagcgatcaagaaggtcgttgacgcaggtatcgtgccaatcgtttccggtggcggcggcattcccgttgtcaaaaaaggcaaccgcttaattgggaaggaagccgtgatcgacaaagatttcagtgcttcaaagatcgcccaattaattgatgccgacaaattgatcatcttgacgtctgccggaggggtttactacaactacggcaagcctgatcaagttgagctcaaagaagtcggcattgacgacattcaaaagcacattgatgccaatgaattcgccaagggcagtatgatgcccaaggttcaagcagcagtcgcctttgtccgcagtaccggcaatcccgctgtgatcggtgatttggaagatgttgaacaaatcatcgaaggcaacgaaggcacaactatcgttaaggatgctgttcccgcagcagttaaatagtttaaaatgaacgaggcatggacgaaacgacggttttgtttacgcctcgttttgcgtcgattgatggggtattagcagaatgatagtgctttcacagcaaaaatgttatgattgagcgagaaaatatcgaggtagataatgaagatcaaaaagacaactccacaagaggataaatacaatgtggtccctgaatggcgtcaacaccagcaggcttacatgatgtggccggaacgcacggataactggcgggagggagccaaaccagctcaaaaagttttcagcgaagtcgctgcgaagattagtcggtatgagccgctgacaatgctggtttcgcgtcaacaatacgagcacgccctgcatgccttgccggaatcggttcgggtggtggaaatgagttacaacgatgcttggatgcgggatgtcggcccaacttacttggtcaacgcccaaaataacgttcgagccgtcagttggcagttcaatgcctggggcgggctggtcgatggcctttatttcccgtgggatcaggacaacctggtatctgggaaagtcagtgatttggaccggattgactactatgacgctgattttgtcttggaaggatccgcgtaccagaccgatggcgaagggacgctgattgccactgaagaatcggtcttatccgaggggcgcaacggccaagttgatcaggcagatgttgaagcggtttttaaacgctatttgaacgtcaccaagattatttggttgtcccgcggctacttcatggatgaaaccaatggcgatgtggacaacatggtcaactttgtccgccctggcgaagtggccttaacctggaccgaatatcaaactgatccaatgtatgaaatctgccatgaagccttggcaactctagaggcggcgaccgatgcgtccggcaggcatttcaagattcaccgggtccagatgcccaaaccattattaatcaccaaagccgagagtgaaggcgttgacccggtcaacggtcggctgccgcgttacgaaggtgatcgtttgatggccacttacattaactgttacttggcgaacggcgccgtgattctgcccatttttggcgatgagcacgaccaggcggccatcgaccaatataccaaaatctttccagatcgaaaaattgaacccgtgtacgcccgtgagctgctgcttggcggcggcgatattcactcgatcgtcctcggggttccagattagaggttttatatgaacttttttgagatcattaaaccatatgtcgaaaaattaaataaaaatgaatacggcttactcgactatgtgatcaagaatatggataaaatccaaaacaagagtatccgagaaattgcggcggcctgttatgtttcgaccaccacttttttgcgttttgtcagaaaaatcggtttctccggttatagtgaatttagcaccgtgattaagtacacggtcctcaacagcgataagcaggaagacaaggctgaaccgtttgttgaagaacagtccaagtatcgtaacgaatatctgaaaaatattgaggaaaccgtgcgggtgcttgatgagcgcaaactgttaaaaatctgtcaggtgttagaccaccagcccaaactgtacttttttgccaaaggcttcagtaagtactctgccgaatacattgaatacttatataccttgaacggcttcatcgtaattttccccaagaatcacgagcagcgccggctggcctaccgtaacgtacagctcaacgacgttgtctttgtttttgattatgaaggtgaggatgatgaactgattcaaattattcaaaatctgcaaagccaaaaggaatacgccttgctggtttcaattaccggcgcgaataacaatacgattcaaaacatgagtgacgaaaacctctatctgttcacggacgaactcaaagtcagcggagttgatatgacgtcgcacgtttctttgattgtgattatggaattgctgctgtatcaatttatggagtatgagaagtcaaaacgatagtgtgttggaagctgacagtttagttttccgtacccgattttgtttgtcttcaagcccacatatggtaaaattcaagaaacaaattgattcgaaaggaatttgagatggcaaacaactcgcaacaagagctcttaaaaacaatccatcaggctaaacctgaaaagctaaagaatgtgctgctaaaaatgggatcccttgaccccgacatggctgcattaattttggcgatttttaacgatattcctgttgatttagatatcgacgccggctttgaagttgatcatgatactgtcgaggcagatccactaccatcaaccaatccggataccgacccgcaagcgattgaagaagaaattcgccatgttcgcggcgttatttccaaccagcttcagattgcccgtgagtctgactgggactggaacggtatgaacaatttggtcaacttcttttctgacctgctaggggaagtcattgacgataccggtgaactcaaagtcccgtttgcattaggcttcccagttgccctaatggtggtccaaaatcaaatgaaggtcttttcagaggatagcctttcgccgatgactctggaggattcagttaacaatgtgttgggcgttatcatcgatttgatcaatgaatccggcagtcatttgccagtgaatgaacgtgaaaaatatttggaccaagcgctgaaactgttcggcagtccagtgttcaaagatttggaagcttttcgatatgagtttatcgatgacgttctcggtttggtcactaagcagactgccaataaagtcattaaggcctctgaaagaattatgaagcaaagtactttgtgggatgaagatcaacgcaagaaacatcacctgatgttgcggttacatctttacctggcactgggagatttgggggtcgcccaagagatagccatcgcaaatatggacgatgacgatgtccgcaaacaatggttttttgtcttgaaaagccgccatcgttatgatgaagccaaagaattggcacttgacgttccccgatatctaagaaaagaatgggacgaattgttgtccaatatgtatcaggaattgggtgagaccgacgaattaattgcgctgttgaggaagcggttgttaaaccatcaaaccgccgtctaccaacaatataagcagctgttagtcgagcgtcatgagtggcagagggtttaccctgatttgttgaaacaactggaaacaaagctgacgcgctatgaatatggtgatattttagctttggaacaggagtattcaaagttgtttgaacaactgaagaagtatcaaagcgcaccaatgatccggaattatctgcgacagatttatccggcggtcaaagataaaatgattccactgtatcacgatgttgtcttgattcctcaatcccagaagacagccgccaatgcgccaaaacagctcgagaaggatttaagcaacttcttggaaattagccacgatgccaccacagttcaaaaatgggtggatgaacttaaacagcgcctgagcggccaaaccagctttttagagggactggaaatcgttcagactcaaattaatacagttgtatagtcaaaaagttccactctaagccacctagacagcttggagtggaatttttattgaacgccacatcaaaaaggcggccgcagcacaagtctttcaacttgtactgtggccgcctttcagctttaaaaactagctcttcttttcttcaaacaaaacgcgcttacgcagctttggtgaatacttcattagctttaaccggtctgggttgttacgacggttcttggtggtcaggtattcttcaccagtttctttgttatgcattacaacatgaattctcattatcttacctcctcacgaatggtaattgttatcattacaaatataaagcactgaccgaatttgtcaagtcatcctcactggttgaactggtttgagcttcgattggcaaacaaaaatcatttagttattgtactggtaccagactgctttcccgtttgtcaccagcccgggctcttaatgcccacagaatggtcacggtatcgacgacttcctggaagagggcgccgatgatcgcggggatgacgccaaaactggcgattaacatcaaaatcgtacagatagcgattccaatcaaaacggattgacgagcaacgttcatggtgtcgtctgagattttgaccgctttactgaccaggcttaaatcgtctttgaggacgacggcatctgctgattcactggcggcagtggctccgtgagcacccatggcgatgccgacgtcagccattgccaatgatggggcatcgttaacaccatcgccaaccatcacgaccgggcggaacttcttttcaaccttttcaatgacggaaattttttcttccggcagccgctcagcgtaaactttatcaatgccaactcgatcggcgatttcttctgcgatcggttttcggtctcctgagatcatcatgatttctgtggcgcccatctgatggagactatccatcacagccttggcttccggtcgtaattcatctgagaaggccacgtacccgacatatttgccattgacggatacgtagactgccgtttgatcaagcgggtcaattgggtcatcggaaacataagccggtttcccaacccgaatcgtttgctgatcaatggttgcctggactccttgggcagtggtttcaataacgttggtggcagtcggaatttgatccggaatcgccgccaccagtgaacgggcgagaatgtggctggattgctgttcggctccggcagctagcgccaagacctgatctttggtgtaaccagctatcgcgaagacccggctgacggtcaaatgccctttggtaatcgtcccggttttgtcgaaggcaaacgttttggcattggccagcttttcgataatcgtcccactcttgacaatgatcccatttcgactggcacggctcatgccggatactaaggcaattggcgcagctaaaatcagtgggcacggtgaggcaaccaccaggacttctgcaaaccggactggatctttggacaggtaccaagctactccggcgatgacgtaagccagtaaggtgaatggcacggcgtagcggtccgccatccggacgaagtgggcaggggtgctctcagcctgtttaactaatcggatgatgttttggtactggctgtcatcggccgttttgtcagcaatcatgtcaaaggaggcatcgccgttaatcgccccggacatgacggtcgatccaaccactttatcgatggggcgggattccccggtcagagaggattcatcaactgacgtcacaccatcggtaatcgtgccgtcaactgggatgacttccccaggcttaacaacaatccggtcgccgacagtgacctggtcaattttgacgtcgaccattttgtcatctttcagcaaatgagcggattggggcgaattctccagcagtgactgaagctcagagttagctttgttggccgcataatcttccaaagtgtcgccgccggttaacattagcaaaacgatgagagcggcccaatactcgcccacggcaatcgttgcgatgacggcggtaatggccagcaggtcgacaccaaattttccggatcgcaaagttttcaccatgtcgataaacatcaaaagggcgattagtgaccccagcgttgagataacgatctgggcataaagcggcaagcgcagcccaaattgtagaaccaaggcgatcaccgcgacaattaagacgccaattagacgcatgtagttggttagtttgttcataataagccctccaatccggtttaatcttctatctagattataacaattctaaagtagaaaggcgagctataactccatgggttatcattttcaggcagaatatgtacaaaaatggcccgccatcatcgggcaggccagtgagacattattgggattatttggaaagttgactcaaagcttcaaagtcttcatcactcaatttaacattagcagcagcgacgttatcctccaagtgttgaatcgagctggttccaggaatcggtaaaatgtttggtgaacgtttgagtaaccaagccaaagcaatctgggcttctgagacaccatactttttggcgatggtgctgagtggactatcggcgccaattaaacgaccggtgtccagtgggaaccatggtaaaaaggccatcccttgggattgtgcgtagtccaccacatcgtcatccttgtggttggaaacgttatagaggttttccacagcgtcaatcttggcgtacttttgggcttctttgagttgatcaacactgacttggctcaagccgatatgcctaatcttaccttcatcctgcatcttcttgagttcaccaacctgctcagcgactgggaagtgactgtcaattcggtgaaggaagaccaaatcttcgtgatcaatccccaaagtcatcatagaaacttcgacttgctggcgcaggtagttgggctcaccatgaggtgtccagataccagggccttggcgggtttgaccaaccttatcagaaatgaaaatctggtcacggttggcggcgccctttaagccttcagccagatagcgatcggcgaaccacggaccgtaagaatcggcagtgtcaaaaaagttgattccaagttcagtcgcgtgggtaacaacatcggctgcacgggcagggtcagcgtatggaccccaagtgcctttaccagtcagctgcatggtcccgtaccccaggcggttgacgacaaattgatcatcaaatttgtaagtgccagcgtttgctgcatttagttcagtcatcaaatacacttctttctgacaataatttggtacaggtctattttcaaaccgttgctgcctgatgtcaatcaaacaaacgcgcaatcgtttgtggttagttaattttacgaaaaatgacaaaaagttgttatccaagctatacggatgggtcagcaccctgtaaaatattgtatacttacgttgataagagagatttatgaatagctgtgtttgattggggaatccatacagaaggtgaaaacgatggcagtaaagtattatggcgtgatgatggtgaatgttcagggctctgaattgttgatcgtgaatttaaagaacctgaagccactcgagcacgtcaaaaaagatattaacctgggagacgatgtctatcaggaccaacccgtgaagtacgaatccgttaatcgggtgtccgaagctttgaccggatttattcaaattttgaatgattacggtgtgaccaactacaaactatttggcagcaatgcccttcaccaagcgatcaactcagattttattgccgatcagctctttttacataccggcatgaatattgagtggctttcaacaagtgaagaaacttatttcagaaatcaaaacatttcagttgagttgacgaaggataagcaaaacgataagcgcaccacttttttggtgggcatcacttctggaaatactgccattacggagttcaaggaaggtaaatttgtcgactccaccagttttgccttggggccaatcaaaattgccgaggacttgcagagcctgcggcaaacggcacccaattcaattgggctgttgaacgattacattgattccaaattgaacgacttttacatcgggaatcctgccagcgtcgtgtccagcaaagttcccaccaagatcattttgctggggtcgctgcctttgcaacggctggtggaaaattacgagcacactaaggccagcgacacgattactgccagcgatttcactggattagtggacgacttggtggatgcttccgatcaatttttgattgaacggctccaagttgatccggactacattcccttggtgctgccggaactgctgttgaccagacggattttgagattaaccaatgcttctgaaatcgggttttccgattctggggtcgttgatggtctggtcaatcaggaagccttggaacagggctactcaaaacgggatttcacacccgagattattcgtttggctttaaacctttccaaacactatgatgttgagccggtccaccgggatttggtaactaaatttgcccttcatttatttgatcagttaaagccgctgcaccaactgggccgccgtgagcgaatcctgcttcaggttgcctcaattctccacgatgttgggaactacgttggcatccatgaacactacctgcattccgagtatattattctccattcagaaatcattgggttgtcccgggatgatattcgggtgatcgccgcaattgccagatatcacagttcgacgacgcctaatgaagacttaattcactttcagcatatctcagctgaaagccggcgattaattgccaagttagcggcaattctgcgtttggcagatgccttggacgacgaccgccagcagaagattaaaaaaatctcggtttcaatcaaggaatctaaagttgtcatcacaacgttcagcaatgccaatctggcctacgaaaactggatcttcaacaccaagagtcagttctttactgaagcatatggttataaggccgttctcaaacaaaggggtgtaaaggcaaaatgacagacaaaattgattttaaaaatcccaaatactataacaaccgcgaactgagttggctggattttaacgaacgcgtcctagaagaagcccgggataaaaacaatccattattagaacgggtcaaattcctagggatcacccaaagtaacctcgatgagtgggtcatggttcgggtagcttcactggcaaaattggttgaagttaagtgggatggcaaagattcatccggccgttctgcagaagaacagctccgggacgtcaacgtgaaagcccatgagatgttggttcggcaatacagcaccttaaaccgctcgttgttgccggcgctcaaccaggtcgacattcatttactaaaagtgggtgacttaacccccgagcaataccagttcattaaaggatacttccacgatgagctttatccagtgctcaccccaatggcggatgacagttcgcgcccgtttccatttattaataatgactcattgaatttgtcactgcggcttaacaagaaagatgatgaggagggcaagacactgtatgcgacgcttcaagtccccagcatcttctcacgggtcatcaaactgcccggtggcgataacgattttattttaattgaagatattattaagcaattcgtcgatcaattattcattaactacacgatcaaagaagtcagtgtcttccgggtgattcgggacatggacctggatgttgctgaagaagatacctctgacctgttgaaaaaggttcaacagcagctgaagttgcgtgagcacggccaagtgattcgtttggaagtggattcaactatcagcagcaagctgcgaaagcggctggtcaaggaacttcagacggccgaagattcggtctatgaagttaatggcccacttgacttgaccttcatgagcaaattagctggtaaggtgatcggtcatgatgatttgaaatatcgaccgttcaagccttatcaaccggcagctttagactccaatcacaacatttttgatgccattcaaaagcatgactggctgatgcagcatccatacgacaaatttgattctgtcgttgaatttatccgtcaggcatccgttgatagtgaggtcttagcgatcaagatgaccctctatcgggtatccggtgattcgccaatcatcaaatatctgggacgagctgctcaaaatggcaagcaggtgacggttctagttgaagttaaagcgcgatttgatgaggaaaacaacgtccactgggcccgtcagctggaaaagatgggctgccatgtgatttatggcctggttgggttaaagacccactccaagctgtcattagtcgttcgtcgagaagaaaatgggattcgccgttacgtgcacatgggaactgggaactataacgacgtgactgcccacttctacaccgatttgggcttgttgacctgcaatactgatatcggcattgacgttacgaatatttttaacatgttatccggttattcacggccgccatactttcaccagctgcatatttcaccaaatgggattcgtgaatttatcaccgaacgattggatgaagcaattaaatatgccaagcagggcaaaccggttcatgttcaaatgaagatgaattcgctgtctgatcaggatatgatcgccaaattgtatgaagcatcccacgctggcgtaaccgttgatttgattatccgaggaatctgctgcttaaagaccggcatcaaagatgtcagtgatcatatcacggtccattcgatcgttggtcgattcttggaacacagtcggatttacttgtttaattttgacggtgaacaacaagtttatcttgccagtgccgatctgatgactcggaatttgaaccgacgagttgagcagatgtttccagtccttcaaccggatttggcccagcgagtggtcagcatctacaccaccatgtggaatgataacgtcaagacaagaaccttggataagaacggtgtctacaaacgagtggacagaagaggccgtgagccattggattctcaagaattctttgcagctcaggcaactcggttgaccgaggctcagcaaggagagaatcggcccaagagtggggcccagtttcagccaatgatgagcccacaaaatcagcctgatccattcaatgatgaagatgggggcgacaaccagtaatggaaaatttggcggtgattgatttaggatccaactcagtgcggatgaccattagccgaatcagtgacgatggcacctacgagacagttgctcaagaaaaggaatatgttcgactgtctgaaaatatgggggttgagaaaattcttcagcccgaagccattgagcggactatcagtgctttgaagaacttcaaaacgatttattcaaagcttgaccatctcaacattgttgcggtggccacagcggcagttcgacaagcgaccaaccagaagcaatttttaaaacgggtcaaaaatgacattggcattaacctcaacgtgatttccgggacccgggaagcttactatgattatgttggtgtcagcgagacattgccggcaactaatgcggtgattatcgataccggcggtgccagtgccgagatcgtcctggttcaaaacggcaaagtcagcaacctgatcagtattccaattgggtcagtcaccttatcatcaaaatttgatttggctgacgacattgcggcgactgaagtctttaaagcaatgattttcgttaacaaaatttttcaaagtgtctggtggctgcgaaacggtttgaacttgccaattattggtttgggcggcagtaatcgaaccctggccaagattaatcggcgtttcaataatctgttggataccaatgatatccacggctatcaattgcgggatgacgccattaatgaaacttttgagcgcattattggcatgaatcttgacgaacgcaaaaaggttcccggaattaacaaggaacgggctgatattattgtcggcggtctgatccccgtcattttactgatgaactatttggattcagacagaattatgttttcaaccagcggcctgcgagaggggatcttgttcgaacggctgcatgatattattcaagagaatattaaaaccaaggaataattaaattctttcattcactcaaaaatgggcttgggcaaaactaactgttttgctcaggcccatttgtgctgtaattttcaatattgtctgtttaactagcgggaagcttaccgtctattttcccacactcgcggtatctgtcccactcaaccgttcaaagaacagcaggtgtttttgtgagaaccagtcaatcagtaagtcgacaaagaccagcagcagaccaaacgatagaatcagtacaacgtggagaatgctggttaactgggctttgggcgcggttgccgtcatgtctaaaagccggccgacaatctcgtaaaggccactgatcaccccgtagccaaacaaattccggattaagattttcgaccagctggctgtttggccattacggtcaatcactttgatgccaaccaggcgcatgccaatcgtctgctggcggctgagttccagtaccagaataaagatgacaaagccaatcgcgatgccaatccagtgtggaatcaggaaaatgcccaaaatattggtcaacagaccaatgatgatccaatccactgccaaagcgactccacgccgcagcggcgaaacgtttttactgagcgccattgtccgggttctgacctgttccttggttggcagaaaacggccaagcagagaagctccccaagcaccgatgatcccaccagtggtatttaacagcaggtcgtcgacatcgaatagtcgataaggacggggatagatgccgtaaagaccggagagctgggttaactcgaagaatagggataagcagaatgtgaataagatcgtctgtttccatgaccgctggaaataatagtgcaggtaaaagccaaatggcaccgttaagaagatattaaacaccggttggataaccgtgggggcttttaatgccgcaacccacgttccgggatgtgtcagtgagaatggattgtatttaatgaactcccggacgaatgtgaaaggcacgaaattgtgagtcggggtcgtcaaatgggccacaaaagattggcttggcaatgggagaatggtgagaaagtaggcacacatcatgtagaagacaaatgtgtagagcataaaaatgctccacttgggaattgcgccatacttgtggtagttcactaacaggatcggtaaggtaataaaaattgctagaattggaaaaataattgcagccgtataaatgacgtgaatgtactgtgacatggaaatctcctaaattttattttattgaatgggctcaccggggacaaaatagagtaacagcccggttccaagggcaattaaggcaatcaaaacgataattgcgatattggcgcgtttgttcattaccagaaaggcgaggtgttcgcggatgactgcgttgggcaaaaagtaaaatggcgttggcgctccaataccaaatgcggcaaatttcaacttccgggcaagcacgccggcccgcaaaatgtgatagttgttggagacaaaaatcactttattgtcgtctcggccgctgtctttttcgatgattttccgggagaaggctaagttctgttcggtgttgatggacttatcttcaaccaaggtatcaactttcgggatgccatgttccaaagcgtatttctgcatggcttcaccttcgggcaataattcgtcaccgccttgaccgccagaaaagatcagctttggatgtttgccggtggttttgatctcactccggtaaaaagaaagagcggtttcaatccggttgcctaacagtcgaccaactttgtagccgtcgatcaaaccacttcccaagacgataatgtaatctttatcttttcgtggaaagtacagtcggtataagatcatcgacgaaatcgtattccaaaccgttaataggacgtagccaatcagtagggtcaaaaacatcgtgacggccccttgaagcggtttgggcccaactgatggattgaagaagaataacaggtcaacggcgatgacggcaatcccggtaatcaaagtcagggaactactgaggctataaccttcacgtttccacacaataaaggcgttaatgaaaaagaagatgaagcttaacgtcaaccccaagaaaaccagtaagccaaccaaggcaactgccagacctaaaatgatgccccagaactggctgttgaggaccgagataatttcaaccagcaagaccagcagaaccagcagcgataagtttgccagggtgccgatatataaggaatttctcagtttaattaagtatgtaaagaataatccgaccaggacgatgaagataatcgcggtcggtatcagtaaagtcatagaaaacacccctttgaaacattatatttcaaaggggtagtggaaaacaagcacggtcgcttcccgtaggcaaactttaactttttagctcattccgacagcctcggcatgtgccagcatatcattgagcatttctcttctggtttggcgtggcaggaagctgcggatgttttcctcactaaagccaacctgcagctgttcatcattgaagatcagcggccttctgagtaaatctggatattttaccatcaggtcaattaactgtgatacagtaagattatcaaaattgacttttaatttgcgataactgtgacaacgagttgaaatcaggtcctcagtgccattttccgacagtctgagcagttgcttgatgtcatctgcgttcaaagtttgtttggagatatctcgttccacaaaatcaatgtggtggtcggtgagccactttcttgcccgtcgacacgatgaactgccaggcgacaaatataaactaagcatggttgccatctcctttactgactgtgacgacaatgcagattgatgcaccggctcatcaacctatccccacttttatcttatcataattataactaaagtcaaatgtttgctataagaaacaggttaataaagtcttgctacatcaagggctacgactcttgtgaaaggttaagtaattcttaatgtttaatctgaatcattcaaattttaaaggagcgaggactaatgaaaattgctggatttggcgttgaagaatggttgaacaaatgggaaaaatcagcaacttatgatatttctcaaagcacgatttcatcaatgacgatgcaagaagccctggcacttgatggccagcagggggcatcattttatcaacaactggatcaagaaaagatgaactatggctggattgagggctcacctgaattcaaacaggaagtcgctaaactgtacgcccatattgacgcggacaatattttgcaaaccaatggtgccaccggggccaatcatttggcattgtatgcattgattgagccgggcgaccacgtgatttcagagtatccttcctatcaacagctgtatgacatccctaagtctttgggtgccgacgtcgatttttggcatattcatgaggaccagaattggtatccagacattaacgaattaaaatcattgatcagacccaacacgaagatgatttgcttgaacaacgccaacaatccgaccggaaccctgctggataaggcatttttgcaacaagttgtcgaattggcccggcaggtgggtgcctacgtcttggtagatgaggtttatttgccattggatgatcccgatcaatttacttccattgtcgacttgtacgacaaggggattgcgaccaattctttgtcaaagacctattcaatgccgggaattcgaatcggctggacggcttcaaatgcgactgtggccgatctctttcgcaagtatcgcgattacacgatgatttgtgccggcgtctttaatgatttgatggcgacctacattttgaagcatcgtgaccaagttctggcgagaaatcgacagctggtgatgaataatctggcgatttatcgtgactggattgactcggaacctcgagccagtgtcgtgatgccccaagcggtttcgacttcgtttcccaagttggatgtcccggaagatattgaagcgttctgtattcgcctgctcaaagagaccggcgtcttactggtaccgggcaatcgatttgatatgcccggccatgtgcgcttaggatattgtgccgatgaaacaacactcagggaaggtctgaagcgcctatccgcctttttgcgccagtacgattaaactgatttgattatgaatgtttaaagttgtttgcatttgtttaaaggtgatcgcttgaaaagccagattggtccaactttaagtttgggttaagctggcccttgtaatctatggacaatcaaataagaaagaagggatcagtaactgattgccaccatgataagtgcagccaatgacttaaagtgccaacaatgagattgaagattgtctcctccaagatatgattcttctacaaggcattgtcatttgggctacaggaaaggaagtcatctatgaagcgaaaacgtttttactttacgtctggaattgcggcgacagccattgccttagtggttgccggacgcgttttccaacggtcacgcatgattgcccatgcgaactaaacaagaaccactcctccaaaaaaatcgctgtgccacttaatcgttcaagccggttaagctgacacagcgattttttaattttgatttgctttttgcttggctaagttggaagcagcaaagactgattcagtttcctcccagattcgcttggcaattttcgacttgttcatcgtgtagagatgaatgccatcgacgccctgagagaccagatcaatgatttgatcaactgcaaaggcaatcccggcgtccagcatggcttctttgctgtcttggtaccggtccataattgcggcgaatttctttggaatcggcaccccggagatttgggtgatccgctcaatttgattcttgttggtacagggcatgatgccggcttcaattgggacgttaatgccggcaatttcagttttttccttgaaatcgtaaaacgcttgattgtcaaagaaaagctggctgattaagtgatcagctccggcagccactttttccttgagatggctaatgtcatcgacaaagtcggctgcctctgtgtggcagttgggataacaggcgctggcaatgctgaaatcggggcgctgctcatggacaaatttgaccaattcattggcatgattgaagtcgcccaccggttctttgccggggatacgatcaccacgaagagcgaggatattctttacgtggatctgatcgagacgatccaagagtgccagaacctggtccttgctctgataaagtccagggacgtgggaaactgccgggatgttgagttggttttgaatcaaatcagccactgccacggtcccatcacagtgattagttccaccggcacccaaagtgaccgaaataaaatccggctgcagtgactgaagtcgtttgagagttggcaggatcgcatcggttggtgagtcctttttaggtggaaatacttccagcgaaaagacggttttttgtttaaacaacgctgttaggctcattgatctcactcctaaccttcttggtggcatcaacgatgttcttcaggctttcaaatgactcgtcttcggaacgggtcttcaaaccacaatcagggttgatccagaccttatccaccggcagcttggcaactaattgcttgattaagccctcaatttcttgctcggaaggaattcgcggtgaatgaatatcgtaaacgcctgggccaacttctgtttggaacttggcagccaccagctgatcgatcaaagtgaaatcggcacgggaggcttcaaaggaaatcacatcggcatccaaagcgtcgatggctttaatgatgtcaccgaattcgctgtagcacatatgggtatgaatttgggtgctgggttgaaccttgctgtggacgaggcggaaggccggcactgcccagtccaaatattcagagtaccagttggactttctaagtggcagattttcacggagagcaggctcgtcaatttgaataatcttgatgtcgtgcttttccaaatccaggacctcatcttgcaaggctaaagcaatctgggtcaccgattcttttggcgtcacgtcttcacgtgggaacgaccaattgaaaatcgtgaccgggcctgtcagcatgcccttcattggtttgtcggttaaatttttggcaaagactgaggcagcaaccgtgattggtgcggttcgactaatatcaccccagatgattggcggcttaacaccccgggtgccgtatgattgaacccagccgttttgggtaaagacaaagccggctaatttttcaccaaagtattccaccatgtcgttacgctcatattcaccgtgcaccaggacgtcgagcccaatcttttcctgaattttgacgatgcggcgaattttatcttcattaaatttatcgtattctgctttggtaatttcaccgtggcggagttttgcccggttctggcggacatctttggtttgtgggaaggagccaattgtcgtggtcggcagaattggcaaattgaattcctttttttgaatcttttcgcgttcacttcgggcgggtaaacgggtgtagtcatcatcggttaaattgttaatccgttcatggacggatttattgtagggatgtttgacgttgcggaaaagggcgtcatttttttcgagcgctgatttaccgtcggcttcatcgtggtaaatggtgtccagttctttaatttcggcaagcttttcaatcgcaaatgccaagtgctgtttgacgtctgatgggaccttggtttcatctgcggcactgtatggcacgtgtaatagagaagcagaggaactcaaaacaactttggcgtccgtattcaggttgtttagcaggtcgatggttgttgcgtaatggttgcgccaaatattcttgccgttaacaactccggcgaataataccttgtcagcggggaagccgttttgtttgacgagctctagattgtatttgccttcgacaaagtcaagaccgattccgtcaaaatccaggctggtgacgtcatgatagatgtcgcggatatcaccaaagtaattttgcagcagaatcttgctggatcctttggcagccaagatgccatgatacaatttgtcaaaaagggctttttcagcggaattgacgtcgaagcttagggcaggttcgtcaatttgaatccagttacccccttgttgattcagatgctcaatgacttgtgagtaagccccaatgaggtcatcaacaaagtcattgggtgtcgtcccatcaaggaaacgactgagtttgagtagtgtgtaagggccggtgatgacggccttggcattgatccctaatttgagcgcttcgtcgacttcattaaataatttatcaccgactaatttaacgtccgtcgtcttagtgaattctgggacaatgtagtgatagttggtgttgaaccacttcttcattggcagggctttgacggtttcagaaccgttctggtacccacgggcttgagcaaagtattcgtcaagcggtgataagttgagggccttgtagcggtcagaaacgatgtttaagaggttggcggtgtctaagaccccatcaaaaaacgagaagtccccaacaggaatcaggtcaatgccggcgtcttgttgcgcctgccagtgattcttgcggatttgataagcggtttttagtaattcattttgatcaatcttgtgcttccaataatgttcggtagcaaattttaattcacgatggtgaccgatgcgcggaaagccgataatggtggttgtcatgtgtttgtatcctcctagagtgcgatttggggcggttagcaaccggagcctaaggtaacttgggggaaaatcgattttgattttgtcccaagttgccttaggtgcaggttgctgctccaaagagcacgtttcatcaaagtaaaatcagtatagatagcgggcagcctcagcaattattgaacagtacgttttaaagcgtctttgtatcaagactcattaccagataaaactgagggagccacgtcttaacaggtatgtccccaaacccctaaatcacgtgtcgttcataagggtcattggaaatcccctcagccaaaatcttcttgctccattctttggctgaaaatagtgaatggtcgcggtaattgccgcaactgtatttatcaacgccgggaacgtctttccattctactttgttggcaatttcatccaatgacccttttaaggcctcggcgacttcggtggtgctgtgtttcccccaggtaatcaaatgaaatcccgtccggcagccaaatggtgaacagtcaatgacgccatccaagcgatcccgcagcaaactggccagtaagtgttcaattgtgtgtaagccggcagttggaacggcggtttcatttggctgggtcaatcgcaggtcaaaatttgagaccacgtcgccgttagggccggtctctgtggtaattaaacgaacgtacggtgcttttacctttgtgtgatccaatgtaaaactttcaacttttgccataaatgatcaatctcccataacatttaatttgtttttaatgctaatatcaccatccgaagttgaggacacaaaaaaacatccgtccctcacatcagaactaatctgacggaggggcgaatgtttcgctttaccaccctgaatttgtcttggcctcacaaccaacacctctgaaagtaccagacttcgatactcggcgatgtaacggtcgcacccggggttcaagcgttaactcgaaaccgctattcagagttcatgttcgttagctgacgaaccatcctttttcaccgaccggattctctataggttcgttcactaattactcttctcttcagagctttaatttactagcattaaaatttaatgataatactagtcgtagttctaatgattgtcaacctgatatgccaaattatttattatccggtgaaaggcccttgaccaaaaactcgacagcttggtcaatatcccggtccaaatcgacttttcgatcaagcagaataatttgggcaccaaagccggcaccaattgagagaacgtagtccaaaattcgggaggtctcccagtccaccaagagatggcgctctttaagcttatcaatgaccttaggaatagtggtggtcaggacagccttaactggaacaatcaattctgacaataattggggatcgttggccgcctgcataaatagaattttgaggatttgtttgttttcgctggcaaaagtcagtcggttttttaaagtcggctttaagaattctgccaagctgtcgtacttgaaacgcttgaggtcttctgagaactcttgggcagctctgggaacggtttgcgaaaataatggctgaacaacggcttggagcagctgttctttggttttgaatcgcttgtaaactgtgccctgactgacacctgctttttcggcaatgtcagccgtcgtcgtggcttcaaaccctttggcagcaaacagttccaagcaggctttcagcacctgtttttgtttttggggtaaatcttttgtggaatcaatatcttccgaataaaatgactgaatcgaagttgatgccatgtcaatcacctacactttccgatacttgcgcattccaatcatatttaaagcaatgaaggcgaccaagaatgctaggatagctgtaaattgtgggacaattgccgaaaagctggcctgcttttgaatgacgtcggttaacgcactggccccgtaatacagcggcatgatgtgggcgataacctgcagccagcctgccatgttggcaactgggatcaaacctgagaagaaaatttgtggaataacgacaatgggaatgaactggaccatttgaaattccgaggcggcaaaggttgaaacaaacaaccccatcgacagtgcaaccattgccaaggcaaaacagatcaataagacgacccagatgctgccaagaatggagatccctaagacatagatacagaataacacgatcaccgctgtttgaatgatagcaacagcgccataaccggttaggtagccgtaaatgatttcacttcgtttaaccggggttgccagcagtcggtccaaagttctggagttccgctcatttaaaagtgaaattccagaaattaggaaaacaaagaagaagaccatgaatcccaagaacacaggcagcatcgttgtgaagaaggtggaattactcttgccgtaaagatagtgctgcgttaatttcaggttggttggcttttggacgttttttggagcggacgctgtcggaatccgactgctgagggtcgctggcagctgctttttaatttgccggagctgagcttgcatcttcattaagccggctttggactgtttcgtggcagcaaccagctgcttaatttgaacttttatcagcgccatctgaactgatttcttgatgatcgcggtcttactctggtcggcattttgatacgtgacgactaagtggccatcagtttttttgatgaaaccggcgtagtctttgtcacgaatggtcttttttgctgaaacattcgaatccatccgatgaattttgatgtgcttgttgtcgattgttttgaccaatgaactagacacattataggtgccgatgtctgcgaccgtgttggtatttgactgaaataagaaatacatcaatgacaggatgaacagcggcgcaataaacattaacgcaagcgttcgtttatcgcggaacatttccacaaagatacgtttagtgattgttagaattctcatttgatttccccgctttcaaaaagacctgttccaaattatccacgtcgtattctttttccaaactggtgggtgacccgtgggtgatgatgtgaccttcgcgaatcatcaatagttcgtcacattcagctgcgtcttccatgacgtgagtggtgatgataatggacttgccggcttgggcatactttctgagttcatcccaaatctggcggcgaagttccgggtcgatgccgactgttggttcatccaaaattaacaaatccggatcttgaattaaactgatggcaagtgacaatcggcgcttcataccaccggaataattactgacccgtttgtccaaatcctggtttaaattgacaacgcctgccgtgtagtcaatccgttgcttcagctgctcttttttgacaccgaacaactgagcgaaaaatttgagattttccttgccggtcaaactttcatatagggcatcatcctgagccataaagccgattcgttgcaggacggggcgattgggcattcgtttaccaaaaatagtcacttcgccaccgtcgggctgttccatgcccatgatatttttaataatcgtcgtcttgccagcccctgatgggccaattaaacccaaaatctcatggcttgaggcagttaggttaacatcatgtaaaatccgttttttattgaagcttttatcgacgtgagtcactgttacaacagcatccatagttggttcctccttttgtgagtgagtgctaactcatttacgacttcagtataccccattcaaagtgagtgtcaactcacaaattgcttttcttgccggtctcacgtataatgacattaaaatttagtcctttaaatagtccagcgagtctgtcaaggaagccattagtgaacgttgtttttaccagcaatagtctgggaatgagcacttcgactcgttgtggggttgaagtgcttttttgtatgctaatgagcattttagtttgcttggaatgatttaaaggacaacaaggagatctatcatggaagacaaaagtttcggtcgtgttgagtccatcccaaaagctcatcggcatcaatcctattgggatatgtttgccacttgggtgggggcgaatgcgaataatggtacttggtatgttggcggggttatcgccgcttgtgggtttgcgacggcttcgacgactctgattatcgtaggtgtgattacatattttttactggcactatccggctatatggggtacaaaaccggtttgcccgcaatggctttaacccgagcttcgtttggcctcaaaggcagtttcctgccgtcagtgattaatgtcgttcaatttatcggctgggccgccgtgaatacgtttatcgcggcaacatcgatcagttatattctccacgatgtcctgggttggccggtatacggcaagccgggcggcctgaaagggttgatctcaggaattgtggtgatgagtattctgcatttattgagtatctcgatgggtgaaaaatcagtccggatcatcgagcggattgggattgtcttagttttcatcttggtaatctgggaatctatcgttgttttccaaaatgtgtcgttatctgaaattgtctcttggcatgcacccagtgccctgaagatgtcaccaggccaagccgttgatgtcctagctgcctttaatttagcctgggtaacggcagccagtgatttcacccgcttttctaagaagcgttccagctccacttgggcaccgttctttggcgccaatctgggattgatctggtttgcgatgatcggaatcatttcaacgatcgcgactgccattaccctgaatcattttgatgccaataattcagacccatcaacgattgccagcaaacttggcttgggtgtcttggcgatgcttgtcatcatcattaccagtaccaccgcaaatgccgttaacctgatgtctgctggatcggcactgaccaatatgactaaacgattatccttgactgtcagcattgtgctggtgaccttagtggctgtcttcgtgaccttcattcccattttctattcgactttcttaaatgttttcactgcctttctggacggcatcgggatgttcttaggacctgaaatcgccatttttctgaccgacttttatctggttgccaaacggaaatatcgagttgaccattttgcctcccggaccggtcaatattggtatactggtggtattaactggattgcgattgcttcatggctgatcgctgtcctggcatacggatacattaagacggtggccgtgttggcggactcagtcggcgcaaccttcatttcgatgttgattgctgccgtcatttattgggtcggcagtcgattgaccagccgcgggcaacttcaggaggattagagtggcaacttttaccaaacaaactttgtctttagatgacgttgaaccggacaatgaatacgtgaactgtgcgttgacggtttctaacgagctgattcggattaatgacgttgtgtttgaccactgccagttcgagcagagcaactttgacggcagtgattggggctacgtggaatttaaaggatgcgatttcttaaacgcgactttccacaagagttatttctccaactgcaaattcacgaatgtccagctgatgggggctgatttttcgatggaaaccctgcttaagaaatgtcaatttcatgatgctaacctgcactatgccaactttagtgaaactaaaatggaagccagcttctttatggactgtaatctggtcgaaagtagttttcaggcagtgaccgtcaagaaagaattatcctttaacgcctgtgaaattaaccaaatcgacttcttggacacgcgaatgaaggggatcgatttgtctaaagccagctttgacgacttaattgtgaatcccgagttgatcaagggcttaaaaatcaatccttggcaggcagggcagattgtcgctatgctgggtgtgattgttgtcgattagctttaattaaatattttctgggattccttcaatttcgagtggcagctgatgatataataatcactcagggtcaacatcgatttgaaaggggacgtccagccgtgaataaattgccgacacgaatgacatttttttatcaacttcatccagtcgtttcggcagtttatttttttgaggcgattttgagtctgctcttgtttaaccatttggcgacggcattgaccggttatgtaggattactgttggtgggcattttttataccggacaatcagcggtctggcggcaattcaagtggaatttgagcttattattgatgattgtcttttttaatgtgttgttaaatcaacggtttgggccggttctctatcagttttccgtgggtgatgtgtcattcaaactcaccttgccggcacttctatacggtgtcgttatggggttgatgttagtcgagatgctcatggcttttgctgttctgaacgtcattttaccggcgcctaaattggtatatgtcctgtcaccagtgacgccgaagctgggcttattagtggttatttcaatgaatttagtgaagacttttagccacaccctggctagtctggcgatgctccagcagacgcgaaacgttcaggctaacgctggcgggttgcttagtcgcatccggaatgctggtcgcctgttgcggattttattggaggacgcactcgcatcggggatggaaacggcccgattaatggacgccaggggattcggggttggcaagcggactcattattgggcctaccattggaaggccagtgactgggcatttttgagcgcgtcgatcttgatttttgtctgggccgtggtttcccgaattcagtcagccggctggtcgacatcagttggcgaattcacccgtggctggatgagccaggatctggttgccttatccgggctgggaggattactattattaccgctggcagccgaaggagtgtatcgtgcatggacaaattaattgaaaccagacagctcacatttacatatccggatgcttcccgcccagtcttgcaaggagttgatttaaccatcaaccgaggggagtttatcgtcatcgccggggcaactggcagcggtaaaaccacgttaattaatcatttcaaaaaagaactgctccccaatggccatcgaagcggcaaggtattgattaagcagcaagccattacggatctttccagattagccagtgccaaaacgattgggtacgttgggcaagatcccactactcagccgattatgacaacggtgattgacgagctggcgttcggccttgaaaatatcggtatcaagagcgctgaaattgaacggcggatcgccgaattagctaattatttgggcctggacgaactgctgcaccaagatatgcatgaactttccggtggtcaattgcaactggttaatttggcctcggtgttaattttgcggccggaagtgcttttgttcgatgaaccgactgcccaactggatccgctttccagccggcatttttttgatgttttggaacggattcatcaagagttgggaatgacgattgtaatgaccgagcataacttgggaaccgcattgggattggctgaccggatgatcctcttacaaaatcagcgggttacttttcaagggcaaccggtagttggcattccgaagatgatggcagatcccgatctgacagcttttgttccagctgtgtcgcggctatttttggataatcatcttgagacaaccgggctgccaatttctgttgccgccggtcaggcagctatcagcaagcaccacctggagttcaccgctcacacggaccagccgagggtcgtcgagtcgtcaacgaccatcttggcagccaaagagatctcgttttcattcgacaaacaggtaaatgtggttgatcatttgaacttgcaattacctgctggcgactggctttcgattgtcggcaagaacggctctggcaagtcaacgctgttaacgatgctggccggtttgcgagttccacagcatgggaaaattacttttaacaatcaaaaggtctggcggattccaacagcagccagaatccagcagctttcttttctctctcaaacgccggccctgcagtttggtgctgaaacggtccaagaggagttgcaccagcaagctgccgaacttcagctagaatttcctgacaaacaggttaaaatgatagttgaccgattgcacctcaacgatctgcttgaccaaagtccatttgatttgagcagcggccaacaacagctgttagggattgccattgcgctgttggccaacccgcaattgttaatcttggatgaaccgactaaggggcttgatccgacggccaaacaagctttgggacagttattgacgaccatcaaccaggctggaacgaccatcttgatggccagtcacgatatggaattttgtgcggcatactcactgcactgcgccttcatgtttgacggccatttgaacacagtcttaccaaccagatcgtttttttctgggaatttcttttttaccaccgcgattaatcggctgctgagaaggcaggtgcccgatgcaatgctggtgagtgacgttagattatctgaagggacgagtgaacatgtcgaataagtggcgagccaaagtgatcggtcaaatattgctcgtctcggtgttgatcgccgtgtttttgggattaacgctgttactgaaaaataagcattttttgttgtttagcttcatgcttttgttatgtagtattttgccggcctattggcggtttgaaagggaacccctgaagacgcaaacgttgatgtttttggcaattctgattgccttggcggttgccggcagagtgccgttcgcctcgcttcccagtgttcaggctgccagctttgtcattatcctcggcgggatttcgctgggaccggagctggggtttgtgaccggctcgaccaccgccttagtctcaaatatgtttttgggacaggggccctggacaccgtggcagatgtttgcctggggattgatgggcttgacggctgggttgattggccggactcagcttagccaccggctaatgccaatgattatctttggcggtgtctggggatttgtctacggctggatcatggatctgtggtttgccttggcatatgtcaatccgctgaccatgaagtcctttattttggcctttaccgccagcgccggtttcgatcttgtgcactgtctttccaacgttgtcttaattgcattgttgtatcgttcctgggaaaaattaattgaccgactgaatcggaaatataattttttaccaaccaaaactcattaaagggatggaatctatcatgaaatcaatcaagaaattaatcaccttatcgatgactggcctcttattggctggtgctgctgcaccgctcacaaatgtccatgctgccggcgccaagactgcttctagttcctatcaggcttcaaaggccaaggccagctacagctatgccaagaagatgctggctaagaatcgaactgggttttccggtaagacaagttacatatttagtaaaaaggcgtatccaacaaccggtgccgtctatggctactcggactttctcttgggattgaaagggttgggatataagtttaccaatgcccaacggaccaagattgctgacagtttggtattgaaccgtaagagtacggctgccgatttggcgaccgcaattattgccacccgtgccgttggtttgaacccgcaaaagctgcatcaaaccggcgctaaaacgaacttgaacctggtcagcgcgctttatcatcgttcgatggccaagcaaacggtcaacgttcaaagccaggcgctgatcgctttatcaactggttcgtatcaacgaccaagcaatgccaaattttccaaggccagcttgagcaatgccatcgttaagaatcagttgagcaataatggttgggcgtacaataaccaaactgccagtgctgacagcgacaccactgcgatggcagtaacggcccttgctcgtagtaaatcgaccagttccgccgtcacttctgcaatcacgaagggccagagttatctcaaagatgctgtctatccaaacggggcgtttggttacgcttataagggcaagaccttcccgaacgctaattcaaccgcagaagcgatcattgccttttcaaccaaacaaaagacggttaaattggtgaatagcgtcttcaaatcaggtcagacaacctcaccaatgcgggcaatgttgagctacgttcggtcaaccggctcgattaaaggagctgccactcaaacgttgggagtcggtcaggtcaacttggctaacgccgcttaccgtcaagccttagcacaccgatcggtttattcaattaagtaagattaaaggatgagtttatgaaaaaagcaattggaattgtcatcggtgtgattttggtgttggggatggcatttggcgtcagggaggtcatcgcgaatcaggtcgcccagcatcctcgaaccgagaaagccgctaagatggattctggcagtcagccaaaggccacctcaagttctcaggtgagccatccagctaaggcgaaaaaagccaaagacaaaggttcccaggcaaagcatcaatcacaagccaaaaaggccagtcaacctaggactgccgactcgtcaagtagtcaagctaccagtaacaagcccagcagttcaaggtcgaaatcacagacaaaacaggcagtaaccactaagcccaaatcgacttctaagcagtcccgaccaaagcaaaaagcctcaccagcatcaactggtaaggcttatctaaaggtttccggatacaaaaagctgttttattctggcaatttgcacattactaagaagacgactgcttttacattgctccagcaaaccaagctgaagatcacttacaccagtagcccggcaatctacgtcagtgccatcaatggactgaaagaaaacgacattaaggtcggcagcggctggatgtactcggtgaacggcaagtacgttgataagtcagctggtgataagttgattaaaccgggagataaggttcattggtactttacaacggagggattcaagtagagcgcgacgagacccggttaggacccggagcataagtgagaacaatcaatgatgaacggtttttgttcatcgttgattgttttcgcttatgtagtagggtcctgggtcgtcggagcgtgttttcaaagtagaagggagcacaaaagggaataacaaccgtgcccagagcgcgacgagacccggttaggacccggagcataagtgagaacaatcaatgatgaacggtttttgttcatcgttgattgttttcgcttatgtagtagggttctgggtcgtcggagcgtgttttcaaagtagaagggagcacaaaggaggataacaaccgtgcccagagcgcgacgagacccggttaggacccgccaagtaggctaggccgttttcattcggtcgtcggagcgtgttttcaaagcagaagggagcacaaaggaaaataacaactgtacccccagcgcgtcagaatccatttcaaagcaaaataaccctaactacaccactaaaaaaccggcagcaatgaacgaaatttgttcatcactgccggttttgtgttatcaattattatcggacttgagcagttaaagcagtcaaaaaatcggtgacatcaccaacgtaggcaaagtctgactcatcgaaaatcggggcgtctttgtcaatgttgacagagacaattttcttggcatttttgatgccaaccgtgtattgaacagcacctgagattcccaaattaatcaacaggtcggctgagaggctggcgccaccaatcccaatttgatcatcatgggtgaactcgtcttcgtcagtgagagggcgagaaacgccaaccattccgccaagcttggcagctaaatcctgtgccagttgaatattttttgcgctgtaagcgcctcggccaagggcgatcacgactttagcatcgtcgagtttggaggagctgttgatgatcgggtcagtggcgatgatttggctgtttccttctttgtggaaggtaaagctggccttaaccaccttggtctggaaatcagtcaccttttcagcgcggaaagtatttggccgaaccgttaccatttggggccgcttttccgggcagacaatgtcacacatcacgttgtcgccataggtcggtttgacctgaaccagtaggtcattttcgtaaaaaatatccaaacagtcaccggttaagccagtctggagtttggcctgcagccgcggcgcaattgatcggcctaaaatggttgccggaaacaagaggctgttggggcgattttgatcaagtacttggaataaagcatcagcgatttcttcatcggttgcgttagtaaagtgatcatcgaccaaagtttcaactcggtcgggtccataagcttgtaggctattttcagccttgattgtcgaggcttcaggaagcacggcaaccacttttctgccgtcagcaatggctttggccttggtgattaattgcaggctggttggttcgattctggagccgacggtttcaacatatacccaaatttcgttattatccatttttgtgctcctctcagtccaattgactcaagagttcagaaactgcttgagcggggtctggtgacaatgtgactgtttttttaacatccttggttggtgcataaactttggtcactttcgttggtgatccagcctggccaatttttgccaggtcaagattcaaatcggcttcagtccaaatggtaattggcttttcaaaactttctttgatattgactggcgtttcataacgcggcgtattgagttctttgcggacagtcaccacagcaggcagggtcagcttgatatcctggacggcggagtcaagttggcgtttggccaccagtgtcttctctgagtccaactccaaggtttctgcaaaagtcacttgggggaactgcaagaattccgccacaatcgggccaacctgaccagtgtcagcgtcgacagattgtctgccgaataggactaagtcgacatcgccaattgcttcgattgctttggccagcgtgtagccggtagccaaagtgtcagcgccaccaaacgcccgggagctcaccaaaacagcacggtcagcgcccatagccattccatctcgaagtgaggttgtgtaactatccggccccatactgagaaggataacttctccaccggcttgatcacgaagctgaagggcagcttcaattgcatttttatcaaatggattaataatgccttggattcctgaacgaaccaggttatttgtgtttggatcaattttaactgaatcggtttctggaacttgtttaatcccgacaacgattttcatagtgcggactcctttacttggcaatctctgcgttggtaatttctaaattcatcttttcaatggtaccttcagccaattccattgctcgggcatctctgatgaggtgttcgactggatattcatggctgtatccatacccaccaagaatctgcagggctttatcaccggatgcaacagctgatcggctgccgtacgattttgccatggcggcaacttccgcatatggcttgttggcgaccttgttatcggcacctttttgatacagcgcggtggtgttttctttggcaattgcgatatcagcgatcttttcctgagtgacttggagttggtagagcggtgtgtccatagcttttcgttctttggagtagttcacggcggtttgtagctcgtgttccataatcccggcgagaacggcgcccatcaacactcgtgcgtcagcgtgggcattgtcgccaatttccaatccttgtccgattcttcccaataaatgattatcaggaacaaccacgtggttaaggacaacttcgccgacaggcacgcccttgaggccaataaaatcttcccgcttgccgaatttgaatcccggcatgtccttgtcaacgacgaagacggccatttggtcatcctcagtcttagcgaggacgcagtagacttctgcaaggccaccattggtaatcatgattttgtcaccggtgatcacccagttatcaccctgtttgattgctcgagtggcgatgcccttgggattggagccgccggatggttcggtcatcgagaaggcaaaaattcgtttggctgcactcgggaggtactcgtcattcaatgatttattcccatatttgataaactgttcgatcgttttgaaatggccttcaagagttacggccatgctggcgttacctgtggccattttctcaagggattcggcagctgcttggtaatcaaaggctgcaccgccatattctcttggcagggtgatgccaagcaagcccgtgttaacgaccttttgaaataagccgtccggatagtcaccagcgcgatcaatctgcatatcgatcggtgccaattcgttggcggtaaactccttaatcatttgaatcagcattttagtttgatcatttgttatcgacatattgagtcctcctgtgcatactttcacaatactttatattccaaaattatatatcctaatattcccaatgtcaatgtataaatggaatatttagcaatcttatttggcgtcacattatataatatggtaatattaagttattattttatccgaatcggccaggaggcttgataatagtgaacatccaaagatttattgatcgcagaaaagaactcggttattcccaaagtgaattggctaaggggatttgtacccaggccacgatcagcaaatttgagaacaacggcaaaatgatctccactaagatcctgacgcagctatgccagcggctgggactttccttgaacgatattttccccagcgaggccgacagtgattcagccgttcgagcggaattgcggcgggccgaatttgatttaattaccactgaatatgatgatgcgttgggaattttacgatcactggaaattgatcaaattggtgataaacaaatccaaatggaatatttgtttatccgcggatatgccctggctttaagcaaacgagatgttgatgaggcgattttttgcttcgaccagattttgaatggctatgacgaggcccacacgacggtttattcaccgctggcatacgtggggatggggatttcctaccaacaggctggcaattttgacaaagctgagttttatttttccaagatgccggaaagattgaagaccaatgcgaataaagacgttgattcggtgtggaagtcattgacgatgctgttttacaccggcaatttttatgcggccaggaacgaaatcgagatcagtaatatgctgctacagtctttgattaatctcagttcggatcggcacgtaactttttacgtggctcaggctcagtatcaattggcggataacgaatattcggtcaatggcaaaacccagcgattctccgaacttattagtgacgcctttgcgttcgcccgatttaatcggaatcggaatttaattaagcagattgatttgtatgctaaaaaaagagtgtagagtgtgaaagaggacgtttagcaattgaaatttaagcgccgctggacggaaaccgagtcaggttttcggctggcggcgcttaaatttcaattgctgtcctctttcacacgtttaatcaaaataacagtaaaacaccaggaaaccgagtcaggttttcggctggcggcgcttaaatttcaattgctgtccttattcacacgtttaaactaaatagcagtggagctaaagagaggcccagacataacttacaattagttgtgtccgggcctctcttttcgtcaaatattgttttcgcaattgctgaatatcgtgattcgacaaatgcatttgctgatgtaaataatgcttcattgtgccatcacagtggtaaatcgctgaataggcggcattcaaataggctgatcgagcggtttttgaacgtttcaggttcctgagcacggttgggttatgcgtataacgggccatctgtcgatattctttggccgtcgttttcttcagataatggttcgatgccaaatagtttttcataatggtcgttttgggaacgccaagacttgaaagaatcagcatggtcgctacaccggtgcgatctttgccatatgtgcaatgatacagaatcgcaccggatctttgcttgagcagataatgaaacatcgtgcgataagccttaacacagtggggctcaagaaccattttctgataaaattgttccataaaatttggctgtttggcggctaactgaccggcatactgagaagtcgtgtggacgccgaaatttgggctgctcatgacggataggtggagatgacgaaccccagaaattttggcgtctggtgttcgtttgatttcaccacttgagcggaaatccaagatgaccttaacgtgctgcttcttaagtagccatttatcgtgatgatttaatcgggttagcgcagccgatcggatgagtcgattttggcgaatgtgctgaccatttttcgtccgaatcccaccgagatcgtggacattgggcgtcgtcgtcaagtgaatggtggcgcctagggaggaagtggtgttggcagaacaaaccgcaaaattagcagtgagtatcactgtcactagtaatgtccgactcatgatttggctcaatgacttcatccactcacccccaacattcattataggactgggcagtcatcatgacagaaatttttggatgtgggccaaatccgcctggcgcttttgtggtgattcatcttcagcgttgaagttgtgccacttgattttcttgagaccgatctttttgaatgtgcccgtggccaaggccttcataatgggattaccatatttgagtttatagagaaacgttggtgtgccagcaattgtgaagatccggatgattggattcttttccaggaccactctgggatgcatggataccgcccggttcttgctaaaaactttatcaatgaaacccttggtcatcgccggcatcagctcccaccaaattgggaaaataaaaataatttcatcggcggtttttaggcgttcgaaataacggtcaacttggtcattaatcggtgtccgtgttcgccaggcactcaggtcttttgcgtgcattaccgggtcgaagtgatcgtgatttaagtcgatgacatcaacgtcatggccttgggcagttaaataattgatcgtttgtttggcaaccgctgcactataactgcgatggtggggctcgttatttgcggccgacagggtgtaagggtggtcaaatataatgacatatttcatgttagaaacctctttttaaaaattgacagtttgacttttcaaaatacatttcaaggaatataattagtataagctccaatgatgaaaagtcaatatatattccgaggaatttaaaatgaaaaagaaaaatgcaattgaacaaatcaagaaccaactagaaatatttagaagtcatgatgttgaccgtgagatcctggcagccatcagacaaaacgatcggttaaacgctgctctggccaatggcatcaccattaacgatctgcatattattcgcgctgctgctgccaaggatggtgtgaagatttccgcgattgtcgaccaggtaccgatgacacaaggagccgtttccaaagccgttaacaagttggctgaaaggggtctgcttcaaaaatcgcaccaccctgataaccgcaaggacacgtttgtagaactcacggcgcctggggaaactattaatcaaattcatagcgactaccatcgtcaagaagagaccaaactggctgagttagccgacagttatttaaaaaatgaactggagatgattgcagaatttgtcaccagcctcaatcaaatccggcaaaataattccaaattaaagtaaccggtttcttctttgctatatcaaaaactcctgtctactgcttataaaaagaaagttaggtttccctaattaaagatttacaagtctagaaactatgctaccattagatttgtacagaagataaggaggtaatgggatgtcaaaagaaaaaaagtcccaaaaggaacatttgattcattacgccaatgggccttcactggaagaaattaacggaacggtggttgtgcccaaaggcaagggattctggcgtacgctatttggttattccggtcccggcgcgttagttgcggtcggttacatggatcctggtaactggtcgacttcaatcaccggtggtcagaattttgaatatctgttaatgtctgtcatcttaatgtcgagtttaattgccatgttgcttcagtatatggcggctaaactgggcattgtgactcagatggacttggcccaggcgattagagcccggacaagcaaatcgctgggatatgttttgtggattctaaccgagctggcaattatggcgactgatattgccgaagtcatcggtgccgcgattgcgttgtatctgttattccacattccgttggtcatttcagtatttattaccgtatttgatgttctgctattattattgctgaccaaaattggtttccgtaagattgaggccattgttgtttgtttaatttgtgtgatctttgtggtgtttgcctatgaagtgatcctgtctgatcctgactggctcggggtctttaagggcttggttccaaatggtgagaccttctcttcgtctcctcaaattggcggtcaaacgccactgactggtgcacttgggatcattggagcgacagttatgccccataatctgtatctccactctgctgtttcacagactcgtaaggtggatcacagtgatgaagaagatgttgcccgaaccgttcgtttctcaacttgggattctaacattcaattatcaatggcattcttggtgaactcactgctattgattatgggagttgctgtcttcaagagtggggcagttaaagatccgtcattcttcggactgttccaggcactttcggattcttcgaccttaagtaatggtgttttgattacggttgccaagtcagggattttatcgattttgtttgcggtcgctttactagcgtcaggtcagaattccaccattaccggtaccttaaccggacaggttatcatggaagggttcatccacatgaaaatgccgctttggatgcgccggttggtgactcgtttgatttcggtggttccagttttgatttgtgtgggtatgacgggtcgtgaaaccccgattcagcagcacgaagcgttgaacacactgatgaataattctcaggtcttcttggcgtttgccctgccattctcgatgctgccgttattgatgtttaccaataactcgttggaaatgcatgaccgtttcaaaaactcgtggattgttaagattcttggctggttctctgttatcgccctgacgactttgaatatgaaaggtcttcctggccaattcgaagcatttctaggtgatcatccaacccagagccaaatttcaatggctgataatgcctcgtacgtcgttattgtcttggtcgttgctttattggtatggatgatttgggatatccacaagagcaacaagcgttttgaagcagcagctgccgaagctgaaagcaaagcagccgaggcggagaaataatagtataataatcaattgaaagagatttcttttgtacccaaataattcatcatcaagaagggatgttacaaaatggcaaatactgaaggcggtcaaaaattcgatcgaattcttgtgggtgttgatgattcggaagatgcccaattagcatttagatatgcaattcgtgaagctcgtcaatccaatgcacgtttgatcattacttcaattttggaggacgataacgttaacgttttccaagcattaagcaaagattttgttcatggggagcgttcagcgcttgccaagcatattgaagactatcggcaattagctttgcgtgccggcgttaagcaagtggatacggtcatcgaagaaggcgatcccggcgagacaatcgtcaaacgggttattccggctaccaaagccgacttgttgatcgtcggttcactttctaagactggtgttcgtaagtactttggttcccaagcagcctatatggccaagtactcaccaatctcagtgatgattgtccgttaattggctttaaaaatgattttaaaacaggatcgggaagaatatttccggtcctattttgttagacactagggggaataatcttggagttaacagaaaaaagccgtaggtggttcattgccacattactgctgggaacatttacgatgtcaatcagtcagtcgtcactatcgactgcctatccgacatttatgaggtattttgatctgccggccagcacgattgcttggctgacgacggggtttatgctgatcatgtcggttgtcatgccattatcaccatggttgatgaagaactttcgatttaagccattatatctttcattattggtaaacttcgttgttggaaccttgattattatctgggcaccgaatttcctggttatgatggtgggtcgattaatggaaggattcagtgttggggtcttatttccatcttatcaatcgatcatacttgaaatcacaccaaccgatcatcgtggtagcgtgatgggcactgtggggttggtcatgggatccgcactggctgttggacccatcatctcgggggtcttattgcaatttttcccgtgggaagccatctttgcgttcttcttgattattctgacggtggtctttctgttggcactcaagaccgtcattagtccgttgaaaattgaatcaactcagtttgattttgtttcagtcttcatgtcgctgggacttattggcttattgtactttatcaacgaaatttctcatatgactgccactagctactggaactgggggattttattggtttccttggttctgctggtcttatttgttcgccgacaattgcgcatgccacagccattattgcgactggatattctgtcgatcaccaactttgatttgggagttttattaacttcattgtcctatatgtccttgatcacggtcaccattatcatgccgctatactaccagcagatactgggattgacgccgttatggtcaggcctggcactggttcccgccgcagctattttgtcctggttaaatcgacggagtggccggctggcagatcgcattgggtttaagccagttattatgattggttttggattattcatcgttggctgggcaggtttattgttgctatcagggttgaaaaatatttggattgccattctatgttcgattgtaattgaatctgggaacgcctttgccatgatgccggccaccacgctgggagccaattctttaaccaacgatttgattccccacggctcttcgattattgcgacgattaggcaaattttggggtcgaccgcgattgtcattgcgacagttgtattaggagaccggaatttcaacggcgtgttcctcacctttctcattctggaagtcattgccattttcttagttttcaaaattaaggatacgcaacaacaggcgggcaaagcttaatttggctttgtgaaatgaaaactattttcacgagtgatatacgttaactgttgcgttcgttaaccactttgaaaatcacaatgcattttgttgtatctgttttcatggcatgatatcctatatctggatgtaaaaatgtctaggatagctgaagacgttacagatttatccaaattttaggaggtcatataatggcatatcggactgtaaacccttacaacaatgaagttgtgaaggagtacccatttgcgactgaggacgaattacaatcagccttggcaacgggtcatgatttatacgaaacgatgaagaagcaagatatttctgagagagctaaaattctgcataacgttgctgcgaaactgcgtgagcactcagatgaattagctcgtgcatgtacgattgacatgggtaaattaatcggtgaatcaaagggtgaagttgaactggttgcgatcattgctgactggttcgcagatcatggtgaggacttactgaagcctgaaaagatcgataccattgcaaccggtgatgctgaaattcaacatcacgcaaccggagttgttatgatggttgagccttggaacttcccttactaccaaatcatgcgtgtgttcgcacctaactttatggttggaaatccaatgatcttaaagcacgctgccaacacgccaacatcagctaaaatgtttgctgacgttgtcgccgaagccggtgcccctaaaggttcgttgactaacttgttcctttcatacgaccaagtgactgaagcaattgatgaccctcgtgttcaaggggttgccttaactggttccgagcgtggtggtacagctgttgccggcgccgctggtaaagcacttaagaagaacaccatggagcttggtggaatggatccatttgttgttttaggtgatgccaacatggatgatgtcaatgacattgcatggcgtgcgcgaatttacaacactggtcaagtatgtacttcatccaagcgattcatcgtgatggacaatgtttacgatgaatttgtggagaatttgaagaagaagtttgctggtttgaagcctggcgatccaatggatcctaagacgaccttagcaccaatgaacaccgaaaaatcaaagaacaagttgcagaaacaattggacgatgctatcgcagctggtgccaaagttgtttatggtaatgaaccaattgacttacctggtcaattcttcatgccaacgatcttaacggatattgacaaagataacccagcatacagtgaagaaatgtttggtccaatcgctgctgtttacaaggttcacagtgagcaggaagcaatcgacttggccaacgacaacccttacggacttggtggcattgtctttgccggcgatgctgatcacggtgcagaagttgcctcacaaatcgaaactggaatggtctttgttaacaacttcatgtccaccttacctgaattgccatttggtggggttaaactttcaggttacggccgtgaaatgagccacattggtcagatggcctttgttaacgagcagttgatcgttaagactgacaagcctaacatgggtaaccttgccggtggtttggttgcacttgatcctcaagaataatgaacgtgaaataaattgactgaaaagtaaagaagtcgggagataacgttttgttcgttatctcccggcttcttttgcgtgccattgttattttgtttaaatcctaggatcaagattcttcgtgcgatgctcttggcacaattacctgtaaaaagtcacttttggttgtgacggtaattggcagagacatcgctggatccccatcgattctggcctgaatgtcgcgttttgacaggttatcgattttaacggttttggttttaaaatagcgaaccccctgggcatttttgagattgccggtgatgaaataactcaagtaggtgagtagtttcatgggagtgaagctcttcagcaagaagacatggagataatcatcgtcataagacgcatccggattaaaggcgatgaacccacctaccgaattggtcgtcgtgatcagtagaatctgggcccgcaagacttcggagcgatcattggccgtgatttttaatttgtaagaacgattggtgaacagctccttgaagcctttgaccaaataaatcattttgccaaagcgcttcttttcgtcgtccttgacgtttcgagcgatatctgccaatcttcccagggtgaggctgctgaccattggtgttttccccacagccccgaggtcgacctctgctggtgagccatccaacagattgttaatggcttgatcggtgttcagggggatgtgaagggctctggcaaaattattgatcgtgccgccaggaatgattcccagcggaattgattggccagccttcaagaagccctcacaggcggtattgatcgatccatcaccgccaatcgtaatcaggcagtcatagttttcgggtgatttttgggcctgtttgaccgcatcatcacgtgacttggtttgactaagggtcaccgacttgccattactttccaataaggattgagcttttttggcaatcgcttcgttgtcgcttttaccggcactgccattataaataattaaatattttttcatgttgcacctcctcaaaggaatgattcggatgacaactttattatattacgcttttggggaatggtcgtctttggggattatggttaatgatccgttcatgaccggtgatgttgcatcaacagtgtggaggtccgtgaaaatttgaagaaatttcatgaaactttcagctgtattagcttcattgaggtcctttaacggcagccaataattttgaccttcctcagactgcttgagggttcctgagaaatgactggtgcggtagagaaatccgagtcggcggtaggcaggactttcgttgaaccattcgacagttccacaggattcgagctgactgaccgtcaggccggtttcctcaaatacttctcgaaccatgccgtcgtaaagactctcacctttttcaacgtggccgccgggaaaggtgtggccaaatttccagtcgacgtcggttttatcttccaccaagacctcttgagtggctggattgtagatcatgcacatatttaccaattcgattgattcggttctggaataggtcatttggctgcctcccgctcaacttcttcgttgacactgaattgtggagtcactttaagggctttgatccgattctcgccccattcatacatctgattggcaatgggcatcagcgattgaccgagctcggtgatttcataggtcacctttgtttgagatcccgcgttgacgtgcctggtaatgaggccgtcttcagccatttcccgcagctgattggtgagcactttgtgggtgactttgggcaacagccgcattaattcgttaaagcggtaggcgccgtcagttcccaagtgaaataagatgaccaatttccatttgccgctgaacatcgataaagtgagctccttggaacaggtgtagtcaccgtttttcagacggtctttgacatcttttctgatgacatcagtcatttgtatccctccaagattttaggcacctgaaagtgcgttattgtatcattttgatacctagtataaagtagatagtatcttggaacaagaaaggatgaatttgatgagtaaagtagctgtcatcgtgaccaacgatgttgaagatattgaatacacatcaccggttgaagcactcaagaatgccggccatgaggtggtaaccattgaaaatgaagctggcaatcaaatcgtcggcaaacacggcactaagttgactgccgataagggaatcggggacgtgaagccggatgagtttgacggcttattgatccctggcggcttttcaccagatcaactgagagctgatgatcgatttgttaatttcgtcaaagactttttgatggacgacaaaccaacttttgcgatttgccacggtccgcaactgttcatccaaaccggcttgacggctggtcggacaatgaccgcctacctgaccgttcgaccggatttgtattatgccggcgcccgcgtgaaagaccagccggtggtggttgaccgtaatttggttaccagccgcactcctgatgatttagacgattttaatggtgccatgctggctattttgaagaagtaattgaatttaaagtaacttgactgcaaaaagaccggaacaaggcgattttcaacgcctgttccggtccttttgctttttatgttatgaatgtctaactcaatgcaaatgagggtccttattcgtatccagtccacctaactggcctctgaattctttggaatacaggttcaaatctgaacggtaggcgtcaagattgtcgctcatgtcaacggtataatcaacttcttcaccgtgctcacctttatccaaaccaagcttttcttctttacggtcaactcgcattggcatcactaaactcagtaatttgataatcactgaagccgcgatggtaacaaagataatcgttgccaaagttgcgacgatctggacggtaatttgatgccaaccgcccccataaaaggcgccattgtgggcaacaatcgggttgacgctcttggtagcgaacaaaccggtggcaatactgccgatgatcccgctgacaccatggcagccaaaggcatccaaagcatcgtcaacaccgattcgatctttcaaatagttaacgaagaagtagctggcgaaagttgagaacatgccaatccaaaatgatccggcgattgttacaaagccacaggcaggggtgataccaactaacccacaaagcgttccggtacaaacaccaaccagggttggtttgccgctgataatcatatccaaaatcatccaggtaaccattgcagtaccggttgacatggtcgtcgtaatggttgcctgagccgcaatgttgtcaacaccgagtgctgacccggcattgaatccgtaccagccaatccacaagatggtggcaccaagcaatacccatggtaaattgtagtgggtgtgagggatgtcgccgaatttaacccgtttccctaagaaagcggaaaggacaaaggcagtgacaccggcattaatatggacaacggttccgccggcaaagtccaatacgcctaatccataaagaataccgtgtgggctccaaaccaaatggaccattgggtagtaaatgataatcgaccaaagaatcaagaaaaccaacaagaagttgaatttgatccggccaacaacggcacccacgaataaggcaggggtaataatagcaaacatcatttcaaatactgaaaaaatcccagtcggaatcttggttgcagtcaatgaagtcagatcaacgccattcatgaaaaagttcttcacggttccaatgactccgccaatgtctccggaaaatgataacgagtaaccaatcacgatccaaagaacaatggcaacaccggtcataatgaaaaccgacagcatcgtgttaaccacgttgcgttttgaaaccaggcccccatagaaaaacgccaatccgggagtcatgaataagaccaaaatactggataaaatcatgaacgaagtatttgcagcattcataacatcgcttccttctcttttaatgtcataaattctaacatcatatttttggaacgtccagcactttttgaaattggttagaaaattagaatgaatttaatgttgatggaaacggtgccaatggcgttgattaaagcatctttgtcctattaacttccatcaaaaaagttaagccgactaattggtatatgtaattaaaactaacattaaagggccgaaacacaaatgtttcttcactgtgtttcggcccttatgttataccctggattgcgataatctttattaattcaattcattaatggcttctggaatcggttcatttccagtgctcatctcaatgacttctttgatgccggcatggttttcgactaaaccaattaatacgtcggcgacattatcgatactattttcgttggtgctataggctcccaaagtcactttgcctgacccggctttttcaaccagcgcggttggctggaggattgtgtagtccagattggtgttgtgaatcaaccattcatcggcatagtatttggcgatcaagtaattctcaagcggagagtcggcgaattcgtctggtgacaatgatcccttggaactcagcatgacaaaacggctgatttctttttcttcggctgcctgcatgactttgacggcaccatgtaagtcaattttaagcaggtctcggccacccgatccggcagtgaagataattgcatcggcttctggtaaggcctctttaatctcatccatcccgttgttgagatccaatttaaatggcgtcacattctctgatgctggcactttttccggcttgcgggcaccagcatagatttcgtctgcagaatttttggccagtttggcgacaacgtttgaaccaactcggccagttgcaccaatcacgataattttcattgttggaatcctcccttatccttattagctcaattatggtagatataaggccggaatgcaaaagaaagattgacattggcttaatctttcttttgcaagtctaacgtcccaagcggggtggatgatttttaaagccatggatagggcgacaactggaatcacgacgactaagcagagttcgatcgctgaaagtttaacgatcgacatgctctctggaaacgccgttatcacgaaccacccaaaaatccaagacaatcttcgccatcaattacccaaacaaaaaattcaaacttgatccacgtcaattccttatcggccgaaccaccatatactaaaggcatcaattaagaaatggagcgggagattatgaaattccaaagatatattaatcaacatacaaatcaaattacactgataacggcagtattaattggcgtaggcctcttggggaaagttgttgacagcgatatggtctacacggtttcattcatcgccgcttcaattatctcagctgtgccgatcgttcttcgggcagtttccgcactccgatttaaaacgatcagcatcgaattacttgtcagtattgctgtgattggcgctttcatcattggcgagtacaatgaatcagcgatcgtcactttcttgttcttatttgggacgtttttggaagacaaaacgttggccaaaacccgccactcaattaaagatttgacggaaatggcaccgactaccgcaatggttgtggatgatgacggcaacactgaggagattgatgttgactttgtcgacgttgacgacgtcgtcttggtcaaagccggcggtcagatcccggttgacggggaaattgtggatggatccggtcacatcaacgaagccagcattaccggtgaatcaaaattagtcactaagggcactggtgatcaggtattctctggcaccatcttagacaacggaacacttaaagttcgggcaaccaaggttggcgatgacaccacgtttggcaaaattgttgaactggttgaggatgctcaagacaccaagtctccggcagaaaagtttattgacaaatttgcgacttattacactccggcagttttgattattgcgctgattgtgggcttggttaccaaagatttccgattagcgattaccgttttggtcttgggatgcccaggggccttggttatcggcgccccggtttcaaacgtggctggaatcggtaatggtgcgaaaaacggtgtcttgatcaagggcggtgaagtgatgaacacctttgccaatgttgacacgttggtattcgataagacagggactctgactgaaggaaaaacggcggttactcagttcaaagactactcaaaagaccagttggccttgcaaattgctgcggcggttgagaaacagtcggatcatccgttggcacaagcagttgttaaattctcagctgatcatcatattccgtttgacgacgttcaagttgccgatgctgacacagtcaaaggccgtggcgttaaggcaactgccaacggtaagaatgttttaattggtaacttgagaatgatgaacgatgaaaatgttgatttgacgtctgaacaacgtcacgacttggaaaacatccaagacgaaggcagttcaacggttatcgttgccttcgacgggcaaattcaagccattctgggtatctcggatgtgattcgtcaaggcgttaagcaaagcctggcgacactcaagtcactcggcatcaagaagacagttatgctgaccggtgataacctgcagaccgccaatgccgttgctgaacaaattggtattgatgaagtccacgcagaacttttgccggaacaaaaagtcgaatacgttaaacaatttcagcaggaaggccacaaagttgcctttgtcggcgacggtatcaatgacagtccatcattggtgaccgctgatatcgggattgccatggggagtggcaccgacgtggcggttgaaacctctgatgtcgtcttgatgtcatcaggactcaatgaattgatccatgcatatggactttccaaaaaaacggtcatcaacaccaaggagaacattttcatcgccattgcgacggttgtcgccctgctgattggcttgattctcggctttatttacatggccagcggaatgtttgtccatgaagccagtatcctggttgtcatcttcaacgcaatgcgattaattaattatcaaccaaaaaccgccaaacttgatccagatcaattatcagttggcgaatatgatttatcattaaaacagtaaatgagatggaggttatcaatatgagtaaagcaattttacaattagacgcgctgtcatgcccgtcatgcatgcagaaaatcaagggcgcacttgaaaagcaggatggtgtggaaaacgtcaaagtcttgttcaatgcagccaaagtcaaaactgattttgacggcgataaaatttccgcagacaaattgtcagacacggtaactgatttaggctatgaagttcaatcaatgaaagtgaaataggtgaagaatatgacaacagcaaccccagaaaaattatttgaagcagaagttaagcaagcagatatcgaccaccataccccaacggctggtgcgatgaccggccacatcgttgccaacttggaagttttatccaacaagctccagatggcaaaatggtatgtgaaggggatgtccgcccaacagctgaaagtcctattcggcgacttacttaagcaggcgtacgaccaaaaggatgccttgggcacggtcttaatcgatgaagcgttaatcacgccaagtacccaaaaggaattcacggagtacaccatgctggaagaaaatggccagaataaatatgaatctgcagagtggctggtcaacgacttcgtccatgactatgacactgagaacatgtttgtcacccgggcaattaagttggctgaaaaagaagaccgcccagttttggcacaacatttgattggcctactgcgagataacaaccacaacattgctactttgcaggccttgcttggaaagacaccacgagagggcttggacgaggaagacgacgaagattaatcattaacctagatacgaaaaaagttccgaggcaaatttgcttcggaacttttttaatatcatttttttcgaattcaaacattcaaacaaatcagcacgaaaacacaggcaatcgtacttgccaggatccaccagccaacccgataagctgtccgctgataggttgaaatttgctccaaactcaatttatcaaaatccggcatcttaagtgaggcattttgaaacatgctagtctgcagcagcgtaaagtcttttttgatcagaagttgataacaataccagggtcaagccgatgagtgccacattgattgagacaaatattaacaggacgcagataatgatcgcactagtcagtataatccgccgagttctcattttcaccactccttcagggcacactacttcactggacgagtgatggcagattgccatcaagaacaaattaccagagatattcaactggatttttgatgtgttgatcgtaaacgtcacggacaatttgcatctgagcatcagtcaaggcgggcagatccgctgcagtggtgttgcgctcgatttgagttggattgcttgcaccagggatgacagcagaaacggcgtcatacatcaagatgaagcgcaaagccattgcggcaagattatcggttcccaagcgttgcttcagttcggcagcagctttaacgccggtcaggtagtcaacaccggagaaggtctcgcctttatcgaactgttcaccatgccgattagttgtcctgtgatcttctggcgcaaacttggtgtccgcggtaaatttcccggtcaaaagaccacttgccagtggaacccgggccaaaatgccgacgttatttttcttcgctaagccaaagaagagatcggcaggacgaaggcgaaacatgttgaagatgatctcgacagccgagatgtcataactgagggctttgatgccttcttcgacccgctcgacactgacaccgtagttctgaatttttccagcttgcttgagcttgtccagttcaaaaaaggtttcaggcatgtagtaattcatcattggcgggcagtgcagcagcaccatgtccaatgagtcgacacccatgttttgcaatgactcatcaacgtaccggtccaagtgagtcgggtcaaagtgcttaatatccaagggcatttcttttcggccaattttagtcgtgtagtgaacatcaggatgattcctgacaaattcacccacggctttttcactttggccatcttggtagccatcagctgtatcaaagaaattgacgccacgatcataagcttcctcgagtgtgtcccgagcatctttagggtcaaacggggtgccccattttccacctaactgccaggtaccaagggaaacctcgctgacactataaccagttttaccaagtgttctgaatttcattagtgttacctccaaatagcaatccacttgtttcaatcataacatctcggttgatactttgactaagcgtatttggtggtggacaggtccacggtcgttaaaaatagtccatcttttgaaaattggacggctccaaacacgtaaattaatcaaatatttttggtaaaagttgcaatatatcgttttaaacacgaacaatggcgttgacttccatgatgatggcaagtatcctatagacacggaataaatttgaaaaggtgagtggttggaatggcaaacgttgtcggtgtggcaatgggatcaatttctgattggccaacaatgaaactggcttgtgaacaacttgaaagtcttggaatcccttatgagaagcacgttatctcagctcatcggatgcccgatgaacttcaagaatttggcaagacagctagggacaagggcatgaaagttatcattgcgggtgctggtggcgcagctcatttgccgggaatgattgcagccaacacgacacttcctgtcattggagttccgatgaaaacacgaacattaaatggtgttgactcattgctttcaattgtccagatgccatttggggctccggtcgccaccgtcagtattggtgaggctggtgccaagaacgccgccttattggcagctcaaattttaggaacaactgactcagctatcgcgaagaagttggctgatctaaaagaaacccagagagtggaggccaaaaacagtgagcagcagttcgattaaaactatcttaccgccagctacgatcggcattgtcggtggcggccaactcggacagatgatggcactgattgccaagtcgatggggtatcacgtgggcatcttagatccaacacctcacgctccggctgggcaagttgctgatttccaaatcgttgctgaatatgacgacgttgactcattgatgaagttggctgaacaaagtgatgtgttaacctacgaatttgagaatgtcgacgaagattcgctgctcaaggcaaagaaggtggctgagcttcctcaaggcgtcaacttacttcatatcaccgggcagcgattgaatgagaagaattttatcaaggattgtgggattccggtaaccaagtttgccgctgtttcagatgaagcgtcacttaaagctgccgttgacgaagttggctatccagcaattcttaaaaccgtttctggcggctatgatggtcacggtcagatggatattaattctgccgctgatctcgctgaagcgtcgtcactgtactccaaagcggaatgtattttggaagcccgccaagacttcatcgcggaagcctccgtcatggttacccgggatttgaatggcaaagtgattaccttcccactggttgaaaatcgtcataagaatcacattcttcataccacaattgccccaggcagattttccaagaccgtccatgccaaagcaaaacagtacgccgaaaccatcgctaatcagcttaatttatatggggttctaggcattgaactgtttgtaattgatgaccaagacgtcatggttaatgaactggcaccgcgtccacataactccggtcactacacgatcgaagcctgcaacatctctcaatttgaagcacatattcgaagcatctgcggcttgccgattcctgaaattgttcaggaaaaacccgcagtgatgagaaacctgttaggaaccgatttaacccttgcccgcaatctactcaaggaacatccggaatggcacttccacgattacggcaaggcagagattcgaccacaacgcaaaatgggccacgttaccgtcgttggtgacaacatcgaccagttactgaaatcaaccgacattttaaagggagaaaactaaaatgactgaaattgtgaaaaaagatttgttgtataaaggtaaagctaaagaaatgtacacgaccaacgatcctgacaccatgtgggttcactacatggatcaagtaacggcttttaacggcaagaaaaaagttcaaatggcaggcaagggtcaaaccaactgtgaaatttcagccttgatcttcaaggacctcgccaatcatggcattaagaaccactttatcaagcaaatcgattccaacaatcaattggttaaacgggtaaagattattccattggaaacagttgttagaaactttgcttccggcagctttgaaaagaaatttgccgttaagcatttaatgaagttcgataagccggttcaagaattcttctataagagcgatgaattggatgatccattcattaacgatttccaagctgagactttgaaggtggcaactgaagatcaaatgaatcagatgcgggcgattgcacttaaagttaatgaccgcctcaaagaaattttctcagaaatgaacattgatctggtggacttcaaagttgaatttggcattgattccgacaaccaattgattttggccgatgaaatttctcctgacagctgccgattaattgaccgcgatacgcaaaagtcacttgataaagatgtcttcagaaaaggcctcggtgctttggtaccagtatataaggaaattcttggtcgccttgaaaaagtggaggatgttaaataatggctcttgcgaaagtttatgttaactacaagaaatcaattttaaatcccgaagcagaagccgtccataaagctttgaagcgtctgggttacggtgatattgaagacgtgaagttgggtaaatactttgaattaaccattgctgacggcaaatccaaagcagagattgataaagaaattaacgaaatttgtgacaaattgctcgctaattacaacatggaaaattaccactatgagattgttgaaacggaggctgcccaatgaaatttgctgtccttgcttttccaggatccaactgtgaaatggacctctacaatgcaattgaagatatcatcaaagaagatgttgaactggtttcttacaagaacgattcacttgccggctttgacgctgttctgattcctggtggtttctcatatggtgactacttacgaagcggtgccattgcccgcttttcaccgattattcctgcattacaggattttgccaaaagtggccgaccagttctgggaatttgcaacggatttcaaattttaaccgaagccggattactgccgggaagcttgcagaagaacgtttctgccaagtttatctgcaagactgaacctctggtcgttaataatgaccactcgatgtttagctcagcctatcaaactgggcagttgatcagtttaccgattgcgcatggtgatggcaattattactgtgaccaagatactttgcgggaactggttgccaatgatcaaatcgttttcaagtatgccaataatccaaatgggagcgttgataatatcgccggcatcaccaataaagccggcaacgttcttggcatgatgccccacccggaacgggccgttgaagcaatgcttgggtctgatgacgggaaggggatcttccagtcgatcgttaatcacattaaaagtcgaggggtaatctatgaatagtgtaatggatcaaacaactgaagcgacaccagaacaaattcgtgataacaagttgtaccaatcgatgggattgacagaccacgaatatggtttgattaaagatgatgtcttgcatcggctgcctaactacaccgaagtcggtttgttctcaggaatgtggagtgaacattgttcttacaaaaactccaagccggttcttaaaaagttctttaccaaaggcaaacacgttgtcaaaggaccaggtgaaggtgccggtattattgatattggcgataatcaaggagttgttttcaaagctgaaagccataaccacccttcagcagttgaacctttccaaggcgccacgaccggcgttggtggtattttacgagacatcttctcaatgggtgcccgaccaattgccagcatggacagcttgcgatttgccgaaccgaaaaccgatgcggacaagtattttattcaacaaattgttgccggcattagtgcttacgggaactgtattgggatcccgacggttggcggagatacagcatttgacgatgcctacgcccacaacccactgattaacgtgatgtctgttggcttgatggatctcgataagattgaagttggtgcagcagccggcgttggtaacagtattatctacgttggccataaaaccggtcgtgacgggattaacggggcctcgtttgcttctttccaatttgattctgaacatgaaagtcaacgttcagccgttcaagttggtgatccatttgaagaaaagctggtgatggaaggctgccttgacgtcatcaacaatcattcggacgccttagtcggaattcaagatatgggtgctgccggattggtttcatcttcggcagaaatgggttccaaggctggcggcaacggaatggaattgaatttggatttggtcccacaacgtgaagccgggatgtccgcctttgaattaatgctttcagaatctcaggagcggatgttgctgtgtgtcaaagccggtcatgaagatgaagttttgaatgtctttaaggaccatggcgttaacgccgtcgttattggtcacgtgactgaaggccataattacaaacttcttcaccacggtaaagtcgttgctgatgtgccggttgattccctggcgtctcaagcaccggtttatcaccgtgaatcagctgtaccagcacacttgaaaaatgccgatgagaatcagtatcaacctcaaattagcaacccaactgaaaccttgaaagatatgcttggccaattaaccattgcttctaaggaaagtatctatgaaacctatgatacccaggttcaaaccaacacggttgtggctcctggatccgatgccgccgttgtccgggtgcgacaccacgacaaggccttggcaatcacaactgatgttaatggtcgctacctctacttgaatcctcgagtcgggggtgccatggcggttgctgaagctgcccgcaacattgttgcatctggtgccgtaccgttgggaattaccgattgcctgaactttggtaatcctgaaaagcccgatcagttctatgaattggatcaagcagtgatgggaatgagtgaagcatgtgaaaagtttgaagctcctgtcatttccggtaacgtttcccttaacaatgaatacgataatattccagtctatcctacgccaatggtggggatggttggcctgatcaaaggcctggaccacatcacgactcaagactttaagcaagccggcgacctggtttatgtagttggtcaaactgaaccgggatttaacggttctcaaattcaaaaaatgcaaaccggaaaaattgccggcaagctcttcaattttgatttagattatgaagtgaaaattcaaaaattaattacagctgccattcaacaacatttgttgaattcagctcatgacatctctgagggcggtctgattactgctattgctgaaagtacttttggcaatcagcttggcgttgacttgtcaggtaacttaaccgttgctgacttcttctccgaaagccaatcaagatttgtcgtttcagttccacaagaaaagcaggccgattttgacaaattagttggcaatgacgcagaaaagcttggaaaggtagtcgatgacaatcacctatttgtccaagccgatgatggttactttgatcttgatgttgataaagcatttggtatttggaaaggggcattgccatgccgtctgaagtaaaaagtttaaatgaagagtgtgggatttttggcgtttggggaacgcctgatgctgccaaattgacctacattggcttatttgccctccagcatcgtggccaggaaggtgccgggattacggttaataatgaaggccatttgaccaccaagcggggatttggtttgttgaccgacgtcttcgattcacccaacgcggttgatgaaatgaccggtcaagctgcaatcggccacgttcgctactcgactgccggcagtaatttattggaaaatattcaaccgctgccctttaactttagcgatacccaatttgcgcttgctcataatggtaatttaaccaacgccatttcaattcgaaagaacttggaagaccgcggtgcgatctatcattccagttccgatactgaaaacctgatgcatttgatccggttgagccaagaagacaacttggacgaccagatgaaagaagccttaaatatcattaagggtgggtttgcctacttggtcatgactaaggatcgcttatatgctgcccttgatcccaatggctttcggccgctcgttgtcggtcagctgccaaatggtgcttacgtcgtctgcagcgaaacttgcgccttggatgctgttggcgctgagttcaaatttgacgttcaaccaggtcagttaattaaaattgatgcttccggcatcaccgttgataaatataccgacgatactcagttggcgatttgctcgatggaatttatttatttcgcccggccagattctgatatttacggcgttaatgtccattctgccagaaaacggatgggggctcgcttggctcaggaacagccggttgaaaatgccgatatggtgattggggttcccaactcatccttgtcggcggcaatgggatacgccgaagaatcaggtttgccttatgaaatgggcctggtgaagaatcaatattctgccagaacattcattgaacccactcaagcacttcgcgaacagggtgtgaatatgaaactctctgctgttaaaggggtcgttcggggtaagaatttggtgttggttgatgattcgatcgttcgtgggactaccagtcgccgaattgtcaaattactcaaagatgctggggcggcttccgtgcacctgcggattgcatcaccgccgctgcgctatccatgtttttacggcatcgacatccagcatgttcgcgaactgattgccgccaacaagacgattgagcaaatgcgcgaaatcttcggagctgattctttgggatttctgagtgttcaaggcgtaattgattcagttaatttgaagaccgacgcacctaataagggtctctgtgttgcatattttgacggcaaatatccaaccccgctttacgattacgaagaagaatacgatcgcgatcaagcccaactacaatcaatgagatgaggtaattcgaatggacgcctataaaaaggccggtgtcgatattaacgccggttacaagttagtcgatgatattaagaatttatcaaacaataaagaccttggctcattcggtgggttgtttcccttgtcgctgggtgcctatcaaaacccggttctggtttctggaacggatggggtgggaaccaaattgttgatcgctatcaaagccaatcaacacaaaaccattgggatcgacctggttgcgatgtgtgtcaacgatgtgttggcccaaggcgcaaagccgttgttcttcttggattatctcggagttggtcacctggataacgaaaaagccaaagcaattttagccggcgtggtcgaaggggtttctcaggctcaggcaaaattggttggtggcgaaactgccgaaatgcccgatatgtatactcatgggcattatgatttagctggatttgcggttggtattgctgattccgataagcttttgagccctgacaatttgcgtgaaggggatgtcttgttgggacttgcctccaatggtcttcattccaacggtttcagtttggttagagacatcttgttcaaacagaatgcttattcattaaatgatcagctgtccggctgtgagtatgatttgaagcgtgaactgttgcgcccaaccaagatctatgtcaaatcagtgttaccggtgatcgagcagggcaagatcgcatcaatcgctcatatcactggtggcgggttaccagaaaatgttgccagaattttaccggataacctttcggcagaatttgagtatggcagttggcaggtgccggcgatcatgaaggatttgcaagagattggccatttatcatttgatgacattctgcacacctttaacttgggccttggcatggtgattgccgttcatccagatgatgccgatgccgttgaatcacaattaaaagcagctggcgaaaccgtttcacgggttggtaagctcatttctggcgacaaacaagtaatcattcgaaaggatcagcaatgaaatctgacgtaaaaaacatagcgatatttgcatccggtgagggaaccaatttcacagcattgacggaatctttcaaaaaagaacacttaccgctcaatgtgaagttgttggtttgtgatcattccaacgttcacgtcctcgaccgggcacataaagaatctgtttcaacatttgtgattaacttcaaagattatcccaataaagctgccgctgaaacggtgattgcccagaagcttgaggaagcccaaattgacttcatcattttggccggttatatgcggatcatcggccccaccttgttagccaagtatgaaggcaaaattattaatattcatccggccctgctgccgaagttccctggccgccatgggattgaagatgcctatcaagctggtgtcgatacgaccggtgtcacggttcactgggtggattccgggattgattccggaaaaatcattgctcaacgcgaggtgccagtccacaaggatgaccagttgagtgaccttgaacagcggattcatgcgacggaacacgtgttatatccaagcgttgtcaaacaattattagaaagaggagaaatttaatgtcgaaaagagcccttttaagtgtttctgataaaagtaatttggttgattttgctaaacagttaaaggatttggattttgaaatcgtttcgaccggcggcaccaaaaaagacctggaagatgctggcgttgaagtaaccggtgttgaagaagtcaccggttttccagaaatgcttgacggccgggttaaaacccttcatccaaagattcatgccggaattcttgccaagcgtgacgatcccgaccatatgaaacaattaaaagatgccggcattacacccattgacttggttgccgttaatctgtatccgttcaagcagacgattgaaaaacctgagaccactcaagcagaagcaatcgaacaaatcgatattggcgggccatcaatgctgcgggcagccgcaaagaactttgccggcgtgctaaccgtcgttgacccagctgactatcaaccagtgatcgatgctctgaaggcacacactgatgacgccgatttcagaaaacatttggcagctaaagtgttcagacacactgccgcatatgacgccctcatttcgaattatttgacggaagaagaatttccagaaaaactgactttaacttacgaaaagcaacagtcattgcgttatggagaaaacagtcaccaaaaggcagccttctaccgcaaggcgttaccatcaaaactgtcgattattcccaaccagcttcatggtaaagagttatcatacaacaacatcaaagatgctaacgctgcactgaatatggtggctgaatttgatcaaccaacggttattgcgatgaagcacatgaatccatgtggggttggtgtggctgataccatcgaaaaggcttgggatgaagcttatgaatcagatccgatgtcgatctttggtggaattattgccgtcaaccgagaaattgatgctgcgacagcagaaaagatgcacaagattttcttggaaattgtaattgccccatcatacactgatgaagcatttgaaattttagctaaaaagaagaatattcgtctgctgaaagctgatttgagtcatcgagacgagcctgatcgctttgaagaaattactgttagcggcgggatgctcattcaagaaagcgaccatgaaattgatcagattcctgacttcaaagtggttaccaaagtccaaccaactgagcagcaattgaaggctttgcaatttggccaacacgttgttaaacacgttaagagtaacgcggtggttgtaacaacggacaccaagactttgggtgtcggcatgggtcagcctaaccggattgactcagctaagattgctatccaaaaggcaatgccaaaggacggttacgaaaatgctatcatggcatcggacgccttcttcccaatggatgactgtgtggaatacgcagccaagcatgatatcaaggccattatccaaccgggtggcagtatcaaggataaggattcaattgcgatggctgataagtttggaattgccatggtgatgaccggggtaagacattttagacactagaagcagagggcgacgagccccgggtgtccccggtgtgtaaggcggaaatttaaaggatgaacgggctttgttcatcgtttgaatttttggcttacacgttagggggcaggggcgtcggagcgcatttcaatcagagcgcgacaagggctgggtgacccggtttccaagggtactttgattgaagtccctgggtttgggactttaatcaaagtacccttggaagttaggggcaggggcgtcggagcgtattttaaaggccgaagggagcacctaggaacctaataagcgtgcttcaagccctcgttgttgctcagtggagcacatttgactaaaattcttaaagcatcaaactatccataccgttcaaagaaaaaatcaacaatgtacaacaacgcacaacaaggctgtccatcagccttcatacataaaccatccatcaacaatcaaaaaaggagatcaaatcatggcaaatgttctggttatcggatccggtgcacgtgaacacgcaattgcagcaacaatgttaaaaagtccccaggttaccaatgtctattgtgctcccggtaatcctggaatgaagaaggataacattcaaattgtggatatcgatgaaatggactttcccaacttggtggagtttgccaaagagcatctggttgatttgacgttcgttgggccggaagtgccgttgtccaaagggattgttgatgccttcatcgccgctcgtttgcgggtattcggcccagatgagtctgcagcccgactcgaaagtgacaagacatttgcgaaaggattcatggcccgaaacaacattccaactgcccagttcaaaacatttacgacctttgatgatgccgaaaagtacgctgagagtttgtcattgccactggtcgttaaggaaaatggtctggccgccggtaaaggagtcacaattgtgaaagactcatccgatctggcagcaaccatccaacacgcacttgataaagccggtgaaattttaatcgaagaatttctggaaggtgaagaattttcactgatgctgtttgttggcggtgacaagaaggtggttttcccaatttcacaagatcacaaaaagatttatgaaggtgaaacgggtccgaatactggtggaatgggtgcttattcaccggttccacacatcacccaagatgttttggatgtcacagttcaaaagattgttaacccaacgatggctggactggcgaaagaggatttggagtttgccgggattatttacatcggctgcatgctgaccaaacaggggccaaaagtgatcgaatacaacttgcggctgggtgatccggagacccaagttctattaccccagttgaagagtgatttttaccaaatgacctctgatttgatcgaccatcaaatgccaaaagttgagtggcaggagggtgagttctatcttggcgtcatggtttctgctccaggatatccaacttcgcccaagcaacatattgcgctgcccgatgatttaccacggaatattttttatgccggggtgacagaggaagatggaaaattgtacagttcaggcgggcgaatctttacgttgtacaatcatgcttcgactctggaatgtgcccaggcaaaagtttacgctgagttaagccggcttgatttgtcaggattctattaccgaaaagatattggctttcgagatttataaaactatttgaacaacacaaaacgggtatccagagtttggatacccgtttttgatttttataatttgagtgtggctggccaatcttactagctttgtcacagtcagtgagcggacttatcaaagtgatttcaagcaataataatggcaaaaaagacactgaagccactgggagtcggtgcctcaatctggatcaatgattatttgcgcagaaaaaccaaattgtccgctgttgagtcagtttcactaaaccgatagttgggtgaatcgaaatctttcaggtcagaaatttgttcaacctgatgttcggccatgaaccggaccatttcaccacgcgccattttcgcaaaggttgccctggttttgatgttgccgtcaaccaaatgaccaaaggtgatattgatgaaacgatcggttaactttaagaatcgggtgacggttttggcgtattcttgggatgccaaattgataattggctgatcgtctgccagagactggtagatgcgatcatcccaaaattcgtacatatttttggcagggccaattgataatcttgaatccatatcaaaacggtagggagcgacgccatcaaagggtttcagaatgccataaaatcccgagagaatgcgtaaatgttcctgcagataagtcagtgcggcttcactcaagaggtctggtgccatgtactgatactgaatcccggagaagctgagaatcgccggggttaatcgatgatacaggtcaatgtcctgtagttgtctgtaactcgcctctgtcagttgatcacttgcatgccacaactttttgagctggtcgtaactcagctgatgcaatgcatctaaaattacagtcgtctgtttcaaatacaccggcattccctgcacatcaaaatcatcttgattgacgaccattttcttggctggtgaaataatgactttcatcgctaatcattctcattaagccagctgtcaagaacgttgatgaattcatcatgttgatccagcaaagccaggtggcggctgttggcaaatagatgccacttggcaccagggatatgatcataaaccgtcttggcgattaacggggtgcagaggtcgtctgtgccgttggtaaccaatactgggacatgaatattcttcaagtcatcagtgacgtcaaaatcgctaatggtgccattctcggtgaactcattggggccttcagcgatcaaactggcttttttaccgttggttggccggcggagtggttcaggcgagttttcgtctggatcatcccagcagtacatttccatgtaacggtcattggctgcggcatatttggggccagagaagttcccagtccgctctgcctcagcgattgcctggcgatcttcgtagctgagatacttcaagaggcgatgctgttcttgaatccataacttgattgaagatggggaaccatcgatcatgacgcttttaacaccttcttggctataatgagtcaaataaagcatttctagcatgccaccccatgattggcccagcatatgtacttcatccaagtgaagatattttctcagggcaattaattcttctgcccacgtctctttaacgtagagggattcgtcgtctggaatcgacgatttgccgcagccaatttggtcatacatgatcaattggcggccagtctcggcataatcatcgagtaattcgaaatagttatgtgatgaacccggcccaccgtgaatcagcagcagtggggcttttccaggtgttttctcgccaacgatccggtaatatgttttgtagcctttaaatggcatgtaaccttcttcaattttcattcaattatccagtcctttccagtaaaaatctttgattggcatccattatacgccagttggcagtcaattattagaggatttatcataattaagacagtgtggaaaaataaacgcttagttgccagaatataaggaaactgtttatttttccactatttggctgggtaacataaaagccggggcaaagcattcacttttgtcccggcccctttgtaagtcgatttaatcattgattaatttatctcgtaattgatccactgaagtataaacctcaccgggattaattttctccagctctttgtgtttggcattaattgaccaagcagccgagtagcatttaatcccggcttgcttgcaggcgacgacgtcggttggagcatcacctatgtatgccatatcgtctttggtggcgttaaattgtttgatcacgtcactaaattgttgtgctttgatcgagccgtcaggagatcctgataagacaggggagaatgcatccgccaatccaagtgagtccagactgacttggaggctttgctcacccttgccggtaatcattggcgtgatcacatcgcggtcgtggagttccttaatgagcttttcaattccctcaaacggatgccgtaattgcaaatgcgcccgccggtagttttcgtgaaagctttccaagacctcatcggaataatccgggatcaactcctttaacatcccaacttcgtttgctccaaaggtggcgaggatgacctggttgctgatccatttgccagtataatcgtgaacggttcttctaaacgaatcaaagattaccgggaaagtctcggcaaccgttccatccatatcaaacgcaataattttttccattactatttttgacctacctttcgaagtgcatgaccaggattccctgtcggatgtgcacttcatgacagggttcctaaatgagcctatacaactattatctgctactaggcacaattattcaaatgaataaaaaaatcgccggcttgatgtcgacgatttttgaaaatattcattgagttatgcccgctttaaactcatttttttcaatcctggtaatgtaatcattgtgatgaaactgatgacgtagaggattgagagaaagcccatgacaaccgtcaatgagtagttgtccattaaaattccaatgacaactgatgagaagccgccaacggcacggccgatgttgacgatcacattgttggctgtcgaacgaatttcagttgggtagaggcggctgataactgccccgtacccgccaaacataccgtttgagaagaagccgacaatggcgccgatgataagaagtgaaatggtattgtgggctaaggtaatcgtgaagaccatggcagccgaggcaatcaggaagatgccaaatgctcggcgtgggccaaagtaatcaaggattgagccgaaggtaatcattcccaagctcatgccgatgatagtggaaatcatccacagtgatgaaccggaaacgtttaagccaagttgtttttgcacgatgattggcagccagttcatcaagccgaagtaaccggcgatttgaacggtggtcataatcattaaggcaaaactttgataggctaatttgggtgaactgaacatgtacttgaagacggcgctggtcgtggattctttcttctcggcttcaaccttcttggctgcgacaaactcttcagtctcgctcaagtgacgacggacaaaataagttaaaacaaccggaacaatcccaaccaggaacaatgcgtgccagcccagacgtggaatgacgattgcggcggtgatcgctgccagaatggcaccaatttggccaccaattgcggcaaccgatgtcattttgccgatttgatttttgtggaaggattcggcaatcattgagatcccgacgccatattcaccaccggcaccgattcctgccaagaatcttaatatgtaaatcaatgtgatgttattggcgaaggccatcattgcggtggcaaatgcaaagatgaagattgtgtaggtgaaagtcttaacccggccaaagcggtcaccgatcagaccaaacatgatcccgccaaataacattcccaagttggtgattgaaccaatcaatccggcagcgccaccgctgagatgaagttggccaatcattgagctcattgcaaaagataaaaatagcacatccatattttccagcgcgaatccagaactggtagaagcaataacccatttctgattcttcgtaaaagtatggctgtgcgtaagtgctgcgtttgtattttccatgttcgttcctccaaatgaatgctcgctgacattctttatttttgctgttcacattattacatggatgttttggaaatgcaagttggtcaattaaggatatctgtgattgtttgcttagctcggacaaaagatggtgtatcaagtaggctcacaaattctgcatgatgactttgaaagtcataagtaaaaaattgaagtggattcacaaaaccatcaattttttcattattaactctgattaaaaagccactttctcgtaaggagttattcattgcatgggttatgggagcaaccactaccaagtgagtcattcgactgtacccttgattgcttaaaactagagcagggcgtcgctttctgatttcatgaccgacggatggatcgaaatcaatgtagatgatgtcttgttgatttgggacgtatgggctaatctttggggatttctctgccaactaatttacccccaaattcttcttgctgttttaaatcgtgtgattctatgaacgcttcattgtggaatggattatcatgctttgggacataaacaattaccccatctctaccctgaaaaacatcaaactcgtgtgcgattggcttgatactgtttggtacagttaaggtattcgagttgccaactttgcgaattttaactgacatgaatatcacttccttctttcgtatacatgaagtatacacataatgtatctgatgttcaacaaatatgatcactaagtttcacttgaacaacctggtccatcgtgataaagttataaacaaataaaagagctttaatttggttcagagaggccaaaagcggacgacaattaatctaagagtccgtgattttgtgggatttagtacagggatgtactgaataatacacagtctcgggctctttttctgtcattaaacaggagggtaattatgcgaggaccactaattgtatcacttgatgtttggaatcgagaaggcttgttcaagatcattgaccagtttccaaccgacgaagggatgaccgtcaagatcggcatggagctgttttacggcgaagggcccacaattgtcaaagagctgctgaacaagggcttcaaaatcttcctcgacctcaagcttcaagatattcctaataccgttaagatggggatgatgcaaattggtcggatgggtgttacctatacgacggttcacgcattgggcggctcggaaatgattgcggctgccaaagagggcctcgagcttggcagtgaagaagctggggtgccgactcccaagctgctggcagtgaccgagctgacttcaattactgaagatgctttggaaaatgagcagaactgcaaattagatatggttgaccaagttgtctccctggcaaaattagccaagcgatcgggtgccgatggcgttatcacttccccgttggaagtcagttcactgaaagaacaggttggtaatgacttcctatatgtgaccccaggaattcggccagccaatttccctaaggatgaccaatcaagaaccgcaacgcctaaacaggccgcagaatacggcagctcagctttagttgtcggccggccaatcattcgagctgaagatccggttgctgcttatcacaaaatgttggaggaatggaattatgcaaactaatcaaattattcaatcactgattgaccaccaaattgtcagtatcaatcttgaaaaacccttcagatacgccagcggaatcttatcaccaatttacaccgactttagactaaccatttcgattccttcccttcgagatatgattgccgacggtttggcagaaaatatcaaagagaattatcctgatgccaccgtcatcggcggggttgcgactgccggaattccccatgctgcttgggtagccgaaagattgaatctgccgctgatttatgttcgggccaagcccaaggatcacggtgccggtaagcaaattgaaggtcgaattaccaaggacgataaagtggttttgattgatgatttgatctccactggcggcagtgttttgggtgctgttaaagccgttcgcaacgaaggcgtcaatgtcattggggttgcctcagtcttcacatacggcttgccggacgccgacaagaattttgccgacgctgacaccaaattagtaccattattgagttacgctgatttaattgcccaaggccacaaagaaaataaattctcagacgaagagtattcacgcttatcaacttggcacaaagccccttgggactggacaaaacgggaggaagcaaatgcaaaataatatctcactcgccgctcacattggtgactatcaattcgataatttattgttaaacgcagctggcgttcgttgctcaaccacagacgaactgaataagaccctggattcaatggcaggtggctgtgtcactaagagtgccacaccagaagaacgggccggtaacgaaagcccccgcatgaaggcattaccgctgggcagtattaactcgatgggcttgcccaatcatgggatcgattattatttgaaatttgctgaagaaaatcagggcaagaacggtaaacaagtgatcttatcgattgccggcttgtcaattgaccaaaatattgagatgctcaaaaaagtccaggaaagctcattctctggattgactgaattgaatctttcctgcccaaacgttaaaggcaaatcgcaagtgggatacgattttgacgccgttcgcgacgtcttaacttcaacctttaagttcttcaagaaaccccttggcttgaagctgccaccatactttgactttaaccagtttaatgggattgctgaagtcttgaatgatttcccaattacttatatcaacgttatcaactcaatcggtaacggtttagtcgttgatccggaaaccgaatcagtggtgatcaaacctaagggtggctttggcggcctcggtggcgattacgtcaagccaactgcattggccaacgtgcgggcccttcgccaacgtttgaacccggaaatttcgatcatcgggactggtgggatcaagtcaggcatggatgttttcgaacatgtgctttgtggcgctaatttggtgcaaattggtaccgcatttggttatgaaggcacaccgatttttgaacgaatttcaaaagaactcaaagatatcatggacaaaaagggttacaggacgctcgatgatttcagaggaaaactcaaaacaatttaagtatgattcaaggtcaagccagcaatggtttgacctttttatattcactaaagccaatggtgcggtaaaattgaaacaacaccattttgaaaggagtcatcctatgccagcaagtaagcttcccgatcatattgaagtgattggtggaaaagtgaataatttgaagaacattaacgtcaatattccgttacataaatttgtggcagtctccgggttgtccggttcaggtaagtcatccttagccatgggcattctgtattcagaaggtgcccgccgctatttggattctctggccacctacacccggcgacggattagccaagttggccgggccaatgttgactcggttaagcatattccatctgccttggcattgcggcagcggccaactattcccggtgcccgttcaactgtcggcacaatgaccgaaattttcaacgtgctgcggttgatgtattcccgtttgggttcgccaaaatgtcccaacggccaccaagtcccgccaaccattaagattgcggaagccatggacgtcatgggcgaccaaatgggtgtgattacctgtccaacctgtggcgtcaagttccacgcgtttggtgccgaagactttgcctttaattccgacggtgcctgcccagagtgtgaaggattggggatcaccaaacagcttgatccggacagattgattggcgatgaaaccaaaaccatccgtgatggggcagttgctgcttggcgaacaccgggcagaaactttatgccgattgttgcccaggcggctggtgtcagaattgatgtgccctataaccaattaacagaaaaagaaaaagagatggtcctgcatggtcaacagaaacattacgccatcgatattcccagtaagaatggccgggtttttcacatggacaacgcattgtacgaaaatgcctataacgccattgaggacagcatgaaaacgacgaagagtgagattgccttgaaacggctaaatcgtttttactgtttcttcacctgcccaatgtgtcacggaacccggatgaatcccaatcgtcttggacaactgattgacggcatgaacattgccgaagccagccatatgccacttgggaagctgccggcctttgttgaccgaatcaaacaatggttgccggacaatatgcagaaattggcccaaaacttgacgactgaattgctcaatcaaacgcaaccattgatcgacctggggttggattatttaaccatggatcgggctggcgcatctctttcgaccggtgagcttcaacgaatccaacttggccggacgttgcgaactcagacaactggagtgctgtatgtcttggatgagccctcggtcggcctgcaccctgacaatgttgccggtctcatcaagatttttcaccaactggttgaccagggaaattcgttggtggtcgttgaccatgaaacggcgattattaacgcggcggattacatcattgaaattggcccggggtcgggtgtcaatggcggccaagtgattgatcaaggaaccccggctcaaattcgccagagtcagcattcattaattggaccgtttttgactgggaaagcgcagttggtgacccgaaagattgccaatgacgatgtttttgccaaagggtctgtgacactgacaatcaaccagcggtttaacttaaacgatgttaccgcagaatttccggttaaccggttgattgccgtcaccgggttctcaggtgccggtaagacgacactcgttttggatggtttacttgatgccttcactgcaaagtttcacaagcattcattacccagttatattagcaagtttgaacccggcaaaatgaagcatatcgtcagtgtggacgcgactccggtcgggaaaaacgcccggtcaaccctggcaacctacaccaacattatggacaatctgcgcaagaagtttgcccagctgcctgatgccaagaagcatcactataccccaagttatttttcctacaataataagcagggggcctgccccgcttgtgggggaaccggtgaaatatcgctggatattcaatatctgcctgacatggttgaaacctgtccaacctgcaaaggtcgccggtttaaccaggatattttgaacattaaatggaatggcaaatcgattgctgacgtccttgactacgacgttgatcacgccattgacttgtttaaagacgacgaatccattttgaagaccttggaagtcctccagcagatgggactgggttatcttcacttgggcgaggccactccgagtctatccggcggtgaggctcagcgattgaagctgacttctcatatgaagagccgccaaaatgatacgttatttatctttgacgaacccacagtcgggctgcacccactggatgtgcatgtgttgttaaaagtcttttcacagttgattgaccagggggccaccgttttgatgattacccatgatcttgacctaatggcgaatgccgattatctgattgacatgggcccccgtggtggtgatcagggtggtcggattgtcgccaaggggcggccggcggacttggttaaggatccgcggagcttgacgacaaaatatctggcggaacattttcaaaaatttcaaaagtaggtaaacaccagcctactaatcaatcttgcggattggtgctgagttgattgaaattgtatgtaggccttcacaaaatactattgacaccgttagatgaaaattgtaaattgatttagatagttggttttttaaaacaactttgatgctacaaccaaaatatggtatttaatctgaagtgtcatcatcgtaattagtgccttcgtgagaatatagcggtatctcgtggctcagtaaggttgattgttgaatttagtgataaaaaatggagggaataattcaatgactaatgcaacgggtagggagcagcttcataagcgaaacttgaatctagttctgcaacaaatttttaacaatagtattatttcgcgaattgatatttcacacacgttaaatttaaataaatcaacggtatccgctttgtataatgagttagacaaaaagggtctgctgcaggaagtcggttcagggcaatcaaccaatgttggtggtaggaaaccggtcttagtcaagattaatgagcaatatggatatacgatcagttttgatcttggtttccgtcaccttcatgtgatgggcaattatcttaatggtgaggtcttttactatcaaagaattgagcttggcagtagagatattcaaaaaattctgggaatgattgatcatcagattaaagtttcaatgcaaaacgatcagaccaagcgtggactactcggaattggtttttccattcatggaattgttcaagataaccaggtgatcaattcgccttttatcgatatgaagggtgtggatctggtcggacgatactccacaaagtatcgagtaccggtccttcttgaaaatgaggcaaatctttcaggtgtttatgagcgcgatttcaatgacggcaaggataagaataatattattgccattagtattcataaggggattggtgcaggcattattttgaacaggcagttatacagaggggttaatggcgaagcgggagaaatcggccgctcgttgatgtttaccgaaaattttactggcagtaaaaatgataaggtcgaagacttttgctcagaagatgcaattattgagcaagtagaagttcagactcatcagaaaaatttaacacgtgaggatatcgtacagagaaatcgtgctggtgataaagttgttcaaagtgaacttaaacattttacttatgcaatttcgcgggttatttataatgttgcaattagttttgccccccaagaactctacttgaactcaccattgattgaagatattccaacgttgtttgatgatatcgttgataatgctcagaagcttgggatgaagatacccattcggctaatcccccattcaggctatgcaacgcttttggggtgttgctcattgttgacacatcgggttttggacatggatgagtataatttgacatttacaagtcagaaataacaatataatatggccagtgatttgcttgagcaagtagtaggttagtatattaaaaagttgaccaatattgaaagaatactcttccaaaaaggtcaacttttgatttatccagagatgtaattctcttggatcgccttatcatatttagtcactttggatgacttgcgatactgtgctggtgtattcccggtgacgtctttgaaattacggttaaaggtccttagattttcatagcccacgttaaaggcaatgtcggtaactggtaatgaagtgttctttagtagttcacgtgctttggaaatacgaaaactgttgaggtatttagtatacgaaaggttgattgttttctgaaagagtttggataagtatacatagtcatagccgattgagtcagcaatttgcttgagtgtgcatgattctgtgtaatggtcattaattatgttaacaatctcattgcgggtgaggtggcaattcagtcggtcctcaatcggacgactccttaccatcagccacattcaactataataaagggttatgcctgtgtttatggcggagatgatcgttattttaacaatttgtttgttgccgagactggcgtatcagaagacgacaatcacattggaactgcagagtacgatggtagtccaacatcaatgaaggaatatattgccgcggttgagcaaagactaccgggtgatgttgagttgtttgaaaccatccgacaaccagtctatatcaacgacaatgcgtatcttggcgatgctgatgcattttcgaaagaacaaaacaatatccgattacgtaattgggatgcaaagttgaagctaaccagcgtagactcgcatatcgtgttacaactcaacgttcccgaagaattgttcaacacttgtgttccagttcagaaaacgagttcgctcgggaaagtgcgtctggccgatgcagtttttgataacccagatgggtctgctttaactattaataatggcattgataaaaagaccggattaagtaagcgaattattggtcctttttctcagctacatcagggagtcaatcaaatcgtattatttgacgatttggagcctgattgataatagatatataacataagtgaaagtaagtgggatgtgtgaactgaaacccacttactttttttgtttatcgataatattccaaactaattgtggcgattttgcgcaaactaaaatccagttttaaatattagatgacaaataatgtccaataaatgtcaaatacaagcatatcggtaagttcgtttaaaagataaactaaccatgtacttaattaaggatcaactttctgaaagcgcttcaagtaactgataatgaatgcactttttaaggtgatagcgttctgacctaattgcatatgtgatgattcgtgtaccaaagataagtggcggtgacgaccgttagtgattgttgcaatcagctaatttttttgatgaaaatgtaagcggcttcaagtgtttgttttaagacaacaaacgattattgaagatattctaatgaacggaaaaggtgaataaaatggcacaaaatgaaaatgttccagaatggcatggcactgttttggatagtgaacaacctaagaaaccaattaaaattgggattgccactgggattggcgcactgctgtggttaggaccctatttgggtgttaatggggttttgcttccagcaaaagttcagcagattattcctaatgaaaaagctcaggtagttgctttacttgcttctgctgccatgatcgcagcaacgttagcgaatattattattggcggattctcggatattacgcgatcaaggtttggtcgcagaacaccgtggataattgctggatcggttggaagtttattaacactgctgtggttcaatatggtaacgacagtgccaatgatggtggttgcttggtgctcgtatcaagtttgtttgaatgcgattgttgcgccattgcttgcttttttacaagaccaagtggcccctaagaaccgcggaacgatttcttccatttatgcttttggatatgtgattggacaatatggtggtcaagttgttggggctcaatttctgagccacgttggtactggtattgttgtgatggctttcctaacattactttcaggaccaattgctgcaattatcgttcgtgagccttcaagcttgggaatgcctaagaagcattttacagcgggaatggttgttcaaaactttgttttcccgttacatcaagcaaaagatttttacttagctctatttggaaaattgttgattaacactgcaactacagcaattatgggttaccaattgtacattttgagtgattacattcagttaaatacgggtggccaacagaagtacatttccatcatcaacatgatgctgatggtaactgcgattatcatgtcaattactgctggacctgtatccgattggatgaagagccgaaagatcccggtatttattgccgcattcttggttgctgttggggtggccttcccgatgttaagtaataatccttggactatggtggtttatggattgcttgccggattaggaatgggaattttcttcgcggtcgaccaggcacttaacctagaagtattaccaaacccacaaacagctgctaaggatttaggaatcctgaacttggccaatactggttcacaaattattggaccgattgtggctgctgcaattgtcacagcttcacacggtagctattttggaatcttcccagtatgtgcaggtcttgccctcgttggtggtattatgattctcttcgttaatgaacatcgtgatgttaaggttcaagaagagaatgccaaataaggacagttttaacaatccttggcccttagtccttatgaaccaaggattactctaattaatgtaaggacaaatatacgatagaggtgaaaacgtttatgactgctacacaaattgaaagtactcaagattcaaaactggttgagagtcagttgagcaccacgagtgagaagctccataataatctcgaagttggcatcgagaaacgtcaagaaatttggggctttggtcaaacatttaacgagttgggctggcaagcactacaaagcctatctgaagaaaagcgtaacgagatattggacgatttgttcaaacccggagagggtgaaaattatcgaatttgccggatccccgttggtgccagtgactatgctttgaattggtattcattagatgaaacacctggcgattatgagttaaaggatttctccatcgagcgtgataagaaatacttaattccatatatcaaagctgcccaaaaacggaatccagacatcgtcttttccgcttcaccatggagcccgcctacatggatgaagacaaaacccgtgtacaattatggaatcttgaaacatgataagaagactcaacaagcatatgcgaattactttgtaaagttcattcaggcatatgagactgaaggaattcacattagccaactgttcccacaaaatgagcctcaacgagatcagaaatttccttcatgctactggactggtgaggagttacgtgacttcatcaagaattaccttgggccaacttttgaaaaagcagggttgaataccgacatctggttaggaactatcaactcgccgctcgaagatactgaaatgaccaaggatgaaaccaccgactatccagttattactgaaacggttctttcagatcccgctgcttatcggtatattaaagggattacctatcaatgggcaggtaagtctgtccttcaacggactgtacaagcattcccggaattgaactatttccagtcagaatctgaatgtggtaatggtaacaatacttggacttatggggaatacgtctttaacttattccgtcactatatcagtaatggtgtgaacgcttatatgtattggaattctgtcttacaagatggtgaaagcacgtggggttggttacagaacagcatgatttcggttgattcaaagactggtcagacgacctataaccctgaatattacgttatgaagcattacgcacattacgttcgaccaggtgctcacttgctttcgtatggcggccacgctgctggggaagcaactgcttatgagaataccgatggtagtgtcattgtggtgatgtctaatagtatgaaccatgatcgagacatctcgattgatgttaagggcaaaacatacgaggctcacttaaaagaacattcattcaacacattcgttttctcttaacgaggttcggtgttaaaaaacggctggatggatttaaatattttaaaagagcttgaaaaagtatttgcgacatggtaaatttaaaatgtaagttggttgattgaactaactaactaataaaacctggaggcttgcttattatgagttattggaacgtagataaaattaagtatgtcggtaccggagagaaaaaatcaggattaggatttcaatattataatccggatgaagtcgttggtggtaagaaaatgcgtgattggttacgctttgcggtcgcttattggcacacatttgaccaacggttagtcgatccgtttggtgatggaacggctattcgcccatatgacaagtacactgacccaatggatcaagcgttggctaaagtggatgccgcatttgaattttatgataaattaggcgttgactttctttgcttccacgaccgggatttagctcccgaaggcgatacgctccgcgaaaccaatagaaacctggacaaggttgttgacaaaatcgttgaaaaccaaaaaacttctggaatgaaagtgctttggaacacatccaacttatttaccaatccccgttttgttgagggtgccggtacttcaccatatgctgacatttttgcttactcagcagctcaattaaagcacagtttggaaattggtaagcgtgtcggatcggaaaactacgtattctggggcggccgtgaaggttatgaatcactttggaacactgatatgaaacgtgaacaagaacatgctgccaaattattccatatggctaaagactacgccaacgaaattggttttgatgcacaaatgctgcttgaaccaaagccaaaggaaccaaccactcatcaatatgattttgatgctgccactacgattgcctttatgaaagaatatggccttgataaagacttcaagcttaatttggaaggtaaccacgcgaacttggccggccatacctatcaacacgaaatccgagttgctcgagaagccggtttgctgggctcattggatgccaaccaaggtgataagctgatcggctgggacattgacgaatacccttcaaacttatacgagacgacagcggcaatgactgaagttgttgaaaatggtagtattggacctcgcggcggattgaactttgatgccaagccacgacgttcttcatttgaaccaaatgacttgttctatggccacattgtcggaatggatagctttgcagccggcttgagagttgctgttgcaatgaaaaacgacggcgtccttgatgacatcgttaaaaaccgctatagttcatttgactcaggaattggtgcagatattgaatctggaaaagcaagtatggcagatcttgaaaattattcactggataaaactcaaaaagatcttcgcgatgcaactcattcggatcatcttgaagagattaaagatacaactgaaacttgaaagtatgaagacagactgatcccttggtatcacagggcatattttaattaatttaaccatttagcttgctgttaacagcgaaactaaccgtttcggcaaaaatgtgaagaactgattcatcatctgaataatttgggctcttcttgcataaacttcatgattaataatcgtttttaacgaatttagaagccataccagtgcttgagacaactcaatatctggcatggcttcgttcattataaagaataaatccccaatggtgcgatcatcctg

SEQ ID NO: 162 - DNA, 61025 bp, Lactobacillus buchneri
cacagaagttaagcttctgcacgccaagagtagttgggggatcgccccctgcgagggtaggacgttgccacgcgattattccggcatagctcagttggtagagcacctgactgttaatcaggttgtcgacggttcgagcccgcctgccggagttattatttttaatggagagttgtccgagctggccgaaggagcatcattggaaatgatgtaaacgggtaaaagcctgtttcaagggttcgaatcccttactctccgtaaccgaataataagtttatgacccgttggtcaagtggttaagacaccgccctttcacggcggtaacatgggttcaaatcccgtacgggtcattatggaggattagctcagctgggagagcatctgccttacaagcaggaggtcacaggttcgatccctgtatcctccatttccatagcaacattggttcgttggtctagctggttaggacgcctgcctgtcacgcaggagatcacgagttcgagtctcgtacgaaccgttgttatgtatttgaaaattgaatgcacaacataggtattattatactcaagatggttaatggctcggtagctcagtcggtagagcaatgcattgaagctgcatgtgtcggcagttcgattctgtcccgcgccattcatggaggggtagcgaagtctggctaaacgcggcggactgtaaatccgctccttcgggttcggtggttcgaatccactcccctccatcttatagggatatagtttaatggtagaactacggtctccaaaaccgtcggtgtgggttcaactcctactatccctgttaataatactatggcggtattggtgaagtggttaacacatcggtttgtggatccgacacgcgtgggttcgattcccacataccgccttttgattgggttatagccaagtggtaaggcaacagactttgactctgtcatgcgctggttcgaatccagctaacccagttgggttagccaaagttatggcggtatagccaagtggtaaggcagaggtctgcaaaaccttcatcgtcggttcgaatccgattaccgcctttttccatgtgttggccaatcaaatattattttgccggagtggcggaattggcagacgcgctggactcaaaatccagtgatcgttgagatcgtgtgggttcgaaccccacctccggtatcactaacaaatatcaataaaaaaggaatcattgaatatcaatcaatgattccttttttattgacttgaaattgaatcaagaacaaaaccacaattaccgatacataccacaaccacgctcaacacgaggctgtgattgatgcggcgttgtacaataatgagtgacaccaacggcacccgtacacagcgttaaggcggatgcacatacaattaaaaatttcacggacgttcaccaaccttcataagttaatttaggatagcattctacgtgatcattttaacatagagctcaatgcgagtcattaccaatcaatacaggactgattaacgatagtcggatgtattgggtgagggagggtaggaaaattagtgagcctccattaccattgcctcactaccgttttttagtttaaataggtcatctataaataatcagcgacaatttttaaaagaaaaagattgaagattatcgtcttcaatccaaagttgtcttgattcagctagggtctagcatattgattaccacgcgatgcttgggttgcaccactggcatttgcttgaaaaacactctcgtaatggtaattattgggattcttgacctcagaataatacttgtcactatcagaaacaaacaccattccggatccagcaattgtccaaccgccatttgtagttgtggctgtagcactctgatgtgaattggagctcccagtcgaagtagttgaacgatgatgtgtataagccatcgtcgagctgcgtcggtgatactgtttggcgttgttgctgccgtcttggtaatcaattcggataccttcagcgtcattgataaccacaacttccgtgttcaaagatttatctgatgatcggacatcgacaattgatccacggggcatcgtttcgcttcccttatacaggggagttgtttggtaataaataacgtggtgagtattggggttgtcttcccagtaattttccgccgcttcctctgcggcgcgcattccaccattttgatcggcgcccacattttgcggtcgggtacccgttgtgaaattgtagtttgatgtatatgatttggcccccagcaaactgtcaccaatcgagtggctccggttgtaaaggtagccatggtaggtccgccccgtcagtccataggtaattgacaccatcttgttttccggccatgcaggaggttccagtggatctccttgacgaccgccctgggacagatgatattcagaataagtcagcactgctcgggcagtcgcagatctgccttgggcatcagctgagaaatgatagtcaccagctgccagcccggcaaaatggctaaaatgagcttttccagttgtccaataataatcaccagtcggcccggcggattccttgttggtataactcaccagcttgttcaaaatggcttggtgctgttggcttgccgacgcagttgaactgtggtgtgaatgagtatgaactttttttgctgattgggttgcatgagaactactggttgtagccacctgcgatgcgtgatgatcggcggcctgatgactgccactgccatcgctgcaacccaccaagccgccagttatggcaatcaatatgacggctgttagcaggatatgttgatgtgatttcacgttgtgatccccctcaaaaaatgtttcgttggccaaatcaatcggccgcataagtcgtaatacgataaaatgcgaacaactattcatttttattatacagttgaatctcatctgttaacagacgaactggaagatcgatttggttaaagctagaataaggatcaagaaacttgagcactgatgggggacttgcttctagagacccccatatgaggatccgaaaatgtctgacgatcctttcgtagtgtatgccattgaacgacacactaaaatgtcaactgacgataaaaaagcccgtcacgaaatatttcgtaacgggctgatcaatttaatcatctaatctattagacgttcaaaattttattcaagaaatcctgtaatcgttcattctgcgggtgttcaaaaatttgttctggggtaccttcttcaaggatttgaccgtcatctacaaacacgacccggtcggctacttccttggcaaatcccatttcgtgggtaaccacgaccattgtcattccttgtttggctaagtccttcataactgctagaacatcgccaaccatttcgggatccagtgctgaggttggttcatcaaacaacatgatgtctggattcattgccaatgcccgcgcaatggcgactcgttgctgctgaccaccggacaatgattgaactgtcgcatcgaacttctcctgtaagccaacggttttcagtaactttttagcctgaacagctgcctggtccttggtttcctttttgagttcgacaggagccaacataatgttttcaccaacggataagtttttgaacaaattgaaatgctggaacaccataccaatattttcccgtaccgcgttaatatcaacatcatttctggcaatgtcgacattgtcaataacgatcgatccagaagttggttcctccaacttattcaggttgcggagaagggtactctttccagatcctgaagggccgatgataacgaccacttcattcttttgaaccgttagattgatgcccttgaggacttcattgtcaccaaaggttttgactaaatttgtgacttttactttttcgctcataccttagttctcctttgtacccaatttgataaccaagttaatacagtaataataatcagataaattgcggcaacgattgtccagactttgaatccttccaagtttctcgcaataataattttaccggtctgggtcaattcaagcaaaccaataattgataggattgacgtatccttcaaagtaataatgaattggttaataaacgacggcaccataattcgaatcccttgtggcaggataactttacgcatcgcttttccaaacggcagtcccaaacttctcgaggcttccatttgtccgggatcgacggcttgaatgccgcctttgacaaacgcggcgatatacgcaccttcgttaaaggtcagcgtcacgaccccggcgacaaaggcaggaattttttgcccagtcaaactcggaattccagtataaatgaacagtgccaaaaccagcaggggcattcctctaaacaggtaaatcaacgttgtcgaagttccttgactgaatttgttaggcaccacgcccatcaatccaaccaaaacaccgaagatggttgcaaagaagattgataccactgtcagccaaagggtttcttgcagccctgaccatagggcacctttattttgcttaattaagccgataaacgtccggtcttcggcgctgttgccagatgtcttggcagctgtcttaatctcatcagcacccaaatatttggccttaatgctatcatatgtgccgctggccttcagatctgccagtccttggttaaacgcctgcagaagtgcttggttatgaccttttttaaccgcaaagccatatggtgcgttcaatgcaggcttggtgacaatcttcaacttggttccttgcttgattgcgtattgcataaccggatgatcttcaaaacaggcaactgaattgccggttgagacatcttgatacatattattggaatcatcgaatgtgaccactttaaagccgtatttctttttgatgctattagcataatcggcacccgaggttccggttttaaccgcaacccgtttacctttcaactctgacaatttatgaatcttgctgttcttagcaacagccatgacaactccagaattgaagtacggtttggaaaagtcaaactgggctttccgttcgttggtgattgacattccggcaatcacaccatccgcttgaccggattcaacggcttggacggccgcgttaaatcccagggctttaattttgactttaaagccttgttcgttggcaatagctcggattaaatccatgtcaattccgacgtatttgttattcttgttggcaaattcaaatgggggaaaggtaacatcagttccaataacgaaagttttgccttttactttggaattattggcgtttcccagatacttaccgacaattttgtcgtaagttccattcgcctgaatctttttcaggccggcattgaatttcttaattaatgccttgtgagtgccttttttaacaccaaacccataccaaccttggttagcgggcttgctggcaatttgaagctttaaaccgtgtttaatgccatactggagaacgggttggtcgtcgaaacaagcaaccgagttgccggtcgtgacgtcttgatacatattatctgaatcatcgaatgtcacggtcttaaacccatacttcttcttcaaactattggcatagtccgcagcggccgttccggttttgagcgccacttttttacccttaagttgtttgaaactggtgatgtcactgccttttttgacggccatgaccgcaccagtcttatagtagggtgttccgaaatcaaacttatcttttcgttccggggtgatcgtcatcccggcaataattccgtcaagctggccggattgaacggattgcaccgccgcgttaaatccaaccggcttaacattgactttaaagccttcctctttagcaattgacttgataatgtcaatatcgattccaacgtatttgttttccttgttggcaaattcaaatgggggataagtaacatccgtcccgatttggtacgtcttagcttgtgctttgctgcctggtagtgccagacagaacaagatcgtggcaaaagctgccagcaatccgaaagccgttaacactttgcgcttcatgaattattcctcctagacatatgtaataaaacataacatataataatgagaacataataccagaaatttgtgaatctgtatagcattaaccaatttgtgcaaacggtgccaagcttgctgcgacattgcaaaacgctgagaattattaattttaaattagaaaatgtgttgacattgatttggcagtttatcataataatcattaaaattcatttagcatttttatgatcatttatacataccacattggaggaaatcagttgaaatttgaagaatcgaacgttttacagcagttgccgaaacaattttttgccggtctggtcaagaaggtcaatgctaaagtggccaccggtgcggatgtcattaacttgggtcaggggaatccggatcagccgactcccgattttattgtcagatccatgcaggagcaaaccgccaatcctgccaatcataagtattcgcaattcagaggtgacccggaactaaaacaggcagcggccaacttttatcaacgtgaatatggggtcactttggatcctgataaggaaatcgccattctcggcggttcaaaaattgggttggtggaactaccgttggcactgctgaacccgggggacacaatgctgctgccagatcccggctatcccgattacctgtccggcgtttcactggcacaagtcaaactggagctgatgacgctgcgtgaacaagacgactttttgcctgattatcggaccattaaacccgaagtcgtggatgcggctaagctgatgtatctcaactatcctaacaatccaaccggagctgtggccacgccggaattctatcagcagacggttaactttgctaagaccaaccatattggtgtggtgcaggattttgcctacggggcgattgggtttgacggccgaaaaccggtcagtttcttacaaactccaggtgccaaagaagtcggaattgaaatgaacactttctctaaatcctataatatggctggttggcggattgggtttgcggccgggaacgccgatatgattgaagccatcaatctgattcaagatcatttatttgtgagtgtcttcccagccatccagaaagctgccattacggctttgaatagcgatcagcagtccgttcatgagttggttgccctctatgaaaaacgccggaatcaatttttcaaggctgctcgagcaattggctgggaaccctatccatccggcggttcgttttatgcctggatgccggttcctgagggctataccagcgaatcattcgccgatctactgctggacaaagcagcggtggctgtcgctcctggtaacggttttggccaaggcggagaaggtttcgtccgggtgggcttattaattgacgagccgcgatttaccgaagcttgtcagcggattgccaagctgcatttatttgattagagtttactagcaacctcgttttgcgcctaaatgttatctagcagaactgtgcgccaataagcagcttccggccgtataaggggattacccaaacatccaagttctggatatttgggtaatccccttatactctggaagctaactgcttatttgcccacgctcgtttgcctaaatcgttaaaatcagccgatcgcgcagctttattttagataatcgtggaactcaaagccaagcatctttggccgcctccatagttaccagtaaccaagaagtttggtcaattttgctcgattcaaatcgcgattggtgatcgtggccatttcggtgccatccaatccattgatggatttttcgaccggcttctgccatgcatatttggcaatcatattgccggcactggtcgctgcatacattaagtctgcctgatagccggtgtggtcaagcccaagggtatggccaagttcatgtgccaggacaccatcccaatattgatcaatcgtaaatttggcagctagactgggtttgatataccccagcggatatttggcatcgtgatagtgggctttatcaatataaatttgcctgccgtcgtaaagaccatcccagccttcttttgtcccactgccaaatgaaatctttaaggtatagtggctttggcttcccatctgaaagacggtttcacccaaggcagtattccatttgttcatggcgttttgaacgtgctggttcaattctggattggccacgtaaatcaacgcttgatgatccttgaacattgaggttggcgaaaaatgaaaaacgttatatgccaagtcaaaaacagcttcatgggtttcatagttcaccggtttcagacttaggatagtttcatccggattcatgtctggggctgcattaatcaatttcatcagcgacttctgagacattgccacttgcgttttggttaaatagccgtgccaaatataccccgttattgttttgcttttattggcaacataatagtagactgccgttttaccattcggctttctgacggtcacccgtttagtagcgtagaagatcgtttccggataatttttagcgttgtgaagtttttgcgttagcgttttatccccatagataatccctttgactgctcgataggctgtgcttttctggggagtgacccggacaacttttgccgctgtggtttttgcatcagccgaggttgcggcaacatcaatcatcaatgcaaacgaaagcagtccgactgccagcaacgttaatttttttacgacccgattcatttgaacgtgcctcctcaaagctgcaagtgtttccattaatataccatatccgattgataatttgctacttatggccttggccgcttctcagaagttgtgaccgtggattttatcagtggtaatctctggcattggttctaccagatgggtcgtatccctgtattcgatgcttagatgactcatgtttttaaggtcggagagaacctgctgatatttgtggggatcgtgaaccaatgctaataactcatgtgagcggaccaacttggtttttaatttccgactataaatgaagaagtaataacggtcgttaaaatggttgtcgacgatcaccaaccagtattggtagttgggaagtcgcttgaagtattggtggtacttgtcaattagttctcttgattctgccagcatggtgaagacctccttgagataaatcgttaagcttgatggccgccaaccaaaccggcacggtcgattgcggtaccgcctttggttttggacgaagctctgattagtgctttgtaaccgtattttttgcggataatgtcgatggtttgctccaatttttccttatccaaggtagtgataggatcctcaaacaggctgaagcgggtttcacgcttttttgaaagccgattgcagcgaaccccgacgttacgaactgcgctgccgtcccatttactttccaataaatagtggacggcattggcaatgcttttggttgagttggtgggttcaacgtgcatttgggctgagaagtgggttcgcccctgcttgtctgtggtggccatcccgatgaaaatactgacgacttcagcgacgacgttgttttttcgcaggcgggtcgcgacttgatcggcaatttcaccgaaaacagtttttagatcacccaattccgtgtagtcgcgcattaatacctgtgaattgccgtaacctttattgtctgaacggggaagataacgcttctcaaggttggagtagtcaatgccccacgcgtggtaataaagctgttcgcccatgacaccaaatttcttctttaacagattaacgtcggcgtgggccagttctttaatggtataaatgcccaactgattgagtttgacggccgtgtggctgccaattccccacatatcggcaagatctggaatctgccaaatagtatcgggaacgtcggcgtagtcccattccgcctgccaaggttcttttttcttggcggcgttatccaaggccagtttggccagcaggggattttgtccgatgccaatcgtcgtgacaatgccggttgctttaaaaactttgtcttgaatcaatttggcaatttgggcattggaaccaaataatttgtggctgtggctgacatcgatgaagctctcatcaatggagtaggggaaccagtgaatatcatcggtaaattgacggtagatgcggttgattcggtagttaagggcaacgtaatcggccatgtgcggttccaccatttcgatatccatctgatcattaacttcaaatcgccgagtccccagtttgacgccaaagtttttcttggtgtagggactggcagctaaaatgagtccaccggaggattcttcgcggctcatgacggcaattttggcggaaaggggatgctccccgcgcttgatggcctcagtggaggcgaaaaacgacttgcagtcaatgcacataatgtcgtggctgggcaaaaggctgggattatcaagaggtgtttgcataaggatcacctgcgattggaaaagttttattgagtatctatataatacgaacatttgtttggtgtgtcaagaaaaacagagcgcggaccaagccggttagcttctgagcatttatgtaatcacgagtgttgatgcgggttaggcatcaatactcgtgattggataaagcggaggaagctggcttggggagcgcattttgaaaacagagcgcgacgagacccgtttagggcccagaacataagtgaggaatgccaatgatgaacggtctgggttcatcgttggcattcctcacttatgtggccgggccctgggtcgtcggagcgcattttcaaggccgaagggagcagtaaatataataagcgcaacaaacttggtggaatctaacccaaaataacatgggaaaaggaaggtgatttatgtataaggaaaattgtatctgggtagaactaaccccaaaaagatcagtaactccacaaaaaagcgcccctcccaagttttccgccttgagaagagccgcttcaatttcatttttatcaattatcatcaatttcatcaatatttcaaaaataatcagacgctaatttgctgcttaaaaaatatctgagttaatcacctgcaactttcaagaacacggcgccaagtcccttatcaaaggttgctttccagtcgccattgctgagtgattcaggtagtaggaaagtaccgcttgaaacgcgttggccagcttgtaggggcattccttgtgattccaacttttcaactaaccagtggagggactttaacggattgcccaatacttctgatgaagcgccgtcctttagcttcttgccgtcatggaatagttcacatttaacgttggctagatcatcgacgttgtcaaataggagattggtatctttttcatcaccgtaaacgacgtagccaccaacggctgcatctgacatgaccatatatttagataggcttgggaaccagtcgctgaagcgtgaatcaggtacttcgacggctggagcaaccttggtctttctcatgagatcttctaaagaatctttgctgctgagatcttctttggcagtaaagagcatttcaacttcagcaagtggttccatgagttcgccacggtgaagggtaactggggattgtaggaaatggctcttaacttgggcgccatatagtggtgagtcggagtcaaacatatcttgagtttgcttactggtaagcgatactttgtagccgccaacgtcttcctgcttgagttgggttagtcgtctttgaacccgataggctgacttttcatccttaacgacaccatcatagtcggactcttttaatggcttgtgtgtctcgtaagcgttaaataatttgtttgctaattcattttccttagttgttaattccatcgttgcttgttcatccataagcgtttcctccataaattgtatttaatctgtggatcctcaactgtatgtacagtgaggaccactcagtgacgtgaaatatatgtgttgttatgtcaatggcactatgtcggttgaaattatgtgtttgcaaaatctgaatctgacctgggttttcattggagctgctaatcaccgattccataagtcctcaccaccttaaataattaattaaattcaaataaaaaggcatccttcaactacccggaaatggatagttaaaaggacgcctattgcgcggtaccaccttaatttgtagtgctattactagcattacctcacacgtacagctttcgcgatacgctgacacaataatgggtgcacccaatgcaatctactaaaactttgatcacatagctcggagatgataatcatctaaggacgtaaattgcttcacaccaaccagcaactctcttattacgaacggaaaatgacgtttctcttcatcgctttttaatttgaatttaatgattgtcattaatttacaccctgttattttgattgtcaacagcaaatttgaaattaattattctttgttgggattttctcgaatcacgcgggcaggattgcctgcaatgatgaggttatctccaaatgatttggtaacggttgaattagcaccaacgatgacattgttgccaagcgtaacgccggggagaatcaccgatccgccgccaacccaaacgtcatcgcccaaagtcaccggtttgcccagtcctacaaagttggctcgttgtttgggatcaaggggatgataagccgcgtaaatttgcacgtgtggagccagcatacagtgattaccaattgttaccggggcaatatccaagatgacgttatcgtagttacaaataaagttatcgccaacgtgaatattgtagccaaagtcacagcggaagttcggttgaacccaggggtcttttccgactgagccaaacagtttgcggaccagggcctctttttccgcaccggcagtgtcgtccagttcattcatcatcttacataagcggcgggctttagtttcgtcgttggttaattcgggatccatcaccaagtatggttcacccgctaaaaatttttccttttcagttgccatgtgattttccatcctttgttgtaaattaatttatattatatcattatttgtaagtataaattgtctttacacataatttattaggataaattagaaattgccgagtgacttaatatcgggtatgataaatgcaattaataatagataaccaaactcacggaatttgaaaggatgcagacaatgaaagcagttattacagtgattggccatgaccaaattggcattgtggcaaaagtttctcaacggttggcaactttgaaagttaacattaccgatatttcccagacgctgatgcatggtgattttaccatgatgctcatgggcgaatgggacgatgatgatgtgcagtttgaagttgtcaaacagggcttacaggatttggcaaatgagactggcctatcgattaatattcagcgtcaagaattattcgacgcgattcaaaagctttaggaggtcgccaaaatggaaaccaaacaaattttagagaccattcagatgatttctgaagaaaaacttgatattcgaaccatcacaatgggaatctcactattcgactgtattgatagcgatggtgttaaggcccggcaaaaaatttatgataaattgacgaccagtgccaaagatttggtgaaggttgctgatcgaattgaatcagagtatggcattcccattgtgaataaacggatttctgtgaccccaatttccatgattgctgccgcgtgtcacgatgataattatgtcgcctatgcgcagacaatggaaaaggcagctgaaaccctgggggttgatttgatcggcggcttctccgcgttggtgcaaaaaggctaccaatcaggtgatcgaaaattgattacttcgatgccggaagccttgagtgagacgcaacgggtttgtggctcggttaatgttggttctacaagagccgggattaacatggatgccgtcaaacaaatgggccaagtggttaaagatttgtctgaaatcgatccggtcagctgtatgagtctggtggtctttgccaacgcggttgaagacaatccgttcatggccggcgcctttcatggcgttggtgaagctgataaagtcattaatgttgggattagtggtccgggcgtggttaagcgggcgcttgaacaggtcaagggggaatcgattgacacggtttccgaaacgatcaaaaaaacggctttcaaggtcacgcgaatgggccagtttgtcggtaatgtggctgctaaagctctgaacgtgccatttggaatcgttgatttgtcgctggcgccaaccccaagtcaaggtgattccgttgccgaaattcttgaagaaatcggtttggaaagcgtgggtgccccgggaacgacggctgctttggcattgttgaatgatgcggtcaagaagggtggcgtgatggcttgtgaacatgttggcgggctgtcaggtgcctttatccccgtgtcagaggacagtgggatgatcaaagctgtcgagcatggtaatttgaatttggaaaaattggaagcaatgactgctgtttgttcggtgggattggacatggtggctgttccgggagatacgccggctgaaacaatcagtgggatgatcgcagatgaagcagctatcggtgtgattaacaataagacaacggcggtgcgggtgatcccggcgaagggcaagcaagtcggagagcaaattgacttcggcgggatattcggctatgcgccggtaatgccggtaaacaccaacagcccagcgaagttcgttcaaaggggaggaagaatcccggcaccgattcattcgtttaaaaactaagagcgcgacgagacccggttgaccccggtatataagctaaagacagcccctgatgaacggtctttgttcatcaggggctgtctttagcttatatgttaggggtcggggtcgtcggagcgtatctcaaaggttgaagggagctgtagatataatgagcgttacaacccctgtaggctaaaggacaaaagacaacccctgatgaacgttttttgttcatcagggctgtctttgacttatatattaggggtcggggtcgtcggagcgtatctcaaaggccgaagggagctgtagatataatgagcgttacaaaccctgtaggctacaaaaccaaagaaaatcgaacacgcatgatgaacgttttctgttcatcgttgcccgtcgttaagactacaaatccttctccaccacaacacaaggcacgccatcctcataaaacacatcggacgtgatctcataacccaggcgttgataaaatttgacggcgtccatttcactatgaatcagtgaatgagtgaaacccatttgtttggccttgtcttcaagggcactgacaacctttctgccaaagccatgtccacgggcttcctttagggttgcgactctgccgactttaagggtgtggtcattgtaagtttcaaaccgacaagtcgccactggcactttgtcatcaaataagaccgcataaaccatgctgtcggaatctttgtcatcgaattcatctcgaaaggcgattccccgctccaatacaaaaacggacattcgaatgtaagcagcagccccacgagctggtttggaactttccacgattaatttcataataggctcctcaaaatagacttcttgaactttaatattgagctggttatcctctgattggcgatactttaggatcggcaggccaatctttgccgacatcaacccaacggtcggcgtttgcatatttgctgagctcatcgacagataatttgactgcactgtgggtgtcacctgccgcagggtagatgaattcaaaccgctgaagggaaacgtccagatagactttaacgccttgattgagagcaaatgggcaaacaccacctggttgatggccaatatattcctcaacttgatctcttgggatcattctggcacgcttgtgaaattcggccttgaactttttgttgtcgactttggcatcaccggccaacacaaccagcagtggatgggaatcaatcaagaacgacattgttttggcaatatgttccggttcacaatttaacgcttcagcagcttccataaccgttgcgctggattcatccaagactttaatgcgatcggctaagccaacctcgtcaaagtactgtttcactttttcaaacgacatatctatcactcccgactgataaagattaagactaatatacaggttcacggaagaatagtaaataagatcttgattattccagaatgaaaaaaatgaatgagcagttaaggatttgtctgggactgaaaagtggctccagttctgacgggaatgggaattccaacagctaccaatgaccttttcaagctgccaatcctgatcgggacttaattaattgtcagattaatggtaacatgaaaccctatgatccaaaattatgagagaaaactgaagatttgtttaagtattgatttggcgagagcttttgctagattgaagtgctaaaacttcgtaaaatatgcttagagacagataaagggggttggcattagtaatgtcacgtaaagagaagttcgctaaaaagcctaagaaaaaaatatggatacggatcctggtgggatttgtgttggttctttttggtggcttcgtgggctctcatttctattttcaaaatcatttcaagttcaccaagattaacgacgttgatgtttccggtttgacggtcgctcaggcaaccaagaagttgaatacctcacatatcgatgaagacggcaattatttagtggttcgggattcaaaaatcaatgtgaattccaaggatgttaagaaattattcaaacaccgtagttcaatgagtgcgatgacttctgccaagctgagtgccaagtctgatgtaaccaacaagcaactcaattaccgcttgaagacgttactgccgaagtttgaaaaccgggttgatcaaatcaataccggtcgcaaacagaccattgattcaaaagttattttgaagaatggcaaaattgttgttcaagctggccagcagggaagcactctggataaggccaagatggtcaaagactttaagaagcaggcaaaatcgagtttattgatttcggttaaaatgactaaagatgcgtacgtcaagccgaatagcactcaaattgccaaacagaagaaacagttagccaacatcttggacaacactgtcacgttgaatacctacaacaagacctataagtttgttgccaaacgctgggttgccaatggttacccaactgctaacgggacctataagtttgattcaaccaagattaagaattgggtggccaaatttgccaataaagtcgatacccttggcaagtcggtttggattaccactcatcaaggcaagagggttcgtgttcatgctggtggaacctatggctggaaagttaatcaatcggctttaaccaaaaatatcatgaagaatcttggtcgttcacattccgtcacaatgaacctgaagcactatgcggttggaaccggttatggtgttaaggggtctggtaagacctatgtcgccatcgacctgcagcgtctccatgaatacgtttataaaaacggtaagctgatggctaatattccaatcatgtctggaacgttgaccggtggtaaccgaacccctcaaggcgccttttacattatgtacaagcagcgtcacgcaactttgagagggaagaacagtgatggttcaaagtatgcatcaccagtcagctactgggaaccattgaccaattcaggggttgggatgcacgattcaccatggcagcccgcctcggtctatggtaatccaagtgctcgtgcacaataccattctcatggctgtttgaataatccaccgtcacgaatgggtgaggtgtggaagaacacgcacactttggaacccgtatttatttattactaagaagtcaaatgactgttggcagggaatcgcctgccaacagtcattttttgatttaatatatgttaaactgatgataaatagcaaaatggggtgaacaatcgtgcatttatataaacacgttgatattagcaataaccgcaatttggtttatggtctaaatgtggtcgccgttattgcctttttaggcttcctgtggctgtttggtgccattgtcggctcaatgactgtcaacttcactgaaagctacttcgtttggctgatcgtggcattattagtgattgtgacgatccacgaggttttgcacgggattctttataaagtctttaagccaaatgggaaaattaaaattggtttcaaaagtggcatgttatccgtttccagccccaagtccctctataccaagcagcaatttatttggattggggcgactccatttgtcgtcatttcacttgtcctgattgcgatatttcttttgggatggctgcctggcgaattattcttaccattggcagccctgcatggggcaggttgtgtcggtgatttttatcttttatggctggtgataagttcaccgaagcactattacattagcgatcaagaaaatggcatcgatatttattcccccaactgaattggtggatttcaacggtgtctccgatacaataaagggattgcaaccaaagtctgagctttggcggcaatccctttattggatggttaacgttaatcttggaccaaaattttaattcctaaatacagattataaatgaacatggccagatccaccaggataactaacgcgattagcgccaggaaaagaaatccggcaaaggcggccttttcggaaatcacaccactgataccgacaaccaggatggtcaggatggtcagcacaagggggattaaatgcaaaataagcgcgtgtctggcagtgctgtgcatatctggattgttatcgctgacgatccaaacaatcagtggaaaaataaacggtgcgaagacaattgaaagataggataaagcattaacaattcgatttgtcgacatgtgagtaactccttagtgattggaataggatttgtagaccggcgaacggaaaagatcgacgaatgcacccccaccggaataatcccggagaacactgatcttttggccctcaacagttcggtgggtcttccgccagccacggtcactctgataggctttggtcgcataggcgttaaacgtgtaccggttcgtaccggaaattttagcaacagctaattttcgatagctcttccaagtggatttataaagggtatgctgcttgccgttgtatttttgggtgacggcgtatttgttaatctgggtcaaacagaacttcccgttgacgtatgaataccaattcccgcgccagctggtcggcgtcgaactgtgaatggcaccaacatgataataggtgtcagcagcttgagcaggctggtggttgacgaaaatggtaaaaatgaaactggcagctgtgataacagcaaccttcaacaatttattcatttaaattctcctaaaagtgtccggatcaaaaacagaattattttgacaaagttggctaattctttagattatactaaaaaatgatagcgtaccaagtgtggctttgtcaaataagcagaaaaaaaggcccgctgactttggtcaacgagcctcaccaatgcaattattgtttatctttacttcttctgattggatgctctttttcttctttatcaacggacttttgatacattttatcgttgacgtatggataggtccatttaaccatggccgacatgataattggcaaggtcaataccaaaatgatcaacccaacaatcacggtcatcgcaacttgaatcaaagtcaaaacgtttgacggaatcaacgcggcaaaagttccacccaagatgatggcagcggaaatgacgaccgttccaataatggttgccgaatttaaaattcgtcgacggacatccggaatggcgccggcatcaccacggtacctcatcatcaagaaaatactgtaatcgactcctaatgccaccaacatgataaaactaaagaacggtgtgttccaagtcagcatgttctggaacagcagatatcccgaaagccatttggtaatctgcagtgatcccatataggtcacgattaaggtgccaataatggtaatggcttgaaccagtgagcgggtaaccaccatcagggctaaaccgattcccaccagcatgatgacaaccgttcggaagaaatcgccattggcaatcttttgaaggtcagaagtttgagaactttgaccgccgatagcgaccttagcatttttcaaactggtgtccttcattttggcattcagatcgcgagtgattgtccgaatccggttagccgacttggtggtacttggatcggaattcagaaccacagtaatcttggtaatcttacggtcttttgacataaatgcgtcaagagaaggggtgaatgacgcactcttgatacttgcggcaggcatatagaaggtgttgcccaagtatgacttttgcatttccttcaagtacttgttaacagtggtggttccactggaaacttgatctaatcctgaattggcagaagtcaaaccagtttgtaattcctgcatctgactctggagctctttcattttcgaattcaatgtttgaacacccgaattaacttgagaactgccactagcgacactttgagccccggaaaccagtgatgaactgtttgaattcagtcgactagcgccacttgtaatctggttcaggccatttgagaacggagcaacttgtgaattcaagcggccaagaccggaagataattgtcttgatccggactgcaatgcggccatccgggcacgaagcgcctttagcttagcggtttggcttctcacttgagaaatccccgtgttcaatcgttgactaccagctgacaatcgaccgacaccggattgaagactggaggtgcctgagctgagttgttgcgaaccgctggccaagttgctgacaccggcagtgtatgaggtgacaccttggctcagttgttgcgcaccggcctctagtttgctggcaccgtcagctaatttctcaacttgtgcgatgctttcagaagtgtttgagttggctaatttttcgttggcactctttaaacctttttgaactttcttgataccttgattggcttggtttaagccgttcgtcagactttccagctgacttcttagataaagtgaatcaatcttggttccacctggacgggtaactgaggcaacactcttgaccccggcctcagaattgaggtagccggttaattggtcgatttcggctaaatgttgttgggtatccagtggtttcttgttttgaatatagacggtcgtcgggccggacatcccagcagggtagtgatcctgaatgatgttataacccgcttttgactgaaccgagttgggcaattcatcggcactgttaaaattgagtttctgactgccaacgaacaacagtggcaaagcagcaatgattaaaatcccaaccataatgaaactgtgtgagagggtgaactttgagaggaaattccacaggaaacttcgatcatgggcagccaggtttttgcttggccaaaagagtcgttctcccaaggtagacatgaagaacatattcagagtcaacagaaccattaatagaatggcaactccgacagcgaccgcaacgcctgaacggtagaaggagaacttggccaatgctaaggccgcaaaaccaattaaaaccgatgaaccactatacagaatggttcgtccggcatgtcgccgcgcacttcttgccgcgtcggttgcgccttgacccttacggatttcctctttaaagcggtcatacaataaaatgttgtaatcagtcccaattccaaacagaactaccaccagaaagacttgggtaaagttggagattgggaaatcccagcgctgggccaaattcatgaccacgtccaatgacagcaggtaggagacaccaactgtcagtaatgaaatgacaggaattaagaaggaacgaaagacgatgatcagcactatgaagatgaagattgccgcaatgatttcggtcttttgaagtccctgctcagtaaccgttgaaaaatcctcatttaagacatcactaccggttacgtaagttctcattcccggggttttaatcttatccaagattttatcagtctggccacgaaccttgtcttttttcggcacggtaatcatgaccatctgggtggtactgtcttttgactgcagctgctgtttggcagcttggttgtcacttggggctgtgacggagataatgtgcaggtccgggtcgttcttgacggcgttggtggcgtcttgaatctgtaaggtctgctcatcactcaacttgccgtgcttgttattgaaaacggcgatgagggttcgggcatttttgccgccctcatattttttctcaatcttattggcaacttcactctgcaccgaagcagggagctgaacagtccctttgtcatggaccagttgggaaatatttggcaacgtaaaaattgccaccaaaattaggccaatccacacaatcagtgataacagatgcttctctttgaatttctgcattaaaattcttcctctcattccctagtgataaaattattctcttgttcaaatttagacacttgtataagcaatattaaaatgataaactcggcgtgaatctgacgcaagggacattttgctgcgttagtttaaatttagacaaaattcgataaatgcaaacagaggctggctcatgaaatatgacttaacaaagaaaccaacgcgtggtgcgcaacgaaccttggaatcattttcgacgacgatgatcgcgcttctctccaaagagccgttcgaaaaaattagtgtcaacgagatttgtgcggtgagtaattttccccgagcgactttttataactactttgacgataaattcgacttggcagcgtattgctggtatgtaattgcccaagaaattgaagtggatcaggcgactgaattgaaagctgatcgaacgttgatcacctattttgatcgactttacgacgtgttcaaaaataaccagacgttactcgataacgtgcttcagtacaatgatttttccggacagctggttaacagttttattaattactttaaaaataagctgcaggaaatcctcaccaaatcaattgattattccaaggcgggcctaccggttgaattgatcgtcgatcattgcagtcagacggttgtgctggttttaaaatggatctttttaaagcatcatgatgccgacaaacagcaggctcatgaatatttggagaagttgttgaatattgaacattttatctgaattgacacatcaaatgaatcattcaatgactatatagtaccatgaacgaccttttcgtgaattgaattttcatgaaaatattgagcgaagcaacctctattatagcaaaagtggccttcatttgtgcgttaagttgagatgtgttagcatgctatttaagtgttcccaaagaatgcttaaatcagttcaatgatgaggaagtgacagaatggtcttaacttcagatgaagcagctgcaactaagcaggaactccaaggcaacttcgagttgtcagggatcactttgcagatggcggccgttgatttgaaaagcacgcctgaacatattcaggacgttttaaacttgaaaaattgccaaaaagaagaaccttggatcctgcgtaattacctaattaagctcattttgcttcaggaaaaagaaccctattcgttctccaaattaataggggatcccaaacgttatcagtttttgaacagtcgcttgattgatcgtggcgaattggcctaaagttttaataaagtgaatgattgtgtcaaatgaaaacaatccaaaattagatccagttaaaactgcttgaatttcagttttaactggatcttttatattactccgaggatgaatgttgggacctggtttaattactactataaatggccaggatcaaaacgcctcgcatcgcactcgcctgaattccacggttatttagcttaaatgtgtgcaagaggacagtaattgaaatttaagcgccgccacccgaaaacctgactcggtttccttgtgtcttactgttatttggattaaacgtgttcaagaggacagcaactaaattttaagcccctccacccaaaaacctgactcggtttccgtctggaggggcttaaaatttagttgctaaacgtcctctttcacactctcatcttgaagtagtcacatcactttgcttaacccagccattgacttgggggtgggcagcgtctgttacatagtagtaagtggcattgccatcgcgattgttttgcttggtgccgaccttggtcacggtcagtggatccttgtaaaagtctgccgttgcgttgagattgcgccccactttatattgggtatagtcaggggcaacgtaggttaacgtggacgcttttggtgtcgtaaagtacattgtggtgttggcaaaataagttgggaccgttgattcctggaaggtcgtcgttgcctttaagccgccggaaacatcactgggattggtcgtcggatcggttgttccggcaaatatccagccccgataggttttatcgaaggaaacaactttcagataccagtcgccatttgaggtctgagccgcccgataacctctgaagtaggtttgcccggcatccgcagttgtgccaagggtctttaaaacggctgccttggtgacaacttttgtactcttatagaccggcacttttgaatagagtggtgctgctccggttgtcaggtaattgcgggagttgccatccgccacgagcgcctggttgctggttacagtcatcgttgatttggcctcagtgtcggttggcgttaaggtaaatgcgccgatcgcaagtgtcaggccaagtcccaatatgagtttgctggtgattgttttcaaattcatccctccaagcacaatctttattcaaaaagtatacacccatttgaaaacgaatcatacaatcgaagtcaattaaattaaaaaatgattagttcgttttcgaatgacagttgacaaaaatacatagttacctgatatatatcactggctccattcattgaacagcttactgattagaatatttttaattttaagtatatttttgaggccgttcgttgtatcctagttgtaaatattatttacaatagtggatattcatacaaggagtgacgacatggaaaaacacgagtggttattttcgcaagttcgctggttgttcattgtgatcgcatttgtcggaatggtgatcggcctgaatacacaattggtggatgcaaaggccagttcgctggaaacagatttccaacgagcggctgccaagtaccaggtgccggtagatctgcttaaagcggtggcttataatgaaagtgcgtttgatagccacaatggtaagcccagtgtggccggcggctatggtgtgatgcatttgactgataccactggcttaacgccaagcggcgcagattccaaagcggttaaagtgccaaatgccgcttctctgcatacgctgcaaaaagcggccaaattgaccggtcacagtgttagtcaactgaagaccaattcagctgccaatattgatggtggggcggctttattagcagcctatcagaaatcctcgggcaaagggctaacgtcaaatattggtagttggtctgcagccgttaagaaatacagccagtcggattttcaggcagctgctgatttcttcgccgccaacgtatataaaattttggcaaaaggcgtcaatcataacggcgccaaaatctcaccccagaaggtgaatgcattgaaagatgaagcaatcgataccaccggtgaatcgggccaaaccgatggacctgccggcctgccaatcgaatggattcccgcattatacaaaacctttgatgatcaaggcgactatgggaactatgacctggctgaccggccgaacgacgaaaagattaattatattgtgattcacaacaccgaaaccagttttcaagaagctctgacactcttctcgacaccgacgtataccacggcgaactacgttgtcagttcggtcgaagggacagtcgctgaaatggttcgaccgcaaaatgttgcttggcacgccggcaactggtacattaattctcattcaattggcattgagcacgagggttatgcggcagttggcggctactggtacaccgaaaacatgtacaagtcctcagccgctttggtgaaatatctggctgataagtaccagattccgctggatcgtcagcacattatcggccatgacaacgtgcccggtttaacaccggcagctcaaaaagggatgcactgggatcctgggacttattggaactggaatcactactttgaattgatgggcgttgatttatcaaaaagtgacggcagcacggatagtcacattatcaccattacgcctaatgacaaaacgaatttgacggccgattcgggacaaaaagtgactgatgacggggtcagccttccgctaaccggatcaaattttgtttacctctacaagcaacctagcttcagtgctgacttgattgctgataaggacttttcttccggtcaagccggcaccactgaaaaggatgactggggcgataaagccgtttacggccaacaatttagtaagatcgatcagcagggggattggacagaaattgattatggcggtcaagatgcctggttctacaatccgggtggtgctaattcaactgatgccactgggaagctcgtagcggctaaaggatcaaaagccgtgccggtgtacggcagtgcctatccaagcgacagtattttgaagaagaataaagttaccggcattaaaccaacaccaatttatcaactgcagccaggtcaaaaatacgtttatggcggcacagtcacctctgattacttcaattcacacttcaattccaactcaccgaagaacgtcattcatggcactgatgattattatcagattcaatttaatcaccgaattgcattcgtgaaggcgtcagataccactctttcagacgattgacagattaatcgatagcaagtgaataacttggaaaggccgaaacagcaaccaatgtttcggccttttttaatcgctattaatgtcaccaaacatcacatcgaccaaaatttgctcattttactgcaaaattctgataatggtgtcaccaagatgtgaggtattggtatacctgtaatttgaggaattttaacgaagactgttgactttctgaaaaatgggtatatattaatagccgtaagtaaatgtcacaaaacattacatgaaacgagggaatagaatgagaattgagagagattgcatcggagaaatgtttgtacctgataacgtcctttatgggattcactcactgcgagcgaaacacaactttccaatcaccaacgaaaaagttgatccggccatcattcaaagctatctgcagatcaagaaggccgctgctttggctaacgagcaggcgggcactttggataaagaaaaaagtgctttgattatggctgcctgcaaccaattgctattctcaaatgactacagtgtctttatcgtgccagccatccagggtggtgccggaacgtcaaccaatatgaacgtgaacgaggtcgtcgcccagcttgccatgcaattaagcgcccagggtggaaaagagcccttggtaatcaagcccaacgatgatgttaaccagtcacagtcgaccaatgatacctatccgacggcaggcaagatggcgatgttaaaacggttggcgccattgacgtcagctgtttccagtttggttgacgccttaaccgataaagccgcagaatattcgtcagcaatcaaagttggtcggactcagctgcaggatgctgtgccaacgacctttggcaggacctttacagcttatgcttcaatgtttaaacgcgatctctcaagattaaagcacgctcaaaaggttctttctcaagtcaacctgggcggaaccgcgattggtaccggaattaacgcgaccgctgaatacgaatcagccattattcccattctcaacaaatattctcatctttcattgcatcaagccgctgatttggtggacgccactcaaaacagtgatgctttcaccacgatttcttcggccatgaagtcattagctgctgatttatccaaattcagcaatgacttgcggctactttccagtggccctcaagccggcctgaacgaactggagctgccaaagaaggctgcagggtcctcaattatgcccgggaaagtcaacccaatcatccccgaagttgttaaccaggtggcatttgaaaccatcggcaacgacgtcacggttacaatggctgctgagagcgggcagttggagttgaatgcatttgaaccaatcatgttcaagagtattttgactagtgagcagcatttgaccaaggcaattgagacgctggttgaaaactgcgtcagcggcatcaaagtcaatgcagcatattgccgaaaggaagtcgaacactcatcgatcgcggcgacggtgctttcaccgctgctgggctatgaaaagacgaccgcgttgattaaggaagcattagccactcaacaatccgtcaaagcactcgtcaaacaaaagcagctgctcccggattcattggtcgacaatctcttcacaccagaagttttgacgaatgttcgcaaagttaagaaagaaaagtctgctgccggttcaaatttaaattaaccacgtttcaccgaaagtcaacctgatgagggctgactttttctttttgaccaaaacagaatcatcaccacgatctccaatcgcgatataattgagttggttaggtcaacaatttgaaaaattggggtgatttgacaatgaaacagaacaaatcgacactgattgacgatgatgccaaggctgatcccactgatttgatgaaccagtttcaaaccagcaacggtggtctctcgcaggcagaagccgagaagcgtttagaaaaatacgggccaaatacgattcgacagggcaaacgaaagtccgaagtgttaatctttttggaaaactttacctctttgatggcgattcttttgtgggtatccggtgtgatcgccatgtttgccggcatgctggaacttggaattgctatttgggcagttaacgtcatcaatggttgcttttcatattggcagcagcacgccgctcaaaaggcaaccgactcattgaagaaaatgctgccatcttatgttaaggttcggcgggatggcaagtctcagcagattaaagttgaacagctggtgcctggcgatatttttgatattcaagcgggggattcaattcctgccgacgccagggtgtttaatgctgccaacctccaagttgacgaatcttctttgactggtgaatcggtgccagttgaaaagcatgacgcttatcagcacggcgatggcgaatttgctcaacagaacatcgtctttgctgggaccatttgtaccagcggcactgcgacagctctctgcttggcaaccggaatggatactgagttcggccgcattgccacgttaactgagtcacagaaaaagaccgtctatccattggaacgggagctcaatcatttaacccggcaactaacgattattgcgattatgattggcgttgcctttttcctgctggcaattttcttcgttaaatatccggtgaccaagtctttcatttttgcattagggatgattgtcgcctttatcccagaagggcttttgccgacggtaactttatcgttggcgcagggaacccaacgaatggcgaaaaaacatgcactactcaaaaacctgagcagtgtcgaaacgttgggacagacgacggttatctgctccgataagactggcacgctgacccaaaatcagatgactatcaaccatctgtggctgccaagtcaagaatatgatgtcactggaaccgggtacgtcactaacgggcagattcagttaaatggccaccaggttgatctagcaggacagcctgacctcgagaagctgttgattaatgcaaccatcaataatgataccgaggttactgaaggtaaagccggtgaaaaatcaaaaattctcggaaccccaaccgaggccggattagtgatcctgtcacgcaaagccgagattgatgccgccgccgaacgccaaaagtttcccagattaaaagaattgccgtttgattccggccgtaaattgatgtcggtcatcactaaaaatgcggacggtaagttggtcatcaataccaaaggggcgttaggcagtgaattaaacgtttgtgaccggattttagataatggtcatattcgacctttaacggctgatgatcaggctaaaattatgcaggtaaatgaaaattacgccaaacaaggcttaagaacgctggcattttcgtatcgggtggtggatgaaaatgatccactaagtcagcagtcacttgaaagctgtacgattgaaagtgcggagaagcagatggtcttcattgggctggccatgatgtcagatccgccacgaccagagatatttgatgctgttcgcaattgtcgacgggccaacatccggatcatcatggttaccggtgatagcccgacgactgccaaaagtattgcgactaagattggcattacttcggacaaggtcagagtcatttccggctccgaactggataagatgtctgatgccgagctgcaggaagccgtcaaaggggaagtcatttttgcccgggttgcaccggaacataaatttaggattgtttccatgtgccagaaaaatggtgacgtggtggcttcaaccggcgatggcgtcaatgacgcgccagcactcaaacgtgcggatatcggcattgcgatgggagtgactggaaccgacgttgcaaaagacgctgcagatatgattttgaccgatgataactttgcctcgattgtcagcgcgatcgaagaaggtcggaccgtttacagcaacttgcaaaagttccttctatatatactcactagtaatgtccccgaagccgctccatcggtcatcttcttgttgacccgtggactggtgccattaccgttgacggttatgcaaattttgacggttgatttgggaactgatttactgccggcattgggactgggaaccgagaaagccgagccaggcatcatggatcagccgccccgtccattgaacagtcacttgttgaaccgatcgattatctggaaagcctttggttggtacggcttgattgcttcggcaatttcgacgtttgcctacttcttcgtcaaccacgtcaatggctggcctcaagttccattggccggatccggtttggtgtacgcggaagcgacgacgattaccttggcggccattgtcttctcccagattgcagcggcgatgaactgccgaacgcagatttcatcagtcttttcaattggcttatttagcaatcaccgcattcttttggggatcgtcgtggaagttgtcttagtcgcactgttgatgtacgttccatttctccagggcgtcttcaataccggaccgctaaacgtcacagaatggggcttcttattctgcattccggtgccgatcttcctgattgaagagctgcggaaatatgtggttcgccagattaaaaagcgacgggcgaagacttcagtctgataataatgttgcatttacaacaaaaatagtttagaatcaattctatcaagaaagggctgattaagtggcagagattttacgacccatcggtgcgattgccagagccttggattcaattgccaacgttgaatttaaacggtttgatcttaccaaaggccaatatttatatttggccaggatttgtgagcaccccgggatttttcaagaccagctggcaggaatgatcaaggtcgaccgaaccacggctgcccgagcaattgataagctggcggcaaaggactttgtagttaaacggcctgatttgaccaaccaaaagattcgacgcttgtttccgacagaaaaaggtcaggcgacctatccgaatattttgcgggaaaatcagtattccaaccaagtggcgctaaagtccatcaccgacgatgaggccgaccaactggaacgccttttgcataaagttagtgccaacattgacgatgactggcattatgttaaaaaaggcaatcttagaaagtattgaggatgaacttgtgacaattgtgattagaaaatgtactttggcagatctttcagaactgcagcagatcagcagagagacttttgctgatacgtttggtccggaaaatagtcctgccaacgtgaatcagtatttggatgaatcgtataatcttgaccggctcaaacaagagctcaccgatccggattccgatttctttttcgccttggcggatggccaagtagccggttatttgaaggtcaacgtcggcaatgcccagacagaagccatgggcaaccatgccttggaagttcaacgcatctatattaagccagctttcaagcgacaaggaatcggatcgaaattgatggctcaagcattggcggtggcaaaagataaacaccgttcgaccgtttggctgggcgtttgggagtacaatcttgtcgctcaacagttatatcaaaaattcggtttcaaacaaaccggcgatcatgtcttcacgctgggcgaaagccgccaacgcgacctcattatgagccgaacaattgaaggagagagccggcattcatgaaaaaattcattttagatcccaaaaccatcgaattatttccagacatccatattgacgtgatgaccttacatggcatcgataatcacgtgaatgaaaaggacgacccgtatttccagaaactcctggatgagggcaccgaggcggccgaacaatttatcaccgttgacccattccgtgataatccggtggttgccgagtggcgggaagcattccggaagtttaagaccaagaagggcgcccgttcaacgattgaggccttattaaaacgggtcagtcacggaaaacgattttcaccgattgcgccgttagtcgatatttataacagccaatcgctgaagtacggcgtctccgttggtggtgaaaacgtcgacgccattgctggggatatgcacctgggagaagccaagggtggcgaatccttcctgccatacggtgagaccgaagatatgccggctttacccggcgagatttgttatatggacgataaaggcgcagtttgtcgttgctttaactggcgcgaaaatcagcggactgaattgaccgaggacaccaccaatccgatcatcgatattgaatcgattaatgaggatcagtcggcccgctcagatgttgccatcagagaaattcaacgtctctgcaaagaatattttggagttgttggtcagcttcaacaattgaatgctgaaaatcctgagattgtcattgctaaataaattcaaaaggcggttgtcacattcccttgcttggggatgtgacaaccgcctttaattttggttccgagcttatttgtgatacttatcggcaatattgtatttgatatcaccactatcaactttcaacaagactttcttcttgttatgcttgtcgatcaccttgaacttggcataggcctggttggcgtaaaccttatggaaagcttttgaacgatcccgcgagcggttaaccaggtagttccatttgtccggattaccggccttgagttctttgactgcttggctattctgactgaccttgatggtgacgcccttgttcttatcggcttcaacggatggtttcttgccgtagggcgtcttatcttgggcattgaacagatactggttcagttcacgagccaccgttttatgacccgggccgtcctgtagggtgaatagactgccgacaaaataaatgacgagcgcggcagcaaccagtgagataaacttgccaaccggtttttggtaccacttcataaattgttcaacatctttattctgaacttcatcttcttcaagccatggctgcttggcgccacagtatggacaaaagtttgagtatgccgggatggttttcccacacatgacacaggacttagtcttttcttcagacatttctcatgctcctccaatatgtacctttgcgaatataccaattaattatagcaaagatttgcttggtgggaacaggtaagtgcaaaattatcgttaattaggcaggtgtttatcgatgaattcttttaccggtagacggaaatcgaggtaatatttctcaagatcctctctagaccaattccaccaggcaatttcttccatatcggttttaatttcgtcaagaaaacgatccttaattggtttggcagggatgccgccgacgatggtgtagggctccacgtctttggtcaccacggcgcctgagccaataacggcaccatcaccaactgttacgccagcttggatgatcacgccgtggccaatccagacatcgttgccgatggttgtccgcaggtgggttcttttttccaagaattcggtgtctggatggtcgaaaccgtaagccccgccgttataggcaaagatgtgttgggcaggccggtcgtagggatgattggtcggtccgattcgaatcatcgctgccatactgatgaactttttcaagtcactgttttgaataaaacaatattggccggtgtaagtataatcaccaattgaactattatcgattaaattgctgcttcctatttccacccattccccgaatgtagtattcttggtttgagtcatttttccaatcgttggtttatcttttgacaactttacaaaatcaatatgcatacgaccaacctctttctcaaaataatttctaaaaactattataatatgttttcacactatttagttaaaaggagcttacaaatgtttgaagtaaagactattgatcggtttgacctgaccgattttgctggagacgtctttcgtacctccaacaccgataccccggatgccattttagtgcggagttccaaggttgatgatagcttgatatccaagcgattgctgctgatcgcccgttccgggactgggacgaacacgattaacgtcgatgcggcaaccgccaacgggactgccgttttcaacacgccgggggttaacgccaacgccgtcaaagagctcattattcaaaaccttttcagatgtctgcgtccactgaatggtgccgttcaaatgatgcagcagctcaaagttgccccgggggaggatttgcaggccgctgccgaagccaaacggggcgattttattggtgaggaactttatggccggacacttggaattcttggcttgggaaccatcggccagcggttggcggacgcctgctaccacatggggatgcagattatcggctataaccgcagcttcaagaatctacgtcacgtccagcaattggataccattgatgaagtgttggagcaggccgattttgtggtgattttactcccgctgactgatcaaaccaaccagctgttgtctaccaagcaatttgaaatgatgaaggatagcgcttatctgctgaattttggtcgcggcgagattgtcgataatcaagcggtggtctcggccttgaatcacaacgagtttgccggttacgtgtgtgactttccgaaaacggaactccaggaccatccaaagattaccctgctgccacatttaggcggcaacacaattgaggcgctgacccattctgcgaacttgattttgcagaacctgctggactttttggaatatggcaccgtcagaagctcggtcaactttccccgggttgatttgccgttcatgagtaaccagcggctgacgtttttcttccacgccagagataccttctgggtggatgttgccggtattatgagtcgctatgacttgccggttcaagaaatgatgggaaacaccatggacggttatggctataccatcgtgaataccgatttggcggaaatcacgcagcaacaaacacagaccttgttaaatgaacttaatcagattgacgggatgattcgggtcaggttgttgaacaacccaacccagggagaatggcagtaaactttagtaagtgtttcacaaccttcgaacttttttgaaattatgagactgaaagtgggagtatgggtctcgtgatttgatgagctcgtttcacaaataaaaagcaaaagaagtattgaaattaattttcagccgcctataataagcattgtaagcggttgttagttgaaaaaagcaaatgattaattcacatattcgcactcatttaagcgctggataatcatttgcttttctgttgtttgcaattgctcactaaataacaaatatagtatttggagatgtgattatgcgaattaaagcagctgttgttaacaaaaaaggcggagacttcgaaatgaaggatgacgtcgaattagcagatatgcaagctgacgatttacaagttcatatggttgccagtgggatctgccattcagacgaagctttacgaaaaggaactgccgaaattggttacccaatcgttcttggccacgaaggatcaggaattgttgaaaaagtgggccctgaagtgaaagacttcaagcccggtgatcacgttgttctgtcattttatggctgtggcaactgtatcaactgtttaaagggaattccaacccaatgcttgaattacgcagcaaacaacttgtcgggggttcgtcctgacggcagtgcccactttactgaaaatggtcaccaagttgccgacatgtttgaccaatcctcattcacgacgaccactgttgtccgtgaacgtaacgcggttaaagttgataaggacttggatttgcgtcaattaggacctcttggctgtggctatgttacaggtagtggcacggtcttcaacactttgaagccggaaccaggttcaaccattgctgtctttggtactggagccgttggcttagctgcaatgatggccggccgaatttctggctgcaccaaagtcattgccgtagatatcgttcctgaccgcttgaagttggccaaggaattaggtgcgactgataccattaacagtaaagacactgatccggttaaagccattcaagatttgactgacggttacggtgttgactatgcggttgacaccactggtgttaaatctgtcatggaagcatcaatcaaggccttggcacaaggcggcacgactgcaacaatcgccgttaccgaccaacacgttgatctggatacttggaacgatctctgtgtcagcgaccgcaaagtcgttggtgtcaacatgggtgactcaattcctcaagtcgatatccctcgtttgatcaagttctacaagatgggattgtttgacttcgacaagactgagaagttctacaagttcgatgatattaaccaagctaacgctgattctgtcagtggcaagacgatcaagccagtactcgttattgacgaagattacaagccaggcaagtaacacgtttccacaaactcacatcaaggcatccaaaagtttcattaataaactaaaaatatttgttcctgccagatggcgttcaattacactgttttcgacaggtatcttgaaagggagcaactattatggcacaaaatgctgttgcattaaaacattatcaaatgtacattaacggaaaattcatggattcaaagtcaggtaacgaaattaccgttttaaacccatcaactggtgaaaagatttcgacagttccagctgcaactcgtgaagaagctaaagaagccatcgatgctgcatacgaagctgaaaaatcatggaagaaagttccagctgctacccgtggccaatatttacacgatgttgccactgaaattcgtaacgagaaggatcacttggttgaaatgctccaagaagagcaaggtaaaatcaagtcattggcaaccactgaaattatgttctcagccgactacttcgattacatgggcagtgctgcgcgaacttatgaaggtgaaattctccaatcagacaacaagaatgaaaatatcatgattgctaagcagccaattggtgttgctgccggcatcttaccatggaacttcccattcttcctgattgcccgtaaaatgggtccagctttggtaactggtaacacgatcgtgatgaagccatcttcagacacgccaaacttgggacttgaatttgccaagattgttgaaaaagttgggattccaaagggtgttgtcaacattatttccggtcgtggttctgtggttggtgacgaactcaccaagaacaagaagattggcatcattagtttgactggttctgttgattctggtaaacgggtcatggcaggtgctgcaacccacatggctaaagtttcattggaattaggtggtaaagcaccagccattgtctgcaaagatgctgacatcgatttggcagttcaatcaatcattgactcacgtgttgataacaatggtgaactctgcaacaactgtgaacgggtatacgttcaagaggatgttgccgatgagttcatcaagaagttatccgacaagatgtcaaagatcactgtcggtaacgttatgaaagatgaaaacgttggtatgggtccattgattaaccaagaagctttggacaaagtttccggaatggtagatcgggctgttcaagctggcggtaaggtcacagccggtggtcacaagttgaacatcgaaaatggcttctactacgaaccaacggttatcaccaacgtcaaacaagattcagaaattgtgcaagacgaaatctttggcccagtactgccagtattgacctttaagactttggacgatgccattgaaatggctaatgattctgacttcggtctgacttcatcaatctacaccgagaacttggacaacgcaatgcgtgctgccaacgaactcgaagacggtgaaacttacatcaaccgatttaactttgaagctatgaatggttcacactcaggctggaaagaatcaggtatcggcggcgatgatggtcgtcatggtatcgaagaattcttgaatactcatgttatttacctgcaagggcatccggagaaggcgcaaggttagagtgcgactaggcccggttaaccgcggcgtataagccgaaaggacggattgatgaacgattcttgttcattgattcgtccttttggtttatacgttaggggttgggccatcggagcacattttatccaaataacagtgaacctatcacttaccaatgaaaaaaggcacccacagcaaacgcacaagaaagtttgtccgtggatgctttttatgtatgactaaaatatctgaaatcccaacgaatattaaccgatgtgataaatagaaaaaatgacacacccacgccatcccggcatataataaagccaacaaactcacaggggggcagacacaatgacaccatccaatatcatcggcgggatactaacatgtggcgttggcctgtttttgatcgtcgcaggcttaatggtgagcaagggaaaatggtcaaggatggttgctgggaatcttttccacgatgatcaaaagtcggttggtcggcataagaaagccatcgggggtttatttatcattctcggcggtttgtgcctggtcttttatttggtgcttttttaaacacctggatgactgacagaagatgtgtcgtttcgtataatgtatcagcatgagattcaatgtgagacgttgtaattgagaagggaggattccatgacaaaatatacggcgacaatttcgaaaaatggacaattagttattccagcgccggtgaggcataaactgaatatttccgctggtacaaagttatccattcaaattgatcaaaataataacgtggttctttcaaaagtaccggaggtgtccgactggaagaaactattggctaatattccagatgagcgggttgagcttgatcaagaaggacattatgatccggacaaatccccagagcttgatgactggatgcggaaaggctaggccagatgactaacgcaattctttcccatatctgtttagctgatatcccttatgatgacggacatcttgtaaaatctcaatgagggttgttaattttgccaggaaaagatacctcaagagtctttaagattacgtggattgtagtcaatacgtgagacaattttcggaatttcatcaatatcccatcaaaatagcggcctgcactggtctcaaccaagtgcaagccgctatattatacatacagtaaagattgaatcattgaaccaggtaaaagacgccactaaccccaatcaacacaaacacgcatttttgaatcatcgagatattcatatggaccgtaatgcggttggcaatcatggttccgatgacgccaccgactattcccaatagaatgagggggacgtcatttaaacctaaaataccgttatagaaacgaatacttgttatatacaattgatcaatcaagaagaaagcttgaatactggcgagatattcctcttttgtatccgccaaggacagaaaataaagtgccgtcaacggcccgccaattccaaacaacccattgaagaagccggaaacgatcataaagataatggcaatataaatgggataatgtttccggccttctgatttaacgaataaaaagtacagtgagagggcaaccaacagaccacccagcatggatttcagcaaatggacattgattgagttgactagttgtaatgccatgaaggccacactggcatagacgacaaacggccagatgattcgtttgaatttgatgctgtgccggtaacgccaagccaacatgatgttggaaacggacataatgagggatgccactccggcactttgggggatgggcaagattgtcggcaaaaagaccatcaagacaattgctgagccaaacccggtaactccctggacaatcccggcaagaacggcgggcaggagcacgaatatgaaattagtcatgaccatcctcctctcaagtcatctccgttacgagacgtgtgataagttactctgagacttccggtgaagttttggtgactgtttggtgtaaagttttctggacataaagagcgcgacgaccaagaaggctaaacacatcgtaaagccggcttgaatgcccatctgttggtaattggcgtggccagcaaaaaagtgactggcaatgttgatggtggccacaataatggccgttccaaacgatgccgcgatttgccgcaaggtgttgaaggcggcaacaccgtcggcaatcaattcattgggcagataggatagtgcttgggtctgaattggaatgagaatcaagaccagcccaagctggcgaattgtctgtcccattgtcagcatcaacaccgaagcgttaacatcaatgaatgcctgcatcatggtaccaaaacaatcgattagaataccggtggtcacaatgatccgtaccggatagcgatcgaacagccggccactgattggtgacataaaaccagttaatagcgctcccggcagtaatgagagaccggagatgatggcacttttacccataatcgtttgaatcaacagcggcaacagaatcgtattgccatacatcgtcgagacaatcagtgagttgaccaaagtggcagtggtgaactgactatttttgaagaccgccaaattaacaaacggatggtcggattttccttgagtgacggcaaacatcgtgattaagacaacgccgaccacgaatggcagccagactgttagagatgtgatagggaactggctcacgtttgaaaaactccatagaagtcccagcaaaccaaagctgatggtcatcaacccctcggtgttaaattgaggttcctggttagtggggatcttgggcagggcaatcgtggccattaccaaatcaatgacgataaacggcagcaccaaaatgaataggtagcgccatgagaaatagttcaaaataaccccggaaagtgttgggccaatgatcggcgaaaagttaaacgctaagccgacgatccccatcacggcaccctttttgccgggcttggcgtagcggattgccagggtatttaccagcggcatcatcattccggcaccgattgcttggatcatgcggccaatgatgagggtgaagaaattaggtgccaaggcaccaaaaatcgttccaactaaaaagacgctgacgaaaaaaataaacagagaacgaaatgtgaacttcttggtcagataagcactgaccggaatcataatcgcgttgaccagggtgtagccgttgctaatccattgaaccgtaccggacgaaatggcgaacaccttcataaaggttggcaaagcgacgttcatgagcgttgaacagagaatgccgaagaaggcaccgaagatcataataatgagagaatagcgattttgctttgacattaacaggacttccaaatatgtattttataagttttgaaaaatagcaactctaaatagtgtaattttaataatggataattgcaataggaatatagttaatcactaatcgcagaataaataaaaacgtggaattgtaatcatgcaattccacgcttttattaagctttcttagatacccgataaaagttcggtgaaaatggcgtttctgccgcaatgttactaccgtcataatacacgtgaacgtatccgtgaccaactcgtttgaacgtgaatcgggcttggtgcagtttgttcagttcgtttctgccgacgatggtgtaggcggttttaccgtctgctttccatttggtatcggtaatgtgccagcctgctgactgcgttaaataggcattcacactacttttacgaactcggacagattcatagctatcaaacttcttcatgccaaagtatttaccaatgttaatcgtcttgtctttccagtgaccacggagtgctgttggcgttcccttgtgccaggttgccgcttgtgttgatgtcgttactgctcccaaaaagccaagtgacgcaatcgccgttacgattaactgcgtgcctttgttcatgactgtcatctccaattaatttgcttggtcaaatttattaaccaattgaatgaccatgcttggctcactaccggggactgcccgatagacgacgtagtctcccggaaccagatcaacggatgccagttgggctttttgggcgacgctaaagccagccacttcgtagtaggcgtgaccgtcgacgtcctcgtcggttaacgtgacgttgacttgttccagtggagcaacatctaaggatgcccggcgtaatgccaagtactggtagttgatcgagtcaaccataatggtgatttcattgttggtgcagggaacgctcatggtctgtttcaaattgatttacttccttctttgagtttcgcgtggcgaatatcattgacattgatggtcaccaacttgtcggtttgaagatagattagatcaccattagtgccaattacaatgccacttatattataaacgtttaagtagccgtcatcatttaattgaagtgtaatttgtttggaattctgccaactgtcctgcaaaacgcggtcgatgacttccggatcctgttccggcaatcgatgagtcgggacctcgtcgacttttttgtcagccatatcctgggtatggtcactcaaaaagtaacccagccacttcaccatgccgcggtcgttgtagagccattggtcacgtggaacgtctcgaatcatgttgaacacccccatacgtttaatatacgaacatatgttctaaacgtcaagggggaacagttcaaacaactgaaacttagggctgaagtaattgccagacttgggattgggaaaatgttacagtttatttggctaattcacaatttattcatatttttagaggacaatgaatttataaaatacattgaataggagtgaagcaattgcgcacggtctatattttcaccatcattattgcgtcgatcgccatgtttttgattgattactatgtgtcattaccacatgtgttgcgggcttgtacctggttgggattcattgtaatcgttggaatttgcagttatcaaataatggctcattggcataataatcaataaaattaaattcgaatttgcttctcatctgtcgagatcgggaaacccttcttaaacgcagtccgcaagaagttaagcaggggcggagtcacctttaattcgtccaaatcccgcaatgagaaggtatagcgaattgccttttcatcaccagcttcaactttttgaacccatttgggctcacggatcaactcacggcccatggcggcaaattggacgccggcgtcaatcaacttggcgacttgggcaggggatgccaaatggccgacaaccatcaatggtaaatcatctgcgaggactgcttggactttttcgaagagcggctgctggtcatcacgatcgacaatcgatccctgccaagcatctgccaatgacatgtggagataatcaattggcttttgattgagttctttcaccaaggccagggtgtcggctattctgataccaggcttttccagttcctcaggcgaaatccggtagcccaagataaactgcgggttatcagaatgtttgataacggctgcgcatgcatctacaaccgccaaagggaagttcatccgtttttccaaggagccgccccagtggtctgttctgcggttggaatggggactgaagaattgctgaatcaaataggtgttggcaccgtggagttcgacgccatcaaaaccggcgtcaatggccaattgagtggcgttggcgaagtcctgaatggtctgctcaacttcttcagcggaaagggcccgggggggttcggcacccaaacgttgtggagcgaccgcgctggcagagacggtttgatggccgcgcagtacccgcgagttactcattcgaccggcgctgaagatttgaagaattgctttggtatgattgattttgatggcgttggcaagccgtgataacccgggcagcatgttgtcatgtgcgacgctgagctcgccttcgaaacctttgcccagatcattgacgttggcacagccggtaataatcatgccgggaccaccggcacgcaatcggaagtagtcgatttcgtctccggtgatcgaaccgtcttcaaaactggacatctcggtcatcggcgacattgcgatgcgatttttgatggtgacaccgtttcttaattgggttggttgtaggaaattatattttgtcatatgagacctcctgatgatgattaatactttgagtgtaccaaacaaacctaaaatttccaggtgaaaatgtttggttcattttcctaaaaaagcgtttacaatagaagtggaaacaaaattggaggagtgatagttgatggaaacattgaaaatgattcagtcacgtaaagcagttcgtgagtattcgggccaagtatccgatgatcagctgcacgaaattttggttgcagccaacgccagtccggttgggatggggcgctatgatgattatcgattgacggtgatccaagatccaactgttttgtcaaaaatgactggcatttatgaagccccaacggtgattgtggtttcagttaaggaagaaagtgcctccgatgagatttcagccggtgcgattgttcacaacatggaattggccgctgaagatcagggattaggtgccaactataatatggccagtttggaatccattccaagcggagtcgttccagatggttttaagccggcatttgccttgacccttggccagaccaacgatacattcacaccacgggaaattccgttggatcggattaagacaaatactgtgaaatgatattcaaaaaaatgggttagctctcaacgatttgttgggtgctaatccatttttgatttgacagttaaaatgtggattctttatctgacgaattgcgggtcgtggaccggttataattccccgcctttttcaaaggttggtaccatcttttcagctcgcagcaacagcaattgatgcagcaaatccttcacgttctcagtaattgcgtgagcgatcttgtcgttaacctgattatgccactcaggtaacttgtccttggcaatgtttttaaattctgcatctgcagtcgccactgcagcccggccgttggcaaagccaaacttgcggctttcagaaactgcagtcattgcttcgagatcgtgttcggcaaagaaggggtcagccaacatggcgaccaacttattcagccaatagaagctttctgtcgtggtccgcagcggcgtgtgcttaaagttatccggggtatccgtgcagttggcaaagaatggcaccggcgcattgaactcgttgaccccttcagccagccaatgaatggcggcgtgttctgctggaaaatcgggacgaatttgcaggatatgcatctcttggttgcggttcattccaattggtcgatagcgcaaccgtgattcttcagtaccggttttcccataaggatcaaaatcagtgccttgatagtggctgctcaagaagaaggcaatgtcttcaactgaaatcaaatgatcggcaactctggtaaatggcattgtccgactttctggatcctggtggatttccgggttaaacattttttggccataccaaacccgcggggtgttgtagtagtgatccgcttgaacgtcctcaccgaaaatatcacggaagttaaagccggaacgggccttgttcaagtgatatttatcggcaaatgctttcagatcgtcgctgtacatgaagtggtcaggatcatcaaagttgatttcttgaatgccggtttgattaggtgcgaccgcataggcatcatccggaattcgttcggcagcccaatggtgcccaccgactgtttcgaagtaccagacctcatctgaatctgaaaaggcgatgccgttgctttcacaagtgccaaatttggtgaccaaatcgcccaagcgttgaacgcctgcacgagcgctgtggatgtaagggaggacacaagtcagcatggcctcttcaccgataccgtcagccaccagcgggtccaatcccagcatggtggtgttggtaaattcggtttcagttgagctcatggcaacgttgtcggagttaatgccggattcgccccagaggccatcactaacgtcagcgttgggtgtttcggtgtagcgcagcggattgtttgggagcttaacccgaaattggttaaaagtcgaaacgtattcgctgggttgatctgtcgggttcaccaccacaaagcgcttggcattcacgcctccgccggcatcttcatttctggcaatcatcgtcgatccgtcagttgtagcattctttccagctaaaaatgcggtacagctggaagtcgtttgaaatttattcaatcaaatcattccttcttaatttaatacatcgattcgattcggaagcggtgcttggtgcagtggaaactttagtaactcaaagccagttggttggtgattgatttaggaagtaccagtgcttggccgtaaatccaatatttttgaactttggtgtgtttggtggccttcttggttgagtatttggtgatccggtaccagttgaactgcaatccctggttggcgtacaaatcaacgtggactttggtgccagcctttaagccgctcttcttccatgaagtggtcttaatgtttttatagctgctgttgggggcgtgattagtgagcttaaatgatttgtagttggtgccgattttggcattaaaattagctttgtgataactcaaggatccgggcatgctggcagcgcttgaaacgggggattgagtgacagatacgaaaccaccaaggcccagggctgttaccgccaacaagatacttttcttaaacatctaaaaaatctcctttcaaaattcaactaattttagtataaaagtctggttaaaaaaattccagccgactagctggaattttagtgattagcctaagaacttacgcaagattgcctgacgactgattaaggtggtcttggtttctttatcagaaatcttaaccagatcagcggctagttgggcatgcttctcttgttcaggtgtctgtgggccggcctgaataccgaatagtcgttcaactgcttcaatatcttcgtcaaccgctttccaggcagggttcttggcttgaagagcatccaaggcgtccttgctgaagtatttggcaacgtgggcataatcgtgtttgatatttggatagtatttcattaaggtgttcaattctttgtcgcttagcttgttcaagatgcggccagttccaagaaattctggcggaaccccaactgagtacagggcaccggtaaaggtgatcgcccgaggcatcttatagccatcgacgtcacgtgagtaaccgatgattccgacgtgttggtgacggtcccgacgctttggaaaggcatcaaataccggctgtaagtcgttaatgagtggatccaaagtttcgtgatattctgcagcggcttttttagcgatttccaagagaatgtcttggtcgtcgtgatcgataatttcaaatttgctcttttgaaggccgtcgcgcagtttgatgatcgctggttcaaccacatccagcgggtaatcgtaacggaatgccgattgaatcgttgccgtcttcaaaccggggaattcttcgaggtaacggtcaatcatcattggtgataggccgccacggaagatggtgcttccggttccggcaattggatagattggcaggccggattcttgttcaaattcggccaaaccggtcaaggctaatttgttaccaatgatactgttcaagaaaccgtttgaaagagcggaatcggatccggccaagaagacccgcatatagcttaattcacggccaaagtggtctttgtacatttcaaggtattttttcaggatttgtggggcgtgtaactgggattcgaatccttcaaacaatggaatcatttgcagagtatctgaatctttgtgcccggtattaaattcagttgacttgtagtgggaaaggctggcgaacttgtcttccatggaaatcagctggtcggctgattgggtcatgggcaagatagcttcgaataacggtcgttccttaaaccccaaatcgtaagcaaagtcttcagcggacaagatggtggtcattgcctgcatcaaactgtagcccttttcttcccaaatgtttggcagacggaaagtgaggtacttatctttgccaaggggatgcttttggaaatattcgtagtgctcggagtacaaacggtcaatgacggatgcatcggcgtgtttgccttcccagtcccacatatactcatcggcatcgagcttggaaaagttttggtaagcttcatcaatttcacgaaatgcggatacaaatgcattatcgttgtgcttgaagaatggaactcctgcgttatctggatgttgagtacccataatattagggatttttctatccataaaagaaagcctcctgagatttgattaagttcatttagaatgattatacagtaaaaaatgtgaacatgaaaataatattagcaaattgtgcaaattcataaaacaattaaatacccgaatattattgaataatttaaacagttaattaattatttcaactaaatattacagcttatttgaaaacattaccagctttttagatgagattgagaacattatcgcaatcaaagaggttgggacattaattgttacgctggctttcattgcaaccttcattaccacttttatatagataaaacttgcaacaaacggctgatcccggccatttaacgaataaacgcagtcattccaaagtccggaataactgcgtttattcgttaaattctgggatcaaatcgcctttcgtcccaatctctttgggttaatcaaagctcgtaactgtttcagcggtgtagttcccgctgttcttaagtaattttgaaactgggcagcggttttcagcttcttgtgcaaattggtcagcggtttcaaagtcaacacctttgaccatgatctgagcgtgaactaagaattggtattcagcccgctcaccaatgtaagccactttgacgtggacctcggcggtgtgggggacaccatgttctctttcaacggcttgaagggtggcttccaaacaggtggccaaagacatgcccaaaagttgttccgggttggtacccggctttgaatttaatgggctgctggtttccactttgatgccgtctgggacataagcatggccgttcagaccttcatcattcacagcttcggtttgatacaacgggttattccatctttcgtcttgcattctggcagtacctcctacgtttctttaaccttgattataagcgctttcaatgaaattaaaaagaaaaaggttggtatcaaaaaaagagtgggactaaaggcgttttgatcccagaatttaagagcacagatcgattattcttggttttggaatgattgatctgtgctcttaaattctgggatcagccgattgccatgtaggctaggcaagcatgctggccgtcgtcgcacgtttttgataaataatatgggatcacaaaaaaagaggccaaggcaaaagcgtatacttttgtcccagcctcttgagccgttattcgttataatccattcgaatgatcacaggatctttagtcaaaaagtcgccaaccccggctaaaaatttttggaaatggggcgtattgttgtggaattcaacagctttttcatcctgccaatgttcaataatttcatactcagtgtcactatggagcttcttgaaatggtcgtagctgacgttgcctgcttcgccacgggagccatcgaccaattcatcaataaatgcttcgtagtccgattgcatccctggtttaactgacaattcaacgttgataactttcatctttgcagcctcctatcaaatgtttgggcatgtacacccttagtatatcgaagttttgaacttattgttcaatttatcatccgtaaatgtgagatcgtacgccgtcccttttttgtcagtgacatagagtaagtatttggctgacatcggtccctggccgataatcgactggccgtttggtgtgcccaacgcattaatcgcagcttgatatgtagttccaagacccaactggttaatttttgatttggcagtgattcgctgcttgcgcttggcagctggcgtataggatttcccgacagctttgtgattgagaaactgtactttgaccttggcaaccgggaaagtcgcagaaacatccttccaggtatactgggttgtcttcttggtgacgccgttgacgttgaccgtatcaacgtgggaaggagtcccgaagagtttgaggacttggtcttctgaggaaccataggcagcatcggtaatgtcgccaatattaatccgattaaaattagccagattgatcccttcagcttctcggtcgtgcttgtattcagcggcggttttttgactgtcaaagtgatgattaacctgttttttggctgaattcgaagtgccgcacgctgatagcaacagcgtgctcattaatgcgagtgtaacagtaattggttttcccataaaattccccctgacaagatggttctaaatgttggctggattgacaacattatatacttatttgggcggcgagtcgtggactttttaaccgtcgcggccagttttcgaatataatgaacatacaaagttctcaatgaaagacaggtgaatcaattggcaaatcaaccgttagtatttgattatcaagctgctcaaggcaagccggagaatattcgccatccggaagggtactgcccgttttgtgatgttgagcatttgaccaacattttggcacgggacgacgatcgcatttggctggtcaataagtttcggactcttgaagatacctttcagactgtggtgatcgaatccagtgaccatcttggcggaccctccacttattcagttgagcagaatcggcaagtgttcgaatttgcatttaaatgttggcaccaaatgattgtgtccaataaatatcaaagcacgattatgtacaagaactatggcccgttatccggcggcagtttacgacatccacattttcaaattgtcggattggataattatgatgtttatcaaaatgttgatatcagtaattttaccggagttgaagtgattcatgatgagcgctgtgaaatcacattatccacgcagccgattattgggtttgtcgaaatcaatattgccatcgaagaggtcggtcatattaacgacttggccgatgctgtccaagtgatcgtcaaatacttgttgaacgattacatgggtggccgactgtcatcgtacaacttatttttctacgaaatggccgataaattttactgcaaaattgtcccacgttatgcgacctcaccatattttgtcggctataaaattgcccaagtccaaaatgagggccgactggaaaaaattgcggcagatatttcagaacgtctgtcggctaatcaataacaataaagggaacggcatcttgccgttccctttattgttattgaaattggttaaaccgcactgactaatggaactgatggatcgtcattaacgacagtcacacgggtatcctgggctaatgcctgcttaatcatctggttgattttagtataaacctttggatccgcagccttgatttcattacgggaagccacgaataggtgacgaatctctctggactttaagagattttcaatattctggaagtcggtgaatagttggtccttaaatatcttggtaatggcttcagctgtgttttcacggttgtacgtgtcaatcgccgtgtttaccaatttggcaatctcagtagtggtgtcattttgaacggattgatccacctcgaagtcggctagttgtaagccattattgactttcttgaataggttaatattttgagataggcccatcaggacgaattgatgttgtgccaattccacgtttcccttcaggaaatccattatgacccggtagtaacgttcctggtcgattttcttttcctgggtggtttcgttatgaccgtgatattgggcattgccgccgcgggcactaaagttcagttcaccgccacgcaattcctcaccgagggcttctttaacattggctggatactctttgacatcaagtgcggtgactcgcttgttggaaagttgatagagtttactgttgtcacggtttaattcgatcaatgtgtaatcctgattaggtgcttcactgagtaataacaggaagtcaattgcatcttcaattcgatagtccggctcatcgacactggttcggatcaaatgataaacatttttgctaaggtgatcggcaatcacggtcatgccttcataaggcagctgctcacgggtcaggtcattgacatcagcaataaatggcgcaatatcgtctccgacttctttttggatttttttcagcatattcttaactcggagttgttcactttggtcaaacgacagcttacgcaagttaagattcaaagtaatcaccggtgcttgtaagtcaggtaacttcgccaaatctgaaacagaaataatagttgccataagtaggacactccttcattttttatattaggtataactatttaattatataacctacttctattataacagatccaggatccaaagtcttattcggcgatttgataaaaaaagcaatcctcatgggttcaaggattgccgtattggagattcgtaataattgagattaagccgccaaaaagagtgaaaagtagacttaatactgccagggcgacgaagagttggcgccatttgaaaggtgacggctggccgcgggcatttttatagatgagataaaaggcaccaacgacgatggtaaacaccgctgtggccagtaaaatccagacaactgctaaaacaatatccatgatagcctccgtcaataatgatacttgtaaagatagcattcacaactggcaatggcaacctggggatgatcattacgtttttctaaaaccgattatgatcgcttaaggtttaagtttcagttaaccacgcctttctagaatgaatttaacaaatgaaatttagtcacgaatttgctcgaagaaaggtgggagacgatgattaaatggttgccatatttattaaatattactggtgtattggtctggttgaagattcaatcaaggaacttgaggcaattgacctggtgccaactgttcacaattgtcacttcaatcatctatattttggttgtgagctatcttaccttggcgccgacatcatacgcgttcgtgggaccccaacaagtctcaccgatgatgatcggttcggcacccattaatttgatcccattttggagtaccactgctgatttttatcaaaatgtggtgatgatgctgccgatgggcgtgtatttgggattgctgctgccaaagttcaatctgcgaaaagtcttattgaccgggttgggtgtcagcttgaccattgaaagcctgcagtttgttttggatctgtcggtcgggctgtccagatgggtcgatattaacgacgtgttgaccaacacgtttggcgtgatcgtcggctggctcattttgaaaggcttgatgcacacgatctttcagcgactcttgagtcattttgcgattacagcattttcacaccaaaagggtaaatgattgccctttcaggagtgaggcactaaaataagcttactttaaattaatgggagatgttatgatggctaaattgaaccaggcaatgaaagacatgattgccggagaattatcgtatatttcaactgttgatgcagatggcaatccagatgttggacccaagatttcgatgcgggttctggatgatgagcatctgatttataacgaaatgaccggcggccaaacccaagcaaacatcaataataacggcaaagcaattgtggccgttgccaacgccaaggcattaaaaggattccggttcggtggaacggcgaaactctacacggacggtgactactttgatcaagctgccaaatgggcagaaggtaagttcccagctccaaagggtgccggtgtgattaccattgaaaagatttggacattggatccaggccctaaggcagggaagatatttgaagaatagtgcgctactttactcttaaataataaataaaaccagcaatgatgattatttcatcgttgctggtttttgtgtttcaaggttacgtgcaaacaaagactattatgcttgttattacgagtcaggcttgataactgatactttctgagaaacttgatccatcagaaactgtatctaaagattttgaatcgtcagactcatctgtaatgatcttaatacttttgggcttcagtgtcgtagtggactcagataataagactaagtcatattccacccgcttggcattgggagccaactcttcttcagaacctgtatcagccatcgcatcgtcatcgaagtttatttgataaccgttggaaaatacaatttgcttgattccgccaaagtcaatcgttgttgtggaatgattggtaacaacatactcaattttcattcgcgtgtagtctttaggcatactatctttgttaaacgaagtcagtgcctgatcaagctgatcttctgtatttgcatgaactttgtcgatctcagcgtgtttaaatttaacagaaagcggcccattttggattgtcgtatccggtttagttcctaatccggtcatggaaatttttcctagaacttcgctatttttccactgaccaacttttgacagatggataagagggtttgaagagacttggtttggatcctttttcttagccttcgctttggtcttagcggtcttcgaactcgctgcaggccgcatgacaaccgttgttttcgcgctgttcaacagggcaatacaagttaccaggccaacccccaatacgataatggcccaaatcatccaattcttgtaccaaagctgcctttttgattcggccacatcagtccgttgctttgaagcgtctgatggcataggtgattgactggctaaaccgacttgtggtttgccacagtatggacaatacgatgcagcaaatggaatctctttgccgcaacttaaacagaactttgtttcttgattcatgataatcccccaaaatatgtattcagctttttgcgtcgtcagttttggacaaaatgactcaggagcatgactggatgctcctgagttttcaagtgcattcagctggtcgttgaaagtgccatttaactatacccaaaccgcaatacccacgtcaactattttttgacgattatttaatggtttgatagccggaaagttatattcttatctcttgggaatccttttataatagccgattaaccgttttcaatcaaaaagtcgttttaattgtattttcgattgcacaaaactaatatgatgttaatcagtaattggttacttattttacagggaggttttaattatggctgaaacaattaattcggggattgctgcattacacacacttgagagctggggtgttgatcacatctacgggatcccaggcggaaccattaacaatttaatgtatgcattagatgctgaaaaagacaaaatcacttatgttcacgttcgtcatgaagaagtgggtgccttggctgccgttgccgattcgaaactaaccggtcacatcggggttgcctttggctcagccggccctggtgctactcacttgtatcaaggggcttatgacgcaatggctgacaaagttccggttctcttgattgttggtcaaaatccacaagctctgatgaaccaggacttcttccaggaattcgatgagaacccatggtttaaggatgccggggtttatgctcgaaccgtcatgaccgctcaaagtctgccccacatcttagacgaagccattcgtcgggcgtttgcgcaacacggtccagccatcgtcacgattccaaatgatttggccaataaggaaattccagcagatggctattatagttccgctgccaattttgccaaaccagaactaggtaccggttcagacgagcaggtccaacaagcattggacttgattgatcaggctaaaaagccagtcctgtacgtcggccagggaacttacggcgctgccgatgaggtaatggaatttgccaagaagttccaaattccagtgatcacgaccgcactgggcaaggaaattatcccttatgactttgaatccttactgggttccgctgcccgggttgcttccaagccagccaacgaggcgttacagcaaactgatttgatgctgtttgtcggctccaactatccgtttgctgaagcgatgttcaaaccggacgttaaattcattcaaattgataacaatccacaagtgcttggcaaacgtcacaagacggacgttgccattcttgcagatgccaagaagacattacagaaattcatcgatatgggtcaaactaaagagccatcagattggtacgcagccaacgttgataacgtcacaaattggcacgaatacaatgaccatatgatgaaccggacggaaggcaagctgcgtttcgaaccagcatttaaagaaatcaatcggatcgctgaaaaagatgccatcttctccattgatgttggtgatgtcacccaaaacgctgttcgtttgttaaagaccaacggccatcagccttggattacttccggattatttgccactatgggcgttggcttaccggggtcaattgctgctaagttgagctacccagatcgtcaagtattcaacctgaccggtgatggtgccgcagctatggtgatgcaggacctgagcacccaagttggctacaagctgccagtgatcaacgtcgtcttttctaacgaagcgctgggcttcattgaagatgagcaagaggatgacagtcatgagtggttcggaattagtttgccgcagaccgatttcgccaaggtcgccgaagctcaagggatgcttggaatcacggtgacatccgttgatcaaatgaagccggcttttgataaggccgttgaagagaccaaggccggcaaaccggtgctgatcgatgtcaagattaccaacgagcgtccgattccagttgaaaaattgactttggatccggataaattcgatcaaaagacgattgacgacttcaagaaacgttactacgcagaagacttggttccgttgagtgccttcttgaaacaacacggagttaaataaatcgttctatagctaagtgagaggctaaagcatcagtgtcaattgatgttttagcctcttttgtgtgtcattttgatactgattaaatatgctggagatgactgttttcattcacaaaagattaaaaggcctcaatcatgcaagccggataccattgaattataattaattgtatataaataaggggagtcaaagattatgggaaaatggaaaagtgcactcttagtgctgactggattcgtaactttgggggcggtttcaacgacagcttcggccaaggcaaagcagaccccggtgacggtgaatgttgtctttaatgttcgcgaccgtaatgcaatgaatacttatgttagccaaacggtagatccaacatcggctaattatcatcaatacttaacaccacaacaggtggctgaccgttttggccgaaccaacgccgaaatttctgattttaacaagtacttcagtcaatatcacctcaaatcggcggcttatcctggcaactttgtgatgaaagtccagggatctcaaaagaatctggtgaaggcctttaaggcgaccccagccaagaccaacaaggactgggacgtgaccggcactaaattgcctggtaagctgtccagtcaagtcgcgtcagtcctgggattgtttgttgacaataaaaagacttcgacgaaaaccgataagaaggcgttaaagtttacccacaacttaattgaagacgacacgccaattgtcgccagcagtcaaaatcagctggcgaagaaatatggtccgactaaatttgccgatcgatatggcgttaacaagctgtacgaccagaatctgcatggggccggccaacgtattggggtaattgtgacttacgacttcaacccaagtgatgttgccgactactggaaacaaatgggggtcaacagcgacgtttccagaattcacaagatctacaccaccgataatactggtgggccaaagccaaagaacaatgatgatgtgacctcccaggaagaagccagtttggatgttgaacaagctggaggagttgctgatcaagcacaaattgacgcttatgtcggggtttccagcaacggagacaccacgccggatgttcaatatttggacgcatttgccactgcgattggtgataaccgtgacaaacaattgacgaccagttcgtcctttggtaatgaattgaatggcttcggtcgtggcgggctaagtgaaacagcttcagaattcaatgatgccatcaacctggtttttgaacaggcagccattcaaggaacgaccatttttaacgctgccggtgacagtggaccgtatgaagtcgcaaataagtccaccaacttgccattcccaacatcggaatatgccgttcaagtgggcggaacgacgttgccttataccaaaattattggcggccaattgattcaagttaaaaaagagcgcgcctggggtgattcctattcacaaggtacggttaccaagccaactgtcttccctggtggcggtggtggtttttcaactctcaatccaacccctgcttatcagcttggtgttccgggcgtcaacacttacaacgcatttaacatgttgaaatataccaagggtggttacttggtcaacccagatcctgaaatgatttctgggactcatcagggacgaaatgtaccggacatttccgggaacgctgatgaaaaaactggttatggcgtatacattacttataaagccgggaatacccaggttcccatctggatgaatgcaggcggaaccagctttgttgccccacaaatggctggcgccagtgctgttatcaacagtggtttaaagacttctgccggattctggaacccacagctgtataagtttgctgttcaatccgacacaccgttccatgttttagatgacgcgacgatggagaataccaatctgtactataccggccagccgggcaaggtttataaccaagcaactggtctgggaaccgtcgacttcagtaaactgtttacgaagtttaatgctcagcaataaagcaaattgaaaaacaggacccccaacacgctatcatctcgcatgttggggatcctgttttttggatatttggctaaaaagtctgtttatttaatgctataggtttgtactccgatgatttggttggtgccggctttcacgccgtggatcttgattggggatttggtatcatacagattccaggccattgagcctttggctgattgatttttcttgatagccaccttgtatttgggagctaaatcttgatccggaagtggggcggcgaccaactgctttttggatttagcaggctggtaggcgcggagcacggaagcggcagacactggtgaaactttatgaatgcctgtgtttttaatggtgtaccaaagggcaaaaatgggtttcttgccaaattcattaccagtctcaccagctggaatcacagcggttttggtaattttcagctggaaattcttaacttgaagaaagttcttccgaaaacttggtgtgtctgaagaacttttattctgaccgctacaccctgagagggagatgacggcgattaaggtcaatgcgagtgcgaatatttttttcatgttctgagctccaatgcttatgtatttatgaaaatgatgatttattaatattttacatg

SEQ ID NO: 163 - DNA, 142686 bp, Lactobacillus buchneri
tcattaacggagacgcgttcgacttgcatgtattaggcacgccgccagcgttcgtcctgagccaggatcaaactctcatcttaaattgtttaaaatgataagcctgtgatagctcatgatttaaatttattatttgttttacgaattgactttgcaaatgtttggttccaattccgaagaattgaaacgccctgcacatttgtttgtcgaaaattttgttcagttttcaaaggtctacatcagaacacaaacatttttggcgaataaattaaaatcgttcgtttattcaaatccttgtgccccttgcctctaacagcaagaataattatataacagccaatctttcaagtcaacaaaaactttttaattagcaattggtatatgtgttcatgtcattgaagcaacgagtaatatactatcagctatttcggccgaggtcaacaggtaatttcaaattaattcaataaatcgttgctgacaaagcttaaagattgttaataccgggaacaaatcctccccgcaaacaccatttagcctgtatactggcaattgaaatcttcgcgaaaggaactgtcatcatttgaagaaaattgtaattatcgatgccaaacgatcagccatcggcaaattaaacggctcattatcttcattaactgccgaacaacttggttcaaaagtcacgcgtgctttattaaaagatgctggtctttccggcagccaagttgatcaagttatctttggcaacgccatccaggccggaaatggccaaaacattgcccgacaaatcgaattgaacagtcagattccagaaagtaaaacagctttcacagtcaaccaagtctgtggatcaggactacaggcaatccatcaagcacaatccgccttgcttctcggagaagcggaaacggtcattgccggcggaaccgaaagcatgtccaacgttccttacttgaacatgtcacaacgaaagacaaccaagtttgggccggtcacattatatgatggactgcaacgagacggcctaaatgattcagcgacggatgaaccaatgggaatgaccgctgagaacgttgccgatcaataccatgtctcacgtgaagaacaggatgcttttgcattgcgatcacatcaactggctgcgcaagctactgaacagcattattttgatgatgaaattattcccattgaactcaaccaacccaaatcacacgctccccacatcgtagcgcaagatgaatcgatccgggtcgacacaaatttggaaaaactggccgcccttcgtcccgcttttaaaccgaacggatccgtcactgccggcaacagtgcaccactaaacgacggggctgctgctctgatcatgatgactgaagaccgggcaaaccagttgggactatctccaatggcagaggtgctgggttacgccgagcacgggatcaacccggaagtcatggggtatgcgccctacttagccattaatcaattggtatcccagctcaacatgtcagtcaacgacattgacctctatgaaatcaacgaggcctttgcttcccaatcagtagcagttgttcgtgatttaggtatttcacttgataaagtgaacattaacggcggtgcaatcgcactgggtcatcctctcggagattctggtgcccgcatcgtgacgacgttattgcataatctgcgccggaccaaccaagaatttggcgttgcctctctttgtatgggcggcggcatgggatcggcgctggcaatcaaacttctttaatcacaaaaaataggaccgtaggctaaacgctgacaacgtttgacccacgatcctattttattttaattaagttttatctgttcatcttcaggtaagtggtctttaaacgaagattgatacagccaataataaacccgcttggtggcttttgacatctcagcatacgccgggttgatcgatttaacttccggatagacgcgcattaaatgactgaaggcactgaagcttccagcagcagacatcccgtcgtcgtccttcttccctcgttgaaccaggccaattaattgatcaacctggaatctggccagggcgtccacataatcaaagagggttccggcagcttggaaactcggctcaatcacctgccgtgacgttgtgtactgtccggaggcaatttgggtcaacaactgatttctgctcatcgtatattgcaccatcaatggcgttaaaaaaacattctgtagaatctgatgagtggtttcaaaaatcccataggctaccttgaccgtttcaccgcgatcattcacctgtggccggtcattttccagcacccgactgtaccgcaattgatagttctgatgtttggcattcctggcactgccggcgttacttaaattcaatacagccaacttttctgccagatcagcacctgattgaggtaagttcaaatatttcccaattgcctcaactgcggctttggtcttggcaagaaccgttgcctgatcagtggcactggtgaccggtgcaccgactaaatcgggattattttgagtgaattttgcgtaaaccaacggatataaaccgattgatcccagggaattgaccattcctgccaacgtgttgttgacaaatagattaatatcttctgtcagcgaaactttgccgattgcatcggtcatcatcttgggtaaatcgtgctcgtcgctaaaatcgtcttcattataggaataatttccgagcagcggctgttcatcattgccgactggctggttgcttaaaaagccatcgctaatttccttggcaacgccggtggcgatcgtctcatcggcggccgatggcttggtcgtttggttattgatcgctttaaatggtgaagcaccgttcatatagccgttgacgtggtcaaaccactgattaaccagggtccgctgttgattgagatccaggttctgcaaggcagagttaattcggaaaacaacgccaccggcgccggcaatcgcccggacaaattgaatcaccgctgtcttataaccaacaacgtacttttcgggagcctggctctggcttaagtactcagaaaattggttcccggctgcccggttgacgactgaactgtcgtcatctccggtcgcccacagtgacatatagttaaattgatcaatgctgacatgttttaaatccttggcggctgccaaataccccatctgcattggtttggacattttaaactctgccaacgaaacacttggctgcagcggaccgggcaaaaacgaccgcaagccccgggtaattcgttcagaatagattgagcttttagcgtaagtattttctcccagcacttttgaagtcattaaccccagcatgctgagaattttttgttgtttcgaacgggtgtcggaatcatttaccgacgaactggccttattcatgtcgaaaccaccccctagtattatgactataatatcataaactatggcgaatcattgccaacaaatggggaattaaccattctgaaacaattttcaaatctgaggcgttatttttgtgattcattcaaaaagtttgtatgcttatggtagagataaggaaagggtgtgaaactaatgggaaatctgaaaaacaagtccgatgaagtcatcggcaaagtcaaagaaaccgttggcgacgtaaccggaaacgacaagttgaagctgaagggcaaggctcaaaagacatctgggaaagccaaagataaggttgaagatgccaaggaaaaggcgtccaagaaagtgaatgatgctttggacgacaagaagtaaaatcaagctgttaaataagaaacccgatacctgcgaatcgcatggtatcgggtttctttcccaaaaaatgagaaagtaaaactttttacatgttttgtattgcatgccaaataatattgttctataattcactctcgtgttattttgatctaatcaattgaattagaaatatgaacggggatgtgaatcgaaatgtcagcaacttatttgcgtcaagcaaccaatgcagaccttccagaaatcaaaaaaattattgaagaagcaaaagcctaccttaaaaagcaaggcatcgaccaatggcaggatggctatccggccaccgaagacttggagtttgatgtcaacaacgggatcacctacgtgttaattattgacggccagatcgccggaaccgcagctctccaccaaggattggatgtcaactacctcaacattcacgatggcgaatgggtcaacggcgtccacggccgctataccgccattcatcggatcgccatgtcgtcgaatttccgcggccagcacctttcccaaaagatgatcagcggcttaatcaccatttccggtgttctgggttacaaagatatccgaattgacacgcatcccgacaacttgggaatgcagcacgtgatcaccacaaatggatttaccaaacgcggcacgatttacatggctgaaaaagaccgcgaagcatcccctcgttacgcctaccaactggttattgggtaagcgaacaagttggagtacaatatggttaatgaggtgataatatggcacaagatgatgctgccgtaaagaccgcactaatcattatgtacgttatcggcgtggtttgtctgggaatcacattcttcctactcgataaagtcaacggaaaatggtttaccaagttctcagtcggccttgtcggggtgattttagtaatgggaattatcttagtcaatgtgattaatctaaattaaagagtgggaccaaggcgttttgatcccagaatttaagcaaataatccggttattcctgtctttggaatagccggattatttgcttaaatggccgggatcagccgattgtcgcgcgtttaaacgagataacagaggaataaaaacaaacgggtgagacaacacaaattgtctcacccgtttgttttatttaaactaaatttgttggaatgcctgatccaaatcagcaatcaagtcgtcagcgtcttccaggccgacggacaaacggatcaattcatccttaatgcccattttcaggcgctctggcttgggaatctcgaagtgtgacatgaatgccggcacttcgaccaaactttcagcagcgcccaaactaacggccagaatgatgagctgaaggctgttgacaaacttggcagcgtccaatccgggttggacttcaaaggagagcaccccaccggcacctttggcttcatcactgatgatttggtaatcctgactggctttgtcaacagttgggtaataaatcttggcaactttgggattactttgcaaataagcaatgattttctcagcgttttgaatgtgccgatccatccggatgtttagggtctgaataccacggcgaagcaaattggcttcttgaggtgccaaaaccgcaccaatggtattttgaatcgcataaatttgatcgctcaaatccttggttttggtgacaatcatccccgccgtaaagtcagaatgaccacccaagtatttagttgccgagtgcagcaccacatcggcgcccaagtctaatggacgttggagatagggtgtcaaaaatgtattgtcgacaaccaccaaggcattgtgctggtgagcgatttgagaaatctgcttgacgcttgaaaccttgagtaacgggttagtcaccggctcgaagtagacgcctttggtattcggtttgaaagccgctgccaccgcatcagcatcttgggtatcaacttcggtgaattccaacccacgcggcttcaaaaaatcattcaccagtcggaaagtcccaccgtaaatgttatcgccgataatcagatgatcgccaggtttaaagagcgccaatgccgcatgaatcgccgccatcccgcttgaaaaagcaaagccgcggtcaccgttttccaatttggcacacacgtcttcaacggcatctcgagttgggttgccggaacgttcatagtcccatttaacatccgcccccagcttggggtagcgaaaagttgatgagttgtagattggcacgttcacagctccggtggagttgtcattgggacggccgccgcgaaccagtaatgtattaaatttaaccattaaaaaatctcctatctctccaaagtggtggtgctacttaacaggaaccaattgatctgatgataacagatacagatatttctttgtaaccggcctgccaaggatttgatccaaagcagtcgcgtacaggcggatctggccgtcataacgttcatgaatcgtatcaacggtggtcttcggagtcagtcggtcagtcttataatcaaacaacacgacacccgcctccgactcaacatagccgtcaataattccgtggatcaagatcggttgatcatcatcttggtcaaaatccttgaaggcgtttttagccttcatcaatagagaaaacgggacttcgcggtaagtcgtctctgggttagccaaaacaaccgcgcccagagatgacgcataaaatctcagaatcccgtcaacgttaatttctccggcaacattctcttccagaataccttccttcaccaggttggcaatcagctcaacgatagtggcctttgtcggctgttggtgtaaatcaacctgctgcagtaccaagtgggtcgctgttccgacctcagtaggtgccggtttatgggtaccgttttccgaaataaatttcggtgttgccaggctgggttgggtgtagcggccgggtttaatcagctgatcgctgtcaattagcgaataattgcccagctggacgttatcgggatcatcgaacagccgcttaatttcggaaacggattggtaggctgtcgtgcgagttgctgcctggtgtgggtaacggaaattcatgatggccttaatttgtcggcgattaacgtctgaatcggattcgaccggctgctgctgatcgatccagctacgaggatcaactgctgcacggccagcctgcttctttccttcagccaccttggcattgtcataaaatttcaggctcaaccggctggggtcatcggcaagcaggttgacaattcggctgtcgccataatctttaatcacatccggatgacgggaaattgccggaccaatccagtccaaatagcttttggcgctgttgcgctctgccattggcaataagatggccgattcttcagtctgtgactgccagctttcaacgatcgcctgcaaatccaacgttggtttgcgagacccgccttttcctggatcgactttaccgaccagaaagagccgctgttcagcccgggttaaggccacgtagagcttccgcatttcttcagacaaaccggcattcttggtcacatccaagacggcctggcgctgcaaaggttcttgaatctcccgggtttgggtatccaaataagaaataccaattcccagatgatcattcaacaccgcacgtcccgtagtgtcctgctggttgaattgtttaccaatatcattcaaaaagacaatcgggaactggaggcctttactgccgtgaatcgtcatcacgtgaaccatgttgtcagatgtattcggcaccgccgtggctaagtcgtcatccctagcctgcattcgctcgataaacagcacaaatctgaacaaacccttaaaaccattcttctcgtagtcaaaggcccgctcatacaaagcatgcaggttcgtctggcgctgataaccgcctggcatcccgccaacataatccaaatagccggtttgcttataaatttcccaaatcagagcaaccaagccgtcttgtttggcaacgtttttaaaatgatccagctgcttgaacaaggtgtcgattaacggatagatcgtctgagcatatttgttgggttcagcgttgggatagtcccggtaaaatttcaacaccgactcatagtaattccctgtcttttgattaattcgcaaataggccagctgattttcatccaaaccgacgatcggcgaccgcagcacggctaccaaggggatatcttggtaaggattgtcgataatcgacagtaatgacagcattacctgaatttccgtggttttcagataactcttggcaccggtaatttcagccggaatcccgtaatctttgaaaattgaagacatggtaatctggctgccccgggttggcgaaatgacagcaaagtcaccgtagtcaaccggtcgatcgccatcgccatccgcaatccgttcgtggtcatcgaccatctggcgaatcttttgggcaatgatttcaacctgtccttcatcggtgtccataacttgctcggcaggaaggtcttcaccctctgatagcggctttttagggctgtacagcagcaccgaaacgtcagcatttacgtcttttggataatacttggcgccaaactgcagcttggcatctgagtagtcaatttcgccaacttggcggtccatgatctgctcaaaaatcaggttaacgaaatgatcgacgttctcagttgaccggaagttatcggccaaggtgattaattcgttgtcattatcagccagcgaataggtatgctgcttactaataaacatttggggatcggccagccggaagcgataaattgactgtttggaatcccccaccatgaaccggtttccgccgccttctttagccagtttattcaaaatggcgtcctgaagccggttattatcctgatattcgtcggtcataatttcataatactgatcccggagctttgcttgaacttggcgggcctgtgggctgtcgtcattcaaaatccggtaagcagcctgctcaatatcgatgaattccatcaaatggcgctgatgcttggttgcctcgtaagcggttcgaaaggctttgaccgctgaaatcagtttggcaacccgctgcttggcggctgccatcaggtcaacgttggcctgttcgtcgataccgaaatatttattgcaaaaggcattgaagtcttttttggtttgttgattaattgcgctaatttggccatgaaactgtttttgttcaccctgcggtttggttagccttggcaaatcggcaaattcgaaaccagtcagtgacttgcggacatcgtcaaatgatgtgcaatttaaaaccactttttgaagggtctcaatggctgccagctggtcagtgaaagctttttcgtccttatccaaggcaccgctttgggccaatttaatcatgtattgatgattgattttgagcttggtaaatgcttcagcaatctttggggcaacgttttgttgatagaaatcactgtcatacaatggtttgccaccgagatcataaaaatcggtgacagcattcagccaaccatccggatcgtcggtaacgtttgcgaactcgtctaatcgataaatgagatccgctaagccgtcgtcactgcggtcgttggaaaagttctccgtcaaccgcgcaaatgagccatcttcatcgttgccatataggtcttctcgaacggctccccaaacttgatccttgagcaactgtttttcagtatcgtcggccaaaatgcgaaagttgggatcgattcccaagagatagtagtatctgccgactaatttctgacaataagcgtccatcgtcgtaatgtcggccaccgcgactttttggatttgggtgagcagccggcccttttcggcttcagctgcctgattaaattcttctcggagggctgcctgtagtcgttggcgcatttctttggcagcggcgttggtaaacgtcaccactaacagttggtcgatgtcgacatgctgatttttgaccatgtcaataattcgatcgaccaacacccgggtcttcccggatcccgcagaggcggaaaccaggacattgcctgccgggcggtctttaattgcctttagttgatcaggcgtgtattcaaatgccatcggacttttcctcccctaattttttcttaatatcgtcaatcgaatcactgttaaccggccggtactggttacccggcaaaattgggtcaaagttcatgattgatttgtacggggtaaactgcatcccggtggtttgaccctgcttaaacggccacagtcgaacgtcaccggcaaaaatcttttctgccgcatcgacaataagtttctcagtgtgggtgagaaacgcatccaattgcaatggattaatcaatgattttttaccagtgtagcctttggcggtctttctaattgggtaaatcggtgagtagccgctatccagctcctcatccaaatgatcaatcaagccggactcgtcaaccaaaatgccgttatagcgatgcttctttaacaaggcatcgtcaaaggtcaccttttgaaggtcctcgggtttgaagacggcattataaatgtgcaagtacaacgcgccggccaaagcgacttccttatcgtcgggattaagtcgttccagattgtgttttaaaacatccagatacgtcaacagctgcattgacgtcccgtcgtaagctgcattgaaatcaaatttgcggtcagaggacttgtagtcaacgatcccgaagtagcgtttgtccttggtggtcatcgaatcaattcggtcaattctgccccgaactttaacctgatgatcatcagccaaatcaaagctcagaccattgagggcctgcttttgattgggctggccaaaaatcagttcggtattttgcggccgcattggcgtcagtttctgttggtcacgcaaggctcggatcatctgctggatggtcgcggctaattgcatggaaatataatgcatccgattggaactggtcagcacaacgtagtcaaagttttggggatcattgatgattcggtcgacggtttctttgacgaggtcgctcacatcttgatcggataagctggccaaatcaatgttttgggcatgaatctgcttaataatccggtccatggcgtcatgataaaaggtcccagtcgatgccgtcgacagctcaaacttcggtcgttcctggagttttaacccatatttgaggaaatattcataggggttcttatagaaggtttccagttgagaaatcgaaatatttagttctgacccgtatagatctgtaatgatttcaggagccaatgactgcggcacatttgtgtaattaatgctcttaagcagcttggccgtctgccggttgacttccggatcccgctgcaggtactgcaaaatcactgcccagccggcactcaagtcctgatgaatatcaaagtgattttgaatgacttgaatcaaatggtgaagtgtcccgcgcttggtgcccacgtatggcatcacgtcgtgctcatcatcggggatcgccgggttgttgacgattttgaggttaaagaaatgctgaatccgtgaaacataaggtgaaagtttcacagcggattcgtcgtttaatttgttggtgtaggtaaaaatgagtttatccgaagcggtcatgaaggccaaatagttcaagtatggttcaaaagccatttggacttccgcgggatcatttaaatactgatcgtcactgagattgctttggagttggttgatgtcgtcatcgccaaagagattttcattaactaggcgatccggcatgttgtcatcgttggcgccgatcatgaacgtgactcgataatcattcatctgaaccatgccgctttcagagacgctcacttgatccagcgtggacggaatttgtgaatagtccgctccttcaaagccggcatagatgagtgaccaaaaatcgccgggcacaaacggtttgtcccccagaatttggacgcattcgtccagtagagaacaaaatgtccgccaaacctgttcgatttggttggaacgattgatatcgccctcgtctgttgccgcatcccgccagtcctggagccggtcaacaacgccggcatccactagaaactggtagagaatttgagcagcttcctggttggttttagctttgaaaaattgtttataaaaactgggtaataagtctcgcaccaggtggcgaatgatattgattttgcgggaaatttcccgatcttggtcagtgatctttgtggtcgtctgttcttcgtcgctgtccggcagccaaacgtactgccaatcagccttttgtgtccagcgggtgtcggcgtaatcgtttttcagcaccaaattatcggtcaaagacaccgcttgacgataatcatcgattgccatcggcttgccgtcaatcatcggtaggactaattcagattttaaaaaccgcatcacgtcatcgtaacggtaattgcgggctcgatttggatcgtagatatcaaataacgctgctaataattccaccagcggatggtcagccattgactgctgaatatccttgaaataggggatctgctgggtggtaaacaccggctctaaaatattttgatatgcgtctaaatggcgggtcaaaatgagaaaatccgagtaccgatatttaccggtggcaaccatttgatgaatcttcgtggcaacttggtccagttcagagtaaaggttgtcagcttgataaatttgaaccgactccggggaaatttggtcaggcagttgatgagtcccgaggctgctggacgtgatccagtacgcctctaatttttgcatatcttcatcaacccgcggctggtcagccatgacggcctttaaataaggcacccggttgtcagcggcaaatcgatagagctgatggaacaatttagccggctgaaagaaaatattcggctgttccggcagttcagttgggtatggccggtccaacgtcaatgacaccgtcaccgaagcggattgattgatcaaggtttgcaccaagccgcattcctgggcagtaaattttgaaaaaccgtcaatatagaagtgatagccactcaaatcaatgtcctgcagtttgctgctcagcaggttcaagacggtgtggctgtcaaaatagttctctgaaatgcgtttgacatattgggaataaataattgaaaaatcgtggagtttatcgcgcagatcattggtaatcgtgctgtcaggccgctgcagcatttccaaaagatcttcaggcaagacatttccggcctgcatctcggcaatctgggtagcaatctgatcaataaacccaggattatgaatttcgtggtcaaagagcaccaattgatcggcgttatcaacaataatttggtacagcagcatactgataccggcactgctgatccgctgcttttgatattccggtgtgttgcgcagaaagaaccacgctaatcgggtgaaggataacacctgaacatcacttcgagcagtggtcatttgattggcgtcgccaagttgttttaaaatactgacttctgattcaaacttaatgtggtttggaaccaaatagaaaaattggtcgtgtggattgtctgatttttgctggcgcagaatatcgatcattttcgattgatgatcgacacctgcttgacctaagacaaactgaagggtcactgctctcacctctttaaaattactttaattttaccatagtatattcctcatgtttgatgaagattgacgtggatttcttcagcgaagcaaaccgccaatcgcacgcccagcaagggattagttgggtatcaaaatgatttgtgaatttccggaacattatcattgaacattaacaaaaagggtctattatgagggttggatgtatcttacatccatctatttgacctaaatgaaagctttatgcttgcattgatcttgttagagagcctaccagtgcattccacgattaagtatcggaagcaagaatttacgatctacccccaatatatctttcaagttcaaatactgataggccctactcctaataacgcccggtgaaaactgggtgtacataaagaacagagtgcggaacagaccggttagactccgagcattagcagaataatgagttttaatgctgaaagcgttgaaactcattattgggctaagcggaggagtctggcttgtgtagcacatttccactatataagagtaaagcttcaaactttgatgcgctttttgcatcaagactcattgttggataaagcggaagaagctggtctgtgtagcacctttcaacagagtgcggaacaagccggttagcttcggagcattaatttgataaccagttttgatgcgtatttcgcatcgaaactggttatcggattaagcggacgaagctggcttgtgtagcacctttccactaaataagagtaaagctccaaattttaatgcgctctttacatcaaaactcattgttaattaaagcggacgaatctggtccgtcggaacacatctttgccaactaacagtcacacaccacaaaccaaaatacattaaaggaggcagccaacacggttgcctcctttaataaaggtatcgatgcaaagaacctaagcccgcaccttattttcttccatcaccttattggtataaaactccaaatcatcgactgcctgatcatcctgatccccctgagcagtcacagcgtggagattctgctgggcaaccgcccaataaaccaggttggtggtaatcggcagaatgtcccgaatgacgtgaaagtcgaaattatcgccatttgtggatttcatattcaaaaagttattccagtcggtcaccatattgacaccactgtgttctttcttcgagaccgcagaaatgatgacgaagtgggaattgcgatttgcttcttccaactgattttttagctgttcaatttgttctgcttccagtttaattgccattctatcactctcccatcggtgtttgatcaataattccaattgaatgattcattaatttttgctcgatcagcatttcataagccagcttggcaaccgcttttggagataccgttttagccggcatcggcgttccttcattaaacagttcatagtcgctggcctgctggtcctttaattgacccattctaattatagaatacgcaatttcggattcatcgacaatcttgatggcatatctttgctgttttataaattcttgggggtctttcacgccagcataagtgactgactcattcagctcgtcatcaacgccggcgtatgagagcatcacaatatcactgattggcggctgaacctcatcgaccgcctcaaagagcgcttccacatagaggtcggcgtcgttgggaccaacggcgatgaaaagtaggttggtatccggcaaggcttgagcatagtcatttgctgattccaaattacccgaatagacctcgacagaaatgtcggagcgttgcttaagtaacgcgtttaacggtgacaccacggggctattttgattaatgattaataattttttcaaatcggtggcttcctaatctaaatgtttttcaaattgtgcgtaatggaccataattaatgtgtaccataataacaatggaaaatcaaaggaggacgtaaaaatgtcccaaaaagttaaaattggtcaatcagacgttgtcagcaccccgttaggctttggaaccaacgctgtcggcggtcacaacctgtttcctaatttggacgaagaggccggcatgaattccgttcgggcggcattggatagtggcatcaccatgctggataccgcatttgcctatggcttcggtcgctctgaagaattaatcggcaaggtgctcaaagactatgaccgctcaaaagtcgttgtggctaccaaaggcgcccaaattgtgaacggcgatcaggtcaccatcagtaaccgaccagccgatctcgagaaatttgtgaaggacagcctcaaccggttggataccgattatctcgacatcttttacattcacttccccgatgatcaaacacctaaggcggaagccatcgccaagctggccgagctgaaaaagcaaggactcatcaaagcgattggcgtttccaacttctccttggaccaactcaaagaagctaaccagaatcacgatgttgatattgtggaagaccagtatagcctggtccatcgcgatgctgaaaaagagctgttcccttatctggagcaagaacagatttcctttgtgcccttcttcccactggcatccggtctgctaactggtaaatacgatggtagtccagttaattttcctgaagatgaccttcgaagcggcgaccccaacttttctggcagccgtttccacgccatcacgcagtcagtcaagaacctgcagccaattgcagacaaccacgatgccacaattgcccaagttgtcttagcttggtacatcaagaatcctgacatcacggttgtcatccccggtgccaaaacgccagagcaagtccgcagcaatgccaaagcaatgaacgttgccttatcggatcaggaatacaatacgattgataacgcatttagattctaatccacatctaaacagacatctaggccaccaatgtttagcgcaaatttctttgccaaccgcttcaatggtcaggccttgatatagaaatttttttaaatgcatttgtgacccccgcttaacggcacatggtatactcaagttggatcggagagcgcttacaattaagttatggggggcctcctttatgaaccgtttagatggtaaagttgcaattattactggtggtgttagtggctttggtttggcagctgccaaattattcgtccaagaaggtgccaaggtaaccattaccgatgtcaatgattccaaggctgagcaagctttaaatgaaattggcaaagacaaggcgatttttgttcaacaagatgtttccaaagaagccgactgggatccggttttccaaaagacgattgaccagtttggcccagtgaatgttctgttgaacaacgcaggcatcttaatttttgacgatgctgaaaccgtcgacatggatcaatggcacaagattttatcagttgacctggatggtgtcatgctgggagttaaatatggcatcaagtatatgaaggaaaaaggcggatcgatcatcaacctggcatcaattgccagcctgatcgggatcagcaacctttattcctacaatgcagccaaaggtggcgttcgactcatcacgaagtcggctgcgctatacgctgctgagaaggattatccaatccgggttaactcaattcatccagggtatgcccacacaccaatggttgattcttaccctgaactcagacaaaagctcgagagccttcacccgatgaaacgactggcagatccaaaggaaattgccaacatggccttgtatctggcttcggatgaatcatcattctcgactggttccgagttcgtcgttgacggtggttatacagcacaataattcatcgtggtttgaaaattcctgacgaccgtccaagtgattggatatgccgatcaatctaactcacaatatgaattctctattaactgcttgcgacaatcatcgtaagcagtttttttgctgagaaatttatgtaaccagttgcataaatgcttcgacataacggtaaacgttttgttactttttgttaatttaattcgtttattgaacccttttaatgataatgctaaaataaatatgtaattttttattcatacacgaacgatagaaggagctattatatgttaaattcaattgccaagtatttcgagtttgatgagcgaaatacgaatttccgtaaagaaattatcgccggaattacgacgtttgtttcaatggtttacatcttgttcgttaaccctaacgttcttggagtcagcgggatggacaaaggggccgtctttaccgcgactgcccttgcttccgcatttggctgtttcatgatgggcttcattgccaactacccaattgcgatttctgccagtctggggatcaatgccttctttgcctattcagttgtgattggcatgaaggtttcatggcagactgctttagccggggtcttcgttgcgtcagttatttttatgattttgaccgctttgaagcttcgtgaaaaaatcatcgattccattccagctgacttgaaagctgccatcggtggcgggattggtttattcattgcctttatcggcttgagtgacggtggcttggtcactgccaacaaagacaccttggtgagcctaggatcgttacacgtcgggacaacttggctgacgatcttcggtctgttaatcaccgttgttttgatgagcatgcggattccaggtgccatctttattgggatggtcctcaatgctattcttggaatggtgaccgggtttattccattaccccatcaatgggtttcttcgattcccagcttaaaaccaacttttggtgttgccttgtcacacattggtgatatcaactcggttcagttagtcgtggtcgtcttaacgttcctgctggtaaccttctttgataccgccggtacgttggttggtttggctgaacaagccggatttattaagaataacaaaattcctcgaatcggtcacgcattaattgctgattcttcaaccatgttagttggatctgttctgggaacttccccaatgggcgccttcgttgagtcttcagccggaatcgccgttggtggtcgaactggatttactgccgtcatcgtcggaattctgttcattttaggtactttcttctcaccattattgaccgttatcaccagccaagtaacggcaccagccttgattatcgttggtattttgatggctcaagcactgaagagtgttcactgggaacaatttgaaattgccgccccagcattcatcacacttgtcggcatgccattaacctacagtatcgccgatgggattgcccttggatttattacctacccaatcacgatgatcgccgctcgtcgtggcaaagaagtcagtgccatgatgtatggattggcggttgtgtttgtgattttcctttggatactcaacaattagagcgcgacaagggctgaaagaaacacttaaagaatctgacaaacatgttctcttgcaccaaattcaacccttcagaccaaaactattttgacctcgcaccccaaaagcggtaaggtataaaggttgtttaacaactgaatatttaacaaggaaggaatttgttatgaattctaagactaatttgtttggcatcagcaacgttcgtgacctcacgaaagccgctgttgtatctgcactctacatcgtgatcacgatggtctttgcagccttgagttttggcccaattcaattccgcttttcagaaggtttgaataaccttgctgtcttcaataagcgttacgttgtggcgatcacgctgggatgcttcatttcgaatatgatgtcgtcactcggaccactggacatggttgtcggaactggtgaaacgctgattgcgctgttgaccatcaacatcgtgacccggttcatcaagtcactgccattgaagctggttgcatccgttttgatcggaaccttttacatgttcatcgtggctgcagaaattgcttatctcggaaacaccgccttttggccgaccttctggggtgcatatctgaccactgccatcggtgagtttgtgaccatgacgattggtgctgtgttggtttacatcatcagtttgagatatgatttgaataagtaaatatgaaaaccgcaatcagaaattctggttgcggttttttagataaccgaatcgtttacctcctgtccaaaatatcttaaaatatagttgtgaatataatcacaatttttatttaggaggttccatcatgacagaattatttgcaagtcccaacacctatatccaaggtcccggcgagctgttcaagagcgctggatatattgaaaagtatggcaaaaaagttctcttgctgtctgatccgacagtgctaaaaattgttgggaacgactttaacgattatcttcaaaataatggcttcgacgtcacccttgcccagtttgagggtgaggcttccgaatccgaaattaatcgggtgactgagattggtaaatccaaccaagaccagatcatcattggtttaggcggtgggaagactgccgactcagccaaggcaattgccgacaacctcgacattgctgcgatgatcgctccgaccatcgcgtccaccgatgctccctgctcacgattgtcagtcatctacaccgatgacggggcattcgatcactaccgcttttacaagaagaatcccgaaattgtcctcctcgacaccaaggtcatcgctggcggtccggttcacctattgatatccggaatcgccgatgcgttggccacaaacgttgaagccaccgacgttcgtgctgccaatgccgataacatgctgggcgctaagcaaaccatcgttgccggcgcgattggccaagcctgtgaggataatttgtttgaatatgccgacctagcgattgccgctaacaaggcccacgtcgccacccctgctttggaccacgtcgttgaggccaacacccttctcagtggtttgggcttcgaaagcggcggcctggcagctgctcacgccattcacaacggcttcaccgctttgaccggcgacatccatcacctcactcatggtgagaaggtggcgtatggcacgttggtcgaattgattttagacggcagcgatcacgcccgtttcgaaaaattcttgaaatttgatctcaaacttggcttgccaaccactctggccgatctgcatttaagttcagcttcagatgaggacctgatgaaagtggctacccaagcttgcgatgagaacgacacgatgaaatgcatgccaaccgacattacgccggaagacgtcttcgcggccatcaaggcagtcgacgagtatagtaaagactttcagaatcaataaccagttggttcaacccgatttttgaacttataatgtacgcaaagacagcggctattccgagaatgggatagccgctgtctttgtctaaatggcccagatgagccaatattaagatcgatttattttgtctcagtcgtcacgataatacggccgtcatgctttttgctcaataactcgtgtccttggatgacaccggcgacggtaaatggcagttgatagccaattcgaattgagagcttgtcctctgccatcaatttcaacagtgcggtcaaagcttcggcatccgaaattacctttgtcggcataatcggtttgaactggaactgcttattggataatggctcatcgccgccaaccgtcgtgatgatgccattttccttcacaatccgggcatcgctgtcactatcggcaccattcaaggcagaattgatgaccacatccgcccggttggccagaaccaacgccgggtcctgcttgttatatgagacgtactcgtcgactcccagcgatttgacgtaggcttcattcttactggcaccgatgccgatgacagttgcgcccaaattaagcgctaactgcgccgccagcgaaccgacgccaccagaagcaccgcgaaccaccaccgtttggccggccttaacttcaccaaagtaataaacagctttgtaggcggtaatccctggggtaacaatcccggcagcttccgcaaatgaaaccccatcgggaatcttgacggttcgagcagcggtggcataagcatattcggcgtaagccccatggccatgggcaactactcgatcaccaacttggaagccatccacattggcaccaagcttggcaaccgttccggcaacatcccgaccaggaatgacctgatgggtggtcgccttatattccccagcccgcatcgatttttcaaaattattcaggttaaaggccttggtctgaatcaaaatctgatcgtcggaaatttccggggtcggcacctcgtattcttcaaagacgtccgcagccccgttatgatcgtatccaaatgctttcattgctagcactcctatccttatatccgatattgtttaataaaattgtaagggttatcaatttggttatcaaacaaaaggctcttctgcgatcaaaacgcctcgtgcctcacactcaaaaataggacccaaccaccctctaggtgatcggatcctatctgaaacatgttgtctgaaaggcatttgaaccaatcattgaccaattcatggtcggtattcgtatcatttaaatatcttctgcagggtggaacggcagactactcggatctaagctcgctgacttagcacctacattattttcggaaatccctcgtctgtcttgcaggtgattagttcattcacctttcaccattattatataatttataagttagcggtacaaccaatccgtcttcaaaattattcctgcaaatcgcggaagatttcctacattttgctttcaatgtcgaataattcactggcatattccttgagattaccggtgtgctgttcaactttttcttccgggacatccgtcttataacgtaacttgtgttccaagctggcccacatatccatcccgatcgttcttaactgaacctcgattggaacatcaaacacaccgttggattgaaagaccggcaccgacaccaccaaatgcaggctgcgatagccactgggtttgggatccttgatgtagtccttgcgtttgatcaaggttacatcggattgctgagtcagggcgtcttcaacccgataaacgtcgtcgatgtagttggtaatcacccgaatgccaccaacgtctaaaattttatgatgaatcgtgtccatgttgagtgggtagccttttcgctgaattttacccaccaaactgcggacacttttcatccgttcttccatatgatgaatcgggttatggtcataattcattgaatactcttcgtccaggttctccagcttagttccaatctcgttaacccccgagtgccgcaattggtagatttgggctaattctttgagatcgccaatctcgcttttcatgggcaatttatccaattctttcataatctgcttaacatccatgaagttacttcgttctagtatcatatttgattccaccttacactttcaaaatgttacaaaatcggtgacagcagcctgctaaacgtctgcttaaacttcagccacagcgactgctcttcgaacttttccggggtctgtaattcgctgacatcaatatcgtttaagaagatgtcacgcaaatcggccgagaacttctgatcataaataaacgcgttgatctcaaagtttaacttaaaactgcgataatccaggttcgctgaaccgaccgaagaaatcttgtcgtcaatcaccatcgttttggcatgaatgaagccatcgccataatagtaaattttaacgccttcctcagccagttggcgggcataatactgagtcgcccggtagacaaatggatgatcgggcatgcttggcaccatgatccgcacgtcgacaccagacatggcagcaatccgtaaggcatccatcatactatcgtctggaatcaggtagggagattgaatccaacagtaatctttggccatggtaatcagcttaatgtaacccattttgatctgttgtaaatccgagtccggtccgctggagacaatctgcatgttgacattgcccttagtagtcgtaaccgggaagtatttcggttcaacttgatcctcatcgatttgatcccggggactggtggcgttccagtccaaaatgaaccgggcttgcagtccaaagacccccgacccaatgatgcgaatgtgggtatcccgccagttgccaaactttttcttgcggcccaagtactggtcaccaatgttgaagccaccagtatagccagtagttccatcaatgacaataatctttctgtgatcacggaagttaatccggaaatccaagagaactgagcgggtgttcaagaatggaaaggccttgccgccggcatcaaccagtggttggaagaacttccgggtcgtgcccatcgatccccatgagtcataaatcactcggacctcaacgccttcacgggcttttttaaccaacaggtttaaaatttcatttccgatctgatcattgtaaaaagtatagaattcaatatgaatactctttttggcagcttcaatgtcaccgatgactttatgaaataagctgttgccgtcagtaaaaatatgaactttattttgacgagacaaaaaagcctgatcggttgtcatgaacatatcaacagcggtcttagcctcggtaacgacttcatcggccggtgtcttttcatcatggcccaattgttttcgctgttcgttaagtcgttcatccagctgcatctgcacgtgtttatgtaatttgaataaccgattcttaggtaattttcgacccagaaaggcataagcaataaagccgaccagcggtaaaaagaccagcactaacagccaagcccaaatcgcggcaatatcgcgcttctccctaaataccgtgaagatcgccaaaattgcgttaatgacgacaattacattaaataccatcgaccaatcaatagtcattttttcctccccgcagccacttttaggctaaaataataatgcatactgtaagtatactagaaagaagcggaaaaattatggatttattcaattttcttattgcgggcctccatggggtccactcaattcgttttattcacttcatcttcaatgaacaaccgctccttggcatcgggctgatcgtggccttggtgctgtatatgatttatcgttatatgaaccgataatacccatttggaaatccgattaagcaattgccttttagagaacggatttcctagttcacttatgaaacacaaataggcctaagccacgaaggcttgggcctatttggtgcatacctgcttcaccacttgggggtgtaaggtgaacgctggcatacagtgacttaatgcaataagggcgtaacaaaatactaagtgatcatgataacttttcaaattattttgaaagcggtaccatatctttaatataaacttctgggtaagcaaccacactgttaaaaccaatttggttttaatgacctacccctttttgccgatattcggccggcgtcactccaaaaattttcttgaagttcttgtaaaaatgactcacatcggtgtagccaaccttatcaataatttcttcaatactcatcttagttgaaatcagtaactttgctgcctcacgcattttaatatctctgagaagctgagagaaggaatacccagtttcccgtttgataaatcgactgatatagccttcactcaaattaaaatgttgagcgagactttccaagttcacatctttgcggttgacacgaatatactgaataatgtttgaaaccggctgctcgtcaatgttgccttcaagaattgtggcatcgtcagcgtgattgcgaataatctgaccgaacaacaacaggacgtaactgttcaggataatttgagatccatgcatggatgcttgagactccatgtacaagccaaaaatgatgtgttcaatctccttgtcattatcacaatgaactaacaccaactgagagaactcccgacgatacagcattctcaaaaagaagttggaaatatcattttgctccattagcagaggagaaaatgcatcctcgaacgatgatcgccgcataataatgttaaccacaatatcgtcgtcagcattacagaaaaacgcctgtttgaggtttgggggaacaatgaccaggtctccctgttccaaatcataggttttaccgttcagaaaaaacttgcaatgcccattgaggacataggagatttttacgaactccaaggtatgttccataatcggcagataacgcaaatgcttaaaaacaacaatttcagaatttaaatggggtgggtagatcagcttggaattggaattgccattttgctccggatgagtcacaggctgtgaaaagaattcactctcgaagaaccgcggacgaatgtcagaaagtggttgatctggaaatttcacaggattcttcatctttgctcgatactgatccgcaaaagcctgccaagttgaaaccggcttaaaattgtcgtatggattggcgacatacaacttcttatactcaatttcagcagtttcaagcttcattaatgaatttaaacttggagagttcaatattttcacttccttgactagacaaacaatgaccggtgacaacagtccgtcgtcccagtcgatcgtttgcaactatttaagatgcttggtaatcaaaactattttcatagtgtccatccctgagttcaactgtgtcatagcctggaatatcgacctttgcagtggcgccataaggaacgtcaacagaaaccgaaagcttgccgtcagtgtagttccattcaaccttggctgttccaaatggcgtttcgtgtgaagtcttggcagacgttaagttaccacccggacgaggggcaacttcgaactggtgccaagccggggcagtcggcttaagaccaccgaccgttgcatgaatccagtccgcaactgagccaagtgaatagtggttaaacgatgtcattacaccagggttgaccgagccatcgggcaacatcgagtcccaacgttcccaagtagtggtgccacccattttgacttgatacatccagcttgggcattcttcagacaggaacaattgataagcctcatccatatgacctgtctcagtcaatgcaggcaggatgtaaggggttccagcaaagcctgtgccaattttaccatgagcgcgacgaacaagtaatgccaacctgtgaccggcaaattctttaatctctggatcgtcatccaccaacccaaaggcaattgccagtgcataggcacattgcgtgtctgaagtcatgatacccttgtcgttaaagaatcgcttcttaaatccaaggtgaacatgattggctaatttggtatattcatcggcctcatcatccttaccaagttcgtgacccattttaacaaacatgtcacaactattggcataaaatgcggttgcgactagattcttttccgtcatggcctttactggatcatccgccggcgccgtgggatccagccagtcaccaagttgtcccagtgagtatgccggcttacggtcccaaacaccatcttctgaaaggtaacctttgacctcatcgatccaacctttagcagtttcgtactgcttggcaagcatctctttgtcaccacttgccatataaattgcccaaggaactcgaactgcagaatcaccccaaatggcaataccttgcggttcagtccattcagcaaatggaataaatgggacataaaacggtactgttcccaatcgcttttgttcatgtgaaacatcttgaagccagctgctcaagaaaccttcaacgtcgtagaaatatgcggctgtggggctgaacagtgagatatcgccagtccaacctaaacgctcatcacgttgcgggcagtcagtcgccaaggaaacaaagtttgatcgcattgaccaaagcgcattgtcatcaagccggttcacattctcattagaggattcaaaagtcccggtttgcaacatgtctgaaaaatagactttacactgcatatcatcggcagtcagttcaccgcgccaaccacggatttcagcatatctaaatccatgggtggcaaagcgggcttcaaagtgagcatccgacccatttgaaatgtattgatcaatttgttgaccccgacggagtggccgagtggaaagcgacccgtcactttccaatacttcggcgtgctgaagttcaatcacatcgccatcctgtgcgttggtaatatgcagatcaatccgttgagtacagttttgaccaaagtcgacttgccaatcagccttgccatcatactcgcgaatttttttgattgaaatcggctggttaaccatgttggcacggactggtggcaggattggaaactccatcttccgtcgatcaaacggaatttgggcaactggcagccaatcggcatcatcatatcctggttggtcaaaaccgtccttctcaagatgcgaatcataagtctcaccttcacacaagtcagactgggtgattggccccttggtcactttccataatccatcatgtgaattagagaaaatctgctcgctggtaccgtcaggataagtcacttccagctgcgcgaagacaccaattttgtctccatagacgttcgccttaccgcctttgaaaccaatccggccgcgataccagccatcccccaagtaaaagccaaacgcattttgaccggctttcaagtcgcccaccaagtcgtaagtccagcattccaaacgatcatcgtaggctgtccaacctggcgttaagatgtctttgccaattgctttgccattcacgtgaccttcaaccagaccaagtgcagaaaggtaaagtcgtgcatatactggtgtgtctttaagcgtaaactcattgcgaaccagtggtaaatgacgatggtcagtttctgcttccggccagctcggaccaacaaagcttgattggagttcccagtattcaagaattccttcatcaaatttaagggtttgtgaccagtcccctttggtatcaccatcaaccagacgggcctttacttcaacctgttctctagaaaccaatggatccaatggccaggcaaacaaaacgttgttaaccggttcggtaacaattgattcaactgtcccagcttggcctggcatatgccgggtaatttggagttcgacctcatctgaatcagccacatggccatcatacttccatgaaatccgcggagtagcggttctaatggctaatacatcgccgtgatagtgttcaacttgtaaatcatatggtgcttttgcattaacgatcacagacattctaaaaatccttctctcttatcagattctgttttgacattaactaactcaattatttttcaattccatacttgcgctgcagacgaatcataattgcaccagcaatgaagctgacaacaacgactccggcaaagcaccacatcgtaattttgatgacccctggtaaaacgagggctggggtaacgaaagcaaatagtgcacaaacaacccgtgatgttccgttgataattccttgaattgaagaacgaacctcaaccgggaatgactcttgcgtccaaactttatacaaagcttcaccagccattggactaccaatgttgtagaaaccgatcgcaacaatgattgcgattaagctaccgccacccattgtcattccaaccatggcaaggaacataataacggcaccaattacaaaccccgtattacgatatttacttccggcaatggatgagaaaacagcactgacaactaacgcaatcacgtttagaacgattccggcaccggttgccaaactttgtgaggcattggccttgaccatcatgaaggtctggaattgaccccaggtatttgcaagcaggttccaaccaatgtagaagatcaaaattgcaatgaagaagtacaagaactttttgttttcgccaaacaatatcttagtaactgatttagtcgcaacctctttactgttcttgcgattttcttcgtaacgagctgttccttcgtcatgcagttctttgaatttgcttgacatcgtccgccacagccaagtgatgattgcgaaaataaccaacagtccaaagacgattcgagccccggtggcaccggtcattttggaaacggcgaaggcaccaatatatgaaataaagatgccggcctgccaaaagatttgcgttgatgacaccaattttgctgaagttttggcatcaggcgaatctcttgaaactactgtcaaagaaatcggcaagtcggttcctgaggcaatccctgtaatgatgaccccaattaataacgtgatgtaattcggggcaaacacagcaattccagcaccgattgcatagaataaattaatccagttaaagactttaatcaggccaattgattcagcaatccggccgccaaacaatgatccaaaagcgatggcaaatgtcaacgccccggaaatgatcccgacttgaccattcgtcaatcccaatcctgattgccacaccgaaatggtagcggccaaccccacaataatgcctgaaccaagcatcgaaccaatcccggcggcatacgccaggggacggtaatatgaaatgtcttttgtttccatagttaatgagtctccttatttgctgctaaattttgattgtactttggatccagtttgcgagaactgtatactggatcgggaatatcatgatgagcaataaagcgcataacgagttctgcagataaccagcaaatccctagtgacccaaccaatagccaaattaataatgttggtgaataggccatgatggcgggtgtgacgaacgaaaagactgctgtaactgcccgaacaattgaatagctaataccggttacgcttgcacgaacatgtactggatataatgactgactccagattttgaataagggttcaccatgaagcatgttggcacagcagtaaacaaaatatgaaatggtgaaaatccaccaaacaccaccgaacactgctgagagaacaaatgataagatacacagaattaaaccgaccctagtcataatgtaacggtacttcgtgtcagcaaacttcatgtagatgccatagaggacaaatgcccccaagatgttggcaaagaatgcacacaaagtggaaaattgctggctgcgaccatcgacggtcaccaaaaagtagttcagaaatgatccccaggtgttagccggaatattccaaaacagataaaaaccagtcagcccaatcattggcacaaagtaccttggcatagcgatgagttttcggaaaggaattttttctgcggcaacttcttcctcagtagaagcccgtctttcaaccgggacaaccatttgagtctccagattatgaaacttcggtgaaagggcacggattccccaggttacgagcgcaaccagtgccagccaggcaaacaggattctggaactcatatagcccatgtcagctgtcaagaagcccaatccttgagaaagaacaattccgcccaaccaataaatttcggttgaagcaatcactttaccgtactgatcaggttctgttcgttccgaaataactgccaaggaagtcggtaagtcggcccctgaggcaaccccggcgataaacaaaccaaccacaatcattggcagatttggcgccaaggcgactaataatgttccaagggcaacgaataaaatatctagattgaagacggtgacccggccaaacttatcagaaagataacccccaaccgccgaccccaaggcaacagacaatgtgaccaatgtactgagtgcgccaacccaccacgcgttcaagccgaactgggttttccacattgccagcacaattccagtcgttaccaaaatacttgcgtcaagatatgaggcaatacttgcgttcatcgtcaacatccatccagatcttgatcgagacttcataaaatacctccattcttataatcaacaatatgtggaaccgctttcgtaaacgtttacaggtattagaatatgctcgggatgaccattcaacaacgtttcaatttattggttttttatgacatgcaaataaagccactcttcatccggatacagacatgtacgctggacctgcattcttgagacaaaaaacggaaccaatcaacgacaaatgtttgtcgttaattagttccgttttttaatcgatatttatttgagcgtcgccgcaatcagcagcatcatcggccgccttaattcatcacgcatctcttggctctctgccaacattttactggtgggagtcggttcaacgatttgatctaaattaaagcctcggttcagcaacgtgttcaaataggtggttaacgtccggtgatatttctcaactggataaccgagaaaatccgtggcccgttttgattcgtcaaagtagcgatctaccggccaatactttggtcggccatcatctccgaggatccattcctcgtgaccttctgcggtgaagatgggatgttcaacactgatgattaatttaccattgggaatcagtttagccttaatcaagtcaatcaatccggcataatccttgatatagtgaaccgccagcgaactgatcaccacgtcaaaactgccggcaagctgatccattgccatcatgtccaatacgtggtaatgaatttgagcttggtccgtcattgatttggctttttgaatcattttggtggatgcatcgattccaacgacttcactggcgccgtgatcagcggcgtatcggcagtgccaaccataaccacagcccaagtcgagcacgcgtttaccatgaaaatctgggaatagttttctcagttcatgccactcgccggctgcattcaggccatcctttgaccgattcatctggctgtacgcttgaaaaaatgctgcatcatcataaatatctgacatcgtcaatctcctacttatcgataaagttccggccgccgatcctcaaataccggcatgaaaccgcgagcatcgtcagtttctttggtgtcaatcgtgaatacttttaattgaggctgatcgtctaaagtcacaatttcatcccccatcggattataaatacccgaatggccgccaaacggattgtccggatcactgccgacccgattaacggcaaccacaaagctttggttttcaattgcccgagctgccagtaatcggcgccactgcgggattcgtgaagtcggccactcggcaggcacgaacagaatccgactatcgtccagactcaaagtccgcagccattccgggaaccgaatgtcgtagcagatcacactggcagcatcgatccccttgatttgaaaatgatcttcttcaaccccggatgccaaatactcatcttcatgcatcaacccaaataggtgaactttgtcgtaagttgtcagcagtttgccatcaggtccaaagatataagttgtattgtagaacgcaccatccttttcagttgagaccgaaccgccatgaatggtcatttgatacttcttggccaatttccctaataaagcctgcgtccgctggccgttcttatcggccacctgatctaaacgggtcaaatcgtacccggtattccacatttctggaaagacaacaatatccgcgctttgttcggcggattttcgaacatttggttcgatttgagcaaagtttttgtcgggatcaccgaatgtaatatccaattgtgccaatgcaattttaatcttcatgtgaccgtcccccctgcatttttgaaaattatacaacaaaaaagcacattcaccaatcactggcaatgcgctttgacgacgttacataattgcggtgattgcggcgatcaatccaaatatgacgccgggcacatcggccacaattaaaatccaatcccgctttggcttgacccaaccgtaggcaacccacaatgccgcgttaatcgaagcacagaaaggctgaataaatgacgtcggttggccgttcaaattttgcaggatctctcctatgtatgagatatacataatcatattggcgatggttgcgatatcgccaatgactttctcctcactgaatacatggttactctcgtgtagttgatgaccaccagggtgactcaactggttttgcacactaatccctccaatttctcttggttcagtgataccatactcaccaagagaatgctagacgttgtcgagattaaattgcacaattctcgtaatcagatcttcaggcaagggttggtcgaccggcagttggatggcgccgatacttgtcttgtagccttccaactgatctttaaagacattgatggcctttgggccgggataaatcccaatatgattcttaaaatttgcgaagtgaatgatgtttttgtggtaatgaaacgtcggcatcccatacgaaatcttttcatcatagcctgccggcatttgtttttggataatttcatacagttgcaaaagcttcttttgccttgctgctggttggttatcgatatattcccgtactaatttttccattgactcaaccccctcgtgaaaaattgttttgatctttatgattaaaatctgttgacatttacattataaggctctaatatacaaagcaacaattaattcgtccataaaaccgatgaagtggagatcaagatcattgtgcacgcaaagagagttgccgatgctgagagtgcaatcgaacgcagatgattaaatggaccactgagggttcttccgaaagttcgcgagtacggagaaacgtgttggcatacgtcagttgccggagggatgttagtcccttgctaagagtgattaattggggaacttaacagatgttttttatctaccctgattaattgaactaaggtggcaccgcggaataatccgtccttaacaatcaacttttgttatggacggattatttttttatctaaattgacggaggtcacacttatgaaaatggaaattaaacgatggcaaatcatagagtgaatttcaactaattgataactcgacacttactaggacagctcctccaagcaggagtctccttgtaagcacctcgcaagcaaatccccaaaacccgggaatttacttccgaggagacttacactccgactcctaaccgcttggatccgctcacttatatcaggaggaaaccactatgataaaacaagccattgaaaaagttgttaaccacgaagatcttacatttgacgaaagccaatccgttctcgatgaaattatgaacggtgaaacatccgaaattgaaactgccagcctcttaaccgcattaacagctaagaatccgaccatcgacgaaattgccggggctgcctcatccatgcgaaatcacgctttgaagttccccgaagccggtaacgtcttggaaatcgttgggactggcggcgacaaagccaacaccttcaacatttccaccaccagcgcaattgtcgttgccgctgccggaaccaaagttgccaaacacggtaaccgcgccgcatcatccaagagcggggccgccgacgtcttcgaggcactcggcttagacattaacgaagatccggccaccagtttccaaagcctacaggacaacaacctgtgcttcttatttgcccaggaataccacaaatccatgaagtacgttgcgcccgtccgcaaacaattagggattcgcacgatcttcaacatcctcggaccgctggccaatccagcccacccaaccagccaactgttaggcgtctacgatgaagacctgcttgaaccactggccaatgttttaaagaaattaggcgtcaaaaacgccatggtgatccacggtcgggatggtctcgatgagatgaccgtcgctgatgaaacggccgtcgttgaattatgggacggcaaattaaccaagtacgttttgacacctgaacaatttggcttcaaacgcgcagcccgaaaggatttggtcggcggtactcctgaagaaaatggccaaatcaccaaagacatcttagccggtaaaaaaggtcctaagcgagacattgttttactcaacgccggatcggcactgcaccttgcccacccagaattgacgattcaagaaggcattaacctcgctgccaagaccatcgacgagggcaaagcccaagccgagcttgaccgactgatcgccttctctgacaaacgcaaggacgtggttgcatgattttagatgatttagtaaccgcaacccacaaacgtttaaaaaagcacgaagctcaaacaccactcacagaattgaaaaatgaagtcgctcaaatgcctgccagtgtgaagcctgattttctggacgttttgaatgaatctggactccacgtgatcgccgaggtgaagaaagcctccccatctaaaggaacgatcgtcactgatttcccgtatctccaaattgctaaaagttatgacgcagcgggagcagatgccatttctgttctgacagaaccggattacttcaacggccacctcaactacctgaagaaaattagccagtcagtctccgcaccaacgcttcgaaagaatttcacgattgatccttacatgatttacgaagccaaagccaacggtgcctcgatcatccttctgattgttgccatcgtcgatgaccagcaattaagagcctaccgagaattggcagagcgcctgggcatgcaggccattgtggaagcctacacggcagatgaagtcacccgggcattgaaatccggcgccaagatcatcggcatcaataaccggaatctcaaagatttccaagtggattttgaaaacagtttgaaattacgggcaatgattccagaaggcatccccgtgatcgccgaaagcggcatccagacccaagcagatgttgaagccctggccgatgccggcttcaacggcatcctgatgggtgaaaccctcatgcgggccaacaacaagcaacaactgattaaagaattcaaagcagctaccgtcaaataaccttcaggaggtgtgtccatggttaaagtcaaaatttgcggtttgatggaaccggcagatattcaggccgtcaatgaagcgcaggctgacttcgcgggctttgtctttgcgaaaagccgccacgtcgtttccttagcaactgcgctggcactgcagacccatttaaatccaaacatccaaaaagtcggcgtcttcgttaatgaatcaatcgccgacatcttggccatttaccaagctggcgccatcgacatcgcccagctccacggcaaaagcacccctgaagagattgccgaattgcagcgcgccggactcaaagtcattcaagtcttcgaacgccaagccattgatccaaagtccaccgccgactatttgatggtcgatagcggtaaaggatccggccaatccttgaattggcaggcagtcccccacgttgatcgaacaatgatcctggctggcggattgacgcctgacaacatcagccaagccattcaaattgttcagccggatattgtcgacgtctcatcgggtgtcgaatccgacggcaaaaaagatcccaacaaaatcatgaattttatcaaaaatgcgaaagaggaatatgtcctatgaaaaatttaactgaagctcaaataaccaaacgaccaggaattttcgccgatacatacggcggccaatacatccctgaaaccttaatgactgaattggaaaaagtcgataaagcctttcacactttgaaagacgatcccgacttccaagccgaattacacgatttattaattaactatgccaaccggccatcactgctctattatgccaagaacatgaccgaagacctcggcggcgccaaaatctacctcaagcgtgaggacctcaaccataccggtgcccataagatcaacaacgttatcggccaagcattactcgccaaacatttgggcaagaagcgtctgatcgctgaaaccggtgccggccaacatggggttgccaccgcaaccatcgctgctttgttcgggatggactgtgaaattttcatgggtaaagaagatactgaccgccaaaaattaaacgtctaccgaatggagttgcttggtgcgaaggttcacccggtcaccactggctcgatggtcctcaaagatgccatcaacgccacactccaggaatgggctagtcgttccgaagacaccttttacgtcatgggatcggctgttggcccctacccatttccagaaatggttaaatatttccaaagcgtcatcagtaaagaatccaagcagcaacttaaagccaaagaaaacaccttgccagacatggttgtcgcttgtgttggcggcggcagtaacgctatcggcagtttcgccgattatatcgacgacccaagcgtcaaattagtcggcgtggaagctgccggtaaaggggttaacagtgatcagaccgcagccaccattgaacgcggctccgtcggcatcttccacggcatgaagtcattattcctgcaaaacgaagacggccagatcaacccagtgtattcaatttctgccggtttggattatcctggtgtcggtccggaacacgctgccctggctaaagaaggccgagcgcaatatgtcggcatcaccgatgatgaagctgtccaggcgtttgaatacatcgcccgacaagaaggcatcgttgccgcaattgaaagctgtcacgcagttgcttacgtcgaaaagattgccccaaccatgtctaaagatcagattatcgtctgcaccctgtcaggacgcggcgacaaagacgttgccagcattgccaaatacaaaggagtcgatattgatgagtaatttatccgccattttcaaaaatcataaagcatttattccgtttgtcgtggctgacgacccggattttgataccacagttgccaatatcgtcgctttggccgaaggcggtgccgacatcgttgaagtcggaattcccttctccgacccaatcgctgacggcggcgtgattcaggcggccgacctgcgggcatttgacgccggcgtccgtaccaagacggtctttgaaatcgttgaggctgcccgtaaacaaaccgatgtgccgattgtttttctcacttatttaaacatcgtcttcaagtatggttacgatgcattctgtaaaaagtgtcaggccctcggcgtttctggcttggtcattcccgacatgccctatgaaagccgcgatgacatcgttccaaccgctgataaatatggcatcgacatcatcccgctgattgcgccgacttccggccaccgagttgaaaagattgccaaggcagcgtctggattcatctacgtggtttcctcactgggcattaccggtgaacgaaatgaattcttcaatggtttgaaggatctggttgccgaaatcaaatcgtatactgacgttcctacggcaatcggctttggcgtccacacgccggagcaggccaagacgatggcggaaatcgcggacggcgtgattatcggtagtgcgattgttgacatcgttgccaagcagaaacaaaatgcccctgaagcagtaaaagaatttactcattcgattcgttcggctgttgatcaagctgaaactaaagaagccagcgtctaaaaaagtccccggtgcgaagaagcactcggggacttttttaaaatttacaaacaagctgacgtgattgttaccaaataaatccggtatctttaccattggactaatcaccttagttgtagagttaatcaaaaattggccaaaaaaataaccgcccataactttagccagtttgcggttatttaataactaaaaatgcgctgccgtcttaaacggttccacaataggaagtcctgttgaatcaggacttcctttttgtgatttcattttaacatggatacgagattatcgacaaaacaaatctcctgggacgaggtagccttttacggatttctgcgggacattaaaacaatattttgcccttcttgtgtaaattaagtctataatttattctttcgtagaagatctacaactcacttcccacatgctatactaaaataaatgaacaagtggaggctgatatcttgataaaaatcgctgtaatcttaggatctatccgcagtaaacttggtgaatccattttcaaatatttacaggccaactttcccgactctgatcaagtgacctacgattggatccggctggaagacttcccgctggaaccgtatcaccatgatgaaacgccattatccaatccgattaccggcttaaaggacaacgaacaaaagtggctcaaccgattgaaagccgatgatggcttcgtaatcatgacgcccgaatatgatcacgcaattcccggcgttttaaaaaatgccttggactatgtcggcccggaggtagatcacaaaccggtccagattgtctcgtattcctactatagtgacggtggtatgctggcagcggaatccttcgtggaaattttgcaaatgctcaaaatgatggtcctgccgacgccggttctgttgtggaatgccaatgataatttcacccaagcaggcgagctgatcaaagatgccgataacagtgaccattttgaagcccgactgaaagaagcttttcacgagattgccttttacacccaattactgcacgagcacccatttaaataaatcagaggtcagtcatgcgagccattttacccaacaaaactgaattcatcccccacgcccctcaaaatgagcacgagatcttcatggcgatgcgcacctatcccgacaacgtcaaagtctaccatccccacggcagtatcgacgccacttcggtcttttggcataacaagctacacccaaatgccttgaacttcgctgtgtatgtcgatcccaaggccaccgaacaggatgtcttgtttcaacgtgtctatgacgatattgaaaaattagcttggaaattcgatgacgaccgcatgatcacgcgtgactatgcccctcagcatcccttcaatcagtggttaacgacgaagcacttccagttggtgcaaactgccttgactgcaacagtggatttgggaaccctatcgctaaacacgccgattgcgtcagggacgctcaagacgttcgctgaagtatcatcgcagaattcactctaccaatccgtgctggaacgtagcatgcgcaaatacgcaggcaagccaacttttaatccggcgatcacgatgccattaccagattggtcagcactcatctcacaccgacaaatttcaacggccccatttgcgttaattcaagacgatcagctggtcgccttcagtttcctatatggccttggcgatcacttggttgaacttggccaaatgaatgcgactaatgctcaggcgctaaatgagttattgaaccgacagcttcagtggcttcaagacaactaccagaccctgactggtgaatttggaatgaccaaccggctggacatgaaaatttttcaaagtttgccgtttaaagatgttaacaagtacgaaacttatatgcgtttaacgtaaaacagactaaccctcgtagtgaaccccaatcccgtcggatctgaattcaccacaaaggttagtctgttttataatgctttaacaatgtatgaacggccaaacacggtcattgccttctgcaggagatttaaactgacttttaagctgccattttcaattttggcaagctggctttgttcaatgccaatctttctggccagctcaacttgagtcatccctgcttgacggcgttggtatttaatcgtgtaggcggcgtcagcttcagcaggaagctgaagaacttcattcaaaggcttattagcttgagctgctaaaattaagtcggcaagttctgaattcgtcaagcttcggccaattgcctgactgataaatgatagttctcggatgccaatcgtgccattgaccagttcagaaagcctcgaagcagcctgctaatagcagcggagtcagcccggtaattttcaataactgtgttcaaatgatccaaagtattgatcagttctgtcttggtcatgtcagacacctctccacggatagtacttttcaacgactaatttgctggcttgggtattgaaatcacgttttgtgaaagccaaaaataacttttttcatttaaaattataacagaatattccaaatttgaatattaaccagtcttattctgccttctcctcaccctttagatacgaagaaaagcaaaccactctctattgaaaatgcttataccgaaaatatttataaccaagcttatgatcaaacatcgtctccgataggcccgttcgattggccataaaaatataaatcccaagggctaccaggccaaagacgacgcagtacaggaatgccggaatcaaacggcttggcacgatcaattgatgagttccccaagtcagtgccatcacaatcacaaagaacagcaggttaaccaagacactgaccttcaatcgtccaaatgggacatggaactcatacataatttcgccataacttaacagacaaatgaagccaaaaccgatggcggtggaaatgattgccccaaatccttgaagcaaaatgaccaatggaatttggaacagcaatttggcaaccagtccgacaaccagataatacatggccttcttactgtagtgcagggcttgaagcagggttaagccgttaatggccagccccaacatcaaactttgcagaatgttggcagcaaggtacttcccgccaagcaaactgaacgagaagaaaatgccattggtttcgtaagacagcccacacagaatggtcacgatcggcagcaggacaaacatcagcatgttcacattttgaaagatcaaatctccgacgtcacctttcttggaggcctgactgtttgccaacagcggcagagtcgtctcggccaccgccagtgccagtgaaacgaccaccgtggtaatcttggttggattggcagaaaacagcgtgtagatgtactgggtatattcggccgaaaaatgctggacgccctgcataacctgtttgaagaataactgatcaatcaactgactgagggtaatcccggagccgacaatgacaaagggaatcgattcataggcaatcatcgtgaaaatcttcttgatactagtcaagtcaaacggcgcgctcttcttggccatttcagcgtagtgcgccgattgtttacgataatacagtcccaggtaaaggtaactagccaaagcgccgacaaaggccgccatgacacttaaatacaccgcctcgatataactgcggtgaaaaacgtcaatgaccagatacgttgataccagaataaagacaatccgcacgaactgttcccaaagctgagacacgccgtacggtttgaggtcttgattaccttggaaccagccacggacactgctcattgacggcaaaatcacaattgccggcaccagcacgcgaatcgaagtcaccgcactttgggtggaaaccacaggactattcttggcgattagcggcgcaatcacccaaaggactgccccacaaacaactccggagagaagcatgacaaaagagccaactttggcaagttgacgtgaattcaaaaatttattttgaccgttataaatcgcaacccgccgggcaattgcggagggaaatccggctgttcccagtgcgataaagaggccgtatggattataagaggcgttaaataaagccatggcaacgttcttgtgctcgggcgacccaatcatatacaaccacggaatcaggtagaggatccccagaacccgggaaaagatactgccaaatgaaagccagaaggatcctgacataatttttttgttcatggcgacatgcacactttctatatttcaatcataaccaacattataatatctttcgggaaagtttgctatcaaatcagaaacttggtttgcgatttttgagaacttgttgggatacagaaaaacagcggtctcgaaacaaaagttgattgcttttgttttggccgctgttggttttggtttgtttggttgcgaaatgtgctacccagcccagccctaatgtataaggcgaaaggcgaatcttcgttggtcaatctgtccttttttttatacattaggggcttcagaaacacgtttgttaggttcttatgtgctcccttcggcctttaaaatacgcttcgacgggccagaggctaacttctaaggggactttaattaaagttccaaacccaggaacttcaatcaaattccccttagaaaccgcctctaccggccctcgtcgcgctctctagtcttccgacacctgcgcgttcttttggatgtctggtgacagatcgtacatctttgctgcttctgttaacattgcgtgatatgaataggcgccatccttatatggttcgatgacaacctcgtcagcaatctttgaaaatggcttcttgccgtcttttacctgtgctgaatccagatctgcgacaattttcttctccacgtcggaataactgcccacaatctgcttagtctctaaactgccttgtatcgaaattttactcattagcaattcctcacaatcatcagttatatttagtgtcatcataccgccaaaagagaagcgatatctctaggtacatcataccaatttattgacccctatttcaccaaaaatcgtaaagaaagtcaaatttaatttttaatatcaacaaatgcttcccagcaaaaaaagcgcccaacaccagttaatcacttgtgtcaaacgcctgaatacaatttattgatgatagaagtagctggtctgggccttatgcgtatcacttgatttgtaatacatcttcaaagccgtcttgccgttatgcttcacgtgcttcaagtacacgggctgattctgtgacaacaaggtcaacttccagtaaccgtgactgttcgctttattggcaaccttgaacaagtaagacttgctcttagtttgtcgatattttttgatgttaacgtaataggttctggcgtctgctttttcagatgccttcgatgatccctgacggaatgaatatttggtcagccggtacttaaccggaacgttgccaaacaggtcatcgtgatacttgccgaaccaagtcccctgcagcgtcgtcggaacggcgtgggtcgtggtcttggcagcggccggctgcgcttcgatggcaatgatgccaactccaagcgtaacggcgaggaatgatagagttttgctaaatttcatcgaactgtcctttcatttgcaaaaaagcaattggaagtagtctaacagataattcaatttcatgcaaaattccaaactaggatacgacctattttgattatcctactaaattggcagttaccaaggaatacaaaaagtcagctgaaattgatcatcgtcaattccaactgacccacttttccatttggtccaacatcttcaactccttaaccgatattcaaaccatagtcgatcctcgtatggcttgagggctttttccagctggttgcggacgatattcacccgaagatccgcagccaaaatcagcccacaaatcaccagaatcgaaatctcaatggccactaagccccaattctgtttggcataaatcaccaaggcttgctgaagcgctagaatcgccaacatcgtcccggtcttattggccaaaaaataccaacgattaatcactcggaccttcttttcggtcaaagcccgtgcttcggctgataaattaggtgcgtttgccaatgccaatttgagcccttgggcgtccttcttcagcagctcagaaatatatgtcgaggtcttcccaacattttgcttcgcaaagaaatccccaaaccataaactaatcagaaaaaaacacaagaaaaaatctgctaacttcaacgtgtccgtcatcgtaatccctccgttctggcagtgactgcggttaacccccttgacaagttcaacgatggataggtaacttatcgttcaattactaatttacttatcctggtacgagcagtatataacgattagctgggctttggtaataatctgcttgtgagattcgggtcgtgtgtaaggcagccgaatgcaaataaatagacgacactctttgctggtttcacaaagaatatcgtctattggcttggcaggaagccaaaatattggcaatttcatttttcttcatctgacagccacttctccaactcgtctttgttagtaattcgtttacggggaagatctttgatagcctcagccaaattcttgtcagcttgaacgtctgccagtttcttttcgttggtcgtcacggtatcactcctagctcgtttactactaatattatagtatcatgtgaacaaaacacgaagccataaccttggtttagcggttgtttcctgcaacacataatcctcaagcttccacaaagtcccgacccatcttccgatcacagaccatcgcggcaacggccagtccaaatgagcagatgccaaagatcagccagctggcaaacacaccttggctccccaagttggcaatggttaagaaaaagccactgccaattggtgcgccaatcaagagcaccatgttaatgaaccccattgatgcccccaatcggtcatcgggaatcagtttgatgaacatggcagagacccgcggattgattttgcctaagaggtagccggtaatcaccgagaccaccgcaatcaagacgatggatattcccgttaggaatgtggctgccaaaaacaccagcatccaactgatgtaggctgccaatctgacaacggttgtgtttgccaaaaagtcatgctgaatgacggcgccaagaatcattcccaaggacatgctgatgctgaccagggcaacactgttcccgtagttgcccagccatagcgcctggttgtgcagcaacgacacattaatcaacccggtcatcccactggcgatcgtgttcatcacaaatgcgaaagccaaaataaccacgaccacctttttggacatcatgaaatgaccagtcacgatcaaacttttcagcaaggattgtttgggcgtggctgattttggctgattaacgctgagcttcggatcaattcccttaaaaattgaccgccgagtccaaatcacgattgccgcgattaggaaagtcgccgcattgatggcaccaaacagcccgtagttatggttcagccagacaatcgcaacggccccaacgccttgaaaaaccatctgcaaagtcgtttctgtcgccatttcaaatcccattgcatcgttcatttcttcattggggattaaaaaccggaagtacggtaattcaagactaccggaaaacgttcccagacaatcgctgatcacgttaatcgccaacacccccccaaagaccagcgtcgatcccggaaggccaatcatcagggctaacccaataaacaaggtaaactggttgactcgggcaaggaccatccactcgtacttatgatgggtattatcggcataatagccaaggaccacgttaatcatctctggtatgtaggttataaatgaagcaatactgacggcggccgttttgaatgacaagctgccagcataaatgataaacacaatattgaacaggctattgccaatcccgttgaaaatggcagcgttcatcaatgcccggtagcctttacttctaaaatatgagtgcatgtgatcccttctttctcaatacttgcttatacattatctgagaattacacttagagtattaaaattccactatatgagaattaatttggggtgatcagatgcaagaaccgggaagtttatatcgtcagttacgaaaagaacgccatttaacacttcagcaggtagctgacagtgaaaatagcgtttcatttattagtaaatttgaaaagggtagctcacagattagctttaatcgaatgatgcatctgctgggcaaaattaatttttcagtcgaggagttcctctatcttcaaggacgcgacaccatccagccaatcaagtcgaccttcatgtcacaccatccaatttatctgacagcgccgttcatgacgccgatggtcacgttactcaacagtctgacgggcgattcagcgacttcagcgacgttgccccggtcgatcgaacaatacgacgctaaaatccaccagcttgaagatgccggtaacctgaattggcaacactacttggcgattctctaccaaattcagaaagtcttaattcagaacgacgcctcacctgcgggggatccgaagaccgcctttaccaagctgcgccaactgagcaggcccatcgtgacttacctctataacattgacaattggagtacgtttgagatcttgctctttagtatcagccactttgccatgccgcttcaaaccgtccatcggttgagtaaaatcgccatcaagcgaaccaccagtacagaaaccttcccgatgatgccgcaaatgagattcgaactgctctttggcctattttcaacctacattaatttccgcgaaatgacttgggcaaaggaaaccctggactcaattgtcaaattacttgagaaggacactgatagcaactttgcgatcatgctgcggttttaccggggctggtacgattacatcgactcaaacggcagtgtcggtgaggaaatgatgaccgatgtcgctgtcatgttcaagctattaaatctgcgccaacccgccgacctgattagcaagatcattccacagattaagcgtaatcagcgggatccggaaaagtcgatgatctttctgttttgattcaaaatcaatcctcccatttactcaaatccggtcccccaggaatgacccgatcaaacgaagtcaccggatcatcgctcacttgaaagaagtgctgcttaatagcggtgaaatcagtattttgcttaaatgccggaatctggtagcactccttcgcgtaccgccaaagattggggaaatcgactaaccgttttttattcagcttgctcttgaaataaaacaccacatcaaagcgaattaaactgaccaccagccaaaagtccggcagggtaatgtggtcacccattaagaagcgcttgtcagcgagtcgccggtccaattgcgccaatcgatcaaaatactgattgaacaacatgtcgtattcggcttgggagtcaacgtcgctaatcttgcccggaatcgacgtgatgtcggtaataatgcgcgtgttcatggcgtcaatttcaggcttcaaatcatctggataaacgtccggcacattttgatcgaaatatgccttccaagatccgcccaattcaaacataatgtctcgtgaagaatcattgaccacaccaccagtcgttaaatcaatcaatgccggaaccgttggccttgccgagaaattcgggacggcctttttgtaattctgcgacaaccgcgtggtatggagcactggatcttcatcgttggcgttcttgccaaagaaccagtcgtcatcaatgccggggtgtcgcaatggatcggtcgcaaatttcgaaatcaccttattcaaaccagtgtaatcgatcatcatcgctgccggggtggcccagggacagaatttcgcccagacatagtgataacggttaggttcaaccggcagttcaccagtggaaaatttcttagtaaaacccgcgtcattcttttgtgtcggcaatgcacaagcatccccgcgattcacattttgactcattaacatcgctccaatctctcatatttgcctctactgtacacggatcggccttaaatgtcagtaagtaaaaacggaattactcgcaatgagcaattccgtttttgattaattattgataactatcataaagcttctcaaagttcacagtaccaagcccggttgcctggttatacaatttgccaggttggccgacatagtacaggttcgagttgttcgaatcactatccagcaccgtaaatggtgtcttctccggatcttgtgccagtgcgtaaatttgtggattccagaagcccattcgagttcccttaccactgttaataaccgcagtcacaccgttaaattggggtgcaacggcactggtaccacccaccgtatgccaaccagttgccttggtgtaaatctggtaaccagtgaagacgtcggcatcagctgaaacatcaggatagttccggccatattgcgtgccgctgaccagaaccgggttgggactcggctgcatcaaattcgaaaggtattgacgcgcgttaaaggtattaacgccggaaacaccctgctggtaagctggggtatcatacagcttactgatgccaccgccgccagcgctatataacatttgcagtgcactcaaattggtttggaataactttcggtgcttagcgtatgccttgtacatataatcggcaccccaagcccgttccttgtcgacggaaatcttcacaccaccgccaagattcttggtaaatggcaacgtggtaccgccagtcgaagtaacccatggattatctgatggaaaatcagcgtaagtactgtagttagggatgttaattgggccaaacgtgccgccaacccccatcccgtaagctccggtatcaccagaagcaacgaaggttgaaatgccttggagggccccctgagccatcaataagctcattgcctgaccatataccggtgtcagcagtttcttctgattcaaatagtgggtcacgtattcatttaagccccaactcattgaaagtgagctggccttattctcgtcgaatgccgttgcgtaggcattggtcaatccgacatcactccagttggcctggtaaacgcggacgttggcttgtggtgcaatcgcacccgattgttcaacatccaaggtggtttcaagctgaccagtaggaccagttgagctgtagacgggtgaagcaatcttcttgacgctcaagcgatttggtttcacgtcaagcccctcacccttccagaaggtttcagcgtcactcttcttaaagccggcaaaagtaatgatcccaacggtttgaccttgaccttgatagcccttgtcatacagtggctttagattgtagtgattgacaaatttacttggagcatccttcgggttcatcttacccttgggtgtcttactcttggccttgctggaaaccaggccgctgccgccctgattgaaggtggtaacccccaagaccgtcagcaccttgtcggccaagttggcaggcatcactggctttttggacgagaattgaaccggattggagtggtaggttgccgtcttcaggttagttgagaacgccttgttgacatccttggccttaccagtgaccttgatgatcagcccatttgaaaaggtgcttgatttgaggtgatatttactcaaaaacggcttaaattgaccggtcacactagctggctgaccaaattggtcacggaagtgctgcggcgtatagaaattcttgaagtcaggattacccggtgtgttaacggcgtatatctgattggtaatctgatcttcattctggggcttcaaaacaatgtccaactggacttgtttgttaggagacatggtcttcttagccatgagtttcttaaggatcttctgaatcccataaggatctttcccagcagctttcttctgtgaagctgcttgagtcattggtgctgcggacacaaataatgctaaactggccaaaccgaccagccaatgattgattgtcttcattcttcccaacctctttctaactttcaatatgatagtggtcgaagtacaccggttctgaataatcccccaatcatcaggactgcataatatatgtaaaaaggcgcaatctgcgaggcgccgaaaaacatctccaactattgcgagagtacacgtttcaagcaaatatgtcaagaatgttacagaatcattcggattgggtatttatacttatacacaaaaaagcatcctgaaagtcaatgagctttcaggatgcttctatagaactatagaatttaaattattttggatttgcagcagttaatgaaaggttgctccagaattcgttattgtcggcagcagcactataacccttaacacgcttattgacaggtgaccaattcaacgtgaagttatcaggggcataagcggcttcggtattcatatacttctgccatttcttatactgctttgtacgatagcttgaattccaagcttgattgttgttcaaactattcagcaactcagtattcttcttagttgcaaagtgacccatgttaaacggtgcatcaacaccatacatttgcgttggtgttggttcagaggaagttgaccatgcagcatcaaaaatatcaatcttattctgcttaggtttctgcaacgtcgaatagaaactattcatttccataggcttgcctccggtcattttcacattcagaccgagtttatgccattgttgcaaatcgttctggtaaatagattcggttgcagcggaactttgcataaccccgaagtaaatagttaacttcttaccattagggtctgtgcgccacttcccatgcttcttataacctgctttatcaagtaatgacttagctttcttcatattatattggaagccaggattcttagcatcataaacatccttaaatgcaggcggaatcaaagtgttggcacgccatgaaaccccattaccaaacttcttataaacttgatcctggtttaaagcatacatcattgcctgacgaagattcttattgcccatcttagaattcttgtccatgacattcagtcccgtcttggcattcatatgcccgacattaaagccaaagtatccatatgaaagagcggggcttccagcaatgccataatccttcagagccttaatcttagtatattgactggatggatgagcactgtttgcagcaatgaaatcaaatttttttgacttgaacgcagcaacaaagttattgctcgaaacaacttgaatcgtaatatgtttaatttgtggctttttgccataatagtacttgttaggtgaccaactggttgattcaccttgcactactttatccaacttgtaaggaccagtgaaaataggattcttccgtaccttgcttgatgccgcaagctttgaaattggaatgcctttaaagtattcatagggttcaacagtcgtccagacgaaggagtttcctgcatatttcatcgatggggacattctagaaaaatggataactgttgttcggccattttgaccgtctgggaaagtaatcccagagattgtctttgccttgccagcgtggtaagcggccatacctttaattgcagcaaaatctgacgagtattgttgtgatgtagtatctttgttcccaataatttcatatgggtattcaacatcttttgctgtaactttagcaccgtttgaccattttgcatctttacgaagagtaattgtaacggttttagcttttcgatcaatcttttgattagctaatccaccgtcaacaattttccaattctttccaacattccaaaggccatcaactgttccttgcgcattacctccaggattaaaggcatcagtgtcttcggcgttacttgccaaagtgggtgaagagatacccgtaaatggtgcatcattaacttcagcaaccttcaaagtactattatttcctgctgtagtcgccttaccagggccactatatgtagctgacattgaaacatgcttgccggcgcctgattcactgctcttaccattagagcaagcagcgagtgtcataactgacagcatcgcaattccggctgtgagccatttctttttgctcatgaaacatccctccaaatctatatttgagctacactaccaactaaatctcacctcaatatgcaaaaaccgcatcatctcctttaatgcccaatttttacttttgatcctgaccacgccgttgagcagcgttggtggttcgacgcatgacttggccaatataactgattgacagacacaaaacgataatctcaattgcggcaggcaaccaagtccaccaatactgagtgatattttcagggtcgttggcattggcaattaaggttcctagtgatggcgttcccattggcaggccaaagcccaagaatgacagcccagtttcaacaccaatattttcagcgaacgacaaagtcgtatcaacaatgatcaatgacgaaatgtttggcatgatttctctaaaaatgatcttaaaattactggtcccggaagtcttggaagcagcgacgtaatccttttgcgattcagctaacgttcgcgaacggatgagtcgtgaagttcccatccaatagaagatcgacaggatcaacgtcaacgtgatggcattgtaatgcggaataatcgtcacaatcacaataatcgtcatcagcattggaatgatcatcatgaagtcatagacacgctgcatggccaaatcaaccaggccgccgtaatacccggaaaccaggccccagcaaataccaaaagttgatgagatgatcgtcaaaccaatcgcgattgaaattgagttccgtgagccaacgattaattctttggcaatggatcggccaccggcatcggcacccagccagtaatccggggtgaagggcttattgtagtagcccatgatgttggtttccatcattttgggaacatcaatgaattctgaagcgataatcacaaacagaataaagaatactaataagaagagggaaaccatcgccggtttatcagccttgaactcaccccacatgattttaagccgtgacggggtggcttcttcattggcttccttggttaatttagcgaggtcctctttggaaatggtcgttgcgtcttcaatatctcgtttcatcttcagcaccccctactcaacccgaactcgtgggtcaacgatgctcaagacaatgtctgaaagcaaagttcccaacaagtttaggaagccatatagcagcaccaacgcggtaatgacggtgtaatcccggaagttgatggcgttcaagaataagaggcccataccaggataagagaagaccatttcagtaaagatcgacccacccagcaggccagtgatcgagtaaccggcaaaagcggcgattggcaatagtgagttacggaagatgtggtgacggtaaatgtccttcatcggcacccctttggaacgggcggtgcggacgtaatcggagtgcttggcatcaatgacttctgaacgcaggtactgaacgatgttgacagttccaaacaacgcccctaaaagcccgggcaaaatgatgtggtcgagccgggacaacaccgtcccgccaagtccgcttgcctgagcggaaaccgatccactggttgggaaccagttcaatgcgtaaccaaaaatccaaattccgataactaaaacaacgaagaatggaatcgacattgtgacatatgtatatacacgtaccaaagtgtcttgcagtttgccttcatgatgggcagcgtacatcccaagcggcagaccgatcccgtaagtcaaaaccattgtgaataatgcaagccataaagtattggcaccacgctgttgaatcaaatcaacaactggttcctggtactcataactcatccccagatcaccgtggaacaaatggacaacccagttccagtattgctggtaccaagggtcatacaatccgtggatttccattaagtggtgaatctgagcaggatcagctcgggggttaattgacccggtaaatggatcaccaggcattgccttggccagcaagaaaaccaaaatactcaaaataatcagttccggaatcataattaagacccggcgtaaaattgttttccacatcagacgtttacccccttgttctcagactgctgttcaaattccttagctaactcaggcggtaacgccaccgagtgagttggtgagactttgacgagtggaaacgccatgccgtcttgatcgtaataagttttctgctgctcttggtaaattttctcaatttctaaacgatgcttgcggtgctcctctcgatgattcacattggtttcgggaatcgcagccagcaagcgtttggtataaatgtgcattggattattgtagatatcatcccgggtcccaacctcaacgattcgcccccgtgtcatgatggcgatgttcttgcacatgtggcgaacaactcctaaatcatgggagatgaagagataggaaatcccaaactgacgttgaattttcttcatgaagttcagcacctgggcctgaacggaaaggtccagggcagacaccggttcgtctgcgataatcaactttggatgagtggcaactgctcttgcaacaccaattcgttgtcgctggccacctgaaaattggtggggatatttgtatagggcatcagcgtccaagccgacaatatccaacaattgaagaacccggagcttttcttcttccttatcaagatgttcaaaattgcgcagtggttccgcgatgacatcttcgattcgtttacggggatttagactcgaaagtgaatcttggaaaatcatttgcacgtcgcggttataatcgagtttgcgacgattttcacccttagtgacgtcttttcctttgtacataacggttccggcagttgccttttccaggccgatgatggctttggcggtcgttgatttaccggatccggattcgccaaccaggccataggtttcgccagcttcaatatcgaaggtgaccccgtcaaccgctttgacgttatcgacaacgcggttccagaagccgccgcggatcggataatgaacctttaggccgttaatttcaattagactcatgaccggcgccctcctttacttggtctgggaaataaaagtctttgtagcaggtgcagcggactaagtgattgtcgccaatgtcgtgcatggctggatgggcttcgtgagccgaggcgggaatccaaggaatccgcggtgcaaatcgatcgccatcctttggcatccgttgaagtgacggtaccatgcctttaatcacgtagagctcatcgttttcgttatctcgctgcggcatcgatctaagcagcgagcgggtataagggtgcttgggctcattaaagatttgagcggcagttccctgttcgacaatttggccggcatacatgacagcgacccggtcggctgtttcggcgacaaccccgagatcatgggtaattagaataatgccggcgtggttttctctttgaatatctcttaaaacgtcgagaatttgggcctgaatcgtcacatccaaagcggttgtcggttcgtcagcgatgattaagtcaggcttacaagcgattgcaatcgcaataataattcgctggcgcatgccaccggaaagttgatgtggaaactggtgcgcggttcgttcaggatcttcgatgccaacttggttgagcaattcaatcacccgggcatgacgctgcttttcggtcatcttggtgtgataaaccatgacttcttgaatctgatcttcgattcgttttaatgggttcagagctgacaagggatcctggaaaatcatgccaattttggctccccgaacctggttatagcccttctcatcaagtttcaataaatcggttccctcaaaatcgatttccccggaaatttgagtttcttccggatcatgcagccccataatggtggttgccaaagtactcttcccacaaccggactcccccacgattgcgagaatttcatcatgctttacttcaaggttgacgtttgaaacggcatcatagtattgaccattaatcttgaatgcggtgctgacatttttgatgctcaagaattggtcagaatttgtatcaaccacgagaatatctccttttggcaatgtatttatgtataaacattaaaaattaatgaacggtatgattgtttaattagaaaacattatattctcattgtattctcatttcaaaccatgttaagtgttttttgtaaatatttgatatcaacatttcgttaataaaggtaaaacgccgatataacagtattaaaggtgtttattaagattgtgcgttaatcaaaagaatcgtcattcttgcatattaaaagagcaatgacatcgattatcatcgctcttatcattctcattatctcacgagcttagcatccaataagcaaccaattagaggtgccaactcgtgccgctctgtaaaatcacttatctaccgccgtaaagcgttcattatgatgagccggatgctcaatctcatcgttaatcactttggccatcgtgccggcagtaatttccgatttgccttcagcgttggtcagcagatcatttcggcccagttcgtagtccgttgcatccccaggtttaaaagtggcactaggcgaaaccgccacccaattgacattactggtattagtgagcagctgatactctttgaactgctgacggggaatctcaatgaatgattcactattaggcagtttctccaacttttccacaaatcgatgaccattgccggtttccaagctgccggcgcctaaaataaagaacagccgcggcttgtcagcacccttggcaaattcgatcagtcgagcggtcaaatcaacgtgtcggtatgcgtgactcatgtcatgagtagcgtaggcgtcaaccaagacgtccaaatcttgaacatccacccgttgaatgtcaaatgcatcttttacaaccagcttgactgcgtctggcaggaggtcctttgccttctcagcgttgcgaacaaatcccgttacctcaaacccgcggttgactgcatcttgggtaatcgcactaccggccatgccagtggcgccgatgataccaacttttaatgtcatgttaaagcctccaataattttgcttcactattttcgattgtttcaaattaattatcgaccggctgagagagacggtcaaccatttggacggtgaacatggaacataaaagaaccgggcattccagcgataggaatactcggttcattaagttaaacgatgaaatcaacacagattgatttcctgattattttgtcaattcaactgccttacctgcaacatcaatcgtaatcggctcgccatcaattaacttgaagtgggaaccatcctgatcaacgtcgacttcaattaaacgatcacggaagacttgtctaaatgagtagtgtgaccatttcttcggcaggaatggtgcataatgcaacttgccgtcgcgaacccgcatgccggcaaagccttgaacaaccgcaatccagccaccggtcatggccgtaatgtgcaggccgtcaacggtatcgttattgtagttgtccaaatccagccgggcagttcgttcgtagagctcaaccgctttgtcttcatagtgaaggtcggctgccagtacggaataaatcgcaggtgacagacttgactcatggaccgtgtattgttcatagaaatcaaagttggacttcttttgttctggtgtgaaatcatcaatgaagtcccagattccttgaagcacgtcaccctgcttgatgtaaggtgaccgcaaaatcttgtcccatgaccagttctggttcaatggtaattgatctgcgggaatttctgaaaccggcttgaggtccttgtcgaggaagccgtcgtgttgaacaaagatgttgagatccttgtcataaggcagatacatattgtcgacaatgtcttgccaatgtttcttttcatcttcactgacatttaattgtttggcttgttcgggagaaacttccttgagaatttccaaggtgtattttaacgtccactgagccagcagattggtataccagttgttgtcaacgttgttctcatactcgtcgggaccagtcacaccatgaatcatgtaattctggttacgttgactgtagtgaacccgatcggcccagaaacgagaaatctcggtcaaaacttttgagccttcgttaaggacatacgacgtatcgccggtgtagcgggtgtaattatagatggcaaaggcaatatcaccatttcgatgaatttcttcaaaggtaatttcccattcgttatgacactcgatcccatcgaaagtcaccattgggaacaaggcgcccttcaacccctgttgcttggcgttatggtacgcaccgtctaattgcttgtaacgatacatcaagaggttgcgagttactttgggatcggtaatacctaagtaaacgggcactgcgaaagcttcggtatcccagtaggttgcaccaccgtatttctcaccagtgaagcctttcgggccaatgttcaagcgtgaatcttcgccataataggttgagaacagttggaataagttgaaccgaattccttgctgggcttcggtatccccatcaatgacgatatcggatttgttccagcgatcagcccagacctgctcgtgagccgtcagcaaatcatcgtatgattggccggcaacttggtcacttaattgatgcatggcatcggttaaagcggcttgagtgtcgtaatcccgtgaggtaacaacgattacacgtttttcaagttgagcggattcgttgggcgctaaagcaccggagaattcgttgacaacttctttttcgctgggttgagctactttttcagcagtcaagtcagtgacattgcgcatttccattcccgaagtgaaccgcggcgtcccaaatggattaggggtcgtttcagctaagacgttacctgagtcagttccctgctcagttgagagaacttcccagaaacgttcgtcgtagttggcatcctcattcttaacgtcgccatcgatcgctgaatccatcacgaggtccactttatttgagccaacgttttgaacagtgacccgctgaacggacagttcctgctgggcaacactcaagaaacgttcaaatttgacagctactttggcatcacccttggttaccgtaaatgagcgggttagcaaagcctttttcatatcaaggttgagctcaaaatcgctgaactggtctttcgccaggtcaataacttcgccattaatcttaacgtgcattttaataaaattaacggcgttgacaactttgccgaagtaatcgggataaccgttcttccaccagccaacccgggtcttgtccggataccagacaccaccgaggtaaatcccgttgagggtgtcaccgctgtagtcttcttcgaagaagccacgcatccccatgtatccatttcccaagctggtcatggattcctggagtcgtttgtcttccgagtcaaagtcgtgggtcacaatattccaaggagcgacttcaaaagttcttttcataagttaacgtcctttctaagctttgtaagtttctttaatgaatccaactgaggcagcacctagggccatgatgatcccggctaacaggaacatgttaggctgtgcgttacccaataatgggaataagccgaagctggcaagtgaggcaacaatttgtggcaggcagattgaaccgttgaacagtccaagataagtccccatatgttcaccagacaaggcgttggtaaccatggttaatgggtaggtgttcatcgatgcccaagccattccaactaagataaatgacagaatcaaaatgtattgagtgtgaatgaagaatacggagataaatccaactgcaccaagggccaaactgattgagtagcccaacttgtggtgattgtttggcattttggccaagacatatgaccagataaccgcagcgattgattgaacggcagctaaaacaccgtaccagttaccggcagcttgatagcctgcagaagcggcattggtagtgttccaaacgttgctggcaatcgcaccggctgagtaggtccagagatattgaaaggcaatccagcagaagaattgaactaaggtaacggtccaaaagactttaggcgcctttttcagcaatgaccaccagttaccaccggttgagttggcttcttcagtaattccatgatatttggcgtaagtcttaggatcatattcatgaaccttgaaaatcgtcagcaaacttgtcagtaacagaattgcggcaccaacatagaaggaaatgacaactgattgtggaacgacacccttttcagccgtgttggcaacaccaaatgcggtaaagatgaatgggaaaatagctgcgatcaccgcaccaccgtttgacaagaagctttgaatcccgtatgcgtaactcttttggtcatcattgaccatatcgccgaccatcatcttgaatggctgcatggcgatgttagacgaaacatccaacagggcaacggttaccgccccaaatactaaggccgtaatcgatgcgtacccgaaaccaaaactccccgagttaggcagcagacacatgacgatgatggcaattaacgttcccagagccaggtaaggcaggcggcggccgccaagcttaggtgcccaggttcgatctgaatagtaaccaataatcggttgaacgattaaacccgcaagtggtggcaaaataaagaaccaacccaacttgttggggtctgccccaattgtttggaagatccggctcatctgtgagctctgcagggtaaaggcaatctgcacacccaagaagccaaagttaatcatccaaatggtactggcaggaagtttaggcaaaccagacttcttggttgcagctgcgctactttgttcatccatttcatattcctccaattcaaaatatcatattaataatagcgtttacattttgtattattgcacgttttaatcaatgttgcaaacggttgcatgaaattaattgagcatttttaaaatcggatcggcgaaaatagactggtaccggttactttggcgagatgtcaatcgtcataaaaatttcttgtggcattttgatacctactacttttagatttgtatttatgagagaaaaaaagttttttgacttttttcactgatatataacggctgtggtctagacctcatgtgcaatatgaaaataagacgtgtaaaactgcgctaacctttcattgcacttcaatcaaaaatgttttatattgaacaagcattcacaagtaacttgatggacacaatttcataaggtggtgagatttacatgttgttaggtagtgttgaagccggtggtacaaagtttgtatgtgctgttggtaacgaagattatcgcatcttggatcggacacaatttccaacgactacgccaaaagagaccttgcaaaagactgttgattatttcaagcagttcaaggatctcaaggcaatctcaatttcttcctttggaccaattgagctccgtaagaactcgcctaagtatgggtacattacaaataccccgaaaaaaggctgggccaatacggattttgtaggtcgaattaaagaagattttgatatcccgattagttggacaaccgatgttaacgggtccgcttatggcgaatacgtcatggcaacgctgttcaacgaaaagatcaattcgctggtctattacacgattggtaccggagttggtgctggtgcaattatcaacggtaacttcgttggcgacatcggacatcctgaaatgggacatgttcgattgaaacgtcatccagacgacctgaatttcaaggggatctgtccttaccatggcgattgtttggaaggtttggtttccggaccaactttcgaaccaagaaccggtaagaaaggccaagatgttccgctttcagaccacacatgggatatcatggcattctacgtagcccaagccgcaattcaagtcactttgatgatgcgtccggccaagattgtctttggcggtggcgttgtcagcgaaggattcttgaagaaggttcgcgagcagtttaatgagttgatgaataactacgttgacgttggcgatctcgataaatacatcgtgatgccattggtcaaggataatggttcagcaaccgtcggggattttgctttagctttgaaagaatacaacaagtaacaacttatttttttgggaagttccacaaacgtttgcggaacgaatgaattttaaaaggagattttttatattatgaaagcactcgtatttactggaaaacaacacatggaaattcaagacattgacaagccagaagtaaagcctaacgaagttcgtgttgacactgcttacgctggtgtttgtggaaccgaccacgccctttataacggccttccaggttcagccgatgctgttcctccaatcgtctttggtcatgaaaactcaggtgtcatttcagaagttggctcagatgttgacggcttcaaagttggcgatcgagtaactgttgaccctaacatctattgtggcaaatgtttctactgccacactggtcgtccagaactttgtgacaacctctcagccgttggtgtaactcgtaatggtggccttgaagaatcctttactgctcctgccacaaacgtttaccctattcctgataacgtttcattgaaagatgcagccgttatcgaacccatctcatgtgccgttcatggtatcgacttgcttaagttaacaccataccaaaaagctttagttatcggtgatggcttcatgggtcaattattcgctcaaattctccagtcttatggtgtccaccaagttgatttggccggaattatcgacgaaaaattggatttgaaccgtgaaaaattaggtgttaccaacacttacaacactactcgtgaccagattccttcagattacgatgttgttattgaagccgttggattaccacaaactcaacaacaagctgttgaagctactcgtaagggtgctcaagtattgatgtttggtgttggtaagccagatgctcatttcgaaatgaacacttacgaaatttaccaaaagcaattaactgttcaaggttcattcatcaaccctaacgcattcgaagactcaatcgcccttctccaaagcggtgacttgaacgttgatgccatcatcagcaacgtcttcgacttggacgaagttgaaccattcttgcaaggaaagactaaaggcgtttcaaaggcagttgttaaagtaggtgactagtttgaaaaataatgaggaaaccgccagccaagttctaaatggccggacgatctcgatgtctaaatccattacgtttttcatcatttctttggtgattaactccgccggaaacgtgcttaccttggttaccagcgcccaaatccacccttcctacttgggatcggcttattggaccgccgctgaagccaacctggcagttgcgtttggctggaatctattttggacattcttaattcttggggtcgtgatcacaattttaaatgccatcctggttggacactgggattggcggcgcgcacttggaaatctgatcttcatggttcccttctcagcgttgattcaagtattcgaagacttcttccttggtaagtacccggcattgtttggtggttttccaccagccaagacgccattcatgattggattttatatcctcttgaacttcttgggtgtcgcaatgatcggaactgccatctccatttatcagcgagtcaacctggtactgcaccccgccgatgacttgatgcagattctgcgtttcaagtattttaaaggaaatgccaacacagcgatgtgggcttcatacattccaccaacactgatggcaatcttggccttcgcaatcacccgtcaattcaccaacttgggaatcggaaccatctttgcgttcttattccaaggcggaattaccgggatcgcggatactaaggtcttccctcacctgaagcatcaagctttggacgtgggaaaagattagagcgcgacgatagcatctgttgcatctgaacacatctcaacacccaatcgcacgaacatttgcccaaggtgctttattaaaaatcaaccctggtttttactggaagttccttgggcttgggtttcctcgtaaatgaacgcggttacacaattaatatgaaagaggcaattaaacatggcaattaaagatgatattacaggaattcaacacgttggaattccatccgttgatttggacaaaacaatcgcattttatgaatcactgggctttgaacaagccggcttattccataacggtgagaaccgttgcgcattcatgcgtttcggcaacttaaccattgaaacttgggaaggcgatccaactgctcgtaaagctggtgcgatcaaccatatttcactcaatacaccagatgttgaaaaagctttcgctgacgccaaggctcagggattacgcatggtgaatgatgaaattcaatccattccttcattctgggataaggggattaaattcttcaacatccttggccctaacgaagaaacaatcgagttctgccaaatcctgtaggacagagtgtgacgagcaacgggtgatgcggtgtgtaagacctaaaagattgaaatcctggtcttggatttaaagctttttggtcttacacgttagcattagttgcctcagaacacgtttcagctagataacaggggttaacaaacggggctagggcaaatgctttttgtcctagccccatttgtgttttataattaaatcattgaatgattccaagaagggaagtactaataatatggctcatatttcttttgatggctcaaaattatcaaagttcgttcacgacaacgagctcggtgaaatgcaagcattggtgaatgctgcggacgatgaattacgcaaaggcactggtgccggcagcgatttccgtgactggctgactctgccaaaggattacgataaagaagaatttgcccgcatccaagcagctgctaaaaagattcagtcagactccaaagtcttggttgtcatcgggatcggtggttcatacctgggcgctaagatggccgttgacttcttgaatgacactttcttcaattatttgccagatgaccagcgcaaattcccacaagtgatgtttgccggtaattcattgagctcctcatacgtttatgatctaattaacttgatcggcgaccgtgacttctcagtgaacgtcatctctaaatcaggtacgaccactgaaccttcaattgcatttcgaatcttcaaggaacgtctcatcgccaaatatggtgaagaaggcgctaaagaacgaatttacgctacaactgacaaagctcacggtgctttacgcaaagaagctgacgccagtggctatgaaacctttatcatccccgatggtatcggtggccgttactcagtcttgagcccagttggcctgctgccaatcgctgtttccggtgctgacatcgaacagttgatgaaaggtgccgcagatgcttctgatgaatacagcgatcctgatttgaccaagaatgaggcttaccagtacgctgcctaccgaaacatcttgtaccgaaaaggcttcaccactgaattattggaaaactacgaaccaaatatgacctacttcgccgaatggtggaaacagctcatgggcgagtccgaaggtaaagaccaaaagggaatttacccatcatctgccaacttcacaactgacctgcattccctaggtcaatacatccaagaaggcttgcgaaacctcatggagacggttatcaagttggataagccaaaccacgacgttgacatccctaaagaaaaggacaacttggatggtctgggctatcttgaaggccgcacaatggactatgccaacaccgaagccttccatgcggtagtccttgcccacacagatggtaacgtgccgaacatggccgttcacatcccggacgaaacaccatacacattgggatatttgatctacttcttcgaggttgcggttgccatttccggttacttaaacggcatcaacccattcaatcaaccaggtgttgaagcatacaaacagaacatgtttgcattacttggcaaacctggatttgaagaaaaaggtaaggaacttaagaagcgcatctaacttcacttaattagaaaacaaacccgctcgctgacatcattgatgttaacgggcgggttttcatttgaacatatatttattcaaaagattgggccccgttgttatggattagcgcttcggtaagactaattctgtcatcttcattaactgcttaatgggttatttcaggaatcagcttacatgcattttatgctcttgattaatttggaacaactagaggttaaatggcggtaccctggcgcatcattggcgtcacgttggcgctcgattcggctcaaatgacgatatgctataagcgtcaaatcgatttgatacctcaaccgctgatttaatgccggagttaaattagccaacaaaaataaacttaaagaaagaagattttaattatggatggaaaatattcaggtacaggagcacatttggaatataaagtaagtctcgatcgaaagactgaggcaatgcaaacattttatgttaaagaaactaaggataccgctggcacagttactaaaagggatatctatgcactacaacgaagtggaaatgatgattatctcagtcattgtgaactaaacagtaacacgggggtctatgagcaagtggacacaatggagctagttaactttggacatggtcaattgttacaatacttccagcataacggcaatgactatttttgggtaggaacctatgctagccaagatgctacacagccatttccatggtcacaacagattggacggattcaatataaaccaggaactagcttagactacaaacaaaccacccgcttaaccgggcttagatatgctcgtaaggataagcccgcatttaaacatgcggttcgggttgaaggggctctctctagcaaaagagataaattgttaattctagtaattgatgatagctcacctcaccgcggacactttgttttgtatgataacgaagcccttaatacagttttagacggagtagagggaagtacaaacccatcaatttcttgtaatgatgggaaagtcattaaggctgcattaaaggattttgttagcgataaagtagtttcattatcctacgactcatctattgaaggagttgaactggctgataatgatgctgtgtacttttcctccagtgccgaaggtaaaaatcgaattggtattagccgatcagcctggggatcgtcatcttcaatccacaaactggttgacaattcaaattggactagtggagaaacggagggcgaagcaattcagttgcttggagacaatgttttaattggaattacacagtatcccaacggtgatggtactggcagtccaagaaataatagtatctatcgcttccccaagtcagcatttaactaacaatgacgatgtgagaactatgtaagctacaaataaaggcacagaactagcaaatatactagttctgtgcctttatttgtcaaaattcataacggcttggctaaattaatgctccaaacaaaatcttcccacgcacgattaggattaggagcataaattccaatcacataatcgctcatagcatcacgcttgttagctgggtaaccctcagaaatgagtgtctgcttaatcttggtaattcgttgctgatttgtccatttgtgaatagaaggccctaaataattagctactttttgtaaattaattcgatctgtaaaatactgcttaaaaggatcattatcgtttgcatccggatcagcagtgaactgaccaagatttgataatttaattgagagtttagtattgggaaaaaggtttaaaactgtgcgagctaaaacttgagatggtgattttttaatataatttaaataatcttgatcactagtaaagcctactgtacttagataatttaattttcgataatttcgattgtaccccttcgctaggtatccctgccagatccgtccataccgtgaagaattacccttaggcgtcacaataaaagcggcatagtattgacttcttttaccattgtgaagataggtttgtttagttaatgcagaaagccaagaattaggaaaatcctttaaattataaaggactttagtgtgcttcttgttccaaacatagacattgtggtgtttgtattgattctttacatgaagaacaccattattattataagaattaagcgtcttataggtattaacatgttgcgtgtcaattattcgataacggtcttgagcgtgggctatttgaccagtcagaccaaacaaaacaagtatcaagctacacattaacaataatagtcgtaaatgtctgttcatagatatcctccttaataccatcagtatactccgagtctgcgcccaataaaaagctaaacaattttaataatgcctggaaaacactgatgaaactgaattaattttaattggaattcgagctggttctcataatcggttatttccgatcagagcagctcgacgaagtgctaaaaagcgatgataagtagggttactttaaatcaaatagtacaaaaacagcccctagtcgttacttactagcgattaggggctgttttaataggttttccaaggggcgataactcttatcgaccctttttaaatttaaatatgcagcttgctttagtccagactaaacttagtaactcacaaaactcacaccatctcatgtccaacaatgatgtgatcaattacctgctcatcctctgctggtttatccagtaatagcttaactgccgactgccccatttcatctggatgaatatcaacagaatggaaatgctgatcggtgagttcacttggtagtgaattgttgtaaccaagaacttcgacgtttttattaggattaatcattttgaaacggtggtacatttgcagaccactgtaatcatcaatggcgacgattccatccatctgcggattgtcgcgaatgaattgatcttctaattcatcattctcttgagttgacagcacgacaggcgatttgccggcctgcttcatcgctgccaggtaacccttgcgccgatcgatttcatacggccaaccgttatgggtttggacaaaaattggattctggcactgatagtgatcaattaagtagttggtgccgtcaaatccggcctggacgttatcgttatcgacatacagccaatcttgtccggctgccggtttaccaattgtcacaaaatcaacgttttctttttgcagcatttcgataaccgggtcattttggtgggagtacagcaggataaaatgtttgatttgggcgcgggtaatcattgatttaacattctcgattacctgctcagtactgtcgccaatcgcgattgataggacgtagttgcgactgttgagctgcgcgttaatcccccgcaaaataccaacgtaaaaaatattgtcgacaacccggttattaactgggaagacgacgccgacggtattggcttcacgattggtcagattcttagcgttatagttgggctgataccccatcaaatccgccgttttcttgacgctgcggcgagtcttgagactgatgcgtttattatcattgagtgcccgtgacacagtggaaaccgataagcccagccgtctggcaatgtctcggattgtaaccatttgaattgcctcccctctactaaattttaccctttttgaagttgcgatcttgttaaacttttgtatcaattattaatattgaacgctactactagattttgacagtattatgtgataatttcaacgtatgaggtgattatggaaatgaaaaagcacagatcattagctgccatcttggcggttgttgcaagctttgcactaattttggctggctgcagcagttcttcaaataagagttccaacaacaattctaataaggccagcatgcaaaacgagactcaagataaatccgctaagcaactgttaacatcaagcgataatctttggtacatgaatggttcgattaattacaacagtaaatcaggcattgatgcttacaaattcaattcaaagaaccataccgtgaccatttacagtgtcaacaagatgcacaagacctacagtgaagctaagcaggcaaatgatctggacaaacagggaacgctgaagtacaccttcaagaatgactcggctgacaaaccggtgatttacatgaagggtaaactttcagatatcccaatgcatcagacaatttcagtgaaaaatactgtgagcggcaagaaccatcaatcaaaactggcagtgaccggctacaaggtcgttcgaaacctggataacgatccggctccccaagtttgggtaacgccaaaagactaattaattttaccagaagagacaatggcagaatcacttttgccgttgtttttttgtatcctgcataagcctcaaaaggagcgtgttaccagcccacgggccttttttcgctgttaaacagtcagttatggtaggataaaaccattcaacttgatcaaagaaggtattcgaacatgaagggcaacaagctattacgacggtcaatcagaacgttttttcagaactggggggcttacgtcagtttagtcattgtgattaatttattgttgggcatcgttgttgtgccaatcatgcagtatatgactggtctgattctcgaagtgaaccggattccctacttatcgtacacgaatgcggtctggcttttgacccaacgaccactggcggtgatggaactgttcattttgctgctggttatctttgcgatggtcttttggcagttcgcgtttctgctgtctgggattagcaacatcgccctcaagcaaaatttgagtctctggggcgtttttaaaattgccatccatgacatgcgtggattgcgactgggcagcttcctgttctttattggctattttattttagttctgccattttcagttgcctacttgaactcgccattgctttcaaaagcgaccatccccgtctttatcttggacgatttggaaaagaatccgttgattgcagccctgctcacagtcctgggcattgccgtcttttacttgggaattcgactgatccaagtcctgccgatgatgattattcaccatcaaaagggactggaagccgccaaaaacagctggcagttgaccagccacaatacctggcagtatctctggcggatcttcgtactgggaatcatcagtttcgcgtcaacgaccttggtatcgtatttgctttaccttttccagacttatctggatgcccagtcaaaaatgattggctttgttggtgccgtcaccaacatgggcctgttgaccgtctggcagcgaattgtcgcctcgtttagtgtggttgtcttcatgctgatcttgttaatggtcttggatgagtccaaatggcattcaacggcggctgtggtccgtttacctcggaagcgacggattggtcggcgggccatgggagcccttctgattggcctgtttttggtcggagacgtggcctttaatgctgtctatctccaaggagcgctgctgaccaagccaatcacgatttcccaccgtggcgtggatgacggtaacggtgttcaaaatacaattccggcactgaacaaaaccagcaaagaaaagcctgattacgttgaaatggacctccacgaaacccgcgatcaccaattcgtggtcatgcacgatgaaaatttatggaatttggctggggtgaataaagatccttatcaattgaccctctcccaaatgaccaagatgaaagttcatgagaacggccacactgcgcacattgccagctttaatcagtatttgcgggctgctgaacacgatcaccaaaagctattggttgaaattaaaactactcatcacgatagtccaaacatgctgcagctatttattaaacgttacgaaaaccgcctgctacgggatcacgatcggatccattcactggattatcatgtgatcagcggcttaaagaagcaggctcctaaattatttgtcagctatattttgccgtacaacttctcgttcccccaaaccagggccaatgcttacaccatggaagaaaccacgttgaacgaaacctttgtcaacgaggcgcatttccaccaccaacaagtgtatgcctggacggtcgatgacgaagacgacatgacccgaatgctattcttgaacgttgacgggattattactgacaacttaactgagctgaaatcaaccatcaactctacgtttgatcatccaagttatgctcagcggctgttgatttactcgaatgaattgcaggatgaagaaaattagttatccaggacatcaaaaagggaatcccagctgggattccctttttgataacctaatattcttctaaatcaatttaggcaacgtctaatttgcatcaagccattcagcttcaaccttacgccaaggagtcccaagctggcagctccactggtgcttgcttcaataaggccttttgatcatctgaaaggtattttttgtggaccacgacttcgtagacgtagtcgtccatccaatcgtcactcatggtgaagtagcccttctcaccattcttgtcaccccaggaattttcaactttccatttggtgggggtctcaccatccagatcaaccccggtaaaggtcattgcgtgcgacacttcggcttgatgatattgcagccgggctgccttgtccatctccaagtcgacatcgaacaatttcgtgtagcgatacaagtgactgtccaggtagcctttcttacggtccatttgttcgaggacatcgttgccaaaccagaccgtttcgccatccttgagctgagcaatggtagcggccttcaaaacatccatcggcagatttaaaaaggcaatctgctttccgccgacaacgttgttttgacttggcagtgaatataattggttgtaatctttttccggcgaattggctaacaccacataatcatccaaatcgacaccgaagtattgatcataaaattgttgaggggttagaccggagacccgatgatactttttgtcatcgtcgcgataggcaaaatcaacggttgccggtggttcaccgaatgaataggccgtgattcggtagacttcactcagcatttgtttgcgagcggcactgatcgcctcatcgctcttttcatccttgaccatcgaccgcagtttggcagcgtcaatccgcagttttcggttcataaccgtgtcaaaagcaccggtattctcaacgttcgccgtttccggaaaatcactgaccggcatcacaccatatttttggaccaatgccgctgccatcgcccattggccgccatcgtcgccagggaagctcaaataattttcaacttcccggtcattagccggccgactggcggtcgctaaaattcggtcatagaagatgttggcgcgctcaattttatcccagaagaataggtacttttgtgaaaggttgaagtccttcaccttatatttggcagcaaactggtgccgtaaagtattcaccaaagaaaacagccagcagcgaccgctttgcttttggttggtcaccgaaccggtctggaggtccactgaaaatactggattcaatcgtacttggacatccggatcctgagctgcttggttgatgccgttttgttcgattattttcgacagcacatcactcttaggtgcgttcttgaaatcactgtggagtgctgaaaaatcttgctccgttaaaacactattcttatcagtcattcagacatccctcctatgtaattgtgtcatattgtaaatcttttcttggttggtcgcaatgcggcatctgtcacttgctcaacataaacgcggtgtggaagattcctgtcactgagtcgcagtccgccggccctgcctgccgtagtggcttggatttcgagcctgtagtctcgaaataccaagatgctgtaatcgcgactttcagtcgcttcaacagcatggacactactgctggcaatgccggcggactgcgactcggctattttgaggatgcaatttaaccaaacaaacttggcagcttaaacactatttacccgcaacggcatcactgaattaatacaatttcggccaaaacaaaattccaattctcttttccaacaccgcttaaagctgtaaaacaaaaaagtctacaggataatctgcagacccaaatgaggattacctactgtgttagatacgcttcttaagccgtggcgtcaccaaataagcaattaaggcaccgactgctccttgaatcaagttggtgccaatcccaatatagccggcataaatgttatacagaaccgagtctgccacaaagtagccgattaccataatgacgatcccgactgaaacagcgattagtttggtccactttcgatcggtatttttaccagcgatcaagccgacaatcaagccttctgcgccgtggacaatcagtgaaaaccacatgtattggccatagccggagatcaggtccaataagaaaccactggcaccaccgacgactccgccgactctgggtcccagtaacagcgcgctgataaagattccagcgtcacacagattaatattgccatgggtcattggaattgggatgataaagaagcggctgatcgcaaccgtgacggcgataaacatcgccgttaaaaccaccttgaaaatatcactgctaaccttgccgcctacacttttacgatccattactgacttcctcccaatacataatcttctttatttgcttcagtaaaatcatacttggcccgacttccgccaatcaattttggccgtgaagaaaggcagaccacattcgccgcaccgacacggcgattggtcatgcggactggaatctgaacgtatttaacgtgcatcccaatctcggttcccccgatgtcgataccaccaaatgccgtgatgtgctccacttcaaccgggtcatccattcgttcataggcagcgacttgagtaccgccaccggcatgcattgccggaaccaccgagacaatttctaaattgttgcgctcggcaaccttccgttcaaccaagagggcccggttgatgtgctcacagccctgaatggcaacgtgaatattgcgcggaattaaaaattcttccaaagtcgacacaacggctcgaccgacgtccaatctggaattggtccccttccagtcaccagaaatttcactggtactgcagccaaccacaaaaatgccattttccgggaatgtcacccgctcaaaatattcagttaagacagccgacaaatcacgcttgattgtttgtaaatccatcttttacacttcttcccctgtttgtcctaacgtaaacttcgccacattgtacaatgacctggtcaaattcaacccaaatttccgttggtgttgcggtgtgcggctggtcaggctcactgcatcgtacaccccaataactgccttttgaaccgctgtatcaaaatccaagttaaagttcaaatacccaactagcagtgctgaaaatagatccccggtgccataaaaatgaccgccgattaaaggcgagccggcccatttaagttggtcgcccttgacatagacacagccaatcccgccgtcacggtggactccggtgacaatcaccttggctttggagtgggtcgcttcacgataatcggtaacagcttgatgaattcggtcatcactggcattaactcggaggcgttctccactgagcagccccaattcggtaatgtttggggtaataatcgtggcaattgatgcgagtcgcttaatggcatccaagtagccaggttcaaaaccggcatacattttaccctgatcacccaaaactggatcaatcagcaggtcaggcaagctaactcccgagagatagtcgtacaaaaggttagctgtactaatcttaccaacgtaaccaacgattcctgaattaaattgaagatcatccaacccattccagtgaccagttgcccgcctgataaaagaatcagtattctgagtagtaggctttccaaaaccttccgtttgagttgaaagcagttctgtcggcaaggttgccgtttgcagtccaaacgctgaaaatacagcgattgcggcagtagccgaaagcctgccgaccgcggaaaaatcttctgcaattaatacactcggcttgataatgatcatccttccaatcatgtttgttacaaatattgtaccccattgccaaactaaaagttaataccttacacattaaatgtaacattctctcatcaaaagtattttaagtataccaagaattccagaagaaacaatagacagtttgctgttaatgtcagcgactctggtatagtagagctgtaaatagtttggaatatagaaaagagtgatcaccatgaactttgccactaaaaccggcatcacaaccctggcgcaaacttttatcatgggctcaattgatgcctacacctttcaaaattttgacggttcatttgtcagtgcgcaaaccggaaacctggttattttcgcttacgaactcgccaccaagggttggagtacggcttacattcgcgtaccggtattactaggattcctactcggagcattcatctcacaagcctttaaacacattcaactggcaagcgatcgtcggttcaacgtcctcttgctgttcagtatcatcctattgggaattctggcagtggcggcagcattccacctgtcgatgctcaacatgttattcagcctcggcctcttctcgggttatgaactgaccgtcttcaacaagattggcacgaccagtgtgaacaacggcatcatgactgggaatttgaaaaattttgcaaataattcctatgaagccatctttagccacgatcgtgaagctttgctcaaagccggccgctttttgagtgggattatcatgtttattctcggcattatcttcagtgcctacctgcttcatgctgccgggccaaaagtctttggggccgcgttgatgatcaatctggttttgttgatcatcccattatttagttggcgaaatcgtcaacgggatgaaacaatgagttgacattcacttatatttgagttagattaaaaagcaattagaaaacttacgaattatcaagctatgaggagaagagtaaccactcagatcgatttcagaaagcctggcagatgagagcaggtatcgaaatgacggtgaagatgagctccaaagggcattaagccgttcacgcggattaatcggtaggaaccgttaacttcccgggtatcataggtaccgttgaggcgttgtctgcaaaggcaacgtgaataagggtggtaacacgagcattcgtcccttgattgtcaatttgacagtcaggggacgagtgctttttttcgtaagtgaaacttttacaattacaggaggattctcacatgacaaatatagcaattacaactaaatttccatatcggtacgacgttgtcggcagtttattaagaacacaggcgttaaaagacgcccacgccaaatatcatgccggccaaatcagtacagctgacctacaaaaagttcaacacgctgaaacaaaaaagattgttgacaagcaagttgagcttggcctcaaagacattaccgacggtgaatttaaccgcagctggtggcacctggactttctttggggattaaccggcgtccaaaaatacgactatcacaagagttacaagtttcacggcagtaagacccgcactgataacgctgaattgtcaggcaaagtcgccttcaaccctgatcatcccttctttgacagcttcaagtttctccaatcaattaccccggatggtgtgacccccaagcaaaccatcccgtcgccaacgatgcttttccgcgacaatcgcagtgataattggtcaaagttctatgatacctgggatcaatatttgactgatgtcgccaaggtctaccatgaaacgattttgcacttctatgaactcggtgcccgctacgttcaattagatgacaccacttgggcatttctaatcagcaagttaaacgaaactgccgatgacgcggctgcccatgcgaaatacgtcaaattagccgaagattctgtcaaagtcattaaccagctgctgactggtttgccgaacgacctgaccgtgacgactcacatttgtcgtggcaactttaagtctaccttcttattttccgggggttatgacgatgtcgccgagtatctgggccagctcaattacgacggcttgttcctggaatatgacagtgagcaggcaggtgatttttcaccacttggcaagatttggaatggcgataaaaacaaacgaattgtccttggcttgatcacttccaaatcacctgaattagaagacaaagacgcggtcatcaaccggatccatcaagcaagcggccaggtcccattggaaaacttggcactctcaacgcaatgtggctttgcctcaaccgagaaaggcaacaagctcaccgaacagcagcagtgggccaaacttaaactggtcagagatatcgcccgagaagtttgggatgtcgactagctgttagccaatcgaaaagaggcgtcgttatggataaaattagggaaaaatactcgcaagcaactaatcgccatgttacccactggttcggattggccattggcttggttggtggtctcaccatcgacgcactatttagttttcggaccgggacgtttttcacttttatcggaattgttctgggaatgagtgggttgctggattttaaacagcgttaatcgtttcaaaccgtctgccagctgccatctaactggcagatttttatgagttgcctcaggatcgaaaaacaggtacacttttattaaaagatttctcataattatgtaaaggaatgatgaccatgctcgcctggatcagcctacaacacagcatcgtagagatcaatgcacttcagtgatgaatgacacttggcacatccccaaacggacaggtttcaaataaaccgtttggctgtgcttatcttaactggagtgcaactaatgacaattaaatatcccagtactattttcaaaggctacgcgtacactttcttttcctttttcgggatcacctcactttgggtgatttacctgcagatgcaggggctcaatctagtggaaatcggtttatgtgaaagcatcttccacattgccagctttgttttcgaagtgccatcgggggtattggcggatcgcttttcctatcgtttctcacttttctggggccgaattgcctcgattgtctcggcaaccctcatgctggtagcccacagtttctggctgtttgccctgagcttcgtgctgggtgcgctgtcgtataatctccaatcagggacaatcgacgcgctcatgtatgattcattggtggcccctcaacagacccaacgattccccaatgttatcagcaatctcaacgtggtgattgaattttcgcaaacggccggtgtcgtgattgccggatttttggtccactggcatttcgaattgacctacgtcgcggcaattctgatcggcattttcggtctgataaccgttctattaatgaaggaaccgactgttcccaaatcaattgatctgccaaaacagacggtcaaatcaatcatcgtcatggcctatcggacgttgaaaactaatcgtcaactccgcggtctgatgattttccaagcggtttttgatgggatttgtaccagctattacttctatttccaatccttaatggaaacgcaccatttctctggcttcatgatctccttgttgatggtgatttctgctggaatgaacatcgtcggcatcaaattgaccccgtggattcagaaacgcttggcaaagccggcgttggtaagtggcgtaagtgcaacgttggtcgggctactgctgctcacatggattaactggatttcaacgttaacgatactgtttttgttttcccaactgctggcgtcattaattgagccgatcttcagcagctactacaatgaaatgattgcttcacagcaacgggcaactttactgagtgttgccagcgttctgttttcagcttcaatgatctttttattcccactaatgggctggctggttcagattcaaacattttcgtttggctttggcgtgattggctgcttgatgttggtattgctgttgttaagtcaaaagtattttaagtctgcaaaataaaaagaggtcggttttaaagtcccaggatgggattttgaaaccaaccttttttcattttaatgtttaaagcaatgcttcacccttatcgtgatcaactagccgttcactttctggcatcatgctaccaccggttgcccagacaatgtgggtggcattagcggtgttgaaggcgggcacttcggtaattgcccgttcgattgcggtaaagccagctgcagctgatggttcgactgtgatattctcagtatccatcagctgggcttcatatttgtaaatcgttggatcttcgaaagtaacgctgccaaataatagcgtccgcatcatcttgccggcaatgcgcgatggccggccaactgccaaaccgtcagccgcagtcttcccgtccaagccgatatcaaagaccgaaattgcattattcaactttgtcatcatccccaacgtcacggatggaacgtgagttggctcacagaagattgcgtggatgtatggcccaataatggtcttgagtccaaacgtcacgccactgggactaccgccaacaccagcaggaagatagacaatcactggatgatcgcgatcaactttgattccctgctgcttaaattggtgctgcagacgaacggccgctaccgcataaccaatgaataagtcagctgatccctcatcatcgataaaatgaatgctcggatcttctgctgctgcctgtcgagcttgtggaatgactgaggaaaaatcagtatccaactcgaccacattaaccccattggcccgaagtttggccttcttccaagctttggcatcccgtgacatataaacggtcgtcttgaagccaaaggttgaagcggcgatgcccacacttaacgctaaattcccggtggaggcaaccatcaccccgtattgggcaaataactgcttatattccggcgatcttaaaatcgcatagttatcagtttctttgagatccccttttgtcatggcgacatgttcggcgaattttaatacttcatagattccaccgcgtgacttgatcgatccggagataggtaattcactgtcggcttttaaatagagactccctgccagcgcagtggcctgggcctgattccaagccgacttcattttggtcagctcgattaatggtgattcaatcaccccatgcatccgagcagtctctgggaaagcagcttcaataaatggtgcaaagcgatcccaacgggccactgcgtcaaaaatatcagcttttgaaaatggcagttctgcaggctggccataatcaggattcttccaaaaaattggtgtttcattcatcaggtctttaacctgtgggtatttaacttccaatgattgtgtattgtccatatcgatgatcccctaaaaaatatttactgctattgtattctgaaattaaggcaacacaatgctgccacatcaacctttaccaagctttaatcatggttgcaggcagatgtcactttccgaagcgtttgtcggcgacatccccatgacagcttactcgttgacctgattggtacttggtgcattgtgcttaataacatccggtaccttaaatttcttcacttggttcacatttgaataggtactggtgacctcctcggtaatcgacttctttgatgatttatcctgatactgcatataaatatgggtattagttggtagataagtcttcttattcaatgtgtatttgtaaataaatttggtaattgtgacctttttcaagacattcttggtactctcgctgttatttgcttcagccaaaataagcttcttggcaaccatcgaccctagcttgccatggccattatatgagaggacatcggttgtctggttctttgtaagcttcagatgtttcttcagatactgcatggctttaaccgcagcgcttccggagacctgtcgacgaacacttttaatcagtgggctctttttaggcaggcgttgtttggaccagctattatcagcatgaatgtagacagtccggccatcaatgaagtaatcataatttttaaccaaaccagtggcattattcagtttggcttgaacaatcattggatcaaggtggaacttggcagtaaatttgccagtggatgtttttttattttgcgtatttttattaaccagcacaacattgccgctcttaatgccatgagcggccttctgtgcgtgattgacaatggtaacagtatcagagggtttattagtcgattgctttgatgaacagccagccaggacgatgcccatgaccgcaactgctgcaataattacttttttcatcagatactccttattcgcatttaagtcaggttaaacattgaccacaagaccacgtaggctccggtcacaaccagcagcgacagccagtgggccttcagcactcttttgacggatttgaaccacttcgagaaatagtaaactgagcggttcttctgaaccacattgataatctgaaaggcagtcattgtggcgcaatatatcaagacgatgtaagaaattacaaataacagatccatggcaattccccgccaatttccggttaacacaaccatcaagaactgccagagatacgatccaagcataccaaaataaaagaaactgggaatgacaatggcaattctggtgggaaaaattgtgatcaccacataagcggccaacaacaaaattccccgcagcagcccttgaagtaggcggtgatcattgatggaaaagctgacggctaacggctggtatttgaaaatggcggacgccaaaaagaaggcaatcgctccccaaacaataaaaatcaggtaagtcgagcgccgcagcttcaggttttctagcaaataaccacctccttgtggattgaattaattagtcagtgacaattgtgagttggggtttccatgttttggccgttgtatcgggaacgatgtagacaccataatggccattaacggaattggtggtcaagctggtgacgtgactggcaaccacagcggcataatacttcaaggcatcggttgtccgatatttggaccaataagaataatagccggtcattgttttgggatcgacctgtttaacagtaaaattagttgttttcgcatttgtcacgccagctttggccgcggcatctctggtactgatatcctcagtggcaagcagcttggccatcgtgtctaatttggtatccgcggtactttgggttaatttggcagctacttgatccatcaccaacttttgaaattggctttgcggcaaacttgccaaagttgtcaaattatcctcaaagaattgaagtgatcgctgagctgagagcgaaataaccccctttgcggcagaagcatgacgtgagggattaacgcctttagtcagatagttgcgccaaatgaagccatcagccccattcccatagttgtaaacttcgtagtagacatggcttgaattgccatgctgcatcacaacactatttttaacgtaccaagttgtattcgggtaatttttgaggttatgcagccgtttggtgtgggtcgcattccacaaataaactgcacttttggatttagcgtgataggccacggccgtgctgcgactcaacacttttgtccatatgtaacttgaatcggtgttcgttgcggtcgaattggcagtagccgcggtggtatttcctgaaactggaaagcttgtagcggtgaagacgccaaacgtcaccagggcaagcaataataactttttcatgatgttttcctcctatgtaccagccaattaattatatcagaaaaatggggtgaaatatcgcctttagtgaatatatacgcaagagagtggggcgcgaggcgttttgatcccagaatttaagccaatcaacgagttattcccgttcttggaataactcgttgattggcttaaacggccgggatcagccgattgccgcacgtttattctggataatagtggggctggggctcaaagagtctagcattagacctgataggaactgagatacaactagcaaacagtgttgtctcaaactacttttattctaatttatttttggtatgacaatccccgccgcagacgtttccaaaaactggtgtcgtcggtctgtaaaatcaagccttcatagatttgaccaatgtaccaagtcaaaaggccgatactgatgaccagaatcgccagtgaaatgctaatttccaacccactcgcgttgtcattgataattctcatgggcatgaaatacgacgagaagaatggcacatacgacaaaatttttgaaatcagcgcgtctgaattgctttgaaacggcatcgtcaagaagaaggcaatcatactcagatagatggcaggctgagcagctttcggggcatcttctgctttggcaaccagtgcaccactaaatgccgagatgatcgtgtaaatgatcacgcctaagaagacaaatagcaggttgattcccagcatgtttttaatcacatcattgaccagtgtctggttgtccgaaatgagttgcttgatgttgtccagatgcatggcaatctggaaaaagccgtaaccaccaacaatatagacaatgatctgggtcaggataacgccaaagacaccgataatcttgccgacaaagtacttcgaggctttggtactggagaaaataatctccatgactttagtgcccttctcggaagcaatttcttgggcggtcacagaagagtaagtgatcaaaatcatatagatcatgaagactaatacccaaaatgaaatgattttggccaggttggcaccgccatggttggtttgaattttttgtttgaaagccggctgaactgccagtgatttggtttgtttggcactcaactttgcgttcgccaggttaagctgttgctgagactgggcaagaaagacgttgattttggttctcatcccgccgcctagagaatcacttgaatgatagacaccactgacttttgtcttgtccgccgataacaccaggtagccagctagattattattgccgacacttttcttagcggctgcagtggtagtgacgctggctttcacgtcatcccgattggctttgataaattgttttcggagtgccggttgatcagaaatgacggcaattcgctgttgatctgaactggaagtcgcactggtgtagccgatgcctaaagaaattgccaacaaaatgaacggggagagcaccaagacgatgaagctccaagacttaacttggcggagataggtttccatggcaacaattaaggttttattcatgagagatccccgctttcattctgaaaatttcatcaagtgttggtggctgctgactaaattcttcgatgtatttaccgtcagtgagcttctcaaagacttcaggtcccttactgggatcatccaatcgcaacaagaaccgagaaccgcgaatattttggactttaacgacatgtgggagctggttcagctgttcttcagtccaatcggtcgtgacataaatttccgatttgccaaactgatcgcgaacttcgctgatggtgccgttcaagaccacttcacctgtccgcagcatgaccagccggtcgcaaactgcctcaacatttgccatatcatggctggagaagataattgctgcgccttgatcacgggcttccagaattgcccttttcaacaaatcagcatttaccgggtccaggccgctaaagggctcatccaagataatcaactttgggtgatggatcagggtcacaatcagttgcactttctgctggtttccctttgagagatccttaatcttatcggttttcttacctttaaccgcaaactttttcagccagtcgtcaatttgtgggcgaatttcttttgcaggtttccccttcaatcgtgctaaatagacaatctgctgctcaatggttagtttgggcatcaagctgcgttcttcaggcaggtagccaatcgcatcaaaatcagcctctttgatgggctgactattccagcggatctggccatcgtacttgaggaagttcaggatgctgtgaaaggtggtcgatttgccagagccgttttggccgattaatccggtgatctggttgtcgggaacatcaaaactaatgtcgtccaatgcagtcagactgccaaattgtttgtggagatgattgatcgtgagcatgcgaatgcctcccatttcttttgagcttatcataccataatcgtctggcggattttacggaaaacatttgatgtcaatggatttgtacataaaaagcaggatcgcaaacttgcaatcctgctcagaatcattttaattatcgatactgtttcattggtttgacaaagtgccaactgcgctgatggtacgcttgatcccagaattcccattccagttcgcagctcttcaagaattcttctttgaccacatccagatgatgttgatcgtagtgttccgcttcacggtcaatcaaagcaaataactggggtaaaatgctgtcactgtcatcttccatgtcagcgtaaaaatcaatccatggtttaaaaacattgtcgtcggtattcttaccctgcttcacaaaccggtttgcgatttccaggtaagtccatggacacggggtcatggccgcaacaacatcaattaagtcgccagttcgcgcagcacgatacatgtgttcgttgtacaagtacgtgccgggagcttgcggttcgtgctgcagggtttcgtattcgacccctgccacgttgcagaagttgtgatgcggatgaatttcactattcaaaataaagtcaatttgtttggcaaagatggccatatccgctctggtttgcgatttttgaatggcatcggcgtacactttaatgaacgcattcagatagttgtagtcctgaccaacataaaaggtcagcgcctcttttggtaaatccccattgccgattccttcaacaaatggatgttgatagatctcgtgtaaaattggctgtccagctgcgactaattcttcagaaaatttcatgagtcagtgctccttaaagcaaaattttcaaacagaacgcgaccggacttggcacttttcgaactcattattccacttccctacgttggtattaaccaaatcaggttcaaagggattggcaagtcgccatctcagcacaaggcacccctagtgatcttatttgaatacccaaagtttaccatattttgaaggatattttacgattttcttcgtatatgatacgctgaaagcaacaattttctgaggattgggggaattttaatataaggagagttgtttcatgaaattcaattggaagatcgcactcatcagtttttccccatacatccctttgatcgtcatttatttgttaatccacttatacgtcgcaaatgatgttgtcgctttgctattcactttaggtgttttttcagccggatatatttttgttcattataagtatgccaagactttcttcagtaaccatcctgaacttgatctacaaaactttgaattcaacacagtcgcaaacgttgttttggcactgtggatcatcgtcatggttggcctcataattctcaggctttatccacaaagtccagaaggctatctattggcatttgatttattctactccgtcattaacggcttcaaatcctacaggagagctgcaaaatgacatttaactggaaatacgctctattcaccaatgcaccaatgttcctcacgctgatcatctacctcggaatgactgcattacgcattgatccgatctggctaattcttgtcgtcgttgtagtctggctcgcatggtatacctatgccagttgaaaagtctactctcggcatcctgaatttaattaccataactatcagcgcggtacaacttcaattgtcatcatcacaatttcgacgattggttttctgttcttactcttaaagcttcaactaatagccaacatcgcgctctttatcacttggttggccgtctcaaacttcttggtagatgggttcgccaagtataagggcctaccataatgacccgacaatttcaaaaaccggcgttgtaaatctcaaacaagatttacggcgccggctagtttatactcatcttatattaggcgttcttcacagcaaacatcggcaaagtattcaaaaatacacagtcatcccgactagttgcccgtccctcagccaaaatagaacaacgttgaacaacattggcacccactttcttcaacaagtgttctgccgaagccagtgagccgcctgtactgatcacatcatccacaatgatcacccgtttgcctcgaagctgttctgcgtcacacccatccaaaaccagctgttgatgatagtcagtggtaatcgaacgcatcccaatcgcaattggattgcgcatataggccttaacacttttgcgcaagacaaaataacgtgggtgatgggtaatcatgctcagttcttgagccaatgggatccctttactctccaaggtcaccagataatcaaacggaatgttaatccgcttggccaactcctgagcggcataacgggttaactcagcatcccccaataagacgaaggaggcaatcgccgccgtgtctgtgatcgggataatcggtaatgtccgcttcagtttgccaattgttaattcatattccttctgcatcttgatcctccagattatataagatagaaagaaagcatcaaaaacgactaatatgtgtgaaaatcgaggcttttcacagccacaactgttaacgaaatttttatttttatgttttttgttcgtctatgtatatgataatactctattttatcctttttatccacatatgatagtccagacacgaattttgcagcaaaaatgtcaaaatgtcactttcagctcacaatccgtcacctaagacgacacattatgtggtctattttgggaatcatccacaagatacccccatatatagccaaaatgggtctcaatcaatccaactatttgtcactcccaaaaccacccttagtgtgattcaaatttttttgaagctcaccaatccgcgagtccacgcgattatgcagggtacaagcaaatctgccgaatacacaatatattgattctgaaaccggttagatatactatatatagtatcagttcgagcaattcaaacgaaatgagaatataatgtacatatgggaggaatcattatgcaagcaatgaaactttcatcagtttcactatctgatgaatttataaaacaagttaaagaagaagttacgcctcactggggagaattaggctgggttacctacaagcggacttatgcccgttggctgcccgaaaagggccgtactgaaaactgggacgaaaccgttaaacgggtggttgaaggaaacatcaaccttgatcctcgtcttcatgaagacaacgttgatccccaagttgttgatgacttaaccgaagaagccaagaagctctacaagctgatctatggcctttcagctactccatcaggccgtaacctttggatctctggtaccagctatcaggatcgtaacggcgacgccttgaacaactgttggttcatcgcggttcgaccacaatcatatggtcacagccatattttgccagagtatctccaaccagacactcctgccgtttcgatgccttactcatttatgtttgaccaattgatgaagggcggcggcgttggtttttctgtcactaaagacaatattcataagattcctctagttgataagaaaatcgacttgaaagtaatcatcgacaaggatagcaagtcataccaggattctcttgatatgggagcaactgacaaggatgaatggttgaagaatcattcaatcaaagacgttcgttactatcgtctgccagatacccgcgaaggttgggtggttgccaatgcgcacttgattgatatgcacttcaatggcactaacgccgatggtaagactgacttagttctggatatgagcgacatccgtgaaaaaggtgctaagatcaagggctttggcggaactgcttcaggtccaatgccattaattgaaatgttaattgatattaacagtctgctcaattcacgcgttggccgtcatttgtcatcggttgatgccactgatattggcaacttgatcggaaagactgtcgttgccggcaatgtccgtcgttcagccgaattggctttaggctcagctgacgatgaagattttattacgatgaagcaggataaagacaagctctaccatcaccgttgggcatcaaacaacagtgtggcagttgattcagaattcgacaactacgggccggttgctgattcaatccaacacaatggcgaaccaggaattgttaacttggagctttccaagaactacggccgtaagatcgatggtctgcaaaaagacatcgacgccaatgttgaaggaaccaacccctgtggtgaaatttctttagcaaatggtgagccatgtaacttgtttgaggtcttcccttacgttgccagtcaacaaggttgggatcttgatgaagccttcactttgggaactcgtttctcaaagcgggttactttcagcaattacgactgggaagtttcccgaaacgtcattgaaaataaccgtcggatcgggatttcaatgtcaggaattcaggattggattttggctaaatttggtaaccgagttgttaccggttatgaagatgctaaagatcctgaaactggcgaagctatcaagaagccaatttacgatccacgagttgttaaagaagttgatggcttgtacaaagccgttgtccgcgctgacaaagattactctgatacacttggatgcaaaccttccatcaagcacaccactgttaagccatcaggaacggttgccaaattagccggcgtttctgaaggcatgcacttccactatgctggttacttgatccaacggattcgtttccaagattcagatccactactgccagctttgaaggcttgcggctatcacgttgaaccagatgtttacacgaagagcaccatggttgccgaattcccaatccgcgcttcccacgctgacagcgagaacttcgcttcagccggaaacgtttcgattgcagaacaattcgcaacccaagccttcctgcagacttactggtcagacaacgccgttagttgtaccgttactttccaaccagatgaaggcgaccaaattgccccattgatgagacaataccgcttcaccaccaagtcaacttcattgttgccatacgttggtaatgagttcaaacaagctcctaaggaaccaattgacgagaagacttatgaagacaaagtaatggaaatccacggcgatgtcgcaacggtctttgcaaagcaaaacgataaccatgataagaagggtatcgaactggttgaccaaaccgattgtgctggcggagcatgcccagtgaaatagagtgcgagtcgcagtgtcagttgcgtccgagcacgtttcaactaggcaactgctaaattaatgcgttcaaccttggcccctcggtcccccgccgatcggccaagccctaaaacagatcattcccacggagaggccagggcaattaacttgctgctggcctctttcattacatacatcatggaggtatcacaatgttaaaaatctacaccaaagtcggcgatcacggtaaaaccaagcaggtaaccggaaaaatggtgccgaagtacgacctgcaaatcgaggcattaggggcactggatgaactggattcatggcttggctatgtaatctcagtcctgtcccccaagagtgcttcactggcaccgaccatccaaacaatccagcgaaacctgtatgaattacaggcagatatcaccgttaaacgtcatcacaacattacctttgacgacaccaaaaagctggaagcagaaattgatgaaattatggccaaattgcctgccatcaaagccttcattctccctggcggcaatcaagccggggcgtcgctccaatatgcccgagctctggcaagacgcgctgaaagaatggtcgttgagttaaacgacaagcagcaaccgctcaatgatgaaatctttgagtatctcaaccgtttatcagattacttattcgcccttgcacgttatgccaattacctggaaggctacgacgagattaaaagtaaatattagttgggaaaaggcgaatcggaaaccagttactgaattggtttccgattcgcctttttaatttgtcattagaggttctccattacacgtggatcgtatgttccgtcgtctgaccagtaattaattttagcgtgtcatcaagggattgcttgaccatattcttaacggcaatgtcggtgtaaaaagccacatggggcgttaagaaaacattgtccatggccttcaacttggtatattccttgaggggaatgtcgccatcaaacgactgattaaaaatctccgtctcattttcaatgacatcgataccggctccggcaatctgatgattttgcagagcatcaatcagtgcgtctgtattgacgatgggaccgcgggaacagttgatgaaaaacgcggagggtttcatttgtgcaaattgggttttgtcgatcatatggtaattctcatcactcatgtaggtatgcatcgtgatgaggtcggcgtttttaaaaatgtcttccttggaagtatatgtaaccagatctcgaaatgcggcgttttcgtgaatgtcatttcccaatattcgggcaccaaagcgtttaaaaatcttggcaaccgtgctgccgatgcggccaaccccaatgatgccaatcgtcatttccgacaactcccttgagcgcaaaccttcaacaatgtagtcattcttggccattcgtgattgaaattgtgggatatgacggaccaaatttaaggcatgggtcaatgtcatttcagcgaccgcttctggtgaataggaaggaacattggtaatggtcaggccattttcttttgcccatttcagattacaagaatcaacccctgccgacctcaatgagagctgagtgatgccaaaatcacggagtttgcgatataaatccggtgtttcgctgagcatgctgcgttgacggtaatcaatgccgtcataccctttagcaagatcgacagtatcgtcgtgtaattccacgtcattgaaatcaacctgaacatctggatgctccgccgcccattcgagcacaaactctttttcgtatcctaaaatgttgtatgccaaaatctttttcatcacgccaccgtcctcattgtgttatattataaaatgattagaatttggatataatatacctcataaagccggtggtgtcaaaatcatttcaatggctggccgtcatctcacaatcccaaggcgtctctgatcatcgtcaaaatatgctgttggtcgtttccaaaaacggtcgattgtcgataggccagaccaatcttgaagactggctgggcctcatcggtcaatcttaaagcgaccacattgggattattaatcttgacggcttgggtcaacaggctgacaccaatgccgtcagcaaccatattgacgatgctttgtgcctcactggatctgaaaatcacctgcggccgaatgtgattttgttgggcaagggtgtgaaagacccgatcgtgaacaaaattatttttaaacaaaataaacgattccttctttaactggttgaaagaaacttcagtgagtttggccaaggggctgtccttggcaacgagaatcgaaaacggctgctgatcaaattcatcaacgatcagctctgaatcagtcacatcatccacgtaccccaaaaatgaaacgtccaattgaccgcttttcagatcccggagcgcagacagcgacccttcttcgacagtttgaatgtgattaagatctgataccggcagctgctttgcgaccatcggaaagtaattagtctcaataatcggcggcattccaatcaccaactgctggcggtgactattttcaatctcccggactgcgagtcggtaatgatacaaaatttcatttgcatgaactaacagttgctcccccgcagtcgtcagggtaattgcctggtgtgggtttcccctgactaagagttggctgccaaatgcggcttcaagccgtttaatcgcagcagaaattgtcggctggctgaccgaatagtcttgggcaactttggaaaaattcttttcggttgatagagaaacataatactttaaatcattcatattcattttgaggtccgctttctaaaggatattcttgttaactattataaatcataatagaccacgtgcacattgactatataaagttgaacagactattctaaaggaaatgatcaagaaagaggcaattagatgacacaatcaattttgaatgacccatttaaaaataagggaacggccttcacagaaactgaacgtcaacagttaggtttggtcgggatgttgccgccaatggttcaaacactggatcagcaggctgagcaagtatatcagcagtaccagtccaaatcatccgctttagagaagcgggtgttcttaatgagtattttcaatgaaaatcgcgtcctattcttcaagacattctcacaacacgtcgctgaattcatgccgatcgtttacgacccgacaattgcgactacggttgaacattacagtgaactcttcgttcaacctcaaaatgccgcatttctgtcaattgacgatccagattcaatcgaagaaagcctcaagaatgctgcaaatggtcgcgacattcggctgctttgtgtgactgacggcgaaggtatcctaggtatcggcgactggggcacccaaggtgttgatattaccgtcggcaaactgatggtctacaccgccgctgcaggaatcgaccccagtcaagttctgccggtcgttatcgatgccggtaccaataatgaggggctgctgaagaacccgctatacctgggccttaaacagcatcgggtgcggggtcaacgatacgatcagttcattgatcaattcgtatctgcagtcgaaaaccagtttccagacgtttacctgcattttgaagactttggtcgttccaatgcagccaatattttgaatcgttataaagatgaccaactcgtctttaacgatgatattcaggggactggaattattgttcttgccggcctcatcggtgccctcaatatttctaaacaaaagttaactgaccagacttatttgtgctttggtgccggaacagccggtgcagggattaccatgcgggtttataatgagatgttagcagccggcttatcaccggaagaagcgaaacagcatttctatatggttgataaacaggggctgttattcactgatacccctgatttgacgccggaacaaaaaccgtttgcccgttcgcgaagtgagtttgcgaacccggacagcctgactgatttgctttccgttgtcaaagccgtgcacccaacgattatggttggaacttcaactcaaccgggaaccttcacggaatccgttgtgaccgaaatggctgcccatacggaacgcccgatcatcttcccgatttccaacccaaccaagttgatggaggccagcgccgctgatttaatcaaatggactgatggcaaaggattgattgcgaccggaattccctctgataacgtggaatacaaaggcgttacctaccagattggtcaggcgaacaatgcgctcatctatcccggactggggcttggggcaatcgccagtgctgcatcagtgctcaacgacgcaatgatctccgctgctgcccactcacttggcggtattgtcgatccgacacagccaggggccgccgttctgcctcctgtcagcaagctcaaccagttctcagatacagtcgcaactgcggtcgcacagagcgcggttgatcagaaacttaaccagaaaccaattgaatcagttcgcgatgccattcatcaaactcagtggcagccagaatattaatattaacgggaggacatatgactgaatatcggattgaagaagataccctcggaaaagtcaaagtaccaaagaaggcactatgggggccacaaactgaacggagccgacacaattttccaaccggccctttgatgccggttgaggtgatccgggcactcatcaacattaaacttgcggcggccacagttaaccaagtgcaacagacactaacccccgaaaaagcccggttgattgaaaaggccagtcgccagttgttatcgctcaacgatagccaactcatggctgactttccacttcacgtttaccaaaccgggtcgggaacgcaaaccaatatgaatgtcaatgaggtcatcgcaaacctctgcggtcaattggactcaaaactgacgattttgcctaacgacgatgtcaatcactctcagagctcaaatgatactttcccgaccgcgatgaacattgctgctaccttggccgttctcaaactaaaaccacaggttgaacatttgattgcagttttagccaaaaagcaagaacagtattgggacgttgtgaagatcggtcgaacccatcttcaagatgcgaccccgatcacgtttggccaagaaattagcgctgggtcagcgcgttgacccacgacctccactttcttgacgaaaccagccagactttactggaggtcccgattggcggtaccgccgttggaaccggcttaaacacgacgccggactttgcttccgcaatggtagccgaactcagtactgcatatgggttgccgttcaaaacccaaaatcagttctacggtctggccaaccattcaggcatcacggcaacccacggcgccgtgcggacactggcagctgatctcctgaaaatagccaatgacatccgctttcttgccagtgggccacgggccggctacggtgagttgagcatcccggccaacgaacccggttcatccatcatgcccggcaaagtcaacccaactcaagcagaagccatgaccatggctgcgacgcgggtaatgggcaatgatacgacaattgaagttgccgccagtcagggtaactttgagatgaacgtttataaaccagtcatcatctttagtttcttggagtcagtcgagttactaaccgggattatgacgaactttaccgataaaatggtcgctggcatcaccgtcaaccaagaccgaatgaagcagttagtcgacaattcactcatgaccgtcactgccttgtcgccgcacattggttaccacaaggcagctgagattgctcaaaaggcccatcaagatggcacaaagctgaaagtcgccgctttggcacttggctatgtgaccgctgatgactttgataaatggatgaagccgattaatatgactaataatgatcgaaaataacagtgtggagcaatgagcgtttagcttccagaataaaaggggactatctaaacatccagaggttggatgtttaaatagtccccttttacggccggaagctgctcatttttccactattcggctagataatattaaaaaatgtttttttggggggcaaactattcagcgttaccccagacccataaaatgtaaggatcctcccacatttttaaatccaattctaagaaccgtgaaccatctaccgagtcaccggcccctgccaagacagcatcccgccgctaacattaatcacttgataaccagccttgcgcaaaatccgggccgctcttagacttcgtcgcccagatcgacaaatcaaataccaaggctgtggggcagatacttgggtgatattgccaggcaatccggataacggcacattctttgcagctggaatgtgaccggcttgatactcatcaacctcacgaacatcaagaattaccggcttattcggtagtagctgcttcagttcagatgggctaattgactttatctttgaaaataacaatacataacgctcctttaaaatgattgatatatcgagtataaaagaactctggcaaaagtgaaacccagtttctgattcagtagcaatactggtttgtgaaaagtcccaaaattttgtatggtaaacccaacagaaagtgagggattcattattcgaaaagcaatccacgccgcaaatgcatggctgctctttgccatcggcatcggcatcatttcagcacctttcgacttgctgctacatcatgaaagcaacttttttgacctactcaagacattttttgaaaatggcttactcggatttttaggatcggtactactagtgctggtattgggttggttaccggtatttctgatcgttggttttttcctttggctgaacaatctggtttcaaaacatgactattttaaatagttatccggaaaaaatgtttaagaacagaaatcccaaataagcgctgattaactcaatccagtattcctgaactgacattttaaccgcaccaagccatctccccagatagtggtcacttttgatatacatattattatgaaccgtccgtaatgccaccagggaaaagaagtagatgctcgcaccaaacgccaaggtatgaagtaggaaaaaacttccactccaaaattgacccttgataaacaaaaagatgaccaccaatgccccaattgcaaacatggcataataccaagcggttggaaacaggattgaccacttggtatggatcaacgaaaaaattaaaaaggttaatggcactcgccaagcaaaataggtcgtatctatgatagacgcgcgagaaacaccgaggttttcggttgctgggataagatggctaaaatgcggcaatacgatgagtagggcaatcaaccagataaaaccgccatatattaaaagcgccttaaccacagtgtgattgatccgaattttccccatagatcaacaacttcctttaatcagatttccccctcaaaatattagctactaggttatcatgaaccgaaacaaaataaaactgccatcagcaatcccgatgacagttaatgctacctaacaacttcttgaaaggtcccaatatccagtgccagggtgatcgtcaacaccagaataatttggaaaaaatcggcttcctggaaccgtcgatacacaattgacatgaatggatcaactagaaagtaagccgctactacattcaaaataacaaaaataatcgcaaacacaattcgctttgcactcatgaaaccgccccgttccgctcgccctaatgtgtcgaagttgctgtaagtgtacaaagtttgcggaggtaagtcaagcaacttgcatatggtattataaatataatctaatatataactttgatacaataaaaccccactgccaattgcgacagtggggtctcttttaacgatgcgctttattcgctttagcttcatgaataatcttcagagcccgcttacggatcttgatacttgggctcttcaagcgacgataagcactcgcgagatcttgtttttccatatcgatcactcctttgccgctgttatcttaccagctggccttgtgaacaccagggatctgacccaggtgggcatacttgcggaagttgagacgtgacatgccaaacttacgcatgtaaccgcggggacgaccgtccaattcgtcacggttccgcaatcggttagggttagagtcctttggcagcttggccaaggcctcatagttgccttcctttttcaactcacgacggatgctggcatacttttcaatcaaggcttcttgacgtttattctttgcaatcttagacttctttgccatatgagtcctccaaataagtgtatttttgatattgtgggttttaggttattttgtgtacactcaatagtaacggttactattatgccaagaaacgtcggacctgtcaagaataatcattaagaagcatgggaacgtcggtgaaatcgatacgttagctcgataatgataatcccgccccacaagccaatcggaaccgcagatgcattatctccaagctgaaaatggaagtaccagccagccaacacaatgatcgttgaaataattgccaagagacaaaatatctttctcaaattcggccatcgtaaaatggtcggtcgagcatttaactcatcctcaaaccgtttgacccgcaccatgacaagcatattcagcagtgccactaaaagtaggaacacgcctgcagctccgccgtgtcgaataaatatcatactgataataaataaaatatcgatcgtgattgtaacctgcttaatcggccggatccattccaaggcttcttttttctttaaatactctttcatcccaacatcctccttcaagaggacgtccaatgatatatggaatagatcgcttaactgaatcaaactgtcaatgtcaggataactgttttcagtctcccaactggaaatggtttgtcgggaaacattcattgtgtcagcaacctgcttttgcgtcaaacccaattcaatccgttcagtttttaatcgtgcaccaaatcgcattgtcatcctcctttcttatgagaatagtgtataacgcaaacccatcagaaacctagcaaagaatctaagcatgctattatacaggtatttagacgaacagagtgacgccggaatcccacacacaatgcaaaatcgtgctgggccagagattcttggtacgataaaacatccagccaaaaatgaggccaagtggcaacacattggcgatgttaatgagccaagcgcccagcgtcagtccttcgagatagtaaagaggaaaatgactgatctgaaataagattgcttggataatattggcggtgacaatcccgtattgcttcatcaaaaagttcatgaagaacccccgaaataagaactcttcaatcaagccggcgcccaaagtcacactcaaaaactcaccgcttttgaacggatcgtgctgaagataaaagccacggtgggcactaaacatcaaaaagaacaggtaagcaataaacattgccaacacgatccaaaacacggtcggaaagtttccgttataaagtttgcgtttgtcaatccataattgggcgttcgtccgactaatccagaacagtcccaggccaaccatgatcacggctttgatccccaaactgaccagatcgctcgccatccctgtcgtgtagtgatgctcaatgaaattgataagttcgcgaccgaaaagccagagtacaatcagaaacacgtaactcaggtaaaaggtcgtcatcgaccaggttcttctcaaaataatgccttccgtttcgtcatatttagattttgattatatcactatccgagaacaaccaaaagtgagcgacaaatcaaaaaaaggccggcgcgcaattcacaagaattgtgtgccgaccttctcaatggtcatgattaactatcagtttcaacccagtgctttaacaggtagacacttccaacagactccaacgcggtaaatccaagcaggtaaatagttgcgtaatagatacttgcaatcgtatctccattcatattaaagaagtggttcataacaccgtcgactcgattttcaatgatcgagaagacatatagaaaagctacaataacaacaacgtacagaacgaacctaaagaatttttgccgagaatcaggtaggaaagccgtcaaggcatccccggtcaaatgaatcagcgtgatcgatgcccataaaagaagggtcatggcaatcgctaataaaatcgcaccgatggtcaccagaatcatatttcgaacaaaattttgcttatcagaattcatggtgtagtgaaacatcttcttaaattgagccccaaaatctccccaaaacggaatcgcagcgatcacccacagaactacctgggtaatgccggcgtacaccatcccgatgaacgaagatagcaggttaacagagtatagcttggtgtcacttgccggaatcaaccggtaggcgtcgctcacgaaaatgtgctcactgttccgagacatcaacacaaaggcaacgatggcgacaaataccgagtacgaaagtgtgatggcaagtggcgtatcggtctccagatctccgcgataaacttgataaatcagcgttaatacaatggcaatcacatcaattaagacaatccggttcatgatccgcaacttgggccgagtcagcgatttaagtaagtcatagaagctagtcatcaatatcattcccttcataaatactttcgtaatagtgttcgattccttcagcgtactttgaacgaatctcttcggcactcttctgtgcgtaaactgttcgatctttgatgatcacgacttcatccaagatgctggcaatttcggaaacgtagtgatcggaaaccagaatcacagcgtcatcactcttccatttgatgatactctgaatgattttcttccgtgacatactatcaatcccgccaaatggctcatccaacagatagaccttggtatcacgtgacagcgtcaatccgataatcagtttctctttcatccctttggagagggccgataaccgcaaaccttcatcaatctgaagaaacccagccatttcgttatactttttggttgagaaatccgggtagacgtcctcatagaaacggataatcttatcaattcgcatgctgggattaaatccattcaactgttcactgaagctaatggctgatttcttgtctggaaccccatccgtgccggccacggtaatgctgccggaagcacccttggcaaccccggcaatcagccgcatcaatgtcgtcttaccagcaccgttttcaccgaggaggccaacgattttgcccatctcaatgtttaaattaacgtcttccaaaatgcttcgataatttctccggtaattcaaattcttgatttcaatcgtgtttgtcatgattgcacctgctttctcttattgatataatcctgcaaataatcgacaatttcctcatcgctcacattgagtttgcggaggttttcatataaatcctggagttgttctgtaatgaggagctttttgagcttttcaatcgtttcccgatcctccgtcacaaagttacccttgccacgctgaggttcaataattttctctgaaatcagctcgcctaatgctcgttggacggtattgacattgacggtaaggtcaacggccaactgccggacagccggcagcttgtcaccaggggccaacttacccacgataatttggcgatagatataattcttaatctggtagtaaattgggatcttgtcatcgaatttcattgtcccacctccctagtgttatattttactattacactataacgccattttggcaaaaggacaaggaaaaccattattattaatcatctatgcaaaaaaaccgctacacagctacgcgcaacggtcttgataaatcaatttttattaacaatcttgccaccatccatgtgaatcacttcgtcacttagatatgcaatatcttctttatcatggctagcaagaatcacggtactcccagcatcggcaatttctttgagtgtctttctcagaagccaagtgctttcttcgtccaagccattcgttggttcatctaacaaaagtaacttaggccgttcgaagatcgcttgagcaatgcttaacttctgcctcattcccaaagagtagttagcaaccttcgtgttccagtcgctctcactcagtccaattttcccaaatgcactcttaatatcctttgttgttgcaattcttttaattttcgacaacgctaccaagttttggaaaccggtaagatccttagggaatgttgtattctcaattgttacacccatactctcagggaaatcaaacttatcatggagaacttccccatccacaattacctttcctgctgttggaattagtagtccagcaattgatcgaatcaacatagtcttccccgaaccatttcgaccgactaatccataaatttttcgtctttcaaagttatacgatacattatttaaaaccaaagtatttcgaattctcttagaaacattttgtacttctactctcatttcttatcctttcaaaaaatcatagttcttaattaaatatttaaattgcaagaccaaccatgataacacaataacgccggccacaagaacgactttattgtttgataagattaccctgctatagtttataaattgtggagcaaaaatacctgtaacctctcgaagcccctttaattgaaacattgcgtgccctataaataagcatccggaataaataaccaaagtgtttaagtaggccactgcaaccgtgtatctgagtactatcatcaaaaatgttataagtaaagtagcccaacccagaaaggttattacaagtactgatatagaccaaacgatcggtacacctccaaacatataattagctaccatttgagtcacgctctggatgatcacaaacacaaacacattattggttattccccatgaaattttccgacggctatgatatcttgatataatactagtcatatgggaaagtaaatttctatctaaaacagccgtgaattctccaagtacacacacaagtaacagtatgcttattgcaaactggattgaattaaactcatatggaacgtcagctataccatgaaatccgattaattcattgaagaagccaaatgttaggtttacgattaacagacttcccgctatccttatgactttcataaaatgtcctcaaacttaattcgcaatttaacaagcatacgcatcaaaatcaatattaatgatagtctcgcaaccgaaactacaatatccatgatagttagctgattctcaaagaataacgtaaagtgatttatttccaacagggggtcccataaatggagcctgggaaaaattagactaattaatgcattggtcactataactattcccatccccaggtagtatggacgattaactgtcatcagccggtaaaactcgccaatgatactcaaaaataatcctgtagaaataatcgtttcaaaaattaatatccaaaatgaaaaatttgcaatcatcgtacctaatgcaatttgcgccaaaaatactccgacaacaatatagagagcactaaagatcagactgtcagtcgtcagagttctctggaattgtttatagcggcttactcgtgacatccgataacagtgaacgtagcttaactggttatttatcataatcagacctacaaacatattagagaatatcactccaaacattgaattggcgaaatatcccgagttagtttcaaaaagcatttgcacattctgcttgaaagtatagtgatccgataaaacagcgttgttaacccagtatgttattaaaaaaatgcccacacctgacaaatataaggcgcaatacatccacttacgtttatttgaaatagacatgcttactccttaatctgatcactacatttcctattgtaattactaccacacaaattagtaaaaaactaatcagtgaaccaatgtattcattccaatcatactcaataaatggttgtgtaaagtatgaagagctatatggcaaagcaatcatgaaaatccataagccaagagatataggatacaccaaaatggttttcctaatgctaagggcaagtacatatataactaccgaaaatagtccaaatgcaaggctcactattatcacaaacaaaatatatgctacgtatgggtgctcaatttccaaatgtaaaaggtgtgaatactttgctgaatcctccatccccataaaactcgtgcctttgtgaaatagaattatggcgacaacaaaatcacaaccaaataaaatcatataaaatgttgaaaagataaagaattgaactaactctgacctaacaaaaaacttatccagtgttcccatacgtgtactcagtagataattgctgccaccatgagttctttcaattatccgctgaagtgtaatcattataatgaaaatgggcataaaccaaatcagaataatctgtaaaaattgacctgatgaattcccggctaaaaaggcagcagtaggtgggttaatgatctccttgctggggataccatttggatataactgaaacaaaccaggaaagttactttgccatgcgagaaattctgccagcaatacaattaatacgcaaataaggatggttctcttacttcttcttgaacttataatggcactaatttcagataacaacatcgaatagacctccaaaataccaagaatgctcacaataaatgtgagcattctatgcggcagtcaacatactaatcttcaggattccaataaccgctgacctcaggttcattcgcattcaaattattattctgcgcagtcagtgcaattaaagctccatttgcgtcactattcgcactgtacttatgttctccacttccctcatggatatcgtaagatttggaaacattacgattcaataatccagtattctcaatccaataggttgccaccgagttagagcccttctcagtatcatgttgcatgttaaccatccagggtttagatgtattagacctatattcatcctctgtctgtccattgcctttaaacattcccagcttaaaatcaaacactgtatcgacatctgcactcacttctgtcataaatgatggggcaacagctgccacactcagtaaagaaagagctgcgtaggttgctaactttttcattcttgaaattcctcctaaataaatttaataaagcattaaagaatagaatcttaaaaatcctaatgcttcagaaccattatttcggaaaagtggctggtttacaagaaagcattacttgcgcaagcaacgcttgatatttgttcagcttacacaaatatttcatctttatgtcaaacgttaattcggcgaaattttgacaccaattttgataatattcataaaatatttaaagaatattcatacatttttcacatccatactgttgaatgtaattatgataatattcgataaatggaggtagaatgataaatcttggaaataacttaaaaaaaattcgtgaaagcagtgaactttcacaagaaattattgcatctaaattaggggttagtcgtcaagcaatttctcaatgggaacacggtcttacttaccccgatataaaaaatttggtaaggctaactcaaattttttgttgtgacattaacgaattgttattttaaggaacagtaatgatacatctaaactttgagatagggttataaatacacattgaatcttcaccaaaagaggtcccaggcacaacttcgcctggaacctctttgttacaagtttttaagcacttgaatttacaatttaagtgcaacactaattaaataaagaatggctcatggccaatttcctgtagaatgatgtttgcgagaacaatcatgaaaggaaactagccatgaaccactacaagcatattaccatagatgagcgagaaacaatatttttaatgcggagccatgggaactcactacgtgagattgccacgaacatccagaaaagttgttcaacggtttctcgagaattgaatcgaaattcagatggtagtaattattcaccatcaaaggctcaagctaagtaccagcaacgcaaaggtaattgtggaaggccatcgctcttaggtcagccacaagtatttgaagtcgttagggaacatttctgtgaggatctctggtcacccgaggaaatagcgaaccgcctagcggtggaaaagcacgccgtccaaattagtaccacgacgatttatcgtgggattttcaagggcttgtttgatcacttatttaagtctggtagtcccagcgcggttcgccatttgagacatcgcggaaaatcccgtcataataaagcttatcaagaaaagcgcggtaaaattccgattcccaacaagattcacgaccggccccgagaggctgataatcgtctcgaaattgggcattgggaaggcgatacggttttaggcaaaagtggccgagcctgtgtcgtgaccctagttgaccgcaagtctcgctacctattaattggtaaagctagtcaaagaactgccggtgcagttaccgacacgctaagccatttaatgaagttatggcctggccgatcattaacgattacaccggatcggggaaaagaattcgccaaggttcaatgcttcctgaaaagtttggcacgcccttttacttcccggatccccattccccttggcaacggggtaccaatgagaacaccaacggtctggttcgcgaatacttgcccaatgggaccgatattgattcaattacggacaagcaaatccaagcctatgccgaacaactaaataatcgtccccgcaaatgtcttggctggaaaacaccgtctgaagtgttctttaatgtggtgttgcatttaatttgacaattcaagcttaataaaaagaaaaccgctgcatctgtacctgcaacggtcatccaaaagccatcaaaatatggcgatctaagattagttgtcgctcaaaatcgactcaacctaattcctgactcgaactatccttactaaacacttaagtaaaaagtagaattcttaaaatgtactagtaatgaatgtcgagaacaataaatgtaatatagattgctgctaatattaatataaccaatcccaacagaagaattatttgcataattgttggctttgttcgccttttccccaataattttatgaatacggatgttacccctattatcaaaaaaactatagcaattccaattagcattagttgtctccttaactcagtttttgattaatagtttttatgagtaaattacagtttactttgactggttgaagtcagagaagcaattggaaattcatccgtaagtgtgatccgacacccaccttttgattttccattattaatcattgttttcacatccgattgtgctgatcctgatcttactgacagaatacctcctgcccctgcaccaaagattgcgccaaataatcccgccgaaattacgcccacgacggctcctccggtcaccaactcatcttgaattaaaccataatacgtacgtaattttgctaatgcactggttgatcctgcaaaatcattgactccacccttgactatcttttcatgaacactcgcaggctttgtaatcgaacgcagccctacttcattagtagcccctgcatcgttgagctgaatatctgcttcagcaccatcatatttatttaataaatcttgcatttttgcgctcaattgatcctcgggcaagttttgctgagataataacttacattccttagaaaattctttccactgctcattagaattggctaccgtaacattttgatccgaagcctgatctgtatccgaaaattttgtggtgctgtcactagccaccaaggatcgggcagaactatctgcattgacggttgatatgtcttgaaccgccacggaagataacaacaccgctgacatcatggttacacctatacgaatacttttctttctatgtttaatactaaaaacctccaaaatatgagtagatttatttatatttcaaaacccattatttcggaaaagtacacacattgcaagaaaggattgcttgcgcaagtattgcttgatattaactgagcttacaaaaagttcatccaatacttttgataatattcacaaagcttttaaacgacattcacacattattcacacgtatactgtcgaatgtatttatgatactatttgacaaatggaggtaaaatgataaatcttggaaataagttaaaagagtttcgccaatacaatgagctttcacaagaaattattgcatgcagattaggggttagtcgtcaagcaatctcccaatgggaacacaacctcacataccctgacatcgaaaatttggtaagattaacacaaatttttgattgcgatattaacgaattgctattctaaaaaggaaaaatgcagccaatcatttaaataaagctctcaaatttcactaaagaggttccacacattagatatgtcaggtgtggagcctcttttctaattgatttttctgaccagtacataaacaattattacaaagttcgccatataggtgtcagtgaacaagttgtcaattgatggttcgctatgagtagagtaacctgtttacggcattgttaattatgcaccagccccggcaactctttgccattcgcatcgattgccaagcgaaccagcacaaccttgctggaatccaccggcaggccgtcaatatagacttcccggtgctcatttccgtgcaggcgtgtgaagccctccttttgaatcgcattttccaaggccttcaatgcttcactgtccggggtcactgcaccggtattgacggtctgaatttcaatgccttcagccaaatgttcaaacttgatttctcccaaatcaaaatctgagaaatcaatctgagttaaggcagcgtcgaagtccttttcgttaatgaataacggctgtttaatccaaatcttgaagtcttcaccgtctccggtatcggtccaaaccgcttggaccgggtatgggcggtattccttgaagccctcgaccggaatgccctttcccgggccaccgctgattgtcttggcaacttctgcagccgcattggaaagccgtaagaagtcagggtcgtccgtgtgctgggtcgcatgcccttcagcagttacataacttcgtgtggtcagatcaacaaagctcggttctttatctctactgtactcatctggttcgaatgtctcccaattaaacatatgaattccccctttgatttcgcggtcaatataagctaaatcggcggggaaagcaagcaaagggctcttattcggactgtaatgattatccaaaaatgacgattaccgcaacgaagatcaggacggcgacggggaggatgacggaactattgagattcataaatccccaaaagttcatttgatcatgattacttccgatgacaatctttttctgcagccgctcgtcacccttaatcaagctgtccaaactaaccgcaaataaatcacttaactgaaccaaccgttcaatatccggatatgctgaaccaacttcccatttagagatagcttggcggctgacatgcagctcttcggccaatcgatcctgggtccagcccaacttttcacgttcttctttaatgcgttgtcccaacaccatgttaaccacttctcttcacaaatttgattgttattattatgccattattagtcgggtgatgcacgctcatcttaagggcgatggcgtgcaaccagtcgttgcggacgataataatttttaacaatgcttttgattgctttccatacccgaccacttataattaaggtgaatcacgtaaccgctttcatttattaagggggattttatcatgacaatcaaaaacgtaacggttgcaggtagtggggttttaggaagccaaattgctttccaaacagcttttaaaggattcaacgtcacagtttatgatattaacgaggatgccattaatgccgccaaggagcgaatcaaggggttgcgacacagttatcggcatgacattgcggccactgatgccgatttcgaagctggtttatcacgaatcagctatacttgggatttggcagacgcagttaaaaatgccgacctggtcattgaagccattccagagcgactagacatcaagaaaccgttctacaacaagattggtgagatggcgcctaaagaggctatctttaccagtaattcatcaacgctggttccaagtgcactgatggaagataccggccggccgagccagttcttaaacatgcactttgccaaccaagtttggctgaacaacaccgctgaaataatgggatcgccaaaaacagatccaaaaatctacgatgaaattgtcgaattcgctcgaaacattggcatgattccgattcagttaaagaaagaacaacccggctatattctgaactcactgttaattccactgttgagcgctggtgaagaactttgggtaaagggggttgctgatccagaaatgattgataagacctggatggcagccaccggtgcaccaatgggtccatttgccattctggatgtcgttggcatccggaccgcttacaacatcaccgcgacccaagccaagagtggcgaagatccaaatgctcaagttctcgctgacaaactcaaggaattgctggatgccggcaagctgggaatggaatctagcgaaggcttctaccactatccaaatccagcatataaagatccagactttttgaagatttaaggagcaacatgccaaatcaaaaacgcttcaggagaattttagttctcttgaagcgtttttgttcattggcaattaaattctgtggttaaagattgccctgattattttgtaaatgatccaaaggataccagccgtgatcgcaagactgattactccggcaataatcgaaaagttcataagaatactcccatgttgagataatttaaagtcacatctttaggttatactaaaaagatattctgggtcaagaaagcatccctttccccaaacgaggtattgttcacggaatttttcccaaccacttacatcggaaataccagaatttttatccaaaacgataattaattattgtcttgcaataattaatttccgcgttacaataatatcaaaagggagtggttaccatgattaagaaacaaccaaatacgttcatcaactttttatacgttatcagtctgctaagtgtggcttcattattaattgcaatgggaactttggcacttgtctttgtgattgctggaatcgtttatctactaatcccatctgctcgtactgggatttttcgcgatattataagtggaattggcggatcgacgaacatttgggtgatctgcttatcatttgcattattgctcattatattgggattaattacccttgtttcattttcagtcttcaagctgattgcaaatgtccgtcgaaacatctatttcaagccaattaatttaaaatacatccaaggtattctttgggggtatgggggtatcattttaaccaactactgtagcggagtcttagccgacacctataatattaactcatcgtcgatttcatccgaccaaggaggcgacggtacctcgctactcatttggtttgccctctacgtgatctatgtaatgttcaaatatggcatcgatcttcaagaagactcggacaaaattgtttaggcggtggtgtctttgatcaaagtaaatctagacagagtgttgttggataaacaaatcacttcaaagatgttggcagcagaaattaatattaccccagccaacctatcgattcttaaaacggggaaagccaaggggattcgctttgagactctggcaagaatttgtaaagttttggactgccagccaggtgacattttggaatatgttccggagtagaatactgagaagtcattcaatgattaggatttggatttaatagccccttgataatcacacggtacacacagtttttcgtgaaacataaagctgttctgcaacttccgtctgagtaacatgctgcttgcttcgctcaactttaattttttctccgaaagtcatttcagtcacctccaattttaatatacggataagtggtgcgatcgacaagataattctttgatattggacgctaagaattgtaacaattaaaaaccaatcacaaagtttgcgtttgaattcattcattgaaaggttagcctccaatttgacaatatgaaataagatcattcatccgtcacaattaccgtcatccactattcagatatcccgcaagacaaaataaaaaagttaccttagatttacgtaaggtaactacttgctgacatctatgatttttctctccaagtcacaagaattactaagacaggaataaagatcacgtttcccactgcagaccgatagtgcccaagatatgcattgaggccggccaagataagaaagcaatggtgatgaataaatttttggtcttgagtttcacggtttaaggatatcaaaaattataggttgttgcatccctacttgctgctcttaaacaatctcctaaacaggaaaaagttaaccaccccaagcaacgccaacatcgcaaacgccagccggctgccaacaacaatgttttgcacataagacaaggtgtagatgtgcaccgacgtcatcatagtcgcaatgaccgtcgttccaagcgacccggccaacatattcccggtgccgtatatggcattggcatccttctgttcatcctttggcaaatgtttcaagccataggccatgctattgccaaacgccatcgaacggcccgttgcgtaaaccgtgtacagaatagtaatcaccaaaacggacatttgttgacccattaccatcataatcacaattggaacgagaaacagcgaattccccaagtaaaggggcagtttgccgccaaatcgatccagcatccatccataaatcggctgccccaatccgttcaggacactcccgggcagcaaaatcagcccagcaataaaggcactggcgctgttcacaatttgtacatagcttggcagcatgaagttcaagccgatgtttgaatactgtagaaaaacatagggtagaaaactaaacaaaaataccggtcgtttgaagacggacagtttgaataatgctttgtgactggattttgacagccaaccgaacaagcaaaaggaagcggcactgaccaccatgtagcagatgaatttaactaaaaatccacgctggcccacaatattaaagcccatgagcagggtaatcatcgctaacgccagcacaccaaaccgcagccagtcaaactcatagtgttcggtcggcgtatactgcttgataatgaagatccccagcagcaatagaaccagggtaatcggcacggtgatccaaaaaatcatccgccaactggcaaaggacacgaccgccccaccgaacgttggccccaacgctggggcaactaagacgatcaagttggccatccccatataggttcccaatttgtgggcgggaacaacgtccaaaataatgttattcattaatggtccggtcaggccaacacatcccgcctggaccaagcgtcccaccagtagcgtccaataatttggcgccaaaccgcacatcacatccccggcaatgaacagcagtgctgctgacacaaagagctgtttgttggtgaaccgccgtttcaaaaaggctgaggtaatcgtcaatagcgccaccatcagcagataccccgtggtcacccattgaacggtgggcagggaaatgttgaactggtccatcaaagttgggaaggtaacgttcatcgatgtttcagtcagcacccccataaaggtcatgaatgccacgacggtaatcaccaggaatggatgctttttggcgttctcattttgttcattaacagtggaatccacggtgttgccccctcaaaaattcgtcatagtcgaattaactcgcaactaatatactaccatttatcggggagcgtcgacaattaaatttgtggggtatcaatgacctcaaatacttcgcagataacgggactttccagcgaaaaggacttgccacgcatcttggctttcttccggaaaagctgtttgtgcagttgccgccaatatttcagcgaccgattcccttcgccttccaaataggcgtgttcttgagacacccatttgaatgggacaacctcgacaactttaagttgaacaatgcaggccggatcgccgttccgcttgagtaacatccgatagtcgccggcctttggcaccacccggtcggcatcataaaaatcaaaccaggagctggcagcggttttctgtccacgaaccaccatttcaaccaacatatcagttgaattgggccggttggtaaacgaccacgtttcaaaattagttttctgggtacggttgcgacgcataaaatcttcccagtaatcggtcgcatccattttcaaaatatccatatgcattcctccgttcatttatgattgatggacatagtttactgtggcgagcttaaatgaagcttatgtacaaaaaagttcccgcacgcctgcaggaactcccatttcatttcatcattattttcgatttcttctatactatgtgtcaggtttcccctggaaaacatctcgacttctcactatgtcatccaaatctctgagttggtccgattatttaatccaaatgctggtatcaaccccctcaattgcttctaagttagtgctgagccacacgagtggtttgattttggtcaattgtttctttaatcgcactgcctaagcgctcgattccggtttgaatctgctcttcagacatgttggaatagtttaatctgaaggttccaggagtgaccttgtcggggtagaatggttcacctggtacaaaggcgacgttgtgcttaatgcaggtgttgaataatttaatggtatcaacatctcccggcacttcgacccaaatgaacaggccgccttgtgggtgactatagttgacgccagctgggaaatacttctcgatggctgccatcatcacattttcacgtttgcgataaactttgcgaatcttgttgacgtgctcatcaatgttatattcagccataaatttagcaacaatgtgttgggttaaattatccgaatgaacatctgcggattgtttcatcacactgtatttaggcattaagtctttgttcatcacgatccagcctaatcttaatccaggcgccaagattttcgagaaggtacttaagtaaatcacccgctcttcattatcgtagaacttgaccggctcaatgtcgtcgccggcaaaccggatggccccatagggatcgtcttccataaccataatgtcgtacttgttggcaatcccaatcatttgttcacgacgttcagccgacatggttcgaccagttggattttggaaattcgggatcgtataaataaatttggtgttgggattagcagcaacggccttttccagttgatccatccgcatgccgtcttcatccatttccacgcccacaatatgggcaccgtaactgcggaaaacgtctaaggcacagaggtatgtcggcttctcgacgatcactgtatcaccaggattgacaaacattttagccgtgatgtcgatggactgttgcgaaccggttgtaatcataatattatccgcagtggctttaatgccctgtttgttcatgcgttgggcaatttgctcacgtaaggcaggataaccaatagcagaagaatactgtaatgcttcccgaccactctcatcgaacacctcattggtgactttctttaaggcctcgatgggaaataattcaggggcgggtaacccgccagcaaaggaaatcacatctgggctgccggcaacttttaaaatatcgccaaccggatcgctatcgtttttgggaactcgttctgaaaatcggaaactcatacgcgaacacctgccttctgtgtgtcatcattttgatctgccacgttcgtttgcggttggtggtatttccgcatcatttctgccatgtgaacttcttgaaccacaaactcgtgggttcggcaaacgtagtcgtgttcacgaccaattttggcaatgtagccgttaatgtaatcaacttccgttggtcggccctttgagaaatcttgatacattgatggaaaatgatatttgtattccttgctgacactaatgactgaatcaacctgttcctgacgagtggcgataagataaattccggcccgttcacaagcgtcataggcttcatcaaataattgctgcgacatctttcgaacacccggatactcgatgaactggcccatttgcatttcaaacattgtacataatgtgttcgtcacagcgttgaaaacaactttggacatgcacatgcccatccattcgtcggcgaagaccggtcctaatttggcattggtgaagtcgtcgaagatcgcttgagtcttggtgtccggcttttcgttgttgtaacgagccatatgcatgacctcgtcaccctcagcccccatgaaatcaatatcagctgggccatccattcgagtggcaatcatcgcagtcccacagataatgttatctttagggaaatacttagcaatcttttcaaagtggcccatcccgttcatcgcagaaaagacatattgatcatcatgaaagataccggccttattatcgcgctctaattcttcagctaactgcatctgcttcttgaaaacaatccaaacatccgggtgacctttatattcttctggatagtagatgttgattggaacaatgcgtcggttttcgtggtcacgagcgacagtgacaccgccttgttcgcggatcttctcaacgtttggctcccaagtgtcgatgaaatcaacgtcgaccccggcattctcttgtaacattacgccatacctaactcccattgctcctgcgccaataataccgtacttcataatgaccactccttttattttttatttaggacagctgcgtcaggcagaaacctacgcataagcaccttgcccaaaaattccaaaaccaggaattcttgtccaaggagacttatgctccggtttctaaccgcctgactccgctcactacaaacaaatccgactaaaaaaacgccccttggttatcaaaaccaaaggacgttaagttcaacgtggtaccaccttaatttgagttgtcttcacaaacaactcctcgaagcgtacgggaaaaatccgatacgccggcacgttaatgggtgctaccattccacctcgaaaagtgaacttattttgctcgatctttcaattcatagtcttaatgccctcacaccaaccaggcactctcttggtaaggctgtaaatctaatccatcggaccaaatcaattagtcgtatttagatgttgcatgaactatagctcatgaacggagaaactgtcaacaacttttttacacttttatgagagcagtctcatgaaaattccattttatcaaggggttgagcggcttaaaaatttttgagaacttttgtaattggtggtcgatttcggtatactcgatgtatcagttagattaattggaggtgaattgaatgcgggcattaattggttttgccgggttaatttcgatggtgatgtgtatcgctgccgtgattttcttaatcatgggtaatcgaactgtcgctgttcctttggtgagtgttggattggttatcttgattgtctgttatgctgcagcaacatacatttctcattctgataacaaaaaatgagattattttaatacataagttgaaacggagggctgctgcatgctgatgattagaacaattcgtcaaagtgactattcaaacgtcagtaacttaattcgaacagcatttgccaacaccgccaatggctatcggaatgaagccgaattggttgataagattcgaaaagaccctgcttaccaaaaacgattggaagtcgtggccgaaaatgggattcacttggttggctatggcttactgagtgaaatcaaggttgtcgatggtgccaaagcatccacagggttggtattagcacctttggctgttgaacccggatcgcaaaaatccggtgttggcagtttgattatgggcgagctcgataatcgggcaatcaaccttggctatcaattcaccgttgtgaccggctggccggattactatcctcgctttggttatcagaaggccagcgattatggtatcaagtctcccacaccggttccagacgatgtcttcatggctaagccattggttgacggcggcttggatggtgttcatggaatggttcagtactcgaaagcttttaacatgtaaataaaaaaacggaaaccaattgcaaacatggtttccgtttttgtatcgattcaattatttaatggtggtttcattttcagacgcagctactttgcttttcgcaactgcctgagtggcaagctttaccaggaattggccatacttgatcaccacgaagacgaccataaaggttgccagggtgatttccaggtttgcgaccatcccaatgattgagttgagaccgtttcccaagtggaaactgttattaaacagattcaatgctgtggcagagatcaccaatgggaatgtaaaggcaccaaaactgggataaaaggctaaccgaacgtacttgaagatcttcgtcagagttccccaatacaacccttgtgccaggatcaccattgctaaggcgaatccccacgatgggttagtattcatggataggtaacccgtcaggcacaatgatgccggagcagccataatagtcagtagcggcaaggttgcttcaaacataaactcccgtcgaagcaggcgaatgcagacaatcggcagcagaattgcatagagtcccaatgacaaccacagtactggtgtcccgagtgccggaatgaaattatttgcggtaaccggaatcactccgattcccacaaaagttacgaaccaacttggatagacatgatcgagctcaactgtcggacgtaataaatggcggtagataaaataacccataatgacaaattgcaaaatcactgcgaacgtccaaacggctgtgggtaatactgggagtccccatgatttcagaaaagtgctgataatcatcaaagacatcgtgaaggttggggcaacggatgcaataatcgggtcattcaagtcgttcagactcaacttaaaatgaacgccaatctttgcgatcaccagtaaaatcagaaccagggcaagaatcccccagatattgccaatcactggtaagccaattgccttaaacaggtttcccaacgaggcaatcccaagaattaatccacaaattggtaaaggtaacttcttcaaaaataacttcatacggtcgtctcctctcttagatgagcttaataatatcatttatggtagaataaataaaattgatagtatttatatttgttataaaccaaatttataaggagtgccaatatgtttaaattcctggaaaccttcatggttgtctacaaaacccgcagtttttccctggctgcccaacagctctttatcacgcaaccaacggtgtccaaccagattaagcaactggaattgcagctgcacaccgaattgtttgaacggagaagccgccgggaaattgtgcccactgaagcggccaacctgttatataaacgagcaggcaagatccttaaaaactggcaggacgttaacgatcagatcacccgcttaggcgacaaaggaaatgaaaaggtgcttttcggcatatcgcaaaccgtttcgcgaatcttgtttgctaaaattgccagtgcactgataactgccgtccccaacctcgactttgatgtgactgtctccaactccgagggcgtcttaaaccagctggaaacctacaagattgatatcgggatcatcgaaaagccactggttaccgagaacatctcccgaatttcaatcggtaaggatcaactggtcaaagccggcgtggacaatggcaattggatcactcgagaaccgggatcgggaatcggctattataccgaacagtatttccgtgaagccgatgtccagcccgccaaactaatccatgtgaacaatagtggcctcattcgtcgaatggtggcaaaaggcgttggtcaagccctgctgtctgacaaggatctacctaccgctgttccgattgaatcacttggggaacatttttcccgtgatttttatttattggtccgagaggaaagcagtcacgacaacacgctgaacaacatccaacaaatcatcaataaagcaatgtcttcccccaatcaagattagttctcgtccaaagtacgcgtccgagttgctaatgatttgaaatgatcatacgtcatctttagtaattctttgggtgcagcgtcttccaggattttaatcttatccggatttgcggccggtcggtccttgtaaatctgactgttaacatgatgggatccctccagcaaaataaaggccaggtccgtatcagtattttcaattcttcgataaataaaatcgccacttcgctcgttgggatccaaaacatcgatattaaccccaaatggttcaaatacccgtttgtagctaatctgcttgaaccatgaaaccacctcaatattcttgccggttaaaacatctttcacatcgggataatcgattgtaaaccgctcaacaaacccttttgccgataatttggcggcctttttcttaacttgatgtaattcagcggaacgatcgcgattttccgttgatgcagcgtaatgtttgttaatcacaaactgatcggtggttaaattatagttcccgcgatatacatcaccttgattgagctcaaatttatttcccttcacaaccggattcgggaaaaccgatccatctaaagcaataaactcaggttggtcatcttgaaagtggacgtagccatacatctgttgattatctttcagcaactctgatcgccacaaatgaatcttagtattggccatccctgtcttcaaataataatcaatcgtgttaaaaagcggcagtaacgataagaattcacccactcgttcctcgtcaattctggcaaataattcgttgattaactcttgggtagttgcttgccggacgagtttgcctttgcccggcaattcatagtgccggtattgatggagctgttcttgatacttggtatttcgtttttccgagctcttcaagtgagcctttgttttttcaagttggtccttgtaatactgcttatccgctttaacctgctgagctttctggtactgtgagcttttaataaaatggcggatgccggttcgcagacttcgattgcgcctgttgagtaattggatttgctgattaagttggtcaatcgtttgtttcaactgcatttgggtatgatagtcagttgcctttagttggtcggcttcttgaagtttaatctgggcattatggactttgccctcaagttgatcatttgcttggtttaatgcaaagttttttgctttgagccgttgcattatttgctcttgggcattcttctcactttgaatagcccgaacttttttctgaagctttttattctcccgttttaacctgctcttctgtctgtcgctatcggtgtgctgcgaagcttgatttgtttgctgaccacgatttgtggtggccttttttaattgggtttgctttttctttgcctcttccaaaattctgtggaatctttccttagcctgttgtttatccttatctttgattgctttgatattcattggcttaaccattagcttacctctcacccgttccacattgtaaagttcataaattaattgtaccaaatttcacccctgatgactcgttaacataaacgaattgaacaaaaataagctgaaccacaaactcaccagatccaatgatcaaagagtctatagttcagcttatttgagtagatacattctttaaattaccatcttaagcctggtcgcacttacagcagcactccggtagattttttcgatggttttttcataatcactattggcaacgccaaagacgactttaatatcgctgccttcttggaccaccaaatgaatcttaatctgactgttatccaaaaggtcgagaatcttaccagcgattgccgggcgcttactaagttgggaggaaaccgccgcaaccatagcgatgtttttctccaacttgacactgtctaaatcgcaggctgacttcagtgagttgacaatcgccatcaatttgccgtcaacatcagtccgcttcgctaagaattgaactgaatcggttccagctggaacgtaatcaaatttgacgccaaacttttgaatcacggagaagactttggccatcacatcaagacgtttgtttaattgatacttttggattgaaatcaccacataatccttcttaccggcgattccagttaccaactggtgagcgttactgttcgcagaatcgactaccagagtcccgtcttcttcaggatggttggtatttaaaatggcaattggaatctgcttttctttggcaggttgaatcgcttcttcttggaagacgctgatgcccatataggacagttcttggagttcttcataagttaattcggtaatcttgcgggagttattgataatccgaggatcagccatcttaatgcctgacacgtcagtccagttctcatagagatcggcatccacaaagttggccaacagcgcaccggaaatgtcacttccaccgcgaggcatcaagtgagtcaaaccgtcttcatcaaccccatagaaaccgggaacgacgatgtggtcatcgtagcttaaaaagtcgcgcagacggttaatggattccccatagttgacgccgttttggtcaaataccagaaagcgggcagcgtcaatgaattggtagccaaggaaatcggccattaatttggcagttaaaaattcgcctcgtgataccaaataatcatgactgcagttaggaatctgcttggcaattttctgcaagtcggtttcaatgcccaccttcaagccaagggcatcccgaatgccgacaaatcggctttggatgtggttatacactggcatgtaatcttcaccggcatctcgaagcttctcaacttcaattaataaatcggtgactttaattgcctcactatcactcttacctgcggcactcaccacgattacttttcgatctgcatttgcttctacgattgcccggacctttttaaattggccggcatccgcaactgaacttccaccaaatttagctactatcattttgctgctcctcctttcttagttggtaaacttgccataaacgcggtttcatcgcgttgtagcactcgtctcatcttttgatgcatctcaccgactggaatgtcatgaacgaccagatagtcaccccgaagttccggggcatagtcgccaaacagctgtgagcaatcaatctctgatcggacaatgtaattattccgggtcaggttcggctggaacttaaaggtactcttaaattcccgcttcaaatgttccttaccttggaaaatatccaagatatcttgaatcacggcgttggcagttggcagttggccagctccctgacccatgaacttcaaagtcccaatcgtctcaccaatcagtgaaatcaaattatagttgtcacgggtgtgggcttcgagggtgtcgccgtagtacaaggtcggctcaaccatgtagtcaaactcatgaccccgctggtgactcttccccatcaatttgatggtcatccccaacttgtcaaagtgagtcatgtcgtcttcggtaatgttacgaatcccaaagattggcaattcttcggttggcttgataaataggtcgtatgcaatatcgacgctgatacataatttgttggcaacatcaaggccgtcgatatcggcacttggatcagcctcggcgtaacctaattgttgggcctccatcaacacttcgttgaatggtttgccggttcggtgcatctggtcgaggataaaattactggttccattgaagatgccttggatcttattcacatcgtcgactcgtaaagcccgctccaagccttgaatccagggaatcccaccgccgacactggattcaaaataaaatttcgcgtcgttttgggcagccactcgcgtgaattcatccatgtactgggcaatcaccgctttgttggcagtaatgacatgcttatggtgcttcaaggcatcgactatgtattgatgcgccggttcaatgccgccaatgacttcaaccacaacatcgacatcttgatcattcaaaatttcatcaatgctgtcagtcatttccggtaaatccggttttttattctttctgatcaaaatatgctttacatggaggttttgggcttggcgcttcgcattcttaataatcttgtaaacgccggaaccgactgttccgaatcctaatattgcaatattcacagctgaaacctccaattttttagtgttcacaaataataaacacttgtatttaacatgaaaacagattatcatataaatcatagaaatgcaaggagtaagttgatgaataaatattatacgagtaccagaaacggttcagttcaaatttcagccaagcaggccatcaagaagggcttcgctgatgacaagggtctcttcgtttatcccgacttggaaaagctccaagtaaacttcgaaaaattactaaaattaaattatcaagatattgccagagcagtgctgacgattttattgccggacttctctgccgatgaaattgacgaaagtgtccatgcggcttatcagtcgagttttgacacgcaaaaaattacgccggttgttcccgttgataatttccatatcctggaactcttccatggaccaaccagtgcttttaaagatgtcggcttgcagctattgcctcaattaatgaagcacgtattggtcgacaataataaggtaatgatcctgacggctaccagtggcgacactggcaaggctgctttggaaggctttaagggcttggataacatgggcattattgtcttctatccagacggtggtgtcagcaagattcaaaagctgcagatgatcacaaccggtgggaacaacaccaaggtcgcagcaattgaaggaaattttgatgacgctcagacaaacgttaagcgaattttcaatgaccaagctctaaagaaatcccttggtgacgatgtcagcttatcaagtgccaattcgatcaatatcggccgactgattccccaagtcgtttattattttgattcctataaacagttggtgaacgatggctcgattgaagtcggccaaaaggtcaacttcaccgttccaaccggtaactttggtgacgtcctggctgggtactacgccaaaatgctgggccttcccgtgaacaaatttgtcgtcgcatgtaatgaaaataacgtgttggccaacttctttaaccacggggtctacgatcgcaaccggccatttttccagaccgtcgccccaagtatggacatccaaatttccagcaactttgaacgcctcctctactataagagtggtcaggacaccgaatacgttaaacaattgatggatgacttggaagacagcggtaagtatgaagtttccaaggaagttctggcaaatatccagcaggatttctactgcggctatagtaccgatgacgatattgaacggtcgattgccgaagtctacgaacaaaacggctacttgatggatccccataccgcggccggctacaaagtcatgcgcgactatcaaaagctcgatcctgaaacaccgatgatcctgttaagtaccgccagtccctataaatttgttaatgcggttgccaacgctgttctgccagaaacttcagcggatgtccaacaagtgatgcgggacttacatgacgcaaccaacgcaccgattccagataacctgagaaaagtctgggatctgcccgttcgtcacgaaagtgtcatccaaaaagatcaaatgaccgattacgtcaaacaaaaagtcgaggaggtattttatgatcaagatcaaggtacccgcaactagtgccaacgtcggggttggttttgactgcctgggtttggcagtgtcctattattcaaccattacttttgacaagagctcggagcacttggtcatcaccggctccccgaaagaatttcaaaatgaagacaatttggtctaccaagcctttgtgaagggctgcagcttcttagacaagcccgttccaaatgttcaaatcgacattgaaaccaacgtccccgttgcccgtggacttggtagttcatcgatttgtgttgtggctggcctaaaagccgccagcgtctggtacgatgacgcaatttctgttgaccaactgctggtcttggccaccgaaatggaaggccatccggataacgtcaccccggccattctgggtggactgtgcgtctcctttttagatgaccaaaatcagcctcaggttatccaatatcacgtcagcgacaagctgcactttgtggccatgattccggattacgaagtcagcacccatgctgctcgaaaagtcctgccgacatcaatgagctacgcagatgcgattcatcaagtcagccactgtgcggcgatgactaaagcactggaaatcggtgatagccatatgatccatgttgcctgcgatgaccggatgcatgaaccgtaccgggctcaattaatccccgattacagtcaggccaaaaacatcatcgaacaattgggtggtacgatgtacattagcggcagtggttcaactatgatggccatcaccgcagacgaaaaggatgccgatcaaatcgctgccaacgcaaaagcggccttcccaagatggaatgtccgcaaaatggcagtcgattcaaccggcgtagtgagtgaggtaagtgaacgtggaaaagtattacatcgttgatagctcgattctcccagagtcatttgataaagtgattcaagctcgtcaactgttggagagcggcaaagtcaagcaggtcagtgaagccgtgaaagttgtcggcattagccggggaactttctataaatacaaggatttggtcttcttaccggaagaaaacatgatggacagaaaagccgttatctccctcatgctggaaaacaagcgagggatcttatccaaagtcctcacgaccatttctgaaaccagtgccagcgtgttgacgattaaccaaaacatccccatccacaatattgccagtatcgtcatctcactggacctgagtcattttaccggaaccatcgataacctattgggaaaaatccgcttggtggatggtgccagtaacgtccagttagtttcgattgagtaagtatcggaactctgcatatgtcaatcagatcatcgtttctcaatccttgatagctgctatcaaggattttttatgtattcatgatagaaactttcaaactgtaagcccttaccagcttgaaagttgtttcacagtccgcatataatacaatattgtatgcatttactgatttaaaaagtattctggaggaaatcatggcaaacagccaggaaccaaacgcacccaaaaaattccatttatcacaaaatcatcatatgacgattccttggaaatcattcacgacggacgaatctgtccccgccaaagaagccggcttgagggaacgggcttctatcgttggccgggttgggattgtcatgctttcctgtggaaccggagcctggcgggttcgtgacgcaatgaacacggtggccagagtgttggggctgacatgttcggcggatatcggcctgagctcacttcaattcacctgttttatcaacgaccacagttattcgcaggtgctggcactgcctaatactggtgtgaacaccgataaactcaattcactggaacacttcgtcagccattttgaacgggattttggcaatgcgacggtcaaacaaattcacgccaacatcagcaaaatcgaacaacgacctgtccagtacagcccgctggtttctggtttggcggccgcattggcctgcagcggttttatttttttgctgggcggcggcatccctgaaatggtttgttctttcattggcgccggtgtcggacagtatttccgggggtcaatgggtaaacaacacattaccacaattgccagcatttccattgctgtggccattgcgtgcttgacttacatgttttcattcaaaatctttgaagccaatttccaaattctggctcaacatgaggctggctatattggtgccatgctgtttgtgattcccggctttccgtttattaccagcttcctggatatttccaaactggacatgcgatccggactggaacggatggcttacgcgatcatgatcaccgctgtagcagccttagtgggctggctggtagcactattatttgatttccgaccagaaaacttcttaccattgggactatcaccactggtattgatgttattgcgaatcccggccagtttctgtggggtctatggattctcaattatgtttaacagttctcagaaaatggccatgacggccggactaatcggcgcggtggctaacaccctaagactggaaatggttgacctgacgagcgtcccacctgcagcggcagctttcatagcggccctggttgcaggactgattgcttcactggttaaccggtataacggatacccaagaatttcactgacggtgccgtcaattgtcatcatggtcccgggattgtacatttatcgggctgtgtataacatcggcctcaaccaaattagtgtcggcgcattgtggctgaccaaggcggccctgattatcgtcttcctgccaatgggattgtttgtggcaagagcgttaatggatagggagtggagacactttgattagagtgcggagccgagcggttagtaaccggagcctaagctgactttggccaaaatcgcttttgattttggccaaagttggcttaggtgcaggttgctgctcggcggagcacatttcaatcacagtgcggagagcaacgttttgacacggagagctaaggtcgctttgattgaaatcctgggcttggatttgaatcaaagcggcttagatcgcagtgtcagttgctcgcagcacatttcaatcccagtgcggagcaagccggttagcttttgagcatttatgtaataataggtgttgatgcgcactttgcatcaatgcctctgattggataaagcggagaaagctggcttgtgcagcacacctcaacaaaaagaaccggaccccaccaaagtggcgtccggttcttttgactcaaaatgtctacttaacaataatcacgcgcccatcatgcttttcctcaagcaactgatggcctttaacaaatccatctcgattaaacggtagcttgtagccgatattaatatcgagcttgccttcacgcatcaaatcgatcactgcctgcagagcctcgcgatcgctcatcgcatcagtcggatgaatgtgggcaaatttcaatggcttatctgtcattggtgagttatgggcaacactggcaatgacgccgtttggtttcaccatcgcaacgtcatcatcagttccggcaccattcattgcggtattcaaaacgacatcgccagtgtccgccagctcagtggccggatcggtctgatcataagcaacaaacttcgttgccccaatcgattcgacgtaatcttgattgtgactggaggcaatgccaattacattagcgccaatatcagtcgcaatctgaacggcaagtgatccgacaccaccagaggcccctttgacgatcactgtctgatcaggttgaacgttggcaaaatatttcacagccttataggcggtcagaccaggggtaatcagacctgctgcccgagtcggcgtaatcccatctggaaccacaacggtggcgtctaaattaccaagcacaaactcagcgtagccccgctcagtgtgggtcatcaccagttccccctcactgagatcggaaacccgctcaccgactttcacgatttcgccaaccacatctcgtccaggaatatacggtgacggcatgctgccaaaaccgccggcacgttctgcacgctcacgattgtttaagccaacggcaattgttcgaatgagcacttggttggcagccggcgttggctctggaacttcatattcttgaaaaacttctggatccccatgtttctcatatccatatgccttcataatatcttcctcctcatttgtctaactagcgcaattgtaagcgcaatcacgagttcgagcaagtaagtcgaatcgacctcataatgtaaaaattgagtcgaaaaattgtaaacaactaggtaaatacccacttttgtaggacattttatgtcatgcttaatgcataaatttataggattggaagttggaatgatgttagatatcatcaaagcaattattttaggaatcgttgagggaatcactgaatttctgccaattagttccacggggcatttaatattagtcaacgaatttatcaaaatgagtcaaaccactcagttcactgacatgttcaacgttgttattcagctgggggcaatcatggcagtcgttgtattgtatttccacaaactcaacccactttcaccaaagaaaacccacgtcgaacaacatcagacatgggtactttggtttaaagtcatcgtagcagtgctgccctctgttgtcatcgggttattattcaacgactggatggacgcacacttgatgaattggcaagttgtctcggcaatgcttctcatatatggggtactatttatcctcatcgaaaaccgaaatgcaaaccgacaaccgctattttccgatctcaatacgctctcctatcgaactgcctttattatcgggatgttccagctgctttccctggttcccggaacctctcgctcgggtgccaccatcttgggcggcattctaattggcacttcgcgatatgttgccaccgagttctcgtttttcttggcaatcccaaccatgtttggtgcatccctgctgaaagtctacaaatatttcagccatggcggtgcttttaccggtatgcagacagccgtcctgttgactggcatgctggtttcgttcgttgtggcctacttcgccattcgcttcttactgaactacattcaacataacaacttcaaaatctttggctggtaccgcattattttaagtctgattgtgattggttacttcggctttcttgcgcattaactctccaacggctgaccatccgccagattaaccttcaatagccaagtcaacatttccggtagcattcgctgccaatacagccaatcatggccgcctgcgccagtgtgataagcgactggtagctttaaatcgttgcgcatgtactgaacgaatcggtcattggttggttttagttcatcttggtcgccaatacagtagaagaagcgaagttgcctcagctgttcagatggcgattgtttagctaacgtttccaaatagtgctctggcgcgattccatcaagaatcccctgggcatccggcatcatcgctggcaattcgctcaaatcaactaccggtgacatcggcatcacggcactgaaccactcaggatgggtgaaagccaattttagtgctccaaatccgcccattgacgtgccaccaacgaagttatcctgtcggtcactggacaacgggagtagtttccgcatttccggcatcacttgcttggttaaataatcccagtacggcaggccattgtgcaaattcatgtagaagctacgattcatttctggtgtgatgaccgctaaattcgtatatttggtcaagacttccaaattagttttgcgaataaacccactgccattatcgcctaggccgtgcagcagccaaagcacttgaagttttcggtcactttgaatctcatttggcagaatcacatgaatcgttgtctgttcctctaatcgggtccaagctcgggtcaaagttaatattgccatctgcgtctcctttgttggttattcaaacttcttgagttgatcgtcggcaatttttctcagtaactgtttatcagcatttttactcaactgatccgctaatttacgcagcctcatatagttcacatgggcatcggtgattgtgccagtgtcatcttgaatatctttggccaacttggcacttttattggccttgttgggcgcaaaatcggcaaagtaggtcgacgcataccgtaaagtttttgagcgtttccgaacatgatgaacttccgggtagtccttaaaatcgagtttctcgaatagggcaactagtttgtgatttctacgattgagctccttgacaatatattggtgccatgcagtggtttgggtgaacttaagctgggttaactgctgttggacactttccaaatccttttttaaggttgactgtgtcccctcggttaaagtttgcgccatttcatgttgccgattgtcgcgtaaaatcttcagcaagccttggtagtcggccttcttatccggatgcgagtatgcgtaggcgcccgtctcttcaatcaagacgtccagttcccgcaaatcgccaaacaaattggctgcctgactgagattcgtatcgataatggtataagttgcgggtgtcagccgtcgcttcaagaatttaattaatccccgtaaggtacgaatcatgacccgcaaatcatgcgcccgctcgggatcgaacggattattcaaataacgaacccattcaacctcaatgtcagcatatctgtgttgtaaaatcgtttgaattgacattggcttctcccccttttaaccgccagtcggcagactttccactactgagtaaattttaactttaatgtagcatattttaataatgatgagttaatgattggctgagaaaatgggacgtaaaaaagccgagagtgggactaaaggcgttttgatcccagaatttaagagcacagatcgattattcctggttttggaatgattgatctgtgctcttaaatggccgggatcagccgattgtcgcacgtttttggtaaataatatgggatcacaagaaatagaggccgaggcaaaagcgtatacttttgtctcagccccggctttctgtataatagctggtccattcggtcgataccgatatctccatgaatgatgaatcctattcaaaaaatgaattgaaaattctatctgccaaactgccaccagtgctttttcttgccggcttcttgaaatcgcgcattactcggctggtagctgtcaggaatcttatcaccttgaggctcttcttcatttactgattcgggaatggtttgcttaattgaagaagtgtttttgctttcaagctgcttaagcttattttgaacatccagctgcagccgctgtgattggtccaataattgatgcaattctgcgatttgtttgtctttggcatcaatttgtttgcgttggtcctcaagctgttcagccagcaatgcggtttgctgatcgtcgctcttaactgctaactggttagcggttttcgttgactgcttgtcagcagtttcaacctggttcttgaattggcctttgagaacttcaacaccctcatctttgatcagaatcttgtttcccttttttatcgtatatgtatctctgaacttatcgtccatatgttttctaattgcagttttcgataccgataattcgtccgccaactctttgatagtcagttccataatgtcgcccccaacataaataatatagtttgcaaacagggtgtttgcagtcacacatcatcattatagtgattaacaagccgttcggcaaatgaattctgggtattccagctaatttattataacaaacatccttttaaaatgagattttaattagattttatgttgacaatctaataaaaaatgcggtaaactactcgcatgctgaatgcgaattcgccgatttatctacatatttgttgatcgaggaaggaaaccgcgatcgttttcgtatttacaaagtgtggtttccacaggacttggtttgtcattacgcaaagttttcgtttagcgcggatatttcatagagagattaggagtgattgtatgagtagtataagcgaaaaaatgtttcgaaaagaagatccgcttgtgtatcaagataaggattctcatttaattcgaagcttaaccactaaagatttcctggcacttggcgtcgggacgattgtttcaacttccatctttaccttgcccggcgttgttgccgctcaacatgctggtccagccgttgccctttcgttcttggcagctgcgatcgttgccgggattgtcgcctttgcttacgcggaaatggccgctgcaatgccatttgccggatctgcttattcatggattaacgttgttttcggagagttctggggctggattgccggctgggcactgctagccgagtatttcatcgccgtggccttcgtggcttccgggctttccgccaatttccaggggttgatttcgccattaggattcaacctaccaaaagcactctcaactgcttcaaccggaaacaacggcggcttgatggatttagtcgccatcatcgtcattgtcttagttaccacattactctcgcgtggtgcttctcagaccgcccgagtagaaaatacgttggttattttaaaagtgattgccattttagtctttattttcgttggtgcgactgcaattaagtcggctaattacacaccatttattcctaagtaccatgtcaacgctgatggttctgcattcggtggctggcaaggaatctatgccggtgtttccgagatcttcctggcttacatcgggtttgactccatcgctgccaactcagctgaagcaaagaatccgcaaaagactatgccacgaggcattcttggttccctggttatcgccgttgtgttgttcatctccgttgctttggtccttgtcggcatgtttaaatactcagattacgcgaataacgccgaaccagttggctgggcacttcgccaaagtggtcacgcactggttgccacagtcgttcaagcgattgcggttgtcggtatgtttaccgccctcattggaatgatgcttgccggatcacgtttgatctattcatttggtcgtgacggcttgctgcctaagtggcttggcaaactggataacaatttgcctaaccgggcattgatcgttttgacgatcatcgccatcgcattgggagcgttcttcccattcactttcttggctcaactgatttcagctggaactctgattgccttcatgttcgtttcattaggtgtctattctctgcgaccacgtgaaggaaaagatattccaatgccaagtttcaagatgccgctatacccagtattaccggcactaggattcttaggcgctctgggtattttctggggcttggatattcaggcaaaaacgtacgcattgtgctggttcattttgggaatggtcatttacttcgcatatggaatgaatcactctactgcaacaattgataaaaaagctgaacacgaaaaagatttgtaaaggttggtgatttcatgggtaaattagacaaagcgtctaaattaattgatgaagaaaacaagtattatgcacgttcggcgcgcatcaattactacaatctggtaattgaccacgcacacggggcaaccttagtggatgtcgacggcaataaatacattgatttgctggcaagcgcatctgcaattaacgttggccacacccatgaaaaagtcgtcaaggcgattgccgatcaagctcaaaaattaattcattacactcccgcttattttcaccatgttcctggaatggaactttccgaaaagttagcgaaaattgcgccgggacattcaccgaaaatggttagtttcggtaactccggctcagacgcaaacgatgcaattatcaagtttgcgagagcctatactggccgtcaatacattgtttcctatatgggttcctatcatggatcaacttatggttcgcaaaccttatcgggaagtagtctcaatatgactcgtaaaattgggccaatgcttccaagcgtggtgcacgttccgtatcctgattcatatcggacgtacccaggagaaactgaacacgacgtgtcactccgttatttcaacgaattcaagaagcccttcgaatcattcttacccgctgatgaaactgcgtgtgtcttgattgaaccaattcaaggcgatggcggcatcatcaaagcgcctgaagaatatatgcagttggtttataaattctgtcatgaacacgggatcctgtttgcgattgatgaagtcaatcaaggactcggccggaccggtaagatgtgggcaatccaacaattcaaagacatcgaacctgatttaatgtctgtcggtaagtcgctggcatctggaatgcctcttagtgcagtgattggtaagaaagaggtcatgcagagtttggatgcacctgcgcacctgtttaccactgccggcaatccggtttgttccgcagcttcgctggctaccttggatgtgatcgaagatgaaggcttggttgaaaaatcggccaccgatggtgcatacgccaaacaacgtttcttagagatgcagcaacgccatcccatgattggtgatgtccgaatgtggggcctcaatggtggaatcgaattggtcaaggatcctaagaccaaggaacccgacagtgacgctgccaccaaagtgatctactatgcctttgcacacggagtcgttatcatcactttggcaggcaatatcctgcgtttccagccgccgttggtcattccaagagagcaactcgaccaagcgcttcaagtgcttgacgatgcgtttaccgcggttgaaaatggtgaggttactattcctaaggatacaggtaagattggctggtaaaatagcattattcaataaagcaaacggcacgaatcccaatttgagattcgtgccgtttttatatctattcttattgaccatgcctcataaaggctttatatgctttcaccccaaagtatactagggcgactgcgatcgcaatgacgatgataaaagtaatcacgacaaagataaaatcgccaacgtgaaaaatccccatattgattcccccaatcattaggattcaaaagtaccgttcgcactcaaattcattatgacgtcaaatctgcagcattccatgtctgcttggtcattttagttcaaagtccatgacttccggattatgatcagaatttttgaaccctaacgatttgacatgaacccgattaacctgcacgttgtctgaaacgatgaagccatcaattatcgacgtaaaggtctttccaggacgatacggtgtcccatttgcccgcactgaaggcacttttgcctgggctaatccctgcttggcaattctaaatccctttggcaattgatcagccgggaacgggtgcgtccaattcattggtttactggtcgttttaaagacggccgggctattgcccaacatatcatggttataatccccagcaacgatgacgtaattgcctgcctgctgctcagtggtcattttggcgaataacttattgatctgagcttttctcaccttggcattcttggtaaaggctgagagatgcaggttgatgactgccaactgatgcccattggccactgggatatgggtcaccgaaattgcccggtccaagtccatgaatttattaaaatcggtatcaatcggcagctggtatcgggtactatctgcaatcttagcttgagcaagggtcaacaatcccgatttggctttcccgattggccgggtgagcggataaaacaggtaggctgaattatagttttgggcatagacgctcgaatagccattcatccgatccctgagccactggacttcattcacgtgaaatgaacggtcaccgtcggtatcgacttcttggaagaacatcaaggccggatcttcttgtttgacggcttgatagatgccattgaggtcatccaagacagagaatttgctaaatgcccgcgaatatttgccgccatccataaagaaagaataattatccggataggcagcatagccaatattaaaggtcatcgccttgtacgggtgatttgtctgtaaaatttgcgagttccggttaaccggtttgagtttaacgttgtcgggcacccggtgatacgtcagataaacgtaagccacatatgcaccgacaacgagtaatagaccggaaccaatcagtaaaagtgctttccagaattttttcataagaccctccatacctaatatcatatcaaatctacagccgaacaatccaaaaatatttccaaatattggtatcgtttacaaggctttaatgataaaatttaggtatatttgttcatacttttaggaggggtcaatcatgaagaaatcacatttttggtttgcacttttatttgccggggcacttagtattggggtggggacatcttcgcaaactgtttccgccaagacagttaacatttatttgacccgtcatggtcagaccatgttcaacgtcaacggacggggacaaggctgggctgacagtccgctaacggataccggggtttccgttgcccatcaactgggttacggcctttatggcttgaagttcaaagctgcctattccgctgataacatgcggacattccggaccgcaacctatgccttgcagtcatctggtaacggcaacctgaaagttaactggactgccaatttacgtgaaggcggctatggtagtttcgagggacaaaaatacgatgacgtcaacaaaatcaccatgccgctgttgaaaccagccggtacttattcaggcccacaagactttggcaaagctcaacaagcgcttggtaaagacttctggccggcacttcaagatgcgtaccacgctgccgaaacggtcgactttggtaaatacagcgacccaactcttcctgaatcattgaaagcagaaagctcaactcaagtaatcgatcgaatgaacaccgagttgacttatatcgcccaaaaggctgaaaaaaccggcggtaacgtcttagtggttagttcaggaatgtcgattccagagtggttgtccactcaaaagaactatacggttcctggtttcgttaattggggaaatgaagcaaccatgaaggtgacttataagaatggtcaattctatttcccatcaaatgtcaccgacaagaccatcctttacaccatcaacaagggagcagctttgcagcaactgccaaagaacaccctcaaggtcaaaaagttctatttgaataagaacaaggtttccggttccacttccaccggggcgtcactggtcttgcaaaacaccaagggatcaaccttgaagaaagccaacgcaaactcaaacggaaactttgtgtttaagttaagtaaagccactttgaacaaactcaaaaagggcatgaatcttaaattgacctcaacccctaagaagctgtccaagatctatgatttttgatatacttctatgtaaaaagcgagtttaagctatgaaaaattatcccagcaatattactcggcaacaatttgaattaattcgaccagctttagaaaattttcgtaagcgaactaagcctcgaaaatatgacctctacgaggccttctgtgcggtcctatatgtcttgaaaaccggttgccaatggcgtcaagtccccggtgatttcccagaatggcggtcagtttacaactattacaaaatttggtcaactaaagctgagcctacggctgattctttattggaacaagttttaa

SEQ ID NO: 164 - DNA, 24992 bp, Lactobacillus buchneri
ggctttaaaacaggatcatagtacatcacggctgtataggcttgttcctgtttaatcattggtaattcattaaaattgccgttaggaaaggctcttcttaaaacttcctggtattgggtttgaataacttgcttaacagccatgattgttcgcaaatctttgactgcgcgagtaatcttttgctgctcggttggtgaatacttttctagtagaccttgatcaacgtgttctagactttctaagctatcatcatgaatcatcagcgtatatttaagctcggttttgacttccttttcttgttgcattaataacttccagccaacgtatggccgtttggtaaaggtcaataattgtcggaccaataaatcatcacgaatattcattaaacgttcgtttaattcactgcctttgaaaatcgtttgttcactattagtttctttaatcaattcccgtcgttcagccgcggttgtctgttcaaaatcaagctctggataaagttttttcgtcgtgcgatcgaccactttatttaagagttcatctgcttttttgagtgagctttcttgttggttaatcgtcaataattgcttagtgacatcttcaccaacagcgtgcttaattaaggtaccgtttttccaattaaatagcatgcgccgcttatcatctaaactttccaaactaatataagttttcagttcgtggcttaactctttgaccacttttttctcgttaaacgagaagtgtttacttaggctatccaaatgccctcgattaatggctttttcttggttgtttttataactggctttggccttgcgatagttcttaacttgttggttaaattcttttctttcatgccgtttgctattgattccctcatgttgcattggggtatcagctattccttcctcgataaatgatttttcgctgatccgatccggaatatttttttgtgctaagaactgattaacactcaacgcccaattttttcgccactcattaattttttcctttttatcccaatcaaccaaccaaatttttctttgttttggaaacccgcttttggttaaaagttgcttgccattttcatctttaatgtactgcgtctttgcttttaatccccaactaccatcggggttaaagggccgattagttaacatcacatgagcatgcggattatccgggtgatcgcgatgaattgctacgtcagctaccataccttgatcgacaaaattttcttgcacatattttgtcagtaattctttctgttcggattcacttaattctaccggtaaagccacgttaaattcttttgcataccgtgagtttgatttacgatcgttcttttcaacttcattccataatttttctcgatcactggcccattctggtgcattttttggggttaaaataaagctttctggcataaccgagcgggcataaaaatagtggcagccttcttgattatcaaataatttttcaccacttctataagcggaactggcaatggcactgcgtcctttaccggcactaatattactaaaactcatatgaaatattgacatgttagtcaccgtcttcctttgattctatgggcttgactttgttgtcgccaccggcgacttctaatacaggatttttgggttagcacaacatagaatttattctatgtgtaagtgcgccttggcctcgtttcactcggcctgctgattaccatagcttcaattcagtgtatgactttcgcttcgttatttcaaatttaatactttgacttaacgttttgcttacgatatagtatccatgattattttcaaatatgattggagggataatcatgtcgcaaagtaacttagaaaaacaagaagctaaattaaaagcccttaaccaaaaaatcaaggacgaaaaaaataagattgaacaacgattaggtaaacaaattagcagtcaagcaaatttagatcatgctgatttatctaatgataatatcaagtttttatcccaaaaagtggccgagtttttaaaggaaaatcaagcacataattagttttagataatggggttgtgttatggctaatcaatatgaaaaactagttgaacaacaagcgcgtttaaaacaaaaaattgagctggaagattttaaattacggcaatctaaatattatgaaagccgacaagaccgcaaagctcgttctcgccgattaattcaaaaaggggctttgctagaaaaatactttcaagctgataacctttcggtcgaacaaaccgaagagcttttaaaaacatttgccgattacgttgatgcccataaacccaataaactaaaaaacgatcatcctaataactaggccgattgtttttattttctggatcattttttggtttaatttctgggttctgatccgcaaaatcttttaattgtttttggattcttttactagttttgtctttaactgatttaagcgctaagtttgctctaatttgtaatccttgaatgccattgtcatatgtccactgtttaattctagccatgtcattagttcgataataattggcaattagttcgttccattgatcccacttatctaacggcacattgattaagcctgcaccaccgtcaatcataattttattagcacttaaagtcgccgtccttttgttcccgtcccaaaagatttgttggcgcatattatgatacataatagtcaatgctttattagtggtcgttgtttgtggatcagccaaaattttttgtaaaaaggattgttcttgtttttcgttaattaagggtggttcaaaaaagtcttcactgcctaaatcaactcctccttttccttgccgtaattctcctggtactaaggcgtcttctgcggccacaatcttgttaatttgtttttccatggttaacgttaaagaggcattttgatcagtgatatattgccacccacgctttaagttaacaattgtcaaaatatcttcaacaggaacgcctgccacactcatgccatccataatggtttgtgtttgcggcaaagtggtatttacgccttcaaagcgggcattagtgtgcactagcttggtaaagtttgttcgagcaaaccgtttgttttctgcaactgtaaattgatacttgtccatatatgcttgtgtcttagtcatattttgtgcctccttttcattccaaccactgattctttgactcgtccatgttaaattacgaaatgcttttcgttgataattttctcttggcgtttatctaagaggtaagtgtgtaccgcgtcaaacaacttgcgtttatcaggatctggattatgtgccgcttgttcccaaatttcttgaatgtcgattgcccaggggtcagccaacaattgctcaattttttcgacttctttgcttgttgggtcatttaaaaagctcctttcccatctttctagattagttatcgcctattcagctatttagggctcctattttagcttctaagcgattttaaagcgattttaatataattatgcatgtaacacttaaaacggcttaaatgagcccatatgacgtttaattccaagaacgctcattgtcagtgttctgctcctcggggtggttagccgcatattctctagccgcttgtttattccaccaaacgccaaataggttttgcatggtgccgtacaggtagttctccacgttcttaatgtgcttctcattgcttctaagagcgttaaagtagcgtctcaaggctttggtcattaaaggcttcagctcctcatcatcaagtgggattaggaccccaatatcctgatgatccttctcaactcggtacttagcatttaagataatgccaatgaagcgccgcatctgttgcggggtacgacaccaaaaactaagtagttgcacagcttctggttctaagaaaaccggtaaaccactgtcttcatcagttaagaaatcattagcatgggtcaccaaatcctggttttgcttttctagttctgctggtgagaattgggctgtggaaaagtccaacttttgagtatctatattgtatctattgttatctatatctttaaagtctttatatagattgctttcgattttcgaaatcccgctcgtagcaaggggtttctggttgtctttaacgaagtcatgcggactttcgattttcgaaatcccgctcgtagcaagggttccagcgaagtcatgcggactttcgattttcgaaatcccgctcgtagcaagggctttcggcgctttcggctcatattcaccgcgtaaatagacatcggtggctttgacatcaagtttggaaaggtataaacgattcggttcattctttttagttttcggattaaatcccatttggatttgttttaataaattggctgcttgtaattcttttttgattttaacggctttttcagtagcacaattaaataagtcttgtaattcttgaacggtaaaaataaagtaaacgtggttatcttcatcaacccagttatttctcaatgaatactctagccgatctttgagtaccatataagctaatttagcgtcactgcttaaatgcttgtattgatcgccatacattaataccttagggaactggaaaaatagggctccatatacgttatcggcttcatagtaattgaaatttgtttgatccatcataaaaactccctttcttgactgacacacgctgtctcaaaagagaattgctaaaacatttgatttgctttaaaatacaaatctggtatgctctaattgaattacaaagctttcatttagccgtgtgggctttgtaatttaccagcatgtgtctatttcttggttgcccagtcggcaacttttttaatttctaacaacaaaaaatggactaaatagctctggtgagctacttagtccattgactttaatttgtttttaactatccttaacttgtccttggggactggtttgcggtataattaacctacaaattaagaacaatgttcagacgattttaacttgccggtctaaatcgtctgaatctaagtagctggcttgtagctacttgctaaacccaaaatcccagattcctcgtgaatcggggatttttctgtttagcttgatctctttattcggttgttaaattagtcatagtctagcatagtgcttacctaccggcaactttattctgtcttgtatactttaccagcccccatcggtccgttgatcagagacaaggtcttcgtatcaattattgctatcaactatttgtgatttcatcattttccccactcaattattcttgaaagtctctataagcattttctattatggtatctaataaggttgatcttgattttgcgttcaactgattaaccatttcatctaaacgatcaatattcttttgttgaattgagaagcttgtctttacttttcgttcccaattcaatttttcgttaagtgcatctttttgctgaatgtctctagccacttggtaatcgttgttggtacttgaaaacttttcaaatttgtttgccataagttaatcattcccctgtttttggatttctgaaaacacgtcacttaatagtttgagaaatggctcttgttcatgcaacttgtcattctgggttgcatattctagtatgccctcctttgcaagcatactagcgttaactaattccttttctgggataaccccaatgacattatctatatgtttgagtgctgataaaaattcgtgagaagaattagtattgtgtttgattcgattgcctaaaaagaatacgttggcagtaatatatgatttaccactaactggatcaacaacttcatcttgtaaagttcccacactttgcaatacttttgtatgactttcatacccaaatcgacttggttccattggagaaatgattttatcggctacagctacaccatttttgcttaacaggttccaagctggtggcaagtcgataattatgtagtcatatttttgattcagttcttgcgcatttttaacaaaccacataaataatagcaattctttatttggttttgaagctaaacgatctgctacttcttccaggttgctagttgatggaattatcgcgatattatcctgaacttgtgtctcaattaacccggagcttggtttttctaggacatctgcaatggtgggctttccactgaaattaaaatgtttgttttcaaaagtgcccgtcaaactcttctgtgcgtccaaatcgatcatcaaaactttttgatcttgtgtttgtaaaaatttggcgaactgaaatgccattgtggttttaccaacgccacctttgatagccataaaactgattacttgcataacacactttcctcctaacatataaagataaaggtaatacttaaagaataccttgttctcctacatagtacgactttaagaacacaaaatcaaggtaaaagtagtactaatggaatacataaaacgcataaaggtatttatttggtggtataaataggtttcaacaattagtcttacctatcatctgttaacattaaatttctttcgataccttataaaggttgttcgtttaatcccagtattcctagcaacgtccacgtcactcatgccagctcgataaagcttaaaagcatgttgcaagcggggatcgtcttgggtgtattggggtttgcgcccatgatatttaccctgctgcttagctaaggcaatcccttgctgctggcgctcaatgattcgcttacgttcactttcagcctgatacttatagagttcaataatcaagttggtcatcagttgacgtaaatttgggtcagcaatccctgtcatggacggtaaattcaacacatctagggtggcacccttattttgaatggtgttcatgatcttagttaaatccaggttgtttctgcctaagcgatctaattcagtgaccattacaatatcaccctcacgaatataggccagcattttttgcagttctggccgattagtgttagccccacttaatttatccgtaaataatttatcaacgcctcttaaagccgctaactgtcgatctaaatgttgctccttggaactcacacgcgcataaccgattttagccatttccaattctccttttgggcagttctaatgaacacttgtaattcctagtatagcacagaaataaaaacggccactagggtataccctaatggataaaaacgtaattgatttaatgggccaacgttgcggcaacacttcaaacttgtgtaattcattacgtttggcgacctaaacggtcgcctgtagattgctcataacatccaatttaaagttaactcctgagtagccaccatcaactaagacattttgaacctgtcgtaaatgcatggcatgtaaagcgatcattgcactggccccgtctctatccgaaacatttgctcgtgtgatgtgaatggcttgaggaaacccgttaatatcaacggctaaatgccgtttaatccccaagatctttttaccagcatcgtaacccttgttttcagcggtggcagtatttttaacgctttgagcattcacgataataaaggaagttaacgccgaacgatcttgttgagatcgtaaggtaaagacaactttttaaaacttgggccagtaatgacggctctgttggagccgactgctgtgaccacaagcgaaagtaagtataaaccgtttgccatttaggaaagtcatgtggcagggttcgccactgggatccgtttttcaatatgtataagatcgcacaaaagacgtcataataaatcaacttggcggggcttcgttcgttgatgaaagttttctaattcaggacgaatcacttcaaactgctgacgggtaatattattgggataattaagcatgataatttccttttttgtaaaagtttattaaagtttaaaccagatctcaaacagtttctaaagaaaaggcttcgcctgatgcgttgtcttttccggaaggcccggcttcgcgtggaaatcggttgaccaagaacatggtgagttgaactattcgctataattcattaagatacatcttaaaaacaaaaagcggtccaagtgtttgggtgatacccggtggaaaagaaaggcgattagcatgacaatgaccaatgaggcagtattacgcgcatttcacaacgaaatagaagaaacggtgcccgtttcattttggcatcactttgcccccagcgggtttgttgatggtctccaagacgaccatcacacgtacgatctcaatgtgcacggccacgaagcctattaccaggcgcttgatctggacttcgtcaagacaatgctggatggttattatgtggatccggtgctcctgcccgaccagccaaagacttggacgatgttacgtgaggtacagccgatccaagccgacgaccgatggatcagtgagcaactaagtcttgccaaagcgcaggttcaggcagcacagggtaaacttacgttttacacagttttttcaccattgacgatgttcaagtggagtctcatggatcatgccacggcgccaaccgatgctggtgatcattgtttggccgacttatatgaagcagattcaaccgctctcaaacgtctgctggcgcaaattggagaagatctggcaaaattgatccgccaattgccgccaaccggcattaccggcatctattacagcacccagtccattcaagacgaccgcgttaaaacggcggattttttccatgctgtgatcgaacccgtggatctcgcggtgatcgaggcaatcaacgatgcctttgcgctcaacattttgcatgtctgtggcctgcatggtgcgacgaacgatctgcggttgtacaaagactaccctttacaggtcgtcaactgggccactcatgtcgatggctacagtttggctgaagggaaaaaactgttcggcgataagccggtactcggtggttttggtgatgggacgcaagacattctttatgccggtaccaaagccgagatccaggcagagacccgccggctgatccaagaagccggtcgcactggggtgatcattggggcagattgtacggtcccacgcgacacgccactcgaccacatccgttgggtacaggaagctgcgcggaatttttcgaaacagtaacatggtaatggcgcatttaacaacgctttctgtattctttgccttgacagcacaactcgtttagattattatttttttaaaagttagtgacagttagatgagtaatccgtgagttgattatcagagaggccgagttggtgaaagcggtcagtcgatcacgtatgaagatggtctaatgtgtgtcgttgcggtgagcttgtgcgaaccgtgatcgggagcgcccgttattgcacagggacttagatgagttcacaaagatggcgacattggccgccaaacaacgagtggtaccgcgcagattgcgcctcgtgactgataacagtcgcgaggcgcttttgcgtgtttggctacataacggcggcgcaggcgtggcatcacgggtcgtggtcgacgttatggagaattattaaattgattagatgaggtgagatcgtttgaaaaatggtacaaaacagtaccgattaggaatcgatatcgggggcacatttacagatttttcgctttacgatacgcaggcgtgcacaactcaggaaatcaaggtgcgcaccgacacgacgaacccggccgacggggtgatcgaaggtctcaagcgttacgcagcgaccggggtcgacctcgggcaggtggattacttgatccacgggatgacgataggcttgaacacgctgttgcagcgccaaggcgcacatctgggtctactcgtcacaaaaggattccgcgatatcttgaacattcagcgtctgcggttgccggtgccttatgactttgcctcgcgcttgccgacaccgctgatcccgcgagctaatgtgttcccaatcactgagcggctggacgccgcgggccacgaacgcgagccgatcgactttgcgtcggtcgatgtcgccgcgaagagtgcgatggcgcgtggtctctcgggcgtggttgtgacctttcttcacagctactcggcaccgcagcacgaacaagcggtgaaatcatacttgaatgctaattatccgcaattagacgtcgaattgtccagcgacatcagccgcgcgatcggtgaatatgagcggacaatcctggcagtcatcaacctctacatcaaacaaagtgtcaaaacgtatctcacgaccttgacagctaaggtcgaaacccaaggcgtcggcaacgtgccgctggtcacgaagagcaacagcggcatcaccagcattgccacggcggtggcccggcccgtcgatacattgttctccggtccggccgccggcatcctcggcgcgagccaagtcgccaaggcgaccggcaacgtgaatgcgatcacggtcgatatcggcgggaccagtgccgatatttccctgatcgacgacggcaaggtggcactcacgcgacgcaatgcgatcaatggatttccgatcacggcgcctggcgttgaactgtattcgatcggcgccggtggtgggtcatacgcgtggttagatcagggcggcatgttaaaagtcggtccgtcttcagccggtgcgtatcctggcccggccgcctatggcagtggcgacaaaccgacgctgacggatgctttcatcacggccaacttcttgaatctggctgattttgccgggggcagcatcagcttggatgcggcccgcgcacgcaccgcagtgggccacattgccacggcgatcggcagttcgatcgaaaccgcggccagcaagattatcgatgtggtgatcgcaaatatgacgactgagttatcgagcattttgagtcagcggggcatcaacccacgtgaatattcgctggtttcctatggcggcgccggaccggtgttagcaaactatttagccgacgaattaaatctaaagaatgtcgttttgccgaaagcgcccggcacattgtgtgcacttggttcgctgtatgcagattacctgttcaacgatgcaactgtgtacttcaagcatctcgatgcagtcgatgcagggctggagccgcaattgacggctttggccaaaaggggtgaagcttggctggcccaacaacaacaagcccatgtcggtgcggtccaccataccttttccattaatgcccgctacgtaggacagacgctggaaatcagagtgccgatcgaagaagcatggctgaagacgccaggccagttccaacaagaggtgcgggcgcgctttgatgcgttgtatctgcgtcaatacaatcataattcgccagataagccaatcgaattgacacagttggctatccagttgcgcggcgaaacgccgaaaccgactcttgccccacccagcacgaccactaccgtggccacggctacgacccggcacatcgtgttaaacggggccgcattggaagcacaagtcttccagcgcaatcagttggccagtggccaaaccttcaatggtccggccgtcgtcgaccagccggacaccaccatcctggttttgccaggctggcagggccgtgtggcggccgatcagagtttaatccttgaaaggagtgagccgaatggcaatgaatgatgcagcccaactcgagatcttgcgcaattatttcaattctgtcgtgactaatatgggaaacgtcatcgagcgcacggccttttcgacctatgtgcgagaatcggccgattttgcgactgccctcgcatctccagcgggcgagttttacgcttatcccaccactgtcggcgttaccatttttctcggcctcagcctgcaacgggcgctgaaagaagtcggtccgcttgaagaaggtgacattgtggtcactaatgatccatataccagtaacgggttggcgacgcacttagtcgatatcaatgtgttcaaaccaatcttttaccaccaccaattggtgtcgtattcttggacgttcgtcaacgtatcagatgttggtggcaacgtgccatccagtctctcgccaagcaatacatccgtgtttcaagaaggcttgcgcatcccgccgctgaagctgtatcaccacggtgaaccggatcaaaatgttttgacgttgttggcggccaatacgcgcaccccacggctcaaccttggggatatcgatgcgatggtttccgcggtcaatacgggagaaaaggccctactgcagatcatcgaaaagtttggtgaagacgctgtcacccaaggcatgaccgatctgatgggccaggccgagcaccgggcgcaaaaggtgcttgggacgatcaaagacggcacctatgcgttctcggattatctcagtgacgattacgagtcggatgtgccgatccgcttggcggtcaaaacgaccatcaaccacggccagatcgacttagacttccacgactgcgatccgcaagtgcgcacggctttcaacatcatgaccaacggtgagaagaattcgttcctgctacaaggcctgatcaacttcatcatcagccgggatccattcatcccgatcaatggcggcattatgcgcccgatcacggtccatatgcccaaagggaccctgatcaatccggcgtttccagcccccatcgggatccgccacgccatcgcgatgcggatgtacaacgtgattctcggctcgctgttgcaagccggcgtcaccgcgatccccgcggctggtgcgggccaagcggccatcgtcgtgttgcacaacgattcgacgtcgtcgccgctcaaaaacaagatggccgtggtcgaacccattggcggcggcggtggggccacctcgatcgctgatgggatcgatggtatcgaccacgcttctggtttcttaaaaaataccccgatcgaaacgcttgaacagaatatggacattttagtcgatgaatacgagtatcgtggtggcaccgctggggcgggccggttccgcgggggcaatgccattgcactgcaatatgagatcacccagccggcggccatcatcacggcgcgaggcatcgaacgaatgaggtttcagccgtggggcgtgtttggcggccaggcaggcgaagtcggcaagcttttccgtacccgctccgggcagcgcgagcgcattcccaaaatcagcgtcctgccggttcggcaagatgacataatcactgtattgtcgccttccggtggcggttatggcgatccgttcacgcgtgagccgggcgcggtggtgaccgacgtcaacaacgatctgcttagtgcagaacaagcagccggtcagtacggtgtcacagtcacaaaagccgcggatggcacgtgggtgctcgatcaagtcgccacgcaggcttcacgggccgcgcacacaaaagcggcgtcaaaccaatgggcgttcggtgattatcgcgagcaatacgagcagcggtgggaaccggcggtcagcgcatatttggccgtggcattgcggcgacgtgtcgcgccggaattgattccagacttgaaacatacgcttcacacgcattttgatgccgcagcgcacccgccgacacaggcggatattgacacctttttaactgaacaaggctatccaaaaaggggagaatgacgatgaaaatcagtggttggaagaaattaggattactggccgcatcagtgatgcttgtattagcggccgcgggctgcagtaccagcaacaaaggtaccacccaaagtaaagataagacggtcactgtcgccatatattccggcgactgggctaagagcattcaaaaatcggctttcaaaagctttacaaagaagacgggtatcaaggtcaaaacggtgcaaggtgccgacgctgagtggctcacaaaactgaatgccaataaaggcaagactgcaccatatgacctgttaatcctgcaaccggattcgatcgaaaaggccgaaaaatcaggcttgttggaagcgttaaaaagcagcaaagcaagcaatctgaaagatttatacccggcgatccaatccaagctgactttcggcagcaaagaatacgctgccggcttctccgtcggccaactgggtttggcgtatcgcaccgacctggtcaagaatgtcccgacgaaatggtctgatctgtggaagtccgaatataagggccacatcgccttgtcgccgctgacctattccgccggcttgcagactttgtccggtttgatcaacgcggaaggtggcaacgaaagcaatgctaaggatgtcaccaaggtgttcaaacgcctcaagacactgaaggcgagtgtcgtttcgtatcctgacaatccgggctccatccaaactcttttgcaacggggagatgcttgggtcgtgccattttgggacgggcggatttttgctttacaacagtccggcatgaagctcgggttctcatatccgaaggaaggcgccgttgccgccgttgcctcttggtcgatcgccaaggacagcgcccacaagagcaacgcctacaagctgttaaattacctgtcctctccagcggtccaaaagaagttttctgacacctcgtattacgggatggccaacaagaacgtgaaatacgcgcctaaggtcaagtcccggataaaaacggggaacagcgaactcaaaaagctgaagtgggtcgattatgatgtcgccgacaagaaacttagccaatggaccacagactggactaacgcattagggagtgggagtaactaatggccaaaattgtttttgaacacttggattacgcatatgccaaaaagaatgtgctgactgacgttaacttaacaattaatgatggcgagttcttctcgctgctcggccccagcggtgttggtaaatcaacgctgctcaacctattggccggcttcttgagtccgcagcggggcagtatcttcatcgacgacaaagacgtgacccgcctgccgccgaataagcggcggttgggcctcgtgttccagaattatgccttatttcccaatctcaccgtagcgggtaacgtggcgtacgggttgaagatcgccaaaacgccccgcgccgagatcccccaaaaggtgacggatgcgctggcgctagtcaaactcggccaatacgctgagcgcatgccgcgtgagttatctggcggccagcaacagcgtgtcgccattgcgcgggctttggtggtcgaaccgcgcgtcttgttgcttgatgaaccgctgagcaaccttgacgccaagttgcgtaaggaaatgcgaatcgtgatccgagagttgcagcaacgcgttggcatcacaacgctgctggtaacgcatgaccaaagcgaggcgctgagtatctccgatcggatcggggtgcttggcgacgcccacttacagcaagtcggtaccccgactgaggtgtacgatcagccgcaaaatcaatatgtggctaatttcattggctcgacaaactttattaccagcgacgcgcacaatgggcagctcaatttggcgcttaaagacgacacgggcaaacaactcactttagccgcagccgcggttgcaggaacaggggcggttgccggcgagacgacgctgatgatccggccggaaaacattcacttgatgaaggaggcgactgatgcgaccctcagcggcacgatcaccgagcttgaatacctcggcaatgcggtgcaggggcggatccaatttgccaccggccagctgaccttttatcggttagtcgatcaggctttgccgcctgtccatgccggtgatgccgttaacgtgctggtcgatgagaccgcctttgtcgcgatccatcaccatcacttgaaggaggcgggggcatgaggggccaaaatcgcaccgggttgttgttcgtgccggcgctgttgtttttactggtctttttagtggtgccactgctgattttgatccagatggcattcaagtccagcggtaacagtatcaccatcggcacccagttcactttgagcaactttaaagcgatcttcgccaatgagacgttttatggcggtttattttcaaccttgaagttgagtgtcggggtgtcgctgatctgtattgtattggcctattttccagctatcgcgctgagcaaagcacctggcaacacccgcacagtgctgtacgtgattttgttgtcgccgatgatgaccagtgtcgtgatccgtgtctactcttggattgtgatcttgtccaataacggcatcatcaatcagactttggaaaagttgcacctgattaagtcgccgttgtcgctgatgtggaataccagctcgttagtcatcgccttcgtgcaggtgctgttgccttatggcatcatcttcatcgccaactcgctgagcaagatcgaccgcaatgtgctgcgcgcttctgccagcttgggggcggggccgttacatacttttttccacgtgaccttgccgctgacgattcccggcattttcagcgctttcacactgattttttcactgaccgccggcagttacatcacgccgatgctaatcgcgagccatcagaagcaggtgagtgctttgacgatctaccaacaggcgatgcagatcatgaatttgccgatggcggcggcgttgtctgttgtactgctgattgtggtcatcatcgtcatcaccatcgccacggcgatcgaacggatgtgggagatgagagtatatggttagacaaaagcacattcaatctaatgttggcttacgcatcctgttttgggtgatcactggtctgatcttcgcgttcttgctgctgccaacggtcatcatcattttgtcggctttttcgccgacagaatatgcgacttttccaccgcaagggttttcggtcaagtggttcagatccctgtttaccagtccgacatggatggcggccatcgcgaacagtttgaagatcctggtgattgccgtgccgttggttacgatacttggcacactggccgcctatggtttgtatgtggcgaatttccgcggtaagtcacttcttcaaaccttgatcctttcgccgatcatgatgccggcaatcattctcggtatctcttttctgtacctggcgacctcgaccggattgctcgggacgtatacgatcatgatcgcaggacatatcatcgtcgcattgccctatgtattccgttctgtcaccaatgtcttggttggcctggacccgaacattcagcgcgcttcgactatcctcggtgcgtctccttggcacacgtttagccatgtgatcgtgccgaatatcaaaagtggcattttatccggggccattttcgccgccatcacctcgctcggggaggtttcgatcagcctgctggtttcctcggccaccacgacgacagtaccggtgcagacgatgacctatatcgaccaaactttcgacccctcggtcaacgctgtggccgtcattttcattctcgtggcggtcatcctgatcgctattttggaaaaacttgctcagaaatcaaacacggaggtgttttaattgagtaccacatgcgatattccgactgcaaaatcacaaccaaataatattcaagtgtccgcattgcttgccgccttgcccgacgaactcggcatccgcttcggccaaaaggaagccaagcaccgcatcgttgcgttcttgaacgcggcctgctccggcagtaaaaaatggctcgacgccaattacgaaatgattgccaaagcagcgaccaatcaacaagtcgttttgcagatcctgttgtggaacaaacccaacctcgaacttgtcaacggcaacattgcccagcactatctgcggatcaacgacccgcggacactcatcatcttgcgggatctttatgcgcatcaagacgcgttcaaagcgatccgtgaagaggcttccgtgatcggctacgtggaaaagaaatatcacacccatcacgaaaacaaccagtacacgatcgacctgatcgataaactggcgacagaaaatggggtgcgcgtggcaccgaccctgatcgtggacgagaaagcttacgtcggcagcgcgagcatcaacggcactgatttagcttcgctgttggcgtaagggggcctggaacttggaactgacagaggccgaatacaaaacgtcgttggccacgttggcggactatctgaaaatcagatcagtgccgcattccccagccggcgtcaaggcagcagtagacttcctgcagaagctgatcaccgggcttggcggcacggtgcaggtgctggacaacaaaggccatgtgccagtgttgtatgcacatttttgcgccgatgaacctgccgctcggactttattattttatgatcactatgacgtcttggacgccggtgacctggatgagtgggcaagcgatccatttttgccagaagtacgcgatggcatcttgtacgcacgtggcacctctgacaacaaaggcagtctgatacagcggttgaccgccgttgccaagctccggcgcgcgcatgcgttgcactgcaacgtcacctttttcatcgaaggggaagaggaaactggcagccaccacatcgaaagcaccctggcggcccatccggcgttgttcgcctgtgacgcttgtatctgggaatttggctcccgtgacgcgcgtggcaatgtggaattgttcgccggggtgaaggggctgctgtatgttgagttgacatgtgtcactgctgatgttgacattcatgccatgtttggcggagcgatcgaaggggcgaatgatcgcatgatcaaagcgttggccaccctaaagaatccagctggccgcgtgcgtattccgcatttttatgacagtattgccgctgaaatgcggccacggttgctaatgtctgtggataagttgccgctgacccgtgctgacctgcaggcagcctatggcctgcggcagccattgcacgttggaagtgatgcgcaattacgtaaacgtcttacgtttgcccccacattgactgtgagcggcttggcgggtggttataccggcccagggcaaaagtcgattgtgccgcgtcttgcgacggctaagctcgacattcgcttggctcggcagcaagatcctgttgaagtcgagcgacaactgcgtcaatatttagcagctggtggtttcagcgatattggcatcacagtattggaagctcagccgggatctgggttggatgacctcgatgatccgttcttggcattggtggccaagacagcagcaacggcttatcacagcaatgtcatcacttacccggtttcttttggcaccggtccgttctatttatttaaacgttatctgcatgtgccgatcgtcagcaccggggtcgggtggttgaaagaaaacgcccacgggcccaatgaatcaatccgcttggtcgattatcggctggggatcgggcacatgttggcggtgttagcgtcgttttaacctagagaatatggcctctcggcgggcgattttaatgcacaattttgatgacatctggacctggagtggtttaggtgccctttttcgtggcttcacctctcttttcggtttaatccagacccggtgatgcaatatgtagatgaagaggtttgtctagtgaccgcatacgtcagtggtacacctgcccgcttatgcgatagatggtaattgtcgacttgccgtttgagcatgccaaatctgcgggatagtggatccaggatcgagcgccatcagtgagtggaccaatccgtctgaaagttgttttccgcctgacaatcggctcatacacccttgatgctcacgcgcctgaaagtcttctcccaagcctccacttgtggcgccaatatcaggggacaacgctagcacggcgaagcacttgttatcgcagagccatcaagcggtgatcacgctcatcaatagcttttctgctgaagcgcttttcaccaatgcctatttcaactggagcggcacgacgagcattggtgcatactttatttccctagattgcataattaaagttaccacccagaaaatgtgaaaaagacctgtctctgcactaggccctgtcaagttgacaaatgaaataatataaagttgaatctgtttctaagcggcttcactccagtattcatctggggtgaggccgtttctttgtgctgagcgattgtggtgattaaaatattcgattcctgattcaacgagcgttattaactcttgataggtctttgctcgcggatgacgcgccatccagcgaagtttaaattcattccaccagcgctccatcggggcgttatcatatggtgttcctggacgcgacatactgcgggtgatctcaaattgattgatgaaatgattgaacgctcttgaggtatacgccgaaccacgatcggtgtgaataagtgatgggaccttaccaactgcagtaaaggcacgctgaaaaacctggatctcagcggcactcgtttctgtggcgctgagattgtatgccaagagtcggcgaccatataaatccaagacaccacttaagcggactttgtactcaccactaagcccataagttagttcagttgaatcagataaccaaactttattgggcgctgtcacttgaaagttttgctttaaaacattgtcgagtaaatattgttcagcttgtttggcccgtttatgcttctttggccgtacttgacagcgaatatcaagttcacgcatgacccggcgaacttgcttcaaagttaccggaaaatcaattagtttatccgcttgtaagttagtcagaagatttccagcaccgataccttggtggtgaaaatcaaaccaatattgggtgcgtgttttgagttgtttattgtgcttttcccatgttgtttcctgtcgtctaagccctttatgataagcttgtcggctgacgccgataacggttaaaagtttcgttacggcaccatgattaccttggctgactaccttgatagcgtggtaagccagccgatgtggtttgttcaccccctgcgctgaagttcctgaaatttttttatgaaggcctcgtagagttccttatctgccagttgtgcttttagttctcggatctggagattagccttatctagttcggttaattcatgattggcttttcgatgcccacggttatctacgagcgcttcatagccgccacttttagtcttgatcacccaagtacggacctgttggtaggagacttgaaagtgatccgcggcttcggtatacgagtgtttagctttagtcacatattcaacgatcttgatgcgttcttcaaaagttgtttgccgactcatggtagggacccgctttctagacggtctggccgtcaaggttttatccctattatacctggaaacccagttgtcgagttgtgttgatgaacgtaaaccaaattttgtggctaaatccagcagtgacccttcaccggccaaaaaagcctgaacagctttaagtttcaattcgttggaataatgattatttgtgtgcgcttccgtgagccctgccaacccatcacgttcaaggcgcgactgccaacgcatgagcgtttctcgatggataccatgttgtctggtaaaagtcccaattgataaacctgattgcttgaattcagctaacagcgccaacttttcctgaagcgtgtgtctagctctaggcatacaaaaatccccctatgattagtcagatgaattatagtatttcatctgacaaccataaagggattatcgcagagggaattccttggtttaccgtcccctcttttccaatcttttttgcttccggaaagtttattacaaccttgcgttgaccggcctgtcagtcaccgccgcgttctttgttggtattgtggatgttttacaagtcattagcggttattttaagtggaacaacccaattatcaaatttgttcaggatctgaacttcaacattcttggcatttcgctacttgttttatttgtcatcacttggacggctgcgttgatcttctggcatgctttcaatctcaaaaaaagatgctgccattattgctactgagaagcttttgaaaaaatgaatgtctacagaagtaccgtttacgggaatccgtcaaggaatcagtcaataattaaaaattctatgtacatttttaaacggcataatttcgatattctatcgggatcatgccatttagtgtcacttgaagccgttcaaagttatatcagttaacagggttaatgaaatattcatacgaaacaggctatggcccttcagagccaggtcacaggttagcttgataatttgtgcttggtcaatctctagttcccctgtataatggattaagcaagaagttttctacgtaaagtcaagtatattaggactctaaagttttaatttatgacatatttggcattattgctttaattgaggcgttttatttctaaattaggagcatcacaaagggcttcaaagaaattacttctttgaagttaacttaggctataatgaacctgatcaattaattacgacaaaagtctttttgattattgttggctacgttgtaatcatacatttgatcagtgataatcaaaatatatatcgttctaagcagtttatggattgaagcaatggcgattttcttgaaccccttcgtttgagaaaattgcttttttcgttcatagtaatctgctatatgacatggactagtcttagccgctagatcgatttgtccaattgcacgataaagaatcttccgcgcaacggcattgccgtgcttagagatccttaaactagaatctttttcccctgattgatatctacctggatcaataccaacaaaagcatttatcttgtttggattactgaatcttctaatgtcgcctaattcggctagaattcggacagcagttatttcagcgataccaggaatgctcattaagatttctagatcgcgattaggcaaagtcttagctaatttaatcatttcctctgatctccgctcgcgatcagctgtaagccgtaataatctattggcgtaataaaccacttcatcacgctccgggtcgtcttgatcaactgctggataagctaaatccgcgagatgcttaagtttaatagctagtttttgagcacggttaataccataacctttaaaatctttaatttgcttagcgatggttgatacttcaagatttctaacatcttggcagtgcggaaagagctcaactaaataccagtaattaacacctctagagttattgaaaatggtttctaattctggaaaagttaactgtaaatatttatgaagtcgattcttggaagaaataatatcgtgagttaattcctcataagcccgacttaaagactgcaattgatggtaaacatcaggctcttttcgattaggttgatgctgattttgatcttgagctagtgccaaatggtaagcatcattacgatcggttttattgcgacgtaagccctgattaatttctttcttagcctttaaaggattaagaagaacataatcataatcgtattcatctaaaaatctagtaactctgcgtgaataaactccagttgcttctaagatgatttgtggatgttcggcgtattcttttagatctatcaacagagttttaaagccgatagtatcgttagtgatcttatattctcgtgtggcgccactctgaagtacacaaacactggaatcacgactacttacatctatgccaaagacaatgctcatttttaaaccctcctaaatagctgttagtggttggaacgtatttactaaggtaattatttctaattttctaaactggacatcaagtgtcgacattcttcgaagagaatactaattactaagtaaaactgcctgttttaaggacgacgtcaagcgtctaaacttcttacggcatatagtttcaccactatttaaagtttagaacaaaactaaaatagtgaatcaactatcccgtcggataatcgattcactataaagcttagaatgttttaagggcggtggctgtcttttcccttgcgaggtgaggctcatgggaacatggaataatcttcaggaaggtttcacagtcaatgagcgtcttccagacactctcgttgatgttgctgtttggcacgtttttaatcgcgctcctcagctatatcgacaagcaccacaaataaaaaaagccgccctgtgtaactttggtagaggtcacaggacgagctaaaatcgtttattaaatttctgccaccgcctttgaagcggcttgcacgggaagtcctgttttcggcggggcttcctttttctgtttccattatagcatgtcccttaaaaactggctaacgtttcatgcttcgatcagattcaggatcaggttgtttgatttccggattttcttcagcaaatgcttgcagctgtttttgtgttcgattactgatttcatggtgtatatcatttagtttattttttagttctgatttttgttgtgggttccttgcttgctgaacttgtcgttgcaaacttgatataactgattaagcgctcgggctgatagcttttttattttacatttgaattacaagtgcatacccccatcttcatgccggttccgggtttggtgttgccgctgctttttcgtcatttcccactcagtctcttttaagccgcgtgcctgtctttgtcgttcgtaatcttcatcatgggcatatagggcggtcatgattgcgttactaaaggccgtctttaagtagtagcttggactaactggcttgtaatttagcggttgataatgtccaatatttacttttctatactgatcgtccttggcttgttgcttttttaactgcttttggattttctcgatctgactattcttaatcgttggatcagctttgcattcgcccaaaaagagttgtttagtgccgtcatgctttaaaacccgttgtaagtgatgattttctaactgatctaagctcagctgtcccgataaataagctagtccttgttgatgttcttggggactgaacacctgtggtggatttgcttgccactgttcaattgtttcagcctgacatgg

SEQ ID NO: 165 - DNA, 74923 bp, Lactobacillus buchneri
aattgttaaggcttatttagtttaccctcaaagccactttacctaaccagaaaaacaattaatttacggcacagccatgcccgacagaaaaagaatggtcttaaattgccggtataacttgactataggtagaaaatacgctccgacgacccaggacccggccacataaacaaaaaatttcaacgatgaacaaaaaacgttcatcgttgaaatttttcgcttatgttccgacggccggatgaaaacggcctagcctaattggagggccctaaccgggtctcgtcgcgctctggtgcgcttatgttattctgaggatccttcagctttcaaaatacgctccgacgcaactgagggtaacttctaagtgcactttaattaaagtcccaaacccagggacttcaatcaaagtacccttagaaaccgcctcacccgttgctcgtcgcgccatggtgtggttatgttattttgaggatccttcagcttttaaaatacgctccgacgacccaggacccagccacataagcaaaaaaaatcaacgatgaacaaagaccgttcatcattgatttttctcacttatgttcagggccctaaccgggtctcgtcgcgctctaacgcacaaactgctcaatcgttctcttctcgtccggtgtggggtccgattccattgatttgatattgtggaggcgttcaactgatatgtgcaggttaaatgctaacgctgtgtcgggcatatcgttcttcttttgataattaataatttcttccgctaaggtactaaatttttctgccatcgtcattctcctccatcaaaattcgtgatccaacttgctctataaatctattataccaataattgaaattttgacacattttaacgatgtttcagtccatattccattaaggccatggcgataatggcgatgatgactgccacccaccatttgttggtttgaatgtaaaaatagtacagtaaaccaaggccaacgaccaactggccggcatatcgttcccagcggttcggcagggacaagaatgccaggccgattgccaaaatgattgacccgatcaataccacctgggcgctgtccagcgagccaaattgggtgactaacccataaatatcaacaataattccaacgattaacgcaaaaattccaaacgcaaatgcgaattgatttgcccgcataaaaaacgccttcttccaatatatctttctcttacataattataagtcaaaaaaggaaatgttggaatattggcgtttagtatttgataaagaatagcaaaacttgaacggcggccagcaggacaacaaacagtgcccaatcaattgccgtgatgcgaatgaccttgtagtgggtccgttcataatcctcgacaaacccatgagaggtcatggcttctgccaagttctgtgaccattggattgacgagagaattgatttaaagtacagcttcggtgaccagaaatgcagtgcctcgccgcgcatcaatgccgaagtcttgataatgcggacttcttcagcaattttaggcattaagttaaatgcggccaaaacgccataggcaaatttggagggcagatgaaaatcctgctccaaggtcaacgacaggtcggtgatgctgctggtcaacgtgaaggttgcccccaggaatacataggcatagatccgggtaaacagaatccaggcaaaatggatgccggcacttccgtacagccattgagaaacgaatagaccaacggcaggaaatagtggccagaagataatcccaaacaaggccttcatactgacgtgttgggtgagaatatataaaaagctgatggtgatcaggatgatgttgacgattaagctttgggtaaatgagatttccaacgcaatcagcatcaccaataataatttcattccaggattcatttgataacctcctggtaagtcagattttggtcttcaaaggcggcgtgataatcaatcagggtatccaatccggacagctgatgcgaaatgataatctgggtttgatggaaatcggttttggcccgattcaagaaaccaaccacgacttccagggaatgatagtccaagcctttgaatggttcgtccattaataatactggcggattcatgatcaacatttcaatgatttgcagcttcttcttctgtccttcacttaacgaatacacgattcgttcgtctttgccggccatatcaagcttgctgagcatgtcatcaacgtctgcttgcgtgtagtcggtattcgtccggttggcgagtgataaatcgagctcttctttgaccgtgatgttcaaaaattggttctcagcatcttggaacaacaatgtcactttcttcgcatacggcagtggccgaattttttggatatccttgccgtcaaagacgatggtccctttatagggcagcaggttggtcaacgcgttaaacagggttgacttgccaatgccattggcaccggtgatcaaagtggttttttctttgtaaaaatcaaagtgattcagggtcaatagcagagaggcgtgcggatccaatttaaaatcgctgagcttgataatcgcatggtcatcgccagtgggaatctcaactcgcttgtgcatttgttgagttgattcgaagtttttgaagaaatgttcagcttgttggtcatccaaaaggctgatttgatgggtatccggatccaaatagtagaattcatccaccaatccccgataactggtcaaatcatggtccgctaaaataatggttttgccgtgttcttgttggagtaattttaatttgttaatcaaatcttcccgcgaccccgggtcaatgctggcaaacggttcatccaacacgatcacctgaggatccatggcaacgatgcaggccaaagccacccgctgcttttcaccaccggacaaagtgttgatcacccgcgaacgcagccgtttgatgccacagaattccagggcgtcgttgatgatgtcgtccattttatccggcgcaatccgcaagttctccaagacaaacgtcatttcgtgaacgacagtgtccatcgcgaattgctgattgggattttggaacatcatcgccactgactggctgattttttcccgggggatatccttgatgttggtatcgccaaatttgatctcaccgactgcatcaatcccgataaaatgcgggtacaggccggcaataaagtacagtaaggtggacttgccgctgccggatggtccggacagcagtgagaaatgatgactcttgaaggtcagattaatgtcgtttaagaccttgacgtcgctttgtggatagtgaaaagtgaaatggttaattgaaacatcagtcatgatcaaatcccctataattacaagttaattgctttactacgatccaataatttaacaatcatcttggtcaagacaccggcgaagataaaggttgaaatataacgggtgacgaatagtcccaagagcagtggcagactgaatttgtcataaccatttcgaatcatgtcccaggcaaatgtcaaaacaaccgttgtgaagattgaggcattcaatccgaaccagtcatagcgtttgtagccggtcagcgtgaaaccgagttcagaagcaattccctggaccaagccggaaataaaggcgcctgcgccccattgaccgccaaggaagacttcaaccgaagcccccaggaattcacccaggaaggccgaaccgaacgtgcgaataatgaatccggttaatggacccgccatgcaccacaggcccatcaacaggtcgttggcaaatggggccattccaaatggggtcagggcaacagtcaatccggtgtataaaaagccggctccccaaaaaataataccagtaaaaatagcaattaaggcaattaaaataatgtttctaagcgtccattggctttgctttttgccgccggttgcttgactcttgttatccataacaagacctccaaatatgattttgatcaaataagtcactgaaagtccaattgctgagcacacaaagaggccaggcacaaaactggtcgttttgccctggcctcagaaattcatctaattgcaatttatccatctaaatacaacggagcatgctcccttcgctggaattgtccagatcaggttcgatgggtttttctcagccaataaggcaccccagatagttgtatgatcaaattcagtatacaagatataaaattaatttacaaaccaaactaatcccttaaaatgagagtataaccaattatcgaaatttgaatggaggagtcattgtggtgaaagtgattgcaagcgacatggacggaacatttttgaatgatcagggaacttttgatgagcaacagttccaacagcaattggatcaattaggcgataaggggatgcacttcatctccgccagcagtaatcaataccagcatctgttgggtctgttcaaaaatgttcacggcccgatctcatacgtttgtaacaacggcgcattagtcatcgacgaacgaggggtgatcatccacgaagagatcattgaccatttagtcttgaagaaagccctggattggattttaagcgaacccagttttgccggcgctgaagtgatcctagtcggtcgaaacggcacgtactgcaatctaccggagaattccgatcgcttccaggcttccaaatatttctacgaaaacatgcagtcgatggctgatttgcggttggtctttgactcgatttataagctcgacattacctgggaagaaggcggtgtgctcaagcgccaggatgaattcaatcacaaattcagcggtcagttgaacgccatttcttctgggatgaacggcttggacgtcatggttgacggtaccgacaaactgaccggaattcaaatgctcctgcaaagttggggcctgactctggccgatgttgccgcatttggcgataacggcaatgattttgaaatggtcaacgcagccggtgagggatacgccatgaagaattctgctgctgatttgcttcaaaaagttgagcaggtgacggcttattccaataatgagcagggcgtccaacgaaaaatcgctgactacttaagctaagaagcggctggtgttggggtattcttcgaccagatcagttaacgagaaggacaacagctgtctggaatcgtgatacctaaaataataggtctggtcggttgaatccaacacagaaatataatgggtatagttaaagtttggatggtcgtccattgacggcttgtagggaattgccacttcatccaaaacgttgaacaggcgatttctggcttcgtactgggtccgactgggcagggtgccgagtttgttaaccgcggccaccaaaaatctggtggttggggtattggttgctttgggcaggtcttggctcatgatgatttgttgcgcttttgcggccagggcctgttgattggtcactttcagcttcttttccagtcgggccatatgttccggataagtgggcgagttggtcatgacgccaattgagtcctcaatgacttccaaaccgtcaaccgttggctccaggatcagtgtttgacctgatttgtcagtcagaatccagtgaaatgaaaagacttctttgccggccatccagtatttgccaatcagggcgatgttgtcgaggtcggctttgacttctttgagtgaagcgtgttctcccagcacccagggtaagaaatcctgaggggtcaaattgagcttgtcatcgacttcattgtctaagtaatgggctttcaggggaaacatcaactcggcgcagctcaggccttgggtgttgacgccgtctgccactaggatgttgtcattttcttcggtgcggccgccgccaatgtaaggatatttgatcagccgggtgcctgataaagcggttacataatttggctggttaatcaggaccggtttccaagccgctttgaccgggaagtccatggtccgtgccaggaggacatgttgattaagtgtttctagggttaagctggtgcacatgatttgtcacctcattgattagttttgatggaatcgcatacaagttaaatataacacgattttgaatggaaattatgacaaagcatcgctggctgggcaatagaatggtattcaacttatctttgctcatactcgcactcaccaataaactagtgtaaacttaaattaattaagaagaaaaaggggaatgattatgaaatccgcctggaatttagttgggatggccctttggctgcttctcatctgttactttgcttatattattcacgatatgcgggcgcgtcggcttcgcttgatcgtgactgaaaaaaagagtttcacgtggcgtaacttttggatttcgtgtagtgaagtggcaattttcctgctgtttttgtgggggatgtcgtacacgacctttttccaagatgtcaaaaaattggacacgaatcgaacaaccaccagttatgcttacaaaccactgattatccgttatcgctccgatcaatcggactacgtgacggttagaaatggcaatggtcgaaagccgattcaaaactatacgtattatgtcaatggcggtaaatacttggtgaacagcatgaatgccacggtggtgtatggcaagagtaatctgaatgtccaagcagaaacctacaagtggaataaggaatacctggatcaccttgatacgcgttaccagcacgcctgggtggcaacggtgacaacgacgtataagaagaactttttcaatggaattggactccatgcaggccggcaggccgatcgatttagtttaattcggattccggataagtcgtttatgcatgtagtgggcgactaagccccgggagatcctgagcattaaggaagtagtcgggtgtgatgcgcgtttcttgcgcattacacccgactacttttttaagcggagggatctgggggtcagtcgccgtcctcaaaatagcagggacaaccaaagaaaataacagcacccccgggagatcccgagcattaaggaagtagtcgggtgtgatgcgcgtttcttgcgcattacacccgactacttttttaagcggagggatctggggcttagtcgccgtcctcaaaatagcagggacaaccaaagctgtggtagcgattatcgccgtcacagctttttgtatgtcaattttcactaaaataaaaccgacccttaatcccctgatcatgattaccaaattgattgccaaaaatggtacaaccgccggcatgcttggcgttatctttaaccccaatccgcagcgtccacgaattcttggtggtgtctaattcattaatcgtcgtatccgcagaatgctggccgtcgataaacgagccgtgtttggaaacacgcagagatttgagcatgccatattgattcatgtcgttatacacccaatccggtgtgtagcgcccacggatatcagagaagtcaccgggactcgtccaggtaccaatctctttgccatccagactaatggtaatatcagacggccagcggttgtttgaaaatggaaattcagagcttaactccatcgacaactcgatcatttccagttcctggtcaggcttcaagtagtttggcacctggtattcaacatatcccttggcaaaccagagcatcccagcttcataacgtttggggtccatgaaataactggggttatcgactttgccgatgaagcccttttgacccgccaagccacaagagggctgaacatcaaaattggtgaattgcccaattggcagctcaatatcccaattctcataaggaatatagagttgttgcggaaagctgacgttgattgtatcgatctggagactgcaaatccgttggttgcccttcttttgtgtcttgatgatgtgggcgtcttccagcttcttcaagtgcatgagggtaattgggctgctcaagcgaattgccttagaaatttgtgagacgttcatctttttttctgaaagtaaacggatgattttgattctgacctgactgtccaaagcagcaaaaatgggcagcgacttatttgaaatatcaaggtccatatgattacctctaattcttgttaacatttatattactatcttaagctcaatgaagctccttagcaactcgtccttaatcattatactaaataggaaaaaatattcaacattttagtaaaaacttgtttacattgggatttgtaagcgctatattaaaagcgttaaaacttttaccggtaaacattaacaatttgcatcgtttgaatattaacatatatgttaataagaaacagtaaaccatgaaaggttgaagaaaatgacaattgaacttttacctcagaaaaaaggaccacaaatcagtaaatacatttatggtcaattttctgagcatttaggaaatgggatctacggcagtctctatgttggcaaaaattctgatattgcaaacgtcaacggcatgcggactgacgttgtggatgccctcaagaaaattcacgttcctgtattgagatggccaggcgggttgtttgctgacacctatcactggatggacggtattggaccaaaggatgatcgtaaaaagatcgtcaacaccaactggggtgatgtcaccgagaataatcactttgggactcatgagtattttgaactgctgaaccaattaggtgctgatgcctatatcaatgccaatattggcagcgggacggttcaagaaatggctgagtgggttgagtatatgaccatgccgggtgaatcaccgatggccaacctccgccgacaaaatggtcaagaggatccttggaaagttaaattcttcggaattggtaacgaatcgtggggtggcggcggtaatatgcgtcctgaatattattcagacgtttatcgtcagtaccaaacgtttttgcctcagtatgacaaagatcatccaatttacaaggttgcctgcggtccaaatgaagatgattacaactggacggatacggtgatgaagtatgccggtcaatatttggatggcatcagtcttcattattacactttgccaaagggaacctggggtcaaagcaaaggtgacgccaccggcttcccagaatctgaatgggattcgacgatgacccgtgccaaacacatggatgaattgatcaccaagcattccacaattatggaccggtatgatcctgataaacgggttaatttaatcgttgacgagtggggcacttggttcaatgttgaaaagggcactaacccaggatttctgcatcagcaaaacacgattcgcgacgcaatggttgcagcaattaatttaaatatttttcaaaagcacgcggatcgggtttatatggcaaatatcgctcagatggtcaatgtgttacaagccatgattttaaccaagggtgatcagatgctgaagacgccaacctattatgtcttcgatatgtatcaaaagcacatgaatggtgaattagtggagggtgtcggttcagttcctgagaacgtcacctatacggcttcacaaaaagatgacaagctgacgatttcaatttgtaactacgatgcccatgaagcccagaatgtggacttcagcggcctcgctgatttcaagaaagtgaaatccggcaagattctgacggctgataagttggatgctcacaatacattcgacaatccagacgcggtagttgaaaaagactttgtcggtgctgaattgaagcatggaacgcttcacttggcattaccagccaaaagtgtcgtcagtgtcactttgaaatagggtcgctcgatcccgtttatcagcataaatgaaaacgatttctaaataaattgattcccatagggggtttaaagatgtcaaagaaagatgaaaaagatttaaaggccggtgaatcagtgcctgaaccaaccaacgccaaggtaaccaatgcagaacagccaaagttcccgaagcttttcggactggcaatgctgcttggaccgttcgtatggctggcaccggctggtaacgtcagaaacacattactgccacagtacttcagtcaaattgatccaagtggtaaggttgccgctatcgcgattatggcgtcagtatcatccattgttgcggcgattgccaacattttatttggtggtttatcagatattacccggacccgttggggtaaacgaaagccctggattcttggcggaaccattgttgaatccggcttaatttgtgtagttgccaacttgcatgatctttgggcaattgttgttatttggggcttcgttgctgcggccgaaaatgccgttgcggctgccatggttgctcaagaggctgaccgaattgcaccaaaatggcggggaaccatttccactctgtatggaattggttataccgccattcaagtgatgaccatgattgccgctcaattcctgggtaatcctaaaatgggaatgtacgtcatggcaggtagtggctttgtaatgggtattttgcacgttctattcgcccatgaaggcagcaacttggatgaaccccgtgaaaaattctcatggagagctttgtggcttcacttttcactgccaacggttggcgcgcgagattactggtacgccgttgccggaaaattaatgatggttatgggtggtacaattgccactgcatacatgctctatattttaaccgactatatgcatttaggtcagcagtccgctgggaagaccttgtcagaaatttcaatgatcaacctggtattcggggttatcttcaccgcaatttcaggaccagttgctgatagaattggtcgtttgaaggcgccagttgcattatcaacgttactgatcgggattgcacaattcttcccattcttcgataataagccttggaccatcttaacttacgccgttttggctgccattggtaatggtgtttataacgccgttgatggtgccttgaacctggcagttttgccaaatgctgaaacttctggtaaggatatggggttcattaacctggccaatacgttctcacaaatttcaggaaccgtggttgcttcgctgattgtgacctatcttggtggatacaaagcaatcttcccggcttcattcgtgattgaattgattggtgcgttcttaatctttagaattaaatctgttaaatagttttgctgataaaaggatgaatatgcgctgtgtgttcatccttttgttgcatccacagttcattagaaagaggtaatgatattgaatagttcacaacttgtccctggaaccaaattcggggcagctctcaatgatttatttggaatcttttttgaagatattaatcatgccgcggacggcggtctttacgccgagatggttcaaaaccgctcgtttgaatttgccccgatcgataatgacgcttaccagccaacgaccgcttggcagttaagcgatccgaccagtctgaaagttgacgacaaagatcccttgaacaccaagaatcgacactacttggaagtcaacgcccgacaagacgttgagctgaccaaccttggctttaaccaggggatgtatcttgaagctgggaaaaagtatcacttttcattctttgccaaaacactgaatgggcaaaaagacgtcaacgtccacttgactgacaaagcgggagatgacgttgccgtcccaacggtgattcctgtcgaaagtcatcaatggctcaagtataccctgactttcgttggcgatcgcacgaccactgaaggccgactcactttgaagttcgaacaggggacccatctcttgattgatatgatctcactgttccccgacgacacgtttaaccatcgacagaactatgttagaaaagatcttggagaagcactcaaagcccttcacccgaaatttttgcggtttcctggtggctgcctcgttcacgacggacagcttgatccagatgaccgcggggcaatgtatcgttggaagaattcaattggagcagttgagcagcgcccagctcgtcggaacaactgggggtataaccagactcttggactgggatattttgagtactttgaactcagtgaagatattggcgccaagccgctgccggttcttcctggcggctatgatccccatcatgatcgcgaagcaccaatcgatcaattgggtgagtggatcgatgatgcccttgatctgattgaatttgccaacggctccactgataccaaatgggggaagatccgggcaaacctcggccatccaaaaccatttcacttggagtacctggcaattggtaacgaagaggttggccaggccttctttgaccgctatccatacttccacaaagcgattaaggcgaagtatcccgatatcaaattaattaataccgcaggaccgtttgctgccggaaaggaattcgaccgtggctggcagtccgcgcgagagaatcattcagatctcgttgatgagcattattatatggatcccgagtggttcttggctaatcagcatcgatatgattcatatgatccgaagggccccaaggcatttttgggcgaatacgcctcaaaggcaaatcagtggtacaacgctgtggttgaagccagctacatgattggtctggagcgcaatgctgataaagttggtctggcatgctacgcaccactattttgcaacgtggactatgaaaattggggaactgatttgatttatttcgaccaaaaagaagtttccccaaccgtgaattactttgttcagcagttattcatgaaatatcagggaactgacaatgttgcctatcaactcaaagatttgccaaaggccaaggtcgtcgatgatcaaccaattgtcggtaagttctttgttcaaggagataaagcccgggcaaagtttgaaaacattgtcttggatgacggtcagcaaaagcagaaatttgcctcacaaatcgttgaccatgaggaaaaagttgaattggggtcaactgacgcgacgaactacacgatcacatttgacgtgaccaagaccgatcaggattccaagggaacccacttctgctttggtcagcaggaaagtgacaaatggtttgtctggattctcggtggttgggcaaatacggattcgatggttcgtgttcatcatgggaaggcagattctgattggacccaaacgacttggtcaatggcaaagggccggacttatcactgcaaattagtggttgacgatcgtcacgttcagacatttatcgatggtcagttgatcaatgatgtcgtcatcactccaaccgtcatcgaaccaatgtacacgaatatgacttacaaccgaaacaccaatcagtattactttaaggctgtcaatgtgactgggcagccaaaagaaatcacggtagattctgaacgatttgccaacggctcggtctatcaattgtctggccgaccggatgctgaaaatcacttgggcgctaacaaccaaattgaacggcaaaatgtaccattctctggtcatcaactcattttgccgccttattccgtcagtgccttagtgagcgccaagcaatttggaacccgctagtagaaaggaaacaacaccatgttaattaatcatcatcgtacattcgcgcctgtcccaccaaaaggctggaatagttgggatggttacggggcctcggttagagaagaagaggtcagaaaaaatgctgagtatatgagtaaacacctgaagcaatttggttgggagtatatcgtcgtcgacattcagtggtatgaaccgaccgccaattcgtctcgctatcatgatttttatcctttggtcatggacaattattccagattattgcctgatcctggccggtttccatctgtatcgggcggtcgaggattcaaaccgctggccgattacgtgcacagtcttggattaaaattcggcattcatattatgcggggcattccacgtcaagcggtccatcaagcaaccgccatcaaggggtccgacaagtcggccagggagatcgccaggaataatatttgcccctggaattctgatatgtatggagtcaacatggatatccccgagggtcaaatttattacaactcattgatggatttatatgcctcctggggagttgactttgtcaaatgcgatgatattgccaactcacagctctatgataaaacgcacaaaaatgaagtggtcgccttaagaaaagccattgctcagacgggacgccaaattgttctttcgttatcgcccggaccggcaccaattaaaaacggttcgttcttccagcggaacgccaatatgtggcgaattacaaatgatttttgggatgaatggccgcttttatataatatgtttgaccgtgcggaagagtgggcgccaatttcccgtcctggcaattggccagattgcgatatgctgcctttgggacatattggcatccgttcagtggatggaccaggcggtaatcgtcaaacccgcttcactcacgccgaacagcggacgatgatgagtctttggtcattaatgcagtcaccactcattatgggtggcgaattaacggatctggatgattggacaaagagtttactgacaaattcaacccttttgaaaatggacaattcaatttctgaaaaatttgaattaaccagaaccgatcaaatgattgtttggtacgcgcgtagtgatcatcatgtttactatggtattttcaacatatcgtccaagccgattatggttagccaagcgcagttgaaacaaattggaattgaaaatgacgcccgtgatgtgtggcataacagtcagttagtggggtcaactgtcacaattggcagtcatgatgtcctattaactgaacaattaagacgctaaggggggcgtgggatatgcaacaaaacattgatcagagattcgtcacaataagtgatccagaaattgcccgtgcccagcagatgacggttaagtatttattagcgttagatccaaaaagatttttggtaacttttgatcaagttgccggtatcgactcaggtggcgtaactggttaccaaggttgggagcgcaccgatggtttgaattttcgtggccattttttcggccattatctgtcggcactttcccaagcgattctcgctacagaagataacgccattcggcagcaattgcttgacaagcttcgcctgggggtaaatggtctccagtctgcccaagccgcctatgcaaaaaagcatcctgagagtgccggctacgtttcggcgttcagagaagttgccctggatgaggtagagggcagggaagtcccaaaagatgagaaagagaatgtgttggtgccatggtacaacctgcataaagtcttggcagggctgttggcggtcaacgtcaaccttcaaaatatcgatccacttctgtctgagaaggccctgaaaagtgcccatcaatttggtctttatgtctttaagcgaatcaatcaactggctgaccccactcaaatgctcaagattgagtacggtgggatgaacgatgccctgtatgaattgtttgacctgactgatgataaacgcatgctgacggcagcgacttattttgacgaaacgacgttgtttaaacagctggctaagggtgacgatgtcctggctgggaaacacgccaacacgacgattcccaagttgattggcgctttacaccgctatgaatcccttcatgacgtgaaacgggccgaccaatatttaagccctgaagaaaaagggtcactcaatatgtatctgaaagcagcggttaatttctggcaaatcgtgattgatgatcatacctatgtgactggcgggaatagccaaagtgagcatttccacgaacccggccagctgtttcatgatgcagtattggaggacggggcaacaacgtgtgaaacctgcaatacttataacatgctgaaattgagccgggagttatttcgagtcaccggtgataaaaaatatttagattattatgagcagacctataccaatgccatcttgggctcacagaatccaaacaccgggatgatgacttattttcagccgatggcagccggctacaccaaagtgtataaccggccattcgatgaattttggtgctgtacgggtaccggcatcgaaagcttcactaagctgggcgacagttattactttaggtcaggagatcaattgtatttgagtttgtacttctcaaatgttttacggctcgattcaaggaacctccagatgactgaacaggttgatcggaaagccggtaaggtgcacttaacggttgttaaaatacggtcacaagatagcgctgggacaatcaatttgaaattgagaaaccctgcctggttggttcagtcagccaaattggcagtcgatggcatttcgcagcagatggatcaaaacgctgatttttgggagattgataacgccggcccaggaacgaccgttgacttggagatgccgatgagtttggaaatggtgcagacaaaggataacccgcattatttagctttcaagtacggtccatatgttcttgcgggccagctggggaagcatagtatcaatgatgatcgcccaaatggtgtgttggtgcgaatcagtacccatgatcacgcatctccatcaacattgaccaccggtatggattggcacgactggcagcagtcattgaacaatcaagccgttgtcgataccgagacgacgaatacactattcaagttgaagttaccaaatacaagtgaaacaatcacttttgtgccttattatcaaacctttgaaactcgatatggggtttacttccagtggcagcaggcgggctccaaagaggctcagcgtcgcgaagaacaattgcaagcgttaagcgaatatcggcgaaaaacagtcggtcaactggataattttgatcagaacaattttgaatttgataagcatctagaacagtatcattctgaggctagcaatgccaaaggtcgacgcttcagagttgcccaccaagacggttggttcagctaccaattctctttagtcaaagctcaaccgggcttgtccttggaacttactttgaatgttgaagacgcagggcattccattgtggttggctttaacgacgatcataaattcgatcaagtcctcaccgttgatcagaatcagccaacggattcaaaaggcttttatcacgttaggataccgatttcagtcaccttgattaaccagcaacctgatattaaactggtctttcgcagtgctgccggtgatactgctcggttatttgggattagactttttaatcgttaaacaaaaacggacgccactgacggcgtccgttttacgatctcatttattttaactaagccatttcaacatttccagctgccggcagtccgagtacttcggctgccaagcgatcagcagtttgtaaattggtgtcattgacgcctggtcgtggcgcagcgttggtgacatagcgtaagccatccaacggcacgccccaaacgtaaatgtcgggttgtccggcaccattagcgtccaacaactggtcggtacttggatccacgtcgaccgcattgaggccgacagattgatcattaatcttaacctggtgggttcttgccagcttggcgtcaactaggctttccagcactgggttggcggtgatatcgaggtcggctttaggaacccgggcctcaattaaggtagctgaacggaaggtatcggtgttgcgcttcggtgccgcagtcacaaaccaaccgtcttgtcctttaacctgcatgccgggtgccaaaatcgtgaccacgccactgcggatgagagccgacaattccttactgcgaaccactgggggtcccatgattaagaagttaatcgttgagtcgagttgactccagaatttctcaaccaagtcttgattactgaagcagtgatcgacgagcatttggcgaaaggcgggtctgaagtctcgtagtaagtctctggcagcggccagcggaccagtctttgagcctttcagggagtcgtcaatttcgccgtttagccagttaatcaggactgactgatagtcttcggtcccaactgcttggacatccttgaacgggttgatgatgtaatcccaatcaaaggcgtcttcttcggcgaaaccaaattgtttgagaacggcttgtttatcgtcgttggctaaaaattcggtttcaaactccgaggcactcttgtatgggtatttatcattgatggtcaacttgtagaagaccagctttaaatctaacagtaaaagttccatgaacttatcgaaggaaatcttaccatcagttgaattcttttggatattttccttggttaaaaacttaggtacgtcacactcgccgtaacccttttcgttgatcggcttggggtagtatggaattccacggccggagccggcaatgattcgcggttctctgccggatggttggtagaacaggctgccgtcttcattttgcatgtagtggccgccacgccccagggtcaattcagaaatgtaatcgataaaactcagccccaagccgcggataatggcgggttcaccagctggaatgtcactgagatcagcgtcaccggggtgagtgggggcaatataagtcagggcgttttgttgggcatagctggccaatttttgttcctcatcgctgaggtagttgtcttgctggccgagactcatgatgaccttatcgaatgtaaaggtgccatcgttggtcttgatcaccgggtgatgatcggtatcataagtgagatccatgacctgtgacttcattaatgatgttgaaacttcggtaggctgttgtttaatcaaatcttggtagaaccatttgatataggcaccaaataaaacgcgaggtgcatagccgttgatctgtaattgagcggccgcggcaatcacgtctgatgaataaccgttgctatccaaataacggttggcctcaacactcttggcccattcaaacaaagaagggccgtcatagaccttgctggacatcgttacagaagcatccgtaaacaaggtgatttgatcagctgaactgttcatgatcaattcatccgattggtcagtccgccagactcgcccaccgataccgtatgggtcaaatagcgtgatcgatagtggtgatttctggtcactgtgatatttatattgattaaacaattgagaggttaataaaattccccttggacctgccccaataattccaactttcatttcacatactcctaatattgaatttaataatcctttggatcgacctcaagtgggccaaattgatccttgtccgaatcgcggaagtcccaccactcattttcgtatccctcaaagccggctttctccatcgcttcattaaggatatcgtagttcttttgggcagccggtgtccatgatgatttcatgctgcgcttggccagcccgtcaaaatcgtcaaagccggtgggcatctcaatgtcgttaccgtttgcatcggttaaagttaagtcaaatgtcacgcccttttggtggctgaagttaggatccggctcggctacccaaatggggtccggatagacctcaaacagacgtttctgggcgtatgttgggcgataagcatcccaaatcttgattcggtatccttgtgacttaagatccttgctggcttcaccgagcttcttgaccgtatcaattcgagaaattgcctggtcaaagtcataaaccacttggtgagtaaaattatcactggttgcgtacttcaggtcaacaatgatgtctggatcaacatcgtgaacattgatatagccttgtgttttcttatcagccatctcggcacctccacgtattctgagaagattctagttaagttaatattatattaatatttattcattttcaaatgcattaccacgataaatgccgatatcatcgacatagatcttgccagtgtaaggtttagcttgatctttgagcatgccgaccttgggataagccaccgttgacgttgaggttgctttgatggcggttcccatcacttcgccggtgtcaccgttcaagccggacggaatatcgatggcgtgaattttggctgttgaagcgttagccttatcgataaccgtggcgaagtcaccgccaacgttgcgggatagaccgctgccaaacagggcatcaaccaaggtggtgaatttgttgaaatcagcgttcatgaagaccttgggaatctgatagtagttacagatccgcgcctgagccagatgatcctcgctggcgtgatccggattaccaaccgttaagatggaaacttgatagccatgagtggccaacagccgggcaacaaccaagccgtcgccgccattgttgccggttccggcaagaatcaaaacgttgcttaagtcgagatctttgttatcgagcatattttcataaattttgaggccagcccgttccatcaagacgagggaagggatgccaattttgttaatcgttttatcatctaattcacgtgattcttcaaccgtgatcgcttgtgtcattatattacctcccattaggatgatgtaagcacttcacaccttatatgttcgactattgacgcatcaattgcaagtagaatgtgccggttggggatttctataaacaagatccgtgttttttctgcttttggtgctttataatggttgtaagagaaaatgtggaggtagaatcatgtccctagattatccagaaaacatgcatgaatttgaagataaatttgccatcgaaaaagcccgtcacccggaaaccaccagggacggactaatgaagcaagtgattgaagacgcttttcaaggctacttggatgaggccgaggaaggccactatgatactggcaaattggttggaaaagagattcaggtcattgggattggcgaaaagttgctgacaacgattaagccaatcggtgagtcgtttcaagctgattttgaaaaggacggcaatcagttgatgtggtacctggaagatcaagccgataaagtcgcccgcaaattttcatgaacattcaggttgtattaatattcagaaaacgctataattaaatgatgtaaggcgtccttagtgtaatggatagcacatgagatttcggtcctcatgatccgagttcgactctcgggggacgcataaatgaattgaatcgagtttagtaaggaaagtcgctgaaagattggcgactttttgttgtctttatatacattactgagtggtcaatacaatcgaatggatcttataaaatccgacgtcgaaaaattcacttacaaaatagtcaaatatatctgtcaaaaaagtaaaacggacggttataaagataaaatgtttttcaagaagtatctctcagttcaatgaggttcccaatttaactgaataacttagctaaatctcatgtgttttaacaatcccgatgagttcttgaaaattgcttcaaggtaacaaaatattgtgttgcgttttaccgcttggaaatcagtaatttcggtatttgcgattggtactcgaacgcttggatgatatttgggtcgactgactttctttgatctcttgagattgcagacttttaacaggataggtctccaaatccgaagcctatcaaacaaaaaatgagttgtgtcctcgaattctttctgttatcttcgaggacacagctcatttttgtgttaattatgatcaactaacggttacagcttcttaggcaataccttcaaatgccaccacatattaaccgattggccaattaacaaccccttaacaattgccgaagtgattgcataggttaatgtatatgaccaagtctcataactttcagggtttacccaaccatggaaattaatcagcatcatcacgatgacattcataatcattaaactaatcgcgtatttgccgccaatcattttgatttgattttctcgccagaaaaaagattggtatttgtaggccaagtgagcaccaaagaaactggctaacacaataatcactaagaaaattgttaaagtggcggccaaatgtcgaaagcggacgattttctcaataccaaatacaataaatagtataggagttaaatataatttagcccaattaaccggggagctgctgaggtatcgtttcgaaacaaaaattgtaacgagtgtaagccacaggacaacgccaagggcaatgtaccacccatgcatgattgttaagatatcgtttttcatgatcgaatcaaccttccttcaggcaaggctcttgaatacttcacgtagtttggtaacctgcatctgcttattcttttgatttcattttgttagaaagtagcagggtcggcagaatgattaacagtgccgccagggaaatcattaaaaatccttgttgaaatgcgtcaagtcgaatagcaactaaatgttggtggataaaagcagccaattgccctgatgccggtttgaggctacccgtttttaattgatgctgaaaacttttaacgtgcgaagctgaaaaagcagttacgacagttgtaactaatgctgaaccaaaggcactgccgatgttttgcaagatccgtgaaccgattgtggcgctcgaaatttggtcggtcctcattccggaataagagtcagccatcaatggcgtcaaaataccaccggccccaattccacgaaccagcagaacgacggcaatgatccagtacggtgtgctttgagtgatccagtaaaaaggaatcgtaccaacaaaagcaataaacacactgacaagaacgacatactttgcaccaattgaatcggtcaatcggccggtgagtgggcgggaaatcaacatccccaatccttgggggatcaacgccagtgaggccatcaagacactcatgtgacgcacgttctggaaaaacagcggcaacaataacatggcaccattaagaacagttccagcaataaacaagcctataattgatccattgaaggacccatgtttaaacaaattaagcgggataactgctttttcgccgcgaatggcgccccagataacgtagacaattagcagcgaaacccccgttgccaaaaaggtgagtgttgacgggttgctaaaattggccttgtgggcagctttaaccatcccataaatgatactggtgctggatccaatcagaagcagtgttccgatgagatctaattttgcggatttattttgtgcagggtaattaggcattttccaaataattaaaccgagtgacgtcaaggttacaggaacgttaatccaaaaaatccattgccaagacaaaaaattaaaaataatcccgccgatgacaggcccgatcagaggacccaagatcatgggtaaaccgaccgttgccatcatttgccccataacggcggcaccagcagtttgaactaaaagggtggttagcaacggcataattaagccaccagcaaagccttgaaccaggcgcgctccaattagaaattggatgtttggtgaaactgcggctaaaatggaaccgatgccgaataagatttcactgagcataaagacatgcttaccatcaaatttatttaataaccaacttgaaaacggaacagcaattccagttgccaatacatagcaggtaatggtccattgaagtgttgtgacagaactattaaaactattaaccaacttattaatcgcaatattgatcattgttgaatcaagtaatggggccattgcaccaaagacgacaacccaagcgatgatgattgtggattttgggatttgtttattcattacacttttcctcctgaataagaaactattagtatcttaaaacgataattgatataatacactatgaagataaaaaatgcaataagatactttaagtatcttacaaaaaggagagtcatcattatggttcaaaaacgtcgtcggggtgccgaactggaacaagcgatttatcaggcagctttacagcttctgaaaactaagggatttttaagtttcaatttcgctgatgtggccgatttggctaacaccagtaaatctgttatttatcgtcgatggcagacgccattctctctggcaattgccgcaattcaggacaagataacgtcagaaaatcacggccgaacggatgatttcactttgactggtcattcgttacgcgaggatttattgcagctgcttcaacgattcattattagtatgcaaacatttaaggacttccgtattacagaactgctgggggaagcaactaaagaagaaaatacgacgattcaacaattaatgagcgatggaaacgcgatcgatcttaacgctcttgatcacattcttacacgggcaaaaaaaagaggcgaaatcgtaaaaacagatttgcctgaggagattgcattgttaccattcgattggctcagatttcaactttttactaatcagccgttaacggagcgcaaattggaattgttagttgatgatgttttattgccaatttatcagtccaaaagcaggagcgattaacttcacggaagtctggttcgctcatctttaacgctcccgttaataaatacttttaggccacgtgataatcggaacactacaaaatagccctgaacaaacatcagctgttcagggctgctgatgtttgttcagggcgtagaaaattgtcggggtaggctctaacaatcaatatatcagtctttgagagatcatcataatgtctgtcaattcagcttatcatcaaaatatttttgaatttgatgcaaattttctacaagagtatctgtattcttgtcaccgagaacatgccttaattctttgttattttgctgataaaattgatcaatccgagttgcatagcggttggcgtgtttcgttaacaaaatctttttgtagcgactatccttttgtgaagctgatcttgtgattaagtgaactgaaccccttgaattggagaaatctaattcaaggggttcggttcactttttgttttgcaaatcgttaagtagccggcattccgttgtaagtcacttcttgctttttaattgagccttcgtcatcaattattaccttggtaggccgtcctactatactgcttaggcgtcaccccataaaaattcctaaaggcattaatgaatctggacgtgtcggaaaagccaacctgttcagacacttcttggacttggagatccctcctggtgacgagtagataggcagcttgacggatccgatagtcaaacaaatattgaagtggggtcacgccgtatttttgccggaaaatattcgtctggtaaggaatcgacaggccggtgatgttactgatgctttgattggtaatgttaaattgataattactttccaaaaaactggtgattcggttaacgattggatcagatttgctttgttgaccatggacgatatccatttggtgaagcagcagcaagtagcgatagatcagcactgattggttggcttggtcggcaattgtattgttgataaatgcccggtagttactttggatgaaattggtaatgttttcaggtaaatcttcaaacacccgatagtcctcgacttccagatagttcaccaggtaattggcgagcggaccgtaaaaggtgatgtaggcagtatcccattctttggcatctgagtcagcactataagaatgcggaacggtggggcgaatgaggatgccggagtttggcagtagatggatttgctggccatcaattttaatggttcctgagctgctttcggtttgtaaccagtgaaaaaagcggtagccgttgggtcggtatattggatactgccgccagtgatagccaattgattcgcaagaaatcggcatggtgtcattcaggttgctaaatgcgattctcataatagattcctttcaagattgaaatagtgatcatttactatcaaatatgcatattttttcatgcaatatcgtgcatttatcgagtcagtgttcccttatcatgactgtgttgaaacgtttatgaaccaagttctggaaattagaacagacaggcgaaacaacgttcaataatacaatcaaatttaatgatttttcattaaatgtcaacttcaaacgccccattttgaaagttgcggaaggagaaatatcaatgcttaaggtccctgattatgaattttggttcgttgttggcagccaacacctctatggcgaagaaatactaggtgaggtccgctctgatacggaagatattatcaacaaattgaatgcttccggcaagcttccctatccaattaaatttaaagctgtcgctaccaccgctgatgaaattacagcagtcatgaaggaagccaattatacagataaggtcgctggtgtgattacttggatgcacacttattccccagccaaaaactggattcacggaaccaagttgctgcaaaagccattgctgcatcttgctacccaatatttggatcatattccatacgacaccatcaactttgattacatgaacttgaaccaaagtgcccatggcgatcgtgagtatggctacattaatgcaagacttcagaagcacaataaggtcatttacggtcactgggctgatcccgaaattcaacaagaaattgccgattgggaagatgttgcagttgcttacaatgaaagtttcaacatcaaagtggcccgttttggtgacaccatgcgaaacgttgccgttacagaaggtgacaagattcagggtcaaattcaattcggctggactgttgattactagccagttggcaatttggttgaagaaatcaatcaggtttctgacactgatatcgacaataagtaccaagaactccaacaaaagtataccttcgttcagggtgataatgatgctgccaaatatgagcactccgttcgctaccagatccgggaatactttggcatcaagcatcttcttgacaagggtggctatacagcattctcaaccaactttgaagacttgttcgggatggaacagctcccaggtctggctgtgcagttgttaatggcagaaggatacggatttgccggcgaaggagattggaagaccgctgcacttgatcgtttacttaagattatgacccataatgatcggactgtctttatggaagattacaccttggaattgaccaaaggcaacgaagctattttgggctcgcacatgctggaagttgatccaacgattgccagtgataagccacgggttgaagttcacccacttggcattggtggtaaggacgatccagcccgcctcgtgttcgatggaatagatggcgatgcaatggatgtaaccatttccgactttggaaccgaatttagaatgatcggttatggtgtgactgcccacaaaccaactaagaagacaccttatctgccaattgccaaacaatattggacaccaaagatgggtctgaaacatggtgcaactgagtggattcaaaatggcggcggtcaccataccgttttgacatttactgcttcagaacaacaaattaaggatttggcaacgttatttcaactaccgtttattgacattcagtaattgctaatcaggattaacctggcgggtccaaagaggccagtcagcgttactgagaagttgagtcattgaagggaggcacaattgatgtcaattactttatattttgtgagacatggacaaacgttcttgaataaatataatcggattcaaggaaattgtgactctccgctaactcagcagggaattgccgcagcaaaaagagccggcagtcggctgagccgaattcattttacccaagcctataccagcgatacaatgcggacaattaataccggcaagctgatattacaggaaaatcaggaagtctctccaaaactgcaattgaagccaatgcaagcattacgtgaattgaactacggatattttgaaggcagcgatgaaaatcagttgtggcatgaattaggcggagaagaaggcgttgattcgtttgagcaaatgattttaaaacactcaattgaagaggctgaggaccgcgttgcctctgcggatccttatcaggatgcggaaaccagcgctgaattctgggaacgcttctcaagcggtattcaagaaattatttctcaggccactgaccatgatcagattttggttgcaactcatggaaccgccattcgaaacttagttgcgcattggagtaatctgcccgtctacgtgccaaccatcaatggcagcattactaaagtgacgtggaacggttcacaatttttggttgactattttaataatgtttctcagcctgtttagaaaacacaatttgaatacgttgagtgatatgtagccctggtttggtcgccagggcttttttgtgcttttaaggtacaagaatgtcgatgatattggaaaattaatttagatgccaattgaaaataacaaatgatttatgatattattccaattaacgcaatcaaacttgtctgaatggagtcgtgcacacatggaatttacagattatgaaattgaaaaattgattattccccaagataacattttcagtatgttaacaaaggatgatctgaagcagtttttgaaattgtattactccgctgaattatcagttaaagagctgcttgaaaaatatcagctaaatatcaaaattcaggacgttgctaagaatcttccaaaggtacaagatgtggctgtctgtccatatgatggaaatcatttacttagaaagatgccatctcggaccagtcaagcaggttcttcggaaaattctatttgtcctaaatgtggtcatactattttttcgactgctcggcattaccctccccgagaatgtcattgcgatggatgcttgaagaaaaaagaagaggagcgggagaagtttgcgcaaatgattcaacagaataatgaaatgcgcaccaaatatgaatttgaaaatttggatgtagaaagtcgtttatatctagctgtcatattacaaaaactacatgcaacaaagctaacaaatgttggaccatatagtcgacacctcattgatgaaaggttagaggacaattttggaaccgattcatcaaatttaattgaaaagttgtacacgagcggcgtactggtgctttctccgttgagtgattttgatgtcttcactgatgtttcattcgacaaacaaacagccaaatttaacctaactgatgtggcatgggacgtttgggttcaaagtgatttgctatctgatgacatcctcctacagacgcttacaaaccccaacaaagggatgataatgggtgaagctgaaacgaccaacttacacagacatcttgtcttgaatgaattgaaacgactgttttattttgaattagcacgcctccacttcgaagtgagaaacgatgctgaacgagaatgtgtttcagatgcgctgaagcgttggtccgcccaattccacccatctgaaatttattatcttatttacatttccgtcaggagagctaacgataaacggacaagtggagaatggggcaattacaaatttcaccaaatacaattcatcgtaaatacaggtgataactttattatgagttatagtcacagacataaaccgatgcagcagtttggctatccaacgaatagaataacgccgctgttagaaacacgaattttctttgaacagatgctcattgtaccgaactggtttaatcagacgattccttcagaagatggtgcattggggctagaacccatcaattcattaacttctcaagtgttggacaaaatgcttgatcaacgagaagatgctgccttgaaaatacctgggatcatctctgatgcgaaatggttcagcatcagaatctgtggagttgtaattaatgatggaaatgttgactggctatatgccgatcaactgacagcatatggatatgccaaacaaattgaaaccactaaaaatcaaaacttaaattggacagagaggatcattattgacggcagctactatatccagggattttattcatttaatttcttaattaaactgattcgggccttgaaagacggggccattgctgaaaaaaattaatgttataatatggcagactttgaaagcattgattttaataacatgggagaatttttgtaaacaataaaattaagacaaataatcgcaaaagtgtgggctatatctgcaaagttaaagccgaagctttagttttacaaatacagctcacacttacattttgagatgaatacatgtacaatacagtttccttaagcttgttggttatttcatctggcgccagttggtgatatgatctttccaaatataatcaaactccccaatcacttcttcaggggtcttaggcttggcgccagttagttcttcaatatcatcggacttaacatctagcagtccatccgcaattgatttatcattatctacaacgtcatttgcactaaacggtgctggagattttgaaaagtcacctgacatgtcatgggggatgttcaaggcggccaagtagtcataatattcttctcgcgaagctgggacatattcaagttgttgtcctgatcgtttactgatcatatcagcaatttggcgaacggaaattgattccgaacctacaatgttgtagacctttcgggttcccttaccaagtagagaggcaactccggctttggcacagtcgtccttgtaaactaatgtggctttgccctcaccagctgttgtgacccaacggttgttggacatgaatgctaacatagctctcattgtcatgaatgtttccatgtataggttgtttcgcagtgccgtgtagtcaatacctgtgctttccaaatagttttcagttgcagtgtgatctggagtaacaaaaatatgttggtaagctggttctgttgcgccaacaaatgatgtataggaaatgtgtttaacaccgtcttcaatcgccgcatcaattgcatcacgatgttgttgaacacgcttgccaacgtcaaggccagaaatcaaatacagtcggtccccaccttcaaaagccttcaacattgaggatttgtcgttgtagtcagcttcaacaactctaacaccggcatctttccagtgctttaacttatcctttggaacccggtctattttgtagcaagtgaaggttaattgctcaccacttacttctttgagcattaactctgccactcgaccagcgagcttgccatcagcgcctgtaataatatatcgcataataatcttcctttctcgtttacaagttcagattatcacatggaaggccaatcgattatcacgcttatttatagatcatgaaagaatggaatgataaatttgaatttccaacaactacaatgctttgtaacagtttctcaaacacttaatttttcgacagctgccacccgtcttcatctatctcaacctgcagtttctaagaacatcaagcagcttgagacagagcttgcatttgagttgtttcgaagaaatcagcatggcgtgtcactgacggtggcgggacaagaattttccaagcaaatgtcaaacgtcttgatattgactgagcaagctattcttgatagccgtgaaattagtgaaaaggatcagcaatcactcacgataggttacaccaatgcaatgattgaaaataagctacttcctaaactgttgaggagcgcacatcaccagctccctaatctccgtttatctttacgaagttttgacttaagcactggtttgagtaatcttcaaagcggtgtttttgatttaatacttgcaaccaaggacactattggtgataatccccgtgtcaagtttgtaccgatgtttcaaggtcacttcaatgtggttctaccgattgggaatcggttgagtgagaaatctaagttaaccttttcggacttgaaaaaatcacagttaatctttttcaatccgttgcaagcaccccctgaaagtgcaactcttcagaatacttttattcaagcaccagaggattttcactatcaaacggctgacactcttaatactgcaatcaatatggtgaagggggggattggattggcagttttaccgtcttttacggttgattcgactgaatcgaatgttactgttatcccactggattatccagtgatacttgattatggcgtggcttatctagaaactaattcatcaagctcgttgttgagtatagttgcgcttctaaaaacgttgatcggtaaggtgtaaagtgaaatttgtaattggtactttccaggcggaaaattatgtctggataaaactaaagcctgagtcatcaaaatagcccccgacatattgcgtcgagagctgttttaatacccaggataataacggtttcttgattgaaaaataatgattcgccctgatgccaagcaaaaccattttttgcttaggaatatactctgaatgtgcatcacttagctattcagtttctccatcaaattgtcataatcagactgactcataataaccacaaccgcatatgaatggtcttctcattactgtgccaagaacccaccatcaatcggtaactcaaccccagtgataaatgatgctttatccgatgccagaaagacaacagtttgggccacttcgattcgttcacccaaacgacccagcgggaaaatcttgccaagttgattctctggtatcccaagggatgctgaggcgtagtcggccattccagttttaatatagcctggatggatcgagttgactctgacattcttgctggcatactccgcggcggcgtccttggtcatcgttctaacggcacccttgctggcaccatagagaatatgaccggctgaaccggcaattccggcaattgatgatgcgttgatgaccgacccgtgattgttctctgccatcactgggaggacgtgcttcaatcccagaaaagttcccaagacgttgattcgcattaacttattccaagtatcgactgttaaatcagcaattttaccaataatgtaaattcctgcattattgaaaagaatgtcgattgtcccaaattgatcaagcgtggtcttcacaactttttcccattctgcttcgtcaccgacgtcctgttggataaacagggcgttctggttattcagttcatcttccacctgcttacccgcatccgcattaacatccgtgaaaacaacttttgcgccttcctggagaaagagcttcgttgtttccagaccaattccattggcaccaccagtgatgatggcaacttttccgtccaactctgccatgttgatgacctccttaaatccatgaggaacacgattcgtggttaacgatagcaccttagttggagtcttgaaagcgattacatttattaaatgaatcacatttatggagattgcgttgcgcacgttgtttaagctgcattcaggaaagtggttcggttcatcttcagatttcaaagatgggcggtgtataatacagtcatccaaactggtgatctttacttacgtgaccaatcattcacacaagcagttaacctgaaatagttgactgcttttctttcgactatatgtcgtgtatcaaatagtctgatttcatgatttgaaggtggaaaacaatgctgatttttatgaccatttcattagttgccgggttcctattgtccaatcaaagccccattaatgctgatttaagccggctagtgaaatcgccgtttattgccgggacgatttcgttcattatcggcaccttgtttttagcgatcctggctatgtcaatgaccgggcggttgtttccaaatggcaactttattcaagcgcagccagcctggatttggttgggtggtctgctgggttcgatttatctaacatcaaatatcctattgtttcccaaaattggcgccattcaaacgacaattctaccgattatggggcagatcacgatgggcaccgtgaccgattggttggggtggttcggctccgataaagttgccatgactgcttggcggctggttggcattctgattttgattgtcggcgttctggtggcagttgccttacccagcctcaccaatcgcgatatccgccggtttgacgccaacgttgctcgacaagacgggccgacacgcgtgattggctggcaaatttgggcggtgattgttggggtgttggccgcgatgcagcaggcaattaatggtcatttgggaacattactgcattcgaccagtcaagcggccttcatttcgtttttcatcggcacgctgttgattgcggccgttgccctgatgattgacaaacgtgtccctaccaccagggaactaaaaaccacccaaccttggaactggctgggtggcattcttggtggctcatttttatttgtgaccgtggtggccgttccacaaattggcgctggcctaacgattatgatgggtttgatcggccaaatcatcggctcgattctgattcagcaattcggttggtggcggtccatcaagcaacagatggtgcctgctcaggcattgggcatggtgctgatgctcatcggcgttggactgattaagatggcctagaaatggcgtgatcattgagactgttgatcgggttctttcatgaagaaggttaacgcaccaattaccgccaagacaacgctaacggcgattaaaatcggtgccggctgatcactgccgatcagatggctcaatcccgacaaggcgtaaggcgttaagaatacgccgatattaattcccacaatcagaattgaagaggccaaggtttcgttgcctttgccggcaatttcggctgaactggcaaacaagtagggtccaaccagcgacgtacttaacccggcaactaccgtcagggtgtaggtaagcgccagtgattgggatcgtgccagggcaaacagggctactgcggcaatcaacaagccaaccggtaaaatcaattgatgaatgagtttgaatatttggccgtaaagagtcccgccaatcatgttggcgacccccaggaaggccagagcaatgctgccatcggcaattttgccgtagccgccagttaaaattaggccggaaattttaacgatcaccgtctgggcaatcatcatactgaacaagactaataatgcataaatcattaaccggcccttcaatagttcccccaaaccgactgatggtgtggccgcctcttgatcggcttgcggttgcttttcttggcggtcatttggcgcaccccaccaaaacaggatgaagactgggatggcaatcagatagtataaatagacttggcgccagccaaacccgattagaattgaggaaaacacaaacattaaaatgttgcccagtgagttcaccgagccttcatagcccatcatggtctggcgttgcgttccctcgtaataatagctgattagactgtaggccatcgcgttgaataaacctatcccggcacccagtaggaatcgcgacgccaaaatcagccagaatgaattggcgacagtcggaatcagtccggcaatcaggacgatgaagaccccaattaacacggttgctttgttgcctaatcttttggcgatcggattactcaagaccacaaaaatcaagacgctcaaactgggaatggtggtcagactttcaatttggctcagtggaatcgatgggaaccgttccgccatgatcggaatggttccggcgaccgcattggcgctggttaagagaattgaaatcgataaaagtgcggatgccaaccgccatcttgcccctcgtgtcataatacttcccccttacatacaacgattaatttttaaagattgcctgaatataatgccgattggcaagtgcgactagtttgtggaccaaactaagtgagagttttccactggactgttgagcaagccgaatcagtggcgtgtccatgacgatggcatccatgaatttggcttcggaactatttggatctgaaatgcccttggtcatgttggcttttaaaactgaaacgattttacgaataattgccgagtgggtactcagttcccgcggcgtgttcaatggggtatattgccccggttgcggagttgctggtggcgcaacggtcatcccagtcagttcggtgaaatcagcgatcgtcggtttgccaactggatgggtgtaccaactcgggatggaatcagttggggtgatggcttggccgattacttcaactggtgcggtgagttcctcaagacgcgatccgattttgacgatgatggtcttcgagactgctggcagctgccaggcttgctgttgctcatcccactcgctaaaggcttgagcaggcagggtgacggtaactgtctgttgctcaccggcctttaaaaagactttttgaaaggccttcagttccttcaatggtttcaaggcgcggtcagacgaattgccaacgtaaacttcaacgacttcggcgccatcgcggctgccggtattggcaacgtcaacggtgacgttaatcgattggccggcttcaatttggtgctgatttaactgtagacgactcatttcaaagctggtatagctcagaccgaagccaaacgggaaggcgactggttggttggccttttcatagtaccggtagccgacatagacgctctcggcgtaagcagccgaacgtggattgtggtcatatagctcagccgacggaacgtcctgataggtaatcgggtaactttcggcaagcttcccggatggattgactttaccggataacaaattagccgcggcgttgccgacaaactggccgcctaaatagaggttgatcaaccccttaactttagttcgccacggcaattctaccggcgctccggcaaccagtaacacaatcacgttcgggttcaccgccgccagttgttcaatcagctcattctgattattaggcagcttcatgttaggacggtcaaagccctctgattcggcactttctggcagtccagcaaccactacgacagtttgagtattcttggcagcatcagtggcagcagtcgccaattcacggttgttttcaccggtaaattggtagccctgcgcataatcgtaggcaatcccggcattggttaatccctgcaaaatagaggtctgcgatgggggattaatgtgggaagatccggcaccttgataacgggtttcagctgccatctggccgattaccaagagcttagtggatggatcaatcggcaggatgtgatcatcattttttaataagaccgcggcgttttcggcaatcttctgggcgagttggccattttttgtcagtaggtccttgcgatcgccagtgaattccggccgctgcttttcagcaattcgaacgacgtttcccgctgctcggtcaagagctggtcgtttgagtcggccggcattcaaagcctcgagcgcctgcgggtcgaacatgttgtgactggatggcatttccaggtcgccgccggcattcaagctggcgactttgtcattgagcgcgccccaatcagttacgacggcgcctttgaatccccattgctgacgcaaaactttgctcagcaaataggcgttgtcgctggaataagtgccgttgacctgattgtatgaacacatcacgccttcgggctgcgcagattcaacggcaattcggaaggcttccagatacaattcgtgcagggcagttggatcaatcatggaatttgataacagccgatcggtttcttgattgttgccggcaaagtgtttcaagcaggccgcggcaccttcagactgcaggcctttaatccaaccggcgccgatcatgccggctaaataaggatcttcgctgaaatattcaaagttccggccgcaaagcggatttcgcttgatgttgatccccggtcccaacaccatatccacctttaagctgcgggcttccaagccgatggcgtggcccatttgagcgaccaaatccggatcccaagtgcaggcaactgcgctggctgttggaaaacaggtgctgatagcgctgtcatttatccccagcgcatcgccttcacccgcctggtagcgaaggccattgggaccatcactcattcgaaagctgggaatctggtggtctggcagtgccaccgattcccaaaaattggcgccagatgttaatttaatgagttcctctggtgataactgttttaactggtcatccacagactgcataataattcctcccctgattgactgatgcaataattatgcttgtttgatagagataattttggttttatcgtatcatcaacggggactttgtgctagttgttaggcgtttggatattgaggatgcacaaaaaagtcagttgcaattcaactgacttaatttgggcatcctcaatatccaaaaaatatctattggttatttgccgctattagctctgcaaaggatcccaagcgaattaggttagaataaaaagcatgcttggcaattggggctaataacttaacgggtagctgattggtcgcatctttgagaatgtatagatcctcttgaacgacagcttggtgattttgtgcatgtaccgaaaaaatcagtttgtattcaagtcgtccctgagtactgatgtaagtaatctttgacccattagtctcgatccgaatgcgttcagactgatttaatgccgctccggatcgtttgatgagaaaaccgttctcagattgatctacagtggaaatgtccggtacccactgaagcagttgttgaggattagacaaaataccctttacatcttccatatctgcatttaccattacaacattcgaaaacaatttagtttccataaacaaagacctccttaattgaatggtcttaatttactaaatattagacttgttgaaaaatcagaatactgatatttagaatttatcataaactttttcatgaaatagttcagttagaaacttttgccgttgcagggattcgagcatttggtctttgtctcctgaattcttagcaatctgtgcaatcaaatagtaacagttagcgagcatgtagtgtgaattatgatttgtgatgaaagtgattgcactttcgacttgtttgaccgccatggcattgttacctgattgatagtcaatgaatgctgccagataaaaaataacattgatattttcttcatacttgatgttgccgatgttttgcattgcacgttgaataagctttgtggcactactttggaggtgatttttactcttcaaaattgctaaggtgatcagtcctaagcgtgttagaactgataaactattcttttcttcagcaatgttaaccgacatttctaaattgttttgagcgtcatccagttttttatcagtatgaaactgggatactcccaaatagtagtaatatgcctgggtttgctggggtgtttcaatttgttcaagtgttgagttttctgacaagaaagatttaagttttaaataattgtgattattacaaagcttctcaactgtctggttgaaagtgttacgtgggctaatatcgaaattatcagccaaactgaattggtcaagggatacagaaagtcgttgacataatttgatcagcaattgcgcatttggggtgtattgattgttttcgacggccgagagcattgattgcgcacagattccatcagataattctttttgtgataaaccctgtcgttttctagtttgttttaaaatagtaccaatttccatagatagcccttcttgtattgcaggattcataacgatttgtcagttattatagcacagaagtattctcccaaaagtattgtcattaattggctatcttctgacttccgttcatttgcaattcattcaaaataaggattgtgttaccagttaaccgtgatatgattaccacagcattaacaaaaagtacatagccactaaggaagcgacccacatgaatttctcaattctgatttccaaagtttactctaaaatccttgccgtccactggtgtgtgaccataattaccgcaatggcggccatcgtcttttatccacgattacctcaaatcgtttcgactcattttggctttggcgtcgcagacagtccaggcagcaaaatcacgatttttatcttacctgttacgttaatcgtgctgggactgatttctgcacccaagtggattgaccagcggttcgctgattatacaatttttaatacggccgttaagagtctcatgattgtgattatggtgctcgtgtgggtgggggtcggtatggcatttttcacttattatgagttggcttggtagtatctatcagaacaaaatagcagtcgtcaaatcacaagcaagtggtttgacggctgctatttgattggattcgtctttagttcaaatactgcgtaaacaacttctgataaatctccacaaagttaaggtacatctgtttgtcgacaaactcatcaacttggtggacactgttacttcctggaccaaagatgataaatgggaattccttcggcttatcccgcagcatgttcgatgcgtcggtgacagctgggatggcaccacttgggatgtctttttcggcatattgtttgccgatttcctgtgccaagccgatcaactttttgtcgccggtcgtttcaactgatggctgagacatgtaagtttccttgacgattttggcgccgttggcattttgctgtttaacgagttgatccagctgtttgtcgacaacgtcattgtcgaactctgggatggtgcgaacgttgatatcggcaacagctttggctggaattgagttgacttgatccccgcccttgaagatagtcgtgtcaaatgccagattccccaacattgcgctctttttatcggttgctctaaattgatgattggcgtcgtgcaggagatcaatcagtggatccagcgcattgtagccatgctccggcattgaactatgggcagctttaccagttgaagttaggcgaatatccattgaccctttgtgggcataggcgattcggtagccggatggttcaccgatgatcagtgcatcaacgtcgtccattgagccatcgtcagcgaaggttcgtgaacctaattcgccaacttcttcgcccatggttgccatgagccgaatccgaccctttttcagcaagccctgatcatgaatctcaatcatggcaatgaccattgcagccaacccggatttcatatctgccgcaccacgaccgtatagcttgccgtcgcgctcggttaatgtaaatgggtcactggtccacttcgaggtatctcccggtgaaacgacatccatgtgcccggagactccgaggactggattgcctgtcccaatttctgcttttagatcagttcgattctcatcgactgggataattgtggccgaaatgccatgtttctcaaaaagattttttaaataaacgctgaccttttcttcatcagtgttcaccgattgaatcgcgatgagatctttgaaaatttgcagccgttgttcttctgaaaataccgccatagaaattcctccttgagtgattttctgggcgggaagggtgaagccaaattgtcggatgcgcacacaacgatcacgcccattactttgattgtaacagttgatggtgagagtgcgcagactttctgaaacaattgatgcccttaacggctatgaatgaccagcttcttattgccggtgataaaatgcccattgcttaattgataacgggtcgtcagattgtgtttaaccaatttcttaacggtcagacgagcccctttcctgtagtgcttggccttgccggacaaattagcattctggtaggcgtaaacacccttggtggcgatcaccttgacctgattggattttggcatggtctggtagtagacgttggttacatactttggattagcggtgatgtacccaaccttgccagcagtctttttgccgtggttgacgtcacgaactttgattcggagggcaccgccatttgatttggcaaaatcaatgacgacaaacattggtcggttgattcgcttagttttgggataagcggctattcgctgtgactttttaaaagttggattttggtagaggtaaattttcttggttgcgtagaccgcatcgttccgaacatctgcatagttgggcagaccggtgccgtttggattctttggattagtcgggttccaggcaggattgctgctaccggaattattgccattggtgtttggtgtcggggtcggatttggggtcaccccaggggctgccgacacgataaccttcacaacggcctttcgcatatggtagctgtaggtgacgttataggttcccggcttggaggtgtcgagtccgctggtgtcaactgccaacccgccaggctttccttcggcgacggcttggtcataagtgaccggttcaccattgccatccgctgcggagacaaaccccgctttgggatcaaatgattggccgactgtcaggttgattggcgatttaacatccaacgtgtctttgaaatagggaacccaagtctcgaccttggttggatgattggcattcgactgatcatacagggaagtcaattcatcggggaggaaggcagtcgctcctttgggattgtcgacggtaccgcctttatcggcagcgaccgcctgccatcgttcagagccggcaggggcgccgagtgttgggagccctgcagacgcgccgttaatggtcttatttttatcaaattgaatatttggtcctagtgtcaattgggtgaggctggatgttccccggagcatgagtccgagggttccgttagaatatcctaagagcttttgggtgtcaaaccctgacaaatcgaggctggttaaacttgaatcatccgcaaacattgccctgaaactggtgacgtttggtgtttgaaaagacgacacatcaaccgtctttaagttaggatcattccaaaacattgccgtcatttctgtgaccttttgggtattgaaattggtaccgttgatgctttcaacctcgtgcatatcggcgaacatgttgggcataatcgtcacattatcagtattaaagttggcaacattgatgcttttcattgaactgtcattagcaaacatcgctgccatatcggtaactttcctagtgtcaaaggacgacacatcgatggaggtgagtgcttgatcttccgcaaacatcaactccatattcgttgcttttgccgtatccacattctccatgccattaatcgtggtcacattattgagggaggaaaacaactcacgcgaggcctcgccctcaagataaagcttacccgtaatgttaatcacggttgccgttcttatatttgaagtcaattgattgtcgattctctccgtcaggacaccacccgttaaattgaaattattgccgtcacgggtccagtctggaccatctgggccaccaaaatgcccactggcggtctcatcttgaacagcggtatttgtttcggctgcttcagtcaaaacattcgtgctggcagccgtccctaacagcaaccccatggccgcggccatagcgacaacaactttgatcacaatttttctttgtttcatagaaaacgccccctcgacgtttacaaactgtcaaaacctgaaccaggttcaattcgccttcagtatagagagaagatggggagatttgtttgttggtttgtacaaagattgcaggggcattgttgtgagaaagtccacaatagttttttcttgtgccggggattctcaccagcatcctaaaaaagccaccagcacgatactggtggctaaaaatatgaactgctttcagttaagcttttccctgaatgactaacttcttattggcggatacaaagtaaccgttactcaactggtagcgtgtcgtgagattatgcttaacgatcgctttaactcgaagatgggtgccttgcttgtaagcctttgtctttcgggtcaaattcttattcttgtaggcttgaacgcctcttgcagcaatgaccgtaatctctttattcttaggcaatgattaatagtagagattagtgacaaatttggcattggcggtaatgtagccgacattgccttctggtgtggtaattgagttgaagaccttgctggcatcaaacttggttccagttgtcatactgtatgttggttgaaccgagatggccgattgatcaacaaacggcttttccggtacgaaagtttccacttcagttgggtgttcaggattggtaggttcatataacccgcggatgccatcaggtgagtatactgggccttcaggatcttctggggtaccactactgactgcctgccagttgtctgcgccagccggggcaattaagtgtggatcgccgatactctcagcagggccaaacaccacgtttggacctagtttgagattggtcaagctggtcagggatgccagcatatttgacagcccccatgctccgtgaatcaacgtctggtgagtatcaaagttggataaatctaagctggttaaagaagtttcgccggaaaacatgcccgtcattaattctgctttagatgtatcaaacttggaaacattcacagtggttaaagattggtctcccgcaaacatataagcaaatctaacaacattttccgtgttgaaatgtgagagatccagatttgttaaagcaaggtctccggaaaacatagcagacatatcatctactttttcagtattaaagttgttgacagataattcctgtagccgtacatcgtcttgaaacatactggccatatcgtaagtgctggttgttttaaaatgagaaacgtccagagttgttaggtgggtgtctcttgcgaacatcgcttccattccagtgacattttcagtgtaaacattcaaatgttccaatgatgcgtcaccagagaacatgctattcatgtcggtaacattatctgtattgaacgtcgataaatcgagctcgagtaagttggtatcatcagcgaacatgtggctcatatcagtcgcttgggtggtatccaatttttcgatgccctcgattgccgtcacatttggtaatgccataaagaaactgctggccgcatttccctccagaataattggtccattgatctcaactttggtgatcgtttcattaaaattccatggataggtctcttcggggtggcttgagatggcccaccactcagacctagaatgccatcactaatttggtacgtcactgtcccaatttcgccggtctgatggggtacggccgctaaaggctgcacgatgccagatgaaactggtgagctctgagatggtggggggtgcttgcggccttcaccgagccggttgtgcccaccaatagccctaataaaaccgccgaactaatgaataattgctgaataaacctctttgagtcatcattttaaccccctcaataacgattaacttgactgctgaacaccactttgtccgcagtataaatcgtgaggggtggaaatgtttggcacttcctacaaatttatccggcatttcttgtcgaaaagtccatgccatttcgtattggtgaaatggcatgcattgagtcgggacatttggcagtatataatcactttgtatagggaatttgaatagttagttttaaaaataatgaaaactgaggtggctattatcacaatcacaaaagtaatcgaaggcccgaccatgactgctgcaacacctgatgaggtcgactgccagcagcgccagttggtctgcattgacgattccggttatatagagcgcgtgatcaatgaatcagatgacgatttttcagcggtcaagcgcgacgccgagcaaaatgatcggttgctcacgttgaagtcaaatgaatacctattgcccggcttcatcgacctccacgtccacgcaccccagtggcctaacgccggggtggcactggatcggccgctgaatgaatggcttgatacatatacatttccgatggaggccaagtacaaggacgtcgggttcgccaagcgggtttatgacgatctggtcggtgaattgctcgcaaatgggacgacaaccgttctttattttggcagtgtagataaccccgccaacctggaattggcgaaagcttgcgtcaatcacaaccagcggggctttattggcaaggtggcgatggataatcctgaccagacgcctgagaactatcgggatgcctctgctcaaagtgcagtcgatgacacagaacgttttattcaacaaattgaccgcctcaaccagacttcccccatcaagcaaacggcggtcattacgccaaggtttgtccccagttgcacgcctgaatcattgaaaggcttgggggaattggcgaagaaatatgatttgccggtccagtcccactgcagcgagagtgattgggagaacggttatgcactggaacactaccataaacgggatgccgaagtcttggacgagtatggtctattgactgacaaatcggtgatggctcatggcacgctgctcactcaagccgacttggataccttcaaagcccgtggcgtggcggtcgcccactgtccaatctccaacgtgtattttggtaacgctgtgctgcccgtcagcaagctcctgcaacaacaggttaaaattggcttaggaaccgacatttccggtggttactcgccaagcatctatcaaaatatccgccaagcagtgatgtcttcgcggatgttaaatgatggagtgaattctgaactggcaccggcacagcggggaaccaattacccaccgatttctgctaaaaatgggttctacttggcaactgtcggtggggccaagagtttgcacctcaaaaccgggcaaattaaggcccgttatttggctgacttgcaagtggtcaagtcaccgttgaagtctttcgaagatgaaagcctggatcaaatatttgaaaaaatcatgtaccacgcttcaaaggcggacgtgaagcaggtgttcgttcagggaaggcttgcgaagacttctaataactaattgccagcttcattttctttaagcggatttgctcaaaaccttctgtcgacatgaaagtccgctcaccagtccagcagtcattgtagtaaatctgttggtcgtcaaagccggtcatcaccagcgcatgagtggcaaagccatcgaattggccgacccagacaacgattggatgttgcttttcggccagaaattgttttaattgggtgattgatttgccgctgagatccaccgcatgaccggcgtatttggtgaccagaccgactaatgccggtggataaatgctgtcaccgttctcggtaaatgggtcaccgacgaagcccttattccaatcgctgtcatcgtagggcatttcgtgagccagggtcactttgtcgacgggttggccagcatattggagcatcatcgtgactgcggtaatttcgcagccggtgggcagttccggcatttgtttgattaagttgacggctagttgagttggttgcataatttctccttgagttagtggatttgttaagtgagggtcacagatatagtttgaatcatagatgatttattttagggatgcaatctgaagtgatgagaacacttggtaatctttcgtgaatcctgaaaatttcattagaatatcagacttctttgatcgcgacaaatagcgttttaacagtcatcaaaaagtgttcgacaattagacaatcaaaaggagtcgcccgatttttcgagcgactccttttaccattttatttgacgatttttacgtatctgctacttccggtgatataaccgccggcaatgtgatatctcaaagctccagagatcgtcatattgtgtgcatgcgagtaatcataatttttgactcttagcttggtaccgaccttaatgcgtcgattttcgccacgcaagttcactgtattataacgattaattggctttttgacgattacaagctgaacttgcttatgcttaccagcattgacaagctttctgttacctgtaatgtaatttccattacttagaatataacgcgtggttaaattgtgatgaaccagtttggttagatgtagaatcgttccttgtttgtaatgcttaatcattccggtcagatttgaccgtttgtaagcgttaataccttgtgggttgatgacagtcagtgtacgatgtttgctctcgtaatacacgggacgcacaaagtgccaatttgccgtaatgaagccacgcttaccatgggtcttgcttaaatggttaacatcgcgaaccttatatcttaaggcaccagcgtcggaacgactataccctgtaactacaaacatgggacggtaaaccctgggtttttgaatatatttgacttcacgaaggcttttatgaaagtttgcatccttgtacatgtagattttctgcaatgcataaactgcttcacccttggtcgccgcgtaatttggcagggttggttgtggattgggctgaggtgtcggaactgggctcggagttggaaccggacttggttctgggatcgggtttgggttgggttttggatttggtgtaggcggaacaggggattgatttttggtgtattttaacgtaataacttttgccacatcaccattttcgtccaatgtcccgaatttaaattgctttggattggttttatccggtgtgtaaccggaaatagattcttgtggaatattgactgcttgcccaaacacaccagtaatatgttgatcagtaccgattggtttgttattttgatcgacatgcttgatcgtggcagacattttttcttgagggttactgtttttgtcatagtacagcttcaagttttgtaagacatcggaaaatgggaaaagtgcttggccattcccaaatggcagagttaacaaatccccactgagtttatatccctcaggagccttaacctttactaaacgataggtatcactgctgacacctaaagggtaagctttgatgatcgctttatctgttagagatcctctctcctgttgggttggaataatcttgtcactgttctgattgttgagaagatagtcaacgttgacaatgccgattactgagtattcaattgagttgatggttaattgaaccgaagattgaatacccccatttgatgaggaaacagcaaagcttgcgtagtaaccatatttttgaagatatgacgaaaagtcctgacttccttctgagagaacgtcggagttggaaccatttttaaacagtttatagtgtaatgtcttagtttgagcatcccaagtaatgtcaattggtaactctttgtcagctcccatgtattcatccgaagagacgcttgtatctggcgtcccgagaaagtcaacatcgtaggggccgtcatattggccggtattgatttgggaattgtcaccggtcgtttcgaacatttggatggttggcgtatggcctgtggacgctgccggatcaccgtatggagatccatcgattacgaagccaaaggcaccttggagaccaccaacaccaaatcctgctccaccaatgccaagcagagaaggatcacccgttttgaacatgaaagatacgccgtcacccatattgccatacatactccttgggccgggtgttagattgtacattcctttgaattcaaaacttcggtgaaggtcgatgttgcttgccatatacgactggccgctgacacgtgcccaattgaatggatatccaccaccgttgtagtaaataaaacttttttggccattgacgtcggcatagtaactgccgtcagatcccagagaagcgggatatgatttacctgcaatggttaccgatcctgaagcaggatttccttggactgttgatagtggaaaagtgacttttccagtagatggatcataactggtcaaaccagtgtttttgaaaaattgggtatagttgtctttggtaattgtgactttggttccggtaggagaactattatcggctacggcaccggtattatttgcagaaacaaattcgttaccgacaaccaggaatgataacatcccaaagagtaataacaaaaaattgcgtaaataatgacttgatgaatccaattgactcatttcaaatccccccaaattacgaaatagttaacaattagattataactcttatatctaatggtgcattgaaaaattcaaaattttttcgtggaattcgtgccatcggattcatggactcccaacatcttttggaatggaaaaccgccaaagttattgactgctttgacggctggcattaacgattatttgggtggggatcattcactttaaccactgaatcttcaccggcagtgaattcacatgtggtaaatgattaaatttccgacggtcaatgtaaataataccgtggctgttgtctcgggcatgaaccaccttgatcggcattttagtgaggtggtccgccacccgaacctcacacaaataccgcccgctttccggcagctgctgcaaacggctggatggattaacgatcgacaacccattggtttgggcatgaatcaatttcccagtggtttcgtagggatgacccagtaagcgtgtcgcctcttgaatattgccgtcgcggaccaaatggcgaattcgcgtcgaactgatttttagttggtcactggccaattcgttgaccgtgaccgttttgaccttaccgccactgattttggccagtgaatcgatggttgttgttccaccccggccaaatgtgtagtcgaaaccggccacaacgactttggcatttaacccaatcacgtactggtctacaaagtgctttggtggtaaggcggcaaactgtttggtaaagtcgatgacatacagaatatctgcgtgagttgcccgcaccaattcaattttctgtttcagggtggttagataccgaaaactggcgctttgactatgattaaacactctggaggcatgtcgattgaaggtcatgaccgctagttgataacccttttggctggcaatctttcgggcagttgcgatgactttctggtgacctttgtgaacgccgtcaaagaagcccagtgccaagacaattggggtgggggaactcgccatatttgattgagaatgttgattcaagtaaacgactttcatcgctggcactccttactacctacttttctatgtactgcaaaggccggaaacaaaagcgcttgtttccggcctttgatcttctttcacaacgattatcagttggtttgaagctgatggttctcggcttctttcaagaagtagctcaatggtttcaaatcttgtgcctgatacttcttgacgtattcggcaactttgtccttatcctgccatgaagtgtccaggaacatgtgctgagtcgtcaatggcatctcgtgggttaatttaacgtcaatgaccactggtttatcagtgttttcagcatctttgagggctttttgcatatcttccttggtgtgaacggtgtaactgacggcgcccattcccttggtgacttcagcccagttggtgtcaggcaaatcaacaccggataatggctgatgagtatcgtcagtctgctccgcttcgataaagccaagcgtttcgttggtgaagatgatgttgacgatgtgcaggccatatttgacttgagtcatgacttcttccattagcattgcaaagccgccatcaccgctgagactgtatacgtcgcggtctggatactcaagcttggcagcgattgatgctggcagggcaaagcccatggttgcgtaaatgcctgaggttgcccatttctggtcgtcatgcatgttgatcagtcggtcgaagttgatgtcaacgttgccgacatcaacggcgaagactgctttgttggaggcagttcgattcaagacatcgaagattggttctggacggaccggcatttgatccgaatctttgaagctgtccaaccagctgttccagttttctttgttggcaaggcaagcctgatagaatgctgaaggctgacgagtttcgccggcttcgagaatggcatccaaagcaacctttgaatcagccaacattgaaacatcgttgtgccgacgctcaccgagtttttcgctttgaatatcaatttgaatgactttagcgtgtttgttgaacaagaagatgctgaatggcacgttgttgccgacccacagaattaggtcggtgctgaaaccggcttctgaacctggctttggtgcaacccggccggttgatccaagataggctggatagtcgtctgggagaattcctttggctaagaatgatgaaaccaatggcatcttgaatttctctgaagcttccttcaattcgtcggcagcatccttggcaccaatcccgaagtaaatcattggtgatttagcttctttgattaatttaacggcttcttcaacgtcttctggacgaggacttggatagacaggtgtttgatgcgacttgacgtttggctgatacgtgtcgttaatttgagcccagccaagatcctttggaatcgttaagactgcaacaccgtgtttcatgtaggcttgacggatggcttcgtcagtcattcgcggcaatgcatctgccgtcatagcagtgcggttccaaacagcaacatcatcaaaaatcggctcttcatccattgcctggaagaagtccatgttcatgctgccggttgggacttgcgcaactaaagcaacaacgggaacgccgtcgcttttagcgtcatacaggccattgagcaggtgaacagcgcctgggccggctgatccgaaacaaacgccgactttgccggtcaacttggccgttgcggcagcagcgattgcgccggcttcctcgtgacgaacctgaacatagttaatctgtttcttttggttgtgaatcgcattcatggtcgagtcaaatgagccacctggcaggccgtagatgttcttaacaccccattgttcgagcaccttaagaacagcatctgaaccactaattgtttcaaccataaataaataacccccttaaaaaattttgattcatattttttcctcacttactcgagtatagtgcgtccttaatcaaatgtaaacgctttaaattgaactttataattatttcattttagataataaatgcggatagaacgcgattcttatttgaaagaaagcggatacagaactataatcgaaaatgtaaggagatgcacaatatggatgcaattagatattattcacgaacggggaatactgaaaaacttgcgaacatgttaggcaatcaattgaagatcgaggcgaaatcgattgatacaccgctgaccggaacggttgaccgactgtatttaggtgggggaatttataacctgaacgtcgatgaacgcttgaaacaatttgcccgcaatctggatcccaagcaagtcaaagaagtctttttgtttggcacatccggcagtctattcacggtgggcaagcaattgaccaagattttggatcaaaagcacattaaagttgccaaggatcatttgtaccttcacggcttgatgccgaagatgggcaatattaatcagcatcagcaggctgagatcaagggatttgctaaagaaacggttactgaataaggctatggaccagcaacttcgaatccttttggagacagttgcccgccagttaccaggactacctcagactggtggtgacggttggtaggctaaagcgacactaattgttgtcagcctactaaatggattagttggaatttgcaaatttatctatcataagctcaaaaattcaaccaaacgaatcaataaaggcgattcccacagcaagttagctgttgagaaccgcctttctcatttggatgtcaaaatgtcgttaataatacaaatcaatttattcacccggtacgtagtcctgatcaatcaccatgactggtttgataaccgagccgtcatttgaagctttgttagcttcattgacctgatcaaaggtgtagaatttttccagcttatcaaatgggaattcgcctgcctgccagaagtcaattaaagtctggatcccgatttgtggaatggcatcgcccatcaaaacaccatcaacgtgtttttgcagcgcagtgatttcattccatggcatgaattccaatgtcttggcagtaacggcgattggagccagatgaccgccggatgccaaagcggtgatggcttggtgcataatagctgaaattccagtggtatcaattgcaaagtcaacaccttcaccattggtgatttcatgcactttatcaacccagtcttcgttcagactgttgattgtatcggtagcgccaagttctttagccatttccaaacgtgaatcgtggatatcgacacagatgatctttgagcagcccttaatcttggcagccatcaaagcagctgaacccacagcaccggttccgacaatcgcaattgttgtgccttctttagggtttaagccgttaaatactgtcccggatccggttacaaagccgcagccgagagggccgactttacgtaagtcaatatctttgtcgatcaccgtaatgtttcgttcctgaaccaatgtctcggtggtaaatgaggattggttaaagaaattatgaattggtgaaccatcttcacgggtaaaggcgactgatccatcgggacgaacgcccgcaaaattcagcttcccccagttaatacatgaagatgggtgaccggttaagcagtgacgacaagtcccatcgtaatcgtatgagagaatgacgtggtcgccttctttaacggtggtaactgacgaaccaactttttcgacaattccggcaccttcatgacccacaaccccagggtatgcgtagtcgccggcagacccattacgaaccgcttcatcagagtgacaaatcccacttgcaacaatatgcaccaatacttcatgtgcttttggctgatcgtcgacttcaagtgtttccaacttgaacggtgcatttaactcttcgatcaccgcaccagtaatttgtcgtgacataacaaaaactcctttcgaaaataactcgaccgtctctaatcaattcgtgtaagcccttccatacgcgaagaatactacgaattttatgcgcgtacaaggaagataacttattattttatgcacaagccaagttgataatcaaagaatcatacattgtgactttaatcactctgttgggaagaagtcatcatgcgaacgacggcattaacattgttattatcagcagtttttgtggcagtcttctcaatctcagccgctttgcctttgccattatccgagagctgaatggcaatcagggaaatcgtgtgattggccttgtcttgaacttggccaacgaagatattgctgatttgtttgggatattttttgatgatgtcattttggacattggtcaatgaggcattgtcgtctgaattggtgttggtttgaatcgtgtcattggtgtctgattgcttcatataatcttgaaattctttgggtgtgatgtaatttcctttggtgagctgggtcaacgataactgatagtcaccaagatgatactgcttcagtgagtgctgcagttgctcgacttggctggcagacaagcgttggccgatgactgagatttgaatatttttgccgtcaacattttgtttggcaatgtattgattgctgagcttctcgttgataaattgtgataattgcgtgtcgacaaatgaattgtggacgatcgtataagctgagattgagctgggaatgacaatgataatcgaaatgatgacgatcagaacttgttggcgcaatgatacattcagccgttcaccgctacggacgcgaaaaaagatggtcccggctgccgttgccaaggcgatgaaaaaggcgttaatcaaaaataagtagcccgcgcccaaaataaatgaagcgttgagatgactaatcccatacccaaccgtacatagcggcggcatcaaggccgtggcaatggcaaccccggggacgacgttgccaccatcttttttcgcggaactgatgacgccggcaaacccaccaaaaaaggtaattaatacatcccagagagtgggttcggttcgggcaagtagttgggcgctggcggtatttaatggcgaaatgaaaaagtaaatggttgcaccgatgatcccaattgtcacctgaatcaaaaagagtcttgccgcttttgataatagctttggattactatttcccaagccgtagccgatcccgacaattggcgccattaatggcgagatcagcatcgctccgatgacgacgggcgcggaatcaacgttgaggccgatacaggcaatgatgatggcacagaaaaggattgcttgcgttgaccaggtaaaattcaaatctttttggacattcatatttaaagtttttgtggaaatttgctgcataatcatcacccacttctattagtattccttttttagaatagcataagcaaacgcttctctcatggattttgtcgccggttgtcgactttgatcctgggatggttgaagacatggggctgattttttcgtatactatagtatgtgactaattcgaaaagaggactgaacaggttgacgcccgaaaaactattaaaaactaaatttggctatgacagctttcgtcctggacagcagaccgtcattgacgatattttggcccatcaaaacgtgttgaccatcatgccgaccggcggcgggaaatcgctgtgttatcagattccggcaatgttagaagatggcctgaccctcgtggtttcgccgctgattgctttgatgaaggaccaagtagacgccctgaacgaaacgggcattcccgccacgttcatcaacagtagcctggattttgacgaaattgacgagcgctttcagcaggcccgagacggtgaggttaagctgctgtatgtttctcctgaacgcttggattccggggcgtttaaccgtttggccagcctgccgattgatctggtagcggttgatgaagcccactgtatttctcaatgggggcacgactttcggccaagttatttggcattgaccgaacggcttcatgacttgccgactaagccgacgatcgttgcgctgacagccactgcaacaccgcaagttgccgacgacattaagcagcgtctgcatataaaagaagaagtcaagaccggttttgcccgggataatttggcttttaaagtgattcagaaccaagacagcgacaaatatatgctggattatttgaaattaaacgccgctgaatccggcatcatctatgccagcaccagaaaagaagttgagcgggtcacgaagcttttgtccaagcacaaattctcggtgaccatgtatcacggcggcatgaccaaggagcaacgccgaaaaaatcaggacgattttctttatgaccgcgccttggtgatggtcgctaccaatgcctttggaatggggattgacaaaagcaacgttcgtttcgtaattcatgattcggttcctggtagtttggaagaatattaccaggaagctggtcgggctggtcgagacggattgcccagtgaagcgattttactgttcaaattaaaagacgttcagactcagcacttcttcattgatcagtctgaacgtgacgagcaaagtaagcatcaagcctacaaaaagcttcagattatgactcagtatgccaatactcagcaatgtctgcagcagtttattttgaattattttggtgagaaggacggccaaccctgtggtcgctgcagcaactgtctggatacccgcgaatcccaagatattaccgtggacacccagaaggttttatcgtgtgttctgcggatgaaggaacggttcggcaaaagtttggtggctcaagtactgactggctccaaagtgcaaaaggtgaaagcttttcatttcaatcagctctccacatacggcattatgaagggtgactcacagaaaaatgtggtttcattaatcgattacctgacagctggaggttacctaatggcgtccggtggccaattccccgtgttaaaggtgactgccaaaggtgccgccgtgctccaaggtgagacgaaggtcactcgaaagatctcggttaaggccactaaaagtgttgccgaaaatgatgatttatttgaatccttgagacaactccgccgtgaattggctgagaagcagggtgtaccaccatttgtcatcttctctgataagacgcttcatgaaatgagtgccgtgatgccgacgactgactcacagatgctggatgttaagggtgttggtgagagcaagctggaaaaatacggtgagcagtttatggacgtgattttgaattatcaagctgaaccgaaagttgggaccgaagtttgatggtacccgcagatgattgacatcagctaaatcattaaattttataagaaatgggccttcacctgaattttgaaattcggatgaaggcccatttttaattagtcacttaggatccgttttacccaaggacaccactttctatgagcacataaaccccaatcgcaacgaaaataatcggaatgaggatttgttttgagcgctccaacttatccttgatgatcggcaggttggcgatttgatagccgatataacaccaaaggcctgtcatgagcgagaagaccaaaacggtgattcccaactcggccactgtatattccgtgaagaggggaatatagacggttaggttgccggcaccgttggagattgttattaatgaaacggctaatatctctggcttgaatagttttcgcaacccagatttgtgccgttcaactttcagctcttggttgagcttggttttaacgtgagctgtctcatgagtttcgatcaattgatgtcgatactgaagccatttgcggatccctaaaacaattgggaccactccgagccagccgacttgttctgttggcagaaaactgagcccatatgccgccaacacgctgaccagcaccaaaatttcaaatccaatgaattggccgataacgatatctcggcgcctcaaagaagcatcaacttgtgaaaaccagactgccaggacaaaggtatcgtcgatgttggttccaataaatgagaggatgctggtcataatcgttgtgagcatgggttcacctccgaatgactgctgttagtatcagtataactgattcacagtggtcgtggtgaggtgagggtgatacagtacttattaattactttgaacagtgaccggaaccgtgatgatgttatttggataatccttcatgtagtatttgaccacatagttgccagctttgctggtatcgacggtgttttcggtcacagtaaagaatttggcgtaattttgggtatcgacaaaatatccttcgtaaacgaagtcgtggattaagtcccatggagtgaacttgtcaccgatatgcaaatagtaattaacggctttatcccatgtggtctgaacatcttcccaaacgagattaattgttacaacattctttagcttgtcgtaactgacccgaatactgacgtcccagtctccccaagcatcgtcctcatgccaaaatacttttccattgcccaatgcatccaagtctgcttgagttatttctgatttgttctgaatttctgctaatgcagatttgaatttttcttggtaagccttttgaacggactttgaaatttgaggttcttctggccaatcctgtccattaccttcagtcactgcaggtgttttcgcggatggatcataacgatttgtaacgtagttgatcgtcaacgaattcttggctgggacggttacagtagtgcttgcaccaggaacaatcaccgtttgtgttgggcctgggacgctgactgttttggtgaccgttgttgctgggccctccaaggagttgctgttaatccagccgttaaattctgggtgctgggcatcttcgatgtagtagtaagtttgatagtattggcgggtcatctttttagccgagatgacggtcaaatcatccttggcatatggtgtggaatccttagtcttgagacttgctttgtactgagtccaaggaatgtcattccaaacgttttcatcactggaagttccggaactctttaaatgatacgtagtttgacgaatctgatctgataaagtcacttctgaagttgtattaacgcgttcaaggccacccgcgtaatctctctttgcttttcccccataaatccaaccacgatattttccttcaaaagaaacaaccttgtagtaaacccgatggttcctggtagcagccattcgatagactctaaaggtatcctttgagcggacggagccagccagtttttttaattgagaacttgaggtaagctgtttggcccctttgagacttgcagctttgttgtacactttgtgatcgccggtcaacacaacatttcggttatttggatcaattgaagaaagcgaaacattattgatgatttcattggatttagcaaacgatggctgttgagacagcgctaaccatccgcctagtgttattacactggtagcaacaattttgataatactattactattcagaaaaataaatattccccctaaagtatattctgtttacacccacaactaatataacggatagcaccattttttgcaattttttcgaactctcccatcctcaacaaaaaagtcgtcagagccaaaatttctcctgcatagtgttataaatgatactgaaagctagaggaggggtattatggctgataacgcgacaagtaggggaaaaaattattcaattattgcagtgttggggatgttctcatttctaacggccttgtccggctccagtacgaacctggcgatccctaaaattgcgattgacatggacatttccagtagtatggcgacgtggatcgttcaaatcggtttgattacgacagccattctgttggtgatgtttggccacatcggcgacatcttatcaaaaaatgtggtctttttagctggggggattggcttcttgatcgggtcggcgattaccggctttgcgccgaactttccgattattttatttggccgggtgattcaagcgattggatcggcgatgattatggccaactcaatggggattgtcactcagtattttcctgataaacggcgggcagaagctctggccgtcatttcgatgttcatttcggttggttcaatctccgggcccggcattggcggcctgattatttcagcttccagctggcggtggatctattggattaacgttcctttggggattgtcattctatggcttgggttcaagtttttgccgattcccaaagaatcttgggcccacgtccgccaggtcacccagggcgccaactggaccgggcagaatttatttacccttggaatcattatcttcttcttgagcggttcattctttcaagccggccgttccaaactattgacggggattatcttcttcgccgttggcggggttattgcactgtatgcgtttattcaagatgataaggccaacctgccgtggattgcgccggaagtcattcataaccgtggcttcatgacgtcgattacagcgttggcgctggttatgctggttaattcagtttcaaacattttactgccattttattttcaaagttataacggcatgagcgccttttacagcgggctgattatcatgctgcagtcagtgacgatgctttgcacgacgccatttgccggctatcttgctgaccggatcaaccgggagttaatgaccgttgtcgggttgttgattttgatgatttctcaagtcggttacgcattcttcccgaataacctggatatgtggaagattattccaccaattatcttaaacgggattggcatggccatcttcctgtcgcccaacaacgctttaacgatgggattggttgacaaatcactctccgggattgccggatcattgaattcgtttgcccgaaccttgggcatgacaattgggatcagctttgggtcatccttgctgttcttccagctgccaggggttaaacgagtcacggccagtgtcggtctgccgtttattcatgcatttgccaacgtcttttggacagcaaccgtcatttccgcggtggcattagtgatcgttttggttcgttacctcggatcgcgcagaaaaccggcagctgctaaggagtctgcttagaaggggaggccgtcacatggcacgttcaaggattaaaccactaagttttttgagcgtctttttactgggtgttgacggaattgtcggctcagggatctttttgatgcccagccgggtctacgccaaagttggtgacttaagtgccggattgatgatgctggcaggcatctcagtgctcatgattgcgctgtgtttcgccaacctggccagcaaaattcctggggatggtggtgcttggttgtacacctacactgctttcggtcggtttgcaggatttgaaattggcatttttacttggttgttgggtgttattaccatggccactgaaatatcggcatttgtgaccagcctgcggagtgtgtttcccagcctcaatcagcatggcaactatctgatggcggcactgggaattttggcagtcttgacgattcttaacttgtttggtcccagtttgatggattgggtcgataatatctcgacggtcgccaagattggtgttttggtcttattcgtcgggatggggctgttctttattcatccggcaaattacgccaatatgagtgccggcatgtcaaacgggtcatcattattcggtcgaattaataccggctttggaatggtcttttatatgttcactggtttttcgtttttgccgattgccgcttccaagatgaatcatcccgaaaaaacacttcctaaagcgctgatcagtgtgctgttgacgtcggcaactttgtatatgattgtccagttgacggcaatcggggtctcgggcagtagcttagccaacgacaacgtgccgattgccgcatcattttaccgtctggccggaacagttgggtatgatttggcattggtcggaatgctgatttcaattctgggtgttgccttgtcggtctcattttcgacgccgacgattgccagttcactggcgtcggaacaccaattgctgccgcgaatgttgggcaggcagaataaacgcggtgtgccaatcgtgtccttgttgctgtcctgcgggctttgtgcactgatgttattttcaggaaattatttgttcttagcctcggctatcgtgtttacgtcatttgtgcagtatgtcccaacgatttttgcggcgattaaattgcgcaaccacaacaagctaccccagggattccgactgcgaggtggcaacttgattccgattatcgccttgttggtcaccgcttatttgattttcagtttctcactggaattgatcattgccggtgtcctggtctttttactgagtgccgtgtggtacttctatgatgaccgagatcgccaggtgaatgggttgcgaagggatattgcggaagtggataaagcattttagtgtggaaaaatcagcgcttagcttccagaatataagggggattagtcaagcatccaggttttggatgcttggcaaatcccccttatatggccggaagctgctgatttttccacgattcggcaaggtaatatccaggtcttggatgcttggctactccccccttatatggccggaagctgcgtattttcccacgattcggcaagggtaatctccagaaaccaaaaagggcgcctgagcaaaaaatcaaattttgccaggcgcccttaatttctcattcaatccgccgaacggtcccattggcttcattccgccaacccggggcgttcaaggttgaaatccccacgccaccagtatctgattgcccgtggtcgtgtaagaataagtggtctccaaggtaaatggcaacgtgcgagttgacctgaccacgtgaattggtgaagaagaacagatcaccacgtttcatattttgaaatttaaccggacgccccattgtgaccagggtgtacgtcgtgacgctatccagattgccaagggtgacgccagccttactgaagcagtaccggacaaatgatgaacaatcgaacttgcgatttttgatgtcactcaaattgcgaccgccaccgtaatcgtatttggatttgccgacaagtttgagtccggcatcgatcgccgcctcaattttggggtcgtcgcctttgagtttgttgaggtcccgaaacaccacgctttgtgcgctcacccagtaagtatgtccattttgggcgaaagaaatgtaaccttcagagcgccggtgattcagatcagcccgttcttgaccaacaattttgcgagtcagatgattggatttgacggttcccagatattttgatcctttagtaccggctggcgtcgagtatagtttggtgtttgagtggataatccgcaggtcataaggatatttgtacgattcaaaaatctgattagggaagacttcttccttaacagcagtgacggcggtcggcgttttatccggactaagggtggctttgataaaaatcaccccgacaattgcgatcacggctaacagactaatagttatcaataatttgcgatgacgatgtagcataatttccccctgatgatcgttaataattttattatgggcatattgaaatgtccatgggccaatcagtcgatagtttataggtttcttaaccggtttgagcacaacttggtcagaaaatgagtaggcgctttcttgacatttgagctgaaacttgtacaataagtgccaagtcgaattaaaagtatcttttacttttacttaaaagtagaagatacttttatgacaatcaaaatcaaaggagaagattatgaaaacagaaccgattcatcgtaccagtatgtggaaatttaagttaagtgctgccaccatgactttgattcccgctgccgtgggaattaactatgttgccaaagcattggctgaggggttaaagctgcccgtttggctggggtccttgggaacttttcttgccagcatgttggctgggccggttgccggtgccatcagtggtttcatcaacaacgtgatctacgggctgaccttatcgccaatttcaaccgtgtacgcgattaccagcatcggaattgggattgctgtcggcatcctgcacgccaatgggtggttctcgtcagcacgacgggtatttatttctgctattattattgccatcgtttcagctgtcatttcaacgccactcaatgtcatcttttggggtggtcagaccgggatcgcctggggtgactcattgtttgcggtaatggtcgccaatcatgcaccagtttggctggcctcgtttaccgatgagtttgtcttggatattttggataaagtctgtgtggcttacctggcattctttatatatcgtcagctgccgcagcggatggtgcacttctttagggatgataaatgatgactgatcaaacattgatttctggagcaccacgggtcaagctcaagtggtaccaggtgatcgatccgattactaagctcttgttgatcttggacatgacgttgctgagctttgccagtacgaatttattgcttcaggccggactgattcttgtcgccacactgctattgttattttccaaattgagttcgaccacctttaaggcactgggattcagcctgtttttgattggtaccatgctgatcatccaagggttgttttacagtcggaatcaaacggtgctgttttctgtgctcggggtgtcgttctacaaagaaggcctgatctacgccaccactctcggctgtcgagtactggtgattattttgaccagtggctttttcatggtgaccacgagtatttcagaaaacgcagcctatttggagctgtctggattgtcttataaaactgtctacgttttgatgtcggtgtgttatattttgccggaaatgatgcgcaatatgcggaaaatccagcaggctcaaaaagttcgcggaaccaatccgcaaaaaacgttgattcagaaactaaagtcagtcctgccggttctgattccattggtgattaagaccttggatcaatcgatggcgcggtcgatttctctccaacttagaggttttgataatcccaaccggactgtcagaacctcccagcgcgtgtatcgcctgtcacggacgctgcacattggtctgactggattggcaattttattgattgggtggaagatatggtcgaagataaacggattgtaattgaaaatttgaccacccgttatccgggtacggagcaaccacaactgcgtcagattaacgcggaggttcacaccggccaggtggttgggattattgggaacagccactccggcaaatcgactttgtgccgtgtgctggcaggcgtgatcccaaagattgtttctgctgagattgaaggcgactggcacatgttaggccggcgggtgtccgacggttggcgcgcctataatgccatgactggagttgtgctgcaaaatccggctggtcaactaagcgggttggcagatacggttgccgatgaaatcgcctttgacttgattaatcaggggatggctgaagggctgattcaaaaacgggttgtagaagttgccacgcaaatggggctgattgaacagctgaatttgcgtcccgagagcctttctggcggtcagatccagcggttggcgattgccacggcgattgctgctaatccggctgttttgattatggatgatccgaccagtgagatggatccccttggccgccggcaatttttccaatggctggcccaagtcaaagagacgaatgtcttcattgtcaccagtgaaattgacgacctgtgcgaagtcggcgacgtcgtgtgggtattgaacgagggtcaaatggtggcccaaggcaggccaggtgaggtgtttaatcatttggcagctgactggcagattccagccccgacaattcagcagcttgctcaaaaaatggattggcacttggctgatggccgatatccggtgaatgacgctgagctaaaggaggcccgatatgtccacaattgaactgaatcacctgacgttcacctatccggaacggtcctttagcttggatgttgaagacgaacacttcgctgatccgatggtggcaattgtcggtcaaaatggtgccggcaaatcaacgctcttcaagttattgacgggattgctgacgccacaaaccggtgtgattaagattgatggagaagattttaacgatcttaaaccagtcgaaaaattactgaaggttgggattacttttcagaatcctgacgatcagcttttcaacccgacggttcaacaagaggtggagtggagtgtcgcgcaggtcatggatgaccacgacacgattacgaggcgggctttagaagctctgaaaagagttggcttggatgataaaacagctgaaaatccatatgatctgtcgttgtctgaacgcaagctgttgagcgttgcgacagttttggcagtggatccggcgatctatttatttgatgagccgatgatgtcgcttgactgggaaagccggcgcaagttgaccgcaattttccatcagttggctgattcgggccaccaagttgtgaccatcacccatgacatggattgggtcgccgccgagtttgagtcggtgtatgtcatggagcacgggaagtttggcttcgccggcagtccacgggatttgttcagcgatcacgaacttgtccagcgagtgggattgctaccaccgcggattatggccgtagcggagtcgctgggcgattcacggacatatttatcggttaatgattattggcagaaaaatcgagatatatagaaaaagtcacctctgtggggtttccaaggttgaaggatgaacttcagctcctggcaagaactcacatgggtgacttttgtgtctaataacgtttcatgatcatcgggtgcttcctcagatcactcggtttgattttactttgtttcatggtcataatcatataccatttcttttggatcttttctttgactaatacaaaataggtcttcgaatttttagcgcccattccggtgccaaaaacgacgccggattcttgggtgtctttcttccaagtgacgggcttccagtaaacaccgtcgtttttgacttggagcatgacctcatttcgacgaatgccgacgtaaacatctttaccgttaacggcctgccagtttcccaagtaccaatgtggaatcgacccggccgcgtcaacccgtggattttcagtcaatagtaacaagcatgcacagctggcaaatgccagtaataaccatttcattttcttcatgatatgtatccccctcatatatatttataccacaatcggaatcattccaagcatgtaaatttaaattaatttattgcttatagctttcagcatcttacttggatttggcgttttctaatcagtcatttagcagtaaactgggaatcattataagaaaagagatgaggggatgctcagcgaatttttagttgtttgtccgttggtttttctggctggctttgtggacgcgattggtggtggcggcggtctgatttcattaccagcttatctgatggttgggattccggctcattttgcggttggaaccaacaagttatcatcagccatggggacgacagtcgctaccttggaatttatgcggagcgggtatatccgcgtcaaactggctttcttctctgtgttagctgcgatggtgggttcttcgtttggggccaacatggctttacatatttctgattattattttcggctgattttattgtttgttttgccgataacggcgttgtatctattattgaatcgacactcgctgaactcgcgactggctgagttcaagccattgacctggtcacagtttgtcgcaacgattctgatttccatatcccttggtgtctgggatggtttttacggtccggggaccggaacctttttgattttgacgttggtcggcattgcccacttgccaatcaacctggctgctggtaacaccaaggtgatcaacctgacgacaaatgtttgtgccttagcagtctttttcatgaatggtaaggtgttggtttggttagggcttaccgccggggcttttagtattttgggtaatttcctgggagcttcatattacaaaaagtatggcagtgcgattgccagaccgatcattattattgtgctagttatcttttttgccaaaacggtttggcagtttttgaattaatttcgccaatcgatatgatttggggtatgatggaattaccttggcaggggcacttgatgctcaaaaagccggcagctgcagttcatgcagttgtcggcttttttatgatggataagattttaatcgtcatccaatttgacggtgtcgttgagttccttggcttggtaaaagtctgggaagacgtgcgccgttttgatgccccaataatagaacacgagtgaggctagggcgatgacaacaaagtcccaagggtagtgaatccaattaattccgttgaactgttcactaccaatgtaagacataacagagatgaatatcagatagataatcatccacatgcttgagtagaaagctttcctggtgtcgacataaccggcccggtattcgtaatagaagtaaaacggcagcccaaccaaaatgaccaggatgacttcgacggtcgttggccacattgcccagtagatggccagagaggccagaacaaaggacaatggtgccatccaaccgaggttcttcaatttaaccggacgtttaaaattaggggccaatttacgaaaggcaacggctgtcaccggcccagtcagataagcgatcagggtcgaagtcgaaatgacggttgccaatgtggaccaagatctaaacaccgagaccatcaacatgcttaataccaagttgacgatcatggctactcgtgggatgccatacttttggttgattttaccaatgaagcttgggatatgttggttgctttccattgcataaagcgcacgcccggttgacgcggcaaaggaaacgccggtgccaacgggtgagacgaaagcatccatgtagagtagaacagataaccagcggatgccaagcatgattgctaagtcagcaaatggtgagttgaagtcaaacccactccaaccggttgcggccagggttgagggctttatggcagtaatgtaagtgctttggagcaaaatatagatcacaccactaattagcagtgaaatgaaaattccacgaccaatatttttccgggactttttaatttcgcttcccatgttgataaccgtttggaatgcgttgaaagaaaaaataattccggcggctgaggtggcagcgaaaatcggcgccgagccgtatggcataaattcgtgaatagaatggccataattttgtgggtagaatcctgagattgtcagcatgataattgtgagggcagggaccccaattttcaaaattgaaattaaactggtgaaactggtcaatagttttactgaccagaaatttaacagtgtgaacactagaatgaacatgaatacgaccatcaagcctgaggtggtaatcgtgccatcctttaagaaagaatgcgtccagttcgcccaagcccaaggccaggaactcatgtactgaacagcagcaactgcttcaatgggaatcaaagtgattagggaaatccaatttgcccatgaagcaatgaatcctagcagcgggccgtgagaatattgggcgtaccgactcattccgccagcttcgggaaacattgcgccaatttcgacgtagttatatgcgatcgcagcaatcacaattcctccaataacccaggaaatgattgcggccggaccggcgattttggtagcttcccaagaaccgaaaagccagccagaaccgattagtgatcccagtgtcagcattacaagttgaaaaagtccaatctttgttgtgttttttgaatccatgtatacctcctgttaacgatgacaactagtttaccaaagataaaaatgattgcaaatgaatgaaagcttgcagtggcgagtggtagttgtcataacagggggttgggggaatttgacggatttaggaagtgacatagtaatgtggactgggccattgaaacaaagacaaagcaattaatttctttgttttgtcttttttaacgtaatgggctgtggaattatttgttaaacgtcagggattctctgttaatgtatcctgtttccccggcgttagttatgacgaggactgagtcacgggatttatcgttattgaggacatagacttttgtgccatttgcgatcagtccttttgtagcattatctgtaggcgttttgccgtgatcccaactattcttataaagaaacaaattattttgatttacggttgcttcagtagaatgatcgacatttcccgtctccttggaatctgatttgctgacagatttgtcagaaacatttggaactgatgtgacattatttgccgaattgtaattcaagacatatgatggaatgtctttggaatcaaaatttaattcgttttgattcatatagccataaacaccatccttagatcggactaacagggctgtaccattttttgtcttatctgttctgataatttccactttttctccacgcggaaggagtcccagtgatttgtttgttttattgctatcaggattgtccccatcccaattatctgaatagataaacgagttcactttagtggtggcagtaattgggttaattgaatcggatgttttgctatttgacgatgttggctgcgtagtggagctgtttggaacattacttgaggaactgttttgtgaattctttgcaggaatatttgaagttgtcgtatttaatgtattagagggggtattcggaactggggtgccgttgctctgaattggcgcagaattcggagcaattgtcgttttggttccggcactatttttaattaacttcacgctctttttgttaatccagccactaatcttaccagccttaacaaagtagtaaatgctcccgttcttaaccttcatatggcgaagagtggtcatcacaagacctttcttgtgtgccaaacgataagtaattttggaatttttagcagtcttgtatggtttgttccaaataatacccttaccattcttcaaagcgactttttgatgtgccatggtcttgttccaaaggattcgttgataatgggtgtgatttgctgaagcattgagactggctcctcctaatacaccaaatgaaatgagtgatgccaatgcgattcttgagattttcatgaaataattccctccaaaaaatatgtttgcaaacaattatgcaacagggtaagtttatagagcgaatatgaaaattaggggtaaaaataataacaatctgattagcttggagtaaaataaatataataatccctctttaaataaaatatgtaccaaataaataaccattgtgataaaataaaaaaagcgggaaaattcccacttttacttggatgaatcgttacttttgccatcttcttcagttatcttgttggacattcgttcaacttgattgacgatagtaatgaaagaactaactttcttattgtattctgagtcaatactggtcagatgttcttgataatcatttcgcaattttttcaagcgatcaaaatccgcattcaattgattcaaccgattccgcagcattttcagatttgcgacggttggtgccagataatccggattgtcacctttcgaattcaaataatcaacataatcaaatgtgtccaggtcaagatccggttcagaaataatggtggttccaccatctaatagcgccttgttaccgctgaggttagtcaagacgagcgatttccccgtgtccatattgacaactttgacatagccgtatgaactttcgttgacgtccggactaactgtatatcctaagttaaatattaaatgcagcgcatcgttttgaggtgccgtaaattggttcctcataaagttttgttgataaatcttcaagacttttttgacggctgcatttggtcttagtttgcgtggcatgtcatcacactcccatctacatatattatacgttgatgctccagaaaaagggggctaaatgaacattttgtccaaaaaatccccttttattgattcattattcttcgatcatagttgcattaatgccttttccagctaagacacgggttgcgttgtatggaccgagaccttttcggaaggtaatgtaaacttttttatccttaggaacctcgtcaatccgctctcggagttctgaaagtggaatattcaaagttggtttgatcgatccagttactggttttccagcttctctgatgtccaggaacacggcgtttttaagatcatcgtcaggaatatcgttaatcttgatcgtggctgattgattggttaactggttaatggccacataacctgcgatattcagtacatcacgggttgaagaataaggtggcgaatagggaatttccagagatggaaggtcaaacgcggtcaagttaccggtaattgcgaccgacaattctgcgatccgtttatcaattccgtttcggccaactgcttggccgccgagaattttaccggtcttatcttcataaatcaatttgaagttgactcgatcggcattcgggtagaaataagctcgatcaaatggtgtgatgaacacggttcgatagttagtaatccccatttgttgaagcgtttgctcggtaaaaccgacgaaactggctgtcaagtcgaagaatttggaaacacctgcgctaatgaatcctttatattccaacggactgccgtttagcatgtcagccagcaagtgaccttggcgattagcagcgcttgagagcaggcttggaattggcttgccagtgattaaactggtcgtttcaatcacgtcaccaattgcataaatgtctggaatgtttgtttgcagatgattatcgacgataatatggtgatcatcagaaagtgaaattcctgctgcaccggcgatctcactattcggtttaactccggtacctaaaaataacatatcggtttgatggactgagccatcgtctaagattaaggtatgcccatgatcctgaatctctttgacactttcattaagaataacgtggaccccttgcttcttgagttcgtcggcaacgatatcggtaatctcaggatcaaatggtgcggcaacgtggccggtttgttcaacaatcgtgacgtccatttgattgtcaacaaaggcttccgagacttcaatgccaattgaaccggctcccaggacagttaccgtcttgggatgtttttcatcaataaatgatttgatcttatctgcatctgtgaccgctcttaatacgaaagcattgttggcatcatggattccggaaatttctggaaccgtgggactggcgccggttgcgatgactaacttgtcgtaatcctcggtataggtgtcaccggtttgcagattattaactgccaccgttttgtcatcgggattaatctgggtgacttcattaaataaccgtacgtcaatgttattcttctgctttaatatctccggcgtccgttcaatgactgccgagcggtccttaattaagcctcccaggtaatagggcagggcacaactggcaaccgagattgccgcgccacgttcaaagatgataatttcagcatcctcattgattcgtcgaagtcgggttgcaaacgagggtccgccggcaattccgccaattacaagaactttcatagttgattctcctctcgaagtacagcgcttacattcgttaatttaatcataccgtgttgaccggcaacgtcaacgaaagggtctttttaagaacttgaattgtcaaattaagtgcaacaccacattaaagaatatttcataaggcgttttccatccgagacatttacggggacgattattcatttgttctgcatatgcttgtatccggcggtcagtaattgaatcaaggtcagttccttttggcaaatattcgcgaagcaagccgttagtatt

SEQ ID NO: 166 - DNA, 980 bp, Lactobacillus buchneri
ttggctagcatgctttttctgattattttttcaaaattcaagaatcccaatttcacagcatttataagtcctaggaatttgctacattttttgattttgtcactttaaacgaaaaaattgagagtaaaactgctaaaaaaggcatttttctcctaggaatttgctacagctacccctgttttgcacaaaaaccaaaaataaaagtgtagcaaattcctaggattaactattgcagttatcacaagggtttggacgccgacactgtcggctcatctttttccaaaacgggtcaattttgaaaaaaatgcacagtccctttatgctcattacatactttcagtttgagcgaaacgaaatctaagacagtttataaaaagacaccacattttcatgtggtgtgtaagtgcgcctttagaccctttaacggaattatgatattcttgttttgtataagacggtggctactaaccaatacgaaatcgctagctttccaaagctaaggcagtagttactaaaaaggcgctgtggaataaaatccatggcgcttttttatagcaaaaaaagcttattgatcaacatcatattgctccattgcttcatgcataaaatttctttccctttcagctatccgtttacgtttagcaatttcttcagcattattttttctcgacgaagtatatattttctgcaattgcttaaagtcaacatcaaagccatttttttgcatttcttgtacaaaaaatttatccaaactcattaacataatagccacctaccaaattaaataatttttacgttgattatcccacctagccacgattaattcagcttcagtcggttcagacaatttgtccccgtcaacatttactaaatcaccattatcggcatcgtccaatttcaattgctgtttaatctgtttcaacaaacctccataaccaatttgacgagtaccagccaaggcttgctccaagtcatcaatc

SEQ ID NO: 167 - DNA, 183964 bp, Lactobacillus buchneri
ccacggtaaatagtcgtggtactgatctgcaccggatacttttcgactgccaagcgattcgatatttcttccggagaccaaaggtcttcgcagaagtgttctctcaccacttcaaacacctgaggattactcaaaagagagactctgccacagttgcctttgcgctgtttgtacttctcctgagccttcgaaggtgaataggatttaccagtagaattacggcttaattctcgagaaacggttgagtaacttttcttgatatggctggcaatctcacgaagtgagtttccatgattcctcattaaaaagatagtttcccgttcatctatggtaatatgcttgtagtggtccatggctaaattcctttcatgattgttttcgcaaacatcattttacagaaatttggccatgggccattctttatttaattagtgttgcacttaaagtgtaaattcaagtttcaaaaagcattaccaagaggacattagcttaaggggaagtgttcgataataagacggttgtagtttcagtggcttttttattttgtctaaaattgttatatttaagtagtcgcgaggccaacccccgaggccgatatggtaaatcccgagtcatccgtttctccaagcgggtggctctttttgtgtattgaaaatttaaaattagtcgggctgctgtttacatttttcgataaaaggtgtaaaagtgaatacatgatgtgagaacgttgatatatcaagctcacctcgttaattcggggtgggttttttctttataggtttacaaaaaccaacgaaagatgtaatatgagaaaaaagacatggaggcttggacaaatggaacaaaaacaacatttttcattatcaaatatagcacctcagaaattagttcaaacgctgttaacggcaactgaacaacgattgatttctggaattgtgaaagccggatatgaagcagaaaaaaagtatgtttcgactaacgcacctgaatggattcagattgatagagctcaaaaattatatccagaattaaaaaatatggcagttgaattcgcactcagacgtgcatgtgatcacggtgtaataccttttacatacaaaattggtacagtcgagcaaaataagaataaatttttggaattagtaagtactggtgataaaaaagtgattctcactgtaaatcaaacaccgaccgataaacacgctagtcgtaatgctaaattcagaagtaatcttttcgatcaatgtgaaagtaaattgatcctttttgatgatgaagaaaggtcaactggagcaatatacatggaactaaatcatggatatcagactgaaatccctgcattcactgttttaggaaaacccaatgctgatggaaaatgggaagctagacttagcttgcagaacaatatacaattattgagcaagggtgaagaagctgatattcagaccaccgcgaagcaaatgtcagagtttggtcccgatgagtttaatcaatataaagaatttaaaacaaaaggatgaagttatatggcactagttgaatcaggacgcttttcgcagaacaaactcagatttttgcgcgatttaacaggcgaaagtttaatgcagctttcaaatgaaattggatatagtaccacgacaatttctaaatgggagaagggaaatttaacacccaactttaaaagtttaataaaattatcgaatcactttggagttaaccataattttttcttgactagcatggaagttccggatttcacgggggccgttttctttagaaaagcagcagtattacccaaaaaaaaggtaattcaggctcaggctaaagcaagaagatttgcaatggttgattatcttcttagtaaggaattagatcttcctaattttaagatgccggattatgctcacacatctgaggagtttgaaatcttatcatatgatgatattgataatgttgctaataaagtgagaaatcagttttcacttggagatggtccaatttctaacatgacattacttgttgaaagaatgggtataagggtaaaacttgaggatcttgacagtgagaagattgatgctgtcactggggatattaaagctagaccgtatattgtattaaatgcccgcaggctttcaagtgttcggcttaggtttaatttagcacatgaattggggcacattctgttgcattcattttatccaaaaagtgttgttcgtaataagagtaatcatagaacgattgaaagcgaagccaatcattttgctggttctcttttgatgccagattatggaattgcacttgatatgatgagaacaaacatgagctatttgattgaattaaaaaagcactggaaagttgcaattcaagcacttatttaccgtggaaatgagttgggattaatacctgactcacaagccttgtttttaagacagactatttatcgtaatggatggcggatcaaggagccgcttgatgatgaaattccgttagaaaaaccgtcatatatgaaaagtgcgattaagttctcagaagctactcgtggcaatagtatcgatgctgtatcacaagaaactggattatctttgtcagaagttcgagaatggggcggtaaactagaattatcacaacaacaaaccaatcaccccaatttgcatcttttatgaaacaaataacgtctatgtcgctgtgattgtgggcgtgaagttgatctttcgtcacaggaattgcgcagcggtaacacacgaagctgtgggcacgagcgaatgaacggtataaaacggtacattaaacaacatatggaagagacaccaggcacaaatcttcatcagctaaaagataaggttcccgttaacagcaaaaccggttatcggaatatttcgactgttatacgcagtggtactaaattttatcgtgtagcaattcagtttaaagggaagcagcatagccagaatgttaggacactagctgaggatcttaaggttcgtgaagcattacgacaaaaatactggccgaattacaaaaagtaaaaccgcctacgattaatttcgcagacgatttttgtcatataaaagtaggtagaaagatttaacttatgcttgttgaacgagccagaattgcaccaagtcgtaaaattcttccatcgattgatcattaacgatttttaaagttctttgatcgctaaaaataatttgcccatgatcatattccaaatacatttttccatctttaaattctgcgtgttctttcattattatcacctcataaaatagatacgttaaaaatcaaaaactattgtttttctccgacatttttactacgtcattttaaatttcgacaaatacccttaaatatttacaagcattagtaaaattatagacgcccctgaaagccatatgcatcaagtgaattgacgcacctttgaatactactaaatatgcttgaaattatcactattataagaggcctttatggctgttttgcagactgatgaggaagaaaaaggcgacaaataggtacttttactgggccattgggcttaacgaaataatttattcagatcaataattcttgcacatgcccgctacctgaagaaccgtagtccagccagaaatttcataaaaaagcaagcaacagccagtgatattgaggaaatcaaatcactgattcgtttcaggcaggcaatgcttgttagcaacgacacttcggttgagtaaacgggagcgttggttaatggttgcgacgctaaattaaggtaattttggtatttaaaagacgtcttactaggcgccttttctattgaaacggcctttatgacgtcaaaaaagaccgcagcgaaataactcgttgcgatcagatgtcttcaaactattttgttggactcgttaattgctcactatcagaaaacgcgcggctgtaaatagtctctaagtgttccagctccagtttgttggcgataacatcgttgaataactgttcaatggccactgtcatagctttttcgtccggcagggcatttgtggcctcagccttggcctgttgcatttggtataactcctgcaggagattaatgagtcgatgacgaaaatgggataactgtaccgaatgaggcaggtcatcgttttcatgtttgacatggtaatcaaaataccgttccagtttttcaaccgtccccagtgataagttatccaccagtcgcgtgtgatttctgagtcggatgataattgatgagttcaccccggtcaacttctggatctgataggcactgtcttcactgtcgaggacagcttgaaccttttgtcttgcatccatattcattcccccggaaatttagaatttgatgataaaaaggttgcttcggcatatgtatttcttgtcacatttaccatatgacaagtgacatataattgtcaaatttttcgctatctcactagcggtgtgtctgctaaccaatccgcaattcggtgactaatttggtatcgataactggcttgccgtcctctccttggtggtgaacgacgcgatccaacatgccgttatcgatgatgtattgatcaaagaactgcttggttggaacctgcaggaggcttcggtcatgcgactgttcaaaagctacttgatccaagaccaagtcttttggagtggcagaaaaaatattataaattgctttaagggcgacttcacctgatttcaaaatggtggtatccaaataacttcttaggaataactgatggccctcaaaaaccgtatcacttgaatgtgattccaacactgcccggtagcgaatctcaatcgtgtcgggtcgaatcttattgataaatcgaatgcggaataattccattattctcagctcctttcctacatcatatgctaaacttgttaaggagtgcaactttgattcattatgagaaaatgtttgcgtttcttctcacattcaattattatatatattaattgtttttttattcgattcgaaaaattaaaatttaataagctgggaggtgttaatgattctaagtcgaacaaaacaatatttaagaaaaaacggttacttctataaaaaagaatatattcggcccttactgacaccggataatatttatattttcagatttggccgcgaccgcttggataaccggcttattattcgctacagtcataagtggactggcagacagcgaatcaacgaaattgatttacggctgcataagcaaaagcatccccggattttcgagaacgaatccgaactattgaactacttggaaggacacctattgaagcacgaggcaaaggtccgtgcgcgtgagaaagaaaaacaacatgaaatatcagatggtgcatctaagtgatatggattcgaaatcaaagctggtttttgcctcattgtggggtgaagccagctttcattttagaatcaaccgacaaaggagaattccatggactggacagaattatcaattatgacgacaagtgaagcggttgaggccgttgccaacattttgatggcatacggggcgaccggggtttcaatcgaagatgccaaagattttgagaaattaaaacccggccgctacggagatcatggtgaaattgtcgatcctaaagatctcacccacattaggcaaggggcgattgtatcagcttattatcccaacaatcagcatattgatgaccaagcagaccaaattgccaccagggtccgaggtttggcgaagtttgatttgaatcccggaccagcagaggttcacctgacgccagtcgtgaatcaagattggcaaactgcctgggagaagtattaccatccagtatcaatttcgcgattcatcaccattgttcccagttgggaagactatcagccaaaatccactcaggaaaaaattgtccgcttggatcctggaatggcctttggaaccggaacccatccaactacccgactatcacttcaggctttggaaatggtcatgcagggcggcgaatcaattctggatgtcggcactggttccggtgttttaagcatcgccgccaagttgatgggcgcgggggaaatccacgcgtacgatgttgacgacatcgctgttgaatctgcagaaaagaacattcaactcaatccaggtgctaaaggaatccgcgttgcggcaaacgatctgctggccggaatccatactcaagctgatatcgtggttgccaacattttggccgaaattatcgtgccgctggttccccaagcatgggataatctcgttcctggtggctttttcctcacatccgggattatcaaggacaaatttgaaaccgttgaaaatgcgatgacctcacaaggatttcagatcattgaaaccttgagaatgaaagattggtatggggtcatcgcccaaaagccaaaggacgaggacaaataatgcaacactattttgtaagtcaacatttaactgtgggacagtcgattgaacttcccaaaactatttctcatcatttgggccgggttttgcgtgccgaagttggtgaccggtttgaactggttggcgatgaccaccaggtgttcgaagctgaaattagtcgactggagggaaaccaagttgccgccaatattatcaagccacttgatcacaacgttgaattgccggtcgctgtcacgattgtcagtggtctgtccaagggcaacaagcccgaatggattgttcaaaaggctactgaacttggtgtggctcacgtgattttcctgccgatggactggtcgattgttaaatgggatcaaaaagcaactaaaaaaattacccggctgaatgaagttgcgttgagcgctgctgagcagtctcatcgaaacgtcgtgccaacagtggcttatttaagcggattagatgctttattccaattagattttgatacccaattggtcgcttatgaggagtccgccaagcaaggcgaggaaaccaatttggtcaaggccgtcaagcagactccttcaggcggcaccatggcggctgtcttcggtccggaaggcggcgttagtccggctgaagttacccaattagtcgatcacgactttgtgttagctggtcttgggccacggattatgcggactgaaacagcaccactgtactttctcagtgccgtttcaacgctgaccgaactgatttagtttgctgaataactttgacaacaatgatattattatgataaagatgatttgatgatgcctttgggcaaatgagagaagagttgatacaatggcaactaaaatttggacaccggacgatgtcattaataaggtttctgagtatatgaacaaggaacatgttgatgagattcgaaaagcttaccaatttgcaaaaattgctcaccagtaccaaaaacggcagtctggtgagccctatattacccatccgactcaggtggctggtattttagctgacctgcatatggatcctgagaccgtctcagccggttttcttcatgatgtagtcgaagataccggggctaccttaggcgacatccaagagctgtttggccacgatatcgccttgattgtcgatggggttaccaaactgtccaagattaaatataaatccagcgaagaacgattggctgagaaccaccgtaagcttttgctggcaatgtgtaaagacatcagagtgatgattgtcaagctggctgaccgcctgcataacatgcggacattaaaatcactgcggcctgacaagcagcggcggattgccagtgaaactttggagatttacgcaccaattgccgatcgtttaggtattggaaccatcaaatgggaactggaagacatttcacttcggtatctcaatccccagcaatactaccgcattgtgcacttgatgaactcacgtcgtgatcaacgggtggattatattgaaaaagccatcaaagaggtcaaaaaggcgatttctgcattgggcgtcaaggcggagatttatggccgacccaagcacatctattccgtttaccggaaaatggttgaaaagcacaaacagtttagtcaaatttatgacctgttggccattcgggtaattgtcgattcaattaaagactgttacgccgtattaggcgccatccattcagagtggaaacccatgcctggccggtttaaagactatattgcaatgcccaaagccaacatgtatcaatcgctgcatacgaccgttattggcccggaaggcaagcccttggaagtccagattcgaaccgaagagatgcaccgcgtggctgaatttggtattgctgctcactgggcctacaaagagggaatcacaaacggggtcaaaacctcgcaggataacaataaactcaactggtttaagcaaattatcgagctccaggaagatactgacgatgccgccgatttcatggatagtgtcaaaggtgaattgtttggcgaccacgtctatgtctttacccctaagggcgacgtttatgagctgccaaaaggagccggtccacttgatatggcctacatgattcataccgaggttggtaatcacaccactggtgcccgggtcaacggcaagattgtccctctggatcaccaagttaaaaatggtgacattgtcgatattattactgccactggttcagccggcccgagtcgtgattggctgaagctggttcacaccaggcgggcacgaaataagattaaacagtacttcagacaagaagaccgtgagaaaaacattgaggacggtaagaacctgatttccagaagactacgggaagccgggtttgagcccaaccggatcatggtaccggataaattgaccaaggcagccgttaacatgcattaccaacacgctgatgatttgttggctgcggtcggctttggggatttgcagccgactggggtggttaaccgattgacagaggatgcccgggcccaactcaaaaaagagcgtcaggatcaagctgaacgagaagttttggaaggccaccagaccatttctgaagattctgacagcgctaagaagcagaaaaaacgcaagtcctcaaatggtatcgtgatcgaaggcgtcgataatctcctagtgcgattgagtcactgctgtaccccggttcccggcgatgaaattgtcggctacatcaccaagggccgcggcgtgtcaatccaccgggttgactgcccgaacattaaaactgcggaagaaaacggtgagcggctgattgaggtcgcctgggctgacaatcctgaggaacggacgatttatgatgccagtttggccgtccaaggatataatcgggccggcctgctgacgaatgtcttgactgccgttaatagtgtcaccaagaacgtttcgtcagttaatggtcaggtcgataataataagatggccaccatctccctttcagttggcgtccgcaatttggagcagctggagcggttgattggggcaattaagaacgttcacgatgtttatttagttgaacgaaaattcagataggagttttgctggatgaaagtggttttgcaacgagtcaaggaagcgtcggtcagtattgacggtcagattcacggcaaaattggcaggggattcgttctgctggttggtgtcagcgatgccgacggtgaggcagaagttgactatttaacccataagattagtaaactgcgggtatttgaagatgatgccggtaaactcaatttggacatcaatgccgtgaatggcgcaattttgtcgatttcgcagttcaccttatatgcagataccaaaaagggaaatcgccccagctttaccaaggcaggcgaaccgcaacacgctgatcgggtgtatgagcaactcaatgaacgtctgcggcagaccggtttggaagttcaaacgggcgtttttggagccgatatgctggtgaatattcaaaatgatggtccagtgacgattatctttgatacggataacaaataaaaaatgatcagataaaaataaagtcgaatcgtgtggttcggcttttttaaggagtaacgaaatgattaatcaattattttgggattttgacggcacgttgttcgatacctacccgaaaatggtttccgcgtttgttcaagcattgggtgatttagggattgacgatgttgaaatcgatcaagaccagatttatgttaccatgcgccaacacgacgttgggacagccattcgaaagttctcagccttttacgggattgatgaaaaacagcttcgaaaattgaatcgcacccaccaaaccaaattggttgaagatgccctgccgtttcccggtgttaaagaggttttggaattggctaaatcaatgaagggacgcaactttttgctgacacacagggatgaccaggctaaaagcatgctgagaaagtttgatctgctggacgatttcagcggctttgtcacatctgatcagaattttccgcggaaaccacagcctgattcaattaactggttaattgagaccaaccaggtagacagaaaaaaagcgatcatgattggtgaccgcaagttggatgttgctgcgggtcacaatgcaaatatcgcttcgtgtctgtttgatcccgatggcacaatcgttgattccggcaatcccgagattcgggtcaccgaaatcaatgaactcgtcccatggttgaccaacaaataattaatgattgtttttaaaatagtttgcgatgccgtcgacaacgtctttcgcaagctttttttgataggccggcttttgaatttggttaaaatcttttttggtattgatgtagccaccctcaatcaaaatagcgggaaccgaattgtctcggattaccaggaagttaccgaattccaccccccgcgaacttaacggcagatttttcatctgctggttgactgattctgccaaatgtttggagtcgccgctatggtagaagtaacaggtgtagccagacgcaacgttgttctcatccgaagagtcaaagtggaaactgacgaagaggttggccgatgatgaattggcaatttccggcctggcggctaatgggacggttttatcggaactgcgcgtcatgacgacccgggcacctctcgcctggagcagtcgttcgactcgtttggcaacttccaaagtgtaccgtttttcgggttgcccggtcattgacagtgcccccgtatccgatccgccgtggcccggatccaaaacaattgtcgcttccgataagctgctgacattttgaacgttgctgttttgaaccagccaggacgctacccagccaatcgtgcgatgcttatagatgaccttgatccagttactttttcgactaatcacctgcaatcgctgtccatgctgaactttggcttttaccgagtaggtaacgtctggcccgcttcgaatatttaattgattgaccttaacagtcactgaattggattccagcgagacgatcaacaccaaaaatgtgatgatgatcgtcagggtggcaacaatccagcttttgttttcccaaatttttttcacagttcaatcgttccctcactcaaataatcatattatagttgaaataagcctgagaggccagtctgaatggaaataacgccgatgttcccttgacattttctggctggtacactagtcttatagacagttaaatatccaaccgataaaaagaactatcgaaataagcggcatacagagagcattcatttggtggaaggatgcgtcgattattttgaagtgacactttttgcttatgatggttaatagcgaaatgctattcgtgcgagcgttatccttgagaattaattaaggtggtaccgtgcgaatgcacccttgtctatggacaggggtcttttttttcggaatttaagtgggaggaaacaattatgcgatatcaacgaccaaaaggaacggccgatattttgccaggtgaagctcaaaaatggaactatgtcgaagagacggcccggatgctgtttgacgattatcgttatcaggagattcggacaccaatgtttgaaaattttgatgtcttttccagaacgtctggtgatacttccgacgttgtcacaaaagaaatgtatgatttcaatgataagggcgaccgtcacatgagtttacgccctgaagggactgctggtgttgtccgggcctttgtcgaaaacaagctttacggacctgaacatccccgcccagtcaaagtcttttatatggggtcgatgtttcgctatgaacggccacagtccggccgccagcgtgaatttcaccaaattggggtagaagcttttggtagtaatgagcccgaattggacgtcgaagtgattgccatggggatggatttgctgaaacactttggcttgtctggcctccggttggaaattaatagtctgggtgataaagcctcccgtgacgcatatcgtcaagcgttgattgactatcttgacccgcactttgatgagttgagtgatgattccaaggttcgtctgcacaagaacccgttgcgggtattggacagcaaagacaaacgcgaccaggaaatcgtcaaaggtgcgccatcaattttggactacttaaatgaagattcccaaaaacactttgataaggtcaaacaccttttggaatcactcaacattccgtatgtcgttgacccagatatggttcggggcctggattactacaaccacacgatttttgaaatcatggttgattccaaggccctgggcgaaggctacacaaccatttgtgccggcggtcgatacaatggcttggttgagcagcttggcggccctgaaatgcccggaatcggttttggccttgggatggaacggctgatgcttttgatggaagcccaaggggttaaattcccggttcttgatcaattggatgcttacgtagtcgggattggcgaacagaccagcgtcttgacgttacaaatcgtccaagcattgcgggcagacggtttcgcagctgaccgtgattaccttgaccgcaaaccaaaagcgcagtttaaaactgccaataagctgaatgctcagtacacaattaccattggtgaaagtgaactggaaaaaaagactgccaacgtcaaacagatgcggaccgggaccgaggtttcagtaccgctggctgagattttcaaagattttgatgagatcattaccaaatattttacagatgatgaggagattgattagacatgaagagaactacttatgctggccttgttgatgaacagctcatcggccaagaagttgtcttaaaaggctgggtccaaaaacgtcgtgaccttggcggcttgatttttattgaactgcgtgatcgtgaaggaattgttcagttagtattcagtgaggaatttggccaagatgctttagcggttgccgataaactgcgcagtgagtacgttgtggaagccaagggtaaagttgttgcccgggatcctaaagaaatcaaccctaagatgaaaaccggtaagattgaagttgacatcaccgatgccaagattttagccaccgctaagacaccgccattttatatccaagacggcattaacgtttccgaggacctgaagctcaagtaccgttacttggatcttcgccgccctgagatgcaaaaaaacattttgttgcgaaaccggattattcagtcgattcacagttactttgaccaaaatgatttcattgatatcgaaaccccaacactgacgaagtcaacgcctgaaggggctcgagattatttggttccttcacgggtttatcctgggtccttctacgcattgccacagtcacctcaacaatttaagcagttattgatgggtgccggttttgataaatactatcaaattgcgcgttgttatcgtgatgaggacttgcgtggtgatcgtcagccagaatttacccaaattgatatggaaatgtcatttgccgatcaagaagaaatcgaagatgtcactgaaggattcattgccaaggtcatgaaagacgccatgggcatcgacgttcagctgccattcaaacgaatggattgggacgagtcaatggctcgttatggaactgaccaacccgatgttcgctttggcatggaattaaaagatctttcagacattatgaaggatgttgatttcaaggtcttctccggtgctgtcaaagatggcggccaagtcaaggcaattgccgttcccggcggagctgagaagtattcccgaaaagatttggacaaatttgccgattacgttgaacgtttcggagccaagggcttggcctggttgaaggtgaccgatgatggctttaacggcccgatcgccaaattcttcaaggatgccgatctgcgtgaaaagattttggccaaggctgaagcaaagcctggcgatctattgctgtttgctgcagataacagccgggttgttgccaacacgctggcctatcttcgagttgagattgccaaagaacagaacatgattgacgaatccaaatttgccttcttgtggattgttaactggccattattcgactgggatgtcgacttgaaacgttacgtggctgcccatcatccatttacgatgcccaatgaagacgatgttcattacttaatgaatgaaggcgaagacccacacaaagcctacgctcaaagttatgacattattttgaacggccttgaattaggcggtggatcaatccgtatccatacccgggcacttcaagaaaaaatgtttgaagcacttggatttaccaaagagagcgccgaagcccaatttggttacttcctgaacgctttggattacggtttcccgcctcatggtggtctcgccattggcctggatcgctttgtccgcttacttgctgatcgcgataacatccgtgatgtgattgccttccctaagaactccaaagcagttgagccactgaccagtgcaccacaacctgttgctaccaaacagcttgaagatcttggcttgtttgttgccaaacctgatggtgaaaagtagtttcgagtttcaaattaactgatttcaataaaatcctgtaatctagtcactgattacaggatttttaatgtaatttttgtcatttacgtttatcattaggcaagacgttcaaaaagttttcgaaggggatttattttatggatgacgtttcaaaattaatgcgtaggcacacctacgtcaccaaaatttcaacttcatttatttacgcaattttagtgtcgattgcggttaattttttctggacacctggacatatttattcatcggggattaccgggttcgctcagctgttgaacaccatcagtacgcgggcgtttccgtttgaaatttcaactgggctggctttattcctgctgaacttgccattatttgtcttgtcgtggcgggcaattggccacgaatttaccattttcacaattattaccgtctttttatccagttttatgattcaattactcaaaccaattccgctcacccatgatccgattatctgtgcaatctttggtggggcggtcaatggatttgggaccgggttggcgcttcgaaacgggatttccactggtgggctggacattctgggcattgttattcgtcaccgaaccggtaactcgattgggacgattaacattgcctttaactcgttaatcatcgtttcagctgccgtcatgtatggctggccatacgccttttactctgtcctcagtctaatcgttaatgcgcgcatcatggacatgacctataccaggcagcagcgaatgcaggtgatgattattaccacccgccccaacaccgtgatcgatagtgttcaaaaccatcttcgtcggggaatcacgatcgttcataatgccgaaggggcttatcaacacgatgccaaaacaatcttgttcacggtcatttcacgatatgaaatgggggagttggaggaagccttattggagtccgatcccaacgcgtttgccagcatttcagattcggtcaagattttggggaggttttacgagccgaaaccctgagggcatttttaaagatttcctaagaaacaagttctccaagtggattatgttataatattttttgtgtgtgatcacaaaatattgaaatacggtgaaaattttgaaagttgtttacttatggttaatcaaattattctcagtcctgaatatttggcggccaaagaacaaagttgtttatgtgatgagctttgatgataatgttgacttcattaagcaattggcacaacgactgcctcagaagtacgttttatatgttctttatcgagccaataccgaagcggctgcgacggatttagcagcctttggtatcaaaacgcggcagtttcgcgatggcattaaattcgtgatggacgatgtttcgcttttgatgtcagcaaagctgattatttgcgataactactacgcttttttgggtggcctggttaagctgccgttcgtcaaaattgtccagatatggcatgctgacggggcgattaagaagtttggctgggaagatccgaccaccgacaaacgcagtcgttctgataagcgccgttttcagaaagtttatgatcactttgatgaatacattgtcgcatcaaaagcaatgggacaggtgtttgtgcacagttatcatgaaaattttgacaagatgcagctgctgggataccccagatccgaccagtatctcagtcaagattggcagcacaaggcccgtgagcgaatttatcgatcagttcctgaactgaaaaatcatcgggtcattttgtatgccccaacttatcgggagcatcaggactttaagctgcccaagggccttggcagtgctttagcagcagatccaactgccttggtggttgtcaaactacacccggttttgcgggataaagaagtgccgatgcgccgcattggtaatcccaagattaagttttatcacgaattggagaccagtgatttattagctgtggctgacacactggtcaccgattattcgtcggtggcatttgattttagcttattgccaaatgccaaatcgatcatcttcttcatgtttgatcttgatcgataccgaagcgatccaggaattcaggatgattttctcgactggctaccggtagagccggtttataaggtcgagcagctcagaaacgaaatcctggcagggacaagcgttaacttcgacaaatttaacgcccattggaacacctataacgacggtcaggcgactgacagagtcattgcgcgttatgtcaaattcttagggtctaattaaggagtgcctcaaattgaaagaagtcagtactttaattaaagaacaatttcaaaatatcggcattatcttccgaatctcaaagtatgaagataaagccgagtatcaaagccattatctgggcctcatttgggaatacttatatccattgattcaaattggtatttattggctggttttcggtatcggcctgaaacacggtaattccactcatggtgtcgattatctggtttggatggttatcggaattacaccttggttctttatgaaccgggccagcctggatgcttccaagagcatctaccaacgggttgggatggtttctaaaatgaaatttcccgtcagtattttgccaaccattaagattgtcagcaacttaagtgccttttggaccatgctggtcttttcaattgtgattggcttcttatatggggtgacgccgtcaatttactggattcagtggatttattacttcatttgtatgattgcctggctgattgcttttggtatttttaattcaacaatttccgtcctggttcgcgattatcggatcttgttgcagtcactcatgcggatgctgttttatatgtcgggcgttctcttcaatttccagacggatgcctttccagcaccgtttgttcatattctgcagttgaatccattcttctacgtcgtttccggtttccgtgacgggatgctgggcagtgcctggttctggcagaaaccaactttgacgattgtcttttggggcatgattctcttcttcttattggttggttctcatctgcattacaaattccgttctcgatttgttgatttaatctagttttgagggtgagcttttgaaacgttcaatgatcaatcttattaaactcatagcccgcattgtactcatcgtgatgaacgatgggtttatttgtatgcccgtcaaaaaggggacggtgttatttgaaagttttaacggcaaagatgtcagtgacaatccatttgctatctacaatcaattaacccaagatgacccgactgcccgaaagcggtgctatttcagtgtcaaacccagtgagtacggcaggctggttaaacagtatccaaatattcaatttgtcaaacggttcacgccgggatgggtgaaatacattgccagggctgattattgggtgatgaattcacggatgccaaagtggtggcgcaaaaataagcgaaccactttcattcaaacctggcatggaacaccgttaaagaagctcggaatcgatattgaaaacgttgagattcccggcagtcagacagctgaataccatcaggaatttattgatgaggctgcccggtgggattatttaattgcgccaaatcaatattcacacgatatttttaaatccgcttttggctattcaggtaaattcttagatattggctatcccagaaacgatattttatatactgaaaataacgctgatgacattcgaaaaatcaagcaaaccctagttggctatcagcctaaacaggtgatgatgtacgcacccacctggcgggatgacgatttttccgagaaagggaaataccaattcacgctgccgtttgatctggcacaattttttgaaaatgtcgatcctcaaacgctactggtcattcggccacattacttggttaaagacaatattgatattagcgggtttgaagaccgggtcaaaattctcgctgatgtcgacattaaccaactatacttaataacagatctactcattactgattattcatcagtgatgtttgattttgccaacctcaagcggccaatgctgttttatccttatgatctggctcattatcgtgatcagctgcggggcttttactttcagtacgatcaagctaatctgccgggaccaatggttgaaaatcaaactgacttttatcaaaagttaagtgaataccgtcaaactggcgcttttactgatttcagtgacaatttgacccgttttaaccaaaaattctgtgcctgggaagatggtcaggcttccaaaaaagtcagtcaattaattttacaagggggatatacaaatgagtgaaacaccatttttaatcggttctcatgtcagtatgaacggcaaggacatgttcctcgggtctgccaaagaggcggcttcctacggtgaaaccgtctttatggtttatactggagcgccgcaaaatacggttcgtaaacccattgagaagttgaatgccgatgccggcaagcagtatatgtccgatcatggcctcaaagcggttgtggtccatgcgccttatatcatcaacctggggaacactttcaaaccggaaaacttcagttttggtgttgattttttgcggcaggaaattcaacgtgcacaagccattggggctaaagaaattgtgctgcatcccggcgctcacgttggtgccggtccgcaaaaagcgatcgatcaaattgccaagggcttaaatgaagtgattgaggagaatcaacacgtccaaattgctttggaaaccatggctggcaaaggtaccgaagttgggacgtcatttgagcagttggctgaaattatcgataaggtcagcgataatgacaaactctccgtgaccttcgacacctgtcataccagcgatgccggttatgatattaaaaatgactttgatggagtcttgaatcaatttgaccacatcatcggccttgaccggctcaaagttattcacctgaacgattccaaaaatccacagggcagccataaagaccgccatcaaattcttgggttggggacaattggctttgataccctgaactatattgcccatcacgcacaattaaaaagcgttcccaaaattatggaaacgccaattttgaaggatcctgacaataaaaacgttaagtggaatcctcatggttatgaagttgcaatgctgaaaaaacagcagtttaatcccaacattattgaagatatgaaagccagaaaaccttactaggcaggccaaatcaatcttcgaattcggtggtatttaaattgaggctttccaagataatggtggccgtttcctcaatggacttgttggccacgttgattgttaaacagccaatttgacgatataattttttcgcgtacgccaattcagttttgatatgggccggatccgagtagggtgtatcagcgtccaggccgtaagaaatcatccgttgtttacggattttgctcagtttctcaggggtgttcagcaggccaaacattttatccttatcgatgtcgttgacttcttcagggagttgcaggtccggcccgattggcagattggcaacccgttgattttggttggccaaataaagcgacagcggcgtctttgacgtcctggaaaccccaagcaacacaatgtcagcttccagcaatcccttgggatttttgccgtcgtcattttctacagcaaattcaatcgcagagatccgttcaaagtaattttgatttaaatcatgaatcaacccaggcacgtgagccggttgttggccagtaacctgactgagcattgccattggcgtttggacgcagtcaaagtcataaatgccattttggcggcagaaatcttgaaccatctggctgagctccgtacttaccagcgtgtgaaaaatcatcgcctgtttgttgagggcaatttttaagatacctttgagaattgagtcggtttgaataaatgggaaccggcgaatttcggctttcacatctggaaattgtgacaaagccgtctgggcaattgtctgggcggtggcgccgcttgaatccgatataataaaaatgttttgagttttcatgataaataactcctaaaattatatttgttaagtaaatattaacatgacacatcaattttatcttaaatcattgacgatgtattgattaatatgtataatttacttcgaaccgttttagaaggcacttaaagtgttgattaaacagttacatttaagctcggagggagggaatttcatatggcaaagacagtcgttcgtaaaaacgagtctcttgatgatgctcttcgacgcttcaaacgtacagtttctaaaagcggtacattacaggaatatcgtaaacgagagttttatgaaaaaccaagtgttaagcgtaaattaaagtctgaagcagcacgtaagcgtaacaacaagaagaaacgtcgtttttaataaatgatgactaaaggtcggagctaatgtttattagtctctgatcttttttaatgttaaaatttaagtattaagcgaaaagaggttactttgatgagtgtatatgataaattgctttctgacatgaaggacgccatgaaggctcgtgataaggtccgcttgggtgtcattcggggcattaaggctcaggtgatgaatgccaaagttgccgatggcaatcatgatttaactgaagatcaaattaacgatatcattatgaaagaaattaagcagcaaaaggaatccttggaagaattccaaaaagctgaccgaaaagatttggcagaagaacaggaagccaaattaaagattgccgaggagtatgcaccaaaacagctttccgaagctgaagttgaaaaaatcgttcaagaaactatttcacaggttggtgctgaatcaatggccgactttggtaaagtgatgggtgccatcatgccaaaggttaaaggtcaagctgacggcagtgttatcaacaaattggttaagcagcagctgcaaagctagtatactttagataaccacaactttgtggtaatatctgaaccaatatgactaataaaaaaggagctcacttacttggctgatactcaacaagttacaagagagtttattgtatccgaccccaacgaattattacaaattgtcgggactcaagacgagttcattacaattatcgaagagggaatggatgtctccatcaatgtctttggtaattcacttcgagtgactggtcaggatgaacccgttagcattaccttacacattttggagaatattctctctttaattcaaaagggaattaatattaacagcagcgacttcatcagtgcgatgaatatggctcaaaacggcacgctggagtactttaaagatttatacaatgaagtgctcatcaaagacgcaaagggcaaggtggtccgcgttaagacctttggacagcggcagtatattcaagcaatcaagcatcatgatgtcgcttttggcattggcccagccggtaccgggaaaacttacttggctgtcgtcatggcaatcgcggctttgaagaagggcactgttgacaaaattgtccttacccgaccagcggttgaagctggtgaaagtttgggctttttgcctggtgacctgaaagaaaaggttgatccttatctgcgtccaatttacgatgccctgcacgccattttgggtgccgagcacactgaacgattgatggaccgggggacgattgaaatcgcgccgctggcttacatgcgtggtcggactttggacaatgcctttgtgatcttggatgaggcgcaaaacaccaccaacatgcagatgaagatgttcttaacccgattgggatttggctcgaagatgatcgttaacggtgatatttcacaaattgatttgccaaagcattcgaccagcggattgattaccgctcaaaagatcttgaaggatattgatcaaattgaatttgtgaccttcacggctaaggatgtcgtccgtcacccagttgttgctaaaatcattaccgcttacgaaaaaagcggcaattaatctcgaatagacttgaggaactaaattaatggatttagaaatttacgataaaactgaaaaaggggtttcggaaaaggatcaaaaattgattcgggatgttttggaatttgccggatcttacattcatttggccgacaataccgaaatgtccgtgaccctggtcaataacgatgagattcaccaaatcaacaagaagtatcggggggttgatcgggcaaccgacgtcattagtttcgccattgaagatgacgatgatgacgatgatttccccattgtgatggatgaagaattgaaagagtcaattcctgaaaatattggtgacatcttcgtttccgttgataaagttgccgaacaggccgattatcttggccactcgtttgaacgggaattggggttcctgtgtgttcacgggttcttacacctgaatggttacgatcatatgaagaaagctgatgcggatgtcatgtttccgcttcaaaaagagattttaaatgcttatggactcaaaagataaccgcaagccacaattggataagaataagtcgtttcttcaatcagtcggccacgctcttgaaggcattaaacgactgctgttggaagagcgaaattttcggattgacttggttgtggcaatcattgtgttaactttcgccattgtcatgaagattagcatcaacgaatggctctggctgttcgcggcttttttctcagtgattgggtcggaagttttaaacaccgttgttgaaaacgttgttgacctcattgttggtcaccactttgacgctttggccaaaagagccaaggatgtagcagctggtggtgtgttactatcagcactgtttgctgtgatcatcgggatgctgatctttgttccgagattcattgcattattaaattaagaggagtaagaaatggataatccagattttcattcaggctttattgccattgttggtcgaccaaacgttggtaaatcaacctttttaaaccgggtcattggtcaaaagattgcgattatgagcgacaagccgcaaacgaccagaaataagattcaaggggtttacacgacgaaagaagctcaaattgtctttattgacacccccggtattcataagccacagaacaaactcggtgatttcatgatggaatcagctttgtctgctttaaaagaggttgacgctgtgctgtttatggtcaacgccactgaacatcgcggtgccggggataatttcattatcgaccagctgaaaaatgttgataagccaatttatctactgatcaacaagattgatgagatttctcccgatgacattatgccgatcattgagcaatacaagaacgctttggaattcaaggatgtttatccaatttcggcgctccagggcaataatgtgcccgaattgatcgacaccttaatcaaagaattgcccaacggacctcaatattatccagctgatgaggtaaccgatcatccggaacgatttgtgatttcagagttgatccgagaaaaagtgctggaactaacccgtcaggaaattcctcattcaactgcggtagtgattgaaagtatcaagacagaggacagccttttgagaattcgggccacaattatcgtcgaacgtgatggccaaaagggaattgtcattggtaaaggcggctcgatgttaaagaaaattgggacgcttgccagaaaagacatcgaaaatatgatgggcaacaaagtctttctcgaactgtgggtcaaagttgaacctcactggcgcgataaggccaacctgctcaattcttacggttaccgcaaagataattattagaggtgaatcagtttgtcaaaaggtcagcgaacggattttaatggcattttgctttatacaaaagcctatcgggaacacgacctgctgataaaatttctcaccagagaattcggcaaaaaaatgttcctggttagaggcgccaaacgcccacggttcaagatgcgttcagcaatcctgccgtttacctacgggctatatggcggtgacattaaggaatcaggattgtcatatatcctcaatgataagcatctcgtccactttcaaaacatcagtgaagacattactaagaatgcttatgccacttatatcatgtcactgattgatttggcctatcccgacggtgagccgattgccacttggtacgacaagctgttgaccggcctgcaactgattgaccagggctttgatgagcaaatcatcacaaatatttttgaggtccaactgctgaatgcttacggcgtcgcaccaaattgggtggattgcacgatctgtcaccggacggatctgccttttgattactctgaggcctacggtgggctgttgtgtcagaatcattggaacaaagatccataccggatgcatttggatgcccgcacaatttactatcttcgactgttttcggtagttgacttatccaaactaacccatatcaaggttaacgatcggaccaaaaaagctttgcgggaagttctcgaccagatttattcaagaagtgtcggtgtcgttccaaaaagtaaacattttattgatcagttgggaaaattcaagttataactgataacggcgttgacaatattttgattgtcaactatgattatttttgaaataaataattcaatgatgacaaaagaaatgacaggatggaccctggtagcgaaatcaggatagtgggagctgattatcgtcggtactgtcaatggcgcttttcgagttgaacaattaagtgctggtagtaataccagaagtagggtggaaccgcgatttcatcgtccctatgttgagtggcttagtctataagtcgttgaacatagggactttttttatgcgtttgaataattaggaggaaaatttatgactgaaaaattatcagttcaagaaattatcctgcggctgcagcaatactggtcagcccagggatgtatgttaatgcaagcttacgataccgaaaagggtgccggaaccatgagcccctatacgttcttacgggcaatcggtccggaaccgtggaatgccgcttatgtggaaccttctcgtcggccggctgacggtcgttatggtgaaaaccccaaccgtttgtatcaacatcatcaattccaggtgatcatgaagccgtctccggaaaacatccaagagttatatctgaacagtttaaaagaattgggaatcaatcccttagagcatgatattcgatttgttgaagacaactgggaaaacccatccatgggttgtgccggtgttggttgggaagtttggctggacggaatggaaatcactcagttcacctatttccaaatcgttggtggtctggaaatggatccggtcgcttcagaaattacttacggattggaacgcctttcttcatacgttcaagacgttaattcggtctttgatctgaactggtctgacgatgttaaatacggtgatattttcaaagagcctgaatatgagcattccaaatacagttttgaagtttccgaccaagagatgttgttgaccctgtttaatgattatgaacgcgaggccaaacgcctgttggaccaagatttggttcacccggcctatgattacatcctcaagtgcagccatacctttaatctactggacgccagaggggctgtttcagttaccgaacgagccggctatctgtccagaattcgcaacttagcccgttcggttgccaaagagtttgtggaagcacgcaaacgactcggcttcccactcattaaagacgaaaagaaacgccaagcactattaaaagacgacaaggaggagaaataatggctaataatttcttattagaaatcggattggaagaaattccggcgcacgtggtcaccccaagcatccagcaactaaagaagcgtgccggtgatttcttgaaggatcaacggatttcatttgctgagattaaaacgttcagtactccccgtcgtttggcactttacattactgatttagctgacaaacagcccgatattgacaaatctgttaagggcccggccaaaaaaattgcccaggatagtgacggtaattggaccaaagcggcgattggcttctcacgcgggcagggtgcaactcctgatgacatcacctttaaggatgttaagggcgttgagtacgtcttcgttgaaaaacacattgccggtaaatcacttaaagaaattttgccggggatgaaggatgtcattaccgccatgactttcccaaccatgatgaaatgggggacgtattcgtttgaatatgtccgcccaatcaaatggctggtggccttgttgaacgataaggtgattcccttcaagattttggatgtcgacacggatcggatgacatctggtcaccgtttcttaggcaaggatattgaacttgccaatgccgacgaatacgaagaaaaactgactgaacagtatgtcgtcaccgacgccgccaaacgcaaggaattaattaccaagcagattatcaagattgctgctgacaacaattggcagatcaatctggatcccgatttattggaagaggttaataacttggttgaatggccaaccgcgttctttggcaactttgatgaaaaataccttgccatccctgatgaagtcctaatcacttccatgaaggatcatcaacgcttcttctacgtgactgatcaagacggcaaacttttgccgcattttatctcagttcgtaacggtaatgattatgatattcaaaatgtggttgccggaaacgaaaaagtcttgactgccagactcgatgatgcaatgttcttctaccaagaagatcaaaagaagtcgattgccgattacgttgagcggttgaagaaagtcagcttccacgataagatttcaacaatgtatgagaagatgcaacgagtccaagtgatttcaaaataccttgggaaccttgctggcctatccgagcaggagctcaaggaccttgagcgggctgcttcgatttacaaatttgatttggttaccggaatggttggtgaatttgcggaactccaaggggtgatgggcgacaaatatgccttgttaaagggtgaagatcaagctgttgccaccgcgatttctgaacattacatgccaatttcggcaaatggtgagctgccaaagaccaacgtcggttcaattttggcgattgctgacaaactggacagtattttgacgttctttgctgccgggatgatcccaagtggctcaaacgatccgtatgctctccgccgccaagcaaccggcgtcgttcgaattgtcgctgacaagcagttaaactttgatttggagcagactttgaatctgttaattgatcgtgaagatcaagcgtcagttgcaccaaaactggatatgaaagcccaagttcctgccgtcagtgacttcgtcaaagaccggatcaaacagtacttggacgacctgggagttcgttacgacattgccgatgcggtgacctctggttcccacaccaatatcctgttcaacattgccagtgccaaaacactccaggatcataaagacgataccgacttcaaggacattatcgaatcgctgacccgagttcagcggattgccaagaagggcgccttcaaggctgatgacttaacggttgatccggcattgtttgaaaatgattccgagaaggctttgaatcaggctgtggcagctgccgccaaggattacactcatcaaagtgccgaagaagactttggtcgtttagctcagctcaaagataaaattaatgattatttcgatgccacgatggtcatggccaaagatgaaaagctgaagaataatcacttgcgccaactcaccatgattgccaacatgattatgtatctcggcgacctcgataaattggttgtcaaaggctaattttgagggctaatatttgtactaattaatgttttatgataatatttaaatacgtatcgccagtaaaacaagtcgcacttttgggtgcggctttttacaggcattgattcagttttgaagatgggaggcgaagtaatggcgaagatcccagaagatgtgattgaagaaatcaggtcacaggttaacattgttgacgttgtctcccagtttgttcaattgaaacagtccggaaagaatttatttggtctttgtccgtttcacgaggagcggaccccatctttttccgtctcggaagataaacagatttttcattgttttagctgtggcaggggcggtaacgtctttaagttcattatggagctgcagaatgtttcctttcctgaggcagttaaaaaggtcgctgagatggaaaatatttctgttgatgagaagtatttccgtgaaagcggcaattcccaatcaagtcccgaaaacacacaacaaaaagcattaattgatctgcacgagcaaagcgtcaagctgtatcatcatattttgaccaataccaagatggggcagccagcgctcgattatctgcataaacgtggtgtgaccgaccagacgattgccacttaccagttgggatatgctccggcacagcggttgctgaagccatttttcgacgagcgcaaagttgattttcaactgctgcgaaaatctggcctgttttctgaagaccaggatggcaatttgcgagaccgtttcgtcgaccgggtgatgtatccgattcgaaatggatccggtcaaacgattgctttttctgggcgattgttaaccactgattccgacatgccgaagtacctgaacagtcctgagactgacattttcaacaaacgaaaagtgttattcaatctagatttggccaggtcaaatattcgtaccggtgagccggcaatcttatttgaaggattcatggatgtcattactgcctttcaagcagggatcaagtccggaatcgcttcgatgggaaccagcttaaccgagcagcagatttatgacatcaaacggattacgcgcgaagttgtgatttcctatgatggtgatacgcctggacaaaaggcgatcaaacgcgccattgattcattcaatgaacagaagagcaatttggtgatgaaaatcatctcgatacctgatggaatggatcctgatgagttcattcgcaaaaaaggtgccgacgattttaaacagttgattgaccatgctcaggctccagttgagtttgaattgaattatctcaaaaaacaatacaatttggattctgagattgaccaaactaattacattgctgaagctttaaagctgattagcagagtggattccggcatttcacgggatctttaccttaaccggttggcggatgaattttcagtggccaagcaattgctgcaacagcagttagcaccattgatcagacaacccgccccggcggctgaaccgcatccataccacaagcaggttcaggtcgttaaacagcaaaagcatttctcgttagttgagaaagccgaaatgcagctgatgaaccgtatgctgcactaccatgatatttggttaaaggtaagtaatgtttcggggttctcatttgttgatgaacagtaccaaatgttgtaccttttagccgaggggtattttaccaaattcgatgattataatgttgccacgttcagcaatctgatttcggaagactcactgcaaagtctattagttgatattgacatgctcgagcttccggataatccgaccaatgctgaaattgatagctatttaaacattttaatgcatcgagccccggtggaagaaaagttaaagaaaaagcgggcagaactcaagcaagccgttaagattggtgatgttgacaagcaacgtgcgttaacgattgagattgttaagcttgaacaacagaagagaatgaagcaacaagtataacttcaggaggcgttttgatggctactaaaaaaaccgacgataaagtaacagaaacaaagactgccacagctaagaaggcaactgcagctaagaaaacgactgcatcaaagaccagtaccaaggccaagtcaaccaaagcgaagacaactaaggccaagacgaccaaaaaagctgacaagccatacaagaaggaatttgacgccattgttaaggctaataagccaattggccatattacctatgacgaattggaaaagaagattgaaaagccttattctctgagtgaaaaggatatggaaggcctcttggagagtatcgaggactccgggatcagtgtcgttgatgaaaacggcgatccggatccgcgagccatcggtgctgccaagaaagtgaccaagaaggaactttctgatgtttccgcgcctactggtgtgaaaatcaacgatcctgtccgaatgtacctgaaagaaattggtcgagtttcacttctgagtgctgaccaggaaatttcattggccaagcgaattgaagccggtgacgaagaagccaagcaggaacttgccgaagccaacttacggttggtggtttcaattgccaagcggtatgttggtcgagggatgcaattccttgatctgattcaggaaggtaacatgggcttgatgaaggccgttgaaaagtttgattaccgtaaaggattcaagttctcgacttacgcaacttggtggattagacaggccatcacccgtgcgattgccgatcaggctcggacaattcgaattccggttcatatggttgaaacgattaacaagttgattcgaattcaacgacaattactccaggatcttggccgtgagccattacctgaagaaattggtgccgagatggacatgccaactgaaaaggttcgagaaattctaaagattgctcaagaaccggtttcccttgaaacaccaattggtgaagaggacgacagtcaccttggtgatttcattgaagatcaggatgcaacttctcctgctgaccatgcggcttatgaattactcaaagaacagctcgagagcgtccttgatacgttaaccgatcgtgaggaaaatgtgttacggttgcgatttggtcttgacgacggtcgtacccgcacgcttgaagaagtgggtaaagtctttggtgtgactcgcgaacgaattcgtcagattgaagccaaggcattaagaaagctgcgtcacccatcacgaagcaagcagcttaaagatttcttagattaatttaatatgatcattcattgagttggggcatttcggtgttccgactttttttgtccgctaaaatggcccttccaagtaaaatgcttctcggaatctgtcattttccattaggataatttataatgaatttatacacaaaatgaggagcaaaatatgaatagcacgcatttatcgaaacgactacaaactgtcagtgaccacgttgaacctggcagccgactggcagatattggctcagatcatgcctacctgccgattcacttggctcaaaatcatgttatcgactatggcgttgtcggcgaggttgccaaagggccgcttgccaacgcgacatcagaaattaccaaggaccatttattggatatccttcatccccgacttgccgatggcttggcagccattgaacccggcgacgacattgatgccatcaccatcgccggcatggggggcaacctgattacccacattttggaagctggtaaagctaaactgaccggaaaagaaaaattgattctccagccaaacgtcggcgaaccggtcgtcagaaactggctgatggccaatcaatatcgaatctttgctgagcagattctaaaagaagacggccatatctatgaaattattacggctaaaaaagctgacaaacccgtcgcttattcaaaattggcccttcagttcggtccatttttgctacaagaaaaatcgccggtgttcgttgaaaaatggcaggaagaaattggcctgctaaagcgggtgattaagaatatgcgtcaggccaccactcccgatacggcaaaaatgacggccattcagtcagaaattaatctaatcaatgaggtgatcaaggttgaaagctaagcagttaattgaaagatttgagcaatttgcccccaaaaaattggcaatggaaaaagatccggtcggcttacaaatcggttcactcaatcaggaaattcacaaagtcatgaccactttggatgttcgcccggaagtcgtcgatgaggcgattgccaaccacgttgactttatttttgctcatcacccggtgatgtttcatccagctcataatcttgatctcgatgacccgcaaaatgcgatgtacgctaaaataattgccaaccacatcacggtttacgctgcccacactaatttggacgctgctgacggtgggatgaacgattggctcgcagaagcacttcagttaaccaatctaagtgggatggtcccagcctatgatgaatcggtctttcgattaaccgtgcaggtgcctaaagtctatgcgacggctgttcgaatgtcacttgtcgatgccggtgcgcaggccagtgctgctcagtacagtggatatacctacgaaattgacgggacagtctactatgttcccaaggccggcgccgatccaactatggggactgccggtgaaccaaatgaaatcgaagactcgcgcttggaatttgaagttcccgaaagaaatcttcatcaggttctgaagactttgtcagatgttcatccgctggaaaagccactttacaatttgattcgcctggaagacaaaaagcatcactttacgatgggtcgaatcggtgatttgccgcacagcatgtctgtccgtgaactggctgaagactgtaagcagacctttggtgtttccggccttcgggtaatcgctcacgacatggctcagccgatcaaacgagttgccattcttggtggcgatggcggcaagttcttccacttagctcagcagaagggcgccgacgcatatgtcaccggggatgtttattatcataccggccacgacatgctggctgccgatttcccggtggtcgaccctggccaccacattgaaagtatttgtattcccaaattggccgagctgttcaaacagtggtccgaccagtatcactggcagctggctatttatcagtcaactatcaataccgatccattcacatttatgtagataaaaggagataactgtcatggcaaaatacgccgaattaattcccaactttttaacgtttgtaaagattaatacccgttctgatcctcaatcaacgagcattccgtcctctgatagagagacacggtttttgaatcaactgaaggatcgtctgactaaaatgggcttaaaagacgttcacaccaacgagcaaagtgcctatgtctttgccacgcttcctggaaacgtcgacaaatccgttccaaccgttggcttcatttcacatattgatacggctgattttaatgctgaaaatattcaaccacaaattgttgagaattatgatggccattctgtcattaaacttgatgagaagggtgaatatacgctggaccccaaagtctttcccagtttgaagaagtatgcaggccaaaccctgattactacggatgggtcaacgttgttgggagctgacgacaaagccggcgtagcagagatcattgctgcaatcacctatttacaagcccatcccgaagtcaaacatggtgacattaagattgcttttggtccggatgaagaaattggtaccggcgccgaccattttgacgttaaagatttcggcgcggatgttgcttacaccgtcgatggcggcccacttggggatttgaattacgaaacctttaatgctgccgatgcaaaagtcgtgatcaaaggaaccgatgttcatccagctgaggccaagggtattatggtcaatgccatccaagttggaatggatttccacgccgccttacctgactttgaccgtcctgaaaagacccaggatcgggagggattcttccatctgtatgatttccagggaaccgtcgaccacaccgaaatgggctacatcatccgtgaccatgaccgagatcgctttgaagctcgaaaacgactcttcaaggggattgccaaccaaatgaacagtgactttggtgaagaccgggttaaggtgaccatcaaggaccagtattacaacatgggagaaattatcaaaaaggatccgacaccggtaaaaattgctgaacaggcgatgaaaaacgttgacgttacaccgcatgttttcccggttcgtggcggaacggacgggtctaagatttcttacatgggactgccgacgccgaacattttcgctggcggtgagaatatgcatggccgttttgaatatgtttctgagcaaaccatggaaaaagcggttgacgtggtactggaaatcgccaaattatacgctgaaaagtaataggtcaaaaaaggtcaaattattgttcagggcattcaaaatttgatagtatagcgttagtggtttggaatgaaaagaatgatttttgtttcgaacctttttattagaacgaattcttgaaaaaatcgtcaactaaaatacattaataaggtgataatttaatgaatcctgataatttaacggaagccgtcacgcaggcaatttctcaggcccaacagattgcggctactcgaaagcagcaaaacattaccgtggcccatttattcaaattcttggttcaacccggcgagttggcccgagagatttattctcaactcggattgaatttgggggatctgaatgatgaactggatgctgaaattgatgccatcgcgacggttgaaggcagcaacattaattatggtcagtcactctcttccaatttgtacgaactgttgcagaatgctgaacagattaaaaatgaatttggcgatacctacatcgctgttgacactttaacgattgctgtgatgcagttacacggtgacaaatttgccgattatctttctcaacagggtattaccgagcaaaaggtgcgcaacgttgtggaaaaaattcgtggcggccaaaaggtgacgaccaagaatcaagaggacagttatcaatcacttgaaaaatatgggaccgatttagttcaggctgcccgggacaataagctcggtccaattatcggccgggacgaggaaattctcgatgtgattcggattctttctcgaaagactaagaataacccggtcctgatcggcgctcccggtgtcggcaaaacggcggtcgttgaaggcttggcaatgcgaattgcctctaatgacgtgccggaaaacctgaaaaacaaaaccatttttcaattggatatgggatcattaatcgccggcgccaagtaccggggcgagtttgaagagcgattgcaggcggtgttaaaagaggtcaaaaaagccgagggccaaatcatcatgttcatcgatgagattcataacatcgtcggtgctggtaaagctgaggggagcatggatgccggcaatatcctaaagccgatgttagctcgtggcgaattgcatttaattggggccaccacgattgacgaataccggaagtacatggaaaaagacaaggctcttgagcgtcgtttccaacgggtcatggtccacgaaccctccgttgaagatacggtgacaattctgcgtggcttgtccgaaagtttggaaattcaccacggcgtcagaatccatgacaacgcgttggtggctgctgccaaactatccgaccgttatattaccgatcgctatttgccggataaagctattgatttggttgacgaagcctcggctgaaattcgggtcgaaatgaattccagtccaactgaacttgaccaatccaagcgccagatgatgcgcctggaagtcgaagaagctgctctcaagcaggaaaccgatgaagcatccaagaagcggcttaaagaagtcgaagaagaactggccaatattaaggaaaaagtcaaccagttaaatgcccgttggtcgcaggaaaaagaagctattaagaaaatttccgacaaaaagaaacaactcgatcaggccaagaatgaattgaaacaggcggaaaacacctatgatttgaatcaggctgccgtgttgcagcacggaacgattccccagttggaagccgatttgaagaagcttgaagataacgatcagcattccgattggctggtcagtgaatcggttacagccaatgaaattgcggcggtagtgagccgagagaccggcattccggtcaccaaattagttgagggtgaacgaaagaaattgctgcacttggcagacaatctgcacaaacgggtaattggccaagatgcggcggtcacagctgtctcagatgccgttattcgctcacgtgccggccttcaagacccaagcaagccactgggttcattcttgttcctggggcctactggagtcgggaagaccgagttagccaaggctttagccgaagacttgtttgattcggaaaatcacatggttcgaatcgatatgtctgagtacatggaaaaagaatcggtttcccgactggtcggcgctgctccggggtacgtcggctatgaagaaggcggtcagttaactgaagccgtgcggcgcaatccatacacgattgtcttatttgacgaaattgaaaaggcacatccggatgtctttaatattttgctgcaggtcttggatgacggccgtttgacggatagtcagggacggacgatcgattttaaaaacaccattttaatcatgacttctaacttaggttcagacattttgcttgaaggcaccgatgagaacggggttatttcacaaaaagcccaacagcaggttaaccaattattaaaagcttcgttcaaaccggaatttctgaatcgaatcgatgatgtgatcacctttacaccgttgacgaaggccgatattgaacagattgtccagaagctgattaatcagttatctggccgtaccaaggctcaagacatcaaattgtcaatttctgacgaggctaaacgctggattgccaataacggctatgaaccgcaatatggggctcgaccgcttcagcgttatgtgaccaacgtcgtggaaactccgctggcacgaatgatcgtggctgatcagatcaagcctcacagcgttgttcacattaaccttgataacgatcagttaagctttgttcctgaacaattacctgctgacgaacagatttaaaccaagctacctggggaggaattcggtgtgccgattaattaccagcttccaactgaaaatcaaactcaattagcggtggcgtattttcccgctgatcatccaaagggaattgtccaacttattcatggcgccttggagcataaggaacggtattatgaattttgccggtttttgagtgaccatggctatgttgcggtgatctcagataatcgcggccacggccaatcagtttccgacgatgacccttgggggatgatgcgcagtctgccgcaattgatccatgatcagctgttggttacccaatccatcaaagcccggtatcccaatttgccagtcagtctgtttggtcattcttttggatctatcttggcgagattgtatttacagcaccacgaccaggaagtcaatgcggttgcgttaaccgggaccaccaactatattccggtggtgccgcttggcttattcattggttgggtctttttgaaatgccattctgaagatgctaaatggtccttgctatctaaaatttccggtctaactccgggggatcattcctggttgagctataatcaggcaaacattcaccgggtcagtacagatccgttaatgatggatgaatatccggttaaaagtttggtaacactgtggcagggcgattattccctgaaacgccttcaaaaatttgactgtcacaatccacaactgccaattctgagtttggtcggcagtgaagataagttcagtggtggtcagaagggcttggcagacacggttgcaacgctgcatgagatcggctatcgaaatgtagtcagtcttcaagagccgcatatgaagcatgaggttcttcaagaaacgcatcgggaagttgtttttgaacgtctgctgcagttctttgacacacaccagtaaagttgattgagacaacaaaaaggctatggcaaaatctgccatagccttttaacgtttcgaaaaactattcttttgatttacttgatgttgcagaatccttgctgatcagatagataccgtttacggcaataaatgcagtaattgcggcagcaattccgatttgggaaggatcccatgttcgaacttcgagggcggaacctatgtaaccaatgatttctccaaagatgtatgcccacaaaacagctacaatatttgaactaataagtttcatgtctaatgccacctcacaatcaatagcattttagcatatattttgtgaaaaatcatcatttatttaatttgccaatttgaatgtgggcttgatatatttggtataattttaattaagaaagaagggcaatcctgtgagttatgttccgttgcaagtcataagttcatacagtttactgcagagtccgattcgcattgcggacttgattgctgaagccaaggatcgcggttatcaggcgttagcgttaactgacctcaacgtgatgtacggggccgtggaattctacgacgcttgtttaaaggctggcgttaagccgctgatcggtctgactttgcagctgaccggcttgattttgaccgataaagaatatgggtgggtgctgattgccaaaaaccagcaaggatatgccaatcttctcaaattatcaacattgaagatgaccatacccgaattgacagcttctcagttaggtgactatttaagtgatttagttctgattttgccgccggcagcagaaatgaatgacctgcttctacaagggcgggctgatgacgctgctgatttgattgatcaggtcaaatcccttggcgtcgatcctaatgcccttaaaatcggtgtcgactaccattcctctgacagcttaaatgacatgttaagtaagctggcggctgacaagcaagttgctttggtggcggattcgccagttgaatacttaaacgccaccgactatttttccatgcaggttctaaaaaatatcggcgcgggagaaaaaatcgccaacgtggcccaactcagtaagcaagtggggccctattggctgcgtccggccacacaaattgaggctcaataccgtcagattcacctcgctgacgcactgacgcaagtcgaccaaattgtcgctgattgcaatgtcgagattaagaaacagcagcccaaattgccgcaattcgacacaccaaacggtatcgattccggaacttacctgcgccagctttgcgaaacgggattggcggatcgattaaagaaaaatcagattaaagatgcgaccccttatcatcgccggctggatcaggagttatcagtgattcattcgatgggctttgataattactttttgattgtttgggatgtgattaatttcgctcaccagactcacatcattaccggcccggggcgtgggtcggccgctggatcattagtagcgtataccttaacgattaccgacgtcgatccaattaaatatgatttgctgtttgaacgtttcttgaatcctgaacgggttcagatgccggatattgatttggatattccagacgacaaacgcgatgaagtcatccaatatgtccatcaaaaatacggtcacaaacgggttgcccaaatcatcacatttggcactttggcagcgaagcaatcgatcagagatgtcggccgggtgtttggcttgaatactgcccagcaagatcagtggagtaaggccattcccaacgcatttcacgtgaccctcaaggatgctttggccaattcccagcgactgaagaatctggtggctgacagtccgcttaatgaagcactctaccaaaccgcccagacgctggaaggcttgccaagacactattcgacccacgcagccggactggtattaagcgacgatcccctggtgaatttagtgccgcttcaaaatggcaacgaagggctgttgatgactcaatattccaaagattatgttgaatcggttggtttgttgaaaatggattttctgggactccggaatctgtcaattttggctgatgcactacaacaggttcaactaaccaccggaaaggttctggacatttctgctgtgcccttggatgacgccaagacgattcagttattcgccaacggtgacacgactggcattttccaatttgagtccaacggcattcgaaatgtccttaggcgcctgcatcccgaacggttcgaagacattgccctggtcaacgcgctttatcgaccgggacccatgcagaacattgatgaggtggttaagcgaaaaaccaatcatgaagcgttaacctaccccgacgactcgctcaaagatattctccagccgacttatggcgtaattgtctatcaggagcaagtgatgctggtagcttccaaaatggccggtttttctctgggtcaagcagatattttacggcgggcgatgagtaagaaaaagcttggcgtgatggaacaaatgaaggctcagttcatcaccggcgccaaacagcggggatattcagattcagtcgccaataaggtctttgactatatcgagcggtttgccaattacggcttcaacaaatcccatgcggtcgcctatagcaagatggcttatgaattagcctacttgaaagtttattacccgggcgaatttcacgttgcgctgttaaattcggtcaacaataattcggttaaggtcaaagaatacctccaagctgccaaatcaatgggggtcaaggttgttggcccaaatattaatcatagtgaagcccggtttacctttcaagatcaacaaattgtgtttggccttgattcaatcaaaggcgtgcgtcacgacatggtagtggatttattggctgagcgacaacaaaacgggccatttaagtcgtttccggactttttaagccgcctgcccggcaagtaccgcaaagttgaattgatcaatgccttgatttatgccggcgcattggatgtttttccatttaaccgttccgaattaatcgctgccgcccctgaatttatcagctccgttgaattaagtggcaattcgatgagcttgttcaaagcgttggaacccaaaatgccaaagatgcctgagatgcctctgatggacaagctggaaaaagaaaatgcttatttaggggcctatttgtctggtcatccgacagaacgatttgcccccttggaacagcgattaaatgctgagacaaccgctacgttgagtgccggtatgaaaaatatttacttgattctctacattaccaaggttaagattatccggaccaaaaccggcaaacaaatggcctttttagacggtaatgatcaggtggggcagacttcggtgactgtctttcccaacttatttgccaagacccagtcatggcttcataaagacttggtgattttgatcaaaggcaacgtcgagaaagtcaacgatcttcaggtggtcgccaatgacatccagccggcggctaacgccctgatgaacctcaagcgatcaaaacagcaatctaaatggtatttgcgaattgatcgcgatcatgacaaaaatacaatgtttcacaaactggccgacctgagcagccaatatcacggccaggtcccggtcatcgtttttgaaacagaaaccaaaaaaacttggcagctcgaggacaagctgtggctaaatccaagttctgaaaccaaagagcaattaatcacaatctttggcaggaataatgtggtttataagtaaatttttggaataatttttcagaagtcaggttcattacgtaaaggctttcatttgcggtagacctaacttttgccattccaagtcggtgctggaaagcccgcttacccccaaaaggtgggcgacaacccgcttaaaaagtgataaaatacgattgaaatctaaaaggataccgatgcgttatttaaattgttttgcgacattttaataaggtgttgcgtgcccaaaaaccgaaggagagattttacttatgaagaaaactaagatcgtaagtacattaggcccagcaagtactgatgtagacacaattactaagctgattgaagctggagctaatgttttccgatttaacttttcacatggtgaccaccctgaacatcttgatcgtatgaacaaggttcacgaagctgaaaagaagactggcaagactgttggaattatgcttgataccaaaggtgctgaaattcggacaactgttcaaaaagacggcaagatcgaattccacactggcgatgttttccgtatttcaatggacgcaagtcttgagggtactaaagacaagatcgcggttacttaccctggactctttgacgatgttcacgaaggcggccatgttcttttcgatgatggtttgttggacactgttgtcactaaaaaagacgatgctaacaaagaattagttgtcactgttcaaaacgacagcacccttggttcccgtaaaggtgttaacgcacccggcgtttcaatcaacctgcctggtatcactgaaaaagattcagatgatattcgttttggtttggacaatgacattgacttcatttctgcttcattcgttcgtaaagcccaagatgttttggacatccgtgaactgcttgaagaaaaacacatggaacatgttcaaatcttccctaagattgaatcgcaagaaggtatcaacaactttgacgatatcatcaaggtatctgatggtttaatggttgcccgtggtgatatgggtgttgaaattccagcagaaaacgttccgttggttcaaaagactttgatcaagaaatgtaaccaacttggcaagccggttattaccgctactcaaatgcttgattcaatgcaggaaaacccacgtcctactcgtgccgaagcttccgatgttgccaacgccgtctttgatggtactgatgcaaccatgctttctggtgaaagtgctaatggtgattaccctgttgaatcagttcaaacgatggctcgtatcgacgttaaggctgaaaatgctttcagcgaatttggtaccccacgtccagaatttgactcaagcgatgttactgaatcaattggtgactcagttgcccgtgttgccaaagaattaggcgttcactgcatcgttgcagctacccgttctggttacactgcacgaatgatctccaagtatcatccagatgctgacatcctggccattacttttgacgaacgtactcgtcgcggtttgatggttaactggggtgttcacccaatcttggttgacgaagttaagagcactgatgaaatctttgaactagcttcaaagaaggctctcgaaactggtttagctaaggaaggcgatttgattatcgtcactgccggagttcctgttggtgagagtggtaccaccaacttgatgagaatccaactgatcggttcaaagctggttcaaggtcaaggagttggtgacaagactgttattggtaaagcggttgttgctaaaaacgctgctgatgccaagagcaaagtaactgaaggcagtatcttggttactaagtcaactgacaaagaatacttaccagctattgaaaaggcaagtgccgtagttgttgaaaccggcggcttgacttcacacgcagctgttgttggtatttcaatgggaatccccgttgttgttggtgcagctgatgctaccagcaagatttctgacggtgaattgattaccgttgattcacatcgtggcgttatttaccatggtgcttcatcatcaatctaaatttaacttgtgagtaatcacaattaatcatgacaggtccgggcggttaatccgttcggacctgtttcctgttatgataagggcggtcgaattttcactgaaaaacgtgtaaaataagattaagctcgattagatcggagataagcatgaataatattattgcgcaagttgtaaccggtaaggtcatcgatgaaaatgacaaggactattacgttcagattgaaggagaaacatttctccttgataagactgagctcaagaaacccttgcgaatcggtgcatctttcactggttttacgtatgaaaatgaacagcataaaatgcaaataaccagaaacattccggatatccgtcgtgatcattacggttttgcgaccgttgtgaaggaaaaatttggtttaggggtctttgtcgacattggcttacccaataaagacgtcgttgtctcaattgatgaactgccgacggtccggtcattgtggccgcaagacggtgatcaactgctgattgatttgacggtggataacaaaaaccgaatttggggtcacttagccgacgaagaaatttttgcggcaattgccaagccggccaaggatgatctgcagaacaaaaatcttaaggctcgggcttatcgtcttaagatttctggaacccggttgttgaccgaggattacaatttggcttttctgcatcctgacgaacgactcatggagccacgtttgggacaggaagttgaagccagagtgattggcatgcttcgggatggcagtgtcaatatttccaccaagccacgggcttaccaagaaattggtgaagacgctcagatgattttggcggccattgaacataccgacgacaaacaactggcgttcagtgataaaagtacgccggattccatcaaagattactttggtatcagtaaaggcgcattcaaacgggcgttgggacatctgctgaaggaaaacctgatcgaacaagctgatggccacatttccttgaaaaagtaggcttttatgatgcacgaacaaattgaggactatcttcattatttacgggtcgaacgcggcctttcagataatacgattaaaagttatcggcaggatctgcaggaggccggtgctttttttgacaaacacgccaaatcaattgccgacattgaccaatttgtcatcttggattatttagaaactcttcaacggcagcataaagcccggaacacggttatcagggtggtctcgacattacggcggttcttccagtacttggttcaattccacgtgattgttgacgatccgatgctcaaggttgattcgcctaaaaaggcccagacactgccggacgttttaactgtggcccaagttaatcagttactatcgatgccggatactcataaaaaattaggtctgcgcgatcgcgcaatcctagagacgctgtatgccaccggcctgcgggtcagtgaactggttaacttgaagttgggtgacctgcatttgccgatgaacttgctgcagacaattgggaagggcgacaaagagcggatcattcccatcagcgacgtggcaatcgactggttgaatcaatacatccaatcgacgcgagtccaactactttcgggaaggcccaactccgagttcctatttttaaatgcccacggtcaccaactgacccgccaggcaatctggcagatgattaaaaaatatgtcaaccaggccggcatcaaacgccatgtcacaccacatacactgcggcattcatttgcgacccacctgcttgaaaacggggccgacttaagaatcgttcaggaactgttggggcattccgatatttcgacgactcaaatctacacccacgtttctcataagcatttaacggaagtttataataaatatcatccgcgagcataacgaaagaggttgaataaatgttatatcaataccgaaaagattatgaaaagatcacgatgggcctcttttcgttggtttccgagctgcagaatatggacttggttgcccaagaaatgagctggtacgccgccaaagacgaccgattgatttatttgtggcgggacccatccaataattggtcgggtttagtcggcattgaacttcaaggaaatcagctgttggttcatcaattggtgttaaccccgcaaagcgtcagtcaggggaactataaccggatttttgacgacctccaggatttatatccaaaatatcaaattgtggtcggctttgaaaatcgagccgcctgggaaaaatgggagaatgcgattaatcatgcctgaagtcaagcagccggaattacatttgaatgattttgacgggccactggaagtcctccttcatttgattcaggaatccaagatggatatttatgatattcagatttcaagaattaccgagcaatacatgcagtatatctatgatgcccagcaattaaatttggaaattgtcggcgaatactttgtgatggctgccaaactgatggtcatcaagtcaaagatgctgctgccgacgattactgacgatcaaccggatgaacagcaggccgacccccgtgaggaattagtgtcccagttgctgaattataagcggtacaaactggtggctgccagtatgaaaaagcgggaaatgaaacggcgggagagttttacccgctccgagttgagcgtggcgccaaccaaggccgaactgattcagccatctccgttcaacagcggcgacatcatggccagctacgtggatgctttgaaacacttcaagtataatcaacccatgtcgacggtaattcacgagtggtcctttacgattgaaggccagagtcaacgggtgcgcgagctgttaaaccaaactgataaccggatttccttcgataaattggttgccaattcaactcaaaccgaagaggtcgttaccgattttctagcaattttggaaatggccaagtataacgaagtccggctcaaccaagcaaccgtacagtcgaccattgaaattcgaaaggggcctggatacgttgatcagtaatctggcaaaaattgaagcactgctttacgcctctggtgaccaaggcatcacgttgcggcaaatgtcccagcggacggcgttaacggtggccgcctgccggcaattgttggaaaaaattgtccaaaaatatagccaagatcaagatagcggcttaaaggtgtttgtcagcgacaacgtctatcggctgggaaccaaggaagaattgtctgaattagtgggcgattatgtcaacgatgccaaaccgcgggttctgtcggaagcggcattggaaaccatttcaattatcatgtataaccaaccgattaccagaattgaaattgatcagatcagaggggtcaatagttcggcgattctccaccggctggtcaaccaggatttgatcgaagtgactggggtcaaagaagaggtcggcaaccccaagcaatacgggatcaccaattttggcctggattattttgggttgaagtcgttgaaagacttgccgccattgccaaaggatgaagtcttggatgatgacaccagtgattcactattaacccgttttaacaaagaaattgataaagaaaattaggaggtggatgtatgaatgaagaacgtttacaaaaagtgattgcacacgcgggagttgcgtcccgacggaaggctgaagaattgattgccaaaggacacgttaaggtcaatggcgaggtagttaaagaactgggaaccaaagtcaccccaaacgatgaggtgaaagtcgacgaagtgccgatttcaaaagaagccccagtctattacctgctttacaagcccagaggggtcatcaccgcggtgaccgatgacaagcaccgaaagaccgtggttgatattttagaagaggtccccgaacgaatttatccggtcggccgcttggactatgacacgtctggcctgttattattgaccaacgatggcgacctggacaacaaattaacccacccaaagtacgaggttgaaaaaacctatgtcgccaaggtcaagggaattgtgaccaatgacgacctcaaacacttgcggactggcgtcgtaattgagcatcgaaaaacggccaaggccaagaccaagctgattcgcaccaacaaggactcgtcgattgtccaattgacgattcatgagggtcggaatcaccaagtcaaaaacatgtttgaaaaaattggtcacccagttgaaaaattaagccgggaaacctattgctttttgacattgaaaggcttgcagccgggggattatcggccgttgaaaccacatgaagtcgaagaattaaaggaattgacgggcaagacaaatcgttgacatttgccttggttctgctatatttgaattaaataaattggtttatcttcagggcagggtgtgattcccgaccggcggtgatagtccgcgactcacgagtgatcgtgctgagctggtgaaattccagtgccgacagtaaagtctggtatgtagaagattaaattttacattttttgtaatgccctgacaaattctttttgtcagggcattattttgaagattgaccattggaggagaggttttttcaatggaaaatagtggtaagcatacgcagtttgcaacaacgcgtctggttgagatgtccgtgtttgccggactctcatatgttttgatgtttttgtcggtgccgattattccaatcgtgccttacatgcgcttggatttggcagacatgccgattttactgggaaccgtcttatttggaccggttggcggcatgacgattgctggtttgaaggccttgctttactgggtaacgactggcgccgatgtgattaacttcattggcgtgggttcatccctggtttcatctttggtgctcatatgggcatactacttggctgaccggcttttctcattcaccaaggggtggaagaaagcaggactggtaattttgaccatggcgattgccttgacaattatcatgtcattgaccaactggctgggagttattccgctatacatgaacctgattggcatgaaattaggctttccactggcaaccgtcattttgtctggggttgtaccgtttaacttcatcaagggaattgtcgtcggtggtgttttctacctaatcaagaacagtttcctgccacgcttaaaactccggtaaatgtggatagatccattcaaaatttgtttgatatagtataattgaacagtgagtaatcttagaggctgggacaaacttgcgggtttggactggctttttgtttcggaggtagttcatggacttaggcattctcatgttaatttttggtagtgatcggcagtttcggcgggtgaaggcgattaaaaacaccttacgggggcgccgcactgtttccaatttatactgggcactggaatatgggatgcttgattttatcgacgttctccacggtgccgactttggtgaggaccagccagtcttgacccagttgtctgccaacgggttggctcaagccgatgatgacttcagaatccaactgactgcaaagggggtcgaacagcagcgagcttatttgaatcagctgctgcctctcaaacacctggcagtttcgtcgcgctatgatgtggccaagttcatgcggcggttcagttttgccacccagattgtttcagaattcagctacggtaacaatcaatactatccccagtcaattaattattttgaagatcagctgttaaaacgctggtttattgatcataagcaggaccatctaccggaacatttccgccaattgttaaacagctttttgagtgacctccaccaggatgaactggctgatctcttcgttcaaagcctggttggacatgacttctcaggattgacagctgagcaggtggcagtcaaacgccacgtgccgaccacaattatcgaactgcagtggctgcagttgtatgggatgcccctggaaaaagtcatgcgcgcaggaaagacgagtttatttgcaccattgactgccggattggccaaaccaattatctccaacagtgctcaaaccacctttaagatgtttgtccggcaagcggatcgaaatccccacgccatcgcaactcagcgtcacatcaagctgacaacggtttatgaacatctcttggaggcagctatcctgaccccggtggcgaagtttccatataggaccctgatttcagaagatttgatgaatcaactagcagctcatcagccaacaaacgtgggcgagtggtctttccaagatgccagtcaggtggttaatcaattggcatttttccaatttcgactttttcagatatacaggagtaaaacgacagatggtcattgatctcaaacgtgaattaaaaaaatattttggctttgacaccttccggccgggccaagaaaaaatcttacagaatctgttggcccatcaggacaccttggcgattctgccgacaggcggcggcaaaactttactttatcagatgtatggggcaatcacccgccaacgggtcatgattgtgtcaccgctgatttctctgatgcaggatcaggtcagtcgactgcaatttctgggatccaaacgggtggttgcgttgacttccgcgttagattttcaagagaaaatggcgattttaaatcatttgaatcgttaccagtttatttatgtttctccggaaatgctggcaaatgaccaggttcaacaacggttgaagcggctgagcatcggcctgtttgttgttgacgaagcccactgcatttctgaatgggggcccgattttcgcccggattacctcaaattagggacggtgcgggagatgctggggcggccactgacgttaatgatgacagccactgctacccaaccggttcggcgagatattattcggcatatgaattttcgattcgaggacgttcaccaaattgtcttgccggtcaatcgggccaatatatttttaagtgcaaaaatttttgccaatcaacatgataaagacgctgctctgattgaactggtcaagcagctcaatggacctggaatcatttatttttccagtaagagtaaagccgagcaggctgccaacacgttgacgaatgaaaccaatcgccgggtgatggcctaccatggggggatggacagtcagccgcggtttcacattcaacagcagtttttggcagggaatttggacattgtctgtgccaccagtgcctttggaatgggcattgacaaggataacatccgctttgtcattcattaccacctgccggcgaacattcaaagttatgtccaagaaattggtcgttgcgggagagatcagcagccggggttggcgattttgatgtatgaacccaatgaccgcggcttacaaatgggtctgatcgatcatacgatcccggatgaaagcctattgcgttatttgtatcagcatcctaaggcattagccaccgatgatcagtttcgggtggtcaaatattaccacgacagcggcgactcgtttgagcaggccaaatcgatctttgatcctgctcgtactcggcgggtgaaggaactgggggcgatggtccaatacgtctacacggaaaaatgccgtcgtgatgaactgctgaagtattttgatgaaacagtcccggatggcgaacgaaacccggcattttgctgcgatcacgatgtcgatttttggaatcgctggcaggattttaaccggcaatatttgattcaaccggaaaaatcaggtcaaaacgaaaccaaaggctggcagcaagtcatcgaccagctgtttttatcaaaaaattaaggtaaatttaagtgaattaatgataaaataagtttgtctatatcctgatcaagaggggggtcaatatgaattcgaatgatgaacataaaaaaactgatgaagatcagccctggaatcaaacattttctgaggatcgtgatgaaaacggtaatctctcgcgagtcaagcttcgaaagcagagccaaaaccaccatctgattacgatggttttagcggcgttaatcattatcgtggcggtggttgcgctggtttacggcctggttcgccaaagtgcgatgggcaatgattcaaagagtgccgcgtcttcgtctgtcagggtcgtccgacaggataacgcaaaaaaaaaatcttcttcagcggccaaagccaaatcgaattcaactaaagccaagccagctgtaaagaaagagcagccaaagtcggccagtaaagccgcttcaacccaaccgaaagcctcgagctcgacatcgtctgcttccactgtgcaatctagtaacgcccagtcagcatccagcagttcaacgactaacaagacgactgctgccagcggccatcaatacgccactgtcaaggccggccaggggatgtttcgggttgcttataataacggtttgaccactgaacagctgatgcggatgaacgggctgaatgccaattccaagctgtatccggggcaacggcttcgggtgcggtagctttaaagaatcactcaaaaataatgtcaggtaaggaatgttagaatgcgaaaaaatggattacaagtagcaattgatggaccggcctctgctggtaaaagtactgtcgccaagcgggtagcaaagcaatttcactatatctactgcgataccggtgccatgtatcgggcaattacactgcaggcaattcgtcagggcgtctcctttgacgacgttgacgagatcggcaaaattgtccatgcctcaaaaattacttttgagcccagtgatgacggacaaaaggtcttcattgacggcaaagaaatcaccgaggcgattcggcaagaagatgtcactaattcagtttcggcagtcgctgccattggcgaagttcgaaagcaactcagtgctcaacagcaggaaattgctaaagacggtggcatcgtcatggacggaagagatattgggacggccgttttacctgacgccgaagttaaaatcttcctgattgccagtgttgcggaacgagcgcagcgccgatacaaagaaaacattcaaaaaggcattaatacacctttggatgaactacaattggaaattgaggccagagattataaagattctcatagaaagatttcaccactaaccaaagcaaaagatgctgtagaaattgatacaacgtcactttctatcgatcaggtggtttcaaagattgcagatgtgataaataaaacactgaaataacaactaattagtcaattgactggtaatattgttcaatttaagataaaattatgattagagttgtttcaaggaggaattgtttgatgagtgaaaatgcaaataatgataaaaatgatttattaaacgctttaaacagcgttaatgaagtaaaggttggcgatgttgtcaccggtgaagtattggccaaagatgacagtcaacaattaatcgtgggtattgaaggctccggtgttgaaggcgttgttcccccacgtgaactttcgtctgaccaaaatgttgacgatatcaagcagggtgacaagctcaaattggttgttacttctcgaatcggcagcgacaaggaaggcggcagtttcctgctttcttcaaagcgtttggaaacccgcaaagtttgggatgaattggctgaaaagtcaaagaatgatgaaacgattactgccaaagtcagccaagctgttaaaggcggcttggttgttgatgccggtgtccgtggattcgtgccagcttcaatgatttctgaccattacgttgatgatttaaaccaattcaagggtcaagaacttgaattgaagattattgaaattgatccagttgaaaatcgcctgatcttgtctcacaaggctattgttcaagctgaaaaagctgaagaacgtgaaaagttaatgcaaactcttcacgaaggtgacgttgttgaaggaaccgttgctcgtcttaccaacttcggtgctttcgtagatctcggcggcatggacggattggttcatgtttctcaaattgcttacgaacgtgttgacaagccttcagatgtattaaaggttggccaaacagttaaagttaaggtattatccgttgacttcgaccgtaaccgaatctcactttcaatcaaacaaactcttccagaaccttgggacggaatcgaagaaaaagctccagttggcagtgttcttgaaggaacagttaagcgcctggttgatttcggtgcctttgttgaagtgttcccaggtgttgagggattagttcacatttcccaaattgcccatgagcacattgatacacctgctgatgttttgaaggttggcgagaagattaaggttaaggttcttgatgttgacactgaccgaaagcgtttggcattatcaatcaaagctttgaccgatgctcctgaagaagaagccaagccaaagaagtcaaacaaccgaccatcacgctcacggaagtctaacgaccgttccatcagtaatgcaccggaagaagaaaccggctttactttgggcgatatcattggagacgaattgaagaagtccggcaacaatgatgacgatgataacaaataatcaattattttaatcatgaaaaggggctggaaacaaaacgcaagttttgtcccagctcctttctttctgaattaaccaagcaaaggagggatttacatggcattgccaacagtggcttttattggccgcccaaacgtggggaaatcgactatctttaaccgcattgccggtgatcgaatttcaatcgttgaagataccccaggtgttacccgggaccgtatttattctcatggtgaatggctggcaactaaatttgcaatgatcgatactggtggaattcaaatcagtgatgcaccatttgcaacccagattaagagtcaggccgaaattgccatcgacgaagcggacgtgattgtctttatcgtcagcggtaaggaaggggtcaccgcagaagatgaacaagtcgccaaaattctttatcgaagtgataaaccggttgttttagcggttaacaaggtcgataatcctgagagccgtgaagatatctatgagttttattcactgggatttggcgatccaatgccgatttccggagtgcatggcctgggattgggagatctactagacaaggttgttgaaaaatttcctaagaccgatgaaaagacggataacgatgatattcggttcagtattattggccggcccaatgtgggcaagtcgtcactggttaacgccattttgggtgaagaccgggtcattgtttcagatattgccggaaccactcgagacgcaatcgatacccgctttgaggcggatggtatcaagttcacgatggtcgatacggctggaatcagaaaacgcgggaaggtttacgaaaacactgaacgatatagtgtcatgcgggcgatgaaagccattgaccaaagtgatgtgatcttattcgtcatgaacgccgaagagggcattcgtgagcaggataagaaagttgccggatacgctcatgaagctggaaaagcaatcatcacggtggtgaataagtgggatacgctcaaaaagaccaaccacacgcaacaggactttgaaaccctgatcagaaatgaattccagtacatgtcatattcgcccatcattttcgtttcagccgttactaagcaaagaatcgaaaaactaccggcattaatcaaacaggtttatgacaatcatgagaagcgggttcaatcctcagcactcaacgatgtcattatgggggcggtcgctgttcatccaaccccaacggttaatggcaaacgactgcgaatttattacgcgacccaagtcgtaaccgggccaccaacatttgtggtgtttgtgaataatccggacttgatgcatttttcttatgtccggttccttgaaaaccaaattcgtgataattttgacttcaccggaacaccaatcagaatcatcaaacgcagccgaaaatagcccaaaaatcagcaattcttaacaaaatcttgatttttcggcgtttatcgacactaaattgggcaaaaccattgcaatgacggcattcttatgctatctttgaaaaagaaatgatgttggcaaacggcgttatttcagcattccggatttgtgagaattcgacttgcaatggtttacatacctatctttgagggaggtgaatacactcatggcaaataaagcagaattagtaaccaatgttgcagcagcaactggtttgactaagaaagacgctacatcagctgtggatgcagtatttgaatcaatccaagctagtttagcaaaaggtgacaaggttcaattaatcggtttcggtaactttgaagtacgtcaacgtgccgctcgtaagggccgtaacccacaaacaggtcaagaaattcaaattcctgcaagcaaggtaccagctttcaaacctggtaaggcgctcaaggatgctgttaaatagtattcatctgttaagccagaacggcatttgtcgggctggctttttttatacactttggaggacaaatatgagctattcaaaaactgctttagaccaacttgaaggcggccaaattgatgattttaagaaatcatttcagcaagctttggatcacgattcggatgatttgctgtactcattggccgaagagctgtattcactcggcttttcaaattactcaaatactatttacgaaaaattatttaaaaaatatcccaacgatgacggtctaaaaatcaatctcgccgaacttgccattgatgatgatcaagacgacaaagctctcaattatctgtcacaggtttcgccgcagtcggacgaatacgtccgttccttgatggttgcggccgatctgtaccaaacccagggaatgttcgagattagtgaacaaaagctcttagaagcccaaaaattggctcctgatgaggatgtgatcaagtttgctctggcagaattttatttcacgactagaaactaccgcaaggcgattaatttatatttagcgctgatcacctctggtacgttggaaatgtcctcagtcaacctggttgaacgtctgggtgtttcctacgccgaaattggtaagtttgaacaagcgatgggctatctggaacaaatcaagccgattaatatgaacgccgacgttaaatttgaactggcattcacctactttaatttgaaagagtatcaaaaggcaattaaagccttcgaggatttgcgtgattcagatccccagtacagctccctatacccgtacttggcggatgcctatgttaacctcaaacgggttgatgaagcgttaaaggcgatccaagaaggaatttccattgaccaatttaacgaaaaaatctggcagaaggccggccaaattgcggaaatggcgaacgaagacgatttagccttgacctatttccaaaagggccatgagatcgcccctgacgacatggaaatcttgaccttactatcagactggtacgttgctcacgaacgctacagcgataatctgaagcttttagaaggggtttttgaagaccacgtcgtcgatgcccatcttgcttataatttggcactgtcttatcaaaataccggtgatatcaaaaaagccgccaacaattacgaattggccgccgatgaactttccgataatcccgattttcttaaacacgccacgctgttttaccgcgaaatcggcaaaccggatctcgaaaaacagtccttgaaaaaatacttggatttggttcccgatgacatggaaatggaagaattgtgggatgaaatgtgattcacaatccgcaactaaacatcagaaaaaggtcaccagttagggatctcgctaaagttaaagtaaaccatggcgggatagcccaaatgggtgaccttttatcatacatatagccttctggttctatagcagtttaaatcgctttggccgcttataagtgaagccttcaccgatcgcctcgttaacttcaataattgaaataaaggcttcttcatcgatcgattcgaccagcttttttaaagtgtgcagttcgcttggggagaccacacagtagacaatctgtttggaacggtgggaatagcctccctcggcattcaaaaaagtgacgccacgattgagctcgtcttggatggcattggaaattttttctgactcgttactaatgatcaaaatcccccgagccgtgtaagcgccgcgttgggtaaagttgacgatcattgaaaaaatccagacgtagatcaacgtatatgccatctggcggacatttaaataaatgagtgatgacagtaaaaccaagacatcaattgtgagcagcgtttggcccatttgaacgcccttaaaccgctcgaataagcgggcgacaatatcaacaccaccggttgtcccaccaaagcggtaaacaattccacagccaaagccgccaaataagccggcaccaattgccgacaacaacaggtcgtgatcgatattaatcacgattgggacccgctgccaaatccataaaaagatcgccagggcaattgttccgtataaggtataaaacatatctttctttcctaagtagcgataaccgatcgcgaacaggggcacgttgaccaggatggtcgaataggccgggtcaatgtgaaacagggcccggagaatcagtgtgataccggtcacgccaccatcggctaaatgattgtaaatgttaaagaagacgattccaaatgaataaatggcggttccagccgcgattaccagtaaatcaattaacgaaatatctaatttgaagcgactttgcttttgtgccatcgtttttcctccctgaatgatctgacaactcatcatagcaattctaattgacaattggcaatcatttcaccgaactttttgtttcaagcggaaattctgttaaaattacaacaggataaatattaaatggatggcgattattgtgcggatggtagaaattccaaaagaattccacgaagcattaccaattttacaaaagattgaatcagcgggctatgaagcctattttgtcggcggttcggttcgagatacgattttaaagcggccgattcacgatgtcgacattgcgaccagcgcttatcccagtgaggtcaaggcgttgtttaaacggacggttgacacaggaattgagcacggcaccgtcatgattcttgatcacgggactgggtatgaagtcaccacttttcggactgagtccggctaccaagattaccggagaccggatcacgtgacgtttgtgcgctccctgaaagaggatctcaagcggcgggatttcacgattaacgctttggcattggctgagaacggacaggtcactgatttgtttggcggccttagcgacatgcgaaaacacattattcgcgcggttggcgatcccaatgagcgattcaatgaagatgccttgcgaatgatgcgggcggtccggtttgccagccaattggacttcaagattgaggatgccacactagctggcattgccctccatagccagttattggcaaaaattgccgtggaacgctcccacaccgagtttgtcaaaatgatgctgggatcagatgccaaccacggcctcaagatcatgattcagactaatttgtatcaacacgtcccaatactgggtgagcatttagatcaactcagacaaattgccgacactgatttcacccttactaatgaagttcaggtttgggcccttctggcttttaaattcggattcaacagccaacaaattacccgctttttaaaaaggtggaagactgccaataaaataattaatgatgttatacttacggttgaattacttttcgcaattcaacgtggtcaagtgactaatttaaccctttatcatgccggaagtgaaaacgtcgacaacgcaatcgcagtatttgcggaccagtcgaaaactactggactatctgaacgttacaaccgacttgccattaaaaataagcaccagttgaagataaccggtggcgaattaattaaaagaggggtcttaaaacccagtccacagcttggccaggttttgaattatcttgaacaaaatgtggttgccgataagatcaacaatgaacctgaagatcttgttcaggcagctatcaactttttaaatgaggactgataattgaatggaaacaatgcgcgttgagaacttagcaaaaacatacggtgaaaagacgctttttgataagctgaattttattattaatgaacacgaccgaattggcttaattgggactaatgggactggaaagacgtcgttattgaatgccattgccggcattgaccatgactcgacaggtgacattattacctcgaaatcttacaccatcggttatttaaagcaggatccagaactggacgagagtctgtcaattatggatgccgttttttccggatcgcaaactgtctatcggacaattcgccattacgaagctgctttgaaagattattcaacgcatccagaggacccagaagcagccaaacgatataccaaggctgaagcccgaatgaatgaagaagacgcctggaacgcgcaaagtgacgttaaaacgattttgacccagttgaagattaccgattataaccagaagatttccgagttgtccggtggtcaaagacgacgagtggggttggcacaagttctgattcaagcgcccaacttactgttgttggatgagccgaccaaccacttggattttgattccattgattggctggagaattatctggctgcctacaagggctcgttgatcgttgtcactcatgaccggtattttctcgatcacgttgccaacaaaatctgggaactgtcatttggcaaactgtaccagtatgacggcaattatcaggactatgtccagcaaaaagcgacccgagttcaaggtgaaattcaagccgagcataagactcaacagctctacaaacaggaattggcgtggatgaagaccggtgcgaaggcccgttcaaccaagcagcaggcccgcattaatcggtttaatgacttaaaggaaaacgtcggtaccttacagcttgatcaggatgtcaacatttcccttggccagacccgattgggcaaggaagttcttaagatgaaagacgccaatttaaccattgacggcaaaacaattctcaaggatttcaatattctcgtccagccgaatgaacggatcggaatcagtggcgagaacggtgccggtaagaccagcctgctcaacgtcattgccggtcgactgaaattggattctggaattatcaaagtcggcgaaactgtcaaaatcgcctactatacgcaactgaccgagccgattcctgaagataagcgggtcattagttatttgagtgagattggccaacaggtcaccgataataccggcaacaagattagtgttgccgaattgcttgaagaatttctgtttccccgtttcatgcacggcacgttaatccgtaaactttccggtggtgaaaaacgacgcctgtatctgttgaaattattgatgcagcaaccaaatgttttactcttggatgagccgaccaacgacttggatattgcgaccttgaccgttttggaagattacatttccaaattccaagggaccgtcattaccgtttcccatgaccgttacttcttggacaaagttgccgatcgattgctgatctttaaaggcaacggtgtgattgaagaacaccgcggtcggttcaccgattacctggcctcattgaagaaggcgccgaaatcgtctgccaagtcagacagcgggcagtcaacttctcaatcggattcggcaagctcaagtcaagacgcacccgcttcaaatgctaaaaccaagaaaaaattgacatattctgaaaagatcgaatatgatcacatcgaagatgacattgaaaagctcgaatcacaagttgaagacattgataagcagatgcaaaacaatggctcagattatgataagctggcggatcttcaagcacaaaaggaccagttgtctgccgaggccgacaaaaaaatgaaacgctgggaatatttaagcgaatacgctgaataattaaaaacagtcacgttctgataaaaaggagaattgccatgttagaagacgcctatttagatcttgcacgttatgttttggaaaatggccacaaaaaagctgatcgaacccataccggaaccatcagtacgtttggctatcagatgcgattcgatttatccaagggatttcctttattaaccactaagaaagtgccgtttggattaatcaaaagtgaactcttatggttcttgaagggtgacaccaacatccaatttttattgaagcataagaatcacatctgggacgagtgggcttttgaaaagtttgtcgcttcaaatgactataccggcccggatatgactgacttttctcatcgggcacaaaaagatcccgaattcaacaaagtttatcaggagcaaaagaagcaattctgtgatcgaattgtcaacgacgatgatttcgccaaaaagtatggcgacttaggtctggtttacggcagccaatggcgggcctggaagacttccactggtggaacgatcgaccaaattcaaaatgtgattgatttaattaaaactcaccctgattcaagacggatgatcgtttccgcatggaatccagaggatgtgccaacaatggccttgccgccttgccacaccttattccaattctatgtcaacgatggcaagttaagctgccaattgtatcaacgttcaggagatattttcctcggcgtgccttataatatcgccagttacgccttattgacctccatgatcgccagagagtgtggcttggaagttggcgatttcgtgcacacctttggggatgcccacatttacctgaaccatattgaccaagtcgaggaactcctttcccgtaaacctcgtcaggcacccgaattgtggctgaatcctgaaaagaaacatttggatgaattcgaaatggctgatatcaaggtcaaaaattacgacccatacccagtcattaaagcgccggttgcagtttaggaggaagtcgatgctagcttttatctgggctgaagacgccaacggcttaattggtgccaatggccaacttccttggcatctgccggacgatatgcattacttcaaagaaaccacgatgggcaatacgattatttccggatcgaaaaccttccgcagttataatcggccactgccgggtcgtgagaatattgtggtttcacaccaaactgattttccaacgggcgtcaaagttatcccttcgattgaacaactgtgtgacttgattgctcaaaatcccgataaacaatatattgtgaccggaggtgccaatctatttgcccaattacgttcaaaagtcgaccggctttatcgcacgaagattgaagctgaattttccggtgacacctatatgccagccattgactattctttatttgaattgagcaaatcggtcgttggtgttgttgacggcaaaaataagtacccccacacttttgaagttttcgatagaaaataacgccggcataaatgcttatgaatctttggcagaactttgatataattgtcgttggactatcaattaattattaattttgtaaagaaacgagtggcgtaaatggcaaaagtaaaaattgtgacggactcatctgcccagttgacagatgaagaactcaaacaatacggcattacaattgttccattaacagtgatgattgatgatacggtctacgttgatcgtgatacgatcaccaatgaaacctttgttcctcaaatgttggcggctcatgatctgccaaagaccagtcaaccaccagttggtaaatttgttgaagcatttgaccggttgggtgaagacggcagccaaattctctgtttgaatatgttggctgccatcagcggcacggttcacgcagccgaacaagcagccacaatcagcaaatccgatgtgaccgtggttgacagtcaaagtaccgaccgcggcctgggctttcaagtgcttgaagcggctaagctggctcagcaaggtgccgacatggacaccattttagccagagtcaatcaggttcgtattaacaccaagctttatttatgtgtcatgactctggataatattgtcaagggcggtcgattgcatccgattgccggggcaatcaccaactttttaaacattaagttggggcttcaagtcactgacggcaaacttaaaattatttctaaaggtcgcggcgataaatcgcttaaaaagtttttcaatggtattattgatgaaatgaaaaacaccgccgctgttaagtcgattggcgtttcatacgtcactgaaactgaagtattaaaggacactgttcaaaagcttaaggctgactttcccgatgcatcatttcttgaacgggtgacgtcaccgaccatttccacgcataccggtaaaggggcttttgcgttgatttattacagtgatcccgagtaattgcagatctgaaatattgcttaaaggggcgaggcaaagcggctgttttgttgtcaccccttttagatttgatcaccatttgagaggttgtttttgtgagtcaaaataaacatgttaaacagacacagcatcattttcgttggattatcggattgatcggcctgatcgtgattggggcagtcgcatttttcggctaccattatttcaactcggccaaagaaaccctgccaagagaagttaaattgacggctgttggggattcactgactcaaggggttggcgatccgaccaacaaaggtggctatacccacttgattcgccaaaaagtgattcaaaaaaatcccaatgttcacctgtccactgccaactatggcatttcaggggaaaccaccaaccaaattaatcatcgggtggtttattcaaaacggctgcagcacagcatacgagaagccgatgtgatcacgattaccactggtggaaacgatttactgaagtttttgaaggcgaacgttgttggcttgaacaaacatcagttgaaccagaaattgaccggttattgtcaaacatatcaaaccagggttacccggctattccgaaatatccgccacttaaaccgtcgggcgccgattttcgtttttggcatttacaatcctgtctacgtttacttcccccaggtcaactatatcaacgacaccgtggcccataccaaccagattaccaataaagtgatccaccaacagcacaggatgtactttgtttcgattaacaaaccacttacagacggtcagtttaccactgccaaatccagaaaaactttggaagaaaaggccgctgccagcattatcgccgagaatcatgattcgcctgccgatattgaacagttattgagtggccaacctgcccaagcaaataaatatctctcaaatgatgaccatttccacccgaatttgaaggggtatcaaattatgaccaatcgcttgtattcccaaatggtcaagcacatatcctggttaaaggagtgatccaaaatgagaaaagcctccaagcagacgaaatcccgcaatccttggaaaatcgctttcatatcgttaatcggcctcctggttgttttagttgccggcatgtttttggcggtttctttatcgtcatctacgacgaaattggtgaatcaaaagtcgaccaaccaatcggagccaatttccgccactatcaataaagctcaactcaatcaactatccaattattatttagataagctgcagaagggccgaccttcgcaatatcactttgaagtcgccaacgaagggattgtctatggctcgctgactttattaggttccaacgtcgattattcactgaccttcgacccgaaagtgatgcccaatggtaatattgaacttcacgctaataagctggcactggggaagtttccggtgccaatcagttttgttttaatgtatgtcaaacaaaactataaactgccaaagtgggtccaactgattcctaaagataaaaccatcaaacttgatataattcacatgaacggtaagaatgggattaattatcgggcccggaccatcgatttgaaaggccaaggaaaatttgcctttgagattcttttgccgaccactgacaaggaggactaatatgcacaaaacgttctaccaatatttaatgaccaaacgcaaccccggaagtactgatccagaggctgaatttgccaacaacgcattttatgatcagtcatttcccaaacaagaagatgagtttgacgcgttatccaagtatttagaagaaaatgcttcataccttccgaccatggaaatttttgattccgtgtggaaggaatatcaagaaagcttttaggaagtgaaacaatggcagtaacaattcaatggtttccaggacacatggccaaggcaattcgtcagtttgaagaaaatctttctttagttgacgtggtatttgaagtgattgacgccagaattccgctgacttctcaaaaccctgaaattcgacgaatcagtgccgataagccgcatctttatatcatgacaaagcgtgatttggctgattctcaattaaccaatgcctggctgcagtattttgctgaacacaaccaaccggcaatcgccattgatgccaaaaccaaatttggcattaataatgtgatttcggtgatttcacccattttgcgtgacaaattgcagcgggaacaggataaaggcatgaagaaacgaccgatccgagccattagcgttggggtaccgaatgtcgggaaatcaactgttttgaaccgattggtcaaccgtcgagccgctcaggttggcaaccgtcccggcttaaccaaggggcaacagtggcttaaatctaatgataagttggaattactggatacgccgggaattctgtggccaaaattttccagtcaagaggttgcggataagctggcattgaccggtgcaatcaaagagagtgtttatgccagtgacgacattgccttgtttggcttaaagcagatcagacagcttcacccggaaggcctcaaagaccgttatcatttaactgacgacgatttggatttgtccgacgttgacctgctgttacaaattactaagaaagtcggcatgcgcgatgattatgaacgtggctccaatcggattattcaagatttccgtgccggcaaaattggtcgttttactttggatgatcctgaaacggtgagtgacgatgaccaagctaacaattaaagacgttaaacaggttttatcccagatgtctgatctcgctgatccgcggttgattgagttaaaggctgacccgcgaaaaggggttcaattggcaattcagtcaacagaaaaccgcctgcaaaagcaggccagagccctcgctgaatttgaacagcggtttaaatatgaacggtctttttggcatcaggggctgcaatatgttgccggtgtggatgaagtcggcagaggtcctctggcggggccagtggtggctgctgcagtgattctgccgcacgactttgatctggtttccgtcaatgattccaagcagctgacaccggcccaacgcgcagagttggccccgctgatttcagctgaagccctgagcgtggggattggatcggtggataatcatgggatcgatgagttaaacatttaccaagccactcgtgttgccatgaaacaagctgtggaatctttaaccccacagccggatgaaatcattgttgatgccatgcagattcccgttccgattcggcaaaccagactgatcaaaggtgatgccaagagcatcagtgtttctgcagccagcattgtcgccaaagtctatcgggaccatttgatggacgagtacgccaagcagtacccggaatacgattttccacacaacgccggctatggaacggccaagcatttagcagctctcaaggaactgggaccaacgccgattcatcgaatgagttttgccccagtgaaaaagtttagcaaaaaataaatatgttttacgtagataactcttaaaaggatgatgacaatgcttttaagagattttttgttaagaatacatttatgtaaaggaatcggcataattggtaagtcaaaaatttatacttgggtaaatcaggtcgactggcgggatgatcaactgccgacctcaggattcttggctgccgtcgctcaactaaacgttaagaacacggctaacttcaaaaccagttatcaacagttaatgcgaaacgaagaccgggtggaccagctggtcgatggtgaacagtggctgagcattgcagatgctgaatatccacttcaactgcgagaatcgtttgcgccgccgttagtgctgttttatcgcggagatttgtcgcttttatcccagccgcttttaggaatcgttggggcgcgggactgcacctcatattcagtcgaaatcctaaaaaatttgattcctggaagagtttccaatacaatggctattgtgtcggggctggctaaaggggttgatacgttggcccaccaatgtgtcatcgccaaccacggtaaaaccattgccgtgattgggacagggttggacgtgtgttatccatataccaatcaggaactacaagcaacgattgccgccgaccatctgttaatcagtgaatatcccaatcataccaagggctatcgaaatcactttccggaacgtaaccgcatcattgccggattggttcaaagtgttctggtcactgaagccaaaaaacattccggtagtttgatcacggccaatttagccctgcaaaataatcgcaatgtcttagcagtcccggggtcaattatgatgccgctgtccgttggtaccaatgaattaatcgctgccggcgcaaaaccggttttacgtgaattagacatcttggaggactactttcagacgcggatttaagggcagtgagttgacactttaaaattcctgcaatatgatgtggtagatttgtaataaaaattcctacaataatataactaaaaataagcagttttgaggggagaaaatatggcaacttctacaaaaacgaaaccaaaagccaaagcaaaatcaaaaactaagcgaaaatcgcctaaaaaaaatctggtcattgtggagtcacctgccaaagccaagaccatagaaaaatatcttggccgttcatataaggtggtcgccagtaaaggacacgtgcgggatttgcccaagagtaagatgggcgttgatatcgaccatgattatgaaccacactacatttccattcggggtaagggtgacacgattaaagaattacggtcagccgctaaaaaggccaaaaaagtgtatctggcagccgatccggatcgtgaaggggaatcgattgcctggcatcttcagcacattttggatttagatcccaacgaagataaccgagtggtatttaatgaaatcaccaaggatgccgtcaaagaatcattcaaacatccccgaaatatcgatatgaatctcgttgatgctcaacaggctcggcggattttagaccggttggtgggatattcaatttcaccgcttctctggcaaaaggttaagaaagggctcagtgccgggcgggttcaatcgatcgccctctggctgattattcaacgcgaaaaggccatcaaagactttaccccagaagagtactggtcaattgattctgaatttaagaagggccgcagtaagttcaaagctgccttttatggcttaaacggtaagaaaaaggaactgccaaataacgaggcggttcaaaaggttctgcagcagttggatcccaaaggtgactttgatattaccaaggtgacccgtcgcgaacggaagcgccaaccgcagccgccatttaccaccagtacaatgcagcaggaagccaaccgaaagctcaacttcagaacgcgaaagacgatgatggctgcccaacagctgtatgaaggaatcaatattggtaaagagggtagtcaaggtctgattacctatatgcggaccgattcaacccgaatttcagtcattgccaaacacgaagcgtcccaatttctacatgagaaatacggcgccgaatatgcggcaacgaaaccgattaaaggtaaattgcctgagggtgctcaagatgcccatgaggccattcgtccgacttccgttttcagaacgcctgccagtttgaaacaatatctgacccgcgaccaatttagactctatcaaatggtttggtcaagatttgtggccagccaaatgactccggcaatcatggataccatggcagtgacaattgaacaaaataacgtgatttttaaagccaatggttccaagatgaagtttgatgggttcttgaaggtttatggtgacagtaaagaaaaggacaacttgttacccgatttggagagtggcgatgttgttaagttggttaagaataatccggaccagcattttactcagccaccggcacgatacagtgaagcaacgctgattaaagcccttgaagaaaagggtgttggccggccatcaacgtactcaccaaccattgatacgattcagcgccggtattacgttaaggaagttggccgtcgatttgagccgactgaattaggggaaattgtcaataagattattgttgaatacttcccagacgtggtaaacattgacttcactgcaaatttagaaggcaaactggatcaggttgaagaaggtaaagagaactggatcaaattagtcgatacgttctataaaccattttccgatgaggttgattccgcaaccaaaaatatggaaaaggtccaaattaaagatgaaccggcaggcattaactgtgaaatttgtggcgccccaatggtgatcaaaatgggccgttacggtaaattctatgcctgttcaagattcccggattgtcgcaataccaaggcaattgttaaggagatcggtgtgatttgtcctaagtgtcacaaagggcaggtcattgagcgaaaatcaagaaagaaccggattttctatggttgctcaagatacccggattgtgatttcgtttcttgggacaagccaatcggcagagattgtccaaaggatggtcacttcttagttgaaaaacgggtcaagggcggcacgcaagtggtttgtccaaacggcgactatgaggaaccggcacaaaaataaaaagcatgcgacgagccctgggttgaccccggagcacaagcagaaacaaccagtgatgaacgttttttgttcatcgctggttgtttttgtttgtgcagtaggggtcaggggcgtcggagctgaactcaaaggccgaagggagcacgaagtaaactaactgctgtatccctgtaaaagcaatcctgaataaattccggggtacgaattttgttcattgttggtgctcctcacttatgcagtaggggtcaggggcgtcggagctgaactcaaaggccgaagggagcacgaagtaaactgatcgctctagccctgtaaaagcaatcctgaatgaatctcggggtacgaattttgttcatcgttggtgctcctcacttatgtggtaggggtcaggggcgtcggagctgaactcaaaggccgaaggaagcacggaataaaccaactgctgtatccctgtaaaagcaatcttgaatgagtcctgatgaacgtcttttgttcatcgctggttgtttttgtttgtgcagtagggtcctggggcgtcggagctgaactcaaaggcccaagggagcacggaataaactgatcgctctaaccctgtaaaagcaatcctgaatgaattccgaatcacgaattttgttcatcgttggtgcccctcatttgtatagcagaacgggaagcctaatcgttaaaaagcatccaactgccaccagaatcaattccatggaattgattcctttgacaaaaagccaccaccccgcaatccccatttttgcattcaacggtcttttgttccacaatgcacaaaagggtgtaaaatcaaggtgatagaaagacaaggggaggcttcaaaatgttttcatcaaaacacagtagttgtacaactattctagtcggcaagaaggccagctatgacgggtcaaccatcatcgccagaaatgaggatgccggagatgccgttaatccaaagaagtttgtggttgttgaaccagaagaccaaccacgcaattatcagtcaaaattaaccaagtttagtgttaaactgccagacaatccattgagatatacctcagtgcccgatgctgtccctgacaagggtgtttggggcgaggcgggcatcaatgcccataatgtggcaatgagtgccacagagacgattaccaccaattctcgggtgatcggtgccgacccatttgaaaaagacggccttggcgaagaagatctgttaacaattaccctgccatatatcaattctgcccgagaaggggttcaacgagtgggtaaactgcttgagaaatatggcacatacgagtccaacggaatcctgttttcagatgtcaacgaaatttggtacatggaaactgccggtggccatcactgggtagcccaacggattccagatgatgcctatgtcatcgcgcccaaccagacaggcatccaagagatcgatttcgatgatcctgacagctttatgttctcaaaagacttgcgtaaatttgcccaggaacaccatctcaacccaaccagtcactttaacttcaggaaggtctttggctcagatacccagctggaccgtcactacaacacaccacgtgcttggtatggtcaacgatatttcgatccggaatcagtgaaggataagacgccaatgagcaatgatttgccgtttatctgccacgccaaccgcaagattacgattgaagatatcaaattcgttctgagctcccattatcaagacacgccttacgatccgtttgcgccgggagctgattataagaccgttccatatcgaccaattggcatcaaccgcaaccaagagctgtcaatcttgcagttacgtccaggaattccttcagcttattcagcaattcagtggctgacattcgcctccaatccgttcaacacgttgacaccattctttaccaacgtcgtcaatacaccggactgctaccgtgataccaccgagacgctggacagccacaacgcctattgggcaaatcgcctgatttcattgattgctgctgatcattatcaggccttgatgcaagacattgaagactatcagcttaaagaaatgggttatgcccacgaacgaattgcccaagttgatcagcagatggccgaaaaagaggcttccggctcacacgttgttcgagcccttggccaagccaatgcccggaccgctgatcacgtcatgaaagcgaccgaggatctgctgacaaaattggttgtcaaggccagccaggatctgccaggctcatttacccgagaacattactaaactaaatcagtcatcataaccaaacgaagccggctcacaaaattgaatttgtggccggcttcgttttgttattcaatttttaagacagattatcttaatgttggagacgagtcattataggttcgtgtcctgggtaaaattgattggtgagaggtctgttgaattggtgatgatgtcactaatcaattggttgtaagcatccaggcccatcttggcattggcaaagttgactttggtcagataattggcgagttcgacattggacaaaccttggaatgaagcatcagcttgtttgactgcttgttggaaattcactcgcagtttggccttggtgtcatttaatttgggcccgaatttgacgtaatgcgggtcaactaagacaccggcaagcttgtaagtccaataggcttgattgggggcatagctgcctgaagcattctgataggattttggcgtggtgtttgcgccggcataaaacggcacaaaagaactttgagcagcgacgcccattgccaaccattgaatccctgcagcaggagtgggcatatttggccgaatttggaggatgtgggcctcttgcgtcttggcgagactaattggtcgatagaggtgcttatcgtgctcagagccctcgccaatggggtcaaacggtgtgccttgataatgggagcttaagaaatcttcaacgtcaaacaagcttagtttgcggttggcctgattgataaacggcatttcctggctggttggctcaaaattcaattctggtgagaacattttcaagccgtaccatacgcggggggtgttataaactgtgtctgacaagtcagcggtaccaaagattttacggaagttgaaggttttcccggacgggtccgggttcaagtgattttcggagacaaaccggcgaatcttgggtgaccacatgaagttgtcggggtcgttaaaatcaacgtcttgaatggcgctttgattggcaatcaccgcgtaaccgtcgtctggaatgcgttgggcaacccagttgtggccgccgccggtttccatataccaagcctcattcttatcggcaaacaaaatgccgttggattccgatgttccgaagtattccacaatttggcccaatcgagcaattccttcacgcgcggttttaacgtaggggaggacaaccgtaatcattgcttcttctccaatgccatcttcgttgagcggatcggcccccaaagccagctgattggtataggtgctttcggtagcactcatggcaaccccgaactcattaaagccattttcttcaaacaggccgaacttgtcagtccattcaggggtggcagaatattgaaagcgcactttcggcagggttaacttgaagccgttgtctttggatgagaaaaccggggtttcactaaattcttgatgctcgtggatgacataattctttggccaagaggatttactatcctcgtttcgggcaatcataattgacccatcaatgctggctttcttgccaacaatcatactggtacaggcggaaaagtttttgtatggtatcattttaaaatctcctattcgcagttaaatgttactccaattattgtatcatctttgctccataaacggtcctgacacgtccaaagtgccatcaagatattgcaggcaaaaataatttaaggtatacttttgccattcgaaacaaatggaggaatcaaaatatgccaattgtagatattcatttaattgccggccgttctcaagatcaactgaagggcttggtggaagacgttaccgcagccgttgttaaaaataccggtgctcccgcagaacatgttcacgtgattttaagtgaaatggaaaagaaccgttacagtgttggcggtgtgctcaagagtgacgaaaaatagtcgcaaataatttggaagtccgccagacaattgttgcgggctttttgtttgcgtttaattcggggatgaatcatcaaattcttttactttgataaagtttatctcaaggttggtttgccagtcgatattattgtatacttaacaaagaaaaagcgtttaaacgcacgaataataggaatggagacctttacatgaatgatcagcaatacataatgtccattgatgaggggacaacaagtacccgggcaatattgtttaataatgatggtgatatcgttggtaaagcacaacgggagttccaccagtattttccaaaatccggttgggttgaacacgatgccaatgagatttggaatgccgttcaatcagtgatctcagaagccttgattaatgcggatgtccaaccatacaaggttcggggaattggtgtgaccaaccagcgggaaaccacggtcatttgggataaaaataccggtgagccgatttatcatgccattgtttggcagtccaaacaaaccgctgccttagccgatcagctcaagcacgacggttatgatgatatgatccatgaaaaaaccggcttgatcattgattcctacttttccgcaactaagattcaatggattttggatcatgtagacggcgctcgccaaaaggccgaaaatggcgatttattgtttggaaccattgatacctgggtcctttggaagctgaccggcggcaaggttcatgcgaccgattataccaatgccagtcggacgatgctgtttaacattcacacgttgacttgggacaaagatattttggacctgctgcacattcctgaaagcatgctgccggaagtccgttcctcgtcagaaatttatggttatacagctggttattccttctcgggtgttcaggttccgattgctggaattgccggtgaccaacaagcagctttgtttggtcaaatggctctgcagcgcgggatgatcaaaaacacttacggaaccggtgcctttatcgtcatgaatactggtgaggagccgacactttccaaacgggggctgttgacgaccattgcttatggaatcaatggcaaagttaattatgccttggaaggaagtattttcgtcgctggttctgccattcaatggcttcgagacggaatggaaatggttaagtcatcccctgactcggaacaaatggcgattgatgctaaaagtaccgatggcgtctacgtcgtaccagcctttaccgggttgggtgcgccctactgggatcaggatgccagaggggcggtctttggcctgactcgtggcacgaccaaaaatcagtttgttcgagctacgcttgagtcattagcttatcaaaccagggatgttgttgacaccatggcagctgaaaccggaatcgatttgaagtcgctggcagttgacggaggggcagctaataacaattatctcatgcaattccaagctgatattttgggaacgccaattcagcgggcctcaatttcagaaaccaccgcgctgggtgcagcctacctagcaggcttggcagtcggcttttgggattctatcgaagaaattcgccggaccgttaaatcacgggatgcttttgaaccgcaaatggacgagcagacacgcacaaaactgtataccggttggcaaaaggccgtccaggcaacgattcagtatcatcccgacgaaaactaatcatttatcattttttcgttgtgagttcaatgaccacttttgattgctcaaacttacgacaactggcattacttgtgtggcaaactggccattaacaaagaaacgcagtcactccaacatttggaatgactgcgtttctgcattaaactatgggattaaatcgctgttcgtcccgagggttagtttttgctatcggttaagcaccaacagcaatgtccagtcgatcttgaagataatgggcaacaccatcttcatcattggtgaattccgtgacctcgtcggcctggcccttgattttatcaatggcgtttttcatcgcgacaccggtgcctgcgtattgcatcatggtcaaatcgttgccttcatcaccaaaggcaataatgtctttttgcaggatgccatagtaatcggccaaaaatttaaggccggtggatttatggacacctttcgtggcgatttccacaatcggatttgggccgccccaaggggagacttcaacctcgtcgccaaattgatgttcgacgaagtcaatcaacccctgcttgagttcgggttccacttgaacagtaatgctgatcgggttttcttttaggcttttgcgactcagtacctgattggtggccaaggtgctggggaagaagccgaaaccactgcttaatccctggttggccaaaaacatattccggccttcaacggcaatcaatgacaagccgagcggtttgctttttgccagtaattcagtcacaatttctttatcaattgtgtactggtattcacgattccactgttgatgtggtaaaatgccaaggttgccattgaaattaatcattggcgtcgttagctttaaatcgtcataaaaagtttcagagagtctattgggacggccggttacgatactgactatgtatccttgcttcgcagctgcccgaattgtttgggcagttttggcgctgattagactatcgttatttagggttgtgccgtccaagtcgagggcgattaatttctttgtaattgtgatcactccttactaacatatccatttataatatccaaaaacacctatcacgtcaattattagtaccaaaaagggagattagaatgaacttaccaactgattttgtgaataagtatcagcaattaatgggcaaatcagaagccgaccagttcattgccagctttgacgaaccgacaaccccgggttttcggcttaatccattgaaagccagtcaaccaactgatttggacctgagtgagcccacggaacactgccgatttggctatcatggtcaggtcagcggcaaaaccatcgatcatcaaagtggggcggtttacagtcaggaacccagtgcgatgtatgtgggtgaagttgcccaccccaacctgggagaaagggtattggatttgtgtgcggcgcctggtggtaaaaccacccatcttggcagctatctgcaaaacaccggcctgctaatcgccaacgagattgacagcaagcgtgccaaagcgttggttgaaaacgttgagcgatttggcatgaccaatacgattgtcaccaacacggatccggaccatttagcagcccaattaccggaattcttcgatcggattttggtggatgcaccgtgttcgggagaagggatgtttcgaaaagacccggacgccgtccaatactggtctgtcgattacccaattgaatgtgcggcccgtcagcggacaattttggcccaggcggttaagaatctaaagcctggcggggaattgatttactccacctgtacctttgcccctgaagaggatgagcagatcattgcctggctggtcgacacctatggatttgacattcaaccgattaaaaaatttgccggaatggatgacggtcaaccagattgggctgatggcaatcaggatttaaccaactgtgtgcgtatctttccacatcattttaacggagaaggccattttattgccaaattgaaaaagccggcagacccggaagttagcaaaggaccgcgtcgcttccgcggcatcagtcgaaatattgaaatgccctccaaatatcagaatcaattgttcaaccagtttgccaaagcaaccttaaagaacgttcactttgacaaattggtggttttcaaagatcatctttactcagtaccggaaaatacgccgaacttgtctggcattaaaattgtccgacttggtttggagatggggactttcaaaaagaaccgctttgaacctagttatggcttagccttggcactgcatcccgatcaagtcagtcaaaaaatcactatagacttggcggattggcaaaagtacgtgcatggcgatacattccaagtctcaccagatctgaaaaaggggtggtacctcctggtttgccagcagcagccagttggctttgccaaagttgtgaatggtacggccaagaatttcttccccaaggggctgagatttgcgatgtaaaaagagttaaatcaccatcagaagattgtggcttctgatttttgatttaactcttttttaataggctaatttcctttgttttaaatagctcaacaattgtggatcaaggatcaaccgttgccgttgtaagtcagcaatggttcggcagttcaacattaacatgattgcttttagtccgtactgccattctttgacatcgttaataatttcattatcgcttttatggatgatctcatgaagccagtaacctgccacgccaactgctgaggcacccagtgtgaggcatttagccacgtccagcggtgatttgacaccaccggcagcaatgatgcccaaccgatcagaaaaggcgcgggcttcgaatagcgactcaacggtgctcagtccccaatccgtcaaataagccatgtcttttgaggagcggcggaagttctcgatggcagcgaaattggtcccgccatgcccgccgacgttgacatacttcactcccaggtcaaccagttgtgaaatagttgcttggctcatgccaaagccaacttctttcacaatgaccgggacaccgacattggcaacaattgcttgaatattgtcaataaagtgaaactcccgatctccttcaggcatgacgagctcttgggcgacgttgatgtgcaactccaaagcatcggcggcgatcatctcgacggctttttgggcatcctcaacgctgtggttggcaccgatatttgccaagacaattccgtttggattggtttgacggacaatactgaaggaatcgcgcacctcaggatcacttaacccaacgctttgagagccgaccgccatcgccaatccacaggcttttgccaccacagcaagtcgccggttgatctctttggtgcgggggctgccaccagacatcgcttcaatatagaaaggggtcgtcagcgacagggggccaagctgggtggttaaatcaatatcatctaaccgatatttgggcagactggcattcacaaatcgaacgccggcaaacgagctgtcgacaggttggtagaacttttcagccagggacacatgttcatctttacgatgggaatgttgtgaagtcataagctactccttgtcaagatcgatgacgggatggactttaagggccagctgctggatgccattttcctgccaatgggcgatcatcgaatcaacatcggtatctttgtcggcaaccacgatcccgcagtcaccgccaccagctccggaagatttggcagctgcagcatggtcgacggcaatgtcgcacatcttcttgagaattggggtttcaatcggcactttggtaaaagcagccaaatgttgaaggatttcccggttacgggcgattccctctttgatgaccgacaggctgccatttttgaaaccgtcaatcaattcgtccaggcaggctttgctttcggccagaaaatgggtgtaagtctcatgctgattgctcttttgaacggcaaccttgtcaaccaaatgcgaagttgaggccggagaaccggtccagccgataatcagcttcaacccgtcaggtggcgttaattgcgtaatttttaaatgcggccaaggcttgttgactaaggaaatcaggtcttcctgcattcgagcagccatgagccagctgcggtcaaatgaacggtaagcgatccagccgccgtatacactggcagcgatatctcccaaagaaccgtttccttggacgtccaaatgggcaattgccgacagtttgaacagtttactcttggtcagcggtaagttgtagaactgacagagagctttgacggtggccaccgtcacggcagctgaagaacccaatccatacttttttccgttggggctatccaaatcactattgatccgcagatcatagagctccatctgccggccgagggactgcgcatattcctcagtgagctgaatggctgaaattatgtagttaaaagtattgtcacggttatccagaatcatttgatcaccgcgacgacgccaatagaccgaatcttctcggtattgttttgaaacgatactgccataggacttgcttcgagaaatttcgacagttacgaattggtccaaagccacaataatagaagggtagccagtttcgactaccgcgtattcaccggcgatatataattttcccggagctttaaccttaatcaacggatcatttcctttctagtttataaatatttgacacccgggccaggcttggcaacggtcactttggttgggccaaacaggtttgagaaggtatcggtgatggtttgaacattggcttgttgacaaatgactttaatattggggccggcatcgattgtatagtaacattcaatcccggaatgcctgagccgtttaacttcgttcatggcggtcaaggtgtcgccgttgaagtagagaaaatccggatcggcactcagtgttagggcgtgcatccgcatggcatttaactcactaattgtgccaaaacgcgtgaagtcatcatcttggatggcggctttgatattctccagatcggcttcgacgaccttaacccacgttggatagtatggggaggtggtgactgaaagggccatgccttcccgactggaaatgggcttttgatgcttttcaatggttaatgcaacgatgcggatgtcgttcaaatgagtcgtttcgactggaatggcgtacgaattggtatcgtctgatccttttcgccattccacaaagccgccaaagattgaccggcaggctgaaccggatccccggcgggccaatcgggacaagtccgttaaactcagattcatgccggcggctttgctggcagcggcggccaacgcagcaaacgccgaggcagaggatgccaggccagctgccgttggcacatgattagtcgatttgacttgggcgtttaaatcaattccagattcttggcggacaatgcttaagaagttgtgaacccgttgaccgctttttccggttaccggctggccatcaattgtaatctggtctttatccaggttggcgttaaatgtcacgctggtttgagtataaaattgatccagcgtcaaagagagactgccagtgtaggggatgatgagttcaggattttgtttgccccaatatttaattaaggcaatattcgtgtgagcaactgctgtaacggtcttatctgacgaggttgtcatgagcttctcctgttgaaaattgataattcttaaatgattgaatccaagtctgagtggcaccggcttttcgaagggcagtcgaaatttgttgagcatcccgttggttcttggctagggcgatgacacagccgcccaaaccactgccggttagtttggcacctaaagcgtgattgtcacaagcaacttgacagaatgtgtccagagtgtggttgctgacgccgagttgggccaggtcacgttgggattgtgtcattagtttgcccagtagcacatcgtcggtggttgccaaagcattgcgagccgtttcggcaatcttgccaagctcgtcaattaatggttgagaactttccggttcgtcgaccaggttatcatgaaccaacgaaacggcctcactggtttttcctttaatcccactatcggcaatgaccaatgatgaggttggcagattaaagtcaatctgctcgttgattttgtttcggataaaccaaatcggcatgttggagctggcggtcgcagagtccaggccgctgggattgccgtgggtaatcttttcttcaatatccgctaacttcagcaattggcttctggtcaaattgacctcaaaaaaatcaaaaaaagcccgcacaattgcgattgccgttgccgctgaggatcccattccgcgttcggcaggcagtttgctttggatgtcgagatcaaaagcaagcctttgagcgccaaacaaactaacgagatgagtgattaatgttttaacaccccgcagattctccgccatttcactaattgggccgtcaaagtaacgacagtgaatttgttggccggttggaattctttgaatggtcgcaaccacatcaacggagtagattgggatggcgatggcgggcttttcgtaaacgacactatgctcaccaaaccaaataatttttgcgtaactttttccagttgctttatctttcaactttatccgctcactttcaaacattccaattttatcatagttcactgattcgagaacgttttaaagatatttttagagattcataaataattctacttctttccatggtagattatcacatcttgcttgtagtatgattaaagttagtgaatatttaagaaaagtcagctcataaacagattggtgaatgacaatgaattcaaaaaccacctttgccgtggttgatattgaaacgaccggaacagatatttctgcggataatcggacaattcagttcagctgctgcttggtttccaacaacaaaattattaaaaccttcgtgaccgatatcaatccacaacgagaagtccctaaccgaattgtgcagttaaccggaatcaccaacgaacggctgcaaaaggccaaaacttttgaccaggttgccgctcagctgtattccttgctcaataatacggtttttgtggcccacaatgtgaattttgattttccgtttctgaactctgaatttcaacgcgtcggctaccccgaattacaaattgaagcaattgacactgtcactttaagccaaatcctgctgccaacgttatccagttatcggctgcaggatctcagcagttatttcaatatcgaacatgaccatccccatacagccgatagtgatgctttggcaaccgccaagctcctgcttattttactacgacaaattaagatgctgccgaaaatgaccttggaacagatcatcagcgttaatccgtctctgcctcaagacacgatgcaggtttttttggatgccgatgaaaccaacaaaaggcaggtgcacgctgccaaattgcctgatcagctgagaatctcatcaggactggttttgcgaaaacaggacccaatcgtcgtgactgatgagtctgataaacagcgtcttcgctatccaaaaacaaaaaaggccaagcaaaaactgcttccggacaacctggagtcgcgacttgagcagaataaaatgatgaacttgatctataacaattatgccgaccaacagcatcacgcagccaagaccctcttaattgaggccccaaccgggattggtaagagcttggggtattgtctgccattgagttatttggtgtcggcccacaagcctgcagtcatcagtacttcgacaacttatctgcagtttcagctgcaaaatcagacgttgccaatgctcaatgaagggctgcctttcaaagtcaatagtgtcattttaaaaggggccagtcactacatcgatctctacaagttccgcaacttattaaacgttcctgacaactcaacccaaaccgcgtttattaaagcgcagatcttagtctggctgacggttaccactacgggtgatttggacgaactgcacttaaacgtcgatcaaacaccatttgtctggaaaattcagcataccggcgtgaaatggctggatccaaacgaaccgttttatgacgacgattttttgcgttacaacttgaaaaaggcacaaaatgctgattttttgattgtcaatcacagttatctaattaaaaattggcagtatttcaaggatctgccgaccaaaccctacttactgattgacgaaacccagcagtttgctgaaactgccattcgtaacaatcaggagcggattaatccgttatcactgacaacggcgattaacaaaatcttggcagatattaatgggactcacgaagataatatcaaagaaattgtggaagacgacgccatcttggaccacgctatcgaagcccttgacggcaaactccgacaggccaagaccctggtctcgaccgtcacgacgaccctctttgaaatggtcgtcaagggcaaacggctccaccggaatgccgagttcttcgagcgcttaattccgattaatgagatgaaggcagccaccgctgccaatcaagaaccgatcaaccgtctccgcgcgctccacgacagcttggacggactgctggccactttaaatgcccaaattgaccataatgccggtgcatacaccaaccacgatttcttaagtatttattctttttttgaaaactataatgagtttaatcatcaattacgcttgctgttagcaatcgttgatgttgacgaccagtcaattgagcagcatgtgacgtgggtcaccgtcaataatgtcaaagacgtcaatagcctgacacttaaccgggggattttgaaaacggaagattatctccgtgaccatgtctattctgcctttgaaccggcaacttttaccggggcgacaattttctcttcacgacgttcacagttcatttacaacttattggggattagtcgcgacgattcttcgattaaacgactcaaaagcgacttcaatcccaaagatcaagcccgactctatttggtcaccgatcaagacgaccggcaattcgcaaccaattccgataattatcttcaaaaggttgccgacaatatcgaagtcatttataagaatgaaccgcggcagaccttggtactgtttaactcactcaatgcgattgaacggacgtatcggctgcttcaggaaagtggcttcacagcgacccattttgttttggctcaaggcgttcacggaacagccgccaaaatcagcaagcagttcatccatcatgaacccgctatcctgcttggggccaatactttctggcagggagtcgatttcccgagaaatctactggaaaacctgattgttgcccagctgccgtttgatacgccctcagacccttataatcacgcgctgtactcgattgagcgcagtaagggtaagaacccattttatagtattacgctccccaaagcgactctcaggctgcgtcagggcatgggacgcctgttgagaaccaaagatgacttcggaaccatttttattttggatcccaggttattatctaagcggtatggcagcaccattctagccaatttgcgcaacgatattcctgtcgtgcacggttcaattgatgaatgtgtattagacatggttaagttttttgaaagcagaaattaatctgcggttgagcagtcggatatttgctataattaggaataacgaaatttgagaggaagttaccatgcaacggcatcgaagagttaaaaaacaatcatacgttaaaatttcctggatcgttatctcgatcattttgattctctgcttttcgttcttcattatcctgcacacggcggagcggccgatgacaattgcccgcggccagaccgaaacgattgctaaaaagtacgccgggttaacgaaagtcgactcgttttacacctctaatttggggaagacttattattccgtttccggtgttgataacaagaacaaaaatgtttacgtcatcgtcgctaaaaaaggcggcacggtcaacgttatcaatagcagcagcggtattagcgagcagcaggccaaaaatgtgattcaacggcaaaaacacccatcaaaattaaacgggattgggctgacgatgattaagaaccagccatattgggtggtcagctatatgaacgccaagaatcatttgtgctttacgacaatcagcttcaaaaacggcaccatttacaaatcgattgaaaacatctagaaatgaaaggacacttcaatgaaattttcaaaacgggcgatgcaggtcacgccttcagcaaccgtcaaagtttccaatactgccaaggcgatgatcagaaagggcatcgatgtcattaatttgggcatcggtgagcccgattttccaaccccaaaaatcattgccgatgcagcaattgacgctattcgatcgggcaaaaccagtttttacaccccggccagtggtttaccccagttaaaagaagccatcgccgagcgcattaagcaggactacggcgttgtctacccagctgatcaaattagtgtgaccaacggtgccaagatggcgctgtacgtgttaatgcaggtattggtcgatgacggcacggaagtcttgctgccccggccaagctgggtcagttaccgccagcaggtcaatcttgcaggcggcaagccggtaattgttgagacagggacggacttcaagattaccacccaaagcctggatacagctgtgactaaaaatgctaaggtattggtgatcaattcaccgcaaaaccccactggaaccgtgtattccagggatgaactggcggcaattggtcaatgggcagtcttgcataatgtgaccttaatcgctgacgatatttatggcaaattggtttataatcaaaaccagtttgtttcgttggttcaaatcagtgacgaggttgctgcttcaacggttttggtcaacggcgtttccaaagcctattccatgacggggtggcgaattggctatttagccggggcgccggaattaatcggcaaggtaaattcgattctatctcattcgaccggaaatccagccacggtaagtcaatatgctgcgattgctgcccttcagtcggaccaatcagccgttgagacaatgcgagaggcctttgaacaacggttaaatcaaatttatccgctggtgcaacaaattccggggtttaagttggcagccaaaccgcaaggggcgttttatttattcccaaatgttgaagcggctgttgacctggcaggtcttaatgactcaggggaattggtcgatcagctgctggccaaagcccacgttgcggtggttgacggagctgcttttggcatgcccggctacctcaggttgagttatgccactagtttggaagacctggtaaccgccgttgagcggatcactgaatttatgaatcagtttttagaaaaacaagtatctggaggaatcggaattgaaacaaattaacatggttgacgcacctaagtacgttaacgaaaaagttaaaattggtgtttggttaaccaacaaacgttcaagtggtaagatcgcctttctgcaattacgtgacggaacggcatttttccaaggcgtcgtcgtgaagagtaatgttaccccggaagttttcgagttggcgaaggaagtcaagcaggaaaccagcatgtgggtaaccgggatcattcatgaagatgctcgttccaaatttggctacgagatcgaaattgaaaccatcgaggtcctttctgaaacccatgactatccaattacgcccaaggaacatggggttgacttcttaatggatcatcgtcatctttggctgagatccagccggccccacgctgttatgcggattcgtaatgaggtcattaaggcgacttatgatttctttaacgatgaaggtttcatcaaaattgatgcccccatcctgactggaagtgcgcctgaagggacaacgacgcttttccatacggaatacttcgatcgcgacgcttatttgtctcaaagtggtcagttgtatgaagaagccggtgcccaagcgtttggcaaagtgttctcatttggccctacctttagagctgaaaaatcaaagacccgtcgtcatttgatcgagttttggatgattgaaccggaaatggcattcatgcaccaagaagaaagcctcgaaattcaagaacgctatattgcttacttggtgactcgagtgcttgaaaattgccaaatggaactgaagacattgggtcgcgacccggaagttctcaaaaagtacaccgttttaccttatccacgaatcagttatgatgaagccattacgatgctcaaaaagggtggctttgatttggagtggggagtcgactttggttctcctgaagaaacctaccttgccgatcaatttaaccaaccggtttttgtgatcaactaccctaaagcaattaaaccgttctatatgaagccacatccaactcgtgatgacgtggtaatttgtgctgatctcttggcacccgaaggatacggagaaattatcggtggttcggaaagagcaacagattacgactatctctatgatcaaattgtcaaggctggtttggatcctaaagaatactcatggtacttggatttacgtaaatacggcagtgtgccgcattccggctttggtttgggacttgaacgggctctgacctggttaacaggtgaagaccacgttcgtgaggcaattccattcccaagactgcttaaccgaatttacccataaattgaaattaaacactggtttggtggattcgaggtgaattgaatggacgattatgcacgcaatctactaaatgaggggcaaactactgtcagcaactatctgttaaaacattatcatcagattggggttaccaatcaggagcttttcatttacctattgattaaggggaatcatgacctggtagttccaatgccggaaatggcagatctgcaagcacagacgaattattctgaacagcagctgttcaatttatttcatcaaatgattgaaaagaagctgaccaaaattacgcaagtagtgattgagggtcagcaggtggatgcttacgatttcacgccgatgtatgaaaaattggcattggtcaagcccacgggaacctctcctgaggcgtcagtaaacgaaaagcccaagactgttagcagcagcgaccgccaagctgtctttcaaagtattgaacaagaatttggtcgaactttgtcgccgattgagatggagtctatcagtcagtggttggatattgatcattattcaccggaattgattcaactggcgttgaaggaagccgttttaagtcaggtttataatttaaattatatggaccgaatcattagtacttggtacaagaaaaatttaaagaccccacaacaggttgaagccgccaaaaagaatcggaatagttcacattcggatgatatttcaactggttacgacggtccggaaattccgtttatcaacttgtcaggtaattcagataaataaacaattaggaaatcggctaaacttttagccgattttttcgtacatagtcaaagggacaatcagttcttcaatctggcattcagaaaaccgtaataaggaagcccgcagaaaatattggtaaacgaaaagaggccctcgacaaatgatgtgtttgtcgaaagtctctgatggactgtgctgattttattgggtttcgtcagtaccaccgttattgtcattgctattggtattgccgccaccattgtctggcgtcgtaccgccattgtcagtggaactcgatgatgcggaactactgtttgaatcatcgttaccaccatcgccactcggtttttgctcagatggcgtggatgcggatgactcgttggaactttctgtactgctggaactctcattttcccgtggttgcgtgacaactgccgagctggaacttgaaccaccttcagttgtgtagccactggtcgtttgatttgaactattatcggtgactgtcccaggataaccggcgacgtaatactcagtggtgccgccacggttggttgcgacaacgtcacttggctgggtccaatcggtgttgggtttatcttcagaaatatagcccatcacgtttttatagatttcctgggcgattgatgtttgtgccgaagtgacataggaattggctttgaattgatggtcgtatccagtccagatggctaatgaatagttcttggtataaccggagaaccaggaatccatcgtcgacatcgccggcactttgttcaaataatcgtcgggatactgtgtcgtaccagttttaccggcttcataaagaccagacactttggctgcagtcccggaacctgcagaatctgtcatcacgcccttgagcatattagtgatcataaatgcggtcgccggcgacatggcgcgtttgccttgctggtgatacttgtgggtcacaccgttaacttgaacaatcttgttgattaagtacggtttgtaataggttccgccattggcaaaggctgcgtaagatgcggccagctgttcagaggaaatgtagagcccaatcccattttgaatctcgagtggtttgctaaacgacatccccaggtttttcaaaaagccggttgctttaggaaccccaacattttcaagtgttcgaattgccgggatatttcgcgactcaaccagtgcttttcgcatcgtgatcgtgccttggtatttgttatcaaagtcatagaccgatttatcggttccaggataaacgtacggcgtatctttgaccggctggtaggtcgggtatttaagatattgaatggctggaccataatccataatgggtttagctgttgatccagaagacctgccggtttggacagccctgttcaaaccgaacgccactttggttttgcggccgccctgcatggcaacgactttaccgttattgacatcgacaatggttgcaccgacttggaaacggttgttggggtaggcaatggtcggatcgttattacttacctgataaagtttcttttgtgcactcatgtccaaattcgtataaactttcaggccgctgtttggtttgtagcctttatcctcgagttcctcaatggtctgctttaaataagaatcaatgtatttagaagtcttttcagaggttcgcgccttcgcgtgggtcgctgaaagatgggctttgacactggtatttttggcagcttgggcttgcgattcagtaatgtctttggtcttgaccatcgcatcaaggacttcatttcgccgcttggtcgcatactgaggatacttataagggttgtagagcgttggtgattgtggcatacctgccaataaagcgaactcaggtaacgttaagtgattaagcgttttatcgtaataatattctgccgccgtctgcatgccgtagacgccgttgcccatatagactttgttgatgtaaaattccaaaatttgactcttactgtaacgattttcaactttgattgccagccaagcttcctgagcctttcgcttaaaggttcgatcactggcagccgttgaaaagaccgacagtttgactaactgctgagtgagggtacttccaccctgaagacctaaagaagatccggtcaaattcgagatcgctgctccggcgattcggatggggtcaacgccatggtgtttatagaatcgtcgatcttcaatggaaacaacggcccgtttgagggttcttggaatatttttagatttaacgtagtcccgattctggcttcccagacgtgaaatcactgtgccgttggcatcatagaatttagtggagttatcactggtcagcgcagaccgggtaattcgtggtgcactggaagcgtagtacgtgaataggccggcgccaaacagaaataggacaccaaccaggattaaagcccatttgaagattcgccgaaaggggccttttttatgggtattgctaaactgtcgtccgcgccgaacttcagcgcgtgaatttttcggattgttctgtgacatagccttctccttcgtaacttattcgatgaaagaatcaaccgcgcgaagatagggtagtaatgggttaattctgtattgaatcaaaaagccttccttttcaatgacttttctgggaatggatttgcggccgccacttttttgggcgtcccaataggtaatcaagtcggtggctttcaaaacatacacggcctgatccgaaatgaatttgataatcgcaaagcagattccttgctgttgtaggcattgtcgcatatgttcaacttgatgttcatgaaaatttttgagtgggaaagactgtttattcttggtctctttggcatcaaagtcaatgtattttccgcgatatacgccattataatcagtagtggaagcacgacgaaaataagcttccttaattctggcggcacttctcttgggatagtcaacagaaacgatctgaattggagtcggcttcttatgaataactgcaattcctgcacgaagataatactgattgctcttgttgatttcgtcctctaaggtcattcctcgatttgagaagttaatcgaatcattgtgggtaccggaagaagtcggctgctcatgaaactggtttccattcgggtatctgatagtcattgaacgttagcttcctttttgtgaatagttatattgtacttcatttaacttaataataaccacaataatgttattataccaagtagagtcttcatttaaaatatttaatcgttagggtgatatcatgagccgcttgtgggtaaccggctatcgaagctatgaattaggaatttttaaagatgatgatccaaaacgaaaagtcattgatatggtcttaaaaaatgaaattgaccaggcaattgttgacggcatggattggttaatttccggcggacagttgggaattgagcagtggtcgttggaaatggccctgaatttgaaaaagacctatccaggcgaatttcagacgtcaatgatgctgccgttcgctgacttcggcagtaattggaacgaaaacaatcaaaccaagctgcagaccctaaaggcacgggtcgatttttcggcgtcagtttctcaaaagccgtatcagtcgccccaacagttaagaaattaccaagaattcatgctgagtcataccgatcaggcattattgatatatgatttagataatccagggaaatcgcaatatgattatgatcaaataaaaaggtttgccgacaaccatccatatccgtataagctaattactttcgacgatttacagagtgctgcggatgaatatcaggaaaacttgaataatagtgttcaagatgactaatttatgatattattttagttggtttgttgcaaatagtgaggtgtaacccatacatggaaaacattaattatactccgaaggatattcttcaaaaggaattcaagcaaaagatgcgtggctatgatcccaacgatgttgacggctttttagacgacatcatcaaggattatgaaactttcaacaaagaactccagtccctcagtgatgagaatgagcgattaaaagttcaagtcgatgaattgaataagcagattgcggtatccggttcgcagccaatgccatcagctggtggcactgctccaaccagaagtgttccgagtcagccaatgtcaagtgcgactaatatggacattttaaagcgcctttccaaccttgaaagacgagtattcggatcacaacttgataataataccaatgattcacacaggctttaaagcttgcatataactaatatggtgtaaatcctgagtaattgcggtcgtatcattacggctgaggaaagtccattctcgcacgggctgcgatgcccgtagtgttcgtgctcggtgaaaaaataagccgggggactctttgtgagttacggcggatattaaagctaaggcttgctatgctttaattccctaaggtgccacagtgacgaacagtattggaaacggtactgatggaacgcggtaaacccctcgagcgggaaacccaaacttttggtaggggagcttcacacacggtaaatgaaccaagtgtgggggagaagtatttcgatatttctcagatagatgattactacttgttatgtcgtcctgggatataataagcacaaaacatggcttatagggatttacaccaaacaggttgagtgggagcttgctcccacttttttgttacccagaaaatgcaggagatagataaaatgaaatttaatttaatggctacttgtgccgccggtatcgaagccttagttggcaaagaaatgcgtgacttgggatatgacgtccaggtcgaaaatggtcgggtccgattcaccggtaatgaagaagatattattaaaaccaatctgtggttgagaacggcagatcggatcaaaattgttgttgatgaatttgacgcccaaacgtttgatgaattgtttgaacaaacgactgcaattgcctgggacaagttgttgccaatggatgccgcctttccagttgagggccgttcgcgaaactcaaaattgcacagcgttcctgattctcaagcgattgtcaaaaaagcgattgtcaatgaattgagcactgcctatcatcgccacacccggttaccagaaaccggtgccgaatttccactggaagtggcaattaataaggatcatgtgatgctgaccatggacaccaccggttcaagcctcttcaaacgtggctatcgaatcgaaaaagggtctgctccccttaaggaaaacatggctgccgccctggtgatgttaaccagctggtatcccgacatgccatttctggatccgttttgtggttcggggacgattccaattgaagcagccatgatcggtcgtaacattgctccaggtttcaatcgtgacttcatttgtgaacaatggccttggattgatcatgatatggcccaaaaagttcgcgatgaggccgacgccaaagctgactatgacattgaacttgatatttctgccagcgatattgacggcaatatgatcgaaatttccaaacgaaatggcgaagaggccggcctgctggctgatattcagtttaaacaattggcggttgccgatttcaaaactgataaggtcaacggcgtgattgtcggcaatccaccctatggacaacgaatgagtgatgaagaacatgcccatgagttatacaaacaaatggggaaagtcttcaatccgctcacgagttggtcaaaatactttttaacctcggaccttgactttgaaaagtactatggggaaaaagcaaccaaacgacgaaagctctacaatggatcaataaggacggactattttcagttctggggaaagaaagttcgagatttgcgtaaattagaccaaattaagagcaaataagtcggaatatatgctaaaataagaacaacttggtgaaaagaagtgggtaaatggttaaacaagtcgcgataatcggcggcggaattattggtgcaacagacgcattttatttgagtttcctacaaggcaatgacaatattcaagtgacactatttgacgacgacacggggcaagccactaaggcagcctccggtatcatctcgccatggctctcaaagcgcagaaataagcgctggtacgcgttggcaaaacgaggggcagaattgtacccatccctcgtttccgacgctcagttgagcaaccaagcctatcagcagacaggtacgattgtgactcgcaagaaccacgatgacctattggcgctttatcaggaggccaggatcaaggagcagcatacaactgcgatgggccgggtcgaattgctggacgccaaagaggtaaaacgccggatgccattgctcacggatgctccggaaggtgtttttgtcagtggtggcgcacggattgacggcggccactttgtttccgagctgctggaacgggcggctgccaataatttggatgtcaaaaatgaacgggtttccttgacggcgaatggcgccattaacacgacagcggggcccaaacattttgatatcgtgattattgccaccggtgctaggatgcacgaatcacttcagccattggggttgaacgtgaaggtccggccgcagaaaggacaattaatcgatttaactgtcaagatgccgcataaatggcgaaatatgccagttatgatgccagagggcagtagtgacgttatcccgttcaatggcggtaaattggtgattggtgcgactcacgagaatgatgagggattcgatttaacgcctcagccagctgctcgccgacagttactcaacaatgccaaagtatttatcaaaacgctaacggacgcccaagtgagtgacatgcgggtcggcaccagagcctacaccgaagattttgcgccattctttggagcagtcccgacattgcccaacttcttgattggtggcggtctggggtcctcaggtttaactaccggaccgatgattggctatcttcttgctcaggcagtgtttgaacgggaaatcgatcactggcaggattacacaaagccggtcagccagtatattgactagattgaatgcagtgcttgaagtgccagggtatgcgcgcccatgttttgtttgtctggaatccaggtgttgaccaccgttgcgaattgattttgcagtcccagtagtttgtcgagatgtttttcgaaatgtttggcatattgtttattgagactgtcaatgacgattttgctgtcagtatagaaaaaaatcaattcactgggatcaatttgtaagtcgatcaatttttggaatccggcaattgctgcgctaaactctgcatcatgattgtccgttggcgtaatcacttgattaagttgaatttgtttgccattgttgacaatgagaatgccgatggcggtgtgtccagtatgctgattgacggctgcgtctgtatatagtttaatcatgttatctacactttctttaaggagtttatttatgataagccaaaagcgtcacttcttttatcaaccaagcccattgagcagtattatttgttggagttggacttttgtcgtctttttcattggcgtgattatctggctggaaattactcattttcagtggattacgttatttttctttgtgttgtttgcggtgatcgtctgggcggaaattcattttcgcagtattcacgtctacgatcacaaatttgtcgtcagtcgcatcacgaatcctcactggttaaccgttgatctggaccagatttcacatgttcagacctcgaaataccaactggcctttgtcgccaacaccaagatctacagcttcattttacccgccaactccgttattgagatcaaagaattgatttccaacaagtaattgctgccccgttgtcagtcgatagttatttaggagggtcataatcattatgaagagcgatgttgaaatttctcaagaaactgttatggaaccaattaccaagatagctgaaaaaattgggattgctgaagatcaaattgaacaatatggtcagtataaagcaaaaatcaattttgacccaaccactgaaaaggcaaatggcaagcttattttagttacttcgatcaatccaactgctgccggcgagggtaaaaccaccgtgacggttggattgggagatgctttcaacgaattacataaaaaggtggttctggcattgcgggaaccatcactgggaccggtcatgggtatgaaaggcggcgcaactggcggcggctacgctcaagttgtcccaatggatgatatcaatctgcatttcaccggggactttgatgctttgactgaggccaataacacattagccgccttaatcgacaaccatattcagcacggcaatcaattaaacattgatccgcgccaaattacttggaaacgggtgatggacgtcaacgatcgggaattgcgccaggtcgtcatcggtcttggtgggagaacctccggtgtgccgcgtcaagacggttttgatattactgttgccagtgagttgatggccattttatgcctggcaaccagtctgcctgacctgaagcaacggatcagtcggatgttgattggctatacttacgaccggcaaccagtgaccgtggctgatttgcacgttcaaggggcactcactttattgcttaaagacgcgattaaacccaacctggtccaaaccatcgaacatacaccagcatttatccacggcggtccatttgccaatattgcgcatggttgtaacagtatcttggcgacccaagcggctttgcattttggtgattatgcgatcactgaggctggtttcgggtctgatttgggcgcagagaagttcatggatattgtcacaccccggctgaagcagagtcctgattgcgtcgtagtcgttgccacagttcgtgcgttgaagctgaacggcggtgctgataagcatgaattgaacacagaaaatcttgaggctcttaaaaaaggcgttgtcaatttgaaacgtcacgttgaagggatgcagcagtacggcaaaccagtggttgtcgcaattaataagtttgccactgataccgaagacgaattaacttatttacaaaactatgtcaccaatgatttgaaggttactgggacgatcatcaacagctgggctgaaggtggcaaaggggcagtcgaccttgccaaggatgtcattgaagcttgtgaacggccagccgaattccacgaattatataacgatgatgattcaatagaggacaaaatggccaaaatcgtcacccaaatttatgggggtgatgggattgaattttcaaataaagccaaaactgctttaaagcgaattaaaaagttgggttacgatcaattacctgtctgcatggcgaaaacccagtattcatttactgatgacgccaagcagcttggggcacctgagaatttcaaaatccatgtttcagatctgcaactaaaactgggggccggcttcatcgtcgccttaaccggaaaaattttaaccatgccagggctgccgactcatcctgcagcactcgacatggatattgatgaacagggtcggattaccgggctgttctaaagggagcgtttattttgccagtactttatgttatcggaatcattgccttaattgcgattgatcagattgttaaacacttggtggttgccagtttggcattaggtgattcattttctgtgatcaacggtgttttgtcgattaccagaattaacaataccggggctgcttggagcattttatccggccaccaatttattttcgtgatcatcgcgattttagcggcaatcttagtgacttactttattgtgaggtactggtcaaatatgccgtatcgaattggtctggggcttttgctagccggtacgctgggaaacgtcattgatcgcatcatgaacaatcacgtggtcgacatgtttcaactcgactttatcaattttccgatttttaactgtgctgacatgtacttgacgtttggaattttgattttggccattgcaatcatccgtgaaagttgattaaggggaacaattattttgaaagagtatattattaccaaccagactggacgtttggataaagtcatctcggaacttgattcttcaatcagccggtcacgggcaaaaaatttaattgacgatcaacatctcaaggtcaatggtgagccagtcaaaccaaagtatcaagttaagtcgggggataaaattcaggtcgattcggtgcaaccgactccgatcagtcttgaaccggagaatattccgcttgatattgtttatgaagatgatgatgtgattgttgtcaataaaccacaggggatggtggttcatccttccccaggccatccggaccacacgttggtaaacgctctgttgtaccatagcccactgtcaacgattaatggcgagtttcggccgggcatcgttcaccgaatcgataaggatacttcaggattgttgatggttgccaaaaatgacaaagcacatcagtttttgtcacagcagttgaaagcccaaaaaaatttgcgaaaatatgttgctctcgtccatggacgcattaaggaagattcaggagtcgtcaacgcgcccattggccggtcaccaaaggatcgaaaaaagcaggcagttgtttcggacggcagaagtgccgtgacgcattttgaggtgttggagcgatttgctgactacactttggttgcctgccggctggaaaccggtagaacccaccagattcgagttcatatgaaatacatcgggcatccgatcgttggggatcctttatatgggccaagaaaaaccattcgtggcaatggacagtttctgcacgcccaggagttgggatttgaacacccccggacgcatcaattgatgatcttttcggcgcccctgccaccaatatttgaacaaacacttaataatttacgattaaacaacgctctaggatcttgacaatccggcgctgttttcatattctgaagtggtatagcatttttatgcaatcatcaggtacaaacgttactcaattaaggagcttttactaatgggaaagataatactagataaaatggctatgcagcgggccttaacgagaattacgtatgaaatcgttgaaaaaaacaagggtgttgaagatttagtcttaattggtatcaagacccgaggaatctttttggcaaaccgaattgccgatcggctccaacaattggaaaatgtttcgattcctgtcggtgaattggatattaccaactaccgtgatgatatcgaacacgatgccatgagcagtgatgtcaaaatgtccaataacaagattaacttttctatcgaaggtaaacgggttattttggtagatgatgttttatacacgggccgaactgttcgggctgccctttccgcggtcatggacttgggtcgtcccaagagtatcaatctggcagttttggttgaccgtggacaccgcgaattaccaattcgggccgattttgtcggcaagaatatcccaagttctcaaaaggaaaagattaaggtttatgtttcagaaattgatgacaaggatgctgttgaactcatcaaataattctcattgcgaggagtcagcatgacggaaagatatttaattttagaagatggatccgcgtatgctggaaaggcattcggatcactggcaacaacgacgggtgaaattgttgccaattcaacaatgaacggttatcaagagattatttcaaatcagatttaccataatcagattatcgtttttacccaatcatctatagggaataccggactcgaccagaatgcgtacgagtccattttgccgtccgcaaaaggtgtcattgtcagggagtacgaaaatctggcgactgaccactttaagcggatttctttggataaatatttaaaacaacacaaaatccccggaatttatgacgtcgacacccgagaaatcagacatcatctacagaagcgcggcaatatgaaagcaagcattgtcgacgtcgcggatgatcatgcttttgatcagctgcacgcgacggttttgacaaatcaacaagttgctcaagtggcaactcccaagccgtttcccaaccctgatgaaggcgccaacgtggtcgtagtcgattttggcttaaaaagcggcattttaagggagttatcccatcgtgactgtaacgtgacggtggtcccttggaacttttccgccgcccaaattttggatttggatccggatggcattgttttatcgaccggtccaggttcgccggagaatttaccaaaatctgtattagacatgattacagaggttcagtcgcaggcgccattgtttgcgatgggcttaggccatgaactgtttgcacttgccaatggcgctaaagtttcccaactaaccgttgagcatcacggcagtaatcatcccattcgggaaattatcaccaatgagatctttttctcaggtcaagaacaggggtatgcagttgatccaaaatcaattgaccatgccaaactgtttatcacccacatcgatttggtgaatggcactgttcagggattacggcacagagattaccccgcattttcggttcaattttctccagatggggcaccagggcccaaagacagtgttggcttgttcgacgactttatggaaatcatggcaagaagaagggacagcaatgacgatagatattaacaaggtcctcctgcttggcggtggcccaaccaacattggccatgaaaatgaacttgatgcagccgcttttgaacgcttgatggcgctcaaaaagaccggtgcgaagattatttacgtggataacaatccattttcggtaaccaccgaagaaattcaaccagccaatgtgtatgttcaagaggtcaattttcaaaatatcgtcaacattattgataaagaaaatccggacgccattatggcgaccactggcgggcttaatggcatgcaaattgcttggcagctggctgaaagtggcattttggcctctaacaatatttcactcttgggcatcaagccggctgatttgcggaaggtcatggacaatcagaaacttcgtgatactttaaccgaaattaacgaaaaagtcattgcctcgaaaattgtggccgatgacgacgaagccatggactttgtccgtgaggttggtttcccagtgattgtcaaaccgatgtcatcaagtcatgataccagtcggtttatttgtaataatactgacgaattagaagatgctttggacgtgagtttcaagcgagcctacatcaagcgctgctcgattgaacagagtattgtgggttacaaagaaattgaaatggtcggtattcgcgatgaaagcggcaataagctgctggtttcgggaatggaagatatggatccaattgggattcattctggggattcaatcatttttgctccaacgcagactttgattaatgaagaatatcaagcgctcaggtcagcaacttttcgcattatggatgctctgaatgtgacgggaacttgtcatgttcaattcgcgcagtccagaaccgatgccaactattttgtgaccaaggtgagtccgttctttaccagaaacaccatcttggctgccaaagcaacggggtaccccttaacgtacgtctcaagctttcttgaaatggggtacaatctgactgaaatcaagttaccgagtaaatataacaagtttctgccgttcatggagccaaccatggatcatgtggtcgttaagattccattatggccgtttagagacattacggacgttgaccagcatttgaacaccttaatgaaatcggttggatctaccattggaattggccggacagtagaagaagcaattattaaatccatgcatagttcccagttttcaccacgggatattttgcccagcgtgtcgacggttaatgatgacgaggtcattaatcaactcattcatccattggccagtcgaatattaattttaatggaagcattgcggcgaggcttttcaattgatgagctatctgaactgactcaaattgatcgtttctatttctacaagttgaatcaattattgagagctcaggattttgttgtcaataacccaatgtcaccgcaatccattgaaattggacacaaatacggttttggtgacggcatgctggctgaattatggcaagtcaacatttcaaagattcagcagttgaacgaaaactaccagaatcacgtcacttacaaggcagttgagccgagcgccggtgagatgctggaatcaaccaatattttttacagcagttatgaattggaaaatgaaagccggccatttgaagaaaagagtgctttggtgattggtcggggtgggaaccaactcggccccaattcggcagcggattattacacctcacagattctcagggcgcttcacaagtcaggctataaaacaattatcatgaacacaaatccgaatgccgtctcactaacgccacagttaagtgacaaacaatacattgagccgatccaactcggaaatattctcaacattattaatttggagaaaccagatgtcgtcattctcccagggaaccgacactacttgtctaaacagttaaaacaatttcaaaatcttaatatcatcgttttgccgccggatcaaaaagttgccacatacaatcaaaagtatgcaacaacagctgtcgatctgttcatcgaaggcgatgaaattttacccgtgacgaccatttcttttgtggggaaagatcaacggactgacctgcggtttattaacgactataaagagccgatggataaatggaagtctgacgaagcaaaattgattgctgatgccactaacaaggtagatccaaaagaatggcaggggctggttcaagtcttgtataatacaactggtgattctaaatatgagatgactggcattcggcctgtacgaattactgagaccgccttcctcaccaaaacgaccgggattaattggattaacgttttggtccgtaaatacctgcacacattggatatggaagccttgcgggaagacttgaagccaacggagcacaaacgtgcatcgattatgactgctcatttccctttcagagaactccaatccagtcgcattgagggaaccactaagcaagaagtcggttcatcactatcatttaagaattttgaataagattacgacaaaagggtcggggcaaaatagtaacttttgccccgaccctttgtgtattctaaatattagcaagctaaatagtgtgataaacagctgccactgacaatgttaagaagacgctccttatatatggtgcgcattctttgtatgccggaaattgaaagcagattactcacccgcttattttcgcatctgatcaattagactttcatcaggggtgacgaacaatgtcgtttgattatcgtaaatgacataccccggtttagtaccattgggtttgcgaatatttttgactttcgtataatcgacttgtactttggcggatccgcgcgctttcgagaaataggcagctagattggcagcttccgccagggttttctcagacgggtcaaagctgcggataatgacgtgtgatccaggaatatttttggtatgcagccaggtatcacgtttgtcggcggtatgcatagttaatttttcattctgtagattattcttaccgactaaaatttctgtcccatcacttgcgacaaacttttctggtttgttaatcttttgtcgcttatttttcttctttttgttctgctcatgatcacggagataatgaccttgttccaattcgtacttgatgtcgaccaggtcttggggatcagccagttcaatttgggattgaatattttcgaagtaatcaacctcctgcttggtcagttgaatttgttcgccaacaaatttaacagcgttcttcaatttttggtatttcttgaaatatcgttgggcgttttgggaaggggattgttgatcggaaagctgaatggtaatcaatttattttcatcatagtagttgggcagttcaatgctggtcattccacgttgaactttgttgagataggttgttaaaatctcgcccttgacccgataatcatccgcattttcggtgtctttcatatcccgctggagtttcttaagcttcgtgcgattctttttaagctgttttttaacgacttgaatcagcaccgcgccttgttctctgacccggtctctttgggctttgctggcgtaaaaggcatccagcaattcgctcaatgttgagaaagtttgatttttagttgtacccggatagggaaatgcggtaaaattaatcttgttacctgcaacatggctaaaggttggctctggtgagtcgaatttttggaagaaatccttgaaattagtctcaactttctcgtccttatgcaaactagttgctaatgccaaagatgtgtcgttgcccaatccttgaattgttttccgtagattttcagctaaaacgtccacgtttggaaaatctttgatcaattggcggacccggtcaaagtcagtcatcgtaaatgggttttccaagtcctgcttcggcggtttgatataagttgctccaggcagcaacaggcgatatcggttaacgtcagaaccgacgtgtttaatagcgtcaataatcttccccgtggcttgttcgaccaggatgatgttactatgacgggccataatttcgacaaccagatctaattttgtctggtcacccagttcgttgcgcgccgtgaaggtaaacgtcaacacgcgatcattttcctgttgggaaatctcactgagaattccaccgctgagatgcttacggacaatcattgtaaagtttgtcggcacactgggattgacatatggaaccctggtaatctgcacccgggcatacgtcgggttggcagacagcagcagctgttgattctttccgtgagctcggattgttaatatgagttcattcggatagggttgattaattttgctgatccgacccgtttgcagcagatcggttaattcatttttcatagaatgggtaaaagaaccatcaaatgacatcttatcactcactttcgtataagtagcatgtactagtatagcgcactttcttgactgatgctaaggaaggcacatgttatttgtatgtcattatcaaatagcgtatactaatttttcggaggtcttttcatcatgaaagatattcttgtggcacttaattctgctgccaaaaatcatcgatctcaaatattcaatattactaaggcaatgaacctgacaatttctgaatggaagttgttaaatcaagtcattgccggcaataccacccaggaattattgtccgaaagtaccaaattggatatttcaaccttgtcgcggcagttgaagcgactattagaaaaagatatgatcgaaaagaccgcggttggtcgggacaagcgacaattgatttataaggtgactgacaagggaactcaggccagtcaatatgttgccgccgaaattcaaaagctgactgaccgggtatttaatcattggactgatgaagagaaaaatcttttaaagatattgatcaatcgtcttgaaaagagtttggatagaatttaattacgagcaggtgaatttaatgaaaattgcgatcgtgactgatagcacggcgtatttaaccaaggaagaacaagcgaaatacaacattatcgaagtgccaatccctgtcattatcgatggccgtgagtacaaggaaggtgtcgatttgacgacggcagaattctacgataagttaaagaattctcaggcctttcccagtacatctcagccgccaatcggtgagatgattgatctctacaattctttggctaaacaaggctatgacaccgtgattagtattcatcttgccagcacgatttctggcttctatagttccctgactcaaattgcaccaacgatcgaagggatcaatgtcatcccatatgattccaaaatcaccgttaagttaatgggctatatggccatccaagccagtaaaatggcccgacttgggcgcacgcccgatcagatccttacatatcttgatgggcttcggcagacaattgacgaactgtttgtcgttgatgatctgcaaaacctggttcgcggtggccgactttcaaatgcctcggcattcattggcggaattcttaaaattaaaccgttattgacatttgatgataaaagtaatgaaattgtcgcctttgaaaagatccggtcgcgtaaaaaagccctcaaacgagtggaggaactctttgctgctgccaaacaaaaagctgattatcctttgcgggcattggtcattaacggcaatgatcctaaagccggaaatgaatgggcaaataaaattcacgaactttatcctgatatgacaatcgaacaaagttattttggtccaaccattggcacccatttaggcgacaaagcattagctcttgcgtggcttcgagactttgatcaggataacatttaaaatgaactattttaacatgcaatcgcttattgttcagtaaaacacgaactaagcgattgcattttttagtgcatgtgataaactttaatagttacataaaataaatatggggtaggattcaatgcgttaagtgtcggaggaacggaatgtgaacttcgaacgaaaaatgatcggcttcgacttgtcgaccatttgcggtgttgtttccgcattcgctatgttatttagttctctaaataatggtgagctcctttataaggagatgctgcatcatgaagtcattgtcattgggttttcgtaagctgcgggttgtggatattgttgtcttgggaattttcatgtcgttattgttaattctcggtcgatttacggtcggtgttcagtcctggcggttaagtttcggcttcgttgtcactgcgattgccagcatgctgtatgggccactgtggtcatccacaatcgctgcattaacggatatcatcggcacattgatgtctgggagtgtttattttcctgggtttacaatctctgcgattttaggcgctgccatttatggctattttttctatggcaaagagatcacatggaaacgcgtgatcattgcccaattaatcattgcggttgtcgtcaacgcaattttgaatacctattggttgacaattttatataagacgccattttgggcatttttaccggttagagcgttaaaagaattggtcatgactccgattcaaatggcaattctttactatatgctgaattcccagacgatgagtaatattcagagcaggttgtttaaataaaatgagaagcgacgcaccgcaccaacatattggtcggcgggccgctttttgtcgtatacaaaggagtgaatcatgatgtattacatttcattacacaacatgcggttccacagtcatattggtgttttgcccgaggaaaaagtcgttggtcaaaatattcaaattgatttaaaagtgaaagtcgatgccgatccgactgatgatgatttgaagtcgacggtgtcatacgcggatttctatccaaccatcgccaaggtgatcgacaataatcaggttgacttagttgagaccttggcccagacagtgattgccgctattaaaaatattgattcgcggattatgactgtcaatgtccggatccgcaaacaaggaacgccgattgatggtgttttggacgacgtcgaaatagaaatggagcattagtatggaagatgtatatttaagtttaggcagtaatattgggaaccgcgaggcatttttggaacaggccatcgaggcattgggtagtgacccacggattatgattgaaaagcaggccagtctgtacgaaacatctccggttggtggtgtcaagcaacgggcatttgtcaatacagctgtcaagattgggaccacctatgaacccctgacactcttaaaggtgattcatgaaatcgaaagtggcctccatcgaactcgccaggttcactggggtccaaggaccgtggatattgatattatcttctttggcaatgaacaaattgatcaaccagggctgtcggttccacatcccgaagcgtttaatcgattatttgtgttgattccgattcaagaattaattgatgaacaatttccagacgctgaaaagattgctacggccattaagtctctccagcaagatgatcaatcaatcaagaaaatcactccggctaataacttctacaccgaaatcaccagtaacgtcactaacgtattggcagcaattggtgacgacccgactagaaagggccttattgaaaccccggatcgggttgccagaatgtatgccaacatctttgattctatcggactggaagattttcaagactataaattgtttgactcaccggagtcagatgactcaaagacggttatggtgaaaggcattccattttattcgatgtgtgagcatcacatgatgccattttggggcaaagtcagtgttgcctatgttcctgataacggtaaaattattggtctaagtaaaatcccgcgactggttgattttgtatcacacaagttaagtctgcaggaaaaaattacggatgatgttctcagccaaatggaaaaaattctccatcccaaaggcgtggcggtaattgtcgatgcccgccatatgtgtatcgaaatgcggggcgtcaaaaaaaccggcaccgtgacccgaaccactaaatttaccggtgtcttccagcaaaacgatgagctgagaagtgagtttttgaattcaatccaggtgggacaaatatgaacgatgatttaaccagtcactttgccgaatttttatataatcaaggtgatcgcattggtttgttaaagcaagttctgcgccaattgggcaacccggatgctgactatccaatcatccatatctgcggtaccaacggcaaggggtcaacggcaacgatgattgccgcaatactccagcagatgggaaaacgagttggtttatttaccagcccgtttatcggtgatattaccaatagtattcagattaatcgccaggcaatcccaactgatcaatttgataagtatctgaatcgcctcaagcagctgatgacttcatttggtgatggacagcaggaactctctgaatttgaggccatgtttgttgccgccatgcagtacttttctgatcaacaagttgactatgtggttttggaatgcggtctgggtggggagctcgacgcaaccaatgcagtgaaaacaaccatatattcaatctttactaaaattggcatggatcatattggcattctgggaaataccattgaagaaattgcgacaaccaagtcaaaaattattcgacaagggaacacaaccattgcggcccccaaccaacggccggaagtcctggcagtcttgaaagatgaagcgagccacaaagctgccactttccttgatgccgacgcagttcaaattgatcggcaattaactaaagcaactaatgtcgtttatcaagtcggtcatcaatctggtcattttcaatttggactgccgggcgattaccaattggaaaatgtccgaaccgtgttgttgtggttggatgattttcaaaaaaagcagcacttatcactggatgtcagtcaattattaacccaagcgctgggaaagctggatgtccctggtcggtttgaaaccattcacgctcaaccgacgatcatcatcgatggtgctcataatgttgatgcgatcacagctttcgttggatccgtgaaacattcattttccagccaatccaaattgattattaccgggtttctgaaggataaagattatgtcgataatgtgcgcttactggcacagattcccaatgcaaccttcaaattaacgcaacctgctaatccagagcgcaagctggacgaacgtcgtcttcaaacggtcttccaaaacattactggcaagatttacccggttttttccgacccgatagctgcccttaaggcaagcctcaaggaatcaagcaatcaccccgatcagctgattttggtggtgggttcattttatctcatcaacccaattcgagattatttaataaagacaaggagcaattcaaatgactaattctaatgaagtccatttcaaagggaagaattttgatttcaatctgactgaaacgccgattatctattccattctcaatttaaccccggattcattttacgatggtggggtcaataccagtattgatcaagttttggaccgcatcgaaactgaaatgggctatggtgccaaaaccttcgaactgggtggcaaatcgtccaagccccattttgatgatattagtcccgatgaagagtggcagcgggtagaaccctatcttaaagcgattcaaaagcggtttccaaatattgtattggcaatcgattcgaataccaactcagtgattgaacgggcgttgcaatctggaattcagatcattaatgatattgatggctttaattctcaagccaaactggatttggttcaacaatatcaaccctcagtcgtcacgatgtttaatggtcgcaattttgacgaacaaccaacgacacttgaagacacgatgcattcatttttcacaggctcgattaaccgtttagaacaagctggtcttcaaagggagaacattgttattgatcccggggttggcttctctgatcgcaatacactggaatttgatttgattaaaatgcgttacacaaaacagatgcgccagtttggagcgccgatcatgatcgcaatttctcagaaaagttttgccaaacggctgtttgatgcaggctcagatgagcggctgatcccaacattactgtttgaagcttacatgacccaacttggtgggcgaattatccgagtccataacgtcaaagaaacccaagaattaattaaaacgtatcagatcttcaaggacattttaagtgattaaggaagtgatcaaccatcttagttgaacaattaatcgcccaaatcgtaacgctaaaaagtcagccgtatccctggatgaatacccaaaaagtgcaaacggcgatcgaattgctgagggcaaactctcaaggacttcgcgaccggaaatcgccatttcatctatccgcaagtgcgatggtctttgaaggaggcaaggggatctttatccggcatccttacctgcatacaatcctattgcctgccggtcacgttgagccacacgaaatgccgattgattgtgccatcagagaatttaccgaggagaccggtttggttttaaaaactagtccaaattcgttaatcgatgtcaacatcattgatattccagctaatccgcaaaaagacgagggtgctcatcaacacctggattttcgctactggttctcctcgattgaaccacataccaaatatcggcctgagctgccagtatttcagctgaaaaggcgggaggccccggcggagtttcaaccatattttgcactaatttgatcgttaaaatgagagattatgattgttgctatatacaaatagatgattcaaattaagaaaagactcaggcaaaaccggttattggcatatacaatcatttaaaaagaaggttcaacacaatggacaatcaaattatcaccagaaaaatgcaggcagaagattatccaaatgcttatgcattgtggcaacaagttcccggcatgaatctgcgggaatttgacgatagttttgaagaaatcagccgattattgcgattcaatcccaatttctgttttgtagcggagaccaagactgacaaacagatcatcggcagcattctgggtgcaactgatggtcggcgcgggacgatttatcatttggcagttgctccgggttatcagaatcaaggtttgggaactcaactggtcaataaagtgattgaacagctccaagctgtcggtattcataaaatctttgtcaatgtcatgaaagataatcttgcaggccaatcattttggcagcagctaaaatttgttaaacgaagtgacgtgattcgttttaataaaattatttagatacgtatcagagaagcggggtgcagactcaattttcttgatacagattctactttacataatatatattatacgaagtagacaaaaagtaaaaagaaccagctaccaaagccaacactctcggcaatggtaactggttctttactttaatttcgtgaacaattaactaacggctccttccagagaatttccggattcaacttgagtgttcgtttggtaattatccactcgtacttttaaaacgtgacgctgaatgcgtttatttaacggtggcaatttcatatagtcaccgtacaatcgcgttaagtatgcatcataatctgctaggactggcacctgtaaattttcaaaggccattgggattaaatgatggatctctgtcggcttgattaattcttttccgtactgatacggtgatgacatgttaatcaacggtaattccgagtgaccgttatattgggtcattgtgctgagtcgaatatcgtatagctcactcaaattataatcggcatacttggactgtgtgatactttgctgatacaggtcaggataaaatcgctttcgaatctcttctaacagcattgccaactttgcttgctgtttttcctgttgcggccgtttatttggcattcgatcgaacggaaacacatcaataaaaatgccattcttagcttttgtcaactcacggccatgttccaagatccgcgtgccatcagccatcactttagcgaaatcgtattcgtactgtggatcgaggcggttctcttcaacgaagtatcctcgatgtgacaactctgccggtgcgacttgcagaaacttttcaaaatcagtgcgcggcaaaccgatgtcaatatcatcgtcccatggaataaagccgtgatgacgcacggcaccgattgctgaaccaccggttagaaaatattccagatgatatttagaattgattgctgccacatttgccagaatacccagttgaacttgatgaattaattttaaatcaaccatatttagaacctccttaatcaaaaatccgatctcatatctaaacctctttcaaattggattgttcacttattaatattaatcgattccaacattgggtcaattaatatgctcatttatgatatacttaacttaataaaatacagattttattaagttatacgcaaaaaaataaacggccccaccaaatttactgcgatttgctgggatatgattaactgaattaaggagcttaaaaatgcaatcatctcaatatattcaacaaaatcaacagctggttcaaaccctgccaacttatattaatgaatattatctcgacaaatcaacggttccattatcccccgccacgctatatcagtatctaaacgagtttcaccgtttcttcacttggatgatcgatgttgggattactgacgtgaaaactgtcaaagaaattccactctccgcgctggaacacttcaaaaaacaggatatggaactgtataagtcttacctgctgaaccgtggcaagcaaacggcttcccatccgcaagcaccaatttctcatcggacagtcaatcgttcgctaaacgcgctctcagccttcttccgatacttatcggaagaaaccgaaactgccgatggtgagccttatttttaccgaaatgtgatgaagaaaattgccttggttcccgacagcgaaacctaccaaacccgtgccaacaacatcaaggatcaacttatgttgggtgacgcggatgtgaaatacgttgaattcatccagaatgactatcccaagacactgaccaataaacggacgctatcattatatcaacgcgatcgtgaacgtgacgtggcaatcaatgcgctgatgcttggtactggcattcgggtgtccgagctgaccaatgcaaatgtctctgatttaaatttgagcaaagcggcaattgtcgtccggcgaaaaggcggcaagtacgattccgtgcccattgccagttgggtgcttccctatctggcaacctatttaaacgtccgtaagcaacggtatttggccaccaagactacccctgccctctttttgacgaaaggggcaagccaacccagaagaatttccaccgcgactgttgaactattggtggcgaaatactcccaatctttcaaccacgtacggattacaccccataagttacggcatacattggcttcgaagctctatttggaaaccaacaatgagcacttggtggccactcagcttggccagagttcaaccaatgcgactggcttatacacgcacatcattgacaccaagcaacgccaagcccttgatgaacttcatcgtgacaagcagcgtcactaaaagaattcgtgggtagattgccacagcattcctcatcgatttgttttctgatccacagctgactcatcaattgattgagttgattttaaagttttctgataggcagaccacatttttgattgaactttcgaaaatgtcatctgatcaaattcactggagtggatccatttacccggaaaatagcttaaatcaatattttccgctatttggccttccaataacttaattttccattgctgatgggtaaaggtgtgaacaaccgttggcgtagatactggatgcaacgcgacacttagttggtaatcggtctgcagtcgggtttcgattatatcaattaacgttgattctgtcaccggttggtcatcagttaaatttttgcggtcaaataaaggaaacatccaaaaattggccaggatgccatgactcgggcgtttttcaaataagtaccccgccttggaatggatgaccactccaaagtaatcgtggcgaaccggtcgcttctttttggtcttcactgggtaatggtcttcgatcccatccaaatatgactggttgaaatctttgaccggtgattggctggtatcataattggtggctgtcatgtagctggcacccaaatccataattgcttgattaaagtcgcctggtcgattctttggaacgattgggttgattattttttcaaatacctgacgagtgtgtggtttagcaacatcgtcgtcgatttctaacagcctggcaaaaacgcgaaaagcatttccatccactgccgccactggttggccaaaagcaatactggcaatggcaccggccgtataaggcccgataccgctcaattcctgaagctcttttgcagtcgttggccattggccctgataatcgaaaacaatctgttgagccgccttttgaaggtttctggcccgagaatagtagcccagtccttcccaagctttcatcagcttgtcctccggggctgcagccagatcttcaatcgttggaaattcgttcataaaccgtaaataatacggaatgactgtttccacctgagtttgctgaagcataatttctgacacccacacatggtaaggatcctgatcctgccgccatggcaaatcccgcttattttggtcataccaggctagtagcgtctcctgaaatgctttgattgtcttatttgaccatttgatcatctgacgatttctccttacagtttaattcaaaataataaagggctgttggcaaaatttgcgttttgtcacagccctttaggtgaatggtcattaatagctgaaatatccttggctaactaatttttctgccagttcttcttgataaagttttcgcgtccgcccatttcttccatttgataacggagcggatttttcttgtagaattcttgatgttcttcttctgccggatagaatggtttggcatcctcaatttgggtcacgattggactgtcaaattgttcactctcggcgagggccttctttgaagcttcggcaatttttctttgctgctcatccttcacgtaaattaccggacgataattatcaccgcgatcttgaaattggcccatggcatcggttgggtcagtttgatgccaatagatttccaccaacttatcatatgagattacctcaggatcaaagaaaattttgaccgcttcagtatggccagtggtgtggctggcaacttgttcataagttgggttgggaacatggccgccagtatagccggaaacgaccttgttaataccgggaatagtgtcaaatggcttgaccatgcaccagaaacatccacctgcaaaaattgctgtatcttccatgcattgcacctcaatttcatttattcaaataattgtttgtatttactgtatccctttgcgtccaattcggcaaccggaataaattttaaggctgctgaattaatgcaaaatcggtgaccaccagcatctttgggaccgtctgggaacacgtgcccaagatgtgaacccgcctgcttacttttgacttcttcgcgaatcatgccaaaagaagtgtccaagtgcttatcaatattggctgggtcaatcggtttggtaaatgatggccaaccacagccggcatcatatttatcggtcgatgagaacagcggttctccgctcacgacatccacgtaaataccggcttggtaaaagtcatcatactgaccgctaaacggcgcctcagtccctttgttttgggtaacatcgtattgttccggggttagtttgtttttgagttcctgcttgtccatgataaccctccattaaattaggttgtgtacaactaaactaaattcattatagtggccaaccaacccaaagtaaacaaaaacggccaaactaaccattcagattagccggaccgtttgaaagagttgatgaattagcttaatgcatctgttaatggcggaacaacttgcttcttacgtgaaacaacacctggtaatgacattgtgtcgtcactgagtttgctgttaaatgctttttcaactgcagatgctggttcgccgacaacaatcatctttgaatcgctgttcaaaacgttagtaatcagaactaagaacaagtcgtagcccttatcagcagcttcagccttcatggcattctcaatgtcatttttacgcttgtcaatttcgctgaattcaacgacgttgatttggtcaatccgaacactcttaccgcccattgtaaatgacttggcatcagaatcaatgagttcttggtccgtctttgctgaaacgttggtcccagctttaagcatctcaatgccgtacttttcgtaatcgatgtcagcaatttcagctaaagtcttgacagcaattttatcttcttcagtggtcgttggtgacttcagtaacaacgtatctgaaataattgctgaaagcattaagccggctaattgagcagggatttcaactttgttttcgtcaaacatcttaacgataatcgtgctgcagcagccaactggttcggcgcggtagtatagtggctgatcagtctggaaattagaaattcggtggtgatcaaccacgtgagtgatggttaaatctttgatgtcactgacactttgttgaaattcattgtggtcaaccaacatgacggagtcaacttcatttttagcagttttgatgattcgtggagttggttcgtcaaaataattcaacacaaatgcagtttctgaattaggttcacccaaagcaacggcttcagtatcataccctaatttgttctgcagatatgaataggcttttgcagcaacgattgcatctgtatcaggactttgatgaccaaaaactaattctttactcatttacataatctcctttgataatcaaaatttatttccctaaacgggctaaataatcttctttagcaaggaactcatcgaacttctgtaagaaacgttcaatccgcgggatttcgttcttgcggttccggtagacgaaattcagatcaaacttgactttaggatccaattcagtgacccaaatgtcatcgtcagtcaacttcttaaggtcgatattgagcatatatgactttggtaatgccgtgttggtgtgggaattaatggcaaacttcaaaatctgctcgggcatggtatatcgtgccgctacctttggccagtcaaccatttggttcttaaaggattcccgcaaagtttggttgagataataatcttgtggatacatcacccatggcctgtcgttgacatctttcaagtggacccgtttacgtttggccaaacttgggttgtggtggataaacaataagtcatccgagataatcttcttggagctgtatggcttccagttcttaatcgattcatccggcaggtacatgattgccaaatcgattcggttgttctccaagctttcccaaatctcttttctggtcagcatgtggaaattgacttccaaatccggattttcctggtaaagtgccagggcaaaatcttcaaagactttggtttcaacggaagcgaggattcccagattaatttgaccagtcgttgagctggtagcttgttgaatctggtcgttggcatcatttaacagatcgtatatttgccgggttgtcttcaacatgatcacacctgcatcggtcagccttaatttcttgccaaccgagtagaataattcagttcccattgtcttttcaagcttcttgatttgttgggtcagcgctggttgcgtaattcccaagatctgggcagcttgtgtgtagttcatcgtttctgacaactggagaaaatacgataaagtctttgatgcaaaaatattttcctgagtggttttcattcagactctccttatcggtccgtgcgaccattatataattaacaggatactgctattatgataattcttattgttaatacaatcaattaatatggtaaaaatttaatcaattgataagccgacaaactttggtctgattgaaaccggggtgccttcactgtcaacatcaattacaaatgagccgttggaatagcgcccacccaatgaataatctgccggtaaaatatcgtgaacccggcgatgatcggtccgcacttcaagcggctggtcttcgctttcaattcgacaaaagtccacaattctgtgcggattatttttaagttcccgcaggatcataacgccctttcgagcccttgaagtggcaggaatttctttaacagctaatttcttgaaagatccacgttgggtcacaattgccaagacatcgtcttcagagaccagttggaggttggtgactttatcaacacctcgaagccccatggattttacgccggtagttctggcgccattaaccggtacctcatcgatcccgtagcgtaacgccaagccattattagagataagaagcatttgcccagcagttgcgggcgtcttcaaataatgaatggccactacccgctcatcatcagttttgagcttctcataagtgtaggcatggctcttgtaggtccgtcccggcttcatatccgcaaaaccagtttgtttgacatgcccttggtcagttgcaatcaagaaggttcctggttgcttgagtgaatcaaaagcataggtgccaatgatttcctcgtcagcatccaacccgatggtctgagaaatatgctcaccggtatccttccacttcacatctgccaattcaaagactggccgatagatcagattacctttattggtgaacataaacagatgatcgcgggcatttaattcggccataaagattggataatcttcatcttttaaaccagtgtcggttgtcgaagctttgtatgaccgaatgctgcttcgcttgatgtagccgtcatggctgaccatcacgatcacatcctcgtcagggatcaagacatctgtattaatcttgatatctgaaacctcagcttgaatctcggttctccgagcgctgcgataagttttcgccaatgcgcgtaactcgttggccaaaacccgattgagttcttttggactattcaaaattttgttgtctttggtaatttcgtcggccaggtgctggtgttcgttctccaactctgtcacgtcggtattggtcaaacgatacagttgcaaggcaacgatggcatcagcctgtttttctgaaaaatcgtaggttttgaccagattgtcacgggcatctttacggttcttacttgctcggatggttttgatgaccttgtccaaaattgataaggcatgaatcagtccctcaacgatatgctgacggtcctgagccttcttcaaattgtatttggtccgcttctcaatgacttcttgctggaattcgagataggccaccaagatctttttcagtgacaaacgttccggccgcatatgggaaatggcaaccatattgaaattgtaggaaacctgcaggtcggtattcttgaacaggtagttcaaaattccttttgagtcgacatcacgctttaattcgacgacaatgctgagtccgttacgatcactttgatcacgaacctccgaaatgccttcgatcttcttgttcaagcgaatttcatcaatccgtttgactagttgagccttattaacctcgtaaggaatttctgtgatgacaatttgtgatttgttgcctttcagtggctcaatggaagtcttcgagcggacgataatcttgccgtgaccggtttcgtatgcttttttgatgccgtcaattccttgaacaattgcaccagttgggaaatcgggccccttcacaaactgcatcaaatcatccagagttgcatccgggtgcttctgcaggtaaagaatcgcgtcaatcacttctcccaggttgtgcggtggaatatcggtcgcatagccggcagaaattccagtagaaccgttcacgagcaggttgggaaatcgggatggcaaaacagttggttcgtactcggtgtcatcaaaattgaggacccagtcgaccgtgtccttttcaatatcccgtagcatttcgctggcgattttgctcaaacgggcttcggtataccgcattgcggcaggcggatcaccgtccattgaaccattgttgccgtgcatttcaatcagcggctcgcgaaccttccagtcctggctcattcgattcaatgcttcataaatcgaactgtccccatggggatgaaaattacccatgacatttcccacggattttgctgacttacgaaacggcttgtcgtacgtattgccgtctttgttcatggcataaaggattcgtcgttgaaccggctttaaaccatcccgaatgtcaggcaaggcccgttcctgaatgattgatttggaatatctgctgaaccgttcgcccatgacatcttcgagggtcaaactttcaattttactcattttttaaacgcgccccctaatcacttgtattatccaagatgctgccatcttcttctaaattaaatttgacgttatgttcaatccactttcttcggggttcaactttatcgcccatcaaagtcgtcacccgtttttcagcgagggcggcatcatcgattcgaacccggatcaaagttctggtatcaggattcatggtggtttcccacagttggtcagcgttcatctcacccaaacctttgaaccgctggaggctgtagcccttgccaaagtcctttgataccttatttaattcttcattggtccaagcatattggactttcaacttcttgccggcacccttctgcagcttgtaaaggggtggtaaggcaatgaagactctgccattatcaatcattggccgcatgtatttgtagaagaaggtcaataagagaatctgaatatgagcaccgtcatcatcggcatcagtcataataataatcttatcgtagttggcatcatcaatgttaaaatcggcgccaacgccggcaccaattgtataaatcatggtattgatttcttcgtttttcataatttccgggagttttgcccgttcggtgttcaagaccttccctcgaaggggcaaaattgcctgatatcttcggtctcggccctgtttggcagaaccgccggcggaatccccttcgaccagaaacagctcatttcggctgtaatcctttgattgagccggggttaattttcctgacagcaggcgttcttgttttttatgccgtttaccggttcgggtctcatcccgggcttttcttgccgcctgtcgagcttgtctggcacgcaacgctttatgaaccaaagtctgggcaaattcaccgttttccatcaaatagtagcccagcttctcactgacaacgttatcaacgattgagcgggcttcaggggtgcctagtttttctttggtctgaccttcaaactgaagaatctcttctggaattcgtaacgataatacgacggacagcccctcgcggacatcgctgccttcaaggttcttatccttttccttgagcatccccacttttcgggcatagtcattaaaggctttcgtccaagcgtttctcagacccgcctcgtgcgtgccgccgtccttggttcgaacgttgttgacaaatgacagcatagtttcagaataaccgtcgttatactgcgcagccacttcgacttccacgccgtcttttttgccgtcgaaatacatcacgtcgcccagggtatgcttatcttcattcaaatattgaacgaattccttaataccctcttcgtaatggaaaacgtcttcctgctcctgatcggttcgttcgtcagtcagggtaattttggttcctttaagtagaaaggcggattcccgtaatcgctcggaaagaactgagaaattgtaaaccgtgctggtgaaaatagttggatccggtttaaaggttaccgttgtcccactatgagcgcgggttttgcctaattttttcagtgtgcccaccggatggccgccgtttttgaaatcttcttcgtaacggtaaccgtcacggacaatcacaactttcagccaagtagaaagtgcgttgacaacgctggcgccgacgccgtgcagtccaccggatgttttgtagccgccctgaccgaatttaccgccggcatgaagcatcgttaaaatcacttcaggagttggtttccctgaagcgtgcataccagttggcatcccccggccgtgatcgaccaccgtgatactgttgtccttatgaattgagacgtcaatttcgtccccataaccggccaaaacttcgtccacggcattatcaacaatttcgtagaccaaatgatgcaggccacgtgaatcagtggaaccgatgtacattccaggacgctttctaaccgcgtcgagtccctcaagaatttgaatcgaggaatcatcatatttttgcttttgctttaccattcgttatgactcctttttttgcaatctacttcataataacctaaatttacgccgatggaaacgaaattttattggctgaacccaaattacatgctaaaatgagaaacgctattaagtttattaattgcgactattgtgaggtttaagatgaattctaatattgaacaaattataatgctgttagtgctagcttatttgctgggatcaattcccagcggtgtctggattggtaaaattttctttcacattgatattcgccgacacggctccggcaatatcgggaccaccaatacctaccgggttttagggccgattgccggctcaattgtcatggcgctggatatttctaaaggagcggtggcgacattactgccgacattttttcatatcaccgcgatcagtccgttgatctttggactcatggcgattttggggcacaccttttcaatctttgataaattcaaaggcggcaaggcggtggcaaccagtgcagggatgctgctggcatacaagccggctttcttctttttggcagccgggatttggattctggtgattttgttaaccagcatggtcagtcttgccagcatgatcggttttaccttaacgaccatcgcaattttctttacccacgacattttattgagtgtcatggcggtgatcctgacctttttcattttttaccggcatcgggccaatatcaaccgaattaaaaacggcaccgaaagtatggtgccatttggccttggcaatcggctgcgaaaacgtaaagatccgaatgaataacccaatcaaaaacgagtgatttctgaaataaggaatcactcgtttttagtttgaattttaatcggccgggcaattgatgcgacagctactatcagttagaagaaactaattgaatatcgaccggcaaaggcgtggcggccagccaactgattaatcgcaaatttatcttccagcttgccgtcggcattgactgtatcagccagtccccaccacggttcaatgcaggcaaacggggcttttttcgggtacggtgaccagataccgacatatggtgcattctcaaccgtgagtgaaacaccatgatcattttgggcattggccagcatcacagtcgtttcctggcgatcaaggctcaaaacgatggcatcgctgttaaacagctcgtggttcaacggcagcggcttggtcaggtcaattgcctggggatcgtttggatcgctatacggcggttttaatgggatttgaacgtatgacttctttggtgctacccgaataaaggaatcctcgaagttaccttctcctttgaccaaaggaatgttaaagccgggatgagctccaattgaaaacaacagtgtgtcttgacttggattgatgacgtttagactcacattcaattgatgatcaaccagttcgtaaatgattcgcagttcgaatttaaacggatatttggccaacgtttcctcagtgggccgtaaaaccagtgagactttggttggtaattgggattcaacttcaaactgattgtcgcgggcaaacccgtgttgggtcatttcataagtctggccagcataggtgtattggttgtccttaagtcgaccgacaattggaaacagaattggcgcatgccgcttccaaaatgctggatccgcctgccaaatatattctaatccgtcagtatctttcacggaggtgagttcggcaccctgctcgttgatgagcacggtcaaatactgatttttcaaggtaatcatttaatctcttcctcccaattttacagaatgtaacgtgaaagatctttattttgagccagtttgccaactttatcatcgacgtatttttcagtgatcgtaatatcgcccatctgcatatccggtccttcgtaaaggatatcttcaagcaatttctcaagaatcgtgtgcagacgacgggcaccgatattatcagtattgtggttgacatcagtggcgatttcggcaatccgattaatcgcctcgatggtgaaagttactttgatattatccgtcccgatcaaagcaatgtattgcttggtcagtgagttggttggttccgtcaaaatgcggacaaagtcttctttggttaaatcatttaactcaactctgattgggaaacgtccttggagttcgggaattaaatcagaaggcttgttttcggcaaaggcacccgaaccaatgaacagcatgtgatcggtattgacggtcccgtatttggtattcacctgagagccttcaacgattggtaaaatgtcgcgttgaaccccttcacgggaaacttcgccactattttgagactttcccggggcaattttatcaatttcatcaataaagatgatcccggtattttcggcgcgaacgatcgcattatggtaaagatcggccttgttgatcagttcttcagaagcctggcgggttagaatttctcgcgcttcacttacaggaacggtgcgtttgattttctttttgggcatcagtccggccaaggtatcattcaaatcgatccccatttggttcatcatcgtgctttgaccagcgggttgttgggatggatcatccatttcaatttcaacctggtcgttctccagcaagccagccttgagcttttctgcgatcgacatccgtttttcacggatatcatccgtaacttcttcttgatcgtcctgattttcagacggcatctggccattttgcatctgagtaaacatattcatcaggttctgcatctcattttggcggttctcttttttctttgccggtgccaaaagtttaaccaagcgattgttggcctgcttttctgcttcgacgtggacctgtttgtactgatcagcccgttccaattggatggcattttcgaccaggtcacgaaccattgattcaacatcgccacccacgtaaccgacttcggtaaatttggtagcctcaactttcacaaacggtgcgttgacgattttggccaaacggcgagcaatttcagttttcccaactccggtcggtccgatcatcaaaaggttttttggtgaaatttcatcctgcatgtcttttgacagctgcattctgcggtatcggttccgcaaggccacagcaaccgcttttttggcctcgttttggccaacaatatattggtcaagcacggaaacaatttcttttggtgtttgagtagactcagtcaatttaagttcctcctataattcttcagaaatcacgttttggttcgtgaaaatatcaatgttgccggcaatgtgaatggcggcttcggcaatttctctggcgctcatgtcctgagcgtgatgtttcatggcagttgccgcagctaaggcaaagttaccgccggaaccaatcgctaaaatatcatcgtctggttcgatcacttcaccttggccggatactagcaataaatctttatcgttcatcacgattagcaaagcttcgagcttttgtaactgttggtcgccacgccactcctgggccaattcaacggcggaacgtttcaggtcaccgtcaaactggtttaatttcttctcaaatcgttcttcgaggttaaaggcgtcagcgacacttccggcaaagccgacaacgacttggttgtcataaatccgacgaaccttgtgggcggttcccttcataatgactttttcacccatggtaacctgaccgtctccagccattgcgagatggccattgtggcgaacagcgacgatagtagttgcttcaaatttgattggcataatatacccctttattagtttgattttaatgaatcattatttcgaggaaaatactttttataatcattcattaaatgtgatttggtaacgtgtgtgtagatttgagttgtcgacaggctgctgtgtcccagcaactcttgaactgaccgcatatcggcaccattattgagcatctctgtcgcaaacgtgtgtcgcagcatgtggggatgaatcttcgtcgtcagactactttgtttgacgatttgatccatcagatattcgataccccgacttgtcagcggtcggccgtaatgattcacaaataaaaatggatggtcttgatggtacttggccatgattgggcttctggcgtcgctgagataagtttcaatcgcctcttgagcatattccccaaagggcacgtatctttgcttgttgcccttcccagtgactaagatggttcggttgtccaaatcgatgtcattgagctgaattccggcgcactcgctgacccgaatcccagtcgcatataaggtttccagaacagccgtatcgcgcaatcccagttggtgattgggattttgtccggctccctgaaaaagcgcccgcatctcattttgatacaaaaatctgggcaaacgccgatgattggtcttcaagtggacatattcgaatggattgttggcgatcacagtattcttcaccaggaaagcatagaacgacttcaatgccgataccttttgggcgatggaatttctggcatattttcgctcataaagatcgctcaaaaatgcttcaacatcaaacgagtccacctgggtcaatggtttgcgttcactgggaatttcggccagaaagcgggtgaattcggcaatggcctgctgataagcctggatggtatcagtagaatagtgacggtcactttgtaaatacttcagaaaccattgaatatttttttgatcttcatctgattcagccataactatcaccttcaacgatgtaatcgtgttcatgtcctaatatctatgatagcaaataaacgccgtttgtgcccgatttgctatgaaattaaccaaaactaaatccgatcataatcatcgaataagcgtcattttaccgacctgattagcagtcatcaatggattgtgctagtcttaaccagaacttaagcattgaggtaggctgaatcctgaaaatgagaatacaaaaaaactgaatcgaataattcgatccagtctaattgattcattatccacgtgaacgaagggaagctcgaatacgagcagccttaccttgtaagtcacgcaggtagtaaagcttggcacgacgaacgtgaccttgtcttactacttcgattttatcaactcgtggtgaatgaagtgggaaaattcgttcaaccccaacaccgttacttactttacgaacggtataagtggcttgaatgcctgaacccttgcgtttgataacaacaccttcgaacaactgaatacgttctctggtaccttcaacaaccttaacgtaaactcttacagaatctccggcacggaaatcaggaatgtcattacgtagttgcttcgcgttgatcttgtcaatcaattgattttgtcgcataaacaaatcttcctttcactaacattcattatcttgtctgacagcggaatgttgttttgcggcttgcgccaaaaattagtgtaacacaattattcatcgtctgtaaaggtgtttttcttgtcagtatcttttgcggcttgcttttcttcttcctcaatccgaacgtcagccaacaatttcttttgggtgctggttaaattgtgatggtcgatcagatcgggtcgccggaggtaagttcgtctcaatgcctctttttgattccataaggcaatttttttgtggtcgccgttcatgagaacttcagggaccttcatcccccggaactctgccggccgggtatactggggttcttccaagagacccgttgaaaaggattcctcaacactggattgatgattgcccaaaacgccgggaattaaccgggtaatggcatcgatcatgaccatcgaaggcaattccccgccagtcagaacaaagtcccccaatgaatactcatcggtcacgatggaacgaatgcgttcatcatacccttcataatgaccacagataaaggttaaatggtcatcatgtgacaactcttcagcatcatgctgtttgaatggctttccggccggatccatgagaatcactttgcccttaggatagccggcagcttcagcagtttgtttggtgtggtcgtacgcatccaaaatgggttgcgcctgcagcagcatgcccgcaccaccgccaaagggataatcatccacgtgacggtgcttgtcggtggtaaattcacgaaaattggtgacatctaaatcaataatgtggttctcaattgcttttccaataattgaatcgtgcatcgggaccgcaaacatttctggaaataaactcagtacgtcgattctcattcgtccaagccctccggaacatctgcggttatcttaccggcatcaaggtcaacattcgtaatgacagaatcgatctttggcagcagtaaatctttgtgctgatcgcgttcaaccacccaaacatcattggcgcccggtgagaggatctccttcacttggccaattgggttaccatttggatcaacaacgtctaggccgatgatttggtggtagtaatactcaccaggcttaagatcatcacttgagaggcttccctcatcaattttaagttctgatggctttaagtactcgacgtcattgatcgagggatgattcttaaagtgcaataggataaatcctttgtgtttgcggacaccgtcaattgtcagcgccacttgttcgtgcttgttaggcaatttagcaaaaaccgtgttgccgactttgaaccgtttttccggaaaatcagtaatcgaaatcactctgacttcgcctttcaagccttgggtattgacaattttgccaatattataataattcattcactcactcctccagctctaatgaatctcattttgaataaagaaaaaagggcctaaacaaaaccttcgtttcgcttaagaaccctattgtttcccatcgtcgacaatcagacgagctttcttttgaccctcaaccggaacactgtaaacaatggtccggatagtctgaatcacatggccatgctttccaatgattctgccaatatcttcttcgttcaacttcagatgatattccataaatcgatcggattcattatgcgaaatctcgatatccttaggatagtctaccaacggtgagataatcttattaattaaaccatcaatacttgtcatgatgataatcactcacttacttttttgagtatttagcttcgtgatatttcttcataataccggcatctgataagatgttacgaacagtatcagatggttgggcaccattgttcagccagttcatgattgactcttcttcaagagtaatcttggcaggctgagttaatggactgtaagtaccaacgttttcgatgaaacgaccatcacgaggactacgtgaatcggcaacaacgatacggtaatatgggcgcttctttgaacccatgcgctttaaacgaatcttaactgacatgcttttacctcctgtaatgttttaacgattaataatataccagtaattcgaatgcttgtaaaggtttttttctttacaccatcaaaagaactgatggattgacttgttttggccaaactgaccaaattaatggcgtgtcaatgctgataacttgtcagaattaacggcgcttcttgttctttttcttcaaacggcgtttcttattctttttcattttacggctgaactgtttcattgccagtttggacattttaccgcccatgccagtactgttcatcatattttccatgccagacatgttgcctttggaaaccttgttcatcatggttttcatttggccgaattgtttaatcattcgattgacttcttggattggtctaccggagccgcgggcaattcgccggcgtcttgatgggtttaatacatcagggtcagtccgttcctgatcggtcattgaatagacaatcgccttcaagtggtccatgtctttagggtccatgttggcgttttttaattggggattatttgccatccccggaatcattttcatgatttcatccaagggtcccatcttttgaatttgatttaactggtcaacaaaatcgttgaaatcaaaggtattctcttggattttctcggataattcctgagcctgtttttcatcatactctttttgggtcttctcaatgagtgaaagcatatcacccattccaagaattcgcgaagccattcgatcaggatagaagacgtccaaatcagacattttctcaccctgaccaacgaatttgattggcttttgagtgacggcacgaattgaaagtgcggcaccaccacgggtgtcaccatccaacttggttaagacaactccggttacgtccaaggtcttattaaatccttcggcggtcgccacggcgttttgaccagtcatggcatcaatgaccaacagaatttcgttgggttcaacggcatccttgatatgacttaattcgtccatcaacttttcgtcgatttgcagacgaccggccgtatcaatgatcacgtagtcattatggtcttgcttggcctgttcgacaccccgtttggcgatttcgaccgggtcaacatccgttcccagtgaaaacacggggacgtcgatttgctgaccaacagtctgcagctgatcaatggcagccggccggtagatatcatcggcaattaataacggtcgggcgttctgctcattctttaattttaaagccaacttcccggcagttgtggttttaccggcaccttggagaccagacatcatgataatggtggggattttttctgctttattcaggggaacggcttcttcccccatcgttttagttaactcttcgtcaacaattttgacaatttgttgagagggatttaacccttccaacaccttggcaccgttggcacgctcctcaacggttttgacaaagtcacggacgacttggaaattaacatcggcttccagtaaagccagtctgatttcccgcatggttgcccgcagatcggactgggaaacttttcccttgccacgtaaagttttcatggcgttttgtaaacgctcggttaatccttcaaaagccaattaattcaccccttattgttcttcggttgtttccaaatttttgatcattgaattcagtttgtcatcgtgtggatattttttttgaatataagcttgaatgtggtctagtttgtcgttccggtcaacaaagctgtgatacaaattcagcttgtcttcatattgctgaagaatcttctcggaacggcgaatattatcataaacggcctgccgactgacgttatattcaccggcaatttcccccagcgagtagtcgtcagcataatacagttcaatatagttggcctgctttttggtgagcagtggctcgtaaaattcaaacaaagaattgatgtagttatttttttccagttccatattgaaactcctttgacggccaatatgtcatctagcgtacagatttatataacgtcagtcaacgttaaaatacctgactattcggaaataaggcctttgaataagccgtaaacaaagtcgtttggatcaaacggcttcaaatcgccgacctgctcacctaaaccaacatacttgaccggcaggtgtaattcactgcgaatggcgaggacaatcccgccacgagctgtgccgtcaagcttggtcaaaacaattccggaaacatcagtggtttccttaaacattttggcttgggtcatcgcattttggccagtggtggcgtcaagtaccagcaagacttcgtgtggggcttcgggaatctcacgagtcagaattttcttcattttacttaattcgttcatgaggttgaccttattctgcagccggccggcagtatcaaccattaagatgtcatagtcttcttttctggctttaacaaccgcatcgtagaccacagatgccggatcacttttcgctttgcctttgacgatatccacaccatctcgttctgcccaaacattgagttgttcaattgcgccggctctaaaagtatcggccgcggctaaaacgacctttttgccttggtctttatacatcttagccattttaccaatcgtggttgtcttaccaaccccgttgacaccgacaaacatgataactgtcggaccggattttgccatgttaatggccgaattttcaccattgccggcttgatcgtacatgtcaatcaattttttaacgattacgttttgaacatctttgggcttcttggcattttgcagcttgacttcatcgcgcaactcatcggcaattcgcatcgaggtttcaaaaccgacgtcggattcaatcagcatgtcttccaagtcgtcaaaaaatgattcatcaacgtgacggaagtttgctaaaagggcattcagtttttgaccaaacgaggaccgcgacttttccaatcctttttcgtattgctgagtatttgaatctgtggctgattctgccggttctggactttcaacccatttttcaggctcagctggcatatccgactcttctgtcgaagattcctgctcagccgatgaatttggttcactaacagttggtgttggtttttgagcatcgtccggctgctttgtggtttgttggccatttgattcttcaggctgttctgtcggttgtttttcggtcttttcagctggttcatcagccggactcttagtggctttggcggactcttcaacatctgtggttgtttgatttgaagtggcggcgctttggtcgtctttggcaggtgcttctggtttgggttcggtttgttcagttgattcagtcggctttttttcgtcgtcttttttggaacgacgtttaaatatatcaaaaagtcccaatcaactcacctccgtttttaaattatctaaattaacagtaacaacttttgaaacgcctgattcctgcatcgttactccatacagttgatcggcgtaaatcatggtttcttttcggtgagtgatgaccacaaactgggtctcatcaccgaaacgctttaagtattttgcgaagcggtctgcgttaaacggatcaagggcggcttcggcctcatccaagatacaaaatggcaccggtcgaaccttaatgatcgcaaacagcaatgtgatcgctgttaaggctttctcgccaccggacaagagatttaagttgcgatagttctttccaggcggcttaaccataatctcaattccagtatccaacatatcattgggatcggtcaagaccagtttggcttcaccgccgccaaacatgtcaacgaagactttcgaaaacgcttggctgacttgtttgaacgccatggcgaacttagtcgtgatggtgtcatccatgtcgcgcatggtggcagttaaatgatccttagcatccaagaggtcttgtttttgactggtcaaaaattcgaagcgcttggaaacttccttgaattcctggatggcgccgatattcacaggcccaatttcgtcaatcccggttcgaagcattttaatttggctggcaacctgcttttcatcccaattccagtcgggattcgctaaatcatgttgatcgatctgataagtcgtttccagagtcgcaaagttggtatccagatcctggtggtttttagcagcagctgtctgggcactggtaagttcatatttggcgttattcaagttaatctgctcatcttgaatcttttgatttaactgatccaaatgatcctgtgcttcaccaacggtggctttcaacttgttttgcgtcaggttaagtgcgtgttggttggcttcggcggtcttaatttgctcattcaacgtcccggcgtcgacttgacgactgagttcagcctttaagtggtctcgctgttggatcaggcggtcccgattctgccgatgagtcgcaatctgctttttgattcctgtttgatcaacttcaagctgattcaacttttgctgctcaacgacaatcgcctctcggacttgttgcttttccgtggtaaatttttgagccgattgtttaacgtttgccagttgaacccgtttgttgtccaagtcatcattgactgcccgcaattgtttgtcgatggcatcctgacggttgaccaactggtcggtgtcagttgttccatcagactgggcagcgttcttcaaagcgagctggagggtcttaaattcacgctgcttttcctgaacagcctcttcaagtgaatggcattgatcctccaaggttgcggtctgttggcgaatttcgaacgcttttcgttgaccacgctcatgtgacgcattgattttagccagctcatccttggcatgctgaagctgacgttcattttccgtcagcttttggtccatctgagcggtcgattgattgagagcggccaactcggatttttgaaccaacaccccttggttatcatgacgactggcaccaccggttagagagccgccggcattgacgacttggccatccaaagtgacaatgcgcgtgcgctggttaatttgcttggaaatgttaattgcgtggtcaagcgtgtcggcgataatcgtggtccccaaaaggaagcctttaatctggttgagattatccggcatggataccaaatcggctgctacaccaatgaatccaagaacttcttgtgactcatgaacgatcgtcgaacttagccggcgacttttaatggttgaaattggtaacagcgttacccgccccaaacgctctttggtcagcaaacgaatggcggaggaagctgcccgattatcttcgacaatgacatgttgggcttgagatcctaatgcggtctcgatcgctttcacatatcgttgatcaatcgttaaatagtcactgactggccccaaaatcccggttaattggtttttccgtttgagaagattcgccacgccccggtaaaagccacgataagaatcatgaagatttttcaaagactcagcttttgctttggcctgctcggcaattttgagtgctgccagccaattggcctgggaactgtcgacagcctgctggtgagtattcattagttgagttaaatcgcccagctgcttggaaacatccgtcaattcagcttggctggaagccagagcagcttgtttgttagctaattctgcctgggtttgaccaaggtcctcacgcactttattaatccgctgtcgctgtgaccccagttgctgctcaagttgggcttcatcatgagttttcatggtaatttgatttttaatgtcggttttttgctgcagtaagtcgacatattggttacgcaattggtcgatttcagattcaattaccgaaacgctattcgctttttgggcttctgccagtttgtcgaagtcggcttgtttggcagcaattttttccgatagccgtttgccggcatccaccgattgggtgagtttgacctgaaaatcgtcaatttgcttgtcagtcagtttgatttgttccgaaatccggtttaaatcggcgtccttaaaagacttctcttgagcggacaactgatgcttgctcttcagcgactgaatttgttcagttgctgtcagaatttgctcgttgatttggtcgattttggcccggttttgagttaaattggctttcagtttgtcgcggtcattttcatcccggcgaacttgagcgtaaattttattaaccaagtcagacttttcactaacggtgtgtttgagctgctggctggctgcgatcaatttctgagttgccaaaattaactgctgcttttcaaactgatctaaacgctttttttgatccagataatccgttgccagactactttgctcttcaagcggtgccattcggctttgaagttcagaaatgatgtcttccactcgattgagattatcggaagtctcatcgatttctttttgggcagtattcttgtgctgcttgtatttgtagacgccggcgacattttcaataattgatcgtcgctcctcaggtttactgttgaagatttgttccacattaccctgagaaatgatcgacaaggacccttgaccgatgccggtatccatgaacaaatcggtaatgtccttaagacgacactgtttttcgtttaaataataggaactatcgccgttccgaaagagtttgcgggaaagcttgagctcatcgaagggggacttaatgaaatggtcggagttgtccaaggttaaagttaccgaggccatgcctaaagaccgtcgatcggcggagcctgaaaaaataacatcaggcatccgcgacccacggagatttttggcagattgttcccccatcacccaacggattgattcggcaatattactcttaccgcttccattgggaccaacaattccagtcattccacccggaaatttgatgagagttttgtctgcaaatgatttaaaaccgataatttcaatggatttaagttgcacactcattctccagtctaaactagattgtcgccctcggtatcaaactgttccagggcttgttgggcggccttttgctcggcgcctttcttggaatggccaattccaacaccataaagtttgccgtcaattgagacgttgaccttaaacgaacggtcgttgtcgggtccgtactcgtccactaattcataatcgatggccaccggaccgtccgcttgggcgagttcctgtaactcagtcttatgatcaaagaattccgcaaacatgccttcatcaagctttggaaaaatcactttggtcacaaatcgtgtcacttcggcctgcccttggtccaaataaaggcagccgacgaatgattcaaaaatatcacataacagcgagtcccgatcacgagcccccgccttttcttcgcccttaccgagacggatatactgattaaaatgacattctctggcaaaggtgctgaaactttgctcattaaccattgctgctcgaagtcgcgtgagccgtccttgaggcatctttggataacgtttgaaaatgtagtcggagacgatcagctgtaaaacagcatcccccaaaaattccagacgctcataaaattttaagccttcaccgcgatgctcattgacgtaagaagcctgtgtgaatgcttcatcaagcaaatcctgatcatcgatatggatgccaaaatcttgctttagcatctcatttaaaccctttatcaatcttttacctccacataaaatccagataacagtaaaaaattgaaattatatcaaacttgagataattccaatttaagattacttttattatttttgatgagccatgacaaaatcaacggcctcgttaatggtattcagcttttcagcatcctcatcggaaatttctgcgttaaaagtatcttccatatccaatacgaattcaacaaaatcaattgaatcagcatcaagatcgtttttaaaatttaagtcaccggtaattttacttcggtcgacatcaaactggtcagccaccaaatcggcaattttgttaaacacttcatctttgtccattttgataaacacctatttcataaaattaatttgctaatgattattatatcaactatttactgcttttgatactatcttttatctgctgcagttcatcattatggtcgacgacgtattgattcagatcaggaatcatatttgaggcaataatctggcggatttggccgatcgtattcttcaccgtgtctgctttgctgctgccatgtgtcttgacgaccggtgccttaacgcccagtaaaactgcgccgccatattgtgaatagtccattgaaccgccaattttgtggaaggcgtcttttaacatcaaagccccaaactttgctttagtgccgctatccatgatggtcgtcttaattaagctgagcatcgacaaagcagttccctcaatactctttaatacggcgtttccggtaaagccgtcggtcacaaccacgtcggcggccccgttgagtaattcacgggattcaacgttgccgacaaaattaatatctttgtccgctgccaacagatcatgcactttccggtgattcatatcacctttatccgcttcggtcccattgttcaagagaccgattcgtggattttcgacttggttgacgttttgggcgtaatattttcccatcaaggcatactggtaaatatttaaaaccttggtgtctgcattggcccccacgtcaatcatcacaaatttatcttgattcttaacgccgatgaccggcaaagtggtggtcaatccgggacgatcgattcctttgatgcggccaacgataaacaaaccggcggctaaaatagcaccagtgttccctgccgagaagaacgcatccgcagttccttctttaacagcggttgctgccagaacgatgctggattgttttttggtacgaacggctttaaccggttcatcacccatttcgatgacttcatcggcttggacaatctgaattcgatcatcatttttaagatattttttaatttggtcggtttgaccaaatagttggaattcaacatcggcataagcatcccgtgccaattcaattccttcaacaacttctttaggggcgtaatcgccgcccatggcgtcaactgcaattttcatatttaactcctatttaatccgtagtaatagtttcgttatattttagatactgtgataattgtacattttctggctgcttttgccagtcttgatgaaccgtaatactctgggcctcctgattggcaacttgtaaaatgttcaaatcaccaaccggatcggccactttaaaatcaggcatccctgattgtttactgccggtgatgtcaccttggccacgcaattccaaatccttttgggagaggaaaaagccgtcggtgctgctggcaaccgccgtcatccgctttttacccaactcgttttttgggtcggcaatcaaaatgcagtaggactgcgtgtcgccacggccaacgcgaccgcgaagttggtggagttgtgccaaaccgaagtgatcggcatcaaatatcagcatggtattggcattcgtcacgtcaacgccaacttcaatcaccgttgtcgccaccagaacttggaattgattgttcttaaaatcggccatggccgtatccttttcttcatccgacattcgcccatgtaggagaccaactgaatactgcggttcaaaaatcgctttgaaacggtcgaaaatcgccatggcgttcttcatatcgacagcttccgattcctcgatcaacggtgtgacgacgtacacttgatttccggcatccaattgtttcttaacaaatcgaatggcactatccgttttagcggaggtaatccaagttgtcttaattggcttgcggccctttggcaattcgtcgatcacagagacgtccatatcaccgtacatcgtaatcgccagtgtccgcggaatcggcgtggcagtcattgccagcatgttggtactatttcccttcagtcgtaaggcctggcgctggttgaccccgaagcgatgctgttcgtcaatgaccgccaagtcaagatcgtgatagtcgacttgatcctggaataaggcgtgggtgccgacaatcagattgacttcaccgtcagcgatccgcggcagcatcgccttacgagctaggccagtggtcgccccggtcaacagggcgatgttgacatcaaatttttcaaacaacttggcaaacgtgttggcatgctgctcggctagaatttcagttggggccataattgcggcttgtttgccggcactaatcgctgccaaaattgcaattgcagcaaccacagttttgccactaccaacatccccttggagcaagcgattcatttccaatggtttgcccaagtcggacaagatttcattgacaactttgttttgggaatcggtcagtttgaattttagttgactggtgaactgcttaactagatctggatcataggcaactttggctgccggatccggttttctgtggcgctgttttaaaatttgaattttcatggcaaataagaaaaattccatgaacttggcagttcgaaaagctttttgggcagcgaccggtgatgttggaaaatggatattttgaatggtatcacggaaggattccaatcgatacttggtgcgaattgactctggaatgacgtcaactagctgatcctggtattcatcaaatccaagcttgatcaattgtttaatggtattttgtttgacttctttgttacttggatagattgaatcataggtgtcgcttttttcgccgtttaaaattttcatcccttgaatctggttacgattgcggtcaaaggtaccaaaaataatcacttgggcttccaactcaagctgctttttcagccacggctgattaaaaaaagtgacgttatagatttcatcattaatttttaaatgaaaaccaagccgacttttgcgccgaccaaaaaaacgaacagttggctcgctaatcacgatccctttgacggtgactttttggccatcgacggcagttcttaaatcttttagcgataaatcatcatatcggcggggataataagtcagtaagtcgttgatggtattgattccgagcttattaagagcagtcaggcgcttttcgccgactcctttgagaaccctaaccgaatcacttaagctggccaatgttatccctcctttgtcattgatataaataaaagcttggccagtgttgaccaaacttttaggaattgtttattcaaccgaaattaagaatgggtagactggttgatcaccttcgtgaatctcaacttccagttcgtcatccaatttcaaaatgccggcctggactttttcggcagccgcctgatcagcgccttcaccgtaaatgatcgtaatggcttcactatcgtcatccagcatcttcttaaccatctgaatggccgtgtcaatcagtttatcaccaacggtggcaatatcgccgtcaacgatgcccataaattgatcttttttaatatccaaatcatcaatcttagtctcacgaatggcggtcgtcacttggccggacttaaccgttggcaaattatcttccattgccttttggttatcttcgagcgaattttccggattaaagccaagcatggcggtaatcccttgtgagatcgtctttgaatgaacaatgaccgtcggaatatcaaccaccttggcagcttgttcagccgccaggaaaatgtttttgttattcggcaagacgattgcctgtttggcttttgtattttgaattgcgttgacaatgtcttcggtactaggattcatcgtctgtccgccgctgacaatgtagttgacgcccaaactttcaaacagttggttcagccccttgcctgaagaaacggaaataatggcagtatctgaagttggctgctgggtgctgatactttcagctttttgaattggtgaagcgtcctcttggctgtcctcatcttcttcaatgatggtttcttgttgaagtcgcatgttatcgactttaacagttgccaaatctccaaactcctgaccccaggcaagcactttgccgggatgttcagtgtgaacatggactttgacaatatcatcatcgttgatcaccagcaatgaatcgccaagcttggcgagataatcataaaaggtctgatagtcaaattgatgatcaacttcgcggcctttgccgattcggaccataatttgcgtacagtagccatacacgatatcttctggatttaatttactttgaacactttgatcggccactttaatcatctgattcatttccgcatcgttaggttgatattcaccggattcagcttcgtttctgccattcaagacatcatcgaaagcttccaaaacgaataccaatccttgtccacccgagtcgacaacaccaacctgcttcagcaccggcaataaatccggtgttttctccaaagcggattgtgaggcctggtagatggcatccatgacagcgacaacatcattggtcgtagcggctgctttcttaccagcagtagcggccattcgcacaacggtcaaaatggttccctcggttggcttcataacggacttataggcgatttccgtcccggcaacgaaggcatcagaaatatcttgggcactcaaagtttctttaccctccgtggacttcgaaaagccccggaaaatctgcgataaaataacccctgagttgcctcgggctcccattagaagtcccttagccaaagcagcggttaaatcgccaacgtttgtcttgacatctttattcacatatttataacccgaagccatggataggctcatattggttccggtatctccatccggaaccgggaatacgttcagtgaattgataaaatcagaatttttatttagtttagttgcggctgcttgaaccattgccgtaaattcggtgttggtaatttctgtaactttcaacaacttgtcctccttggtcacttgcataatcagtcattcattacctgaacgccttgaatgatgacattgaccgaatttgcagataccccaagcatactttgtaggttatacttaacctttgcttgaacgtttttagatacttctgaaattttgttgccataagcaacgataatataaacgttaacttcaatttcattatcgtgttgtttaaccacaacacccttgaaataattctcgcggtttaaaatcgtgttgacattgtctctgagctgattgcgacttgccatacccacgactccgtaattatcggtggcagccccaccaacaacatttgcgatgacgttgttgtcgatgtcaactgttccaaatctggttttgattttgacggccatgtgcagcagcctccttaattttctattaacctattaacgatagttaatattaccacaataacgctaaaaaccaaagtaatcttgatgcccccaagaagactgtcaagtataattacttgaaagaaaagtattgcaatatcaatgtatgtatgataaattattctagtgtaatgaaacagactttaacactaaaatcaaagagaagggagatttgttacccatggcaaaggattttattaacggtaagcgtacccactttggtaacaaacgttcacacgctttaaactcaagccgtcgcagctggaagccaaatttgcaaaaagttcgcattcttgttgatggcaagcctaagaaggtttggatttctgcccgaacacttaaatcaggtaaagtaacccgtgtatagtaataacttggatcgatgttaatcggtcttttttattaccttcaaaaatagaggcaactctcagcagccgttttcggtgagctgagggttgccccttttttagttataacgattaatatctttgctttgaataacacacatcaccccactgccaaatttaaacctggcagtttcaccaacaaattcattgctggcaagcgacattgggtgtttaacctgatagtcattcagctggtatttttcatcaaacaaagttaaatgatccatcggtgttaacgccacgaatgccaaatattttttatcaggttccttttcaatctgataagttcctggcaaaaagaaagtaatcgtattttgcttgtcaatcattcgaattttcggtgcgtagggcttgaaccggggttccaaaaccatccacagattggctagaaaatgatccagtcggccacccgtcgcaccgtagatatcaagtcgatcggcgtgatgttcctgcaaagcgaccttcaaccccaattgggtatcagtatcgtctttttcaggaattgactggcggatatccttaatgtggtcacgaactagttgaagttctgccggttttaaggaatcgaagtcaccaatcgcgacaagtgggtcgatcccccgctcgatcaaatggagattgcctctatcgatgccgatccaatcacctttaatctgtccatttttcaattcgtctggccagaggtcaatggggccgccaaccaatagatttaagatcttcatttatttggtcgcatcctttattgctttgattcggctaacaggatcatcggcgtcaaaaacgtatgatccggcaactgccaccgttgcaccggcttgataggcacccacaaccgtgtggtcattaacgccaccatcaatttcgatgtcaaagttcaagccttcagtttttttcaactcatcgagttctgcgatctttttaaccgtttcaggcaggaacttctgaccgccaaatccaggattaaccgtcattaccaagacctggtcaaccatgtatagtactggcttgatggctgataccggcgtacccgggttgatgacaacttcagccttgacccctttgttcttgatcatctgcaaagcccggtgaatatgaggggttgcctcaacgtgaactccgataatatcggcaccggcatcggcgaattggtcaatgaaacgttccggttgttcaaccatcatatggacatccaagatcatcttggtgatcggacgaatggctttgacccacccaggtccataggataaagctgggacaaactgaccgtccatgatgtcgatgtggaggacttccgccccaccctggtcgactttttcaatatctttttgtaaattgacataatccgcgctcaaaattgaaggtgcaactttaatcataactaacttcctcactttttataatttggtttccggtttttaatgtcggtgtacaactgcagataattctcataccgactctgcatgatgtcaccgctggccacttcttttttcacttcacagtccggctcattgacatgcacacatccccgaaagcggcacttcacagatgcccgcttgaactctgggaaataactggcaagctggcggtaatcgatctccaaggtatcatacgaggaaaatccgggagtgtctgcgatatacccatcgttgacccgcaataaagcaacttttcgggtggtgtgttttccacgatttaatgccgcagaaatctcaccggtagcgagctgcaaatccggtgccaagtgattgagaagtgtcgatttgccggcacccgtctgtcccattatcacattttcttttcctgaaaacaattgccgtaaatggttcaacgaattttcatcaaacgcggcttccggcagaataacgtcataaggaatgttagcgtaggcaactgctaaatctttaaaataattcagttgtttttcagataacagatccgtcttggtgaaataaatgatcggcttgatattggcaatttccaatgcaatcaactgacggtccaataagttactggaaaactccggctgagtggttgccgtcgccacaatcgcctgatcaatattggcaatcggtggccgaaccagagaattctttcgtggcagcatcttcaatatgtatcctttgtcgccatcttcaacttggaactcaacgtcatcgccgaccaacggtgtaatttgacgctttcgaaaattccccctggcgcgtgttcgataaaccttgccttctgagtgaacatcataaaagccactcaaagactgaaaaatctttccttgtttcaattgatcacctcgataaaaaatcacttcccttacattataagagaagtgactttgttttgcagtaattattaatgtgaatcgtaggtcacgttgttatcacgcatgatcgtccgaccatcgcggaccactttgtattgaccgacttcattgccggataatttaaatggcaaggtgacttgcgtatcctttgtgatcaccatctgcttgtaaaccgtcgacaaactatgatcatggtctttgagataaatcaagaccacgttctcgttggaaccactggaactatctgtggaagcagcatcactggagatgccactttcattcaatgtggagtcagatgatgccgccgaactgttgtcgaggtacgggatggtaattttgacattgaagctcttcaattcatccgaactgtctttcttaggcccacgagaaatccaaaccgcgacgttactgccctgttgaattgattcgttggcatttggtgattggcggacaactcggcccttgggctggtcgtcagaataaacataatcaaaagttgggttaatttccaccttgttagaatatgagaccacttgagccttggtcatgccggttaagtctttcagcgtaatccgtttaacaccggttgaaaccacaaaggtcagtgtcttggtagccggattgaaccgtttgccggactcaaagtcctgttggagaattctgcctgagccaaatgaacttgaaggagcgttacgccgatgaaccgtaaacccttcgtcttccaatttctgtttgacaacgtcatattcttgaccgacatagttgccgacccgaacgcgacggggcccggaactcacgaccaaattgaccttggtgccctttttgactttggtttcttccttgggactggaactgatgacgcgatgacgatcaattttatcactactttgatatttgacactgccaacggtcaaattagccgctttaatcttggcttccgcctcggtttccaacgtcccggagacaattggcaccgtggttttcccgttggctgaaacaatcatgatgaaggccagaattattaacagcaggccgacaatcccaccgataatccaccaccttcgtcgccgctttttcttcggcggctttggtttgtcgttcgaggtaccggcaggcttttcctcacgtttggccggattggcatccgctgaggcagtcgtatcatccaatggtgaaaatggcatcacccgggttgcttcatcaaccgggttttgtggtggctgaaccgtaaatttaggttcattagcccgtgacttgtccaatgacgtattcaaatcagcagccatttcattaactgtttgataacgatcatcgggattcttagcggtagctttcaagacaacattttccattgcctggggaatgcgcggatcaaaatccctgactgaaggcattggtgtttgtgaatgtttaatggcaattgaaacggcggtatcaccgttaaatggcactttgccggtcaaaatttcatagagaataatccctaatgagtaaatatccgatcgggcagtcgccatctgacccttaatttgttcaggggacaaatagtgaatcgagccaataatcgaacgggtctgagtcatcgtatcttctgtgccggcccgggaaattccaaagtcggtaatcttaatataaccgttcttatcgaccaaaatgttttgaggctttaaatcacggtgaataatattatgccggtgggcttcactgacagctgagcaaatttgctccataatattgacaacttcggcataaggaatgggaaagttatccttgatgtatttctttaaatcttcaccgtcaacaaattccatgactaaatactgcatcccctcaacctcgtcaacatcataaatgccaacaatgtgaggattatccagttgggtcgccgccattgcttcatgctgaaagcgcttcttggctttggggttgtctcggaaatcaagtcgcaacagtttaacggcaacttttcgcttcaagatgaggtcttcggccaggtatacgtcagccattccaccctcgcccaagcgaccgataatttcataacgaccgtttaatacatagcccttattcatcggcggtcacctccgaatcgtattgggcgatcaagacagtaatgttgtccaagccgccgttttgattggccaaggacaccaacatgtcacacttagtctgtaattcttcatccattgacaaaattttttcgatgtcggcatcgtcgaccatattggtcaaaccgtcggtacagagtaaaatttgatctccaggttgggcggtatacggtttgaagtcggcggccgaatcgttgttgattcccagactcttggtaataatatttttgtatgggttggttttggcctggtctggagtgatatcaccgtgtttgaccaattcattcacataggaatggtcttccgtgatctgagtgaattgcccgttggaatagacataaccccgactatcaccaatgttggcgatcagactctgtttgccatcaataagtgtcgccacgatggtcgtccccataccatggagtcgtgtgtccgtgttggattcatcgataatcgcggtattttcttttgccaactggttttcaaaccaagtttcaattttatccagactagaaatactggtcgtttcaaaagcggctcccatgtgggtgacaaccatttgagaagcgacttcgccagcattgttgccgccgattccgtcggtaattaatgccaaaatgagcccggtttgatttttaaacgcgccgaccgcatcttcatttttgtcgcgaacttttccagttgaggattgatatgcaatttgcaaattgatcaactccgttatgatttccgaatgagggagcaaacaaagaagccgtctgaatcatagtcatcggggtagatttgaaccatcttgctatccggattcaaatgattggcagtctttgtcttcgtgatgtcaaaattagggttctcgctgataaacttggcgatcacgtcttgattttcctgtttaacaatcgtacaggtactatatgtaatagtaccaccagttttaactttagcggaaaccgcgttcaaaatttgtaactgaatctcacttagacgattgatatcagcaattgttttgtcataacgaatctccggctttcttctgaggagtcccaagccagaacacggcgcatcaactaaaattgaatcaaacaagccgtcttcaaatttggtatcgactttgcgggcatccaattcaaaagtttcgacttgcttgtagactcccaggcgagtggcatttcgctggacggttttcagtttgtttttatgaatatccagtgcaaagactttgccggctttcaaacggctggcaatttgggtagttttgccgcccggggcactgcaggcatccaaaacgttgtcatcaggggaaatctgcattgattcaactggcagcatggcactttcatcctgaatggttaacaggccgtcagtgaaaaagtcactgtgaatgatttgaccatcgttaataataatcccttcactggaaacttggctgggttcggcatcatagccgtccttggccaaatctgccagcaaatctttttgagagattttggctaagttggcacgaaccgattgctttggcgctttattcagggatgctaagattgaagccgtttttggcttgccaagttgttcgtcaagcatttctaccaaccaggttggcacactatattcaatcgatagtcgggtcttttcatcctgaatgtcatccaagtttggcatcccctgccgatccatctgatgcaaaataccggtcacaaatcggcgggtaccgtcatgtcccatctgcttggcaattttaattgtttcatcaaagattgcccgcttgggaacccgatccagatactccaactggtacatcgcggtatagagcagctctttgacccaggtttcagtcttttccggttcacgcaaaaatggccggagttgatattccagcgttaatcgatgctgaatgaccccgtacacaatgttggtgaacagtcccttatcagctggacccattgaagtagattgaatcacggcattaatctgcagatttgaatatgaaccattactggtgcgaaccaacgtcatgactgcaagttggcgtggattatttgttgtatatttcatttatttaatcacctgttggccaactttaagtgactgaccaatcccatttaagtaatctgttatttgttgttttggcttgccggcgggctgaagctcctgaatggataaaacagtgccttttcctgctgacaataataattggtgcttggttttctcaaccactgatcctggcgccatttcagtggtttgatcgacaacttgtgccccccaaattttggttcgtttaccgttgataaccgtataagcgaccggatccggccgcagggcacgaactttggcgttaaccataaacgcggtttgattgaagtccagttgctcttcttccggtttgatgttgggcgaaaagacgacttgatcctcatcttgaggcactggggagatatcgccggcgatcacttttggcagagtggctaacagcaggtcgcggcccacgatgctgagtttgtcaaacatcgtttcggtatcatcatctggctgaattggaaccgctttttgtgccaaaatgtcgccggcatccatctttttaaccatgtagatgagactgatgccggtttctgaatcaccattcataatcgcgtactgaacaggcgcgccaccacgatacttaggcaaaagtgagccatgaacattgacggccgcaattttgacggcgtttaacatcttcgtcggtaaaaattgaccgtaggctgccgtgacaatcaagtctggatgaaagtcaatgacccgctgcatctccgggcttccactgagtttttcaggttgaaacactggcagatgattggcaacggcggcttgtttaaccgggctttgtgaaatccggtgtttccggccgactggtcgatccggttgggtgacaacacataaaatatcgtatttttgatcaagtaatccttgtagaattgggaccgcgaactgtggcgttcccatgaacacaactgtcgtcaaatttatcgtttcctttcgtgattcaaattacataaagtccagcggctcattatcaattgcaatttggaggccttgacgctgctttttttgtgactggactaaaatctcgtctaaagtggcctttaactgaggttcctttcgatacttgataatgatttggtaatagtaacggttgtcaattcgggtaatcgtttttggcgttgggccgagaatgattgcctgtggggatagctgtttttttaaaaagttcataatcccaaacatctctgaagccgtttgattctcactgggagaattgccggttaacttaaccgtatagtagtacggtggatatttgccatcgtgacggacacgcatttcggtggcgtaaaacttctcgtaatcctgcgttttggccaattgaatcgcataatgatcagggttaaaggtctggatgatgacctccccggttttgtcggctctccccgagcggcctgagacctgcgtaaggagttcaaaagtccgttcgcttgatcgaaaatctggaaactgcaacgctgaatctgcgtttaagacgccgaccaaagtgacctcaggaaaatccaatcctttggcaatcatttgcgttcccagcaaaatatccgccttgtgagcgccaaattgatcaataatcgcctcatgggacccctttttacgggtggtatcaacatccattcgcagaactctggcggttggaaacatgtctttgacctgttcttcaagctgctcactgcccatgccataaaagcgaatccgtttactgtggcattgtgggcagacagttggcaccggttctttgtggccgcaataatgacaattaagagtatgtgtatttttgtgcatcgtcagcgaaatatcgcagttggggcaccgaggaacgtacccgcagtcccgacacatcaaaaaggcagaataaccgcggcgattcagcaataaaatcacttgctcatgtttgtcgaggcgaacctggatcgcatcggccaattttgtcgatagtgcactgtggtgttttgccagttcagtcttcatatcaataatcgaaacatgcggtaaagcatgctgattgatgcgatgcggcagctttaacagtgtatagacacccttcattgcccgtgcacgggattccagcgatggagtggcacttcccagtaccacggggcaattattgtaggcagcccgccatttggcgacatctcgggtttggtagcgggggttgtcggcttgtttgtagctgctgtcatgctcctcgtccataatgattaagccaatattgctgagcggggcaaatacggctgagcgaaccccaacgaccactttggctttcccttggttaatccgctgccattcatcgtagcgttcgccggaagacatcgcactatgaagcatcgccacttgatcaccaaaccggctgcgaatgcggccaacaatttgaggggtcaaggtaatttcgggcaccagcatcaacgccgtccgccccagctccagcgcgtgggcaattgactgcaggtaaacttcggtttttccagaaccggtgacgccttccaataaaaagacctgatcttttttgtggacgaccgcctgttcaatcgaatcgactgctgcttgttgatcaggctgtaacttaaacggctgactgggggcgacatctctgagaaatgggttgcgaacatggcgcttcaatgttgaagtcacccaccccttcttttcggcagctttcaaagtggcgctggtcactccaagggacgcccatttggaaactagcagtgtatcgttttgatgggtcttgagcaggtttaacaattgaatttgtccacgagcatttttccgtacggttttgagggcgtcagcaatctgggcgtcatttaattggcctcgataagcttttcgcataattggccgggcgtggttggtgagatcatactcaacttgaatatcgccggctttctgcagatttaaaatctctgctaaaacctgattattatatttctggcggtcatattcgacttctggctgtccttggaagatttccggatactgctggcaaacttgttcatttttggcaattagtttcttttggttcttagtccgcattccacctgggagcatggtttgtaaacagctgattttaaaggaataggtttgatcagccagccactcagccaagttaagtaactcagaattaacgactgggtataaatcaatcaggtcggcaatcggtttgagcttgccgttgaagctggaactgtcggaaaggccaaccacaaacccagtaattttgcggttgccaaaagggacctggacgcgcatgccaggttgaatttgatccgctaaatgatctggaatcgaatagctgaacggactgttggtttggcgtgctgggacgtcaacaataacttgagcaacctgcaaggcagattctcctttcactgattttgcatttgtgtagcaataatattgattaactgatcggcaacctttgccttactctcgacattcgtcttaatttgcttgccggcagcaaataaaaatgtcacttggttgttatcggcgttaaagccaatcccgctttgggaaacatcgttagccacaatcatgtccaaattctttgattgaatttttttggtggcgttgctgattaaatcattggtttcggcagcgaagccgatcactaactggccagggtgtttgatagtggcaatttcttttaagatatcgggattcctaaccagttccaaggtcatggtttgattgtcagctgtttttttgatttttttattggctaccttggccggtcgataatcggcaacagcggcggccattaccaaaatatcagcgtgaacaaaggcttgtttgacctctgctaacaattcagccgccgtttcaactcgaatgaaattgacgccggatggcggggtaatcaacggattagccgcgatcaacgtgacattggcaccggcatttttgaaagcgttggccactgcgaaacccatttttccagatgaatggttggttaaatagcgaaccgggtcaagtggttcacgggtccctccggcagtgacgacgacagattttccggctaaggatccacccttcagctttaagctttcatcaacccacgttaaaatttcgccgggttccggcatccggccctttccagaatagccctcggcaaggaagccttcagccggctccatgatttgaataccggcttgttttaagttggcgatattttgttgggtggcaaaattggcgagcatatgagtattcatggcaggcacaacaaataccggcactgccatcgttaataatgtggaagtgacaatattatccgcaatgccattcgccaatttggcaatcgtattcgcggatgccggggcaacaattgccaaatcagcatcatcagcagtcttgacgtggggaatgattgtcggatctttactgtcaaaatcgctggtcaggaccgtattcttactgacagtttgaaatgccagtggtgtcacaaatttttgggctgcttcactcataatgacgtgaacatcgttgtggttcttcactaataggcgtaccagtgacagtgatttgtagacggcaatgctgcccgtcacaaatacggcaacgtttttgttttgaaacatttttccaccccgtttcagatttcattctttattgtaccaaatctaagacggataaaaacagtcggcgtcttaaaagttggctgcaccccagtggaaaaggcgattaactccaaaatgatccccccggattgctaacgccgagtttcggccgggatcacaagataagctgataacaggattggctggtatcagcttgtccaacaaagacaaagggactgccagcaaaacagtcgttttgccgcagtcccttaacgatcaatcttattcaaaatcttttgctttaggatcgattttcaatacaccagcagcaatttcttccaaagctttgccgactgatttttgtgatttgtagtgatccaataatggcttggcaccggcatccaattcatgggcccgcttactggaaagcgcaattaatgaataacgggaatcaattttatctaacaatttatcaacagatgggtaaagtaacataattatttatctcctaacattgactcataatcgggcatcacccgagcaacttttaatcgttcacttctaataattgacttgattcggtcaacagccaaaggaacctggtcgtttaagacggcgtaatcatagttacgcatcatgctgatttcgccgacggcctttttgatgcgcttattaatgacatccatcttgtcagttccacgaccaaccagacggtgttttaattccattagatctggcggagtcaaaaagacgaagaccgcatcaggaacattggcgcgaacctgcatggcaccattgacttcaatttccaagaaaacatccttgccggattccaaggtctcgttaacatattttaatggcgtcccatagtagttgtcaacatacttggcgtactcgagcatttcaccattctgaatattctcttcgaactgctctttggaaacaaaataataatcgacaccgttcttttcaccgggacgcggctttctggttgtcattgaagttgaatattcaaaatcaacatcaggctcctcaaacaacgccttacgcaccgttcccttaccaactccggacggtcctgataaaacaatcaacattcctcttttagccatcgaaaaaatcccttcaattatttgtaatacctgctattatcgccctttttgccccatttgacaagtcctagggcactgattaagaaatttgcatttgggggttgcgttttagaacgaacgttcgtataatgaaactacaaacaaatgttcggggtgaacaaaatgcaaaacaaacaatcatatctctcagaaattaccaagacctttcgaaccaactatgatcgcttcttcgaaattgtccgtaacactcaccaaatcaaacaaatgccgactttccagctgaattatttcattcaacagacactcgaaaacaacttccccatcacgatcgaatttaacgatcaggataatgaacagaccggctacttaaccaaactttccgcagaccgttacctattgacttcagatgataatcatttcactcgaattgtgaagttgtcagaaattaaagcgattcgtaaatactaagattatatcagattatattttagggcttgagacaaaacattcagttttgtctcaagcccttttgcatttttatgatttatctgggtaaacagtgcgtccaacagcagtttccaagtggatagcggaaactaatcatttatttttcgacagcacttaagatgctttaatcttttgtttttcctcatccgccaatttcaacagctcactggcatgttccttggttaacttggtaattgccgttccggaaagcattcgcgagatttcagcgacactttgggcggttgtcagttccgtaatcgtcgtggttgtccgattgtcagcaatctttttttcaataaagtcgtgatgatcactcatcgcagccacttgtggtaaatgggtaatacataaaacttgagatttttgtgaaatcgtataaatcttattgccaatcgcctgggcaacccgtccagaaacgccggtatcgacttcatcgaaaataattgatgtgacaccagcagccttggcaaacatggtctttaaagccaacataatccgggacaattcgcctccagaagctgacttgaccaatggcagcattttctcaccaggattggtctgaatataaaattcaactcgatctgcacccagccggtttaaagcacgattttgctggatattgacctcaaagaccgttttatccatgtaaaggtcggataactgctggtgaacggctttttcaagctttttagcccaccggtggcgaatgtcggagatcttagttgcctgctgaattaaatcggatttgagcgtggctaattgcttatccaaatcgtcgctggcttcggcatcccccgacatttgtttcagttcctgtttgattttggcaagatagtccaaaatttgactgaccgaatcaccatatttgtgcttgagttgatagatggtgttgaggcgctgctcaacttgatccaaacggtcctgatcaaattctaaattactcaattgatcggaaatctgactggcaacatcttgaagcgcgaagaaagctccggatagattatccgaaatttgtttatattcaggatccaaatcttcaatgtcctgcatcgaactcattgccgatccgattgaatcaattgacccgctggcctcctcgtcgccgttaatgccttcataactggctaggagggcatcatgaatcttttgaaaattgttcaaccggtctctttcagcgactaaatctgtgtcctcattctcatggagatcggcagcttcgatttctttaatttgaaatttgagcatatcaacccgttgtgcccactgcttctcattttgatgtttcttttgatttagatcgcgcagcttaataaattgatcgtattggtcttgataggattgcaacacatcggccaattcatcttcggcatagtcatctaataattgaatgtgccgttccggccgcattaactcctgatgatcattttgaccctgaatatcgacgatcgtttcgccgattcgtttgagggtggcaatattgaccatgattccgtttacccgacagctgttgcgaccattggcaaaaatgacccgctcgataatcacgttaccgtcactgtgatcaattccaaggtcatcaaggacgttgtaggtggggttatcatcatgaaggatgaagtttccctgaataacggctttggaagccccggtccgaatgagatcatgggatcccctgccgccaaccaagaggccgacagcatcaatgatgatcgactttccagccccggtttcaccggttaacacggtcattcctgcctgaaaatcaatatctaagtgttcaatgattgcaaaatcggtaattgatagttcgagtaacatgttttcaacctctcaataattctattcagttcccaacatactattgatctgattgcgcatattaatcgcatcggcttcggttttgccgataatcaagaccgtgttgtcatcgccgagggtgccgaaaatcccgctatagttcatctggtacatcaaactagaaatgaccggtccactaccaggtaagactttcataaagaccaacttgtcttgagagtcaaccgacacaaacgaatctcgaatcgattgaaccagtttcttttcagtatcaatatttttttgcgtcggcaaactgtatcgatacccaccggtaactgaaggtactttgacgagctgcatatctttaatgtctctggaaacagtggcctgagtgacttttatcccctgcttatccagtagcgagacaaaatcttcctgtctttgaatattattacttgtcagtaattgtttgattagcctttggcgttctttcttacgcatcattacacccccaacaataaaattgaataaaaatacaggtttacgaaccctttaattcagaataagcgttctcgataactttttcaatcgaaacatttggtgacatgactggttgatcatcagattctaactcaactaaaaattcaatattgccagcgccacccttgatcggtgagaaatcaaggttttgaactgaataaccgttggccacagcaaagttcaaaatcttttccaagaccattttatgcacagcgggatccttaatgataccatgcttgccgacgttggccttaccagcttcaaattgaggcttaatcaaagccaccacatggccatttttagtgatgatctgtttcagcggtggcaggattaactctaaagaaatgaatgaaacgtcaattgaggcaaactcaggctgtccatgggtgaaatcggccaacttactgtacctgaaattggtgtgttccatgaccacaacccggggatcctcccgcagtttccagaccaattgattactgccaacatccagcgcatagctcaatttagcaccgttttgcagcatcacatccgtaaacccgccggttgaggagccaatatccaacacggtcagccctttaacattcagatgaaatactttgagggctttttcgagttttaacccgccacgactgacgtacggcattggcttgcctttaaggtgcaggtcggtatccaccggaattttggttcccggtttgtccaaccgttcttcgttatcaccaagaatctcacccgccatgacggcacgtttggccttttccctggtgtcgaacagcccttgggttactagtagtacatcgactcgttgcttttccatattacttttcgtccttatttttaaaatagcttgtgaaatcatttaacagactggtatcaattgataacgcttctctggcggttacgagggcttgctgggcatcggcgaccgtctgattcagcatttcatatgattttgccaaaccaaccaaattgggatacgtatttttattagcgtcctggtgaaccggtttgccgatttctgcttctgtcccaacaacgtctaagatgtcatcgtaaatttggtaagcttcaccaaacttctcagcaaaggttaacagtgacttgcgtttttccggaataacccggcccataatcaggccagcttcaacggcatagcgaatcaaggcaccggttttgttgcggtcaagtttttgaagccctgacaacgataaccgggtgccttcaaattcgatatcgtcggcctgacctgaaaccatcccatgggggccggcagctttggcaagtgccaaagtcagttcagcttgggtttgactgtccaaatcattatccaccagccactgaaacgccagtggttggaggccatcaccagcaagagttgccatcccagcaccaaatttgacgtgattggtaggctttccccgtctgaggtcatcattgtccatagccggcaaatcatcatgaattaaagaataagaatgcatcagttccagcgcacagctggtttttaagacggtctgatcgattgggtcgcccaaactcgccaataccgcaagcgtcaacaatggccgtaagcgtttccctccagcgttgactgaataactcatcgctgcttccagagtggtctgatccgtatccggtttgatgtcattttccaaaatctgattgatttttggaacccacaaccgttcaaaatcagttagcttggttgccatcgctatcatccttttcatctttaggtgcttcaaattccacttcattgccatctttgtccatcattttggccatggtgtgttcggccttggttaaggtgtcttgaagctgttcactcagttgaattccggctttaaatttggccatcgactcttccaaggaaacgtttccctgttccaattgattgacgatggtttccagttggtccattttttcctcaaaggtttgattgtcttgtttatcaggcatattatttctccttctttgcatttatctgattgacagaagcgttgacgataccgtcactaaaatggacatcaattgttttgctgctcaagtcggcaacccgtttaataaaatgtccctgttcgtctgtggtgtacgtataacctcgactgagaatcttcaacgggctcaagtggtcaagtgagccgaccaacatctgataatgttgggaaacatttttcaggttctgagttgttgcccggttgagtcgacctttgagtgttgccagtttttgctgctcttctctaatcgtatatgttggcgcgaccaaacgcaggcgcaatttaagatcagaaaaacgatcctttcgtttaccggtaatcttgtcagattgattatagagtcgctgcgtcagtagatccaaacgttgagcaaaagtttcgtaaatccgttgaggtgtcgtgaaaacagtggactgccggagtcgcttcaatcgctgcttgtcttgctgaacaacctggtaagtcgcattaatgatgcggttttgggtcgtcctgaggtcaactaacacttgatccaacctgggaactgccagttcggcagctgccgttggtgtcgcggcccgaacatcggcaactaaatcagcaattgtggtgtcggtttcatgaccaactgaggaaatgactggaattttactggcaacaatcgctctggcgacgttttcttcattaaatggccacaaatcttcgatcgatccaccaccacgcccgacaatgagggtatcaaaattaccaatttgattgacccgctcaatttgtcggacaatgtctgcactggcctcggttccttgaaccagggcaggaaacaggacaatttgggcaatcggatatcgacggcggacagtggtaataatatcacggataaccgcgccgcttggcgaagtgacgaccgcaattcgtttgggaaattttgccagctgctgcttgggcaaattgaataacccttcggtggacagtttttgtttgagctgttcgtaagcttggtatagctgaccaacgccgtcaggttccatctgttccacatagatttgataacttccactgggttcatagaccgaaatatggcccacaactaaaactttcatgccttcttcagggatgaattttagccggttgaaagccgatttaaacatgatcgcactaattttcgcgtgatcatccttcaagctaaagtattggtgggcattggggcgcaatcgaaagttggagatttccccagtgaggtataccttagttaaatacggatcaacatcaaattttcttttaatatattttgttaaggcgctaacggttaaataatcattcgccacgttcaaggctccattctgctaaatcaacagtttgctgcatcaaagttgcaattgtcattggaccaacaccaccgggaacgggtgtgatgtaagaaactttgtcaaataaatcatcatagtcggtgtcccccactaggtgcccttcttcgttaatattttgaccgacatcaataatgacggctcccggtttaacatcgtttttagtaacggtatgaagactcccggttgctgaaacaatcacatcagcgttcttagtatattcagtaatatcttttgttaaaagatggagaattgaaaccgaagcaccagcatttaacattaaagcagccattggtttaccgacaatggcacttcggccgatcatcaccgcgtttttccccttcaagtcaatgtgatattcatcaaacattgtcatcacacccttgggcgtacatgcaactggatacttggttgaatcatttaagtataattttccaacgttaattggatgaaaaccatcgacatctttttcaggcaaaatggaacgggtgatttgtttttcattgatttgctttggcagtgggtcctgcactaaaatccctgtaatcttgggatcctgattgtactcctgaaccactttcagcaactcatcttgggtaatggtatccggtaattccctgacaattgaatagattcccaatctaacggccgtccgatgcttatttctgacatatcgctggctggcaggatctgtgccgacaatgatcacaactaacccgggagtgattccgtgttggttttggagttgttttacccgttcgctcgtctgtgcgtttaacttctttgccaatgcttttccatcaataatcgttgccatctagaaaccgctcctttatattttcatcgtgagaaatcatatgtacaaaaaaatagatttacacatgtgtaaatctattttaccagttcttctaaggcatgtgacaaaatcccgttaacaaattttcgtgaacggtcgtcactaaatttttttgcaagttcgattgcttcattgattgataccttggcaggcatgtcatccacataaaccatctcgtagatagcaatctccaagatgattaaatcggttcgggcaattcgctcaagtgaccaactggaagctaaatacttttcaattgtatgatcgatttcagacttgtgttccaaaacgccagaaataagttggtgcaggtattctgggtagtcgtcgccatatttaccgctcgtcaaaacttggaagaaatccttccaatcagtttgatcgttggtatttaaggcaaacagtgtttgaaacgcaatttctctgatctggtgtcgtgttaattccactattcctcaccattttcttcattgtcagcgaacggattattcggatcaaccgtactggtggttttttccggaatcacgccttgaacatgcacgttaacttcggtgactttcaagccggtcataaacaacagctgctgttcgacttgactttgaatttccaatgcaacttttggaactgaaacgccatagttcaagtatacatagacgtcgatcgttaattcctcatctgtgtatgtcaaattaacgcccttaccgtgttcttttcttcttccaagtaattcattgacactcgttgaaaatgagccacgcatccggttaacgccgtcaatttgcgatgcggctaccccagcaataatttccaggacattgggtgcaatctcaattttgccaagttcgggatcatttgaatgaagaatgatattcgtgtcttcagccattataaagcctccgtttcagatcaatcggctactatgcccgtgaaatgtaagttccatcggtggtattgatagtcaacttgtcaccctggttaacaaagaatggaacttgtaatgttaatccagtcgtcatagttgcgggttttgaaccacccgaagcagtatcacctttgataccaggttcagtggaagctacttcaagaacaacggtattaggtaattcaattcctaaggtttcgttgccgtattgaataacttgaacttccatgttttcttgtaaataattcagttcgcttttaatttgttcagcaggaattgaaatttgatcgtaagtatccatatccatgaagacatgttgatcaccatcagcatacagatattgcattttgcgcgtatcgatttgagcctgttccatcttagcgcctgaacggaaagttttttcttgaacagcaccggtccgcaagttcttcagctttgaacggacgaatgcgccacccttaccaggcttaacgtgttggaagcttaaaatccgccaaattgcgttatcgacctcgatggttaaaccatttttaaaatcagcagttgaaattgccattgttgttcctcctaaatgtaatgtaacataaatagattatataatactttcggtcaaaatagccaatgaaaatggcattctgatcctgagcaattaaaaagccgggatgcaaaacacgcgttttgtcccagcctctttaattaaactattgtgcttactttgcagcttcagcaactggataaactgaaacctgacgcttgtcgcgtccttttctttcgaaacgaacaactccatcaacgactgcaaacaatgtatcatcgttaccacgcttaacattgttccctgggtaaatatgagttccacgttgacgatagatgattgatccactgtgaactgatgagccatcagcagcctttgtacctaaacgacgaccagctgagttacgaccgttggcagttgatccaccacctttatggtgagagaagaattgtaaattcattgctaacataggtttacacctccagattaattgatttatttcgctgtgtttaacttaatatacttactataactttcggctatatcagccattccgttcgcaaaagtattcaaaactgcatcagcttgaatgcgcttctttgaatcgctaacaactggtacattgactgataaatagccaccattgtcatcgtcactgtcgacatcgacatccagtccaataacctcttgaagaccgttaaccgttgtgatgcttaacacagaaacagcagaacagacaatgtcttgcccatattcacccgcatcggcatggccggtgatggtgaacccacttacatgaccgcgataacgtttaatggtcgccttaatcatatcagtcacctcaaagtaaattatgccttgattgaatcaataacaaccttggtatatggttgacgatggcccttctttgaacgtgagcccttctttggtttgtaacggaagatgataatcttcttttgacgaccctgtttttcaacagttccagttactgatgcgccatcaactaatggtgtaccaactttaactgaatcgccaccaaccataacaacttgatcaaaagtaacctttgcgccttcttctgcgtctaatttttcaacgtagattgcatcgccttcggaaaccttgtattgcttaccgcctgtagtaataactgcgtacatatcttgtgcacctccttataagtttgcttagactcgccgagaacaagcgctccgatcactatcgaagacttatcagcttgaatcgagcggttgtagctgtggaagccacaattacaacgttactagtatacataattggcaggtgttcgtcaatagaaacctgatcccataaaaaaacaaccgctacccacggctgttttatttacgttgagctaaatgtctgccattggctcgcgtggtggttgaagaattggtaaaatactgaataatgccactaacgatgaaaatgaagacaataaagattacaaatcccacaacgtccacctcctaattgttgtgacagcagattgctgcacaactacattatccagttttgtcagcgaacgttcaaatttttgaattcaaccaactcaaattttaataaaaatgcaactttcttaaggaattcataatcatattgacatctttgccctaaaagactgattaaacattgactaccctgttaatatttcatataattgttattgttgatttgtcgcaatagctcagctggatagagcaacggtcttctaaaccgtaggtcgagagttcgaatctctcttgcgacattctgacatcacatcagacatttagagatgtttgctgaataccttcaattcctattttaacgggattgaaggtattttttatttacaccactatttacgccgcactctaggaaatgtcaaaataccagtccgcttacttagtgttatcaaaacggccgaaccgaagctgaatctcttcgtttcgaccgtttcttattatcttcaattaataatcctgatcctgccgatcttcattaatcttgtttttatctttgaaggcctgttcaatctcctgctcagtataaccgaaatcaaccaagccaaatttaagaaacagtcgccaggaatggctaaagctgtcaccgctgtgatcaaagtaagcgtcaaacaacatgcgttttaaggctaaatattgcttatccaggttatcttcttttttgaactgtttgattttgtccagatcatcctgcgagtttaaaatcacgtgattccaatttttgaggttggaaatcaataggtagaaatccattgcgtcaacgtactcgtatagcaacgtttcccgcggcgttttgttgggatcgtgcttaccacgatgcgtcttccagaccttgaaccactcggaagtgttggccatttcagccagttccacgtccagggccacaaaggcatttttcactctgccgtcatttgaccagtgaagttgcttctttgattcgatctggcgattcaaatacaccgatgaagcaatcaatgattgtaaatccatttcaaactcctatccaaaaataaacttgttcgataaaatttcgagctgctttttgttatccaaataccagtctttgatgaacgggtaatccaataatagattcagccagctttctttttgatcctgatcgtggatggttgctccccacttgggccgatcttcatcaccggcgttataaacgttcagctgggtatcgttatccaaggtcaaggaggccccaccattttcaccagacatcaaaatatattggttatcagccgacttaacaaatagctcgtccaaaatcggctctggaattgcgccggcagcgaattcatagaactcaccgttaacgccgtccaagacgttaaagtcaatcttaaagccgaagctttctttgagcacttcagcagcccgcataatcacgttcatcgcatctttaagagccgaaacgtccaagccctccaaatcaacgacaaagtaatcgattaaggccgacccatgaaacatcatttccttactcttcagattcaagtagaatagcggtcggttatgggccgtggggccaaagaagaatccggcagcattcttggtcgatttggtaaaggtaaaggtattatcaccaagtgatgaaaatttagccagcagcttttgaacgtgttcagagttgctaattgaaagtccatcggcgtggtcagacaacttcaataaccgttcaaagaataccagctgaacatcttcatcagaaaattggtgtggaaattccacaaaatctgaattgagttgataattggtcaacgaaacagctgcagtcaacaattcatcgaggtcctgggtctgatttaggctggtaaatgcattgacatacttggacccattgtccaatccggcttgaattgactgagtatagtgattcaaaagttcagtcgtcgttaaaacattcttttctgtttcagtattttcattactcaccgtcagtcacctgcgattctttgctcaagctttgcaagtatttggcgtataagttgttattgttctcaataaatgcttcaaaactgccaaatgaagctcgaatattttgtttttccaaattgtaaatggtctcttctttggacagcgccaaaatttggttttcattctttttgatttcggaccgggcgcctgaagcttgttcatcaatattcgttaactcaagcagagcgttttgtaattgctgatgctcttccttaaccttgccagcttcccaaggcattggcgacttctcttcattttccttgatctgtttgcgaatctcttccttacgctgatcgcgtttggtttgatcttcaatcaattgagtcagtttttcattcttttgtcccagttcgcgcatttgatcgtcgtttacccgtttgttttgagcttcaagttcaaatgatttggccaaggtattatattcatcttcagcaaaattgaatcgaacgttaattgtatccaactccccaaacatccgatggtcccaccagttaccaaagtaaatgttgaatttccccaaatcatattcgtggtaatagaagaatggataggtggttcctaaataatcaatgagtttgtcactcaaatgatgacttaactgagccttcagatcagtggccaggccaaagaaattagtctccggctgatcaggctgttcacccttgacttctgttgcaaagcggttgggatccatcaattcgtatacttttaaatcattgccatttttgatcgagtcattcaaatccgacagatattttaccttttcgcttaacgcggaagctaaaatcgagtcgttttggctgaatggatcgttttcaattttgttatccataatattgcctcgtattccccttatttatacatttaatgttatctgaaaaacgtacataaataaagggctaatcgcatttatttatgaaagatttgtcaaaatgatgagaaaacaatccattcttttgaaaattcggtgaaatcacaaaaacgaccagaccatcataatgggttaatgatgacctggccgcccctgtattcgattgttttcagttgaaagtttgactttctttttccatttgcctatatggagttgtcaaaccgtcccgtgtcgctgcatgataacttattcgacaatgtagacatttttatagttgtacgttgctccggccgtattgtaaataatgcctttcaccttactgctcaacaggtttttacttgctgattgatatagcggtgtaatgccctggttgtccagtaagatattttgtgccttggtcatgtcctcaaatcgcttgtcagcgttcccagcatcggtggttgaagatgccttaatcaacttgtcatactgcttgttcgaccactgtgggacgttgcttgggttgccagacgttaggatgtttaagaaggtaatcggatcggcaaaatctgcgtaccaatcacccatcgtgacttggtaattatgtgatttctgtcgtgacagcaacgtttggaaaggaatatttcttaggttcaccttgagcccaggcagattcttttctagttgcgactgtagatactcactgacttgtttttgcgcgaattcgtcagaactgagcagtgtaaagctcattttggtgatccccagttctttgaggccggctttccaaagtgcctttgccttggttgaattataggttaaagaatccggtttggcagtggtggctgtaaaatctttgccggtcttaggattaattgacagtcctttggaaacaaaactttgtgaattaaaggaaccgtctcctaaaatcttcttggttaactggccgcgatcgatggccatcgaaattgcttctctaatttttaaatttttgaacagtttcttcttttggttgaatgccaggtagtaacaactcgaagtttctctggtcaccaaattcttattgttcttcagatttttggccaaaacaccagataagccaacgtattgcagcttgtcggtcttaaattggttatagccggtcgaagggtccttagtcacttgatagtggagtttgtccagtttgacagctttcttgtcccaataattttgattcttggcaagcgtccaagtcatcccggttccgttccagctggttagcttgaacggtccattgtagaccatatccgcactcttcgtcccgtaattgtcgccaaacttctcaacgaccttttggttctgcgggaagaacaacgggaagcccatcagcagtttgaagtacggaattttcttttccagggttacgactagtttataattgccgtcagctttgattcccagtgtattgggtgactttttgttagcttggatggcatcagcattttgaatccctgaaaaaagataaccgtactgagaggccgttttgggattaacagttcttcgccaggaatacacgaaatcttttgccgtaacgggatccccattgctccatttagtgcctttacgcaaattgaaagtatattttaacccatcatttgaaattttagttttggtggccagtgcattttcaattttgctgtccttacccagacgataaaggccttcatcaatgttgtttaacacttcaaatgtttgaaccgacgtcgttttggaaaggtcaacagttgagagttccgaatcaacggcagtggtaaattcctgtttggccgccagtttccccgaaccgctcttttgcgatgaacaaccagtgagaattaaggctgcggagatcactaaccccacttttaagccaagttgaatatttgacataacagacaccccttcatgatctatatgagactgaaatacattcaattataaacacattatattttaatgagagataatcggtataaaaagggctcacagcagtacaccatcgtgcaccaccatgagctctttgaataatcgatcacgctcttacaagtgcggcaaagttattttaacacactaatacttttcaagatactggtcacgttcccaaccggaaacttgcgtgcggtatgaatcatattcaaggttcttagcttcaataaagctactgtagagatgttcgccgagggcctttttcatcgtttcatcagctgaaagatccttcaatgcgttatgcaaggtatcaggcaggttagtgatatggctcttctgacgttcttcagcatccattcgataaatgtttcgatcaatgctgtgttcgggttcgatcttgttgcgtaggccatccaagccggcttccaagacacaagcgattgccaagtatgggtttgcagttggatcaactgagcgaagttccaaacgagtggaattaccacgagcacttggaattcgaatgagcggcgaacggtttgaaccggaccaggcaacgtagacaggggcttcgtaaccgggaaccaaacgtttgtaagagttaacgattgggttacatacagcagtaaaggaacgggcatgcttcaagaggccgcctaagaagtaataggcttcttgagaaatttccaactcgccatccttgtcgtagaaagtattgcctttatcgttgaataatgacatattcaaatgcatccctgaaccattaataccactcaaaggttttggcatgaaggttgcgtacaagccgtacttgcgggcaacggtcttaacaaccaacttgaatgtttgaatattgtcagcagcagccaaggcatcagcgtacttgaaatcaatttcgtgttgaccaggagcaacttcatgatgggcagcttcaacatcaaagcccatttcttcaagggtcaagacaatttcacgacggcaattttcacccaaatccattggggccatatcgaagtaacttcccttatcgttcagatgaagggttggttccccattttcatccatcttgaacaagaagaattccggttcaggtccaatgttaaatgaagtaaagccggctttcttcatgtcgccaagaacacgaatcaggttattacgaggatcggctgcgtatggctcgccgtttggacggtagacctggcagattactcgagcgattttaccacgatcagtactccatgggaaaatcatccaagttgataaatcaggatacaaatacatatcactttcttcaattcggacaaagccttcgattgaagaaccgtcaaacatcaatttgttatcgagtagtttctccaactgagtgattggaacttcaacgttcttaattgtcccaaataaatctgtgaacatcagacgtaaaaacttgacgtcctcgtcttttaccatcttgcgaatatcatcttttgaataatcatgctttgtggccatctatccatcgctcctatcaatgatttagtttgtttaaattgttcaaattattcggatcatcaaatgacgaagaaggcggcttcaatccaccaatgttaagaaactcgtcttgaagaatctttctaacatcactgtcagtcaaacctttctcgagattacgcttccgctcgtcttccaattgattctgcttcttgtacacctctttgataccagagatattcagaccgtcgtcaagataatctttgatttccaaaagccgatcgacatcattcaatgaatacatccgtcgattgccttcattacgaagcggcttaatcaattcctgctgttcataatatctgatttgtcgtgctgtcaagtcagttagcttcatcacagttccaatcggcagaactgacattgaacgccgtaattccttctctcgcattgttcacctcctaaatcttgtacccataataccattcccataatcaaagtcaagactaaatgtcacattttataacatgaatttattgattgttgtcatccagccatttttcaacgtcgctttcaatctcagttaactgatttggtcgctgaaccaggttataccaatttggttgcggttcagttttgttcctaaaccaagttaattggcgcttggcgtaatggcgtgaatccttcttgatcagctcaattgcttcttccaaggtcgattggccctgaaaatacgggaataattcacgatagccgatccctttgccggcttgaaattgctgtccgtcatggtcgaacaaccagcgaccctcggacagcagtccctgcgccatcatttgatcgacccgctgattgattcgctggtataacaacgcccgatccgtcgttaatccaatgacgaaggcatcgtattttgatccgacattatgctgatcagaaaatcggtgaccggtgtttatgtagacttccaaagcccggacaacccgcctgacgttgtgaaccggaatggcccttgctgcagcaggatccactttggcgagtcgttggtgcagtgccaaatcccctttttctttggcttcagccagcaattgtcttctcaagtcatcattttgatactggtcgccaccaagctccagcccagataaaagtgcctgaaggtaaaaaccggttccaccgacgattatcggcagcttgccggcctcgtgaatggcttcaatcagttccgaggcatcatgaacgaaatcggcgacagaaaaacgttcgtcaatatttctgacatcaattaagtggtgtttgacgcccgccatttcttcctgggtaattttagctgtcccaatatccaagtgtcgatatacctgcattgaatctccggaaataatctcagcgttaaatttttgagcgagtttgatcgacaaatccgttttcccaacggcagtcggtccgacgattgctaaaagtttgatcattccactccctcccgcatctctgacctgatctgaacagctctggcgggatagtcggtgatgatagcggccagattgcgttcaaaacagtactgcatatcctcagtggaattgacggtccaaggacgcaaattttgagcaggggcaaaaaatggatgtcgtttaagccaacgaatgtcgggatggaaatcggcaattaaatggtccttcttgagggttttggcctgcttagcggcagttttgaacaatttggcaccggctaatttaggatccagccggttgagaatttcaagtgaccgggcattaaagctggagtaaatcagctgaaacgggtagtcgattgaggcaaaatagtcaaaaaccgctttttcaatccctggatactgaatcttgttggtcttcaactctaagttaaaaatccccgtgaagttgtctttaattaataattccaccacctcttggagcgtggggaccgtggttcccttaaattcactgctgaatcgaacacctgcgtccaaatgtttaatctcagccagatttttgtcaacaattctgccagaaccgttggtggttcgatcaactgtttcatcatgcataataattaactgatggtcttttgagaaatgaacgtcggtttccaggccgtctgccccatcgtcaatggcggtttgaaaagaaatcagtgtattttccggtcgggttcctttactgccgcgatgggcaataattttggtattgattttcacaataaactcctttttgaacgattaattaatcaattaactagatatctatgaaaaaataaagcataatgaaagtataaacgagtattggagggtttagatatgaaacagtttactaatgggctcattgttggtgttctcggaaccgttgctgctggggttggtgctttgctgacatttaaaaagtcagtggtggatccaatcgaagatgaagagcaaaaattcgaggataaccgaaaaaaggcaatgcgtaagagccgagctgcccaccacggataaaacattatccaatccattacactaataacgattataaaaataggactatgaacaaaacgaatgctttgttcatagtcctattttatcaataattactctttttttccttaccattccaaccttgataaccactttttaagatataaagatctttataaccctttttgcttaaaaagagtgcggctcgtttgctgatcgttttgccttgatcatacatataaaccggcaagtctggacgaagctgactgtaaaagtttttgatggttgagtaaggcatgttgcgagcacctaaaacatggccgtctttaaaacttttttgttctcgcaagtcaatgacctgagcttttctcatgcctttttgaaactcatcatttttcaaatacgttgcaacctgtttaacacgcatattttgaaaaatggtatagccaccccatgcaagtaaaataacgatcaaaatgatggttgtcaccagattggcggtgattgcaccgattatcaacaaaaacatccctctttctctcaaataatttgattatttggttccaaatggttgattatttctaaattgcaaggctaatgatgcggcaccaataattccggcgtcattaccgagttgagccaacttcaaccgtgttgagtcacgaacagaaggaaaggcgttctcttggaaataacgagtcgttggctgaagcaaggtgttaccggcgttggaaacaccgcctccaataatgatgttctccgggttcaacgtgttaccaatgtgtgaaagtgccaatcccaagtatgagcagacccgatcaacaatttggttcgccaagatatcaccgttatcagctaggaagaagaccatcttcgatgacaaatcttcgtcgccatcaatcaattctttaatccgtgaatggccggtaaacttcttggccatatctttagcaatatggacaaccccggttgctgaagcgtactgttccaaacagccgcgctttccacaggtacattgatatccattagggacaaccgtgatatgaccgacttctccggcaccaccgttaataccatgaaccagcttgccattggcgataacaccaccgccaacgccagttcctaaagtaatgaagacgacatcttttgctttgtcgccggcacctttccaatattcaccaagagcggcgctattcgcatcgttgtcgatcagaattggtaaattgagattggctgaaatggttgctccaaccggttgcacgatgtcccagttcaagttatatgctccaacaactgttcccttttcgcggttcacagcaccgggagttcccatgccgataccataaaaatcacttgcgttatagtcgtcttttctcatttgatcactaattgatttgatcatgtcaggcacaatgtgactgccgtgttcactaatgttggttgggattcgccacttcgtcaggacgtttccttttgtatcaatgaatgcaaatttaactgtcgttccacccaaatcaattccgattaatttcttagccaatgtattttcccctactttcttgtttttcttcaattcgatgttcccgcgttaaaatcagtttggcatgaataaactcatcatgactgatcagcttggcatcatggagatggtccaactccaacgccatgacttcaatgtcccaaagtcgtttgccgacatatacataaatatcgaattttttcagcagctgctgaacatcatacagcgttttcattatctcacatcctcatgtaaatttctttcattttcacaaaatttaaaattttgcccgcatacctattgtaaacaaaacgaaagcgattacaaccagcataattgccgaaataattcgtttggtttggctggtcttggaaaaaccgacgcccgtcacatacgccacaaggaatccaccaaccagtccccccagatgcccagcaatatcaatgccggaaacaaaaatatcggttccgatatttaggacaataaacaacaggaatgttttggccatcgaaacaattgccgggtttttggaaaaactttctcccagcatcataaaagcaccaaacagtccaaagatcgcagtactggcaccggcagacaagctgtctgtaaaagcaaaactgcccaggttgcccatgattccggaaacaaagaagataaccgcaaatcgccagtgtccaaacaattgctcaacgtactgaccgataaagtataaggtgatgccgttcattaagatatgagtgaagccaatgtgaataaacattggcgtgatcaatcgccaatactcgccagcacggatgagtgggttgtatttagcgccaaattcgaccaaggtgacggggttttcagttccgcccattactgacatgatcgcaaaaaccaccaccatgatgattaatagtccatatgtgatataaggctgatttcgtaaattactcatgaacccctcctgttatccgtttagtaaatgagtttgtcgactttaacatcaaaatcttccacatcccagacgggttcgtcaaatagttgaaccggtgtcaccaaagcgatacttgtgccggtaaagcccttcaaaaagcgatcgtaaaagccgccgccaaacccaactcgaaagtgatttttagaaaacgccaatcccggtaccagtaaaacatccagctggctttttgccagcacttgaccgccaacgggctcaatcgtaccaaatttggtctcactgagtaccgtatcaggttccagcagcacaaaggtcatctggcggtgcggaagtgttcggggaactgctacttgtttatcatgggttaacgcccagtgaataattggctgggtatcaagctcatcatccatactgagggtgatccccagcgtctcactattcgcaaagtgtggctcggcgaataactgctgatacaagcgttgaatttccggcttttgttgtggatcttgtaaaaagtcatgaagccgagcgatctgctgatctcgcagggcggcttttaattggttacttttggccatttacctcacccgattcttcagtcaaatctaattgacagactctgttgtatataaaaaaggtttgggtatttacccaagccttatttggtttctcgatgtaatgtaactttacgctcgcgtgggcaatactttttaagctccaaacggtcgggattgtttcgacggttcttgctggacaagtaagtacgttcgtggcattcagtacattccattgtaatgtgtactcgcatggaatacgacctccaaacttttatagagtagctagtctaatagcctcaacttaaaatattttatcatcaatcctgataaattactaggacaaaatcgataaatgttaagtgtttttacttaacagtcgaagttgattggaccgtcttccaataagccgagtagatttgtttggccagcgccatgttattactttcagcgttaacccccaagttaggcattgccaaagcaaccaccacctgtggatgagtcgatggcgcatatgaagctaaactcagggtaactgtttcgttgccattataaaatgtctgagcagttccagttttggcagaaatttccggtttgatggaatccaacatcccaccggtcttgtaggtgttggttccatgaaccacccgatacaagccggttgtgaccacgtttcgttgcgcttgagtcatatcaatatgattgagtacctttggcatcactgtcgctttaaccgttcctaatttaccatctgggctggtgccgcgaattgcttgaacgacatgcggttcaattcgattaccaccgttggcaatggtagacatgtactgagcaacctgcatcgttgtgtaggcatcgtagttaccaaatgaaagatccaaggcacttccaatgtgcttatagccgctggcaccctgtaacccggtagattcaccagggatatcaatcccagtcttgacacccaggccaaattggttgaagtaaccgcgcatcgtgttgaagacgttgggactcatggttaatgcgccaccttcaacatagttgaagtgaccttctttcatcgctaactgcatcatataagagttggaagaaacttgcagcgcatcactggcatcaacggcaatatttgcatgaccgttgtggttgaaccaagacgactttttaacaccaccggtcgtaattggctgatcggttaaggtactgttcgttggtgtaatgacatgatccatcaatgcaccggaaaccatggcacccttgacaacagaacccataacaattgagctgttaatggttcctaaaatattatcagtgatcttggaagtcttcggattgcggtcaacccctgccattccgatgatggccccgttattcggattcatgacgaccgcataagttccggttgaattaccaccggcaccggactcggcagaacggactaaggattggagctgcttttggaatttggcattgattgtcaattgaaggttgtcacctttttgaccgccatatttcttaatttcctttttgatctgattatcgctattcaaaatgatttgggtctgggatttggttccccgaagaaccggttcatattggcgctccagataactttgaccgacactgtcgtttcgtgagtaaccttgtgccaataattcattgacccgatcacttggcagaccactcttttcattcgagacagttccggtgattccctgaattgaacggccatttggatagttgcgactccaactggttccaacattaacccctggcatatcggccagatgttcccccaccatggcaacttctttagtagaaacgttgtcatccttaatattaacggtggataattggtaggcaccactcatcttggcaaatatggttgcagcatttttgagtgctgatgaaaaagtggcatttggataactctcaaccttattgacagccttgtcgtatttggcatcctcagaataaccggaaatcccagggatcgacttttcgactttggctagattatctgtatttgccaaataataatcagccagctggcgcttggttaaactgccggttggaacagtcacatattgggctaatcggttggcggttttgtacatgtccgaggacaacacattcacgcccttggtataaataattgcttggtgcgcggaattgccgactaaaacgtgtccggttgaatcaaaaatcattccccgctgaacattcccgttaactactgaggtgtctgatcggttcacttcggctttaaatttagaaccgtacatcacctgtaaatacgccaactgggtcagtaatgcaacaaataaaattccgacgataataaaaataatgttgattcgaaaaggcagtgaaacagcctttgctttgttcgttttcttggtgcgctttttaaaaattttcacgatattaactccttgccatgaaacttattctatcaaattttccaactaaaaactacaaccggtagtcaatctttaacttattatgatattctatatgttgttaatcacttttaaaaaggatgtagattatgaa

SEQ ID NO: 168 - DNA, 79528 bp, Lactobacillus buchneri
tgccccaacgttgggtagtcgaacgatcttttagttggctagagaattgtcggcgactttggaaaaattgtgagcgtcaattaaccaccagtctgcaaatggtcgttttagcgtttttagcactattacttaagagattttagacagcttctcaggcattgacagccttgaaatccggtcagggggatgcattaaccactgataacgggattctttatgggatgtccatcgaaaacccaggttattcggttgttggtggcaccttcaccaaggaaccttatggaattgccgttgacaaaggccaaggccagatgagagacgcgatgaacaacgccctgaccaaggttgaaaattccggtcaatacaacaagctcctttacaagtggttccacaaagttcacggatttgactttaagggggcagaacgatgataagtatttttcaaaattatggtggtgagctcctttatggactgggacaaacccttttgtgctcgattattgcgttggtctttgcattaatcatcggctcaggttttgccatcctggaagttgtacccaacaaattctttagagtgattgccagagtttatatcgaagttttccggaacattccattactggttatcacgatgttcttctacgtggttattccaatgtacattgttgaaattagtggattcgcatctggtacgattggcctgatcctttactcgtcagcgtttattgctgaaacggttcgatcaggaatccagtctgttgatcctggtcaaatggaaggcgctcgtgccaatggattgtcattctggcaggcaatgcgttatatcgttttgccgcaagcctttcgatatgtcattccaccactgggcaaccaattcatcaacttggttaagaactcttcggtcctagcctttgttgccggatttgatttgatgtatcaaggcaacgtcattgcgtctgactcactgcaaagtatgagcacatatctgtgtgttggtgttctgtatctgattttgactttgcctttgagttactatatgcgttaccttgaaaagaaattggcataaaggaggaatcgagatatgttaacagtcttaggtgcttattcatggattaacatcaggttccttcttgaaggggcttgggtcacgatcctggtttcagtttgttcgattatcctgagttacatatttggggtaattttgggaattatcagatatgttgaaattaaatatttatcagcgattgtcggtttcgtgattgatattatccgtaacttaccgctaatcctgattatcttctttacctattttggcttaccaaacatcggcttcaagccggatccaatttgggcgtcggtgatcgccatggcggtctttgaatcggcgatggttgctgaaattgtccgtgccggaattgtctcaattccagtcggacaaatggaaggggccagatcgactggaatgtcttattggcaggcactgagatatattattctgccgcaagccatcaagaacatgattccggcgattgtgagtcaattcatttccttggtaaaggatacgtcattggcaactatcattgtgctgccggatttgatgaaccatgcgcaaatcatttacggtcaaaacaccaattatacgattccaatgttcttggcgttagccgtcatgtacttcatcgtatgttactcactgtcacttctgtcacagtacctcgaccacagactgggaacagccaagaagtcgggtgaagtggaggaagttgtgcagggagcagaacggtagagtgtggattggagcgcttagcaaccagagttggcttacacgcaggttgctgctccaaggaacacattttaaccagagtgcgacgagggctggcttagaagttagcttcaggcccgtcggagcacgtttcatccaaataatagaaaaaatactcaaagaaccccaccaaaagaaggtcatccaatggaactaatcaaatttgcccgcttcatgggacagatcatattgcttctaatcttggcattcctggtgggattttccctgggattataaatgcaaacaaagaagagtcatcaaccaaaatcgttgatgactcttttcgtatccataagcaactttcaatccagcacttcaatcttccgtacatcgaccaaatcactcatttggcggataaactcgtccggatccattttgtgctgcaattttacccggacttccagtgagaacgaatccggtttgtaggcaacgattctcattcgaatatcggcactgccaatcgctcgcaggcggtccggcagctcatccatcgatgccagttcgccgttaaatgtgacttgcaggcgaagtagagagcgattgggatagcgtttaaatgcccggatctgccggacgattgtctgggtgaccaaaatgcacaacgttccagcaatgccgatgacgtacatgtcggccccgattgccagcccaattgcagcggtggcccatagaccagccgcggtagttaaaccgtcaatcttgtgattccgggtaatgattgccccggcgccaataaaaccaattccagtaacaacctgtgaggcgatccgagaagggtccaaactgacatcagcgtggttgatgacatcaaagaaaccatatttcgaaatgatcatgaacagcgcagatccgaccgccactaacatatgggttcgaatcccagcggtctttaaccggaccttccgctcataaccgacgaggccaccacaaattgcggccacaaataaccttaaaatccattctagttggtacaaaacataagcggtcatgggcagccctcctttacagaacaattttcttaattataacgccaagcttattggaaacaaaaaaagacaaccggaaatggttgcctttgagcctaggtgcttattcaaatacgtaaacctatcctaacacaaacgtttgaggcagaaatggccaatcggccttgtggtataattagtttcgaagatttatccgaccatactgatgaagaggtgaacacatggctgcgacaattaaagatgttgcccgggctgccggggtttctccggcgacggtctcccgagttttgtccaatcaaaaagccttctattcagaaaaaacagcccaaaaagtacgggcagcagttaaacaactgggttatcggcgcaacaccagtgcagttgagctggtcacgcaacgcagcaaggtgattgcggttctggtcagttctactcaaaccaatttctctgatcagatcttaaaggggatccaggaacaggcgcgggttcacaacctgagcgtgatgattattttcgccggtgaaggcgatgcggaggtccaggcaaaagcgatccgaaccgtcattgaacgatcggtgatgggcattttactagtggcgattgatttggacccttcaaacgatgagttgctggaaaatgcgaatatcccatttatttttatttcgatgacgttgaagaatagtgcctttccgtttatttcttcgaatgactttgatattggttatcaggcaaccaagtatctcattggcaaaggccatcaaaaaatcgggcttgccgctaccgacttggattcatttgtcggccatttgcgctatgaaggctaccgggatgccatgcgtgacaaccatttgtcatttgatgaggattggatttgcggggggcattttacctatgaagatggtgtgaacgccatggaacattatggtccgcaaaccgagttgactgccgtgattgcttcaagtgatctggcaggcattgggattttgaatcaagccaccaactatgggatgaaggtgccagaccggctggcaatcttgacgattgacggcacccaattgtgtgacatcgttcggcctaaattatccagtgttacccaatccttctttgagatgggggctaacggaatggatatgctggtgagtgactcatttaaagaattttattcaatgtatacgccaattagaattgtcgaacgacagagtgtttagggggcaattagaatgaaagcaattgtattacgtcacccgggtggaccttccgccttatcctatgaagatgtgccaatgcccaaagtcaaagacggctggacgttgttgaaagttaaaggttttgggatcaaccgttcagaaatttttaccagaaatggttggtcgccatccgtcaagttaccaagaatcttgggcattgagtgtgtcggcgaagtggttgaaaccaccgatccaaagcgcttgaagaaggggcaaattgtggtttctgtaatgggtggcatgggtcgtgcttttgacggcagctatgcggaatatacgttgctgccaaatgaccatatttatgcggttaacactcaccttgcgattcaagatttggcagccgttccagagacttatgggacagcctacggatcactgctcaaactgcacctcgacgaagcagattcactgctcattcgtggtgcaaccagtggtgtaggggttgctgccggtaaattagcgcgggcaatggtgccatcgatcaagctggtcggctccacccggcatctggaaaagaccgatgaattgaaatcggtcggctttgatgaagttgtcttggatcaagataaccaattgcaggcaaccgggagacaatttgaccgaattttggaattggttggggcattgacgctgcccaactcaatgcaattcattcaggagaatgggattacctgtgttaccggtgaacttggcggtatttgggacttaactcacttcgagcccatttcccaactcaatggaggttatttaaccagttttgaatccggtgccctaaaccaacgggtgtttgatgatttgtttgatatcattaacaacaatcacgtggacgtagcaccaaccaaggtgtttgatctgaaacataccgccgacgctcaagcctacctggatagtcatgatagtttcggcaaggtcgttgtcttaccataaaattatctcaactataaaaaaagagctggaaatcgaaattgatttccagctctttttttgatgcgtgattagttttcgttatctaatgactcttcttttgctgcagctgcttggctctcacggtatttcttagtttcataataaaataccggaataccaacggcgataaagataaatgaagttaagacacctggtaagtcagacatgatttcactgacgatgacgaacaaggagccgccgattgctaggattggggtgattgggaacaatggtgttgagaatacccgatgctggtctggattgcgttttctcaagaggaagacgccgacaaaggccatcacatagaagcagtataccgtgaagatacataattctgacaagcggtcagcgttggagaagatgatcatcactgtgacgatcaataactcggcaaccgttgagaaaatcggggtgtgtgactttggatgtaagtatgacagcgtctttgagaatggcagttgaccacgtttagccatcgcatacataatccgtgggaaagtcatgatcttaccgttcatacagccgacaattgagatgataatcccaatacttaagatcttgccgccaacttcaccaaaggcctggttggcgatgtatggaatggcactggtgcccaaacgatgaatctgttcagcaggaacagaacgataaacaccgtaagagaccagcaggtaaatcgctaagacagccaaaataccaaaggtaatcgcctgtggcaaaagcttacgcgggttcttaatttcaccacccaggttggcaaccaaaatccagccatcgaacgcgaatagagttgccaagatcgcaacaccaaagttgccggcagattgatgtacgtgaaccaaactttgaccaaaggcactttcattaccaaagaaaaggccaaagatgattaatgcggcaacaggaaccaatttacaaatcgtcgtaataatagcaaacgtcgcaccgtaacggttcgagaataaatttaaaataccaactaagacgatggtgccaattgccagaatggcattgtacttgcttgggaagccaaagaaatctgataataaaatggccagatatgcaccaagcgaggcgatcattgccgggccgtagataataatctgcatccagccggagagaaagccccataacttgccatagatccgttccatataaacgtagagaccaccggtttcaggcatttgagatgcaatttcagcaattgtcaatccggcggtgatggttaaaatcccccctgccagccaggcaaatagggccattgacgttgagccggcatcgtctaggacggcagactgacgaacaaagacaccggcaccaataatcgttccaatcacaagggctaacgctgaccagaggccaaggtcacggtccagcgttacttctttctgttctttcatggtttttcctctcttctcctcaaaaaaatatgcaacaaatagtatcagaatctgctgttgttaacaaccaacttattccgtagttaataggtatttttcaaatcgcttggcatccacgtcatttaattctgctgtgataacagttccgtcatcgcggtaatcggtggtttcaatattcgtgttctcattcaaatacgaaacaacgtcaccgtcactaaatggaattaataacgttaatcgatgatagttcttgaaaatcttttctttgatcatcgtcgttaattcttgcagtgacttttcatccatggcggacatgatcaggttgtcgccttcgcgggatgggaaggcaacctccatcttgtcggctttattgagggcaacgatcatcggcacgccgttaacaccaatttcactcagggtatcttcggtggtcttcatcatcagttcacgatggggatcagagtagtcgacaacttgaatcagcaggtccgcattggcagcttccgacaaggttgacttgaatgcttgaactaattggtggggcagttgactaacgaacccaacggtgtcacttaataggaaacgtttctggtctggtaaggttaattttcgaactgaagtgtccaaggtggcaaacagcatgttcttaaccatgacctgtttgtcttcgttctcgccatacaagttgatcatgccattcatgaccgttgatttaccagcgttggtgtaaccgaccagggcaacggttggcatttcactgcggtcacgctgcttgcgcttggtctgatcagccttggcggtttctttgagttcttgattgacgtgggtaatccgcttttccagtgtccgccagttcaattcgtattgtgattcaccggcaccacggttggttgcgccaccagcaccactactggtaccggtctgttgatccaaccgttggctggcactggtatgcagccgcggcagttgatattttaatttggctaattcgacttgaagtttggcttcgcgggactgagcccggttagcaaagatttcgaggatcaaaccggttcggtcaatgatccgggaatgcgtatttttctcaatattccggatttggctgggcgacagttcatcgttgaccacaatggtatcaacaccatcatcgatgacgacttgggtcaactcttcaatcttgcctttaccgaagtaggtggcaggatccggccggtctaatttttgaaccaaggtttcaacaaccttcatattgttagcttctgccaggttattcaattcagtcattgaatactcgaagctgctggtgttgcggttcaatccaatcgtgacaacaggagttaaagtaacttgtaaatccatgtggtgcctcctaataaattatgtgttcaagtataacacacaaatgtaaataaatagtggacaaagtgcacttcgttttcggatctgatcattgaccggtgtcgaagattaaaaatatatgcaacttttattatttgaaattcatctctgataacattgatctcattgactttcgtaagaataccggcaaatcagtcttataataatattcaaatgatattgattttaattaaattttaatttaaaatgaatgggttcacagataatacataagacagaagggaagtttcatatttatgaggactaaatcacttttaaagatcgccggtgtttctctgctcaccgcggttgtgttagctgggtgtggcagcaaatcctccgattccggggccaagaaacaatctgccaattggatggtagccgccaacattaacaccatggatgtctctaagatgactgatttgatttccagtcaaaatgttaatgcgactaatgaggggttgttgaagatgacaacgggcaatgcagttgtgcccggagttgccaagaattataccgtatccaaggatggcaagacctggacttttaacctccgtcactcgaaatggaatgatggaacaccggtaactgccaaggacttcgtgtactcatggcagcggaccgttaatcccaagacggcttcacagtatgcttatatctttaccaacatcgaaaatgccgacaaaattaacgccggtaaattatcaccatccaagctgggggctaaagccgagggtgattacaaactggtggttcatttgatcaagccacaaagttacttcaaattcatggtttctcagagttactatttccctgaagaaatttcgaaggttaaaaaatatgggtcttcatatggaactgatgctcaaaagaacggctacaatggacctttcgttttgaagggctggaacggaaccaacgatacttggaaactcgttaagaatccaaagtactggaatgccaaggcaattaagcttgataccttaaacatgcaggcgatcaaagatcctaacaccgccttgaatggttaccaaagcggcaagcttgatttcaccactttgagcggaactcaagttaaacaatacaagaacgataagaactatcatgtgtacaagcaagcctcaatctactacttggaaatgaacgagaagaagttcccgatgtttaagaatagaaatatccgtaaagccttctcacttgccatcgacaagaaacaattggccaacaaagtgctcgccgatggttcacaggcaccaaagggatttgttgccgacgatatgtcacagcgtaacggtaaggactttgctgatcagtcatacgtgaagagtgcggtggcctacaacttgaacgaagccaagaaatactgggctaaaggtttgaaggaaactggcaagaagtcggttaacctgacgttactttcagacgataccgacgttgccaaacgatcaaccgaatttgttcaaagtcagttgaccaaattgccaggtgttaagatcaccaaccaaaacgttccttataagacgcgtctgtcacgttctgccagtggccaatttgatctggtcattaccgcctggaacgctgattatcctgacccaagcaacttcttggatatcttgacttccaagaacagttacaacaatggtaaatggagcaacgccaagtatgatgctctcgttaagaaatccgaaagcactgacgccgctaacgaaagtgctcgttggaatgacatggttcaagctgaaaaagtcttgatgaacgatcaagggattgtaccactttatcaacccgcaatttcaactttgatgaagccaaagattcacggggttcaattcttcccaactgctccacagtgggattggtccaagattactgttaaataatctttaatatcatagaaaagctcaccgaattcgcggtgagctttttatgcatataaacatgtatatcgataccttgcacttctcttaatatagtgagtaagcgattgattcctgctgtgaatcggtttacgcctggagcgcatatctgacttaattggtgcgtatctctagcacagaatcatttttaccaataaatttataaaaattttgaaagtgaaagagaatcttcaaacactggtggttaagcaattaaacattcacaattaaccacccataccaattcggcaccggacaaatcgattgaatgaccagatagtgtttgcttttaatcaaattttaatttaaaataaggtcattacaaattaagtatttcatatatgagaagggaagtatcgcaacatgaaaattaattcattagcgaaactcggtggggtagcgctggttactggcctgatccttgctgggtgtggaagtaaatcttcacaaggaaccaagaagcaagaagttagttggatgacaccatctgccatttcaaccatggatacttcaaagatgattgacctgtattcagcacaagttgccaatggtaccaacgaaggacttcttcgcatggccaaagacaataaagtagacccaggggttgccaagagttacaacgtttctaaagatggaaaaacttggacattcaatctgcgtcactccaagtggaacgatggcactccggttactgcaaaggatttcgtctatgcttggcaaagaaccgttaagccaaagacggcttcacaatatgcttacatatttgccaacatcaagaacgctgctaagattaacgcaggaaaaatgtcaccttccaagttgggtgttaaggctgacggtgactacaaattcgtcgttacccttgatcaaccacaaagctacttcaagttcatggttacccaaccagaattcttcccacagaattcaaagacggttgccaaatatggtagcgattatggtaccaactcaaccaagaacagctacaacggtccatttatcttgaagggctggtcaggaaccaacgatacttggaagctcgttaagaactctaagtactgggatgctaagaaggtcaaacttgaccaagttaacttccaagctgttaagacaccttcaacttcattgaacagtttcaacagcggcaagcttgacttcaccactttgagtggaactttggcagccaacaacaagaacaacaaagattacgttgtcttcccacaagcttcaactacttacatggaattcaacactaagaagatcccagcccttcgaaacgtcaatatccgtaaagcgatgggattagcaattgacaagaagcaaatggttaacaaagttatgcaaggtggcgacattacccctaagggctttgttccagcaagtatggctaaacacaacggcaaggactttgccgatcaggcatatgtcaaagccggtactgattacaacttgaaagaagccaaagccttattcgcaaaaggtctcaaacaagttggtaagaagtcattgagcctgaccttaatgggtgcagatgatgatgataccaaacgagcaactgaatttgttcaaagtcaattaaccaaattacctggtttgaagattaccaactcaaacattccatttaagtcaaaattaaccaagatggaaaatcaacaatttgatattggtctttctgcatggattgccgattacccagatccaagcaacttcttggacttgatgacatctaacaactcatacaacgatggtaagtggtctaacaagcaatacgatgctttgatcaagaagtcagaatcaaccgatgccaacaacgaaaccgctcgttggaacgacatggttcaagctgaaaagatcttgatgaaccaacaaggattagttccactttatcaacaaggtcaagccgctttgcttaagggatctgttaagggtgttcaagccttcaccacctcaccacaatacgactggtccaaggcttacgttaagtaattattaaatgaacagttcgatgtatttgaggctggttattgaaatccggcctcttttacattattatggggtttatgaaaaaatagttacaacataattagaaatgagaggaacacttatggcaaaatacttgggaaaacgaatattctacattattctgaccttgtttatcgtcagtacgattacctttttcttgatgaaattaatgcctggtactccattgactaaccaagccaaattgacaccgacacagattcatcaaatttataaacagtatgggttggacaaacctgtctggcagcaatacctggtctacctgggtggcatcatccacggtaacttcgggacttccttccaattcagtaaccaaccggtttcatacttaatttccagtcgacttggaccatctctgatcattggtggccaaggaatggtactgggggttcttgcaggattggttgttggtgccgttggtgccatcaaagccaatacttgggttgatacttcagctaccatcatctcaatcctgttcatctcaattccttcattcgttttggccgtactattgcagtactacctgggcttgaaattgagattattcccaatcgccgactggggtgggtttatgtataccgtcctgccgaccttggcgctggccgcgtcgccattagccgaaaccgcccgattcatgcggacggaaatggtggacgtgttgagttcagattatattgaactggcaaaggccaagggactcaacaaagttggcattatttaccaccacgcactgcgaaacagtttaattccagttgtcacgattattggaccgttggccgttaacattatgaccggttcaatggttgttgaaaatatcttctcgattcccggaatcggtgaacaattcgttaagtcgattttgaccaacgattatccaaccatcatgggactgacaattgtgtatagtgcgatgctttgtgttgtgctgttgattactgatattgtttatggattaattgatccacgaatcagaattaataagtaggagggagaataataatggcagacaatgcaaaacaaacttcagctgacgattttacaccgattgccggtgccgatcgtgccaagctggacgacgaaaaaatcgcaacgccatctttaactttcttacaagactcgtggcgtcgattgcggaagaataaagcagcaatgattgctttggtgattttaatcattctctttattttagctttcttctcatttttatttgaaacacataatccaaatgcgaccaacccgaacttcgcgaacttgccgccgaagattcccggcattgatattaacgggtttaacggaaccattgatcaatccggccaacgggttaacgcttatgcgcaggctcatgccggcaaccatttctatattttaggaacggattaccttggtcgtgacctgttctcaagaatcttatatggaactcgaatttcccttgaaattgctttgattgccagtttcttcgacttggcatttggggtggtttacggcattacttcaggttggatcggcggccgagttgataccttgatgcaacgaatcatcgaaatcatgctgtcaattcctaacctggttgtgatggttctgttaatcctggtcttgaagccaggaatgaccgcaattatcctgtccattgcgattaccagttggattaacatggcccggctggtccgggcgcagacgctggaactgaagaaccaggaattcatcctggcggcccgaacgttgggtgaaagttcttggaagattgcctttaagcatttattgcccaacttgagtagtgtgatcatcattaacttgatgtttaccattccaaccgcaatcttcttcgaagccttcctgtcatacatcggaattggtatcagtgcccctcaggcatcacttggtactttgattaacgatggtcagaagaacttccagttcctgccttatcagatgtggtatccagcgatcgttctttcagtcttaatgattgcatttaatatcttgggtgatgggcttcgtgatgcccttgatccaaagagtagagagtaggtgttttgagatggaaaacgaaaaagatgttcttgaggtaagaaatctcaaaatcaacttcaatacttatgccggtactgttcaagcgattcgagatgtgagttttgatttgagaaagggtgaaaccctggcgattgttggggaatccggctcaggcaaaacggttaccacaagaagtattatgggattgaactcgcccaatgctgtgattgacagcggaacaattatgtttaagggccaagatttgttaaagaagtcccgcaaacaaatggaccagattcgtggtcgagacattgccgaaattttccaggatccaatgacatcattggacccaacaatgaaaatcggtaagcagattgccgaacctttgattattcataagggcatgaaacgtgaaaaagcttatgcccaagctttggaaatgatgaagctggttggaattgaaaatgccgaacagcggattaataattatcctcaccaattttctggtgggatgagacaacgaatcgtcattgccattgccttggtgaactaccctgagattctgattgctgatgagccaacgactgccttggatgtaaccattcaagctcagatcttggatttgatgaaagagttacaggccaagaccaacacgtcaattattttcattacccatgatttgggcgtggttgccgggatggccgatcgagttgccgttatgtatgccggcaaaattgtcgaatacggaacggttgacgagatcttctataatccaaagcatccctacacttggggcttgctgaactcgatgccgaccatggataccagtgggactgagttaccatcaattccaggaacgccacccgatttattggatccaccagttggggatgcgtttgctgcccggaataaatacgccctcaaaatcgacaccgaaaagcagccaccatttttcaaggtatctgatacccattatgcggcaacttggttactcgataaacgggcacctaaagtgacgccacctgaaccaatcatcgaacgtcagaagcactacgccgaacttgttcatcaagaaattaacaagagcaagggaaatcatgttgaagaacaggaggagcaactgtgattgattattcagaagaaaacaaaatattacaggttgaacacctaaaacaatacttcaacattggtaagccaaatgaagttcgtgccgttgatgacattacttttgatgtctatcgcggtgaaacctttggtctggttggtgagtccggttctggtaaaaccaccacgggtcgggcaatcatccatttatatgaaccgacatccgggaagattgtctttgacggccaggacgtttccaagctcaattccaagaagcaaaagcaaacattccgtcgggacatgcagatgatctttcaagatccctatgcctcacttaatccccggatgaaagttaaggatattgtggctgaaggaattgatattaatcatttagccaaagatgatgcggaccgttccaagcaggttgaagatttgctggagaccgttggtttgaacaaagaccactccagccgttatcctcatgaattttccggtggccagcgacaacgaatcgggattgccagagcgctcgccgttcaaccgcaattcatcattgccgacgaaccgatttctgctttggatgtttccattcaggctcaagtggttaatttgctgaagaaattgcagcgtgaacggaacctgacttacctgtttatcgcccatgacctttcaatggttaagtacatttccgatcgaatcggcgttatgcactatggcagaatgctggaaattgccagttctgatgagatttatgcgcatccactacatgactatacagccagcctcttgtccgctgtgccggtacccgatccagagtatgaacgggcccgagttcaaattccttacgatgccagccaggaatttgacggcaaggaacgttcattagttgaaattgtgccgcatcactgggttcgtgccagtgaggatgaaattccaatgtatcaaaagcgtgctcaggaagattccaggttaaaacagtaatttaccgataacaaataacggtttctcagatgacgtgtcttcaaatcatctgagaaaccgtttttgattgcttcagttatcagctttagattgcttaagatcaatcaagtcgcgtaagtcggtacagtgctgcaatgcttcttgatattgacttttggtctttggatcaacaacgttggaacccggggcgaagtgaattgattcggtaccagcctccacggatgttttgtagtaccattttttatagcgcaggaaagcgagctgcgacttcatccgatcgatgcttgactgcagggcagcttcttcttgatccaaatagtcatagcgttgcttcaaggtgccgtccccctgcatgcacagactgatgaaatggccgatatctttgatcggaacgccactttgttttaaacagtcgatgacttccaggaaattcaaatcatttggtttgaattttcgtctgccggcgtcatccctctctacgaagggcaacagccccttgcggtcgtaaaagcgaattgccgacgtgctgattcccatgatttttgccacatctccaatagaatacatatggatacctctttccaatattttgacttgacttaaaccttggttaaagttgtagcatgaatgtgtaatctaatcaaacaaggagaggaatttaatgacaaataaaacatggtttgtaaccggcacttcaaccggatttggtcactcattggctgcttacttggcacaacaagaaaatgttaatctcgtcgcaactgccagacatactgatcagttaggctataaggagtggatttgaagtgactgaattagaaaaactagatgcgggtgaaccttactatttcttagatgatgaggttgctgccagaaaggccagggccgccaagctatgccaggaatttaattcaattccggcaactgaacccgataagcagacagctaaaattaagcagatttttgggaagactggtgagcgggtgtccgttcaggcaacctttaattgtgataacggcaaaaatatctcggtcggagaagattttttgagtaactataatctcaccatcttggatatcgcaccagtcacaatggggcataatgtcatgatcggccccaacgtcgatatctatacggtcaatcacccggttgatgcccttcagcggcgaaagtatatggctcaggggttcccggtcaagattggcaacgatgtttggattggtggcaaggcatcgattatgcccggcgtcacgattggcagtaacgttgtgattgccggtggcgctgtggtcaccaatgatgttccggataacgcaatggttggcggcgttccggcaaaattgattaaaaagctgccgccaattaacaaagattaattattttacgactcattggttatcaaaatgtgaaaggcgcttgccttaaagtgcacttcaaggtttatcatcagttagtaatgaggtgagctgatgaaaattaacgaagtttctaaaaagtttagcgttgccgccgacacgctccgatactgggaacgggttggtgcgattcctgctgtttccagagatcaagccggttatcgaaactatgatcaagaagatctgaactgggtctcttttgccatgtgtatgagagacgccggtgtcagtgttgaatatttgattgactatatttctctgtttaagcagggcaagcagactgttcaggcacgcaaagatcttttgaacgaacagctggcatccgtcagtgaacgcctggctaaaatgcaggcgtcctatgataaattgaaatacaaagttgatcattatgaacatattgataaagattaccaaggtaaaatggccagcacgcattaacagtgcgtctggtccgacaaaaaagtacccattcccaattaaggagtgggtactttttgaatttttaaaactaaattagatggtcattgctatccgccatagctattggaaacaactgcccagtcaccggttgttgcgtccatctgttccaaagcaccgctggcggtgaccctaaagctggcgacttgtggattagtgccggtatcaacgccactcttcttaaatgcctgagagttgtgattctccaaaacgttgacgtacagttgaccgtttctcatctgcggcatgtaggtaaagtcggttgaatcgacggccatatttggatatttggctttcacgtagggccaaatccaattgaccacctgttgatcagtgaggtggttggtggacggcgctgcttgattggcagtcgagccgctggtcgttgatggggactgcgaactggccgtctgtgaaccagtggttggttcagtagtggctgatttgctcatggtcaaactgcccgaggtcagcccattcacttcaatttgattgttactttggacactgatgttataaacgattggcgtttggtcattgccgtaggcttttaagacgtaagtgtcatcgccggtttgcttgtaggaaacgttgctggctttagcaatcgtgtctgaattataaagccggtggttggtgtcatattcattggtgaagctactgatagcggagctggtgatgttcaaaaattgtttggtataaggcagcttttgcgcatcgctgcctgaattgttagcgaagtcggttgcccaagttccctggacggcctgtggggcacctgtctgccaatcagtgtcagtattggcgtctgccaagatgaaattgctgttgacatgatggtagctggcattgacggtataagcctggtggccgccgttaagccaattgaatttaagggtgtaagacttgcgctggttgctgaccatggaaaaattataaacatctttttgatcagtggcgctaagtgatttgattttactgttatcaatggtcccgtcttgtttggaagatagtttccagtaccactggcccttactcttataaaattgggaataaagctggtcattggtcgttgcctgcgaatcttccgggaccttggcggttgccggtgacaacaagtgatttaatttggttgcgttgggattggccgtcgttttatcctgcatgtcggcttttttgttcccacagccggtgagaagcaaaataccggtgagtccgatgattgcggctggcaaaatttttttcatgatgtgaaccccctgtcgcccttattataacagaccacgagtggggggaatggtcatattttcttcaaatttatgtggtttactaggattaggagatgattgataaattatttactgaacacccgtacatagcagcctggttggtacttgaactgatttttgtcctgtcactttttggctggacgtgggccagctcagcaacgattgccgacttaatggtaccgaacttcgtgattccaagtgttgcttgtacggccattagtttgttgacctggaaaacgaagcattgaggtgtatgattttaagtagacataagacaatggagtggtgattaatgacgttaaagcagcatcaagattggctggtcgatttttacaagcgacgagattggtacaaatactcgccgttcattcgactgaattttttaactgaagaagtcggtgaattgtcccgggcaatccgggcaattgaaatcggccgcgatcatccaggtgaacatgataccagggatgaacgcaattataatctgcatgaagaattagctgatgtgatggaccaggtcctgattctttgtgacaaatatcaggttgatccggatagtttgatggcgtttagtgaggctaagttgaagaagcggttcaacgaacaataggggctggtttgacagctgaggagactgattcaatccagtctaataatataaaacagccgtgagcagaatgttgctcgcggctgtttgggcttcttctataaatcttcactcacattattaaagtactcaaccgaataactcttgccgtcccagttgaccttggtgacactcccgttcttagttgacacatcgactggaatgtcactaaatttggcaaccacattccggatcagtgtcccatgggtggccaacaaaatcttgtcaccatcatcggcatcggccactacctgatcaatggctggtttaagccgtttccagaacgtttcaccgctttcggcatctttgtacggatcagccgctgcaatcatgtcctcggccttttcaataccaaattcggcaattaagccatgaaacgagttgattccgatggggccgccaatggtgtgccaggttttgacgtcatcttcgccctcgtagtagccaaagttcagttcacgaaaggcaccggttggtactggatctttgattgctgccgggttttctttcaagatcaattggccggtcttgattgccctggaagtatcactgctgtacgccgcatcaaatttgatttgtgaaagccgcttgccggctgccactgcgtcggcaattcccttgtcggttaagggtgagtcgatcactccttggatacggtgatatttgtttaagtatgtttgaccatgtctaacaaaatatagtgagatcgtcatgtgtgtcctcctaagtatacaattatttaaaacatctcaattataccatattgtatcggtcgaatggcaagtataccaattaacaatgtcaggccatttaagttaccgttaagccagaaacgataatgtcttttgaattggtaccgtttttatgctaaactattaagtcaagttatagggggtaaataatggcagataatatcaaaacacaagaacaacaccatttggaccacgtcattgatgaaatccatatttcccaaaaggaccttgagcaaaagattaaggcaaccaagcgggatgttaaagatatcaaccgcaatttcaacaatgacgttcggctcaaaactgagacgtacagcgggatgatggaaactgccatgtccattcggcagcaacagcaaatgctttctgaacgtgaaaatcgccaggaacatgccgcccgagaacttgggacgctcaacaagcttgagcagaacccctatttcgcacggattgactttcgtgaaggggacgaaaaacgagacgagaccatctatattggcatggcatcgtttaccgaccggcctgaccactacctgatctatgactggcgggcaccgatttctagcatttactataacggtggaatcggcaatgtcagttacatgacgcccgacggtgaacagaccgttgatgtcaaattaaagcgccaattccaaattgaaaattcgaagatcaagacggtgtttgataccgaagaagtcgtgggtgaccagatgcttctggatgccttgagcaatcgttcagacaccaagatgaagagtatcgtgaccaccattcaaaaagaacagaaccagattattcgggataccgattctgatttactgtttgtccaaggctcagctggttccggaaagacggccgccgttctgcagcgggtggcctttctcctgtaccaataccgcgggaatctccattccggccaaattattttattttcaccaaaccaactgtttaatgactatattaaccaggtgctccctgaactgggcgagcagaacatggttcagatgacgttctatcagtacagctcacaccgtttgccgagtgttcaagttgagaccctgtctgagcgcttcactgagcaactggacaagactgcccagaagctgactgacgtcaaaggcagcttggattatttccgagcagtcagtgcttacgccaaccatttgaacaaggaagacatgcgctttagaaacctgatgtttaacggcgaaatcctgattccaaaagaaaaaatcgccgaaatctattatggtttcaatgagaactacaacctccgcaaccgactggagtcaaccaaggaagaattgatgaagattcttaaccgcaagattcacgtcgaaatgcggaaaaagtgggttgaagatgcggttcaaaacctatctaaagaagaaattcaacagttccatgccgaaggtgaagaagaaattctcaatgccgataaggaattcaagttcctggcccgacggattgttatcaagtcatttcgaaaagtccagcggcaaatttctcgcaaccactggttgagtatcaataaccagtttgttcatatgcttaaagagatgccaaagatcctcaatctggctgattttggcatttctaacgagttgtgggccgaagagatcaaagccaccgtcggccgtttgaagaagggcagattgtcgttagctgatgcgtcatcgtacatttacttgtatgacttgatgactggtaaacgcggcgataaagatattcgttatctctttattgatgaggtgcaggattattcagcctttcaattggcattcttgaaattcagtttcccaagggcacgattcacgctgctgggtgatttgaaccaggcgattttcacccatgaaaacagccgtaaattgttgggcgaacttggcagcatgttccccgaggataagacccgcgtggttcaattgaccaagtcgtaccgatcaacagaacagattaccaactttaccaagcacctgttgaccaatggtgagaatatcattccattcaaccgtcaaggcgacctgccgcacatttacgtcaaggacggggtcgatgctgcagttgagcaggttaaacagcagtccgagttgaacttggccgaccatgaaacaacggccatcattggcaagacactgaaagaatgtcaagagctaagcggcaaactcgctgaactgggtgtcaagtcaacattgattcgaactgaaaatcagcgtttggtgaagggcatcattgtcgtgccttcataccttgccaaagggttggaattcgacagtgtgattatgtgggatgcttcgacggcctgctacccggacgagagtgatcgccaactggtctacacgatttgtacccgggcaatgcatcgattgacggttgtggcagtcaaatcgttgtcaccaatttttgagacggtgcctcaagatgaatatgaattgaattaagcatgagtcggatcgaaatggtccgattttttattacctaatttatgtcggctggcagacttcaagtgaaaacatatctctggttctcggggcagtctgaaaatgttatacttatttggttgagtaaagaataagcggagaaaatgcatggatgatttaataaactattattcattcaccaaagatgagtggaaacattttaataatgacaatgaagtcgatttgccgttgacgtccaacgaactgcggcacattaaggccttcaatgatcaaatctcgctgcaggatgtcgctgacatctacaaaccgttggtgcacatgattcgcctgcagaaaaacaactttgatcaatggcagaccaccaaggctcggttcctgcgcaaaaaggtgcgaaccgtgccgtttattattggaatctccggaagtgtcgcggttggcaaatcaaccacggcccgggtgcttgaggaactgctttccaactattttaccggcgagacgattaagttgattacgaccgatgggtttctctattcgaatgctgagctgaagcagcgcggcatttatgacaagaaggggttccctgagagttacgacatgcgcaagttaatcgcatttttgaacgaggtcaagtcgggagtgccggtcactaaatcaccggtgtattcgcatcaaagttatgacatcattcccaaccgctttgagttggtcgatcgcccggacgtgctcatcattgaaggaatcaatacgttgcagttacccagcaacgagcagatttatgtcagcgacttcactgacttttcgatttatatggatgctgacgtccatttgattgagaagtggtacttggaacgattcggccgcttgatggacacggccttccaagatcccgacaactattactatgattacgcgcaaggggatcgtgaggaggcctttgatatggcccgcagagtgtgggacaccatcgacctgcccaacctgcgagcaaatatcctgccaactcgctcgcgagctgatatgataatgcacaagacggacaatcatttgatcgatcgattgtacctgagaaaatattaatgtttggattttcagaataatgttgaccaaacctaggtgaatcgtttattatttatgtaagaactttgaaagggtgtatgatttggcaaacgttgacttatcaagcttcgataagattttagtgctggatttcggtagtcagtataaccaactgattacaagacggatccgtgacttaggcgtatattctgagcttaagtcccacgcattgtccgcaaaacagatcaaagacatgaaccccaagggaattgttttctccgggggtccaaatagtgtgtacgaagatggcgctttgaaggttgacccagacatcttcaagctgggaattccaatcttgggaatttgttatggcatgcagattatggcatatacccttaatggtgaagtcgagaaggcttccaattccgagtacggtcatgctgatattcagattacttctgatgatgcagttctcttcaagggaaccccacgtgagcaaccagtctggatgagtcatggggacttggttaacgaagttcctgaaggctttgagacagttgccaccagtcgtgactgcccaatttctgctatgcaggatgttgagcgtaatttgtatgggattcagttccatgctgaagttagaaataccaagtatggtaacgacatcttgaagaactttgctttcaacgtctgccatgcagaggctaactggtcaatggatgatttcattgatctccagattcaacatatcagagaagaagttggcgacaagaaagtactgctgggtctctctggtggagttgattcaagtgttgttggtgttctcttgcacaaagcaattggtaagcaactgaccagtatttttgttgaccacggcttgttacgcaagaacgaagctgaccaggtcatggatagtttggtcggtaaattcggcttgaacattatcaaagtggacgctcaggaccgcttcctttccaagttgaagggtgtcacagatcctgaaaagaaacgcaagattattggtaacgagttcatccaagtgtttaacgatgaggccagcaagcttcatggcattgatttcttggctcaaggcacgttgtacactgacgtggttgagagtggaactgatactgctcagacaatcaagtctcaccataacgttggtggcctgccagaagacatgaagtttaagctgatcgaacctttgaacacgttgttcaaggatgaagcccgggcaattggtgaaaagctgggaatgccagaaacgcttgtttggcgccagccgttcccaggaccaggtctcggcattcgtgtgcttggtgaagtgactcctgagaagctgaagattgttcgcgatagtgattgggtcctgcgggatgagattgctaaagctggtttagaccgcgatatttggcaatacttcaccgttttaccaggctttaagagtgttggtgtcatgggtgatggtcgaacttacgattacaccgttgccatccgagcagtgaactctgttgacggaatgaccgctgactttgcacggatcccatgggatgttctgcaaaatgtctccactcggatcgtaaacgaagttgatggcattaaccgcgtagtgtatgacattacgagcaagccaccggcaacgattgaatgggaataacaaattaattgatattatgaaagtccaaaatcagatcttgattttggactttttatattttctgtgattttcatgatttcagcctaaacaatgaaaagtgggactgccaaccgcaccccattaatggtagaatgaaaatcacatatcaagattgaggtgcgaaatgaattcaatttggaattattggcgaaaactaaatattaaatcgaccgaattaattggggtagcagtcggggcgttcatctattcgatgacctataattatctgctgttgccttctcaccttggtgaaggtggagcgatgggaatcacagcactgttatactatgcctttggggtgccgtcgtacttgtcaaacctcctcatcaatgccgtgttaattgtgattggctacaagttgtttgaaaagaaaaccacttatctgacaatttgggcgattgcctggatgacggtctttctcaagattccggtgttttatacatatcacacccatgagttaattgtgccgacgctgttagccggcgccttaaccggcatctcaattggtttaattttccgcttcaacggcacaattgccggggatacgattattggtaagattctcaactacttttttggcatctcactgggtaccgggagtttgatattcgacctgttcattgtggttccgtttatcatgattattgggttcaccaataccgttttaacggtgatctacctctacgtttactccgtgttcactaatcagtttttggcgaatattggtgctaaaaaggccgttctggtggtttcaccaaagtaccggcaaattgcggtgaccatttccaaagaattaaatcaggaaatgacgatttttaatggcaccggctattatagtgatgccgatcagcacatgttgtacatgattgctggtccccggcgggtcaccaaattggtaccgatcatcgaaagtgaagataagaatgcgttaattgtgattgaaaacatccgcagtgcccgggggttggatatgcgtcggatcctttagcagtcttcgcgaaataaggcccacaaaatcagcaaatgattttgtgggccttttctgaaccaatgatccaattttacaactgagacttatgaaacccattttccatcttcgaaagtggtttgacgaacacccgccgcaatggcgccattaggagaaagaatccgccaaacgctgccaggatcagcattgcgtgccaatagacgcttggaatcggtccggcaatggcctctctgaaggcttggatgacgtaggtaaatggcaggaacggtgccaagcttgccaaatgggaaggaatcagttcaagtggatacacaccaccggttccaaatagttgagcaatcatcatcaagacactaaagactttgccaatattgccaaacatatagaccaacgtgaacatgatgatggtgaaaacggtcgttgccagataggcggttgccaacattgccaacaagctccgtggccgcagtccaatgatgaccagttcaccgagcatgatgaaggtggtttgggtaaatgacagaattagatacagaaggcctttaccaacgtattgctgaatccggttggcttttgggaaccgtttgtcttctggaatcaggtatttccacgagacaatcgtggtgaggagtaagacgcccacccacattgataagactgtgtaaaagggtgccatgccgtagccgaagaggcccatgttatacagctgcttttgtttcaaggtaattggggatgccagcaaatttgaaatcttgggattttcacccaataagttaatgattttattcaaattcttttcgttgatgaatttggtttggtcatttaagtcgttcagtttatcttcaatgccgtttaagcgatgtttaattcggttgacctgggaaactgaaattttactgattgcttttccagacgaagttaacgcatttagttgtggtaacagggttcttaaggatgacagcacttcatcattgccattcaactgggtgtccaaggtatcgttgaggtcgtcgatcgcctgactgaccgtgttggtgaacgtggatcccgcgttagtcagactattacccaaagcgtcggtcgtttttgcaagctgcttaatcagttgattaattgatttttgcgatcgattggcttggttagcgtttttcaggctggtcaaattacgctgctgatcatggatgcgctgtttggcattgctgaggcttctgatcagtgaagtcgtctgattgtttggcagtaggttattcaacacgtcggcgattcgcagggcattattgatgccggtaagcgtcgagtcattcagtgttttcagttgattaatttcactgtttaacagcgacttacttgaagcgtgtccgccagtctgcaggtcatcgaccaatgagttgatgcggttattatctgactgaaggtcatttaatccgtttgataaatcattttgcgctgaactgagagattgtttggtggccttggttaagttgcgaccatgattgacaacattttgcagatcggttatctgacgggaaattttcgggatgtctccctggaccgttttgagatattgctgcacattgtctgagtccttatttgccttatccaggtaaccattggttttcttcaccgtgttgatggcgtccaacaaagaagaacgaatttggagaatctccggtttgtgggtgttaatcttggctccggcggcattcatttcttttaaggcggctttggtactgattttgatgaaactgtcccgcacctgctcggttaacgtgtcgacagcctggccggtaattttggttgcggccgggtttaatttttcgttggacttataaataatattgggcttctcaggattggtggaaaccagtgtggccaacttgctggaaaagtcattgggaatttcaatgagcgagtaatactttccttcatccaaaccattgtttccctgccagtcattggtcatgatccagttgatggcgtggttttgtttgagttcgccgacgatttgtttgccgacattcagctgcttgccattgaccgtgctgccctcatcgtcattcaccacggcgatcggcagtcgactggtattggccttggaatacgggtcccaagagaccatgatgttggggaccgcataaatggccggaatcagacaaaaagccagcagggttatccacaccggccggctatgaaatatattgtgtaagtcacgtttgagtaaggttaatattgttcgcataaatgggtccttttaattgattcgatcaagcagtccttgggcgagcgcaaatacgcggttgttcaggttatgaatgaccacgatcttgggatacagtttgttgatcccctcactaaacaagtaattgagtgtttgaccatcggatttgatcatttcaaagatttgattgagtttggcaatgtctggatcattttgaattgattcgatccagctatttaactgggttagcaagtcgggcagggtgctttgatgattcatcaggttgagaattgaaatcagctggtccttattattggtggacaatgtgtcaatcaagccgataatctgatttagttgttgtcgctgacgagtcacattgatcattcttaccagatgaccacgccagatccagccggcgaccttaccgttaccattttggacatagtaatagactgccttgttgccgttagcccgttggatatttgccgatttagaagcgtaaaaagtggttaaaggataattgtcggcgttatggaccttcttggttaatttggccgaactgtacagataaccactgactgcacggtagggtgccgtggttaaagtctgggtgctggtgaccttggccgctgtggttttcgctgacgcggtggttggttgaatagcaaatagcgcccctaagatggtcagtgatagtatccatttaataactgaatgtttcataatattatagctccctcataaaagtaggttaatgttgttaactatagttaccattgttaatcattcgcatacgcgttattatcagtataatgcatttttcgacagaaacaagtagcaaggaaatttgagggatggaacaatgtttaaaaatatcaaactgatttaccaacgggacctcaaggcaatttttaagtacaaagcagcgttattgacgattagtgcgctttgtattttgccctgtctctatacgttggtcaacgtcaaagccatttggaacccgtatacttcccacgaggtccaaaaaattccggttgccgtcgtcaataacgatcaaggcacaacggttcaaggtaaacagatgaatttgggcaagcagatcattgcccagttaaaacacaataatcagatcggctggcggtttgttgattcaaagactgcccaaaagaaagttcgcgctggaaagtattacgccgaaatcaaaattcccaagaccttttcggctgatttgggcagtattgtgactgccaatccgaagaaggcccacatcgactatatcgctgacaccaaggccagtccaatgagttacaaaattaccgaagccgcctcaaagacgctgttgaacacgatcaaaaaacaattcgtataccaagttaacagcaccatttttacctatttgaatgtggctggtaaaaaggctggtgacaatgaatccgagattctcaatttaaaggacctgattatcaatcttggagacagtatggaactggcaaccaataccttaggagatatcagtgaagcctccagtgggctggccatggtcttttctgaactgaagccggtgatttcagcatctcaggatatcagtattaaccaagcgattggctcgtcgaaccagcagttgattcggagtgtgaatcaggccgttaaccaatcgtttggcaacgttcaaaccagcttgaatgggattcaaactgacgccgcacgactgcggtccctcaccaatcagttgaacaagcagacttctgcggccggccgtaatcaggccactggtttggctagtcaaattttgtcgcagattaagttactaagagggcagatcacgccattaattgcttatctgcagacgattaatcaatcgcagcggttgagtggggtgagtcggttaatcagccaactcaatgacgtcaagaatctgctggatgcccagtctcagcaagtcacccaactacagcgggcgcttagttcaggcagtacggccaataccggcctgcagcagcgaattgccagtcattcctattcagttgccagcggcctgaatcattcactggcgagttataatcgcaacgttaaatcagaattgaacgggattcaacgcaacctgctgtcagccagcaatcacgcttcgggtgtcttgaacaatgttaatgacattcgcagcttgaacgaaaagtcgttggatacgattatttcaggcaatcaactggtcagtgactccaccggcgacttggagaaccagctgcttcagtataagggcgtgattttgcaggcaagtaatcagttgaaattgacttcagacgataatattgccaacattatcagcatcctccagaacaatcccaagttgatgggcaacgcactggcccaaccatttaacgtcaaaaatgagaacatttatcgggtcagttcatttggtgaggcgtttgcaccaacttacatggccctatcgatttgggtagggtgtgcgatgctggtcgcagttctgcacacctcggcgcccaaatatcatcgtttcaaaaatttgcggccgcgtgaagaatatattggcaagatgctgctgtttaacaccttgtcgatgattcaaacgatggtgattgtcctttcgaccgtctttattctcagggttcacgtggaaagtttgttcctaatggtgatgatcggcgtggtgtcatcactgacgttctcggtaatcgtttatacgatggcgtcggtgtttggtaacttaggaaaggcgttggcagtgatgatggtcgcctttcagttggccggaagtggggcaatttatccgattcaattgaatccgttgttcatgagaatcattcagccgattttgccattttcgtacagtgtcagtggctttcgggaggccgttggaggacccaatgttggtaccgtggttctcgacttcttcgtgctcatctgtatgctgattgcgggcttgatcgtcggcctgttcatgaaagacttctttaaacgggtcaccgcccgtctgctcaatgattttacgaagagtgggattggacaaccttaaatccaaattgaaaaggatggccaccaagcacaatgcctggtggccatccttttcaactgatctattaattatgcaaatgaggtggcaacactaccaacaacaatcaacaggatacccgcaatggtaaagatcatttcccggcgactcttgtgttcgtgaagaattgtaattccgccaaaagtggcaatgatgacacttaattgcgtccagatgaatgcggaggtgtttccgtttgcctgagcagagtaaatgtaggaaagcgcagcgactccccaaagtaatccggcgatgatgttgaggtattgttctttttgtttaaatgattgacggtcggtgaacaaaccgaaaataacggcaccaattaaaatgcccatcatttctggcaggaaaacggaagtgccgctttgtgccttaatgattggaatgttagggaatgacgaatagatccagtaaccaacggtggtgcaaagtaagaacgtggcgtccttaaaggtgattttgccgcctttttcgtcactgacagacgttaacaacgctccggcaatcacaataatcaaggcgataaaaccaatgattttggattgagttccctgccagtcaccaaagatcaatacgccaagaatcgagttaccaactaattgaaacaccgtggataatgggtaggtgttagacacgccgattcgtttgaaggatataaattggccgatttgaccaatcgtccacaaagcaccgcaaacgattgcaaaaagaaacgcagtcatgttgacggccggtcgggtcaccaagaagacaattaatccgatgatggtcgtcccggcaccaattccaaagatttggttggcgggggatccgccgacttttccggttatcagtggcattaacccccaaccaagggcgggaagtaacgcaataagtaaattcataatcaaaactctcctcaattttaagtaataatgtaatactataccttatgaaagaaattttctatcaaaacggttacaaagtttagaaaatcgtaaaattatctaaaaataaagagaaataagatcaattgaatgattttatttctctttatgtaaaacattttcaagataattggattagtggcgattcttgtatggctgaacttgtgagtgctgataaagcagataaacgccataaacggcagcgactatcaggccaactaccagcagtttggacaagatcagaaacccaattgccagtattatcagccaagccgaggccttaatgaacagccaactgacatttagaaccaaataccccactaaaaaaagcatgagtaacataaagatcattgtccaaactcctttctgcatagcgattaagtctgacttatttacgtttaatttaccatattgaagggaagatgcaactggatttaccgacaatttatgatttcatttgtctgtatcgaccattcaattgaaggggtagaacattggtgacggtactaatcattccccaaagttttaaaattatgcttcaaagtcggccaaacccagtgatcggcggtttgaataatcaagccattgaaaagaatcgaaaagatcgttccgacgttgacggcatacaaattgtgggtcaccgcaaaggaaatcaccatcgcgataattggtggaacaaaatcgaccagctgggcagccacggcactttttttcaaatacataaaccgcaaaatattggtggtatcatcatttggatgcatgagaatatttgcccgctgatacagtgagatggccgtacagaagaagataatccccaaacatgataggatgccccgaatcacaattggtaactggccgatcccaatttggtcaaaaagttgggcaaagatattcacgaaataactaaaaaagcagacatagaggatttccccgacgaaccgtggccaatccggatgtcgcagcaggacttggttggtgaccgtgttcaaaaaaccgataaaaaacaggataatgccaacattcaaattgaaccagtgactgtagttaacagcagaagcagtccaaacggcacttcccatgttggctgaaatggtcagcgcattgccaaaggcgtttaaaatcagtcccgagatcaggccgacccaacgctgagattttgtgttttggatgacgattccccctagaataatgaatttcgcatcaattggtgctgattgttcaatcaccagcacgtcagaattcaagtatacgagtaatcaagccatccgacaagcctccctcagacaaagagtaatgctgataagggtggaacaatttcctcgatagccagctcgtttggtgacatttccttactatcaattaactgaaagtaatcgataatggcggaaaagaccaaattggtgagatacatgagtggtagttggcggacagttccttgatgctgccaatccttcagccactgaaaaatggcaataaaaatttgatcatcgctgacttttggaatcagttgccgtaaagtggtgctctgccgaatcgaccaaataacgtcgagtgattccttgttggtcctatggaattcatcgagtgttgaaaccaaattcctaagcgcatccgtgggtggcagggagagatcaatgcgatcgactaaaaattgaatgtactttttctggtggtaccgaaagaccgacaccagcaaatcatctttatttttaaagtacacatagatattcgactgtgccatttgaatgtgtttggcgactttggtggtcgaaaaggcggccaacccctctgtcagtaaaatggcagtcgcaccctgaataatccgattatattgttctgtcgttttaattttcatatcttcattatattggaaagtgctggcattgcaaccttgacaaacgataagactatcgctattatacacagtaagtattaacgatagaactatcgtttatgaaacggaggtctttttgatgaaaaaagttgcgattgtgacgggcgcgtcgtccgggattggcctggctgctgccaaactgcttttgaagcagggttattacgtggttggcggtgcgcgacacgttgaacaaatgaaggtgctgactgaactcggcggaaaggttcatgaattggatgtcaccaaagagtcaagcttaaaagcctttgtggcctttgtcttggattcatatggcagagttgatctgttggttaattctgcaggctacggttcatttggcgcgctggaagaagtgacaatcgaggaagccaaacaccaaatggacgtcaatttattcgggttggttcgactaattcaattggtcttaccgacgatgagaacccaaaagtctggtcgaattattaatatttcttctctggcgggtttgatgtatacccaactgggcggctggtatcatatttccaaacacgcattggaaaccatgtcggatattttgcggttggaagttaaaccttttggagtggatgtggttgtggttgaaccaggcaatacagcaaccggctggcaaaaaattgccgttggtaaactgttggcggctactccaatccattctccataccgacgggtggccgagcgtttagcgaagacattaaaggacagtcgggcaactaccaacgatgtggcagcagtgattgtcaaagcggccatgacgcgcaaaccgaagttacgctatcagataagatttcaagaacaagtgacggccaaattgttgaaattgattcccgatcggattcaagatcgactggtcacgcggatgttcagctaaaaatcaatgttttgccattcgagccgcataagcgttgccagagtcgtataatataattaacaaattttcaaggaggcaactcatggcagaacaattaacccatttctacgaaaaatttcaaccaagtcattacaatatctatctggacatcaatcgggacacgaagcagttctcggggacttccacgattacaggtgatgcgaagacgacagcaatttcgattcaccaaaagtttctcaatattgaatcggtccaagctgacggcaaggccgtttcatttagcaaggacgacgatcaggaagcaatcaatattgatttgccgacaaccggtgtggtgaccttagcgattcaatttagtgccaaattgactgacacgatgatgggcatttatccatcttattatgaagttgacggcgttaagaagcagctgatcggaacccagtttgagaccaccgctgcccggcaggcctttccatgtgtcgatgaacccgaagccaaagccacctttgatttagccattaagtttgacgagcatgccggcgagacgatcatcagcaatatgccggaagtccgcacagaaaatggtgttcactattttgatacgaccatgaggatgtcgacttatctgatcgcctttggatttggtgagatgcagaaaaaggaaacgaccaccaagagcggtgttaaagttggtgtgtttgctaccaaggcgcacaaggccgatgagcttgattttgccttggatatcgccaaacggtcaattgagttttatgaagacttttaccagacaccgtacccattgccacactcatggcagctggctcttccagacttctctgccggtgccatggagaactggggcttggtaacgtatcgtgaagcctacctgctcttggatcccaagaacacctcatttgaaatgaaacagctggttgccaccgtaattgcccacgaattggcccatcagtggtttggtgatctggtgacgatgaagtggtgggatgatctgtggttgaacgaaagttttgccaacatgatggaatatgttgcaatcgatgcgatcgagcctgattggcatatttgggaggtcttccaaacttctgaggccccggctgccctccaacgagacgctaccgatggtgttcagtcggttcacgtccaagttgaaaacccggccgagatcgattcaatttttgactcggcaatcgtgtatgccaagggtgccagaatgttagtaatggcccgagctttggttggcgacaaggccttgcgggaaggcttgaagaattattttgccgcccacaagttccataacgctaccggtgccgatttatggtcggctttgggcgacgcgtccggcatgaacgttggtgccatcatgaactcgtggctggagcagcctggatatccagttgtgacggccaaagtccaaaacggccagttgatcttgtcacaacaacaattctttatcggtgccggcaaggatgtcgaccgcaagtggcagattccgcttaacagcaattacgacgccgtgcctgaaatcatggctgataaaacattcacagtcggtgattatcagcagttgcgtcaagaaaacggcaaaccattcttcttgaacgttgggaacaattcacatttcattattcaatatgatgaaaccttaatggcagatattcttgatcatgtgggtgatctggacgcaatttctcagctccagattctccaagacctccgtttgttagctgatggtcgtcaaaattcctatgctaatattgtgccgttgctgccaaaatttgcggacagccattccaacattgtcaatgcggcaatgtatcgggttgccaacaatttgaagaaatttgtgactcctaaatctaatgaagaaaaagcactcaagcaattcttcgatcgactgagtgctgcccaacttgaccgattgggctttgcccccaaggctgatgagtcaaatgatgatcaactgacgcgaccttatattttaagtgcttcattgtatgctgaaaacgctgatgccatggctgctgctcatacattgtttaaacaaaacgagggcaatctggcaggcttatctgctgatatccgggtgtttgtccttcgaaatgaggttaagaactttggcagtcaagccttatttgacaaattattggctgcttaccggcaaactgccgatgccagttacaagcaagacatttgcgctgctttgacgagtaccactgacccggatttgattgccaagttggttggtcaatttgagaatgccgacaccatcaaaccgcaagacttgcgggcttggttccgcggggtcctcgctaatgatgacggtcaacaagccgcatgggactggattcgaaaagactggcagtggctcgaagatacggttggtggggatatggaatttgccacctacattaccgttatttcaggtatcttccacacaccgcaacggttggctgaattcaaagaattctttgaaccaaagatcccaacacctggtttgactcgcgaaatcaagatggatattagtgtcatcgatagtcgggttcaactggttcaagccgaaaaagctgacgttaatgcggcagtttcacgagctgttaaataagttttcaattatcttgagggttccatcgagctgatggaacccttttgttatcggctgatgccgattcggctacgcattccgatttattcattgacggttgtcggagtgatattttttcagttatgttacacatttataacattcttgaaaagaagtaatcgctgaggcttcatggcgcgactcagctctgtaatattctttttgcttactgctggccttcttgtgctcaaacccattctgtcatatgttggtagagaaattgacgacaactgtttagctaattgaatttagcgtaagcaaataaataaatgcggagtggttttaaatgagttcattgaggaaaaagggacgggcgatcatcctatcgattttgaccgttatcttatcggtttcgatttttggggcagttaaggcatcggctgccacaactgtcattccagatatttcagagtggcaggggaaattaacggcttcgaaagtttcaaacttgaagagtcaggtttccttcattattaaccgccggcaatatggcgctaactatcaagacaagtacgcaaccaataacaccaatttatacgtccaatatggcattccatttggtgaatatgattacgctaccttcaccagtgcggccagtgcccgtaatgaggccaacgtcttctaccaaaattccaacaagaacgctaaattctacgttttggactacgaagaaaatgacgtgacttcaggttcaagcaatgctgctgttaaggcctggtacgatcaaatgcgttcattaaccggtaagaaattaatcttttattcctaccagtcctttgcgacggctcatgccaatactgccagaaagaattttgatgcccaatggattgccaattattcttcacggccaaccattcaaaccgatttgtggcagtacactaataagaagtacgttcccgcattgaaagaatcagttgacgccagcacaatcctgaattccagcaagccaattacttggtggatcggcggagctcaatcagctgatactgcgcaaccaacttatttcaccgacgttgtcagcagcgtcacgaccactcaaaaactgtacctgtatgattcaaccagctttaagaaagccaaccgggttgttaaagttcagccgggaaccaaagttaacgtgacggcaattcacaaacgagacagtggttcatactattttgaaaccgccgacggccgctacttaactgccaataagaattacgtacaataattcacgcaaacaatttggagggaaacgatgaagctctataaattaggtggagtgttattactgagtctggttcttgtgggctgcagtaatggcaattccggtaaacaaagttctaataatgaatcaaagaccgatatgcagaactcaagcagttcgaccaccagctctgataccaccagcggacaaagtgcctcaacagcttcttctgacagcaacgctcaatcggacggtcaatcgtacgatttctcatcgctaactaaggatctgtcaagtaagttgtcagatacgttattgccacaaaattcgggactgagcgattcatccaagaacgttcatatcagatataatgggaattctagtaacagtaccatatactacagcattggtaatgatgcacttgcactcaatgacagtagtttgaaagctgagaagccgtatgcggtcttagccaaacgcagctactcttcagcttcggaagctcaaagccatgtcgattatacggctgcttcggaaattaaagggctcccgaaagttgaccttggccacgggattgttggtcatactcaatcaggagccggtcagcagtacatttcttggaacgagggcaactggtcgattagtgttcatggcagtcccgtgaataacacgacgccgaagaaattagcgctttcaagtgtcaatatgtttgagagctactcattaccggcaccggatactcaaggagtcgtcaaattcaacgttggcggttcagctcaagtgattacttggcaggctggtagtgtagtctatcgactgcaggcaaccgatcccgccgtcgcaattcggatggctgccagtatgaaataagtcaaaaagagattgggactaacgcgatttgatcccagcatttaacgaagaaacgcagttattccggactttggaatgactgcgtttctttgttgaatggccgacgcaagtttgatcaatatcaaagtggtaatcgtatctgcaatgaaagcttcaataacgagtaatatccccacctctttttggtcatttatgacacgttggcgtgatattgcgcctcgggattgcctgacgtaaaatagatggataatacaaaaaatgaggtcatggaatgtcagtcagatttgaatatgcaacgcacgatgaattgccacgaattgttgaaatctataatgagattattcccagtcgccttgctaccgccgatttagagccggtttcggttgcctctcgtgagaactggtttgctgagttcaatcatgaaacccgaccgttgtgggtcatgaaggttgacgatcaaatagccgggtgggttggcttggaatcattttatggccgaccagcataccagaagactgctgagattagtatttacattgacgcaaattatcgtcaccaaggcttgggacagcaggcaatcgactttgtcagtggagaattggaacgcctcggactggatgccctggttgccttcattttcagccacaacctgccgagccaaaagctctttatccacaatggatttacggtttggggacatctaccggatgttgccgaaatggatgggcaacggcgcagtctggatattttgggaaaacatttttaatgtgagttaacggtgattgggacacgtcccagtcgccttttttgtggatgaaacggaattttcgaacagaaatggttgcatcttataggctacagatgtaaactgtagttgttgagagctacaaatgtaaactttaaaagaaaaataaaatgaggttatcaaaatgatagatgctaaaaatgttaccatcaccgattctgaatgggaagttatgcgggcaatttggacaatggggtcgacaaccagtcgcgagctgatcgacgcgatgaatgaactacagggctggtctgactcaacaactaagacactcttgcaccgattgattaaaaagggcgctgttgaacaaatcggcgatagtcgaccatttacctttaaaccggtcgtcggcgaaaaggaatcaatgtccgctgcggcggacgatttatttgatcatatgtgcgcgatgcgagccggctctacaattgcccaagtgatcaagacacgcgaattgtcaaaaagtgacattgcagaattgcagcagatattggctgagaaagccaaggatgctccggaaatggttcaatgcaactgtctgccggggaaaatgacatgtggggaggatcgttaaaatggcaaataataaagatgatatgaatatggaccatgatatggacaacatggatcattctaagatgaatatggaccatgatatgggaaacatggatcattctaagatgaatatggaccatgatatgggaaacatggatcattctaagatgaatatggaccatgatatgaccagcatggatcattcaaaaatgcagatggatcatggcgatatggacatgtccggcatggatatgggcggcgacatgatgatgcatggcggtcaaatgatgcacatgggtaacctgaaacaaaagttttgggtctcagtggtcttggcgatccccgtattgctattagcacccatcatggggttggacgtcgctgtgttgaacttccacgccccactcattgaaggaattgcgattcttttatttgatacggcactatatttttacggcggctcaccatttctgaagggcgcctgggctgaagttaagagtaaggcaccggcaatgatgactttgattacgttaggtatttcagtttcatatttttacagtatttatgcattcattgccaataacttgatgcacactgccactcatgtgatggacttctcgtttgagctggcaaccttgattctaattatgctgttgggtcattggttggaaatgaacgcggtcatgggtgctggcgatgccgttgagaaaatggcggctctattgccgaagaccgctcatttggtaactgaaaatggggaaaccaaagatgttcaagtatcagatctgcaagtcggccaatcatttcaagttcgctcaggtgaaagtattcctgctgacggcaccattaccaatggtcaatcaaccgttaatgaagccttggtgactggtgaatctgccgctgttaacaagaatgttggcgataaagtcattggtggtgccaccaacaataacggaacgttgacagttgaaatcaccgggaccggtgaatccggctatttgtcacaagtgatgaaaatggttcaggaggcccaacagtcgaaatcaaaggctgaggatcgggctgatttggttgccaagtatctcttctatgccgccttatcagtgggaatcatcgcattctttgcctggttaccccaaggactatcgaccggcttgacccgaatggtcacagtctttgtgatcgcttgtccacatgccttgggagtggcgattccattggttgtcgcccgttcaacgtcgattggtgcgcaaaatggtttgctggtacggaatcgtcaagccattgaagccagtcaacacgtcagtcatgtgctgttggataagacgggaacgctgacggaaggtaaatttactgtcaacgccctggtaccagctgcggatactgatgaacaatcactgttaagtaaattggcagcccttgaaagcaactctacccatccgctggcacaggctattattgctgctgccgaagaaaagggcatcaaggttcaggctgctaacaattcgcaaaacatccctggtgtcggcatttcaggcgagattgacggccagaattatacgatcgtcaacggtaactatctgacaaaaaacgggatttcatttgataacgcgactgccgatcaatgggcagccaaaggcaactcggttagtttcctgcttcaaggccaacaagttttggggatggttgccgaaggagatacgattaagagcggggccaaagagctgattgccggattgaaacaacgtggcattacgccagtgatgttaaccggtgataatcaaaaagcagccgaacacgttgccggactgcttggtttggacgaatttcatgctggattgctgcccaatgacaagcaaaagattgtctctgagtaccaggcaaagggcaaccacgtcattatggtcggtgatggtgttaacgatgcgccaagtctggcggaagccaatattggcgtggcaattggtgccgggaccgatgttgcgattgattcggccgacgttatcctggttaaatcagaacccagtgacattcttcacttccttgatttagcaaagattaccaaccgaaaaatggttcagaacctctggtggggagccggctacaacattattgccatcccactggcagctggtatcttagcgtttgccggcatcattttggacccagccgttggggctgctgtaatggcaatgtcaaccattatcgtggccttgaatgcaatgggattgactgctgaaaaaattaggaattaattaacgtactttaatatcagaacggttatgattatcataaccgttctttttttacgtattacgataatggactagtaatggaaaaatatgatgaaaacttgtcatatcgggattaggtcattacttatgacttatctttatacgcctgatataattacattgtaaaagaaatgatgtcaatattgctaaggggaagcagacaactttactgtcatttttggaggaaaaaacaatgaaatcatcaaacaggggaattattaatcaggaggatgttactgctaaacattataagatgtataaagctggcaagcgatggatgattgccggcttaacagttgctgcctttggcgttggcagtcagttaagtacggtcaccgacgcatctgcagacacaacgccgaccacccaaggaaattcggctggtagtgcaaatgcagctcccgaaccggctacggcaactgcgagtgagagtgcaccgacagcaacaactgcaccagctaccgcacagaaaccagcagcccaaccggctacggcaactacggagactgcagaccaaacagcgactgcagaccaaacagcgacgccagcatcacaaactgctcaaccggcgccagcagctgagacccaacagtcaacgactgcgcagactcccaagtcccaatccgagtcaacaactgagccacagtcacaaccggtcaattccggtcagacggaagctgccaacccaggtacatcacaggcagcccaacagcctgctcaggcaacagcgacacctcaagcagcccagccggcaaaagcagctgagactgacactaaccagccagctgccaagccatcaacatccaacaataccaccgttgataaagcagcagaaactaaggaaaccggaaccaaggaaacagaaaccaaggcagctgacaccaaggcaggagaaactcaggcaccggaatctaaggcaaccgaagccacaccggcgccagctcaggcaactacggagccaaccattgccgaagatttgtcatatgatcaagcggtcaacgtgtataacgccagtaaaaagctttacgaaatcattaccaaccagctggatcaggccaagaatgcttatgatcaacaattaaccgtgtataaggacaaactggccgaatataaccaggcgcttgaaaaatatcaggataatcaaacccagtattccagcgaaaaggcggcctatgagaaggcgaaggccgaatatgaagctgccaaaacagcttacgatcaaaagaaacaggactacgatcagaccaaggcattgaatgacaaagcagccgctgactaccaagctgccaaggataaggtggaagctgcggtcaccacccatacggctcaaaagacgacgtacgacagtgccctcgccaaatatgaaacagccagaagtgcgtatgaagctgcccgagctcagtatgagaaagggcaggggacttcgaccgatgctcagtttaaggcgatccaggaccattatctgcaaaccaaagcagattatgaaaagaccgaagctgaataccagacagttaagacccaatatgacgccgctcaaaagcaaatcgacgacctgcagccgcaattcaaggatgctgatcaaaaacaaaaggcaactgccgatcaattcaaagcaatcgacgctgaatatcaaaaaatcaatcagcagtatcaacaagctcacaccacctttgcaaacctggaaaaacaatttaccgatgccgggattgattttatcgccaagaccgatgcttacaatcaattgaaagctgatttcgatgccgttaaaggcgttcacgacaaactggccgagaggtatagtgttgcccagggggcttatgataccttaaccacccgtttggctgagttaaatgaccagtatctgattgaattgaagagttaccaagaagaaatgaaagtctgggatgaggcttacgccaaggcaatggcattcgagaaagcggtagcggaaagtgcgccggaaaagactgctaatccgatcctacccggcctccaggttacaccgactgctaaaatagttgatgtcggcgataacggcgtatttgatctgcattttgatgccaatgggattcggaccatttataccaatgctgaaatggtggttaacctgccagccgacaaagggctctcatttgacgccactgatctcagtcaatacgcaattgcgggtgtgacacccacttatgacgccgccactaaaacgctgacctaccactgggatacattggaaagtggcgtcgcccaagaccttcactatgtctatggcaccgaaaaggacaccgtgatcaatggccaaacggtcacggtgggcatctcatttaaggccgacgaaatctcaacgcctgtcaccctgagtgcctcacagacgatggccatggcgtattcggcaatggtgaccaacaccccggctaacgtctacacagattcctatggtaatgaatacaagaatccggctcaagaagatcaggccatttgggacttcagtgtgacgatcccaactgcccaaccgaagaatgcactactggaaccaggtagtgatgtgaacgtttattattatctggctggcgagcagacctatgttggcatgacaaaaggaaccgctgaaaacggcttgattgacacagctcccgaaatttccaccggcgaactgaaagatgggtctccggcaaccgttcttaaatggacaattaaggccggtgacgtggcggatcaaattgctaaggaccaaacgctgaaattccaagtgatcgccaaggtcaacaaagacgccgccaacttccagtggcttaagactgatgtcggagtcggcttcactttccaaggtgcccagccaatcaatcagttaatgaacaagatcgcggctaccatggtactgccgcatgatccaaccacttggaacgtgactggtgggagttggaaaccgatggttcactacggctcaaaagacggttttggcgcattggcggataaggatttgctcaatccggacccacaagtttattccgacgcgaacgctgtcttggaattctatgatgctttgctgccgctatttctatttaatgatgtagatccggaagttccccaaaacgaacggctgcgtgactttaactattatgcactccaccagtcgatcgatccgcgtgaggatttagagacggttatcatccacaactttgtctacctgccttcaaatagtatcaaggattccaagacaccatctggggcggtcggcgaatggacgtacttcaaggaaaatccatacttgtcactggctgtgaaatatgagggtgagggacagaaccagtaccacactttatttgataatctgccaaccatcacctcagatgtcgaaaaggataaagatggtaacccaatctttgcgactggcggcaacgatggctctgtcgggtacatctatatcaatcgccaacaattattggcagccggacttgatccgacaaagaatgtggtcgaattgtatctctatatgcataagaagggcatgggtgacattccaaagaatccggataccattagtcgggaaagtatctaccaatatccggattacccgtacaaggcttataagaatgatacaatcaccattaccgataagaacggtgctcaaagaacgattttgaaacgggatctgttgaaatctcccgaagatggtgggttacctgctggatcctgggcaccgcatggcacttatggcggcgtctacttcaaaaccactgtcaaatcaggcgcaacgcctggaacgatcgtgcatcagatgacccctaaggtcagttggtcgaatgccagaacctatgtgagtttgcaggattgggtgtcggatgccaatgcccctgaaggcttatggcgttggctggcaaaggacgaggccgaacagcaagcctccatcgatgaaggatcaggttggccaggagttgtctggcaattcctcaaaccgtcgacaatcgaaattgcggcgccaaataaaaatgccagtcgttacgtcacttctgcaattttccttgacggcaaggccacgggctcagttcttgagactggtgctcatcaattgacccttgggtttgtgctggacaagagttcactcggtaacctggttgccagagacacaccatttgaaacttacacggttctgccaaagggtgtcacgttcgacgcggctgcctcaaaacaatccggcgtcattccgtatgggaaccaatactcagttattgataactttaaaggctctggtcaacaggtgcttaagattgtctggacggacatttccaacttaacaccgggaaagaacggcgcgactcgggtgattgtcaacattgataagagtgcgccaaaagatatggttttccagaacttcattaatgttggtcccgatactgagaattatattgtctcagtcccagcgattagtaacgccactttagcaactagccagaagattgcggatggctcaaccaccggtttgattgataccaagacacctttgattacatcaggtaactactacattttggagaaagattccaaactgcagagcaatcaattggtcagccaaagcgacaaagatgattatcaccacgccgttgcagttgaaaccggtaagcaggcgaccgtcaagattacctttaccgacaatacggatgagagtctgtcacagcttgacttacttgatttcttaccgcaagccggttcaattgaaggtgtctcaacatctgatgtgagaacttcaacctatacggctggtttgactggtccggttgttctgccggccgattggacagggaaagtcaacgtttactacaccactgaggaccaggcaaacgtgttgaaggatctgagcgcagtgacttggcagctggaaaattcagtgactgactggtcgaagatcaccgcctttagaatcatgcttcccggcacttcagggcaaaccatcaatggccgtccggcagaagggattacctttaacttggcagttccagacaaatcaacctttatctccaaatatgctgaagccggcaaacaggttggggttggcgagttaaacgacaaactcaaagatgaagtggcttacaactcatatgttgtcggggttaatcaaatgggctatacggaaccattgttggccgcaattaaagtcgtcaacgttgatgaaaaggccaaggaaccagcccaaccaattttggatgaaacccgcccaaccaataatgcggaacagccagttgcaccggtggcaccagtcgaaaataacggaaccaaagtggtcgatgtgaccggtccaacgacaccggaagctggaacgacagtcgtggccgactaccagccaaaccttgaccagccacaagaaccggttgccccagtggcaccgaaaaaggctgaggatccggtaacgcctggtggcaacgtggatcctaataagccagtcacaccgacaccaagcactccaactccgggaactccgacgccaacaccgaatacacctggtacgccgaatgagacaaatccgacaccgcaggagaatgtcgttcatgaagacccgaccgagtctcaggaaccaggaatgatcaagactggcgaaaaggcacctgaagcatcgaagaagcaaaccgcaaaagaccctcaaaatagcaaagaacaattgaaggtcaatgatcctggcaaagtggttgctaacgatgctcaagccggccaagctaagcaagcaacaacccaagctgttggccaagcagctacagagaaaggaactaacgaaggccgacaagcagtcttaccacaaactggtgataccgaaactggccaagcggtttcaatcattggcatgatcttattggcaatgtttggttggcttggatttggtaagaaacgggaaagagaataatcagccaaaagactagaggccgggacacaactgattgttagttgtgtcccggcctctcttgggttctattgatatctagttgaaatgtgtgaaagaggacagcaattgaaatttaagcgccaccagccgaaaacctgactcggtttccgtgcgtttcactgttattttgattaaacgtgtgaaagaggacagcaaccaaattttaagcccctccacccgaaaacctgactcggtttccgtctggaggggcttaaaatttagttgctaaacgtcctctttcacactcttattaatcttgaacaacaaccaacgacttaatagcctcacgtttagccattgcttgataagcatcgtcaatttcatccagattgaagcgcttggtgaagactttgcctgggtgaatgtcaccgtctaagacagccttcaacaggactgatttatcgtaggtggttactgaagctggacctccggcaatgccaaggttgccatagaacgagctgctgaggtcagtcttcttggtatgcggcagaccaactcggccaacgattgcacctggacgggcaaccttcatggcagtttccgttgaaagctcagagccaacacattccagtacggcatccgcgccggcaccgttgattaatgccatgactttggcaactgcttcgtcgcctcgttcagggacaatatcagttgcaccaaattcagtagccaatttttgacgatcttcatggcggctcattgcgatgatccggctggcaccacgcatttgagaagcaatcacgccacacagaccaacggcaccgtcaccgacaacgacaactgtgtcaccagctttgacgttggcaacccgggcagcatgatagccggttgccataacgtcagccaacgacaacagcgagttcaacatgccatcgctgtaatcggctggtttcccagggatcttgaccagtgaccattcagcgtgctggtaacggacatattcggcttggtagccggaactgaagttatcgctatgagtttggcagctgccttcataaccggcacggcaggcagcacagtgtccacatccatgggtaaatggggcaatcacaaagtcgccgggctgaacggtggtaatgtctttgccgacttggtcaacgatcgcaatcgcttcgtggccgctgttttcggaattgggttccttatcttccaagccacggtaagcccacaaatcagatccacagacgcaggcacggacaatgtgtaaaataacgtcgtcatcagcttggatggttggcttgtcaatctcttcaatttcaacttttcctggttttacaaataatgttgatttcatcaaataatctccccttacatttatttacaaagtcattgtagaccttgaagtccactttaaggcaactaccaatttaaaattaatcttctttggcgagtcgggcttgaagtttcaaatcatattctcgcatgattgggatcatcaaggcaaaaataccacaaacgactgtgccaattccggcgatgacaaagagcatctcaactcccaatgcatccgcaagtggaccggcgaaaattagtccgattggcccggttaaactcatcagggaatttagtacccccaggactcgtcccagttgctgagggggataactctgctgaatcattgccatcaagagcgtgttgaaaaacggtgtggcaattccttcgacgacatttaaaatggcaaaccacataaacccggtctggttaccgggaagcaggccacttaaaccggtagggatgccgacaaggaagaatgcaatgatcactggtttcattctgtcggaccatttgccccagataccgatgatggccccgcccaccagcatcccaccggagtacaaagcttcgataaagccagcttggccaacggttccctggaaatatttcattgtcattagcggatacatgctggccgccggcatgtacagcagggtgaagactgctccggtgatggtaatgtaccagagccccttattgtgcatgagttgttgaacgccaagcttggtgttgtgcagcatatgcagagcagcgtcgatcttttcgttgttgggaatctggacccagatcaagatactgatacccaggatggcgccaagtacatccagcaaaatcagatattgcagggggataatcgcaaacaggaaggcgccgagagccggtgcaataatcatattggctgattggaccatgccgagttgaccgttgagctttgtcaattccttatcgggaaccatcgttggcatcaccgattgaatcgtcggcatttgaaaggtttgagcaatggaccgcattaataacgacacaaaaatcagccagattggaaaaacgtgaaacaccccgccggaaaccgacaggataattgcaaagattgccgccaccacgtctggaacgatgagtaaggccttcttgttccagcgatcgaccagcggtccgacaaatggactgagcagtgccattggcagcatgcccaaaattgtcgcgatgctgaggatggtggccgagccggtttctttggttagataccaaatgatggcatactgaacgatcatgctggtaatcccagtcaaaaattgactcgtcaagaacaaataaatatttcgccgccagtgcgcttgattaaccctcatcacaaataccccgttattttataaagtaaactttatccatattttaccgtaattggggttaaaacgggggaaataccgtcgaagttcctgactttatgaactgggtgtgataagctcatttaagatagattttgttaactaaaggagatatatcatgacgttacctcaattagatttaaagaatgccaagggacccaaagccaccattaaaaccaatcacggtgatattgtggttcaattgttccctgaacaagccccaaagactgttgaaaacttcgttgccttggcagaaaaaggttattacaacggcgttattttccaccgggtcattcctgatttcatgatccaaggcggcgacccaaccggaaccggcatgggtggcgagagcagctttggcggtaattttgccgacgaattttcacctgagttatttaacatcaatggcgcattgtcgatggcaaacgccggccctgataccaatggcagccagttcttcattgtttccaacgaacatgttgatgacgggatgatttctcaaatgaagacggccggttatcctgaagaaattattgaagcctacaagaatggcggaacgccttggctggacttcagacacactgtttttggtcaggttatctctggcatggacgtggttaaggagattagccaagttgagaaaaatgctcaggataagcctaatgaagacgttgtgatggaatcagtcacaattgatcaataattttccatcccactttttggaggtgggcttttttagtccagaacaatcattcacaattccaagccaattcgcggtaggatggacttataaagatatttaatttgtgattaaggcggtgaaatgatggcaaaatttgatgcaacatttcgaaatgaagtcaatgtgactcaaccatacattcaaggtgaaacagaggatgaggtcgctcgaaagtatcatttggataaagtggtcaagttgggctctaatgagaatccttatgcgccgtactaccactccaagaatgcaatgattagaagtatcagcacactgaatcggtatccggaagatgactttgtcaatttgattcagctattggcggatgaaaacggcttaaaaccagagaatgtggctttgggtagtggtgccggcaacattatcgaaacggttgccaagatgtttattaatgccggtgacgaggtgctgattgccaaacagtcgtaccggttgtaccgggaagtgtctcgattaatgggcgccaaggtcattgaaatcccattgaccgatgattaccagttcgatctggacgactttcagcaaaaaatcaccgacaaaaccaagctgatttggatctgtaatcccaacaatccaaccgggacgttgactgatgcagccaaacttgaggcttttatggatcacctacctgacaatgtctgggtgattgttgatgaagcttatgcccaatttgccgatcacttgagcttggcgaactttcttcgctatatcggccataaacgggtcatggtcatccggactttttccaaattctatggtctggcaggtgcccgactaggttatgtgctgggtgatcctgaggcaattcaggcctatgacactgtgacggaaccgttcaacaccaaccgaacggcgattgccggcgcaagtgctgcgcttcaatttgatcaaatcgaatctaataaggcgcgcaaaaaaattctcggtgatcgtgaaggactggttgagtcgttgggacttctgggcttccgagttgccccgtcccaagctaattttgtgtttgcccaacttcccgatggcgcccctgacgcgacaactgttgtcaacgccctcatgaaaaatggggtgatcgtccgtgactgcacgccctgggggtatccgcatcacattagagtcaccgtggggacgcatgcggaattggaattcttcttgtcgaagttgaccgaagtcttatcaaattaaatgacaatccaaaaaagcgcaccaactcaacggttattgttgaattggtgcgctttaatattggaagagaaatggaacctattttttaatctgtgccagcacagtcttgatggcttgtgcttggaattcagcggtggcctgcttgaccaatttggcccggtcagcagctgacatggttgggttcttcttcattgcggccatcacctgcttggtgacaaacgctttaccttgggcctttaatttagcttggtaagatttgcttgccatcattttcttaagggctttggcttgttgagcggagagaacctgaactgatttgttgacgtacaagatgttgtgacgtttgacgaatttgtggccttcaccagaaatgccgaaccacaatttggcggcatcactcttgtactcccaacgcgtggtttgagtgaccatgtgagtcgtaccgctggtcatgaccactttgttagtggtatcagtcgtttgcgtatgggacttctttttagcattggctgatttttgataaatataaacttgatgcttattagctgttccaatcggctgatagagaatcatctgcatttgcttgctgccgattgggtaaatttgctgtgatgtttctgtcgtcacttgtttcatgccgtaatgatcgtggtcgttcttaatgatgaagaccattgatacgactgccaacaatagtgagagagcggtaagggtataactgaccggtttacttgaaatgtagatgaagaagacaaacgccagaacaaccccaattgcaagtgtgataacgatcattagtcttcacctccatttttagtgtaatcagttgagtgaccacggttcttcaagaagaaggcagtgatcaaagctaagatacagaagagcagtgaaatggcaaatgcggcgtgataaccggttaacgtggcgttgatcatgtgatcacggtagccaagcgggttacttgtcagcattgagtgagccggtttgttgctcttcgtcacgttggtcaagatactgatcaacacagccgttccaactgaagcggcaacctgtcgctgagtgttgttgacggcagttccgtgacttaacaaattaattggcagtgagttcattccaacagtcgtggcaggcatcattgtcattgaaattccaaacatccgaatggcgtagaagacaacaatgtataaggttgacgtgctcttggtaatgaagataaacggaattgaacctaacgttaacaagctcattcctaagattgacagacgtttagcaccaaaacggtcaacggcccggccggtaattgggctcataattcccatcatcaaagcgccggccagcaacgttaatccggaatgaaaggcggacattcctttaacaatctgcaggtaaagtggaatgaccatttcgactccgaccatggccatcatggtaacggaactcaaaatcgctgagacggtaaatggtactgaacggtagacccgaaattccaggaatggggtcttcatggttaattgacgccagatgaacaaggcgatgaagacaacgccgacaatcaacgttgaaatcacgattgtgctgccccaaccatcttcaccaactgatgagaagccgtaaagcaaacttccaaatccgatggtagacatcacgattgaaagcaggtcgatgcccgtcttcttggtatccaatacacttctgacaagccagaagctggcaagaataactaagaacatcaatggaatgatcattccgaacagatcacgccaagtccagttatcaatgacccatccggaaagcgttggcccaattgcgggtgccaggccaataacgattccggcaagtcccatggcagtcccacgtttggcaggtgggaagatggaaagcataattgtctgaagtaatggcatggtaaccccaacaccgagggcttgaatcaaacgaccgattaataaggtcgcaaagttgggagcgatgtaacaaacgatcgttccggcaaagaaagtggtcatggcactaatataaagccacttagaattgaatcttgtgcttaaccaagcactaacaggaatcataattccgttaaccatcatgaacccagtggtcaaccactgaacagtcgatgtgttgacgtcgaatgctttcataatggtcggaaaggcggttgaaagaatcgtctgattcagaacggtacaaaatgttccgaccagaataacgataatcatcaaaccacggttgtatgacttcccgtttttatctactgcgttacccacgatttaggaccttctttatttaaaattttgatttctctcaaaatcgaacatggactaatataaaatgtttcaacataattgtcaagcaagttgacaaacatatttaaaaatatatacttaatgttaattaatgtctcactggtatcagacgatttaataattggaatgccggttttaaggcaatggaagcaattacaacttttgaaaatgagaaacgagggatcattttggataaagagttccagcagaagctggctcaaatcatgaaagagaacgactggcacttgggcatcggtgacgtcgccaacgcaaccggcgtttcccagaccaaattgcggtactgggaacgaaagggctatatcgaaagcacccaaggaaagggccagaatcgcaaattttcctatagtatgctgatcaaggtctatcagatgaaagttttattggatcagggctacactttggcagtcgctgcccaaaaggccgaatccaagagccacgaactcaaattagcgagacaggtcctattcgaccgatttgaagggatgaccgaaatcgacggccatcctgcagttgacctgggctatctggacgataatcaagattcgatcctctatgcagtggttaaaaaagacggcaccaaatttaaagtcgttccaacagaaaagtaaattcaaaagaatttatgcttgctttttatacccctaaaagcgttacactgttactgatagaaaaacaatggaggaaatttcatgttagagaagatcacttataaagagctgcttagccatgcgtttgatattccagtatctgtaacttactgggatggtaagaccgataactacggagatggtgagccgcaagttaagattacgattaagaaagaaattccattaaagaaaatgacttcacagccaacattggtattggcagaagcctatatgaacggcgacattgagattgacggcagcattcaagagctggttgcctcagcctttcgtgcagaccatagcttcttaaccaacaacccattcttgaagcacttaccaaaggtttcccactcggagaaagccagtgagtcagacattcaaaagcattatgatattggtaatgatttttatagaatgtggcttgataagagcatgacttattcatgtgcctattttgaacacgatgacgatactttggaagaagctcagttgaacaaagacaggcatattttacacaaactcaatccggttgccggcaatacgttattggacatcggcagtggttggggcactttgttgttcatggccgctgaagactttgatttaaaggccaccggaattacgttgagccaggaacaatatgactacaccaagcagcaaatcaaagaacgccaccttgaaggtaaagttgacgttttgcttgaagactatcgggaagtcaaaggccaatttaactacgtcacttcagtcggaatgtttgaacacgttggcaaggaaaaccttggcttatacttccagaaagttcatgatttcttgaaacctgaaggacgagccttaatccacgggattactggtcagcaccagggagccggcgttgatccgttcttgaacaagtatattttccatggcggctacattccaaacgtcgctgaaaacatgactcacatcatggatgccggaatgcagatgagtgatttggagccgttgcgccgtcactatcaaaagaccttggaaatctggtacgccaactacatgaaggtcatcgataaggtcaaagaaaagtacggtgtgccgttctccagaatgtggggcatgtacttacaagccagtgccgcttcatttgaagccggtaatattgatgttatgcagtacttgttgaccaattccccaagtggaaccggtctgccaatgacgcgtcagtacgtttaccaggctaagggcgaataaaatttttagaaacgattaaagggaaacgcaattttgcgtttccctttttaagtgccattatttagcaaatcgaattgatacccaaacactgccgataatcatcatggtgccaaagacaaatccccacgaaatggtttcacctaaaactaaccatccaagtaacgttcctacaaccggctgaaacagaaagaaaagtccagaactggcagcgttcattaactgaaggcctttattccacatgacaaagcccaaggctgtcgagacgattcccagataaaggagactgagaccaattttgggatccagataatgagctcgggtaatcacatccatgtggctcaagacaaatggcgtgaggcaaacgaatgcgacaaaagtcgacataatcgtgatttgaagtgagttataggtgcctgaaacttttttgaccaggaccgacatcaacgcccaagtcaatgcggcaatgattaacgaaaaaatcccgagtaacacatgggttcctgagaagtgaaccccaacaatccagataacgcctaaagtggccatggtaacagaaatgatcttaacagcatccaatttctcaccaagcaaccaccaggcaaatatgatcatgaaggtcggcgtagctgaagtaatcaccgccccagtctgagcgtttgacagccaagttccggtttcttgggtcacgatggaaatggcattgccaataataccgattaaaatgatgattcccaagtcacgttgattgaaacgccatttaatgtgaaaaatgactgcaaataacattaaacaaactaacgcaatcaggtatcgcaaccagaccagttcaattggcgggatagtctcaaccaccactttaacaacgacaaacataccgccccagatactggcagctaaacttagcagcaatgcaccgagcattttttttgaattcaatatgatgttcctccgctttttagatttcgtatgaaatgattagcggaataacccgctattaacggatagttggaacatcacattcatttaatggtgaatagatcatgtagttgcctcctttgatttttatgttgtgaaatgagtatacctctacatgatttgaaattcaaaggtaggcaggatcgcagcagttacgttgatcgaacgtttcttgtcagtattactagtaagtttccccgtttgagggtgttccatctcctggcgcctgttgactcacgtcttttcgaagggcaagattgcgaaattggcgccaactaaacgccaataagcctaaaagagaaagaatgatcccaagcaataacccggggacgtgataagacatcacgatgtggtttgactgatcagtgagtggtaatgcggtaaagttacccaacaccttaattggctcaacgggttggccattgacagtcgccgtccatccgggatcatatggaattgcggtatatagccattctgattgtgaattgggccgaactgccgtccccactaaacgatcgttggtataggtgggggtaaaagcgctttgtttcaggtgttgatcaactttgctgaattgcgagtcatttaggctgttgaaatgactctcatgaagggtgttttgacttttggatgtgagctgtagggtaaccgggacgccacgtttggcagttcccaatttaaccaggtactgtttatcaagttgattggggatggtttttaatcgggtgtgattgacataaatggcgctgtaatccagcagtttatccgaagtatcgaagtacagcggaccgctgagcttgggaatgatcgtcagggtgtatttttctcgagccccgattgtttgccgttgtgggttggttccagattcgcttactaaatacggttggttggaaggtgccagtcgttggagaatcctttccagattggtaaatagtgtgccggcggtgagttgtagatgagcgaattggttggtaaccgggaagccgattcccgcaaaggatgcgtttttctcaatttttccagctgggttcagctgatatttaacccccaacagcatgtcggaaatggcagtcgaaccggcagtgctgattcggcgctgattcttactgaacagaccgatcattttcaatgattgacgggtcgattcggttaacgtcgagctgtattcttgaatgccattgtaattgaacaaaacgggatcgttatagcctaagtaagtttctttgaatatgggagccaactgactgtgagactggtcaatgcggtatagctgattgtcggtggttttagtctttgaaacgatggtatcaactcgaggataggcagtctcgtagcctgtttgcaaaggcagcggttcactcttgagggtgtagccgaagttggcacccatttccaggcagacaattgttccaattaataattgctgcatcggatgaacggctgtaaataggagatatgagaagatgaccgttaaaaggagattgactatgaggacgttgagtgagttgggctgaacggccaaatagtcgtttgtgagcacatggcgtcccaggcggatgtcgagataaccgacaattaacaatcccgctagaattgttggagtgctcaatttagccttgaatgacaagccttgggggttggccagcaccatttcgtaagccgcggagatcaagacaaaactcagcaagaatgaatagcgaaatggagagccggacggttcattgagcatgtgccaaaccagattgatcggtccaatcagcatgctgagtgagagaattccagccgttaccgagaccgctagtttgtggtttcgaggaatttggggatggaaaaagtagccgatcactaaaagggcgatcgctaaggacgaaaaaatcgccggagcatgtagcagccgattatcgtacgtttgcccgcccaagcccaattgtgaaaagatctccaaaccaaattgtggcttggcagccgcggccaggctattggcggtcgacgggctggttttggcggtctgaagcatgcccaacatggtcggcaacagcactaccatgctggacatgacactggccgcttcggtgaaaatgaatctggtaataaactgtcgattgtggctgatggcggtgatccaagagaagtgaagatcgttggttcggataatcgtttcgaccgcgtagatgagggtaaacagtccgagcatatagccgatatagtagttggacacgatcgctgccgtcagccagacaaataaactgatcgattggtttcccgctttgatctgatcgattccgtcacagattaacggcaaataaatgaggccgtccagccacatgatattgacgaagttggccgaagcaaaaccgcaaaggctgaaagctagagtgaaaaatggcagtaaaagatgaattcgattgaaatgccgagagagaaaccagcaggtcgtcgcggcaatcgtcatgtctttgaggatgaaaatccaggaaatggccaccggcagctggctcgctggaaataggagaaccagtaagttaaatggactcaacagatagtacgtgatgagcggaaagatgttttcgccgacgccaagcgaaaaagaaaataatgagaagtgcccgattaagagggcgtttcgaaagccggtcagaaatgggacgtattgagcactcatatcaccaactaatagattgtgagtcccaaatggggtgatttggttaacggtgaagatcatcgccaacaccacgccggtcagggctgccgataaagcgaccattaacaggatatttctggttgtgtattttaggttcatgatgactgcccccgattgtgttggatgactttttgagtattaaattgctggtggtgaaggactgccattgctgattcccaccacagcagtccatacagcgccgcaccaatcacatcagttggatagtggacctgtaggtagagtcgcgagaggcaaatcagggctacccagaagactaacatcatgctgaaaaacattcttaatctcaccgatgagatgagcgggaggatgaattgaaaaacaattaacagcagaataacggcactgacaacatggccgcttgggaagctgtagcctgagtcatgggttagcatggtggttggtcgtgggcgttcagttagctgcttaatgattaatccacccgcattgccggtaacgactaccaccagggttgtcagagcctcctccagcatttttcgctgccaaagaaacacactggcgataattgccaacccaactgttatcattgggctgccgaacagggcaactcctttgaaaaaacttgttctgtctggggtaataaatcgctggagatagttaagaaaatcgcggtcccaaaaatacaactgaacattttgcaggaggaccaatcctgtgatgccaataaagatcagccagccgaagaacagcagcggatgatttttgattgttgatgtctgcatgaatattcctccaatcacttggttatcgaacttacaagccaagaatactgtgatttttggtgagaaaatacagggctaaaaaaagagccttctgataaattctcagaaggtctcaaagtggggatgcaggtgtcagttaagaagaacgcatcgcaattgatggtgctattttgttaaatcggggtcggaaaagctgacttcaaacgagacgccatggggcaagatgctcttgactcgtaagccgacatcatttagctgggcaagctgactggcaatcgctaagcctaatccgttgccggtaatgtgactgttgtgggcaggatccccacggtaaaagcgatcaaagatgtgggcctgatcagccttggggatgcttgggccattgttttcgacagccagaactgtttgatgatcatgcttgctgattttgaccgtgatttgggcatccggcggggaatatttgccggcattatctaaaagggcagataaaatctgggtaatattggtctggttggcatgaacgattgctgattgctcgcccacaacttggattggctgctttaaaagcacccgctgttcttcgacggtttcgttgacgattaccgctaaatcaaaatgacttttggtgacgacttccttgtcggctcgcgacagggccagcagactgttcaccagcgcctgcatttttgctgactcgtcgtcaataaaatgaagtgagctgtcgataatttcaggatgcgctttgccgcggcgtttaacaagggcaatatgaccccggatagccgcaatcggtgttcgcaattcatgagatgcattggaaataaatgctttttctttttggttatttttgatgatggctgataacaaatcgttaaagctaatcgcaagctgttgggcctcgactggggactccggaaccggtaggagggtttcaacccgattaattgattggctatgagccttggcagcttcctggagggtttgcagcggctccgttaactggcgggcaatcagggaaatgacgaaccagcccagtgacagactggcaagtgaaaccaacagaacgattaaaatgaccgatgttaacagttgaacgattggattgaggctcagccaaatttctgagcggatattcttttgactaccgtgccgaacgccactgcgataatagaagaggccatagcccttggcataaatgagagccgggaaaaccggtatgtggatcatttttgaaatcggggttggtgctgccgccaaaaattgaggcgccccctgggaataaaatagttccggctgcttagccgtatgaacctgatccgttaccctgacataagtattttcagtattgatactgctgtttttccgccactgtttccaatccggtttgtcgtcaatgaatgagcgattaaggcttctgagtaattccaccgattggctttcgctttggcggaccaaattcacgcccaccaccaagacaacggcgataccggtaaatagggcaaaaaaggttagcaggataataaagtggtggcggattgcttgataggtggtgcgatgctgtttgtttgccaaactaagactccttattcctgataatttccggacatcacatagccgactccacggacggtgtggatcagctgtttggaatatccccgatcaactttattgcgcaagtagcggatataaacgtcaacgacatttggctggccttcgaaatcgaaccccccaaactgcgtcaagcagctcatcacgggtgagggtttcgccaccgtggcgaatgagggttaataacaattcgtactcccgttgggtgagttgaatcagttgatttccccgcgaaacctggcgggacttggtgtttaaggtcaggtcctctacggtataaagttcgctttgctggtggtgatggctctcgtggcggagaacgactcgaattcgggccagcagttcttcaatttcaaatggtttggtaatgtaatcatcggcaccgctgtcgagtccggcgactttatcgccgacgtaatctctggcggtcatcatgataactgggatgtcatcatttttgcggattcgccgtagaacttccagtccgtcaagctttggcagcatccaatccaggatgatcagatctaagttgccccggttattgtcatagacttggagggcttcttgaccgtcttttgccaacaatacctgataatcttcaaattttaattccgggattaaatacgagctgagtgcttcctcgtcttcaaccagcaggatagtattcgtcataatttcccctcaattctggttcaattgaataatcatgaacattgtagagtgactggcagctcatttgaaagtggtagtccctgacaagtttctgtgaaattctcagaaacttattcatggtgccccagtcgctgcaagtaggtggcaaagggttccttaccggtatcttttccggattctttggcttcataccagtcaattttatcatttagaatctgcagatgatgctggacttggcggtattcttccatgaaatcggccttggttttcttgagtaaatccaggcggtcagggatggtctggtcgccctcagcccgccaagtgacgtattttttcaggtcgttgatgctcattccggtgcctttaagatgcaagaggaatttgacccacttgatgtcctgttcggtaaaatatcggcggccgttgtctgtccgacgggctttgagtagcccctgattttcatagtagcggatggttggagcggagaggccgacaatttcggcaaattcgccgatttcataactggtttctgattgaatagctggcatgatatttcctccattatttttaaatgaatgtttgacttaaagttaactttaagttgtatgctcctatttgtaaagtaaatgtttttgatgaggaggaatttcaatggtaaaaaatgaaaatgttaaaaatggtgtgattttcccagctggcccgaaaaacgatgcttatgccaagtattttgtgggtcagagttatcttcagggattagtcaatgatccagcggttaatgtgggggttggcaacgtcacttttgaacccggctgtcgcaataattggcatattcaccacgatggctatcaaattttgttggtcaccggtggcgaaggctggtatcaagaggccggcaagcctgctcaacacttagtgccgggagatgtggtcgtgactcacgatggcgtcaagcactggcatggggccacaaaagacagctggttctcacacattgcgattaccgctgggacaccagaatggctcgaaccggtctcagatgaagaatacgatcaattggaggttcaataatcatggctaaaaaacaaactgctggaagagatgcactgggtgattttgcacccaaatttgccgaattaaatgacgacgttttatttggcgaagtctggtcaagagaatcgaagctgtcggccagagaccgcagcatgatcacctgtgccagcttgatgtcacaggggctgttcccacaactggaagcccacatgaaaatggcgaaggcaaatggggttacaaaagacgaaatggtcgaaatcatcacccatttagcattttatgccggctggccaaaggcttggtctgcgtttgacattgcgaagaaaatttttgattaattgatgatggaaatttatgagtgtggaacgcaatgcgttttgacccatcatttaagcaaaggagcgagtcattcctgtcttggaatgactcgctcctttgcttaaactctgcacgttttatcaacataacagtggtaatcaaagccatcgaaattgaatcaataaaatgacggcttatcgaacttggtgttcggttcattgacaccgatactcttgcgagcaaatttccgtgagttgtcgtttaagatgtcgatgattaactgggccaccgcctggcgagtgacttctgtgccgccaaacggttcaccgctttcagtcaattcgtaattggtattgccatccttgttgtacagccatgccaatcgcaagagggtatatgtcagatcagaatcttcgatcgctttggcagtggtcttgcgcttggtgatcgagctttcaatcatgctggtattccactggccaaaggcacccttaacttcgtcttcgatcccgagaacggtcgcaccgataaattggcgaacgtggttggcatccatcgcttgaatgatgttcttaacggatgtgatgtcccgcatctcattaagatagacagcgtcgacaccatccatggcctggttcaaagtatcgtgatcgttaaagtcaccatcaatgactgtttcgcgcttgggatccgttacgtgaagccgactggtggcattccgagcgtaaagtttcaaattaaaatcagtttgttttaagagctgggggattaagaaactgggaatttgtccggcagcaccaagaattaagacagttttcaaaaaaattcctccctaaattgatttggctacgcctttactataacgcagatttgcgtttgcgtaacggtgagcaatcgttttagggaggaattttgtttaactgattatttggctaaagtttggagtgctttttgagcagccacgttcatgatattccatggccggtcaaatcctggttggaagaagaagtcggcataggctaaatcatccaacgtcatctttgcttggacggccaaactaatggcattcatgttggcggtgacgtcacgcttcgacataatctgagcacccaaaatgcggtgatttccgggatcaaaggtcaacttgaagtagaccttttgattgccggcctcatttggtacgaatggtggctgggtggtatcagttacgaagacggattgactcaacacgccgttggctgcggaagtcccttccttgattcccgttgaagcaaaatggtaatcaaagacagacagggcagatgaaccggaaacagccggcatcttcatgtcgtctccaaggacgtttttcgcagcaatcctgccttggcgtcgagcattggtagccaaagcaatctggagttccttaccagttggggcaaatggaactttggtgctgtcaccgacggcgtaaatatcaggctggctggtttcttgatgatcattgactttgaccagacccttatcggttaaatcaagggtgccctttaaccagtcggtatttggcttgatgccggcagtctcgatgaccaggtcacttggatattcagcttgatcagtcttaactgccgtcacctggccgtcctctccattgaatgacttgaccgtttggccggttgccaagtaaatgttgtgatcctttagcgtcttggaaaggacatcggtaaactcctgatccaggtacagggccaatggacgagggagaatatcaatcaacgtaacatgcttgccggctttggagaagacttcagcggcttcaataccgatatagccggcaccgacaacggtgacattttgaacatcggggtcaaccgtcttctcctttaatttgatggcccagtcacgtccacgcattgcatagacgtttttgagatcgccgccaggaacaggaatttttgccggtacggcaccggcagatagtaccaacttgtcatatttttcttcacgagttgaatcatcgtccaaattatggacaactaccgtatgctcgtctggattaattgaggtaacttcttggtggacaaacacattgacaccttgggcacgcatttgttccggcgttgcgtaacgaacagcgttgacatccttgacgaccccttcaagataaagctgcattccacaggagagaaatgaaatgaagtcacctttttcataccattgaatttcggtatccggcttttctgccaaaatccccctgacagtttcaaacccaccgtgagatgaaccaacaacaataactttcatcaacgattccgcctttctagattcgatatttacaagtatttgacttgctaaatacagcgtaacatatttatgaggtgatttatcgaataaattagaataattataaactacatattgattcttttggccataaaatgcggattattgtttaaaaggtgaatacacaggtagataatgcccaccaccgaccatcattcaaaatttatcatgataacattttatttagaaccattatgacggaaacgctatcattttgaactgattttcgaaaaaacgacagtcaaaaagacgcccaagattcaactggacgtctgcttgatttggattccttatgattaatgagggcggtcaccttatcgttcacgctgctttgccaagagtcgcagcaaaaacggtttaattcgataaaaaataacttctgccacgacgaacccaactgccaaggcaatggcaattgtcagcgcattgaacatgtattgcccggtgcgaatttcatttcccaaagtgaagctgcgcatccccaggtacaaaatgccgcccggaactaatgaaaccaagctggggacataaataatattgaccgggactctaaacatcaccgcagaaatattacccagaatgccgataacaattgccgcggtgaaattggggagaattaacccgttatcgacttgcaagactaaataataggccacccaggccagtgatccggtgatgccggcgggtaacagtgatctccgggggacgttggtaaccaatccgaagccgaccgttgaggcgaaactgacgatgagttcaatcaggactttcataggccgcctccaatcagatggaaaatgatcccggacagcccaacgcccaagacaactccggcaccgatggatccagcgataatcaatgcgtcaaccgcccggacaaccccggaaatagtattccgatcgatgatttctcgaaacgagttggtaatggccactcctggaaccagtggcattaaagcactgacaatgatgttgccggcgttagtggcgattcccagtgactgcaggacggctgccaaaaagccgaccgtaaaaccgcctaatccagctgccacatagggggtcttgatccgggggctggaaagggctgcggccaagtagccaaagatgccgacgaaaaacgctagggaaagatccgcccaagttgccttgaacagcagcattggtgcgacagacaccatggcggcaccaaacactttttccggccaagtaaagtcaatcactttcttgtcgatttggtcgatggttcgtttgagctcggcaaaatcaatctgtccggtcacaaatttccgtgacatggtgttgatttcgtcaaccttttccaagttgaaatcccccaggcggactttaaccaagtgggttttggtctgatttttgaccccaacaaacagggcggtaatcgttgcgtggcagctgatatcataatgggcagcgcggccgatatattcaacggtgccttcgacgcgtgatgtttccgcgccgctggtgagcagaattttaccgaccttgccgcagacggcgatcagctcatcttcagatattgattgatccatactttcaccccttgaaaaatctctttgcattccattataaactcatatgtttttaatcatgacaaaaagatttttcaaattggtgttgacaagggcatgttgtgatgataaagttactagcaattattaaaaatacattagacattgaagagaagagtaacgttaacgcattcctaaagagagcttcgtttggtgagagaagtggtttgcagcgacgtgaagatgagctctgagtcagatatccggtcaaaaggctaggatatccgcgagtccgcgatattggaccgggtattccaaggagtacttattaaggctgtcattgtgaggtgacagtaaatcagggtggcatcgcgaagctttcgtcccgtagttgaaataactatgtggacggaagcttttttatgatttaaggagatgatttggatgacggcaaatgcaattaatgggttcttattggcagcacaaaagtgggttaaccacgaagttactaatccgctatcaatcttggtgttgaacctgatgccgacgcgggtaaatactgagcgtcagtttttaacgcggttcagtgaaattggttccgacgcggaattgacgtttatgtatccgtcatcccatcattttcgagggacgtcaacagacctgatccaacgggattatgtctgtttggatcaaattagggatgcccattatgatggcttaattgtcactggagcgccaatcgaaacgctcccgttcaaccaagttgattattgggatgaacttgaggaaatcattgactggtcaaaggatcatgccaccgaatgtttgtatgaatgttgggctgctcaagcctgtttgttccacgactttggtgttcggaaacacttactgctgagtaaattgtttggtgtttatccggcagaaaccatcaacgcggaatcaccgattgcccgtggatttggcgctgggggattgctgaagatgccccaatccagacataccggcattgttttggacgaggaccatcttccggaaggcttgacggtggatgtttcagccgctgttaccggcccgatcatcttgtcagccgacagtcttcacagcacttacatcaccggtcatcccgagtattccgaagggacgctggcattggaatattaccgcgatttatatgagcagatgccgatcagattgccgcaaaactacttcattgatcaggattccggaacggtggactattcttggaaaaacagcagtattcagatttatgataactggatgaaaatcatcgcaaataagaaagtgggtttatcaatatgacagaagaaaacagtcacttacactttgaaacacttcaggtacatgcgggtcaaacggttgatgaaaccggttctcgggcagtcccaatttatcaaaccacctcgtacgtattcgacaatccagagcaggccgccggccgatttggcttgacggaccccggcaacatctatacgcgtctgaccaacccaaccaccgatgttgtcgacaagcgggttgccgctttagaaaactgtaccggcggcgtcacactggcaaccggttcggcagccatcaccgccgctattttgaatgttgccggcaagggggatgaaattgtttccgccagcacgttgtatggcggaacctttaacctcttcaatgtcaccttaccgaaattaggcattaagacccatttcgtggacccggacgatccggccaattttgaagcaccgattaatgagcacacaaaagcactctatatcgaaagtattggtaatccgggaattaatttgattgatttcgaagccgttgccaagattgctcacaaacatggcattatcttgattgtcgataacacgtttggcaccccatacctggttcgaccattggatcacggtgctgatgtggttgtccattcggccaccaaattcattggcggccacgggaccacaatgggtggcgtgattgtggaaggtggcaaatttgactggaaagaaagcggccgttatcccggcttcaccgaaccgaatactcaatataatggcctggtatttgccgatctcggtggtagtgcgttcacaaccaaagtcagagcagaatctttgcgggatttgggggccacgattagtccgttcaattcgttcctattacttcaggggctggagtcactttcattacgagttgaacgtcacgttgaaaacaccaagaaaattgtcaacttcttggatcgccatcccaaggtggcctggatcaattatccgggacttgaagacagcaagtaccatgatttggctgaaaagtattttccaaagggggtcggctcaatcttcacccttggtttgaagggcggtgaaaaagctggcaagcagcttattcaaaacctcaagttattctcattactggccaatgtcgccgatgccaaatcattaattatccatccagcttcgacgacgcatgcccagctgaatgaggaagagctgcgagaggctgggattacgcccgacctgatcagagtgtcggtgggtgtcgaaaatgctgatgacctgattgccgacctcagtcaggctttggataaaattccggaagacgttcaggaaacagttggggcaccgaaaccttgaattgaattagtttgacgaaggattaactgcactatgtggttagtccttttgttttgtggatgattgtcgactcagttggtcaaactgtgggggaatttaacttaacgtttgtgattttgccggctgggctccgcctgccatagtggctttgatttcaagcctatcgtcttgaaatacaaaggtgctgtaatcgccgctttcagcgactcaacagcactttcactatggctggcaatgcccagctggcaaaatcaggcaaccgagaaggcaaaatgactgatgtttggttcatgcagttctcaagctatattggtttgcaagtctccaagaccttccaagggtttcgactattcgaatctaatttttctaccatctgccaaatgagggttacaagctgccaggtgagggatatttcaaaccatgtggatgttaactcgtaacgggggttccatcagcgttccaaagaagtggcgctcagttcgttggcattgactaccatagtgaaaggtgttgttgagtcgctgaaagcggcgattacaacaccctggcatttcgagactacaggctcgaaatccaggccactatggcaggcagagccgacgaactgagcaccacggcagtctaagcaaaaagaacctcgatatgaataaaacgacaatattattcatgaatactgatgtgaataaatttccttcacaagccaaatatacatctttatactcaagaatatgaataaatatcaatctacaaataaaaatatgaataatacccaaaaaacattgcattaacctgcatgttgttgtaagatgttttcaattcattaatattcaattagaggaatatttagaaaaatgagaggcgattggtttgcaagtggctttagtcgggattacaggatatgcaggaatggtattgtatcaactccttcgtcggcatccagaagtagccgggattaacctgtatgatcataaattaactgaaaatgagaaattgtcgcaaatggtttcggctttttacacggacgacacccaagttcagccatacgatcctaaaacaattatggtggacaatcaaatggtctttttcgcgacgtcggctggggtgaccgcccagctcagccaaccgtacattcaggcaggctttccagtgatcgacctatctggagacttaaggctggaggatgccagcgagtatcaacgctggtatcacaagccagcggcgccgcaactggcaatgcggcaagctcattatggcctggcagatttcgaatcagccgttcatcagacctacgttgccaatccaggctgttatgccacggcaacgctattaggtttggcaccattggttcaaaatgacttgattgacccggggtcgattatcgttgatgccaaatcgggaacctccggggctggcaaaaatcccgcccaggccactcatttcacacaggctaatgacaacctgcagatatataagcccaaccaacaccagcacattccggaaatcatgttggaattgcagcgctggaacgatgatgtggccgctatccaatttatgacgacgctcctgccaatcacccgcggcatcatgagtacgatttatgccaaggttaagcccggcgttggcggtgcccaaattgatcaggcctatgccaccacttacggcaataagccatttgttcattatataggtgagcatttacccgatatcaaacaggtcgtcgggactaacaactgcgatattggggttgtctacaatccggtcactcagatgatggtcgttgacagcgtgattgataatttactgaaaggagcggccggccaagccgttcaaaattttaaccagatgtttgattatgaagaaaccagcggcttgaacctacaaacgtttttgccgtaaaccgaggagagatttgaatgcagatgacaagtaagacactcattgaagtgagtcagttcacttggccgaaaggcttttccgccgattcgacgcacgccgggttcaagcccgaccaggacgatatgggatggctttattccagtacccccgcaaacgcagccggggtttataccacgaaccagtttcaggccgcaccaaccaagctgaccaaacagacgatcaacttggcacatcaattacaagcggtggtcatgaatagtggtaatgccaattcatgcaacggggcgcaaggagaaaccgatgccttgatgatgcagaaaatgaccgccgatcgacttcaaatcgatccgcaactggtgggaattgcctccactggcgtgattggcgaaccgctgccaatggacaagattaaggctgggatttcccaactgaagctgacccaaaacgttggcgtcactaaagcgatcttgaccaccgacacccatcccaaaacgatgaccgtcaaatgtttgattgacggccaggaggtgaccaccaccggattttgtaaagggtctgggatgattcatcccaacatggccacgatgctgggttttgtgacaactgacgcagcaattaccggagaagatctccagcagctgctcagcacaacggtcgatgaaaccttcaatcagattactgtcgacggcgacacgtccactaacgacatggtggtcgtgatggccaacggcgctgctggaaatcaacccttaaccaaagccgatccggattacccgacctttgcggcagcctttaagcaggtactcacccatttggcacaggagattgccggtgacggtgagggggcttccaagttagtcgaagtcaatgtctctggcgcttataaccatttggagggccaacaggttgccaaggcaattgtcggctccaacctggtcaaagcgatgatctttggcgaagacggcaattggggcagaatcatgcaggcaatcggccagacaaccgcccacgttgatttaaacggcgtcagcgttgccattaatgacctggagctggtttacaacagcttgggcaccgggatcgatgatgataaagtcgcagcaacccttaaacagaacaaagtcgtgattgacgtcgacctacatgccggaaaagctaccggaactgcttggggctgtgatctcacttatcaatatgttcaaatcaacgcatcatatcgaagctaggaggtgaaggaaatgagtcagataattgttgtcaaagttggcggtcacgccactgatcagctgacagaagaattttttgaacagctacggagctggcgccaaatgggcaaacagattctgattgtccatggcggtgggccacaaatctctgagtggagcgcccaactcaatttgccggtcgccaaaattaacggcgtccgggttaccagcccgcaaaccctcaaagtcacccaagctgtattattgggactggttcagccgacactctgtcgccagttgtctgctcatggacttccggtcgtcggattaaatgccggcggtcagcctgtactggttggtgactacctggatcaggcagtttatggtgaggtcggccaggttatcggcatcaatcgggaatacatcaaccacgccttggctgatgggattggcgtgtgcgccccgttggcgatgaccaagtcgggtaagaatttaaatgtcaatggtgacgtggctgctgcagcagttgccagactgctgggggcagaaaagctgtatctggtaaccgatgtgcctggggtcatggtgaacagccacgtcattgatcaattgagcctgcagaaggccaatcagctgtttgaggctgagatcattaaatcagggatgcagccaaaaatcaaagcggcatttgacgcactaaagcatggtgtgaaagaagttaaaattactaatcagctgcagcattcagggaccagtttatcggttaagcagctggcaatttaaggagtgtagaatatggaacatgtttttccaacgtatgcccaatacccgatggaaattgtttcggggcatgattggcatttagtggatagtcatcacaaatcgtatttggattttaccagcggaatcggggtctgcagcttcggttacagcaatgattggattgagcagagcgtgattaatcagcttggaaaagtgtggcatacgtccaatctgtaccccagcagtctgcaggatgaagtagctgcttcgctgtgtccggccggcatgctggcctttttctgcaactcgggtactgaagccaatgaggccgcattcaaattggcccgcaaggcaactggtaaaggtaaagtcttggcgtttaacaatggctttcacggccggacttatggttcgatgtccttgaccggaaatcccgacatccagacgggatttaagccactggttccagaggtcagtttcgctgattacaacgatccccaggcacttgacgcaattaatgagggtttggccgctgtcattttggaagtgattcaaggggaaggcggcgtcgttaacggcaatggcgagtggctgcaaaaagttgccgctaaatgccacgaccagggcgttctgttaattatcgacgaggtgcagacaggcattggtcgaaccggaatgaagtttgccttccaacactacgatcttgatcctgacattattacgtgtgccaaagccttgggcaatggactgccaattggtgcgatgctgggtaaaaaggaactggcgaaggcgtttggtccgggttctcacggcacgacttttggcggcaacaagattgctttggcttccgcaaaagcagtcttagaacagttaaccccgaaatttttggctgaggttcaagaaaaatctcaagcggtctttgcggccattcacaaacagatttcgccattaaccgttgtggacagcgtgagtggattaggtctgatgatcgggattcatttgagtgctgccgttaaagtcgaggatgttattggccaacttcaagaaaacggcctgctgacgttgtcggctaagcacaatacgttacggttactgccaccattggtaatgagcgaggctgatctgttagccgggattgatcaaattgccgccgttttggcaaaggtggctgcggtcagtgaatcacaatccgtctaaaatgtgaaataaatgtgaataattttaataatacctttacatcccaagtcgcaacggttatctttaagatattctgttgccgttgagaggtggatcaacttgcaaatcgtgagacatttcttgaattatgggtggtctctgttgggtggcttggtggcgctgttactgatttatttttatgatggtgccctgcagttccctgactggtccacaaaaggcagtctgcggttggtatttaacctgtctgcttgggattggtactttttgttagatatgctcctgattctaccggtggttcgaatcctgatgcggcaggcattcagtcaagagtcggttgaatttgaaacctataaagacaaagctctccgcctgcatcatgctgacgttcaagctaatcataagaaccgtgcttggtcagctaatggcgtcaccgtcaacccttgggagtttcgctacactcagacccaatcatacaagggagcggcggattttggttttaacatctttaaaaatttgtgtttgaatcttctcattgtgcttttcggacctttgtggttgatttatgccctcattaaacgttcaaggcacaggaaaagcctgtaacttcagcatcatgctgagttgcaggctttttagttgcccttcaaatttagtttagtggtgcggtactcttcatcagttccgccggccacagagcgagaaggtggccgtagccttgggagtcaaatgccaagcattcccattcacgtttggattggaaaaccgagtagttgacgtcatccggggttgcggtgccggcagtcagtttgtcaaccggaatggaggtcaagacatcgtctgaaacgacgtaaatgcgattgttgacattattgaaggcaactccttgattaggcgagcccccgcgagtctttaacttttcaggggcagcggcgaatttgacactgttttcgtcgagtcgaccgtagaagaacatgtagcccatgccgttctttcgaccccaataagcgttaccgttcttatcaaagacttgtatattaaagatgtcagcaaggtaacattaatttgtactaaactgatattaagcgctgtggattagtccatctgaggtacggatcctaacggatactggttacgttagactctaaccacagtcttttgttgtactgttgattagtttg

SEQ ID NO: 169 - DNA, 73743 bp, Lactobacillus buchneri
catttaaaatatttatttagtttggctgtcctgtcgcatatatagaagaaaaaatctgacagaatccaacatgtcgttatatattacacaaagtcattgtaatatatttgtaaagtgctataaccagaaatgggtacaacaaatgttacctggtaacaaaattaataatttgggggaattaaccatgaatatggttgcacgtaacatgttaatcgcactttcggtagctggaacattattagggggatcggttgggggttcatgcggcgacggtcaacacagataatcaaccgcttgctcaaacttcggttcagaagcctgccgaaagtcagacggctgtcaatgatgatgcccaggcatccaatggttctcaaagtgctaactcaactgccaatgtgtcatcgagcaatgataccgccagtctaaaggcggaggcagttagccaaacagcaacacctaaagccaaaaagacagtttcccgttcaacggagtacagagaaactaagaccaataccaaagttaagaagaccagacggggcactaagacggttaaacaacaggtgattcgcaaacaggttgttaataatacgaaaaagggaaagtcagctaatcagtccgctaacaagtcaaataccagcaatcaggatgacagcaccaattcaacgcaagccgataccacttccccagtgaatgccaataatactaccgcacaacaaaataccactcaggctcagccaacgatcacgccggcagaggcccaagccaatcaggatgcacaaaatcaaaatattcaattgcaaccacagctgacccaatcgcaaatctctgcaaataaaggccaagcaatctatgatatcacgggtgctttttcgaatattgtggggcaggggaccgcaattgttaattcaatctgtgagattatctcaaccatcagaaacttgctttaagttgatctagagggggataatgatgatgaagcctatcaagtacaaatatttgtatagagctttaagtttagtgggtatttcggtaatgtcggtgttgttgattgggacaactggtgcgtccgctcatgaccagagtcaattcaataatgtcactaacagtcagaatcaaaccaatgatgatggcaacaacgacaatgacaacggtaatgacgataacaacaataataacaatcatggcggcggaggctacattcctggtggaaacaccagtgggggtagcgtcaataataatggcgatggaggaatatctgccggtggtgccacagctggggccaagagtggaaatggtggcgcgtcagctacggttgccataaatcccaataattcgaactcgcctgcttctaaggctcctaatgcaactaccagttccagcacaaatatgacgaagcaaggtagtcagaactcggttgaacaaccaagtccaaataatgacaaagcaggccagtcgtctcagtcaagtacccccacatcgcaaaagagtggggcagcagttaagccagatgaacatagccaggttgaatcagttagatcgactaaggtaacgcagcccggccaatttagtcctgaaaatcgtaagaaagcaagaccttataaaacgacgtggaagaaaggtcaaagacttgataagggtcagcgtcgtgaggttgggtatatgaaagcttattataaatattacagcgctcagtatccagacttccattatgcaggcggtggagattgtactaattggagttctcagctagcgcatgttggtggatataataagacatcacgcggcaaagaaacttatcatattgttcacggatatcggtgcaagaatcctaaaaaatggtatgctggagtttatcgaaaaaggggacagctaataaagcataaggcgtattcaacaagttggacgacagttggtggattttggcattactttactcacgttaagaagcgtccacattttgttacacactccttgagaagagttatggctcacgtaagagtcggggatgttgttcaatttttgggacgaactagcgaaaaacataactcgtggttccacactgtcacaatttcaaaagtaacaaagcatatggtttattatacttctcatgataggaatgtattgtttaagcctttagttaaggcaggggccagtgctaggattagtaaatatcgagttataagaatggggatttaaatgatgagattaagttttaaaacattgaagaagagaataaaaatgattacttcaattatcgttttcactgtcctaacttctatgattcttttatctatttctcctgcaaatacggttaggatgacaatgtttttatctgggcatcccagttatgctattaaatgtaatccagtccatgatacaggactaagtaaggcaatggatgcaaatatctatacaattcaagataagtatgcatataaccggcttggaatgaaacatgtggtactatttgaagttcatactatcttgatattccatacggctacagctacttaccgatacttttgagatgatctaatatttatcgacttgaacggaaaaggcttttaagtggggcagttatcttcaagatagctcattaaaacggattaaacagaatgcggcatttacggtattcaatggtccttattgaaatgaaacaggtggatgggttgaaccggaacacccggatcagccaggagcctgagatggtttatgagattgggcatcagtatccgcatcattaatgatgacatttaaaaaggctttgttactgaactgattagcgttcagtaacaaagtctttttgattggaattgtagaaagagacctgaagttcaaaagtgatgttccattcttcgagcttgttttttgacggattagcgatataactgaattatgagttagatgcagttctggtaacacatttatctgttgggggagaataacatggaaacgagtagcaggaagatatcacagattttgattggcttattgttcattctaattggcggtattgcgatctttctcagcatcttttcgctggggccgttaccaatatccaagagcatggccgctgtttattggctgatatttgccggtggaatgaacgtagttggtggaattgtctgcttgtttacacatcgccattccgtgttaataattcttgcggcagtgctattcgttgtcaatttgatccccggtattcagcaggtgatctcaggaaattattttttatttccgattatagttgtgctgatggttttagcgattgcaatcggggcagttggtttgtgggatcgaaacaaatgatcaaaggggatacaccaaaaaggctcgctaaaaattatgtaaacactatcgccaaaaaaattcgaagaaagatttttacaaggatataaataagctcttgttgactttgtctgcagttctcgctttgcgtggtaatcagttacaccaactttttattaaacatatgtacgtattacgatctccagacagcagggttcacttcgcttggtagttgttatgcctattaaagagcttcaaaatctctttattaattcgggatttagggcgaaacagccatattaatacaaatgtgaacataaggccgatccaatactcaagcaatgaaagggtggtattgacagcaatactaaaaaacagaacaagaaaaatgtcaaaagcccaactactgatacgatccgcggtcacctgatagtcgctgatctccttaaaaatgttattaaacggtttcttgaatctcattagtatcaattcccctcagattattaattaagttgaacactttagacccattcataaaaggtatagttcttttgagaatctcagtcaataattgagatagcttttaagcactgtttagagtcgcacttagcttgtaaaacgggagccaaccagtaatgccgattaccaacagaggtacggcaatactggtttataaatatccgttcaatccaaatgtaggtgtaaagatgattaaaacaagacgaggatgtcgcttttttacaaaattggttttaacatttaccgtcatcaccgtcattggtctgggtggaatgtcatttagttcccaaattttaatgactttcccaatgtcgataacccttgttccgccaagggttatcgacattactccgtaaatggattcaatttgatcgctgattaatgattgtcaccagttcaccaatgatgtatgataattctgaaaactgaatagatttcttcggggcagggtgcaattcccgaccgacggtgacgatttttaaatcgaagtccgtgacccgcgttaagcggttgacccagtgtgagtctgggaccgacagtaaagtctggatgggagaagaaaaagtaagcatttcaaaacatcggtgagaactgagatggtttggtgagcaattggaagtcgcctttttaggttgtcttcttcgttaccaatcagtcagttctccaagactcgtatgaaatcttatttagcttatctaattaatgcctcgcaattgttgcggggcttttttcgtggggtgagtaagattgaatgatcaagattatatgcagctagcagttactgaagcctggaaggggctgggagcgacttggaccaatccccgggttggtgccgtcatcgtgaaggatggccgaattttggcacgtggataccatcatcgatttggtgaaccgcatgccgaaattgatgccatatcccatttgaatagcctgacagatgccaagggcgccacgatttacgtgacgttggagccttgcagccactatgggaagacaccgccatgcgccgaccgattggtagccttggggttttcccgggtggttattgggcaggcagatcctaatccaattgttggtggcaaggggattgaccgactaaccaagcatggcgtggtcgttgataacttggatgacaccgaaatggttaacgaagcgtacaacttttattaccgtcgcaaacggccaatggtgacattgaagtacgcgatgtcccttgacggcaaaattaatcaggcgggcaataaccggacacggttgtcgggcgacgaggcatggcaagatagtcagcgactgcgtcaactgaaccaggcaattctagtgggagagcggacctatcgcgttgacgatccccgattgacaatcagatcggcgagagatgagacccagccgctgcgaattatcttgattcgggatgctcgacatcttgatttaaacgctaaattatttcaaagttctgaacccgtgtggattttgaccagtcaccagccaacgtttgcactacctgaatttgtgaaggcgttcgaggcacctgattggtcaccggcagcggttgttaagctgctaagtgaccaggggatccaatcattattggtggaaggtggcagccatgttcaagcggcctttgttgcggcgggcttagtggacaagctagtggcctacattacaccattaatgattggtggcacggggctgtcggcagtgactggccttggtaatgctcatatgcttcgttttacatcgccgactattcagagacttggcgatgatattaaactaacggccaggagggatgactaatgtttacaggaattgttcaggatcaggggcgggttgcccgcatccaaagggccaatcaccaagctaaactcgcgattcaaactaaattaatacgtcagtccgcgttttccttgggagacagcgttgccgtaaacggtgtctgcttgaccatttcagcatttgagcccgatggctttgttgccgatgtcatgccggagacgatgctgcgaacgaattttaaggatttaatggttggagattcggtaaatctcgaaccagcgctggcagcctctgatcgtctggatggacactttgtcctcgggcacgtggatacgaccgccactctactggcccgtaaaccggacgatgattctcagagattgacatttttgattgatcagaagtatcagccctacatcgttgagaagggttcagtttgccttaacggcattagtttaaccgtcgttaccaccactctgacaacctttgaggtagctttgattccttatacaatgatccacacgtcgttggggcaggttgccattggcgatcaggtgaacgtggaaaccgacattttgggcaaatacgtggtgaatctggcacagaaaggattggcaaattatgaatgagcagataattaaaagagttgaaagggcattggctgaattaaaagccggcaagttaattattgttgccgattcggttgatcgggaagctgagggcgacgtgatcgggctggcagaaaaggtgagcgctaaaaatgttaatcagatggttaccaaagcccgcgggctgctctgcgtgccgatgggggccgaggttgccaaacgcttaaacctggggctgatgattccggattccagtgatgcctttgggacggcattcacgactactttggatgccaaaacaacctccaccggcatttcagccttcgaccgagcagataccattcatcagttggcaaatggcaccagcacctgggatgacttctatcaccccggccacatctttccgttgatagcccgaaagaacggcatctatgaacggcaggggcacaccgaagcagcggtggatttggccaggttggccggggcttccccggtggcctatatctgtgaaattttgaaaaagaacggcaaaatggcccggcgaaaggatttgaaagccatcgcggaaggcaaccacctgacgctactgacgattgacgaaattattgcctaccgccgttatcgggacgcacaaccgattcaaagtatcacgactgttagcttgccgacccgctacggggattttactctggaagcctttgatactggggatgatagtgagccgacactattaatttccaaaggtcacttagcgggggatgagccgttattgacacggctgcacagcgagtgcttaaccggcgacattcttggatcgaagcgttgtgattgtgggcctcagctccaagaagcgctacgcaggattcaacgcaacggccgtggtgccgtcctatatctgcgtcaggagggtcggggaattggcctggctaacaagttaaaggcctacgctcttcaagagcaagggcttgatactgttcaggcgaatcaacacttggggcttcccattgataatcgtaattatgaaattgccgctgccattttgaagcgcaagggtgtttccaaggttcggctgatgacaaataatccggataagattcaccagttagcagaatatggtattcaaaccactgagcgggtgtcactggaggtgggccttaccccagaaaataagaactacttattgacgaagaaaacaaaactaaatcatttattgagtgaggtcggaaactaatgaataattttacaggaaagttaatcagtcagcacaagcgaattgggattgtcgttgcccaatttaacgaattggtgaccagtcggctcttggaaggctgcctttcgcagttagcgctgcttggaattcctgatgccgccatcacgatcgtccacgttcctggagccatcgagattcctcgagaggtcaaattgttgggagattccaatcaggttgacggcattattgccctgggcgcagtgattcgtggtgagacggctcattttgattatgtgtgtcaagcagctacaaccggattgtcgtcgctcacgctaaacggtcccgtaccagtcatgtttggggtgttgactactgacaacactgagcaggcgctcgctcgggcaggtggcaaagctggcaacaagggatccgagtgtgccagcggactcatgcaagtgttgacggtcgaatcgcagattgctgggatgaaaggataattaagcgattgagatcacaaaaaatctctcatattttatgggggggtatagctcacagtcggtgattatcgaaattctttggtatttctcgattttaccgatttgaatagtggaaagataagcactttcggtcatataagggggttagccaaacgtccaaaatctggatacgcggctaacccccttagactctggaagtgattgcttatttttacactcttttattctaatgatcatccaagcgccacatccagcaccatcatcaacgtaaacccagccataatcccaaagatcgcccagtgagattcttccttagtcctggcgtgggcttccgggatgagttccttgcaggcgacgtagatcatcgcaccagctgcaaacgacagggcgtatggcagcagcgagttgaccgaagcaaccaacagggcgcctaacaccccggcgatcggctcaaccgcaccactagcctgaccatacataaaggctcggaatcgactcatgccgccttggcgcaggggaatcgaaaccgccgcaccttccgggaagttctgcagcccaatcccaatggcaaccgtcgtggctgccagcagcattgccgcctgttcgccattaccggcagcgccgatagccccaaaggccaccccgactgccagaccttcaggaatattatgcagggttattgaaaagaccagtagaatcgcgcgtttgacggccgctcgggaactaccctcggttcgagcgcgttttaaataaattccgggaatgattttatcagccagatacaaaaagaatccgccggcggcaaaaccaatgccaacgaccagccaggggatccggtcctgctgctcagccaagttgatggctggatccaacagcgaccaaaaagatgccgcaatcatcacaccggctgcgaacccatacatcaaggccaaagcgtgactgcggatggttttgaaagcaaataccaatgcggaccccaatgccgtgactgcccacgtgaataatgtggcgaacagtgcctgctgccagggagcaaaattcattaaagtgtccataacgacctcgctttataagtaaagttcagttcctaccataagtataacaagaagctggcagtgaaagccagtctggcggcagtttcacatttctcagattcaaagtgacttttaatgctaaaccatgataagtccgctatacttagggtatgtaaaagcaaatttttgagaaatgggatgattttttgacgaaggttactgcttacatggtccgtcacggacaaacatacttgaacatgtacaacaaggttcaaggttggattgattctccgctgactgaaaagggaattcaagatgctaaaagtgctgggaaacgactcgcaaagattaattttgccgcttcctttaccagtgactccggtcgggcaatcgacaccggaaaaattattttgaaagctaatccgcataacatgaatattgttagttaccaatatcccgaattacgagaacaatttcacggttatttcgaaggtaacgaccttaatcaaatgtggcagttcgtcggcgcccaagttcaagaaaccaccgaaaaagaagtgttgaccaattttggcttggaacgggcacgggacttgatccaccgggccgacttgtacaacaatgctgaaaataacgccatgttttgggagcggctcgaccacggctttgataaaattcgccaaaacacccatgacggcgaggatatcctgattgtctcccacgggatgacgatccgctcaattgtcgatcgttacgcaccaaaactggatctgggtgtcgctactaagaacggcagtgtcaccaagttgatcatcactgatgatgacattgacgtcgagtacttcaacaatctcggcgaggtctagttgtttctcttctattaatatgatatatttgtaagacatgtattggtcaggacgaatcaagccctggccattgtttttgattatgggaaacgtgggctgtcggtgtatttttgaacacgactgcgcgcaggctattgaacgaggtaaatcaatgattacgattcaaaacatgggattacaattctcaggtaaaaaactttatgaagatgttaacttaaaattcacaccgggcaactgttacggtgtgattggcgcgaacggtgccggcaaatcaacttttctaaaactgttgcggggggaattgaccccaagcagcggtgaaatccacatggataagaacgagcggatttccagcttaagtcaggaccattatggctttgaagaccagaccgtcatgcagacggtgattcaaggctaccaacatttggccgacgtcatggcggaaaaggatgctttatatgccaaagctgatttttccgacgaagatggcatcaaggccgccaatttagaagccgaattcgctgaaatggacggctggaacgctgaatcagatgcttcacaattgctgcagtcactggaaattcctgaagatctgcaccaacaattgatgagcgagttgactgaaggccaaaaggttaaggtattgctggcccgagccttatttggcgaaccggatatcctgttgctcgatgagccgaccaatggactggatgtctactcaatcgaatggctggagaacttcttggctgactaccccaagattacaatcatcgtgtctcatgaccgtcacttcttgaaccagacttgtacgatgatgtgtgacgttgattttggtgagatcaagatgtatgtcggcaactacgacttttggctgcaatccagtcaattggctgccaagatgcgggccgattccaatgccaagaaggaagacaagatcaaggaactgcaagcctttgtcgcccggttcagtgccaatgcttccaaatccaagcaggcgacttcgcggaagaagcaattggataagatctccttggaagacatcaagccgtcttcgagaaagtatcctttcatcaagttcgaggagaaccggccattggggaatgacttgctgagagtcgacaagctctccaagtcaattgacggtgtcaagatccttgataacgtgaccttcactctgcgtccaggtgagaagactgctttggtcagccgtaatgatttggcaacgacaactttgatgcagattttggctggtgaactcacgcctgatagtggtgagatcaaatggggccaaacggttgagatgtctgctctgatgaaggattttgcttcagagttcaaagataacgatcaacggatcattgactggctgcggcaatttgctgaaaagggcagcgatgatgatgctttcctgcgtggattcctggggagaatgttgttctctggggatgatgtcaacaaggaagtcaacgtcctttccggaggcgaaaaagttcgctgcgtgttgtcgaaaatgatgctccaaaaaggcaacaccttgctgatggacgatccaaccaatcacttggatttggaatcaatcacggctttgaacgaagccttggtgaacttccccgggtcgatcatctttacatctcatgatcacgagttcattcaaacgatcgccaaccacataatcgaagtatccaacaacggtctgatcgataaggcggatacaacctacgatgagttcattaatcacccagacgttcagaaaaaattaagtgatttatacgattgaaatgccgatttaacgcccactttgagacttctcaaagtgggcgtttttttgtcttttgcggcaagcaagttaatgtcatttctgggatatgttcgttataatgggtttgaatatataagataactaatagcaacaataaccaaaggggaatacgaatatgaaagtcaataaatacttgctaatgtcacttctcgtgattagcacagggggaatcctgacgtttgccaacgcagattcgacgatgacttcaaatgatgtggcccatgccgcgaccacgcaagttgctgatgatgcggtaccggacgggacgattgtgacaccgatgaaagtggtgaaggcacccgatcccgctgataagactgacaacccaacgattgatcctaaggaacactcggatattccagtgaccaatttttacaaaggaagtgtttttcatcaagcacccatctacgtttccggaaaattggccaacccaatgggcaccaatgcgaaagtgggctcccagacaatttccgatacacagggaaccatcaactctaatgattatattcaagcacccaatccagatgaaacgatcaactatgcttattacaccggctctaatgcctggatgatcggctgggccaaggacaactcgaaattttatctgcataacgtcgatagcgatggaaaattgacgaatacgattgaggttccagggccaacggcgagtgatttcaatcccaactggacctataatgccggtaatgttcaattttcctggcaaaatggtcatattgagttggatttacagaataatgatctgtatgcgtcaagttccgccaatcctcttaattatttaaataatgtgccggcaaaatttgttgatgccaaaggcaacgagttggcgccaacccagaacatctccggctattcaggaacttttgtcgatgttaattaccccaccattcctgggtatcgacttgtgagagttccctacatgaataacgcccatcaatttttaatcaataacattacggccacgacaccaggtgattggcaatttgaacaatctaatcggtatgtgacaattgccagaaaagtgattgacgaccaaaatactcaacagatgtacatgatatttgattactcgaagattcccgattttagttttactggcaaagctcaaagtaagactgtgactgttaaggcgacgccgggtggctttattgctgccgatttcagttatggcatgattcggacttatgcgacggcctcaatgccgttacccgtcggcaacccactaacgtttgtctacgaaccaatcaccgaataccatctgaccatcaactacctggaaaaaggcaccaacaaagtgctggctgatccatacaaagccagtggtgcgggaacctacgaaatcgattctccggaaatagccggttacacagctgatcagccggtcgtcaaaggtgtcttgggcaaagacgataccatcaatgtctactacactccaaaggacgtaccgccgaccccaaccaatgattctgccgcagttaatgtgaactacatcaacgaagcaaccggcgacttgattcaatccaaaaagatctacggtaaaatcggtggcgactatcaagctgatggcccttatcaaccagataagctgaccgtcaacggtgacagctatactttggataaagacaaactgccggcaaatatcaaaggtcaattttccgatcaaacgcccgcagtgaactattactacaagaaagatgccaccccggtaacgccaaccaataactctaccgcagtgaccgtcaactatatcaatgaagacaataacgatttgattcaatccaagaaaatctatggcaaaaatggtgacacctaccaagctgatggcccttatcaaccagacaagctgaccgtcaacggcgacagctacactttggataaggctaagctgcctgataatattaacgggaagtttaccgaaaatgcacctgcagtcaactattactacaaaaaggatgccactccggtatccccaaccgataactcggcgacagtcactgtcaactacatcaatgaagaaactggtgctttgattcaatccaaaaagatctacggtaaaattaacgattcctaccgggccgacggttcctatcaaccgcaaaccctcactgttaatgggcagacttacactttggatactgacagactgccgaataatattactgggatatacagtgataagacgcctgatgtgaactactactacaagcaaaaacaaaccccagtgactccagtcaatccaccaattaatccggttaacccggtaacgccggtcaacccaacgccgacgccgagcccacaaccgaccccaggaacgactactgacaatcagtccggtaagattgctaagaagggcgaagtggtttattccttgaagaagatttatctctacaaagataaaaccttcaagaaggccgatcgtcaatttggctatgtcaagaagccacgggtcttccgaccgatgtttgtggtcactgattacgctaagtccaatgctggctggttgcgttataaagtccgtgacgtcaaccatttgagcaagaccgacggctggactggctacattaccaccaactttgactatgttcgaccagtctattatcacagcagtcatcaaacactgacggtgatcaatccccgcggtgtcaatgaatacctcaacaaaaatttgacgggcaaagtgaagaatatcaagcagggaacggttctccacgtaaccggcttcgtcaaacacaatttgaccacccggtacgtcctgagcaatggccactacattaccggtaaccggaagttagttaagatgggtaaaatcaagcagcctcagcaattaaaagccacccacttcatcaaccgatatgccgatccaaatttggctaagcgaaatgggcacttcaagaaaggcaccaaactcgtgattaagcgttataccttcagtcatgaagcttcactgatcaagtccggcacgatgcgctatgccgtcaagggcggttatgtgactgctaatcagaagtatgtcaaagtgatcaaatagttcgaataacaccattggagaaatcaatctcaatggtgtttttatttgccgtcagcaaggaagttgctggcttttggtcccggatttttcacgattatccctccataacggtccgcttttgcaagctaattttgccaataaatacccaaaccaatatataatcattgtaagtaccaataagtcacgtaacacttctaggggggattttctgtgacacaagaattaggcaccactgatttggggacatacgagtacgtttcacgggtgtacaacgaaaacattcagctgccggattacaaactgccgaccagcgtagctgatgggactcaggttttcttcgacacagacgtgatcaaattgtcgatggtcattgccgaccagagagtacaaaagatcacgattgtgacaccaaaaccgcagtcactggagtacatgcgggtgtttgaaggcttcgaatttggcatggaagcactggggacttggattaacacttaccatcgctcaactcttagtcatggcaaggccgccgacgtcgtcaacggcatcttggccagctacagcaccacgaaagataatgttttgactgtcagcttaactcgggcacactaaaaatcgtcacgctatttatttctcaataaatggtgtgacgatttttttgattgcttagttaaattagttcaagccggagacttcagcgaatttcttggcagtccgaaccatgttggaaacgaagccatattcgttatcgaaccaggtagcggtcttaacaacttggaagtcaccgttagaggttacttcagtcaaagttgggtcgtagactgccccgtgggtgtcgccgataatgtcagatgagacaatctcatcttcgttccagccaaatgccgggttatcaacggtgtgcggtttgatggcatcgttaacttggtcagcggtaactttggtgttgagaactgaaaccaattcgcaaactgaaccgtcaaccacggcaacccgttgagcatggccttgtaaatggccttcaagttctgggattaccaggccgattgctttagcggcaccggttgaatgaggaatcgtgttggccgaagcggtacggttaggacggaacttcttacctttagggccatcaagaatcatctgtgaactggtaaatgcgtgaatcgcggtcatggtcccaacttcgaggccgaattccttgttcaggaagtaagccattggtgccaaagcgttggtggtgcaagaacctgctgagatgatttgatcgtcggcatccaaagtatcgtcgttaacgttaaacacgatggtcttcattgggccggcaggagctgagatcaagactttcttaaccccggcgtccaaatgggcttgggatttttccttggaagtgtagaaacctgtacattcaaggactaaatcaacgccattttcctttacccaagggatgttacttgcgtctttttctgcataaacacggtagttctttccatcaacgaccagtgagtcatcggttgacgaaatctcatatggcagggtaccgtgagttgagtcatatttgaagagataagccagcatggatggactggtcaaatcgttaatcgcaacaacttccaaatcaggatcgttgatttccaagattcggcgtaaaattaaccgaccgattctaccgaaaccattaattcctatctttaccataagtgaaatcccccttacaattctgatcgacagtcgacatgataattactttgtgtacaacctgttgtaatcatcaaagtaagtttaagcggattgagggggaaattcaatcaaagcgacttggcaacttgaactatgaatggcggtcaaaaaaggccgccatgcaagtaaagcgacttgcacaacggcctcagcttagaaggacctaatcagattcttcaatattcaatttcattcgcttctgcagtctaaagttaatcacagcggcaatcaatgcggctgcactcagtaaggttgccaacaggaagtcatatttcccgccgacaaacgaacgagcagccaagcttcctgtaccgttgttctgactgatggccatcaccgccgccataatcccgactccaatcgagccggcaaattgctggatcatactgaacagtgagttgacgtcggcggtatacttccgcggcacgtttaacatggcgttggaaatggtgttggagaagcccatattgaagccaaaacgcaggaaggtgtagttcaacaggacaatccaggcggtcaagacggcttggatgccgaagaaaatcaggccgcccaacgtcattgaactgagccccagaataattggcaaggcgtatcccttactgtcagcgaggtggccggcatatggtgaaatcgccgcaccaactagtgatcccggcagcaggaccagtcccgcgataaatggcgaactgtggaggacgtattggcaatagacggggatcaggaatgacacgccgatgttgacgaattgcaggacgaagtaggtgaacgccgacagtgaagacgacagccatttcaaaattcggatgtccagcagctgggttttaccgtgagtatcggagtaaatgaagattgccagactaatgaagccaatgacaaacgggatcaagacttgcccactcaacagtgaatatttgccggccttgctgacaccgaagacaaatgagaacagggtggcagccaggaagatcaagctgatgacgtcaaagccgccagtgccgactggatcaatgcgaatataccgcgatccgaggtaccagctgatgacgatgattggcaggattaaccagaaaatcatccgccaggacatggtcgatgacacggttccgccataggtcggcccaagcgcaggcgccaaagaaatgaccatcccagccagaccggtcatcgaaccgattcgacctgcgggaattttgttaaagataatgtggaacatcaacggcgtcgacaatccggtcgcaatcgcctggatcaatcgtccgctcattaagatgggaaagcttggtgaagtggcacacatgatgtcgccgaccacaaaggcaatggcggccagtaagtggatgctttgcgatttgaatttcttaagtagaaaggcggttgttgccatgacaatcgtcaccatcaacaggtagccggtggtaatccactggacggtgtccagggtgacgttgaagactttggttaattcgggaaaggtgacgttcattgacgtttcggtcaggattccggtaaatgagagcagtgcggcagccagcagggcaagataggtttgccggctgattttttcgttagtgttggacatgatttcatctctttctgattcaatagttgaaaatgggatttaatttgaattcttcttgatactttgaatgttgacttttgaaataatggcagatgctcaaaacttctcagacaaattccagggcaagaaaaaagcgagtggcaattcactcactccggttcaagttacttgctggtggctttaaatttgattccaatccagatcccagacgacgcccatggctttttcgccggtatggacggcaatcgccgggctgatttggtaggtgctgacgctggccttcgggaaatgttcatgaaaggctgtcacccaggctttgcttaagtctgggttgttggcgtcgaccactgaaatccgcattggcgaatcgaaagtcgtctggtcgatggaattgatgatgtgctggagcgcttgtttcatggtcctctccttggcctctggaacgatcttgccggcgtcgtcaaacgtcagaattggcttgattttcagcatgttcccaaaaaatgcggaggtgttggaaattcggccggttctgcgcagatgatccaagctgtccacgaccagagaaacgtgaatcgagtcgcgcaactgttcaagcttggggataatcacatcggcattctcaccattttcggccatcttacccgctaacaagcataagtcagcttcgccggcgctggcgattttcgagtcaaacgggtagaccttgatgttggtgacttggtggctgtaggccactaaattctcatagaagctggtgatcccggatgagaggttgacacagatggcttcatcatatcctttggcagccaaagtatcaaaggcttcctgcatttgggccatggtgacttgcgcagttgtcggcaatttgtcagtctctgccaatttcttcaggaattcttgcgaggtgatgtcaacgccatcgtggtattcctgggtgccgaagatgatggtaatcggcagaacggtgatgttatattgggcagcgaccgctggatcgaggtagctggcactgtcggtaattacggctgttttcatttcgattatcctcttttcggggttgtaattgtattttaacccttattttgattcaaaacaaaggaagtccacaaaaaagaagcctcgacgaaggtcgagacttcctaattcctacatattagtagttaccttgaataaccagtttcttgttagcagtaatgtaagtgccattgcttaacttgtaacgggtggtcaggttgtgcttttcaaaactcttaacggttacatgagtgcctttcttgaaggtcttagcgcgaccagttaagttcacgttcttgtatgcgtgaatgcctttcttgttaataacggtaatcttgtggctcttaggcattgtcttgtagtaaacgttgacaacgtacttcgggttggcggtaatgtagccaaccttgccagcggtcttcttgccgtggttaacgtcacgaaccttgtaacgaagggcgccaccattggacttgtcatagcctaagacaacaaacattgggcggttaacccgcttagcctttggataggtagccatgcgttgtgacttcttgaaattggcactgcgatacatgtagatacccttggttgcgtaaaccgctgaacctttaacggcggcgtagtttggtaggccggttccgtttgggttgcttgggtttgatgggttccaggcactgttgccggagttgccgttgttgttagtggttgaattgttattgtttgagttgttgttgcttgggatattgccacgctggccaacagttactttgacggtctttgaagcagcattattaccggtagtgtaagtgacgtcgtaaaccgcacctgcattatttgtatctactgcattgacggttttgccatttaactgaatggtgacgttaacgccatcggataatttggtcacagcttgtccattttggtcgagatgtttagttaaaccgttgaatttctgtgaatcccagttactgccgtaatttactttgaagtcttttccgtcaatgtaagaagcatcggtggtttttataccagttatatgctttgatacaccactatagttatagtcgatattccaacttcctgctgttgttcctggggtgactttgacgattgatgctggatcagtagtcgtatccttcgtggcatcgtcgttgaataatgcggtcacattggcaacggcggcttttactaaatcgttatagttgtcatagttggtggccggcaatgactcttcgtttgccaggacgatatttttgaatggtttggcatataagtcttggtcgcctaattgagtatctgtgtcgtcagaaacgaacccgaaaacatatgtgtcattgtagaagctatcatcaattggattattaaaatcgaagtgtgagttgggtttaacaggggccaccattgtaagtttcttcgttgggcttagactttgagctgatggagcgccgtcagctgggtctatgggtcctcccatgtaaatagcaatcggagtctggtcggaaatgggtgtagcagtgtaagatcctcccacgtagctatatccatcggtaaatttaggatccgtttgctcagaattgaatgatatctgattggctctcgacgaatcgtatgaaaaaacaggagcatagtttgggaaaaataaaactgcttcaactttttctgcctgtgatgaaatattctcaactgaatagtgaatcaataagtttttatatttgtccaggttaacagttcttccgttttgtggggtagtaacatcaccaggggccttatagtttgtcggactgtcgcttgaaaccaccgaagacagggttactggtgaaccaccattcgctggttcaccagttaaccacattgtacgctggatagtagcgccgttatcgcttgcagtcgcagcaaacgaagtgatccctcctaaaattaagaatgcaataccaattgtaactgtcgtaagaataagttgtgctaactttgtagacagtgtacaaaatttatttcgtatcaaaagaataccccctcaaaaagtatattatattaatgggttgtaaattcagctcacataactattttagcataattacgttagctattaaatagaggctagtccgtgcggtttatcttttataaatagtttgtatgtaaagctcatcacttatttactatagtgaaagataatacaattttacgttataattaacccaacaacaaaaaaggacgggatcacatgaaattcatttcttggaacgtgaacgggcttcgtgccgccgtgaagcatgactttgccgagacatttaagaagttggatgctgatttcttctgcattcaagaaactaagatgcaggaagggcagttggagttggacttgcctggctaccagcaatacttcaattatgctgaacggaagggttactccggcacggccatttttaccaagcacgcgccattggatgtgacctatggcattaacagcgacgagttcaatcacgaagggcgggcgatcacccttgaatatcccgacttttatctggtgaccagctacgttcccaactctggggctgggctgaaacgactcgattttcgtatgggctggaacaaggctttctaccaatacttaactgaattggatgccaaaaagccggtcattctctgtggcgatctgaatgtggcccacaaagaaatcgatttgaagaacccgcaatccaaccaccacaacgctggctttacagatgaggaacgccaagatttcaccaacctgttaaaagccggcttcatggataccttcaggcacttttatcccgaccagacggacatctattcctggtggagttatcggttccattcccgcgatcggaatgccggctggcggattgactactttgtggccagcaaccggttggcggatgagattgaggactcgaagattttgactgatgtgttcggctcggatcattgtccagtagaactggatacaaaattaccacgacccatgatataatagagtcgtggtaaagttgtagagcgatagcttagtagttacggagaaccgctagacccgtcaaagtttatgagcggttctttttgattgcccggataagatccgcaactgcgaaaattatccaggcaactgcttttagacatgcagcgatcgcaaaaatcatcgctgcacatagcattaagacttagagcaatcctttcttggatagatttttgttgcatgcgcaacacctcgattcaaaaaacgactactaccgctttgacaaccctacaagtaaaaattataccgtaatttgtccctcgatacattaaccattcattagaaaaaggaccaaatcaaaaactcacaactgccagtcggaagttgtgagtttttgtcatcttttatcattgcccgccagcaaatttactttaaatacgtctccggttgacttaacttctcataatcctgcttggacaactgataaacgatcgtatgcagaattgggatctgagtcattttgacatttcgtgagttggcatagacgtacagattgatgttaacgtcgtgcgcccgctggtgtagcaagtagcggtatttgacccgcaggccagctggtaattggccattgaccgtgctgcggtcactttgactggttaagttggtgacgcgcttgatttttgcctggctggtggtagttaagatctggcggttatgcgcgtcgtagaccgtgaccgaatcctttttagaagcgggagtccctgctgaacacgcagagagcgcgagacctaatccaattgataacatcagcacttttgatcgttgtttcatttgaattaccccagattttacagaccattattcaaaatgcttcaaatcaatctcactgagtttggactttcgaaaatagaacatcgcgatcagtacgaacaatactaactcaccaacggttgccagcggtgagaaggttgacgagccgacgttggcgaaggtgctgcccgaaaccaagacgatagtagcgtcccaagccgcgtgaaacagcattggaacgataattgatcctgaccgcagataaagggcacttaacaagaagccgatactgatggcgccgaaaatttgaaccaaagttgatgaaacggattgagacataaaattactgccgtgggcgatcccaaataagatgctggagatggtcaccgcgtaccaaatcgttttggcttttgaaaaatgagggaaagatttcaagaggatgcctaaaatcaatccacggaataaatactcttcaaaaacgccggcaccgattccggaaacggccgccatcacgatagtgtgagtgctgtgcggggccagtgaaattaatagcaaatacaaaagaaccagaataaatggtaccgaaattaatagcgttttgccaaagttgacagtggctgccaatctgacgggttgcttgatccaataataatttaacgcaaaaaagatcactaataacaaaatttcctgaacagcaatctgtgagatttcgcccatcccaagtgccagctcaattgaataaatcgcgatcaacaaaccaaataccagcacttcaagaatggcggcctgccaataacgacgagtcactgaattttccaatctaatcattccccctaaaagttaaataagcattctgacatatttttattattcacaatctatggcaggtatgcaagtatcttgacggccgattacggttcaatgacctgactattgacgtagaacttcttaccgccaacgtaatagcggatcgaaatggtgacactttcatcatacttcttgtcttgggcgggattaacggtagccatgtgctggtcggtcttggtgatcttcaaacggtagcggtgattgccttttttggcgacgtgcttcatggtcagaccgctgatttttgacttggtgtagaagtaataggcgttacccttcttcaccaactgttccactttggcggctgaatgcggctctggcatctttttgacccagtagtcgtagccggtgaaatattccaggtagccgtcatcggtcacccgcaggcagttttcaattttgtactgctggcgtagggggaaggctttggtgccctgccagatcagaccgccgatcgtgccggtatacggctgcttgaagtaactttggtaagccggtgcgtggacttttttgaaggtgctggacttggcccagatgccgctagtggtcgtcacgttgtggtatgactggacgacgccctttcgcagtgaccagtgcaggcggttcaaattgatggttaagtatggatgcttggttttgcggctcctggtcaggctgctggacttaaagaccgtgccctttggaatggtgattttgatgtttttatagtgactgttggtggtgtggatcgtctttttggtcatcaggtattgatctttggaaaaatgtgatagataagtgctggcatctaccggaattgttgccccgatcgttaagagaacccccaacgcaaacagtccgaattgtaatctgaattttgtcatggtgctttccccccttatttaaacgtggtcacgctgttattttcataccaggattctttaccaactttgaaaatccaattggtgaggatctttttgaccttggaggtattcggcactacggtgatagtgccggcctcggcattggtgatggtcaattggtagtggtccttggattttttgacaaagggaagctgcttcactcgtgatttggtggtcaaaatcgtctcgccgctggccattgggtggctggccttttcgactttcaggctggcagtgggtttgggtgagactttgaagacaaatggcgaactggcatcgtattccaggtagccgtcggtcgtcactcgcagtcgagcggcagccgaagtggcgtagtcaaccggcaaacgggttcctttccagaggtcgccggtttcggttctgactttcccctgggactttttgccgtcggactgggcagcgtagtagctcagataagtgggcttgtggatttgcttaaagttgtagcctttggcgcggatccagtgactgtaaacggtcggttttttcaccgagagcagcggctttctgatgttatagcttaaccggtcgacatagacgtcgacatacttattgccatgcagatgcttggtgccggcgacttgaaccaccgttcctttgggcaaagtgagtttggcgtgcttgttgctattgtatgtactgatgctgcgctgggttttcaaaaagctgtttttgaccacggtggcgtgggccggctgagtctggataaatgttgccccgagcatgaataacgcccccgcaatcagctgagtggttggtttcaatgtagattcccccttggatggtccttttgatacgacctataaaattattgtagcattttagacggcaaaaaagctgcctaatcctttcagatcaggcagcttcaggttaaaaatttagttattcatcaatttgtcaatcatcttgtcaacggcatccacgtagccagcgagtttctgatcagctgcgccttggctcttgtcatcgacttccaagtagaacttcactttaggttcagttccggaaggccgaacagccagccaggtctcatcgtccagccagtattttaagacgttggatttcggtaagtcaatgatcgtccgcttgccatcctgatccgtcaattcagatgactggtaatcggcgtgactcaagactttgtggccgttaaattcagtcagtggattgtcacggagttctgacatgatgtgggccatcttgtccttaccgtccaggccgtcaaattccttggcgatggtcttctcagcatagtaaccgtacttctggaacatttcttgaacgccgtcgtacagagtcttgccttgactcttatagtaagcagcaacttcagcgagcaatagcacggtctgaatggcatccttgtcacgaacgaatggcttgatcaggtaaccaaagctctcttcaaagccaaacaggaaggtgtggtcgtgttcggtttcgtagtggtgaatggcttcggcgataaatttgaagccggtcagcacgttgttggtggcaacgccgtacgaagcggcaatcttgggtgccaaatcagtcgaaacgattgatttaacgatggtcccatcggctggtaagtcgccggccttctttttggcggccaaaatgtagttcaagaggacactggcaatttgatttccacttaacagggtgtaatcgccatcaggttgacgaacggcgcagcctaagcggtcggcgtcaggatcagatgcaatcagcacgtcggcagaaactttcttaccgagttcgcgcgccaaatcaaaggcttgcgggaactctgggtttggaaatggggtggttgggaattcggggtcggcgatggtctgttccggcacgacaacgtaattcttgaaaccagcggcttccaaggcccggcgagcgataattttaccagttccgtgaagcggtgagtagacgaatttcatgttggccccgacgtttttgatcaggtcgtggtcgatgttgacagtttgcactttttccaagtaggcttgatcgactgcttcgccgatcaggttcatgattttagcttcacgcagctcttgttctggcgtaacattgatagcgaacaagtcgctgttcttgcggatgtaggaagtaatcagatccgattccttcggtggcatctggccgccgtcttggccgtaaatcttaaagccgttgtattgcttcgggttgtgggatgcggtaatcatgatcccggcataggtgttcaaatggcgaacagcgaatgacaactcgggggtagggcgaatgtcgtcgaatacaaaacttgggatatggtgataacctaagactttggcagattcatgggcaaattcctttgaatagtaacgggagtcaaagctgatggcaacgccacgtttgcgggtggcttcatccaaagtatccataaatgaagccaggccttcagcagcttggcgaacggtgtagatgttcatccgattagtgccggcacccagcaccccacgcattccggcagttccaaatgagagaaccgttccgaatgcatccttcttttggtctgaattatttttcattttatttaaatcaagtacaagattttctggtaaattaggttgattggtccattgttggtaagcgtcttcaattttgtcgtccacgacatgaccctccttatatttaaaatcaacctaattatagaaatttaccaagcacacgtcaacaagtttactagccaaaaacgccaatataacggaatatccttgacatatcaaggtaaagaacatatatttattttagtaaattaactaaaaggattcgatacataaattcgcagtatttgatggaggggtgagatcatggcaacaattaaagatatcgcgcacaaagcaggggtttctatcaccactgtttcgcgagtgctgaattatgacaaatcattatctgtcagtgacctgactcgcaagaagatttttgaggcggctgaagcgctggattacacgaaaaagaagcggtcgagctcgactcgagatacgatcgcgattgttgaatggtacaccgagcagcaggaactcgatgatttgtactatttgtcgattcggatgggcgtggaaaagcaggccgaacgcgatcattataagatcaaacgttattttgccggcgatccgctgactgcgattgacgacgtaagcggcatcgtggcgattggcaagttcagtgatgcccagattgaggagatgcaggaagtcagtgacaacctggtctttgttgactttgacactttggccaaggggcatgattgtgtggtcaccgactttgacagctccactaagtctgtactgaaatacttcattgagaatggcttgaagcgcattgggatgatctccggtgttgaatacagtagtgatcatgagttgaagattaccgatcaccgcttcgatgttttcaaaaactacctcgaaaagcgttccctgtacgacccagccaacgtatttgtcggtgattacaccctccagtccagctatgacaccgttgacgaagcactgaaacggtcgaaagaatcgttccccaacgcgctgtttgtttccaacgatgccatggcagttggtgctttgaaggcgctccatgaaaatggggtgaaggtgccggacgatgtcagtttggtcagtttcaacgacactgcggttgccaagtatgtgatcccgtcactgacggcagttaaggttaatactggtaagatgggcgccgtcgctgttcgtttgttaggcctgctggataataatctggacaacgatgagcacacgccggaaaaagtcgttgtggctactcgattggttgaacgggagagtgtccgcaagggaaagccaattcatgaggcagattaacttgtaaattaacatctaaaatgaccgctaacgttgaatttgcgttagcggtcattattggttacataacattttttgaacagccgattatccgagtaaataggtgacgccggtcgactcccgaccaataaaggtggtcatctccgggttggttggcacgatggaaattggtacaaatgggaactcatcgttgagcatttcccgcaagaactgggctcgggcgttggtgccggaatgcagaatggtcagtttaacaatgcattcgtcgtgcatcgcctgcatttgggtctgccagaattcgttgagcgactcgtctttggagccatgggcaaccaggtcgaaatcgttatcgccgaattgaatcatgtaggccgtattggcgtgtttgcccaagaagccgcgaagcttgccgatgatgcgattgttgacgatctgctggttgttgcggaccgaaaagaagatccgggtacggttacggattttagtgagttggggcaaaatgtccggaatcgatttacctgccgcaatgagtttggcagcttccaagacctgataggatagtccggcggcggtcacctggctgttgacgacggtgacttggctggtcgacttgctggcagcggtcttggcattggcataggtattagacagcttatcacttaaatgaatcgagagaatctggctgccgtcagcgcccaactcattgtatagtcgagtgatttcaccgacagaaacgtcaccaatgatcggcttattggaacattgatcaaataattgcaggaacttctcgctgctaattttgttgacataaccaaggagcttgccatccatgataattggcggattcaggaccgaaattccgtatgcttgaaggtcagcttttgataggtgagccgcagagtcggtcacaagtttaatttgattcatcatttcaccccattcctcgaaaaattattatactattattgtatagcatgaataactataattgttgtgttttgaaaaagattagattttaattctaactttattcacaaattagtcatgaaagggcggaaattcatgaaaggcaagtacgaagtgaaccaattcatcggcgtcccactggaaaccgatgactccgggcagtatcgcatcaagcgcgatgaatccggggactttaagctacatagctggcggaccggcaaacacaccaagggaaagttcaagcaggtcggccagatttttatcaccgagaataatttgatggtcggaattatcaaggcgatcccggttgcctttaaagatcggcatcaatacacaccactgcaacggtttaccagtgaatatgtgtctgatgaggttttgaatgcggggaaaaagaaactcgaaaaatagtgttggcggcactaattggggggagaatatgatttatctgaaacgaatcttgaaatatattggcatctttattgtcggcgttgtcgtgctgattgcgctcatttcactgtctcccaaggaatcagtgcgagttagaattgccaatgccgggcacccggcattggcagttaagtgtaatccaaagttggaaaaaggctatcgggatcctcattatctgattccatacaagcaagcctacctctctgacgatgggtcatacatggtgaacgaatttgcggttaagcgggttttggtgtttcattatgccaaacaggtggtaccgatactgtaattggtactaatccgtaaggctccatagatgattcattttagccattatctttttcacaccaatttgggaaatataatgtatagtaaaaataatctacccacacattcaatataggaggacttccaaatgacgacatttactaaagacagtttttccatcgcaggaaaagtggcattgattaccggcggcgcatctggattagggcttaattattcaattgctttatcgatgtatggcgcagatgtgtttattgtgagtcgatcacaaaagggctgggatgatgccaaaaaggccgttgaggcaaacggccaacacgtcggttttctgcagaaggatattacagccgatggtgcagcgagtgaggtcattcaagcagttttggaccgatttggccacttggatatcttggtgaataatgcggggatgcaaatccgcaatgacgtgcttgcctttaaagatgccgattggcaaaaggtgatcgacctcaacttgaacgctttgtattacttatcacacgaggctgccaaggtgatggtcaagcaaaagagtggaaagatcatcaatattggttcaatgcagtcgtatcgcgctggtaagttcatcttcccgtacactgccagcaagcatgcggttatggggttgacgaaggcctatgccgacgcactggccccttataacattcaagttaatggccttgcacctggctatatcaagacggatatgaccaaacctttgcaggaagatccaatcagggggccggagatcaagggccacattccatcaggtgagtggggtgtgccggaagagttgatgggtcctgtcgtgtttttggcaagtcaggcatcagattacgttactggggtgatgttaccggtcgatggcgggtacttactaagataattgataattgggagctgatgattcagcttctttttgattccatacaaaaaatgacctccaagccaaaagcctgaagatcatttgaatgcctagcacgaaactagtgcgggtatttgtttaaccactgaaaaattacttcttgagtaatgcttcagctttgctcttaagatcatcagttgacatgttcatgtaaggttcaacatctttttcagtcttgagagtgtcgtggtcgtttttctccatgtaatagtcccaaatagcatcacggactggtaatttttgatcgctccagtcgaatgcttcagacatcattttgttcaataatggagattctgcacctggttcttcagccataaataattacctccttctatttgatctaacttcattatagttctttttgagaaagtggctcaaaatttgttcgatttatttgaatgattaagctgccggctgaacttttacaatccaatttacctgtgggtcgggcttgttgagggtttcaatatctttgccgatttctttgtttcgagccacaatccgacccgaaattggtgatttcaaagtttccaccgatttgtccccttcgatgtccaacagatcgtcatcgacttcaatcgtatctaactggttgggaaaatcagcgaacgtaatcttgcccatcaaatcatagacagatttgtcgatgcccaatagatagttaccgtcggcttccttccggtaccagattccgtctttaacctgggccggagcctgagcagactgctttttgcctgtgaagaaattaatgattttttgccaaattgaaatttttgccataacgacaccgcctcgatattatttacctcaattataccgtataattagagatgtacgagaatttgaacaaagggggaatgtcagatgtacctaatcgatatttccaggaatggcaagcccagctatgacgcgcgggtgaaccaatcattggataattattttgtgaatgatctcaaacttcctggacacggatttatgttctatattaacaagccatcggtgattattggccgaaatcaaaacgtgtgggctgaagtcgatatcgactatctgcacgagcacgacattgagttggtccggcgaacgtctggcggcggggctgtctatcacgatatggggaacttcatctttgaaaacattttgacggataacgccgacgactttggcgattatgggcattttgcagaaccagttttgaaagcgcttcgtaaattaaacatcgacgtcaaaatgagggagaattccagtgacctcattttggacggtaagaaatggtctggcatgaccatgtttaagagcggccaaggcttggcggccggcggaacgattatgtataatttgaacattgaaaatgccagaaaagtcctcactgaagaccagatggaaatccaaaagggcttgggagtccgctccaaacgtagcccaattgttaacctgaaggactttcttccggatgggatgacgatggctgatttccgtgaatacctgctcaaagaaatctttgaagtcaaatcgctggatgacattgaaacctaccatatgactgatcaggactgggaagttgctgacaaacgcctggcagaaacctatgggacagacgcctggaacttcggccataatcctggctattacgattacgccgatactgaatttgaccagggcaagctgggaatcaactggaccattgatgacggcaagctttcccatctgaagttcaatcccttcttcaagattgatggcgatctgaatgccattgaagccgccttgagtgggaagaagcctagtcggtggaatgttaagcgtgcggttaagaaggctgggattgagacggttgatgaggagcgattgactgactttttgatgagtagttttgataagagtgaataggttcttgtgagtggacattcaatgttttgatcacagcatctggtctagttggctgttgatcttaacggaagtcagaacatcattataaataagctaaccctgtgaattgaagcgttgtaattcaattcacagggcttttattatggcttcttatagggttgaattgggtccaattcccttaaaagctgtctcaaatattgacttcaatccaatgaattataaagaaggatgacagaataatggtatgcgttttgtgaataccttaacatgggtctacgttaattcgtaaaagtccaattgtacaggagtttgcattcaagatatgatttaagtgtcaaagggacatggtactaaaaaactttgaatgatatttccatctaaaaatgtaagcgcaaacattttaactatcaccacatatttaaagaaaagaggaaatcatgatgaaacaacaatttgcacgaccggtatcagttatcgggacaagtagtcttcctcaacgaagttttgacgatcctaaaatggctggtctttcgccttatgaactatgggcagatgcttgtcatcaagcaatggatgatgcgcatgttaaaccaaaagatattgacaaagttgtttattcccagtttgccaacttcatcaccatgggtggtgtgatggctccggtaggcagcttagaggagtgggcagggttggcaggtaaaccaatcacgcatatcgagcaggcctgtgctggcggatatattgcctttactgaagctgtaaatagtgttgcatcgggacaatatgacattgttttagttgccggattagagaatcctaaacatttcaattctcgaaatcaaccagcatataaattaaaacctattaaagagtatgacaatggttggtggtcaccaggtcgggtattgtttgatactgcctacacgcgttttgatggtgtcagtgataatttgcttactgaagaacaaggcaaacattacattaaacactatggaattacggagggtgaactggatgacacttataactcaatggcaatgaatcttcgatataatgcctcacacaatcctcgcgccttgatgcatgaaagatatgaggacatggctaagaaggccggttacgacgatccattggaatatatgagatcagaacataatcctaaaatcactcaatatattcgcaagagcggcagtgttctccataacatggaagccggagcgattgttgtgtgttctgctgatattgctaagaaatattcagatcacccaattcaagtgattgacgatgcaactgtctccaacacgactaggtatccttttaatttccatcaaatgaacgttgatgtcagagacaatctttacaagaagcaccctggaattaaagggagcgactttgatttgatgattaccactgttatgacctctggtgaacaactggatagtgccgaagtgttcgggtatctacctgagggtgaaggctacaagtatgagttggaaggtaagacgcgatttgatgctgagaaaccaattaaccctcatggaggcgatattagctttgggcatggttttgggtgtgctggagtatgtatgctcggagaagcaattttacagatgcgcggtgaagctggtggatcgcaagttcccaagcctgttaataagtgccttgtacgaggtatgggtggcggccatacaacagttggtattattttggaagatcaaaattgaggagtgagtaatatgtatccattacgtccaattttaaaaacctattatgacagtctcgaagacggcaaggtgttagggatgaagtgccaggattgtggcaaagtcgtctggcctccgctcccaacttgccaagattgtggcagctataacctggactggatcgagatgggcgatgaagccataatcgatgaaattcgctttgaggactctagtgtgggtggcgattacacatttagaaaagccgatgaatttttcactgaaaaggatccctattgtgtatcagtcggacattggccaaatggttctcatcaattccatgcagccctatatggtgtcactgaagaaaataaagatgatttaatcgctaaattgccattaaaggctaaagtgcaccttattcagttaaacggtggattcaaatcagttggttttgaacttgaagacgttgaagcgaagtgattgatgcaaaaaagcttaaagacctctcgtccttaagcttttctgttaattgctgccatctttttgctggtgaactttcattaattctctgacaaaaatttccgtaattggattggtattagtttctttgtaacctaaaacgaagttcagatcattatccagaccattaatatcaagcaggttgacgccgtaactttcaactgggttgttcaccttattcattgagtgtaggaaggtaaccccttgtccagaacccacatgaagcaatgcctgctcagcatcatttacgtaatacaacgcgtgaggtgagaaaccatttttcatgcaaagactgatcgcatagtcaacaatgaatggtgagatcttgcgattgagcataatgaaatcatcatttgccaatcgcttaatgtcaacagatttcatgttggctagtggatgtgtactgggtaccgcaatttgcaacttgtttttttgaagttcaattgtcttgatatttggaatgctatctatgtaagtatttaagccaaagatagcatcatactgattattgattaactggcgtcttaactgaagtggcgtaccacgaaaaagtgacagggtgactcttggatatttcttagttactgactttaagacatcgtacatgagcgtagtatcaaagaaactttgatatccgatcgtgagcttgccggttaattcattagtatgtggctgaatggttttcttgatattatcaaatttcgtcacaatatcaatggcttgttccagtaacgcatcgccttcgctagtcagagttagcgtgtgtcttccacgaacaaacaactggacgccaagctctgcttcaagatccattatttgtctgctgagtgtgggttgtgtcacataaagatgttccgctgcttttgtaaaattcaagtatttagctgattcgataaaatatcgcaaactggttaagttcatcgcggattcaccatactttccgatttaattcacagtcattatatcttacgatttagcaacatttctaggtcattaatcatgttctgaaaggagattatcattatgggacgtttaagtaataaagttgcagttatcactggaggcgcgaacggaattgggctagccacagccactcggtttgctacagaaggggcaaaagttgttattactgatgttaacgataccaatcgggaaacagccctgaagaaaattggcaatggggcgatctttatccaacaagatgtttctaaggaagctgattgggccatggtatttgaaaaggttattgatgtgtttggaaaagttgatattttgtttaataatgccggaattgcggcaatgggggatgcggaacatttcactgctgagcaatggcatcagattatggccgttgatttagacggagttgcatttggaatcaagcatgccattcaaaatatgaaaactaatggtggttcgattattaatatgtcctctattgaaggcttaattggctatccgaatttatttgccttcactgcagcaaaaggtggggtccggttgatgacgaaatcagcggcattatattgtgctcagcaaaagtacaatattcgtgtgaattcagttcatccggggccaatccataagcctgaaaaagataatgatcctaaagagcagaagttagttagcgagcatttgccaatgcttccattggggcgctttggtgaaactgtagaagttgcaaatttgattctatatttagcctctgatgaatcatcttattctactggcagcgaattcctggtagatggcggttataccgcacaataataatgttaagtaggtcttgctaataaaattggcaggacctttttatagcatagctgaattgcttgcagtcaatacacgaggccaatttcaaaaaaatgaagctgtttattccgaagtaaccttctgtcgcatcaacatcggcatctgtcgggtcaaaaagtgattggcaaattcatcatccatcaaccaagtcctaatctccgacttcttcaaaatcaacggcattcgattatgaatgatactgacggaatcgttgggcgccgtggtcatcagaatactttgcggtgtgccttcaaagatgttgtagaaaccgccaatgtataagggttcgggttggtcgttgtagttgaaccaatacttttgcttgtcaggtgtccattcaaaaaagccactggttggataaacgcatcggcgggcctggaaggacttggcaaacattttcttttcagtgaccgactctgatcgagcattgataatgagttggcccttatgaaagccagggaagccccacttcatcgccacaacttgaattttctgctgctgggcaatgaccaacgccgtttgattcgatgggaagacttcacccgttgttggctgatagccagcttgggttgccagctcatagatccgcgcaatttcacggttacgctttggctcaaacatgtaacgtccacacattggaattcctcccttaaaagcccgttttgaagttatctgagctgctcgaattgaaatagaatgtgtcaaagattattaatgatgctctcaaagccaagcccatccataatgattttggcagtttgcataaagtctgtgctggcggctcgttctacaaattcaatatggcgttccttggccatgaaatcaattgttcgcagctgtgctgcattgatttgaccgtgtaacttgttaccgtgtaaattgatgaaaaatggtaagtctctaatagtactggtaattggacagatggttataaaaccagtccgcaaattaaaagcgtcactgctaactacaatggctggacgacgtttcttaatttcgcgaccaatacttggatcaaaattaatgtaaaccagatccccttgcttaggagtgtaaccatgataatcataatgggtaattgggtgatttgacatcagatttcctcccgaccgactggttggtcgttagtatccttggggataaatctaagatcagtcgtagcatatttgggatcttggtaaatatttggggcttttggcgtatagatgaggctgccatcagcggcctgcatactcataaattcagttccttcagcgactttgaactgcttgggaatacttaaaaccaaagtgtttccctgcttacgtgctttcaaactaatcccctccttttttattaaatatatagtaacacctagtaattactacgacaacaaaaatggctaaccacttgtcgacataaaagttccaaagttaaagcgaaaactttagctttagaactttttatgactaagatttgatcggtaatcattctattcggattattgaatactcaaggggaaaacaatgtcattctccggaaagcttaacgccatgccgttttgcaacaatctcccaaaatccacgcctgccacctgatacaaaagatacggaatcttcataatttcttccaaaattacgcatattattcaggtatccttatgatgttgataagagagggatgtaatcaatcatatggaggaagacaacaatgaagaaaaggacaagcttttggatacaagcaattggcgtgttgacgctggttctggggaatttttttactgccggaaccgctttagccgatgtgatttcgactaaggaagttgtcgtcgataacgcgaaattgattgatgataaacgcgcattagtaacgaaatcaaaagttggcgactccgccaacttggcatttgatatgacagtgggtgggctatcgcaggccggcactgtgcactttgactataatgctgattatttcaaagtgaagaagaaacaattcaaattttcaaatggtgacactaaagtcgtcgtcgacattgatggcgaagagtcaaccatttcatggaccaacgccattgataagaccgacctcgaggtgattttgccggtgaaattcaaccggactgtcaatgaccgcgagttggactttgtggtggacgataaaaagattaagctaccaactttgacggtgcttgatgaagacgaaaaagttaaacaaggagagacaaccgatcagccagacggcaacctgcaagatgacgacatcttgaagcaagcgctggctgacgaaaaggcatccgatgaagcccaagctgcccgcgaggcggaagaagctaagcaggctgaggctaaaaaggaagctgaagttaagaccgaagaacaagcagaaccaaagaaagaaaccgaaattgacgagaactcctctcaagctgatgacattcagcagccaaagcaatctaacagtgagaaggctgaaactttgctgaaggagaagcgtgaagctgatcagaagaaggctgaggaaaagagccgtcaggcgattgaagagaatcgtaaagcagaagaacaagcagctgttgggacacaaaatgatccgagagcagtcaaagataatggtgagagcaaggaatctcagacaccacaaacaccagatgtttctgatctgaagggcgcaaaagaagcagttgcgagcgatgcctcagatggtgaggagccgacgagtaacgaattaactcggcaattaccgggcaatggtgtgttcggtgatgaaggaaagactgatattaccgatgctatccacgctgcctcaaaccctcaattcttcacctcaatcaattttagctatattgataaggatggtaactctcaaaatcagaaagtaccatctgtacttgaacaagagcttcaactaccggctattcttcgagagcataaaaatattgagattacttatctttgggatattgatagcatcaaagaaaataccgggattgacattaaagatggcgactactaccaatttgatcttaagggattgaagtatgaatacggtccatcaggttcctttgacgaatacatcacctatgggggccggacaattggtcggtttatcatgacccgtgatgcagaggaccgtgacacgcaacatgctaagattattttccttcctggagacttggaaggtgtgacaaatattgattacaaagcaaaaatcaagacggaaatcaatgcgaacgccgaggaaattagttttggtgaaagtactaaaggtgaatatccaattaaagtcgaagaagatctggtatctattcaaaaagatggtgtgttacacacatctaatggggtaaccgatcttgacatgcttgaatggacatctacctttaaggtgcaggacggtaaagaagcaaataaggttacccttcgagataagttcggtggcggctatgcaaccgccaatgataaagtcagctatgagtttgaagtgaaaggtgctgacgggcagacagtgtccatcactaaggatcatgacgattatgataaattggtagccaccggtccaaatttccaatttaacgctaaaggacttgggcttgaacggggaataattgaaattaaagtgaaaatgataacccccgtaactaatttcaacaatcgagatttcaaaaatacaattcgtgcgacggatgtcgaaattgttggtgtgaaggaccctgccaaaacgctggatgtcacagcgacgatcacccgtgaaaatggtcaggtgaagaagactgcaaagatggataaagacggcagcatcaaatataccgttgaattcaccgtcgatcctggtcaaacaaatattgtgttgaaggatactttgaattccaagagatttacgtttagtgagaatattgatgattacacattaataccatccgttaccggttggatgaaaggtgatcccaaaattgacggtcagacgttgacggttgagtttgctgatgtaattgttcccagcgaaaacgaagggtcaaaggtatataagtttagttacatcattaagccaacagcagacgtgactgacaaagattaccagagtatcagcaatacggttgaggtgaacggccaaaagaagggtaatcactttggcccccaaatcaacagtaagaacaacgtgagcttggattggcaaaagatgatgagctcatggagcatccacgtcaaccaaatcaatcgacaaattgatggttcattcaagatcacggaaccaatcgaaggggagacgctcaacttcttggattataagaagttttataacagttttacagatacaggtggtttgactgaagaagttaagaaacgaatttcattttccaagcatgaaaatgatcaaacatgggattacacgatcatcgatggagaagcatactggggcaagaacaaggacaacaaagcattcagtgtcaaactttccggcaaccagattatcatcaccgttgagaatttaccggctggtgaaaaatcatttaatctttatctaaaggatgttccattggacaaagaaaaaatcttaaatgccaattatgccgaacttgaaaaaatttgtaactatgctgggttagaatactcaggttctgatgacgcaagtgtaaagacttgcgtcaatcagggaggcctcatccgaaacaacatttcaaaggatgggcaattggataaggatttcctgaacaatggcctcattaattggacgacgcgtttcaactaccggcaatacctgggttcaaatgagcacgccgccttggtcactgatgggattgatatcactgatgaagttggaccggatgtgatcaaagacgctactggaaagcttactaaacgtaatcttcaagatattcagcaacgtttacaagataccctacagatctccctggctaggattaactctgatggtcgcggcgtatctgacagtcaaaggttagttgatgatcaatatgaagttcgggttgatgttgatgaaaatcataaagtaacttttaacttaaagttatccgaagatgcttacaacaatatctatctggaccatgagaatggcgatggcgaaagggtactcggtaaaaaagtgttcgagttgaaatatcaatcaaaagtcttgaactttaaggccgatgaagaagcgacctatgaacatctcaaagcttggacatttaataacaaagtcactgccggatggaaactgaatgctgacgatgagactcgtcatacccttgaagcaaaggcgagtgtatcttacgcagacggcggtcatttactcgacaagtcagggaagttgcttgaacacaaccttgaattagacgagggtgacgggcagacccggtccgttggagccgttaaatggaatttggcaattaacgggaatggctacgagcttagatcgccagttaaactaaccgatacgcttagtggtgggcactaccacttgaagaccaacgatgatcgctacaagctgaaaatctatgaagcaaaacgatccttggtcaataaggaagttcattacactaagatatctgataaagccttaattgaaggccacgattacgatgtggtttactctgatactttgaatacgatgacgattaatgtgaacaactcatacaaggttaaaacaccgctattggttgagtatcataccgttacttccaagacggttgggacaacctatagtaatgagatcaagttgacaattgcttctaaagattttgaagacaaagaagaaatccaatcaagtgcagaagttgccgggcagtacacaactttcgctgccaacgttaagaaagttgatgccacgactggtgctccacttgaaggcgtcaaattccaacttcaaatgaaagatctggatagtatttggaaaaatgttggtgaacctaaagcaaccgacaaagacggtttcgcatcattcgacggtctgtacgataaaccgacataccggattatcgaaactcaggggctggagaattatgatgacagatgggtctcgaaagaatttaccattaaagatgcccaagaagagactgaagatggcaatgaaaacacttattgcgtcactgctaagaaccaccgaactaatgctttgaagattaaaaagacggttaccaattcactgaataccaataaagacgacaaatttgaatttaaggtatatgtgatcaacgacgagggtgacgtcgataccgacttcaatgacgatttcacctacgatattgatggtgacgaaagtgttgtgaacttcaaagaaggggtttcaactaatcttcaagagatcaaagacggtcaggtgatcaccattcacggattaccacaggacaaaacgtaccgggtgatcgaatcagccaatggttcataccgcacaacccactcacttgacaacttaacgacggttgaacctgatggcaatggcggtaatgaaacaaatactttccaaatgatgatcggtaagaatgctccagccggaatcgtgcagtttaccaatgatgttcagacgacgcattttggattctccaaaacaattcaaggtccaaatgcgaatgctgacaaagacaaggaatttgatttcatgctgaaggtattggatgccgacaatcagccggataagagctttaacggcacgattgaaggaattaaacactcaggtggagacattccagtcaagtttaaatttgtcggtggtgttgccaaagaaatcatctacacagatggtagcacggtaccgattaagctgaaaactggcgaaagttatcggaacattcaattgccagccaatgtaaaagtgagggtatatgaaaaacaagatactcagtataccgaagttcattacaaagttggcgatggggatgaaaatgaagccggcgattcggatgaagacggctggaaagcaactggttccattaatgctacgaatacgatgctgaagttcattaacagccaagttgtgaaccagttggaatttgaaaagtttgttgcaggtgacatgcctggcggaatcgatagttttaatttcgaagtcgcagccaacgatgacgcaactcgaaatgctgttaagaaggaaaattatactgccgacattagaaacgcaacaaccggcaagactaagaatactggtaaagtgacctttgacgaaaatggtcaggtaaccaagattaagtatggtacgttaccacctgaagagatcacgttgcaagataatgaaaaattggtgattcttggcctgccgaataaggcgactaagtttaaagtcaccgaaactactactggtgagtttataacttacactcgggtagatggggaaagtaagaacgaaggcaacagtgcagaaattactttgaatcgacctgatggggcaaattcaatcacctttgaaaatattgcgcctgacttggttgaatttgggatcaagaagactgtgagcggactgattccacctgtggatgaagacttgaattttgaatttaagttgacagttaagaatccacctacatcgtggggtgaagaatctgacccgtttgcttatatcaagagtgactccaatgacgaagagtctttgaaatttgtcaaggatcctaaaacgggagaatttaattatgaattaactcttaaggcaggacagtcaattagaatgtttattccaaaagggttgaagattcaagtaacggaaaccaaagcccatgattacaaagttagtcacgaatttggtaaacaccaagaagatggcgatactcatgatgtgacaactgaaaaggatatgccacaacttgtcttcaacaacgattctcagaagactggcattgaagtcaaaaagacagtcaagggcgaaactgctggggatgaagacttcaacaagcagtttagatttagagttgaaggaaccaatgaaaacggcggcaaattagacggggaattcaccctgcgtaaatacgaagtaagtgggaagtacaccgacacccccgtttcgtttaatgctaacaacatcattgccttcaacctcaagcacgaccaaaaagctcaactccttggcctaccaattggtgccaacatccaagtaactgaaaccaaggaaagtagtgaaggctacgatccaagttacaaggtcaacgaaaacaccgagaaatcaggcaatgtcgcctcagaatttgtgactgaggaaggtaaattggggaccgtgattttcaccaacaccaaatttgaagccgaaacggccgagctgaagatcagcaagcacctagctggcggcggcatcatcgacgctgacaagaacaagaccttccagttcgtgattgaagctaacgcaagtgttgacggcgaatacgacgcactcgtaaacggtcatgacaaagtgaaagtgatattcaccgacggcaaagccactgtcaacttgaaggctgacgaaaatattctgatttatggcttgccaagtgaacacaacacttacacggttactgaaacaaatggttccggtttccacacgcagtaccaactcaacggaacccggatggaagacggcgttaaaaccaaagaatttaagctggttgataaggatcgcgtcaacgtggacttcaccaacagcaaggacaccgagaaagttgccagcttaaagattaacaaggaaattgccggcgatggtttgacaactagcgaccatgaccgtgacttcaacttccgcatctactctggtgtaactggcgaattcaaggccaccaaggttgaccagcacggagactcacacgaaatcactgtgaaattcgccgacggtcaatccgacgtgcttaccttgaaggacagcgaatcattgacagttaccggcttgccgattgattacacttatgcggtgggcgaagaatatgttgatggctttgcaccaacctatcaggtcaacggcgccaaggttcaagaggggatgaccactcaaaccttcaagttagttgaagatcaaaaagggacggtcgaatttaccaacaccaagaatggggaaatggaactgggaatcctctctgtaagcaaatttgtgaacgaactgggcgacagagctcgcaagtttgaattccacattgaagcaaccgatggagctaataacccactaaacgggacgtttaagacccaggtcacaaccaatggccaagttgttgaaggttccattcagttcaatggtggtaacggcagcttcacattaactcatggccagtccatcaagttcttcataccacttggtgcaaaatatgaagtctctgaaaaggactactcagctgatggctatgtaacaactgttaccaagcgaacagcggttgtgaacagtccaacggttaccggaacggcgactaaagaagatgacagcatcgtttaccacaacgatttggaagacgatgaaggggagttaccattgccaggcgaagaagacggcgacgatgcatcctcaggtacgctcgatggcaatgacaccaccggaacctccggcaagtcaggcaccctcgacagcccaatgggaatcccgtcatccggctataccggcaagtccgccttaccgcaaaccggcgaagacaacaacacactgctcatggtgattggaatgttcatgctggttggcttactgggaacagcaacgatttactacaccaaacgcaaacaagagaaatgaggaatcaatcaaaaaataaccataattaaataatcaattaaaaggtggctagacattgctctagtcgcctttttgtgatgttaggatgttagctgctcacattattttctcaaaaagtgttgacatattctaatctaactatcataatacgaactatcaatttgaaagaagttttctacaagcttcgctaacagaaaatccattcggcggctgagagatggtagtgaaattgtagactgtgactttcatgctttacccataaatcggtgagcgtaagttagccggtttcggacttgtccgttaaagcaagcaacgagtggatacgaaaagtgtctatgaaggtggtaccgcggccaattgtcgtccttttgtcttagtgacagaaggacgatttttttgtatcgcgggttgctttagtgggattgataaagattgttgattacatactttatagtggagaggaagttatatttatgaaatatacagtattaggtgcaggcgcaatgggtttgagatatggggttcttttgcaggaggccgggttcgatgtcgactttgtcgatacgtgggaaccacaagttgaaacggtccgtcaacagggtggcgtttacgtttcccgtgacggtcaaaataaacatctggtgccggtcaacgtgtactatccagaagaatataagggtgatccggatgttttgattgtctttaccaagcaatatcaactcgctgatttcttaaaacgctgttcacgattcttcaacgacaaacaatacgttgtcacttgcatgaatgggatgggtcacgttgaaaaacttaaccagtacttcccaaaggaacgtttactcggcggaaccgctctgatcggaactgtgttgaacaaagccggcgacgtcgacttcatcggtcccaagggtgccggttcaatgaacattgcgaatgaaaccgagaaacctgatgagatgactcacaagattgtcgctgaattccaaaaagcggggctcaatcctaatttgaccacgaacttccttggtactttgatggccaaagtcgtctttaactccgttatcaacaccttgtgcacgatgtttaagatccggatgggtgagtatatccaatcaccagttgccgagaagttgggcgttcaattaatcgatgaagccttcgatgtttgcgaacgcgccgggatcacgttattgaatacccgtcaggaagagtgggaaaccgttaagtacgtcagcaccgtttccaacccacttcacttcccgtcaatgtatcaagatatctccaagaatcgccaaaccgaagtggactacatcaacggctacatctacgaccttggcttaaagtatcattacgaagccaagacccacgacttcttgagaaacctggttcacttggccgaatttgccgggacctttgacgttgacagctacatgaagtcagtccttgaacgagataagcagaatgcggttaagacgcctgaagaacatgttgcgcaagcttaaattcactttggatggattgagcgaagtggtgtgagaaaatttggattgcctgttaaaaattcaagtccactcattttcacacgataataatatagaaagaatgacaccgaaatcatcagacaagatggtcccggtgtcattttttgcggttatctaacccgtgcaacatcgaaagcaaaattttagttaacattaatgaaactcaccgcagaaaagttcataatatgatgtatctgtttacctagttatttaccaacttatacttgtattttaaatgtactagcagtaatatagttcggtacctaattaagcgcacaacaatcttaaaacgaacctggaaggagtaggaaaatgctgaaaattgccaaaaaccggatctcgtacgtggcagttctcggggcagtgctgttcatgacgattcaagtgattgcgaccttgaacctccccagcctgacctcggacattgttaataacggggttgccaaaggagacattggctatatttggaaagtgggtctggaaatggccggcttttcactcattagtattctggcggcggtctgcaacgtctttctggctgcccggacctcacaaaagttggggcaaaatttgcggagtgacgtttaccgtaaagtcatcaacttctccaaagatgaatatgatcaaatcgagacgtcatcactgatcacgcggaccactaacgatgtggttcaaattcaaaacgtagcaattatcatgctgcggatgatgctgatggcgccgattatgctgattggtgccagttttttggcctacaccaaggaccatcagttaaccaccatcttcttggtggtattgccgatcatgattatctttgttggcctcctactctatttctcagtcccattgtttagagcaatgcagactaagacggataaaattaaccgaattttccgtgaaggcctgacaggtgtccgggttatccgggcatttcggcaggaccaatttgaacaagaccgctttgaagatgccaaccgggattataccgataatgccatcaaggtcaacacgattgtcgctttggccttcccagtcatgaccttgatcatgagtggaactaacgtggcgattgtttggtttggtgccaagctaattggtgcccagtcaatgcaggttggtaatctgattgcgttcatgagttacgccatgcagattctgatgagctttatgatgctctcaatggtgttcgtgttcattcctcgtgcacaggcctcagccaagcgaattcagactgtgttggctttgaaatcaaccatgaaacagccggagcatccggtggtccttgatcctaaagctacccagcacgacttgaaattcgatcatgttgaataccgttatcgccaagctgaattgccggcgttaagtgatattgacttcgaggcccatagtggccaaacggttgccattattggtgggaccggttcaggaaagacgactttggtttccttgatccctcgattctatgatgttgataagggtgagattgagctggatgggcataacattaatgatttctcgatgaaagacctcagagaccaagtttcgtttgtcccacaaaaggccactctgttcaccggaactatccgtgacaatatgaaatacgggaacccagatgcgactgatgatcagatttggcacgccctggaaatcgcccgggccaaggacttcgtcgaagaagatcccgccggacttgatctccaagttgaacaaggtggggacaacttctccggtggtcaaaagcaacgattggcaattgcgcgatcattagtcaagcaagccgccgtttacgtctttgatgattcattctcagcactggatttcaagaccgatgccgatttacgagctgctttgcgggccgatcaacacatccagcagagtattactgtgattgtggcccaacgaattgcgacagttgctgatgctgatctgatcctggtccttgataacggcaaactggttggcaaaggcactcatgacgagttgcgggctaacaacaaggtttaccaagaaattattcactcacaattacgagaggaggatgacaaataatggctgataaagataaggcaccacaacctacctccaatcgtggccatggtggccgtggcggcttccaaggtgtcgttgaaaagccccataacttttggggcaccaccaggcggctgctgaattacatgcaggatcgactgattggcctgattttggtgttcgcctttgcgatcatcagtgttatcttccaaatccggacacccaagattttgggtgaagcaaccactgaaatttttaaaggattgatgaagggaaatgcccagcagaaagccggttttagcgtggcttcgctgccaatcaattatgaaaaaatcgttcaaatcattcttatcgttatcgtgatgtacctggcatcggctgttttcagtttcttccagcagtacatcatgacccggatttctcaaaacaccgtctacaaattacggcggcagatgaagggcaagatgcggctggttccgattaagtattatgattctcatagtaatggggatatcatgagccgagccgtgaacgatatggataacatcgccagcacccttcagcaaagtttgacccaggccgtaaccagtttcgtgacctttgtcggaactctctggatgatgtttacgattagctggaagttgactttgattgctctggtaaccattccattgagtttggtaatcgttggcatcgttgctcctcgatcgcagaaatattttgcggctcaacagaagagcctggggttgttaaacaaccaggttgaagaaaactatgccggtcaaattgttctgaagagttttaacaaggaacaagatacgatcgaccagttcgaagttcaaaataagaaatactaccaagctgcttggaaagcgcagtttatttccgggattatcatgccattgatgattttcctgaacaatatcggctatgttttcgtggcggttgttggtgggattcaggttgccaacggaacggtaactttgggaaacgttcaggccttcctgcaatataccaaccaattctcgcagccgatttctcaacttgccaacttgatgaacaccatccagtcgacgattgcgtcagctgagcgggtgtttgaagtgattgacgaagaagaaatgaagaataccaaagccaaccgaccagtggaaaccgacacggataacctggttgaattggaacacgttcaatttggctacaccgatgacgaattgttgatgaaggattacaacctggccgttaaacgcggtcagcaggtcgctatcgtcgggccaaccggtgctggtaaaaccaccatcatcaacttgttggagcgcttctacgacgttaagggcggcagcattcgcctcaagggggtcgacacccgtgatctggaccgtgaagatctgcgttcacactttgcaatggttctccaggatacttggctgttcaccggttcgatctatgacaatatcaagtatggccgagaagatgccagcaaggatgacattatcgaggctgccaaggctgcccatgtggacgaatttgtccgcaaactgccaaagggttacgatactgtcttgaatgaatcggcttccaatatttctcaaggtcagcgtcaattaattacgattgcccgagcctttgtggcggatccggaaattctgattttggatgaagctaccagttcagtcgatacccggaccgaagttcagattcagcacgcgatgagtcagttgttggaaaaccggaccagctttgtggttgcccacagactgtccacgattcaaaacgccgacaacattattgtgatgaaccatggtgccgtggttgaaaccggaacccataatgagttgctggctaaaaacggcttctatgccgatctttacaacagtcaattctcagacgacgtttcatttgattaaggaggagcttacgatgaaaaaattaatgagtttagtaatcgctgccgcttctctgatggtcattctgagcggttgtggcaaaccaacgttgacggtctctaatcaccatttgagcgcgaatgctttggcagtgacgctgaaaggcaagagtaatcaaaagcaggtcgattacaccgtgaatggcggtacgaagcaaacagttaaaacaaacagcggtgcatttgtaattagtgtgccaaccaagaattatcaacaaactgtcaaattaagcacggatggcaagcaccaaaccgtcacggtcgccaaagccaacgtgattggcagctaccagaagatgcggacgacttataaccaaggcttaaccggcgccgcattgccaaagaaggaccaacagctggcccaatcaatggctaagcagggtgcccaactgaagaaggaagctgccgagttgaaagccggcaaggctaccagtatggcagccatgcaggccaaggcgcaaaaggcgacagctctgcaaaagcaggcagctgaattgaagcaaacgcaagctaaactggccccggcaatgaagaaagccaaggctagtgtcaaagatcagcttctgccagccaaccccaaagatggcatccacaatttgattgataccaacaagatgacattgcgggtcaataagtccggggataaagtcttaggcatcgcaatgatggtgccggttaacaacttgaagcacaaaaaggacctcaagccgttcatcatgtcgttctcgattttgacaaacagtgtcggcgctaacgccaagcacgttttgaacaaattccagaaggcggccaaggccaagaagtccagctcgacaacggcaccgaagttccattccaatgggctattgtttagcttggggtactcaaccagtaccttgtatgtatttatcacaaaataatgcttaaattaaaaaatgagatgtgatttccaactcaatggaaaccagcatctcattttttgtttgtctaaattaatagcgcacgcccatgaaccaagccagaatgtacagcagccaaatgtgcagtgggtaaaaggcgtagaagaagcctttcatgctgcggccaagctgaccgttgtaaaggtacattgggataatggcaagaaacatcaaccactggaagttagtcgtgaacatactgctgaaattaaagccggtggacaaaatggctactgccacgacggccagcatctgccagttgcggttcttccttagcagatacatcaacggtcccaggtaaaggataaagccgttttcagcaatcagtggacttggcagtagggtcacaattcgaaaggcaatgctgttgccgccttggcccattgtcagcaaggtcaggccggcaaagatcaatggtagggcaataatgagaataccttcccagattttggctgcctgatgattctgatgcccctgagaaatggtctgcaggccatacattgtcaaaaccccaatgaacaagtcgccgaagatgttgttaatcaagccgaaactgccgagtttgaagaaatgttggataatcaggttcccaatctgcatgacccaaaagccaaccagcagcctggacaagtagcgtttttgattatgggtatgaatgaagccttcaacgctcaggaagaaaaagatcgttgctaccggccggccaaaccagtccacccagttgggcacaccgataccgttaaacatttcatgcacgtggtcgatgaacatcagaataattccatgtactttgatgtcgaagttggtgatgccccaaccacgcttaacagttgattcgataagatcactcctcaattattgttgtaggcaaagtttaccactaattaaagctgatttcacaaatggtaccgttttgaatctgtaagattttctaaatgaatttccggaaatgagacggcgttgctttgtagtatttcttgaactggtcaatgaaatgcgacggattatgaaagccgacttttggtgcgatctcgccaatttccagagttgggttggttaacaacaattccttcgcctttcgcatccgataatcggtcaggtattccagcggggtcatatcatatagccgcttaaaaacccggttttggtaggtaactgaataactggtggctttcgacaatttgtcattcgtaatcggttcggcatagtgggccgcaatgtattgaagaattggcgtggtaattgtggcatcttgataacggtgattgttcagtaaatgattttgcttcagcagcatgataaatttatagatttgaacggattgatcaagcagtgcgattggatgattgttgttaaattcattcaagacttcgggaataaacgatgttagttctggtgaaaccgtgtcgatcaccaggaaatcagccagtttcagaaaatcagacagcgaatcgcagagtgtcccattgaaggttaaaaacgatactttccaaggttcttttccggttggatgatattcatgggcgactctgggacggaggagaattccctggttggcctgcagggaaatcgactggtggtcaatgttaatcacaccggcgccactttcggtctgcagccaatggtaggcgtaatagccgtttagtcggtgaattggcggctgattccaatcatagccgacactgtcacaatacagcggcattgtttctgcaggtttattaaacgcaattcgcatcttcgcactcccttttagtatattttactataattgggttaaatttgggtattttacggtaaaaatatagcattgatgaaaacccttacattatatactcgattcgtaaggaaatattttctacgaaattttcataccgaaccgcccatttgtaatggcgaatcggcacgctgggaggcgttttataaattggatgctgtacaaaagaaagatcggcggaaaaatttctggtcgattttcaactttgcgtttgctaacataggtggatctgcggtctacatgacctttggaacttacttcatggtctatgtcacttccgcaatgttcacaggagttcccaaggctcaggccaacaagttaattgccatgattaccgggttaattttcattattcggttggtcgaaatctttattgatccgattattgggaacattgttgataacaccaatacacgctggggtaaatttaagccgtggttaatcggtgccggaacgatttcgagtttgctgctggcactgctgttttccggaatcttcggcttgtctcgggtgagtgcaacctggttcaccattctctttatcccgatcttcatcacctttgatattttctactcattcagagatgtgtcctattggggcatggtgcctgcactgactgaagatagtcacgagcggtcactgttcactgcggctgccaactttgccggctttggtcaaaatattgtcacgatcattatcgtgccggtggttacttacgtgaccttcttctttaccggcaaacacaatgaaggccaaccaggctggactgcctttggaattttgattgccgttgtgggcattatttgctccttggtggttgctcttggaacccacgagaagcaaaatgctttgcgggcagttactaagaaaaagaccagtttgaaagaaatgttctgggctttggcacataatgaccagatgttgtggactgcctttccatacctgatttatggttttgggaatgcggctactgccggtttgatgttctatttattcaagtatgtcatggataagccgggattattctggattaccggactgattccaacgattgccgggttctttacctcgccgctttatccaattattaataagtgggtgacccggaagacgatttatgccgtcagcatgtgcagcatgatcttggcatacatcctactgattgtttccacggataatttagtgatggttgtcacagcgatgattctgtattatgtgccacaaggattcatttttatggcggttattttgaccttaaccgatacgattgaatatggtcagttgaaaaatggcacgcggaatgaagccgttaccttggcaattcggccgatgttggataagatgtccggtgccatttcaaatgcgattgttggctgggttgccgttgcagctgggatgactggaaccgccaccgcggcttcaatgactccaggcggcatttcattattcaaactggtcgcattctgggccgcacttatcttgcatgttttggcattattcatctatgtcttcaaggttaagatttctgaaaagaaacatgctgagatcgtcgatgaactccagcacaagttagctgttgaagggattagtgataactcggatacggaaactaccacctctgaaaaagctgccaccaactctgaagaagcaaacgttgaagttgcggccccagttagtggtgtgagagtcaacttggcagatgtggttgacgagcatgaccataaaggattgcccggaaacggtattgggattcaaccgaccgaaggaaagatttatgcgccgtttgatggccaagtggttctgttgtttaccacgaagcatgtcattggcttacgttccgacgacgggttggaaatcctgattcatgtcggccttggcaccgtgaatatgcgcggtgaaggcttcattaaccacgttgattccggccagtcattcaagaagggtgacttgctgctggaatttaaccgagacaagattcaacaggccggttataaagataccgtgctggtcttgttgacgcagggtgacaaggttactcaaagtgattacacgcaagaagatgtcgtcagtcatggcgatgaacttgtgaaggttcaattgaagaagtaagcgtatcaaaaaaatggttctcaatcagatgtgatctggttgggaaccattttggcatgcaattaaattacttcaaaaccttgaagcggtcttcgtcattcatgaattctttttcgccagctggggcttcaattgaaccaaagtccatttgagcacgtaatttccagctgtcagggatgccaaatgcttttttaacttggtcatcgatcagtgggttgtaatgttgcaggttggcaccgatgccgttttcggcaagggatgtccaaacggcaaattgagcgttaccctgagcttgttctgcccagtcggcaaagttgtcggcgtacagtgcaaagtcgttctcaaagcggtgaacaacgtccatgtcagtgtagtacatgacagtaccaaatgctgacttgaaggcgttgatcttttccaaagtcttttggtaagcttcttcagtaggaacttctgacttcaggcgtttgccaacgatgtcccacagcttctcgtggttggcaccaaacaagatcacagcgcgagtggtttggttgttaaatggggttggggcccacttgatattcttcttgattaagtcagcaatctcgtcttcgctctggttgatgttacggcctaatgcgtaaatagagcggcgcttcttggcaagatctaataattgttctttcatgggttaaaattcctccagtagtgtacttactttttattagttaataattaacataatacagattggcaaaactgatgtcaatacatatcatcgaaacattttacattttaactttagcacgttttggatggtaaaaaattgatctgggtcaattttaataaatcctttgttagccaagctgccccaaacttgattgttgatcaagaaaagcccagcgactagttatcgctgagccttttccaaggttgatattgaagtgctatgcagcaactttgttggttgccggaacattcagttgatcatcagaagacgaactgctttgattcattgcggaagccagaaaatcttcaatgttcttcatgtaatcctgaacggcgttgcttgctgaagcatgaccgccaacgtggccgtcaagcacccacagttttttatcagttgaggcactcaggttgtacatggtttcagtttcagtatcagggatgaaagtgtcatcttcagttgaaatgaataaagttggcaatttcgaattcttaactgctgtgatgccggagacgtcatccaggctaaagccttgaacaagcttgttaatcccgttcatcgccgttaagagctgatcaaatggaaccagtggaattgagccgttgaggttccagccaattttagaagtgatgctattgagactgttagctgcaccagtgtacaaatggtagatcaaagatgggatggtcgaaaaaccacaatccgcaatggttgctttgacggaagaaggcaaattgccttggccggcatattgtagtgcagtgtcggcgccaagtgattgaccgtagagaacaatctggctgtcttggccattggtttggtcaatcttgttaacccaattgacccaatcctgtttgtctttatccccgaaggttaaccattcaccgtcactggagttttggccgcgagtgtagggcatcaaaacgttgtagcccatgtcataaaacatcttggaaattcgccccatgccctccggctcggttgtccagccttgaccgtaaatgatggtcttcttcgagtcaccatttttaaggtaagttgccctggcagtaccagtcccgtccgcaaaaggaacctcccaagtttgcttttggacacggttgtcgtaccagtcctgagcgtcggtatagtatgttttgacgtaatccggattatatttctgatccaaatccgcccaattttgactgacatcccagcggtttggggacaacaatgttcgaaaatgcgaaatgaattgtgccccttgacgactagctactaatggataaatcaccgaggcggcaatgccactggtgatgctggtcaagaaattgatcaatggattgttgctggattgcttgatggcgggatcagttgactgattaatgccgtcaatggtgatttgatccttgtcagatggaccagtagttgatgactgatcagttgtggtctgagcaccgtcagctggcgtggcttgactgtcattcggctggacatctggcgtatcacctgaactatcagctgggctgtcagtggtgctggtggcagtatctgcatctgatcgattgtcagttgatgaactggtggttgtcgtctcggcggttgaatgatctgcaggaacgggttgctcgctagaactgtcatcagtctctggggcggtcggttgttcattacttgattcaacagtttgcgacttggcattttcatttggttgatcaaccgtagtcgtttgtgagtcactatcacttgatggcacaggtgaatctatcgttgatgaactagcggttgctgtcgcagttggctcactgctggtttgagcttgcgatgtatccgcatatgtagggttggcaagcagcaaaactcccaaacaaacacccaagcaagccgttaacttcatcgagtgattgaaatgctttgaaatgttcatgtgtgaattctcctttcttaatattttcagaaccattctattatataattcagcaccttatatgtatataggcagttggatgaagttgagcataaaaaaagaaccagcgatcgaaatcgctggttctttcaaattttaaactaatgaattagtcttcaattggtgtaacgttagcagcttgtggtccacggtcgctgtcttcaacgtcaagggtaactttttggccttcgtctaatgacttgaagccgtctttgttgatagctgagaagtgaacaaatacgtcaccatcgtcagtagtaatgaagccataacctttatcagcgttgaaccatttaacagtaccttgtttcataatatatgaaacctccttgcgcttttagcgcataattatattttaatgtatcaagttgcagtgattccaaggagttatttcataatactataaaacaaatacctttgaaaatcgaacccttaaacacattgactataatataccaacataccaggtcaatgtcaaattagtttacgatcatttcgggattatgaagcaattgcttgcttggcagcaactggttcaaccttgatggcatccttgtcaacaacgactttgaagtctttgacatctggattctgcagataactattggttaatttatctgtaatttctttggtaatcactctgtgcattggacgagcaccaagttctttactgtaacccatgtcgaccaacttgttcttggcgtcggcagtgacgctgaagtggatcccacgtgacttgtcgactaattggttcaaatcgttgagcatcaaatcgagaatcttcaacagatcaggcttggttaatgagttgaattgaataatatcatcaattcggttcaagaactcaagcttgaagtatggcttcaatcggtcgatgacattttgtttgttatcggcttcaccttgaccggcattactggtcatgataatcacggtgttgctgaagtcaactgttcgaccttgagcatccgacaaacgaccatcgtccaaaatttgcaacaatagattcaagacgtctgggtgtgccttttcgatttcatccatcaaaatcaggctgtatggatgacgacgaacttgctcggtcagacggccgccttcttcatagccaacataaccaggtgctgaaccgattaacttgctggcactgattttgtccatgtattctgacatatcatatctgaacatggcttttgtcgtgccaaacaattctttggccagagccttagcggtttgagtcttaccaactccggtagggccgacaaacaagaaactgccaattggtcggttaccttcagtaaagccaacccggctacgacgaatggcagcggaaattgcatctagggctttatcttggccgatgacttctttcttcaggtctttatccaaattgttcaactggttgacttcattcttgttgacgtcggttaccgggactccagtgatccgttcaacaactgattgaatcacttcaggggtgacctttggtgtcgtgactttggtaccgctgtcgatgttcttgatttgatcttgaaccttgtccagcttgtcacgcaacttggcagcctgctcgaaatcttctttcttggaagctgcgtttttatccttttcaagctgttctgcttcttgctgcagagtggacttgtctttcgtgagtgatgagcccatggcaactttggctccggcttggtcaattaagtcgatggccttgtcaggattcattcggtcttgaatgtagcggttactcaagctgacagcggccttcaaagcatcagcagtgtattgaacgtggtggaacttctcatatttcggtgccaagcctttgataatggttaacgtatcttgttcacttggttcgttcaccatgattggctggaatcgacgagcaagggcctggtctttttcaatgtcccggtactcattactggttgtggcaccaattaactggaagtcgccacgtgccaacttcggcttcaaaatgtttccggcatccatcttgtcaccttcaccagttgagccggctccaataatttgatggatttcatcgataaacagaattacattcttatcctttgaaacgtcatcgattaacttcttcatccgttcctcaaattggccacggattccagttccttgaacaagtgagacaacatcaatcgagatgatcttcttgttgaggagcttctcagacacatcgccagcgacaatcttttgtgccaaaccttcgacaacggctgtcttaccaaccccggcatctccgatcagaactggattgttcttggtacgacggctgagaacttcttccatttgttcaatttctttatcacggccgatgactggatccaacttgccatctttggccattttggttaaatctgttccatattcatctaacaaagttttcttctgttgaggtctgcgttcttgaacttgaatgggttgttgacgtgactgttgacggccgttggaatctgacattgcattcctaaagaacgggtcgttgaaaatatcgtcaaaaccgttagttccaaaaatatcgttattcataggcaatacccccatattctaaatgatttcctatatttgttgaaaatgttcgagggcgaacatccattcccctttcgaacaactatatagtatcatatattggtaatgaggtcaaacaattaacacaaagatttaattgccataaacgcttgtacaccaacgttcgcaagacaatttgctaaattgtagaaaataaaattagcactccataatatgaagtgctaacggtaccagtaatgttattcttcgattaaatcgaaattaatccgtaatctcaaaggtaaattccacagaatctttcaaagtattgtggacggtgcacagatgaatggtatcctcgatgaatcgatcgttgccttccttatccaagttggtgtggcaggtcaatttcacatgaatacttttgacccgtgaagacttgtcggcaaaacgttctgtttcgccggtaacttcgacttcaaattcttccactttaatattggaaccggggcggtgaaccaatgatgcggcgctggcacccagacaggcaccgactgcgcccagcaagtattgaaccgggttggggccggcatcggtgccgcgaaatctcgtgggttcgtcagccacaaactgatggacccccgcagtgttaattgtttgagcgccaatgtctcttaaggtagtatgaacgttataaattgccatagtttaactctcctttgattatgatttggtttacaatcttaatatagatgattttaagtggaaacgaaatgaaaaaggcttatgaaaggcgtaggataacaatgaaaacattgatcttaatttcccatcctcaatttgaggattcgggaacgcaacaatttcttaaaaccagcttttattccctggatgatgtgaaataccaggtaattgatgaattatatacagcaaccgggacaatcgacatcgagaaggaacaaaatgcactgcgggattttgaccggattgtttttcaatttccaatgtactggtactcatcgccggcgagcttaaaacgattcatggacgatgttttcaccagaaactatatcgttgccaaacgatccttaaaaaccaaggaattgggtattgtcgtgtctttgggggacgctgaggccgacttccaagccggcggcccggagcagtttaccatttccgagttgctgcgtccgtttcaggcattcgctaataaagcaggtatgacttatctgaagccatttgttgttaatcaatttggttatttggatccggcccaaaaagagaagttactggtcgactatctggaatacttgagtgccgagatgcccttgagtttggccaaccgcgagcaatggctggttgctcggctgcaggataccaaagcagataagtcagcggaccttcaacaggccattgatttggtgatcaactccattgaagatcaacagaataatgttgaaagtttaaaacaagacgtgaaaatgattcgcgatcaggaggaatagggatgagtgatacaacggattggttggttcaacagctgacccaactaaaggaagctgaccaatcatttgttaataaatcgatttatcaagcagctattgcgttggctaaggagcaggaaaagcgagcgcagcaatcccaagatgagttggacgggcggatttggagcccggataagtggtaggttaaatagaaatatatctgcctttcatctgtaagccgtgtccaagtgtcgacacggctttttttgtccaatcagtgataaactagaatcgatattgaagcggaggggtgaatgtaatggacatggtactactactgaccatcattttggctgcggtcgtatttgcgaatattctcgcgcgacacgtctcgtttattccgctgccatttttcctgattttgctggggattctactggcggttctaccggtataccgcaatttccatttggacccatcgacgtttgccttggcaattatcgcgccgatgctgtttaatgaggctcaaaacagttcgcggttttggattggtcggtcgatcaccaacattttgtcgctggcagttgggctggtactggtcaccgttttggtggttggttcaggcctacacgccgtcatgaccatcctgccgctgacgctatgctttgcattgctggcgattgtcacgccaactgatgcttcagcggttaattcgatttttgaggccaatccgattgctgaagagcaggcagggatcttgcagcacgagtcgctgtttaacgatgcggccggcattgtgctgtttgacttgtcgctgactgcctttgtctcggggaccttttcgttaaaactggccgttgcgatgtttctctgggaatttttaggcggcttgttatttgggagcctgatcggagttgcgattgtcagtgcccggctgtttttgattcgttataacgacgatacgccgattatcatggtgttgatccaattgatgtctccatttttagtgtatttgctggcagaaaaattagcattgtcaggcatcttggcggttgtcgccgccgggctggttcagggatctgaacgtgacaaattacggttaacttcatcgcggatgcagctggttaccagcaacgtctgggaagtcgtttccggagcattatccgggattgtgttcgtgctgctgggcctgtcgttgccggaagttattcaggcacttcaccaatctccaaatcctgatctgaatattttgaagttaattctgattgggattggcgtttatgcggtaaaaggaaccttgagactggtttggagcagatatatgctcaagcgccgtgttaaatcgaaccatgagtggcgtgatagcctcgtcatggcacttagcggagcgaacgggacaattaccctctcactggctttctcgatgcctaacacggttaatggccagccatttgagttccgaggcatcatgatttttgtcgcagcggtggttatcttgaccagtctcattatgccgacgatttttgttccaatcattttaccgagtcaagatcggcagcagccgcggtatcgttgggttaaacggatgattcaagccgcaattagtgacctgctgaaagaaaaggagcatcaagccgaggcccaggtggtcattgattcgcttcagcagcagttggttttggacagcacgccgaatttccatttgcgtaggcagctgatgagtgagagccaccaagtggagctgaagaccgttcagaagatgtttgatgacggtaaaatttctcaggatgagctgacgtactatacaaaatttttgaacttgaataatttttccgcggatgaaaagatttggaaaaatgtcttattgagaattaggtttagtctgcatgttggtagattatataaggatttgaaccgcgctcaagaggcgtttttgaccgccccggtggctttggaagaagtctattggcgcgagcaatttgaaaagcatggagaaaacatcctcccaattgaggaagccggatttaacgcggtcatggactttttgaagactaagcagggtgaaaatggtgtcgagaccaacatggtcaagcgattctatcgaaccaggcatcggcgaattaatggccaggatgttgatatggacattgtctaccagatgttcatgcgggcgtttcatagcgagtatgagctgattcaaaactctttgacgaccggaaaaatcgatgccgctttggcagaaaagctgcaaacgcggatttcgactgatgagatgacttatttgcagaatatggagttgttcagggattagtgtgcgacaagactcgggttgatcgcggtgcaaaaaacagtgtgcgaaccaggccggttagactccgagcattaggtgaataggaccctttgatgctggtcttgcatcaaagggtcctatttatctaagcggaggagtctggcctgggtagcacaattcagcaaagtagcagcaaaaataccccgaaataacagtcaaacaacctctagagttacaggattaggctggtcttgcatcaaagggtcctatttatctaagcggaggagtctggcctgcgtagcacaattcaacaaagtaacagtgaaaatccctaaggataacagtcaaacaacccccgaagttacaggaccaggcctgcctgggtagcacaactcagcaaagtaacagcgcccaaacaatttttactaaatgtcctttacttcaagtacactcgaagcgctaaactcaagttatcaactaacaaatcaaaatgaggagaggaaacaaaatgaaataccgtaatttaggtaaacaaggccttaaagtcagtgaattggctttaggcagctggatgaccgacgtgagtgattcagccaagcaggatttggcagatcagagtttgaaactggcttatagcaaaggcatcaacttctttgattgcgctgacgcttacagtggtggggcagccgaacggtttttaggcaaggcactcaaagaatttccacgaaaagaaatcgttctttcaagtaaggtttactttccgacaggtcctggagtcaacgaccgtgggctttcgcgcaaacatattatggaatcgattgatcagtcattgacgaatctccagactgattacctggatctgtacttttgtcaccgatttgatcccaacacaccgttggcagaaactttaactgctttgagtgatctcgtcgaccaaggcaaggttctttattacggtgtcagtgagtggcgcccagtgcaaattttggaagcacaattagtgattcaaaagttgggcttacacccgatgtctgtggttcagccgcaatataacatgtttgatcgctacattgagcatgaactgatggatgtctgcgaaaaacttggcctggggatcgtcccattttcgccgctttcccaaggcttactgactggcaagtatcgtaagggtcacaagattccagccggctcacgagcaacttatcaagatcaaatccaagcgctgttaacggacgacaacttagataaggttgaagaactgattaagatggcaaatgagttggacactgatttggcgaccttcgctttagcttggacaatgcgtgacccacgaatcagcagcttgattactggtgccagcaagcccagccaacttgaaaataatttgaaggctgttgatttggaaatcccagaagaatactttggccgaatcgacaagttatttggattcaaaaagtttgaaagacatattgggtaacggaacagtgtggtaaaacaagcacttagcttccagagtctaagggggattagccaaatatcctggttgtggatgtttggctaatcctccttagacggccggaagctgcttgttttcccactattcggcgaggtaatactaagatagcaaaaaggtctgagcaaaatcgttagttttgcccaggcctttctgccgatttggttatgatgcgacctatccgatgatggaggtggccattaggaattgtttgattgttcaggatcgggatatcccggtgcccagtggttaatcggcccaaatttgtggccaacttggatctcattttcaattgccacgtcaacaaactttttagcaatgcgaacagcggtttcgatgtcgttaccacgggctaattcggcagcgatacatgcggacaaactgtcgccggtcccgtttttacggtcagtatcgaagaagtcaccagtcagccagaaacttttcccggattcgaggaggacataatcggacacttctttttggccgggtttgtggtggctgcctttgatcatgatgttggcggcacccagatcctttagtttctgggctgcggtaaccatgtcatcctgagtgttaatgtccatttcagccaatttttgggcttcaaagaagttgggagtgatgacggttgccagcgggatcagctaatcgcgaagcgtctggtaggcgctttgttccaaaagcatgttaccatgcttggtggtaatcaccggatcaaccactaatgggccgaaatcgtatttttgatagttcttgatgacggtgcgaatcaactctgtgtcggccagcatcccggttttgcttgcccgaacatgataatcgtcggccaaatctttaaattcctggtcaataaaagatgtcggcagggttaccgaatcatgaatcccgtaactatttcctgccaccgcggcggtcataacagccgttccgtagatgtgccgtctaaaaaatgtatgtaaatcagcctgcatgccggcgctgccatcgctgtcagagcccgcaattgtcagtgcctgtggatattgttctgtcaaattaatcacctcaactgttcatttaattattaagaataccacatttcattagaaatcatagagaaaccgcagattgatttgcgttccaacctaaacttgtattataataatttagtctattggaattatgaaatcataatacaaaataaggagagtctaattatgcgaatttgtcatccacacggcgtacaaggacgtcgtccagttaaccgtaaaaaagatattaagcgaaacaaagaattatcagacttgcaacatttcttgaagcaaaagcctgctaagtaatttttttgaatttgtttaacatcatgattcacactaaataggagtcagtcagctaaccaagctgtctgactctatttttatgccgtggccactgcttcaaatgcctcaacatctttctcagtgccgataatcgtcacaatgtcaccaggtttagtaatcgttgactgattcgggataatcgcaccgttctcgtccgcgtgggagagggcgatgacagaaatcttgtagcgattggttaagttgagttccttgagcgtcttgttaaagagttttggattggtcagttcaaattcaatcaccgacaattcaccctttagcttcaaatcattgagaatcttaggctccatcacgtgcagggcaatccgctgacccatatctcgttccggctggataacttcatcggcacctaatttttccaggacttttgcatggcgggcattttcggccttacagatcaggtttttgacacctaattcttcacaaatcatggtggtcatgatactggcttccagatcggttccaatggcaacaaagacgttgtcaaagttcccgatgcccagttggtttaaggctaactcattttgcgtatcggctacgattgcttcggttgcccggtcacgaaattcgttgacccgagcttcgcttttgtcgatgaccagaacttcctgatcgtgttccagcagggtgttgacgatactggaaccgaagaggccgaggccgatgactgcgtagttttgtttcattgttttgctccttttggttgttgggttaatttttaatagtgtttagcttgaaaatatgattcataacactcattgcacttagaggtgttagtgcttttattttacctagtggaggcgtgctccctagggcagcaacctgcgcctaagatacttccaacgaaaatcaaactcgatttccgttggaagcaccttagactacggttgctaaccgccctagtccgcactcttacccaatcatcacattctcctccggataccggaaagcatcttccgggcgctttgagttgagcagtgagtacatcaccgtaaagatacccactctgcccatgaacatcagcgccgcaaaaattaatttaccgacgacactcaggtgcgccaccaggcccaggctaaagccggtggtaccgaatgccgagatgacgtcaaatgtgatgtattccaatccctggtttttggggatcgtttccgtaaacgttagaatcatcgttgctatcgacaagaccactgccaccaagaagaccagtgacaatgaacgggtaacgttatcgttactgaaccgccggccccaaaaggttgcgtcccgcttgccgcgcaatgttgaccacactctgatcagcaggatgccgactgtggttgttttgataccaccggcagtcgatccgggagttccgccaatcagcatcaaaatcatggtgaagaacatgccgcccattgtgatatgggtgaccggcagggtgtaaaagccggccgttcgaggagtgaccgccaaaaaccaggtgttcatgatccgctggaacatggttaaatgactttcctggccgaagttgccttcagtcagcatatacaccacaaagctgaggccaatcagccccagataagtcgtcaatgctaatttggtgtgcaggcttaaatggtgatcttccttgtagaaaagaatatctttccagaccagaaagccaagtgagcctgaaataattaaaatcgtcaagacaaagagcaggtatggatcggtctgaaattgttccaaactgttatcgtacaagtcaaacccggcgttacaaaaggcgctgattgaatgaaaaatgctgtagcccaagcctttggcaaacccgtaccggggataaaaatcgataaaaatcagtgccgttcccaacacttgaatcgccaaagaaatccggaccaccaaaaacacaaccgaactggtattggcaaatgactgcaggtttagcgattgctgagtcaacaaccgggttgtcagatcaacttttcggcgcatgaaaacaaacaggagaaccgcaaaggtcatgaatcccagaccaccgatttccacgagcatcaagatgacaattttgccgaaaacgctccaatgaagcgcggtattgacgacggtcatcccagtgacgcaggtggccgaagttgccgtaaagaaggcgttaatgtagccggtcatgtgaccggatttgctggcaattggcagtgacagcagaaaagttcccaccagaatgatgatgagaaatcccaatgttaaaatctgcgggagtgccaaccgggtttttaagttcaaagaatcagtacctttcacttggcagaaatgccaatttctaataatgatgtcatctgtattatcgcacattccaccgattgcgcccaactccggcattaaaatagactataatgttattaaatacttgattgtgagggataatctgatgctgataaaaaatgtccatattgaaaacgctgaagaaaccagggacgtcaaaattgaggatggcaagttcgtcaaaattgccgcctcaattcaacctggcgacggtgaacaggtgattgacgccaccgataaactactgttgccgccgtttgtggatccccatgttcatttggatgcgacccaaacggccggtgatcctgaatggaatcaatccgggaccttatttgatggcattcgaatttggagtgagcgaaagaaaaagctgacgattgatgatgtcaagacgcgggcaaaaaaggctcttaagattcaggttgccaacgggattcaatttgtccgcagccatgttgacgtgaccgatcccgatttgacggctttaaaggctttaattgaggtccgtgacgaggttgccgatcaagtggaactccagctggtggcctttccccaagaaggcattttatcctatccaaatggcaaggaattgatgattgccgctgccgacatgggagccgacgtgattggcgggattccccactttgaatttacccgcgactacggcgttgagtcactcaaattcttgatgaaagttgccgaaagcaagggcaaactggtcgacgttcactgtgacgaaattgatgatccagcttcacgaaacttggaagttttggccaccttggcacttgaaagcggcatgggcgacaaggttaccgccagtcacaccactgccatgggatcgtataacgacgcctatacttacaagttgttccgcctcctgaaaatgtctcacatcaatttcattgccaatccgttagtgaataccaaccttggcggccgcttcgatacctacccaaagcggcgggggatgactcgggttaaagagttatccgaggatggcatcaacgttgcctttggtgaagatgacatcaaggatccttggtatccaatgggcaatggtaacatgctcgacccggttgagatggggattcacgttggccatttgatggggtacgacgatattatgaattcctaccagtttattacgactaacggtgccaaggcgatgcatatcactggccactacgggatccaggtcggtaaaccggctaattgtatcattatgaataatgataatttctataacgcgttaaatgaacgctcagaaattctctactccattcacaatggtaagattctggttcaaactgagcccaaacaggtcaaaaactatttcgaagattaatttaaaagcactcagccttttgacacacattgctgcgtcggctgggtgcctttttgaattgtggggggatttccaaggtcattagttgccatttatcaggaagtatgacacactttgattgatgagacacgaattgggggatgaatgcggtttggatattttatattgtggagatgaccacatgttttcaggattgattatttcaatcctctcactgacaaaacacgcgcaagaaccactcaacatctacattttaactgggcaattgtataatcgacatcagcaatttcaagcgctgactgacgatcacgcagcctttttgaatcaactggtcaagcgggaaaatgtcgatagtggcgttaccaaaattgacattaccactcagtttgaggcggatttgcccaaggcgaacatcaacacgttattcacgccctatagtatgttgcggctgtatagtgatttggtgccgcaattttcagaccgaattctgtatttggacgctgacgttgtgtgtcgccggccgtttgaagatttttatcatcaatcactggcaggaactgattttgttggcgtcttggatcattacggccgttggttcttccatcatcaacttagagcatttgattacattaactcggggatgctcctgatgaatctggacatgatccgccaagacaaattgctggcccgctgccgggagtactgtcgaaaatggccgatgattatgccggaccagtccgcaatgaataagctggctaagcacaaggcttttgcccctgaaaaatacaatgagcagcaggatgttcaatctgacaccgtttttcaacatttctccacccggtggaaattatggccgatcgtccacacggtttcggtcaagccttgggaagttgataaagttcatcagcaacttcatttgcatgaatatgatgatattttagcggagtatcaagagattatggctgaattggatgctgaaggggaattgaaaactgagtgagggtgcgatgcgagatgtgttgcccttagaattttaatgaacgagctgattattcctgtttttggaatgattggctctttttatattttgtcttgattggattggtgcgcaggggcggaaagattatcaattggttggtgcggttatgctcttttgagctccctccggcctttaaaacagactaagcttgtgatgaattaaaacccgacggggctttagttcatcactttttggtataaagtgattgtgaagttagtaatgccgtgagcatatttggcgctggacgccgtctctaaaactggctaa

SEQ ID NO: 170 - DNA, 126539 bp, Lactobacillus buchneri
gccgcggcttcgtccgttgacaaaagttttctagttctgagcgaatgacttcaaactgttggcgagtaatattactgggataattaggcataacaatttccttttttgcaaaagtataccaaaattcaatttagatctcaaacagtttcttagcaatgatataagaacacttggtagaccacatttttttaaagtgcggattaacaagctgagatattttaatcgttcgcttagtcttcaccgtcattatcagtgtcctccaaatcatcaatcactatcgtactgtcatcgtgttggttaaccttctgaatttccttagctttcgtttccgcaatgtctgcttcggcatttgctttgcgcaactgagcggattgcataaccgttggaactggatatcgctttagcaactcagtgagtgctttcaccttatcgttagtttcaacgagagcttcacctttgtctaatcgcaaggtcttcagtaaagatgtatcgcctttattagtaaaattgacttcattctcgtagtagaatgcctgctttccagtttccggatcaatgtatggtagtaattcgtagtgctttccggaactattaatatatggtccctgcttaacgtaatgtttcatccaccgtaaatgtttgactcgtttggcctccacataatcaccgatgttagcaaacgcttggcgctgaagttcacgaacaatatcatccgccttaatggcctctgtctgttcgcgtatcatgcgaagattatctaattctgctcgcacactagcattaactagtagccttggaccatttacattggcagtgttccaaggcgccccatacgccttctgataagcccaggtggcattgaatcgttgcaaatagtagaggcaaaacaacttttgcttttcgtttaattgaccattggtttccaattgatcaactattttgtgtgcaccctttttcggttttgtgtgcaccctttttgtaactttgtgtgcaccctttttatttggggtgcgttgccaaccataccgttttttccacgatttaaccgtgtttatcgatacttggtacttgtcagcaatgtccttatacttcattcctgatagataatccttctcagcttgtttctggttattcattacataccaccacacctccatttttaaattggactgaactcatgcattcaataaatacaattattctccacggtatggtggcgtgatattgctaccaaaggtctctgttagtgcgaagaagtatcgataatcttcattgacattgtcatattgactaattgtatctagtgacttggccataatctcagcagcctgctgaattcctttgtcaatcgtgccgttatctagcttcttttgaacagcacttgtgtccaatacggcatctctcaatgccttatttatctccgtactaaattcgtcttgaatcatgctgacgattgccgatttattaaacctttgatcacctgaattgaacatttttgtcaatttaattcctcccagttgaaccgaaaccattactaccacggtcactctcatttagtttatcgcattcaatagattgtactgagacatcacgccgaataaccaactggcaaaccttatcgcctttgttaatttgattaggccgattagataagttaacgaaaatcgccatgatttcgccacgatagccagggtcaaccgttccgagaatgcactttaatggtgtcctaatactcatccctgaccttggtctaacttcagctgaataccctttggttaactgaattgaaatccccaaagaaactcttttcgtttcgaatggtgcaaaataaacagtttgatcagcatataaatcaaggccggtatcatctggatatgcctgatgtggtgccatggcagatggggtcatttttttatatttaaggattaccttaggcacgttccctcatcctttcctgcttatgtcgcatgtcgtctgttaaccgttctttaaatggtgtctgtaatgtggaattaatattattaatatcttctgaactatacataacaccactagcaaattgagcctcagaactaaatataatcaaaaattcaattccatcaatataatatttagcaaccccgtttataagctttccctgcgcataaatatatttcatcttaatgtcattgcttggagacttttgtttaaaataatctcttaactcatcgtatctcattttattttcgcctctatacaggcttttccttttagtctaaactcattcaatttacgtgcctgtaaagctttacgcttgcgatccttgattttggattttttatgactcttcgtatgcttgttgtgtttgctcaatagtaaaaatcctccattcaaagcatcaaattgtttgcaattatttaattactttaagataatgcatgtgtaccataaaataactaaggagatgttatttatgagtttaaaagataaagcagacagtgctaaagataaggtaagcggtaaagctaaagaagttgaaggtaaagttaccggtgacaaagctagagaagctgaaggtaagggccaaggcattctcggcaaagccaaggataaattatccgatgccaaggaaactgttaaggacacagttgatgacattaagaaaaaagcagataaggacaagtaatttatcaatttcaggcgagtcttctaaccaggctcgcctgtttttttcttcaaattaaaagcgccctctttgcgaagacgcctctttaagtctctatccagttgtttgtcaatctgttgttcttccttggaaacataaccatagctggttcgttgcataggcgtatatggatgtttacggtcactcatcagtaccaccagcccctataacggccatatttagcgatcccagctggcaacaacatgaccaggattaaaataattagcgtaaccacattgccacctccaatttatgtatcaaaaaagcccacgttttccgccgcaggcatcatgtaactcactacagttcaagttctagacaacataacatacaagtttttatttttgcgtgagctgcatgtttgttgactggacgggtactactcattaatttttaggaagaatttactttgatacaagtccaatcaacaacgtggctggcagggaatcgaaccctgcacggtaatctttccgccatcttcgtacgtatacgttacagtcacacatctaatttctgaagggtgaaactcttttaacaaattccacaataccaatataacccctgtttttgcattttttcggcagaacatcggcagattgtcggcagaaagtcggcagattatcggcgaactttttttgctcgcagtgtatcacgaggacaaactatcgcaaaaacccataaggcttgtttctggtaatcgttatatgtacgctcagccagataacctaaatcatacttctccgctaagcgttcacagcactttttgaccgtgtagtgattaatgaaccggtattccaacaagtcggctaagaaggcgttttgatcatcaatggagctcatgagttgaatagtcttcaaacgtagttcacattccatcttagcggtggcttgtttaataattttatcttcctgccgggtatgtcttggatctgactgtgcctttggcataccgtccatcatcggcgactgcagggagaaactgaatctagccgcttcaagttgccaatcccgatactcatataaaaattgtttagcattttttattgtttgttttctatccaataagccaaagacactatccatctccgcaactcctttattgtcaccttagttgatgttatactgaaattgcctatcaattagcatcaccttggcttccggagacgggagcttttttatttttcctccaaatcctcaattcgccccattacataactgattaccatcatcaaagtagcaacggcgtaaaaaatataaaaatctactgattccagatgccatttattcacatagcccagccaacattgactggcataaatgattacccaaactgctaagcttctaatcaaagccatcgtctgcctccacatcctgaaatgccttaacaacgtaatcagtaaactctttgcgattagcagcaatgtttctagccaatcttgtaggtcgacaaagctcattactgtcaccaaaaaaatcaatattatctaaaacatccatggcaatatcaattgcatcgctgtaaccatccatgtaatctggtaataaaacatcatttacataatctttagtttcttgcagtaacatttactatctcccctttcatatttctggatcgtgcaaatgatccagttcatataatgcgatcataatcccgccagcaataccattcatggcttcatggtcaatgaaaccaccattctcggatgctgcttcttttaaccgtttctcaagccgacttttaagcaatttcatgccatcgctcatttgtttgcccccaattgtcttgttcgttcgtgcgattgcaccgtattttgggagctgatttgatgttgataatttacaattgttctacctgccgtagatactctaattcccaaaatatgagcaatggttgctgttggataaccgcgattatagagctcgacagcttcctgatgaatcttggcagcttcacgtgctgacatatcccccattttgcgggatcggaaacttaaaactggctgttcggtctgcttaagaacaattgcttgccattcaggtgaatcatccggagctttaaccactgatttataacgctcctcacatcgtcggaccaggaccaataattcatcatagaagtgcttattggcccgattatgatcatggataattttttcatagttgcgaatttttaactctagtaatttactcataagttcaacctctctagacctgttcataatcgcccaggacacctattttctgtcacgtaattgcgatactcaatctgttcgtgtgtcatgctgtgcctccaactgatacccgtctagccacgcgcgagcaactaattcctgatatttccgataacgagaataatcaaattgataggttcccggtgtgagttccatccagtcgcgcatctgctctggccgcctctccgagcacagcatgtcaccaattgatatatgtttttgtttacactcctcaatccagtcagcaacggccttaggaatcactggcaactcagcatatgtcttcttgaaaatgtcatcagcaattggccaatgttcgccgtttacgccagtggcaatccaatcgccaacgttaatggacaaagcaccttctttagtcattaatattgaacaaggaaatacaggttgccaatattcattttcggaatttttatcataagctggaataatatcatattcatctatcatcttctgtgacccgtcaaattgttcagcttgaattggttgcttttgatatatcttaatcatgctgtgcctccaatagttctgggttcgtatgcacgttaccttttacttccatttttgaaacagcataataaccatctaattcttccgtccatacatgtggatcccacatattttttactagatacttgtcatcctgtacacagccttggatagttgcttcaacaatatctccttcgtagatttccttgccgttcatgtctttcaggccggtatactgccctaccgtttcagggactacatcttcaaaccacctagatagcccaacgtcatctaactcttccgtttggtcaccaacaatcagtgcaccatcaccattcttgatatagtacccataaacgaaagttccatcatagtctgctatttcgtaaatatcatcagcatctcttaacggaatccctctgaacttaatctctctgctcatttgtcttcctccctaatattcctcaaatatgccgttcttagcgtcgtactcggcgattaccaccggtattcgatacttggccatgaacatcttcatacgcaagacagacgctctggttaacgttgcacgaccgcctttcacatccaccacgctgaccaaattaccgtgttcgtatatgctgaaatctggcgtatatgtgcaaccacggacatgcttcctaggattttgtagatcgaaacttggtaaggtctcaaacttctcatggattttaaaatccaatttcaagttcttcaagtgcaggtagtacgcaccctcggccttgctatcaaattggtgaccatcaatactcattttgtgggcgttgaacttgttgtccttccttggcaattcaattgctgacttaggtggctcttggacgcctgtgggatagtttgtcatttgctcaccttcagaccaattcagtttgtccttcagaaactccactcaaccgcttaagaatttgtaatgtagcagttgaaggaacccagttcgtaataaattcatcagctacgtcaaagtctttcttgcgtaactgggtccgggttttaatgccagtaacttcgttaattccacgattaatgtctttataaagcattgctcgttgcttctggttaagcacgagatgatgaatgccaatatagctattaactgctcgcttaacccgggtactgatgtaactgtattcaccgggtgcgattggctggtcgtcttccagcttggtaacccgagtatcaatctgcttaacttgtcgattaacctgatcgctgttttcaagtaacaggtgaatcttctcatcaggggtttggggtaaactgacttgctgctggtaagatttctgaacttgaataaagtactgacgtgcttgtttacccttatcagttctttgaatcatggcaatctctttcgccatgtccaacgttaaggcgtggtcagtaatcttacgtacgttaccaaacgcgctctcgtcattcacatttttgttaatcacggcgaaatcaacgttttcagtgaatccatattcgatcatgcgatccatccattgagtgtatggggtctttacccccagaaagtcgtgaagatcacgaccactgacagcttgtccatctgcatagttcaaaattttaattaactgatccatttctgccatctcctatttctccaaaagttctgggtgttttaaatttgtgtagcgaatcagggcaacatcttcaggactcatccgatcttgaataatctttagtgggaagtcataaaggggtttagatgctcccttagcaggtcgactgtgtgtcttttgtaggctcggatgactagcttgcaagtgacgaaatacatcacttttatgctcaccaactgcaatcaccttgccggttcctaattcaagtgctttgtacataatttttagccttctttgctagtggtatttgatttgagcctagctaattgttcagccaattgatgcttctgtgctagagtcaattgtttctgtggttcaggtgtacctggctggtcatcatttgcccaatccggtaatgtctctttgacagtcggtttgcgatagccaccacgggaattagatacccgttgatcgtgcttctcagccgcttcctgagccttctttagggaatcaaccccatcatgtgcccagttgtggaacgtatggtcgagccatgtatcagccccgttcgcggagacgttctttttgccggcaagatgaatcgcatagcaaacaacatcatccccgaaactgtcaatccactcccaaagatcttgttgagcaatgccattaggaaatccccaaaggctttgccaaagctcaaatgatttagtagcgtgagaaaattcctcgcgtgcaggcgagactacttcttgtttctgtttagtttcgtttagtttatataatgtgttactgtcttgcttactactatgcttactgttttgcttactttgatgcttactatcttgcacactatctgacgtataaagtacgcatacatgataggatgttgcttttttaccattcgttcggaaatcaatcagacctatttgctttaaaacgtttcgatctttgaggatgcctgaacgtgataatccagaaagggatacaatcatagaattcgcagcagtaaaccattcctgccagccggttttgttgtttatggacatcagtgcatgccataaagcaatctcaccactagacagccttgctttatatagcttaaaatcatcaaacgctcgtatctgttggatatagttcaagacatcgcccccttaataaaatgtaatccggtcaatatcaatcacatcatttaataccttgccagatcggcaatagtcgcagtgcccacatggaaccggcttctcacggccttctttaactgcttggatatgtggctgatcatttttaatctgctccatacgataatccatcaagtaatccggaatgctgaagattcccttgtcaggtactttctgtttggaaaccgcaatgatgagcggtgtacactcaacatcaaacgtctgcttaatgagctccttatagactgccatctgcatgtcgtaccctcgagcctccgcaaaggagaccggtgcgcgttgatcaggtgaccaatgctttttatggaaatcatcaactgttttaaggtcataaaacatatgatgttccaggtcgagacaatcaattttgccccgccattcaactccaaatatggtacccgtgacaatcacttctttgtcaccgtggtaaatctgcttgaaagtcggatctgaatccaaagctttaatcatcttgtcagcatcgagaaattgtttcttgataccgcgctccggcttaccgtacttgcagagttcatcagcatgctcttcaatgaacttctgatgagcttctgggctctcaaagtaggagtggaggtaattgccgaccaataatggggtatcgtcctgctgaggctcccagttgccttttagctcggccaatgcttcagcttcacactgctcaaacttccagaaccacgacttggattgcgtcaaccaatcctggtcattggagtagtaattactttgactcagcttcttgggcttgcgtgtcgttgaggttttcgaagaggctttcttggttggcatcttctttggtttcgttgtcgtggtcatctttacctgcatcccccttctcttcgtgcttctttaagaactcatccactggatcctcgtcaggaacatcaatcacatcatcttttggagttggctttttggattcaactggtttaacaaaatcggtaatggatttattggctgattcctctggtgtgacatctttacggtcatcgtcgtattcgttagtggtggttcgattgattgcatcaaccagcaaatctgaatcatcagacgtgttgagaaagttcttagcggctcgattgataacggttcgtttcgccatctcgcctgggaatttatgctgaaccttgttggtcttagcttgtgaccaactggtatcaatctgtttcttagtcatgacggtataaactttctcaccatcactcttttcaatcactgcaaataccccaacaatcggcttgtctaagttttcaaatgacggtttaaactttgaaaccgtcaatcggccatcggtagcgctaatttcaaagtcatcatcttgatgaacgacttcagcccagatgtctttgacactgtcgaggcgtttaatagcagcctgagtaccaaagtaagaacgctgaagcgtgactttgttgccataaggaatgaagtaaacctggtctttagctggggtcaatccttggaccaccatgtcgatcagtgagttagcaattgattctttagttccattcatcaataagttgccgccttgggcattcgtcattgcgtagaaagctgatttcaaagcgttggccgggttgtagttcttgggtgtggccagtccctgcttccgtaagtcatccagcttggtattgatttggtccgttaaatctttctgtaaaactgttagttcatttgccataatttattcctccatatatttcgagtgaaatgcgtccactggaaagctccagggttctaatgatgtgtaaggctccaagtcctgaagttcgttcacggtcgcttgatacgtttgattgttcccggcatcctcatagttatctcgaaggtagcggttgatcgaatcttggtcatcaagaatgaattggtcatttccgtatggtcgcagtggaattcgccaatacatctcgctatcgtccatctcgttgccatgcgtgtctttgaattgctctttccattcagcaagttcaaattcatatgcatacttacgagcacccatgtccatcatcacaaccacccgccaatcttcctgacggctcgttgcagaaaattcaatttacgagtagaataaatttgaagaaaaaattgatatgtgctcaatttggagacgtttgacaatcctacttgtcgggcgtcttttttgttgtctgaattatccatgtcgctcaacctcttcataatgtccggttacatcgtaatcacttagtttatctttttcttttctgaggcaagtcagcagcgctcttttaacggtaggattgctttcttggtcataagctcgttccaatccggcgactcgcaagcgtgcatatttaactgctttaatcccattcgcctgcttgatattcatacttcaattcctccaattcttcgtcagttccagtttcaaattcatcggccaattcgtcgtaataggcatcttcgccagggctatctggatacatgtttgatgccccctaacagtcgttgcagaaatgtctgtgtcggtctatacttgatgtatagaatgttttggcatacaaacaatttctctttagtcgcatcagacaatcctacttgtccggtgctttttttatacatatttttcataacgtcctccttacttgaaccattcgctagggttcttcaccatcagatatgctaagtagcatccggcaaagaaaccaaaatacaagcatccgtatacaatgaactttcccaattcataaatcatattcgtttcctccaattcaatggatcagctcgatatgctacaatctggctttttaaatcaactcctgcatatttatctaagaatctgtcaatttcaatatttgaaatcatcttcgctccaagaatcattggttttatataacccattttgatcaagtcataaacgttatctgtacttgttttaacaattcgggctgtttccggaacgctatgaactgctggcttaattgcggcttttgtcgtcatataacttcatctcctaaatttgacgctcatgatgttgagcaatttctttaacacgctttctaccttcatcaatccagctcatcccgtaggtattcgctataattgccatgagtggaagtagataataaagaacgtcgtagcactgtgcaaaggcctgctcaggatcactgatattcttaatattgtttggactactaggatcagagaaatcgtctaaagcttctttcaaagcatccattgattgccccatttcagtaatcacccgatttgagagtgctgctaaattggtggatacatagtaatagtttggtaacggaggaataaagccatttgtgaatttatttaaaacggaaattttaaattcatcagcccctaacaggccttcagttgatttaaataaatttgccagatcatcaaaatgaagtggtgatttatcatgtcgaagctttgaaaccatggactgcgttactcctaagaaatgtcctaattccgttgtactaagttcaggattggcattcataaaatcagttagtttatgaccaaccattgcttttggctggagaccaaatacattttgcataacaccatcttctttcatctttagttgattccttatgaaagccgtgaccgttagtattaaatcaaggctaaaggattaacctttcaataaagttagccgttcaacctgtggcagaatatgctgactagctaaaaagtcatacaagaacttctgaccaagctgggtccacttcatcgtgtttgccactttcttagttccaaccttttgatcgaagtaagcaaacggttcaacgtgggtatagccacagtcttgatacttggcatacagcaaccatgttttgccttgtcgatactgaattcctaactcgtgaagcaattggttgaacttggctgttgacatgccataatttttagcaacaactgacgttgtttctagtcccggattggcaagcattttctgcgtataagctgcagccggtttgagcttttgattctcttccatagaatctgcgagtgcccgtaacgcactcggataatctttgggaattggcaattgttgttgtgttgaattgaagtaattctcttccagttcgtcatacacgtcccatgcctgatcagttcccaacattttggcatggcggctagcacctcgcttagtccataaatacaagtggctagttcgtttatcaaccaagtgaagattgttcacctggttcttgaaagccttgagctgattgccttccagcagataataatgtttgccttctacaaacttatctttattgttggaaaagttcttcttaatcacatcgcttgtcgtttcatagaattccgcaagttgttcagtagtgagaatcaattgactgttaaatttaatttgtggcacattgctcttcatttgaatcattcctttcgttctttgaaatttgaatacaaacacatcatccttagtgagataattgggttattccaactaaaggtggtgataactatgaatcatgaggaagttaaagacttagtaaacaaagcttcaaaaattgcttttgaaaagcaacaaccatatttggacaaattagctaagaaagctgccgacgacttagaaatcaaagatgaaactgacctcccaacagtcattgcaaaggtcgtccagtcaagcgaaatgttagctattggtattggacagagattgtctgctcaaactcttacagaagttttggatcaacttgatttgaagaagaaagattcataactgctgtttcaaacgctttttgaatatccttatccgaaatattttggcgctcttggttacttgcgataacctggagcgttttatttaattcacgcaattcagcagttaaagcttctacttgttgtttgttcatttaattcatctcctttcattaatgaattttggggggatagtaaatgttaaacgaattctttaacatctgtgcaaaaaaaactaatctttacgtttaacgctttagaagccgcaaatgcgtattccaaagttaaacgattcttaccgtgttctagattccaataatgttgagctgtttttaaccccattctgcgagcaacctccgctccagttaagcctagttgctgtcttcgctgtctcattaatgcatcagcatttactttaaccttcattgcttttacctcctttctaaatgtatcgtttaactttatgttttcattatagttaaacaatgcgtttaatgcaagcatttttctaaattttttgttgaaaacaataaacaatttgtttaactgttttataatctaccttaggagtgatgatatggatgagaaaaataaaacagggttgccaatgagattgatcaatcttagagaagaacgcaatttatctaaaaccgaagtcgctcgtagattaggcttaagtagtatgcaaagatacgcaaattatgaatatggcaaaaacgaaccagatgcctccatgcttaaaaagatagctaacttgtatgatgtttctgtcgattatctagttggaaaatctgaaaggcgaaaatattatgatttaacggacaaagatagagatgatattggtgttcaggtagatcgaatgttagcaggtttgtcttctgacgcagaaactaattattatggcgaaccaatgtcacccgaagataaagaaaaaatgcgagtagcaatggttgccgcactagaagctgcacaagttgaggcgagaaagcgatttactcctaaaaagtaccgtaaagatgataaagagtaaggtgattcaattatggcattcgagcatgatccaatcgatatggcacatataatcatgaaaaaatatcatacttgtgacccttacgttctcgtcaacaagctaggctatattctaatgtatgccaatctaggggatattaattatgcgcaaagagactattttaaaaggataaccgttatcactttaaacgaccagatagacgagtattggcaacgtttcgtgctttgccatgaaattggtcatgccctgcttcacaagggcttctcaaccgcattctatcggcataccagcggttacggcatggttaactgggctgaaaaagaagctaacttatttgctatgcaacttgagattgcccgttatgatgacgtagcgttaaaccacatgactgattatcggttacttgaagcaatgggacttgacgagtcattagcacgttatataaaaagatgacagattaaaaaccgtttgaaacttttatttaaggcatcaattaaacagaattattgcttggaggggctacatatgaaaagaactattattgggatagcaatcttgctagggactttaatttctggctgtggggcacaaaaaaataaagaacaatctaaaaaagcagaacccattacccctttaaaaatcgaaaatatttcaaagggaaaaatactgtctaatgaggatgggagatatgaggttaagatgattgccccgaaaaggtcaaccgttgaggcaacatatgtaatgcctaatggagctgttggcactgaggttcccgtacataatttacataacggatacttcattattagagaaaggattaatccaaagcacaaaaaaatttatataagtatcggggcctacaacaagcataataaagatcacaatgaaaatatcacaattgtcaataatggttattcaacgggaaacgtccaacaattaaataatagaaaagagcattataaaacaaattcgaaatcggtaaaaagttccgaatcgcaatcttctaatccagctaataacaatcctcacacgcacggactttctggattaaaatatcaagccgataaatatctaaagaaagataattcggtagccttttatcatccggttaaagtattggggtacgacaataccaaaccttacgtagctaacatcgaatttaaagcaaacgatgaaagtaaagcaaccatgaaagacggtgctgtctctatacttgagggtgtaaaaaaagccgactacaaagatttttcaaatattaaaatctcttttactcaaaatgtagccgatgccaacggcaagactttaaagaatatccctgttttgggatattcatttagtcgaagtacccttgagtcgatagatcctgacaatatggacagctctgatttaagtaaagttgcagatagtcacttcgataagcacgttgaagataattaaaatcagtcaaaataaaccaattaattgagaggtaataacatgaaattcaaaaaaacgttgttggttggattagcttcattatcacttgggactttgggtatattaagcgttccagcaaatgcatctgcgcacacttggtgggatggaacaccagttgcaattcgtggtcactggacaactcaaaacgtttatctgaaatacatgggttttagcaaccatgcaacattcaaagcaagcgctcataaggttgagtttgcgtactcagcatcatcaaatattacgttacatgatacttactggcgtaaaaccggagctcattcatacacagtccacggttcatggtatcgagatggtggttatgatcaccgaataacagtcaagaagttgagctctcaccatcttcgtgcctattttgatgggcactcaatcactcgtggctcagcatatccaaattcatttttcaaaaaataggagattaaaccatgaaaattagaagatcgttattattgacgattactgcgtttacactcggattaggggtgattcgtttgcgacaagtaagctgggaaaaagcatccatttacaccgtggccaaataattcacgtagcgcctttctatcacatgggtaaagacggctacatgcttcatgtaaacggacacggttcaaaattatattacgccaggacaaacagtagtaactggtttaaatattgaatgagaagcccttcgctgggcttttatttaaacgcttataagaacatacgtttattcatagtcaaggtattttttatgaagaaaggaagatagatatggcacgcggatcaatcagaaggaaagacggttactactactattcgtttgaagttgggcgtaaagacggcaagcggcgccgagttgaacggtctgccggcacttcaaaggcaactgccgagaagttacttagaaaagctctcagcgaatatgagaacggtggtcaagttcccgtcgaaactagtatgagtgttgaagaatatcttaatttttggtttgaaaattatgtaaaaaccaatttgaaagaaaatacccaaaagaattaccgtggcattcttgatgtgcatttaattccccaattcggaatttatcgtctgaaaaacgtcagcccttcaatgattcaagaatatcttaatcagttgggagaatctcacttagcaaagcatacatgccaaattattcagaccgttttacgtaaagctcttaaaatggctgttttcccatatcagctggttaagcagaatcccactatttacacccaattaccaaaatatcgagaagacacaaccgttactcgaaaaaagttgaaattgattaccatgcaacaatatcagcagattatggaaattactcccgaagcaagccccatctacatccctattcaaattgcatttaacaccggtatgaggcgtggtgaagtttgcggactgcaatgggattgtgttgactttgacgaccggacaatcaccattaagcggaacatgcagcaatatggtaaagacgactacaagttggaaacaccaaaatcgcaggctggttatcgaacaattgtcatcggtcaaattttaattgatattcttaaaaagcataaaaagcatcaaatggaagaacggctccgctatggaaagtattatactaattcgaattttgtatgtacgaaagaaaacgggaaaccagttctcccgaattcgatcaaatactactgcgaacaaattcagaagaaacttggtttcccgtttagttttcattcattgagacatactcatgccacaatgctattagagaatggtgcgaacatgaaagagatccaagcacggctcggccatgcaaaaatcacgaccacgatggacacctattctcacgttactcgaaaaatgcaaaatcagacggctgacatttttgagcaacttatgcaacgccaccagaatggcagctaaaaacttcctacattttaagcttaggtaggaaggtggtaggaattcaatatactttagtaagcaatcagctaactagaatgcctatttatcgcccttttcttcctcatcggtttgaagaaccgccatgaaggcctcttgggggatatccacttttccaacagccttcatccgctttttaccaaccttttgcttctccaagagtttcatccgcctggttcgatcaccaccatataacttggcggtcacatccttgcgataggccttaatattggttctggcaataattttggcgccaatggctgcttggacgggaatttcaaagttctgtcggggaataatgttcttgagtttaccaacgatgtctcgagctcttggtgcggcaaattgacggtgagaaatgaagcttaaagcatccaccttttcaccattcagcaaaatatcaattttgaccaggtcgctgggtttgtagtcttccaactcgtagtcaagggatgcatagcctttagtgctggattttaatttgtcaaagaaatcaaagataatttcggataaaggcatgtgataaatcacgttgacccgatactcatcaaggtattccattgtgtcaaattcaccccgtcgtctttgacaaagttccatgactgggccgacataatcattgggtaccataattgtcgctttgacgtatggctcagaaatttgcttgatagcagaaacatccggcatttcagatggattttcaacttctttggactcgccatcggttagcttgacctcataggttactgatggtgccgtggtgatcagttccagattaaattcccgttccaaacgttcctgaaccacgtccatatgcagcaggcccaagaatccgcaacgaaaaccaaatcccagcgccttggaaatttccggttcaaactccagtgctgcatcattcaacttcaatttttccaatgcctctcgtaaatcgtcaaacttggcattgtcagttggataaagtccggcataaaccatcggatgcatttcccgataacccgggagcgcttcatctgcaggatcaagggcattggtgacggtatcaccaactcgggtttgggtaatatctttgatgctggcggtgatgtaaccaacgtctccagacatcagatagtcgcgtttaacaggtttaggcgagttaacccccacttcagtgacttcatattcactgccgctgttcatcattttaatcttgtcgccgggtttaacagttccttcaaataaacggacactcaaaacgaccccacggtaatcatcgtaaaccgagtcaaagaccagggcctttaggggtccttcaacgtctccgtccggcgcgggaattttgtggacaatttgttccaacaattctgggacaccaattcccttttttgcgctggccagaacggcatcagaggcatccaagccaatcacgttttcgatttcttttcggaccttttccggttcagccgagggcaaatcaatcttattaatgactggcacaatttccaaattgtcatcaattgccagataaacattcgccagtgtctgagcttcgactccctgtgctgcatcgacaaccaggacggcaccctcacaggcagccagacttcgagaaacttcataggagaagtcaacgtgtcctggggtatcaatcaaatggaactcatagtcgtggccgtctttggcatgatacgtcaattccacggcgttcaatttgatcgtaatgccccgctcacgttcgaggtccatgttatccagtaattgatctttcatatcccgcttggcaacggtatccgtcatttccagaattcgatcggctaaggtcgatttcccatggtcgatgtgagcaacgatggaaaagtttcgaatatatttttggtgattcttcattttatctaaatccatgttgtattctcactttcatttgtttactgataataattataccagccattccagtttatccaaagttaaaccgaaccagcagggttgccttgacataaaaagaggtcaagcaacggcaaaacagccggctgacccctccacatgatcatgttatttatcaaaagcatctttcatcttgtcaaaaaaattactaccgcccttgccagcaatgttgtcaccactggccttggcgaatgcttccaaggcaatcttttgattcttattaagtgacttcggtgtgaccacattaaccgtcacccgctcgtcaccattaccgttaccacgaaggcggggcgcacccttacctttgagacggaaagttgtcccggtctgggttccggctggtacctttaactcaacatcaccatgaaccgttttgactttgattttgccgccaagtgctgctctggcaaaagtgatgggctggtcaacgtagattgttgacccatcacgcgtaaagtctttgctgggtttgactcggaagacaatgtataagtcaccgtaaggaccaccattgtccccggcttcaccttggccttgaagacgcatttgctgcccgtcatcaattccggctggtacgttgacttcaagttcgtgacgctcgtcggttttaccactaccaccacaggttgggcacttttccttgatctctttaccagtcccatgacaaaccgggcaaacttgacgggattgcattctgccaagtggggtgttggtctcagtggtaacgtaaccacggccgccacagttcgaacaggtgactggtgaagtaccaggcttggcacccgttccgccacaagtcttacactgggcttcacggttgtacttgatcacagtcttcttaccgaaaatggcctcttcaaattccagggtcatctggtattgaagatcacggccctgttggggtgcggacggatctgcccgctgttggccgccaccaaagaactgactgaaaatgtcatcaaaaccaaatccaccagcgctgccgccaaagttaccaaagcccccgccttggccaccgccgccaaagccggcaccggcaccatcggccgaaccatattggtcatagttggcgcgcttttgtgggtcgcttaacgtctcatatgcttcattgatttccttaaattttgcttcagcatccggcgctttattgatatctggatgccactttttagaaagcttacgataggcgtgtttgatttcgtcatcgctggcgtccttggaaactccaagaatgtcataataatctttttctgccattagaaactcccatcctcattcaattcattaaccatgataatataccatattttaacaaaaagccaaagccagccggccttgacttctcattacaatatctgattataaattactttttatcatcatcgtgaacttcgtggaagtcgccgtcaacggtgccatcgtcacccttgccgtcggatttgtcatcagttgaaccacccttggcaccttcgccggcagcagcaccgccgtctttaggagcttgttgttgatacaacttgacagccaaatcttgaacaatcttgttcaaatcgtccttcttagacttcatttcgtcaacgttgttgtcttccttagctttcttgagggcatcacgtgcatcttcagccttcttgatttcgtcatcggaaaccttacccttgacgtctttgagagtcttgtcagtctggaagatcaactggtcgacttcgttgttcaaatcagctgattccttacgttgcttatcagcctcttcgttttctttagcttccttcatcatcttttgaatctcttcatcggaaaggcctgatgaatctttgatggtgatcttctgctctttaccggttcccttatccttggcagaaacgttcacaatgccgtttttgtcaatatcaaacttaacttcgatttgaggaaccccacgaggagcagccggaatgtcagtcaactggaattgacccaacgtcttgtcgtcagcagccattggacgttcaccttgaagaacgtgaatgtctacggcaggttggttatcagcagctgttgagaagacttgtgacttgctggtaggaatggtcgtgttgcgatcgatcagcttggtgaagacaccacccatggtttcaatacccaatgacaatggggtaacatcaagcaaaacaacgtctttaacatcaccggtgatcacaccaccttgaacagcggcacccaaagcaacggcttcatcagggttgattgagtggtttgaatctttgccagtccatgatttgacggcttcttggacggcaggaattcgagttgaaccaccatttaagatcacttgatcaatgtctgaagtacttaatttggcatctttcaaggcattatcaaatggcaccttggtcttggcaaccaagtcggcagtcaattcgttaaacttggcacgagtcaaggttgtttgcagatgcaatggaccgttgtgaccggcagaaataaatggcaaactgatttctgattcagtaacaccagagagatccttcttagccttttcagcggcatccttcaaacgttgcaaagccatcttatctttggataagtcaacgccattatccttcttgaaaccgtcaaccaaccagtcaataattcgttggtcaaagtcatcaccaccaagatgtgtatcaccattggttgagagaacttggaagacaccgtcacccaattcaaggatggaaacatcaaacgtcccaccacctaaatcgtaaaccagaatcttttcatctttctcctgtttgtccaaaccatatgccaacgcagcggcagttggttcgttgatgattcgcttaacgtttaaaccggcaattttaccagcatctttagtcgcttgacgctgtgcatcattgaagtaggcaggaacagtgataacggcattttcaaccttgtcacctaaataatcttcagcaaagtccttgatgtactgtaaaatcattgcagaaatttgttgaggggtgtatttcttgccttcaatgtcaacagtgtaaccttgttcacccatgtgactcttgattgaacgaaccgtgttagggttggtgatttcttgtcgcttggcaacttcaccaacttgtggctgaccatctttaaatgcaacaacagatggtgtcgtacgggcaccttccgggtttggaataattttaggcgcgctgccttcaagaacagcaacggcagagttagtagttcctaaatcaataccaataattttattacttgccataaataatcctctttttcttttaaagttttattttgctacaacaaccattgctggtcgaagcactcggtccttcaaacgatatccgtcttggaggacctgaacaaccgtgtcagctggatgatcatcatctgccggcgccgtttgaacagcctgatcgaacttgggatcaaatggtttgttcaacgcatcaatcacctcaacgccattatcagacaaagccttggtaaaatgctcgtaaaccattgaaaccccctgcttaagttgcttgccgctttcgtcggtgacatcaactttaagcgctcgctgcaggttatcaacaatgggcaggatatcatgggccagctgctggccgtcatacttgattaaatcagcctgttccttcttggcatgggtttcaatatttcgcatatcggcttccgcacgaaggaacttatcttccattgtatcaagtttcttttgtaaatcgactaccgtttgtttcaactttttaatatcatttgcgtctgggctttgggcctgatcagcctttttttccggcttagctgcctttttggctgccttggctggttgagttgattggtcctgtgttggcccacttggattcttcttaaccgaatcatctttgttttctgccaaacaatcgcctccttaaattattgattatcgtcatcgtagtagccaagtaacttcttggtcaattcttcccgcaaagcaccaacaattccgatgacctttgagtaaggcattctggttggtccaatgactgcaatcacgccatgaccatactctttcaaatcataagttcctgtgataatactataatcttttaacaggtcgttgcgcagctcgccgccaattctgacctgaacatctttagagttgggatcaataatctttgaaaccgaatcctcggtgcccagtaaattgtagagtggcttaagccgatcaacattttgccgttctgcaaacttcaatagattcagttcaccatcaacgtgaactttgtctcggcccgcttcgtccagcatgtccccgaagatcttcaagaagccttccggggtctgaatatatttggtcatcaacattggaatatcaaactttaacttgtccatgacatccttgagcggcttgccgaccagttcgctgttaatgatattcacaatggtttcaagttgctcggacgagacgttggccagcctgaaaatcttatcaatgacgtgaccagtattggtaacgatgatggccattacctgacgatcatccaacttgaccaaccggaaaccgccaagtttcaggttatcgccagactctggattaaaagtcagcgccatgtaatttgtcaaatctgacaatactttggctgactcctggacaatctcgtcaatccgattgaactcactgttaaaagaagttttgattaagtcttccgcaccttcgtccagcgggtccggctgaacaagattatcaacatagtaacgataaccttcgatcgatggaacccgtccggaagaaaagtgagtcttcgtaattaagccctttgattcaagtgcagccatatcatttctgaccgtcgcggaactaacgtgggtcggaaactcctcagccaatgccttggaaccaactggcattcccgttcttgtgtaatcacgaatgattatttgaagaatatctttttgcctatccgttagcacccaaatcacctctttttagcactcaatataaccgagtgctaaggcacatttataatttaacaaaccgtctattataagtcaagggaatatagccttattttagcattattttgtgtagagtgctaatagtgctaattcaagatctcaggatgctgctctaagtactcacgggtcgcaactttgtctttatccaactgatcaattaaatcttcgggagtctgaaatttgatctcagctcttaagtatgaaagccagttcacgttgacgacttcaccatagatgttgcggtcaaaatccatcaaattgatttccaccgtcatcggatgaacatccgagaaggtcacattcttgccgattgaagccattcccaagtactttttgccggcaatttcgacggtgaccacgtagattccaatcgttggcagccattgatattctgagtgttcaacgttggcagttggatagcccaacagtcgcccccgctcctcgccgtggacaatgacgccacgggtttgaaatgggcgccccaacaatttagtaacactatcaacgtcgcctgaatccaattcaatccggatccgagtcgaactgacctttttatcattaatgtcgacagacggcactgtgatgacgtcaaaagcccctttaacaaatttggggaaattggccatcgtggccacttttttatcaccataggtgtgatcaaaaccagccacgactgccactgcattgaaccgctttagaaagttgttgatgaattcttccggagtttgactttgaaaatcatacgaataattcaccagaaagacttggtcaacaccaaaatctcttagcagctgcattttataatcattcagcgtcaaatatcgctgttcatggggcgacatttttcggtaaacaattgccggatgatgatcgtatgtcaacaccgccaacttggcaccgcgcttttcagcctcggtttttgcccgttgtaaaactgcttggtgacctttatgaaagccatcaaaaaatcccattgcaacgactgtcggaccatcgaccttaaagtcatcagacaacggatagtgtaatcttgaaatttgcattgttaaaaaccaccttcattaagctaaaaacattctaaacggtctgtattgaccgatttgttcgtccaaccggtataatgccttcacctgttgttgataatctaatcgaactaccggcgcgtgggtaggactgattgattggtccaagaaaccgccatgagaaacgattgaccagcggctgtcatccaattgataaccgggatattccgccagtgcttcagataacggatgaaggacgatactcaggtcttccgcagcaacggcttctttgacttgagccaaagtggatgtctgtgaaatatcaaaaccaccgcttttaattctggtcagatcagacatgacagacggcaagccaacccgttttccaaaatctactgccagcgttctaacgtaagtcccctttgaacagccgacttcaaaatagattgtctgcgtgtgggcagcgtcatcatacgttgctggtttaatttgcttaaaataatcaatacgaatccggcgtggatcccggtcaatggtgatccccttgcgcgcatattcatagagcttgtggccattgactttgacggccgaatacatcggcggcgtctgcagaatgtcaccggtcaattgagccagagcggcgttaatctgttcatccgtcaacggcgttttaaccggcacctgttcaatcaagtgaccgtccagatcctcactatcataagcgactcccagggtaatcgcaccgcgatatacttttccggactgcattaacagttcactgatcttggtcgcctggccgatacaaattggcagcaccccatcgacatttggatccaaggtgccggtatggccaacttttttggtgtgcaaaatttttcttaacttgctgatgcagtcgtgacttgtcatgccacgttctttatatagtgcaattacgccatccattcgaattctcctaattttttcatgtaagaaaattatatcacaaaaaaactgcccagccattcaggcgtggacagttgagatgattattcaccatcttgatttaatttattaattaatcggtcaatcttgtcaccatactgaactgatgtgtccagctcgaacttgatttccggtgttttataaatacttaaccgatgaccaagttcgccgcggattagtccgctggctttttccaatccctttgcagttgtttcttcgtcctcttttttatcggacaaaatactgtaataaatggtcgcctgctggagatcacctgtgacttcgacaccagttaaagtgacgccctgaactcgaggatcgcggacccgctttaacagaatgtcgttaacttctttttgaatttcctgttctaatcggccaacccgataatgagccatcaaaacacctccaaattacttgacaggcacttgtttcatgacatatgcctcaatcacatcgccgactttgatatcgttataatctttgatagttaaacctaattcaaagccttgtttaacttcattgacgtcatctttgaagcgcttcaaactgtttaattcgccggtatagacaacgactccgtcacgaatcaaacgaactttactattcttctgaacgacaccgtcaaccaccataccaccggcaatcgttccgactttagaagccttgaagatgtcgcgcacttcaacctcaccagtaacttgttcagtgtaggtcggagcaagcatccccttcattgctgattcaacttcatcaatggcgttgtaaataacttggtgaagacgaatgtcaacgtggtcgctgtcagcctgtgacttggcttgtggtgttggtcgaacgttaaaaccaatgataatggcgttgctggcttcggccaaggcaacatcactttcattaatcgcaccaaccccggaatgaatgatgttgaccttgacgccttcaacttcaatcttttgcagactgttagccaaagcctcaactgagccttgcacgtcagctttgattacgatgtcaacttccttcatttcgccttctttaagcgaatcaaacaagctgtccaaggtaacccgggtggtctttcgtcgttcctcaacttgagcttccttggcacgttcttcaccaacggcacgagcggtcttttcatcatcaaagacaacgtaacgatcgccagcttctggtacttcattcaaaccagtgattgacactgggcttgatggcgttgctttcttaacatcgcggccacgttcattggtcatggtccgcactcggccgaatgtatgaccaacaacgattgggtcaccgacgtgtaaagtgccttgttgaaccagtaaagtggcaaccggccccttaccttgatccaaacgagcttcaattaccgatccggcagcgggttgatccggatcagccttcaattccatcacttctgcttccaagatgatcatatcaagcaattcgtcaatattcttaccaaatttggctgaaatatcaacgaagatggtatcaccaccaagtttttcaggaaccagaccatactgcatcaattgatcagtaacatgctgtggattggcatccggtttatcaatcttgttgatagccacaatgattggcgtcttggcagctttggcatggttgatagcctcaatagtttgaggcattacgccatcgtcggcagcaaccaccaaaatcgtgatatcggtaatattggcaccacgagcacgcatttcagtaaaagcggcatgtccaggagtatccaagaaagtgatcaggttgtcaccgtgacgaacttgataagcaccgattgcttgagtaattccccctgcttcaccagcagtaatgtgtgaatgccgcaagtgatccagcaaagtggttttaccatggtcaacgtgtcccatgatcgtcacaactggtggtcgggataccaagtgctcagtattctccatttctttttcaaagatcttatccaaatcggacaaatcttcgtggactttttgttttgcttcaataccatagtcggctgccaaaatctcaatcgtatccttatcaagtgattggttttggttcaccatgacgccgagcataaataacttcttaacaatttctgctggctcacgatgcagcaatttacccaattcctgggcgttcataccatcttgatattcaagcacctttggtaatggacgattctttcgttccggtgcaccatggtgttcaacttcacgcaatcgttgattcttttgcttacgttgtttcttgttgcgcttcttgttggctttacgggagccgccacgattattattccggttcaagctgccgccaaaacgaccactgccggtattgtgatttgagaaattgttggaactacggtttgtattactgttattattcgaactggtatgattgcttgcagttgtactgctgccagttgaatgactgtttgtattacgggtcgacgtattggatgaattgtttgaagcttgatgattgcgtcgatcattattctggttggtccggtgattattggactggttcgaattgttggaatgattttgattattcgaatggttattattgttggaatgatttctttgagcagtattatttgtgttgcgagcaacactcgagtggccgttgttattacggttgctctctgcatttcggttagcctgctgtgtgtttcggcttaccggatgggacccgttgctgtcatggtgagcagccggtcgactctgtgcatgagcattggcatgttcttttggctttgagtttgccgaatgaacattgttggtgctgctcttatggcttgattgactatttccagtcgattgtttgccgcctttactaaacatcgcccgaatttgacgctcttggttagcgtcaacggttgacatgtgatttttgatatcgaagccctgtttattaccacggtcaacgatttgcttactggagacattcagttctttagctaattcgtaaattcgctttttccccatataatcactctcctttattgttatcggttaattcaaccaatttttttgccataccccgatcggaaatgccaataatggttcgtttcattccaattgcttcactaagcactgctttagtgtaactgttattcacgggtatatgatagtaatttgacttatcattaaacttcttttgagttgccttgccggtgtcttctgcgataaacaagaaaaaaatcttgccgctgcggatttgagacaaaagcatatcttgaccggagacaattttgcttgcccgccgtgccagacctaaaaaattcaaaattgcctgatcattgtccatcttcaaacaactcttttcgggcttgcttatggtcaacataggcaattagatcgtcataaaagttgtcatccaaagttgttgaaaagactttttcaaaagtgtgttccgctttagctttgcgggcaatctcaacgttaattgagatataggcaccacggccggacttctttccagtctcatcgattgaaacgtggccgtctgagtcacggacaattctgactaattcctttttcggcgccatttcaccagtaacgatatctttacgcattggaatttttcgttttttcaaaaaatcgcctcctaaaaattagtcttgagtgtcctcattcgactcatcgggattggtattaacatccgcaccgtctgtcggggcatcctcagttgaatcctccgtttgatcgccttggtcggaagcctcatcagcttctgtatcatcgctagcggcagcggctttattggcaagaatttccttggcttcagtttctgatttgatgtcaatcttgaagcccgttagcttagctgccaaccgagcattttgccccttcttaccaattgctaatgacaactggtagtcaggcacaatgaccgtgcaggcccgctcgttgtcatcatcaaagataacatcaatgacctcagcgggattcaaggagttggcgatataagatgcatcgtcttcatcccactcaacgatatccatattttcgccgtggagttcgttaacaatggtttgaacccgctgacctcttgggccaacggcggttccaaccgggtcaatgtcggagttgtttgagcgaacggcaactttggcccggtcgccggcctctctggcaattgagacaatttccacagttccatcataaatctcgggaacttcttgttcaaataaacgtttgagcatccctgtagccgttcggctgacaaacacctgaggacccttggtcgcattctcaactttggtgacatagaccttgatacgatcctgtggacgatagacttcgttgggcatctggtcttttgaacccatcacggcttcaactttccccagattaacgtaaacaaatcgggtgtcttgacgctcgacagttccagtcaccaattcatcttcatacttggaatattcatcaaaaacgttttcccgttcagcttcccgaacccgctgcatgattacctgcttagcggtttgagcagcaattcggccaaagttcttgggggtcacttcgaatttgatttcgtctcccagttcataacctttgttaatttcaagggcctcatcaagagatacctgaagctggtcgtcaacaacatcgtcgaccaccgttttaacggcgtaaacgtgcatctcgccttttttgtcgtcgaatgacacttcaacgttttgggcctgaccgtagtttcgtttgtatgccgaaaccaacgcggcttccaaggcttcaatgacaacctcttttttgatgcccttttcttcttccagagcagacagcgctcctaaaagttctttactcattattgtgtctcctttaactaaaattgaattgcaagccgtgctttggcaattaagttccgcggtacttccaacgtatcctgcttaccccacttatcattttgaagcaccagtttgtcgtcatccaacgacttcagggtgccttcaaatgttttattgccgttaagattttgatagagggaaacgtgaatatactcgccaattgcctgtttgagttcggcgtcgtttctaagtggtcgttcagcacccggagacgaaacttccaggaaataggcctgggggatcgggtcgggatccattgcatccagcttttcgcttaattcatcgctgaccaagacgcagtcatcaatggtaatgccgccttttttatcaatataaacccgtaaataccagcttttgttctcttttacaaactcaacatcgaataagtaaaatgagtgtttttccagaattggttcaacaacttgtttgaccgtttcaacaacattgctcaaaaataggcctcctaaaaattatccattaaaaagagcgagcatctctgctcactcccttacaagttatttagtaaattaactataacatatccgatgattcattacaaggctggcgcgttttaacgccaatgtgcaaatcaattatgctcgccttacatcaaatcaaacaagttcaactgattttcatccggcaatcccgccagcacattgttctcagtcatgaagtcaatcaaagttttggaaactttgccgcgtttggctaagtcttctttggaaataaacggcttgtcctctctggcagcaacaatttgcttagccacgttcaaccccaatcctggaactgaattaaatggggcaattaacgtatcaccatcgatcagccattgactcgcatcagacttgtccaaatccaccatttgaaagtgatacccgcgttcgagcatctcattggccagttccaaaactgtcagcaggttcttctctttggtcgaagcttccattcccttatcattaatcatccgcatggcgtttttgaccgcttctttacctctgcacatcgagacaatatcaaaatcatcggcacgaacggagaagtatgaagcatagtaaaccattgggaagtagactttgaaataggcaatccgaagggccatcaaaatgtaagcagccgcatgggcgcgggggaacatatacttaatcttcagacacgattgaatataccaatcaggtatcttggctttcttcatttcggcttgccagtcgtcaggaattccacgaccatgacgaacactttccataatctggaaagacaattcagagtccagtccccaattgattaagtcggtcatgatgttatcccgacatccaatcacattggcaatggttgccgttccattcttaatcagctcatcggcgttacccatccaaacatcagtcccatgggacaaaccggaaatctgaagcaactcggaatagttacttggatgtgtctgttcgagcattccacggacaaatcgagttccaaattccggaactcccagtgttccagtctttgattgaatctgatcttccgtaactcccaagatttttgggctggagaagatcgacatcacgccgggatcatccattggaatcgtttttggatcgatgcctgacaaatcttggagcatccggatcatcgttggatcatcatgacccaagatatcaatttttaaaatattatcatgaatcgagtggaaatcgaagtgggttgtttgccaagcggcatcctgatcgtcggctggatactggatcggcgtgaaatcatagatgtccatgtaatccgggacaacgatgattccagccggatgttggccagtggtccgtttgacgccggttgcgccctttgccagtcgatcttcctcggcttgtcggtagacttcacccttatcgcgttcgtaagccttaacgtacccataggcggtcttatcggccacggtaccaatcgttccggcacgaaaaacattcttttcgccaaacaaaactttggtgtagttatgggcaattggctgataatcacccgaaaagttcaaatcaatatcaggaaccttatttccggtgaagcctaagaaggtttcgaacggaatgttgtgaccgtcgccaatcatcatggtgccacattcaggacactttttgtgtggcaaatcatacccggagctgtattcacccttggtaaagaattcagtgtgttgacagttcggacaacgataatgtggcggcagtggattgacctcagtaattccggtgagggtcgcaaccaaactggaaccaaccgacccacgggaacctaccaagtatccgtccttgttacttttggcaaccagtcgttgcgcaatcaagtaaatcaccgagaacccgtttccgatgatactctttaattctttatccaaacgatcagaaacaatcttaggcagtggatcaccataccaagcgtgggcggtgtccatcgtccgtgacttaatctcgtcttcggccccttccattcttggggtgtacaacttatccttcaatggatggacatcttcaatttcatcagcaatttgattggtgttgtccacaacaatttcttcggccttttctgggcccaggaagttgaagtcactcaacatttcatcagttgtgaggaaatgaaggtctggtaattcttgacggttcaggggattggcgccaccttgggaattaatcaagatttttcgataaatgtaatcttgcggattgagatagtgaacgtccccggttgccacgaccggcttattcagttcatcgccaagtttgaccatattggttaagatttgctcaagattttcatcatcggcaatcaaaccggattcaatcagtggtgcgtaagcacgtttgggctgaacttcaagataatcataaaagccagctttttggcgggcctcatccaatcccttttgcatcatggctgtaaagacctcacccgatgagcaggcagaaccgacaatcaggccatcgcggtacttctccagttgcgtccgggggacccgtggaacccggtagaagtacttgacgtttgacaaggaaacgattttaaacatgtttttgaggccggcctgggttttggccaataaaatggcgtgagacggccgagcatggcggtacgcatcgttatcagtcatgtgatcattaagctgatcgtgatagacaatgccgtatcgatcttcagcatcctttaaaaatagatagtttaagtggccagtggtttcagcatcataaattgctcgatgatggtgttccaaactgacatcaaatttcttagccaaggtattgagtcgataaccacgtaaattaggatacaaaaatctggccaaagtcaaagtatcgatgattggattttgcatctcatgcatgccatgacgaacgtagccggtgttcatgaaccccatatcaaacgtcacgttatggccgacgacaatcgcatcgccacaaaattcccggaaaagtttgaagacttcttcctcagacttggagccgtgaaccatctcatcggtaattgacgtcagattcgtcgttcgttccgacaaatgaaaacccgggtcaataaattcttcaaattgatcaatcacgttactgttctgcattttaacggctgaaagctcgataacacggtcataaatggctgataagccggttgtttcagtatcaaaaacaacgtaagtcgcatcctttaacggaacgtgcttatcattgtaagtaatcggaacgccgtcatccaccaggttaatttcaacaccatagagcatcttgatgtcatttttttggccggcatgaaaggcgtctggaaatccttggacacccgcatgatcggtgattgccagcgctttttggccaaagtgcttggcctgcttggcaaagtcggcaatgttattagtggcatccatttggctcattgtggtgtgcaggtgcagttcaacccgtttcttatcatcatctgcagtatcttgacggctaaccgtcttaatggggttaatatcataggcattcaaagttagttcatgagagtagttatcctcttggacactaccacgaaccttcacccaatcgccttcgttaacgccttcaaagagcgcttcttcacctttattggaaaatttctttacttgaatggatgatgtatagtcagtaatcttcagcatcaaaagctggcggccggaacgcaatgcccggatttctttatcgaaaatgtagccagagacaaccacagagcgttcctcttctacaatttcttccaccttcatgacgggtaaatcatctttgattcgccgaccaatggttgacttgcccccaccgttaccactcttgggatgagcttgagcattctccttgatcgcttggttagccttcttaactaattccgcattggcagcatcgtttttcttcttgagggcttgaatgttttgctgagaagaactttcatcgacgatcgtgtgaattgtaaagtcgggaaaacctgcccgttgaaaggcatcttcaattggccccaaggcagtgttggtcataaagtccttgacgatgtcattttcagcgacaaactccacccgcgaatcgacaatggagggaaacttgtctgcacataattccttcattaacggtgaggtaaccccactatgtggaacgacccattgccagtattgccgaagcagttgttcagtaaaggtatcattttttgcagaaatattcagtgaaacatcagcaatttctttaaacgcagactgtagtctggcattaaaatcgttaaaaacctcaaatggcaggattcgtggaagtgaaatgtcaaattgccaccgctggctttgtttatgaacttccaggcgatcaattttagcatcctcaaaataaggcaattcatttgcctgtgtccattgaagctgttcaagcaacttttcaaataattgatttcgatccaaactcatcacaatacctcttctaaaaataacggtttaacaacaactggctggacacaaaacccaagttttggtccaaccagtttagaagtgacgaaaacatacgtctatattaattagttacgacatcattagtcaagattcttcaacatttttttgattgtgtcactcaattcggtgacgttaacctcaacggtttcgccagtttttcggattttgatttcaacaatcccctcttcagccttttttccgattgttactctcagtggaattcccatcaagtcagaatcggcaaatttaaccccggcccgttctttgcggtcatcgaccagaacctgtaattgatcagctgttaattgggcttcaatttgatgagctaaatccatttgaacggcttttttggcattaatggggatgatgtgaacatcaaatggggcaaccgctttgggccataccaacccattttcatcggcattttgttcagaaattgctgaaagtaggcggctgacaccaattccatacgatcccatgatgaccggcacagcgcgcccattttcatccaagacgttggctttgagactcttcgaatagcgcgtacccagcttgaagatatggccaatttcaatgccacgggtaaatttcagtgttcccttaccatcaggtgttttctcgccttctttgacaaccacaaaatcgtccacgtcatcaattcggaaatcacgatcagaattggcattgacataatgataaccatcttcatcggcaccaacaacggcattcttcatgttggcaacccgttgatcagcgacgattcgaacatcctcaccaacgccaacgggccctaaagaaccaaagtctgcccccaaataggtcttggcttgttcgtcagtggccaaatccagaaagtcagcacccagatagttctttaatttaacgtcattgacatcgtagtcaccgcggacaaggaccatcaccggcttctcatcggcaatgtacagcatcgatttgatggtttgcttatctgagacttttaggaaagcagccacctcggcaatggttttcgcgttgggcgtttcaaccttcttaaggtcttcttcaggttcagttgaaggctggtcgtcgacttttgatttggccatttccaagttggcaaaatagtcactttcatcggaataaacaattgtatcttcgccgacagcagccatagcggagaattctttggaatcagatccccccattgcaccgccatcgccgatgatcactttgtacttcaaaccaattcgatcaaaaatattacgataagcctgctccattgcattgtacgttttatccagatcctcatcgttagtggcaaatgagtaggcatccttcataataaattcacggcttcgcagtaatccataccgcggacgattttcatcccgatacttgttttgaatttgataaagaaccagtggcagctgtttgtatgatttaatggaatcgcgaattaacgccgtaaacgtctcttcgtgagttggtcccaaaataaaatcggtttcatggcgatttttaaatttgaatagttctgggccatatgtatcatagcgccctgactctttccaaagatcagccggcaaaatgtcgggcatcagcatttcatgagctgatgttttttccatttcctggcgaatgatggtttcaattttgtttaaaacgcgataggccaatggcaaatatgcgtacatacctgcagaaatctggcggatatagccaccacgaactaacatttgatgacttaaagcttcggcgcctttgggggtttcttttaacgttgggatcagcatctgtgattgtttcatttataaggttctccttcaaaattaacttgtttaatgtaaaaagtatctctcaatatcattccaagtaaccagaatcatcaacagcatcaagaacgcgaagccgatcaatgtgataacagtttccgttgtttgagaaaccggctttcttctgatagcttccaaaatgtttaaaatcagtttaccaccgtccaaaccaggaattggaatgaggttgataattgccaggttgagtgagagaaatgcgaggaagttcaagactcctgaaagtcccatcttggctgcttgggaagttgtcgcaaaaattgccaccggcccacccaaatcgttgagactaaagtggccgctaaccatgctccacagggcgccaaacagctgcttggcaactgtccaagtggtggtgaaacctgaaagaattttggctttaaaactggtatccattgtttgagtaatgccaatgaaccctgtcttttgaccgccggaagtctgggctttgggtttcatggttaagactttatcctgaccatcccgctgaaccttcacagaaatttgcttatcagcttttgatcggatctgaacagtaagatcctgccaatcagtggtcttgtgtccatcgacctcaacgattcggtcaccggatttgacaccggcagtccgggcgacagaatcggtgggcatgacattgactttattggtattggatgcaacaccaccttgaacaaagcctaaaattgtatataccaagatggcaagtaataagttattaaacacaccagcaacgtttgtcagcattcgattaggcaacgatgccgattgaaattgaacatctcgaggagcaatttgtaattcggtcccgtctttttcgatgatagttgcgtcatgatccaccggatacgacttaacttgggactcatcaccattttcatatcccttgacatacaaattatcgtcaagattagtatctgtgatggttaagggaatgccctggaaaagtgaatgcttattgctggtgttaattgatgttaccacaccactgtcattcaattgaagagtcaccggcgtcccgggctttaattcgtcctcaccgtcatcggcctcaccggccatccgaacataaccacccagcggcaataatcttagggtaaaagttgtactatttttccgataataaaatacttttggccccatcccgacagaaaactcccggacaagaatgcccgagcgtttagcagtaatataatggccaaactcatgaaagatcacaagaataccaaagacgataatgaaaacaataattgtagttatcaagtgacactttcctcctaaaaactaaataacagctaacaaatgaagcattggtaaaacaaaaagtaagctatcaaagcggtccaagattccaccatgtcctggcagaatcttccccgagtctttgacgccataataacgcttcaatgcagattcaatgaggtcgccaaattgaccagctatagagagaataatcgtgaagatgaacatttgcaagagggagtgtccggcaattgggtaaaatgcgataaatgcggtacataaaatggtggctgcaagtgaaccgccgatcgaaccctcccaagttttattggggctaattcttggtgccaacttgtgtttgccaaacattctaccaaaaatgtacgcgccgctgtcagttacccaaacgataaacaaagcatacagcaatactgtcagtccaactccccgggcggcaacgaagtagtgaaatcccataccgatatacagcatgcccaggacaattaccccggcatcgtcaaacgagaacaggtttcgactcagaaccgtttggagaagcagcatcaaaacaaacaaaaagaagacaaagttttgactgatgtgtccgggtaaaaagctcgtccatgcatctggcagaatgagtgaacagactcccaaataagcaataattgattcaggtgaaatcaataatttcttcttcatcactaatatttcagagatggctacaatcccaagtgccaaagcggcaatatccacccagattccacccattacgatgattggaataaagattaataaagctactacggctgttatcacacgttgtctcaatttgtttctcctctatttactagttttaattccgccaaaccgacggtcacgctgctgatattccatgatcatttgttcaaaaaccgttcgatcaaaatcaggccacaaaacatcagtaaaaacaagttcactgtatgcaatctgccacagcaagaaattggatatgcgttcttctccgctggtgcggatcagcagatcgggatcggctaaattgccgagaaatccggtcattaaatttgcatcgatggtttgatccgtgatctgctctggatccagttgaccgctggcgacctgacggccgatttgctgaactgccattctgatatccagacggctgccataattcagggcaaagttcaggatcatccctgtgcagtcagcggtgtctttaatagcgtcattaactgccttttgtgtttgaacgggcaattgatccttgatacccatcacacgaacttgaacattatttttaaccaagtccggcacgaaatcgttgaagaacttaaccggcaagcccattaaataactgacctcgtcgtgtggccgtttccaattttcggtcgaaaacgcgtataacgtcagaaccttaacaccaagatcactagcgactttggtaatcgttttaacggtttccatcccgcgtttatgaccggcaattcttggcaaatggcgtttctgtgcccatcgaccgttaccgtccataataatggcaacgtgtgccggaatgttgtctgttttgagttgcggggttgcttgttgattgtcttgtgtgttgttaaacattttacgctccttaaaaactgaatgttggcttggctgtcagattcaaaaacagcatgggatcctcgcgacatatcgttaaacaccaaatggctggaacaaaaccaaagttttttcccagccataaaatgctattcgtattagtcggattcgccgtctggacgttcaaccattcgccattcaccgcggtttgcctcagccaatgtgttgaaatacttcaacagcttattggcatcttccggactcttttggcccagcaggtttaagcctttgccggttgtatagggttctgaaaggtccgtgatttcatggtcgttttcaatagttgctgtagaaaaggcaattacccagtcgttttcaaccagttgcgaaacgatgaagaataagttaaagccgtcgtttacatatgcaggcattgcatataagccatcttggaccggctgcaagtggccgccgttataatccaagacgcccaaattgtcctcagtaacaggcgtattcagtttaaaaagcatcttgccaaattcatcggttccaggtacaaccgcaatttcatcgttatctgaattattattgttattatgattatctgccatcgtattgacctctttctagccgttcatgacttcttgttctttgtcggcgacaattccgtcgacacctttaattgcatcatcagtcaatttctgaacttgatcttcatagcgatgcagttcgtcgtcagtgatatcttcactcttattgctacgcttgagtgtgtccatggcctctcgacggacatttctgatggcaaccttacttttttcaccggttgccttgacttgcttggcaatttccttgcgccggtcttcagttaatgcgggaaccgccaatcgaattgccgttccatcattagccggactgatgcccaagtctgcttcataaatgcctttttcgatgccttccaaggcacttttatcgtaaggggtaatcaaaatcacccgtgcttctggaatggtaatcgaagcgatttggtttaagggcgttggcgcaccatagtaatccaccatgacgccactcaacaagctggcgttggcatgaccggcacggatactgcccatatcatgttccaacacctcacgggtattcttcattttttctttcgcttcagttaatactgattgtgcatctgccataaattatttctccttcacagttgttccgatattatcaccagtcacgaccttacggatattgccgggcttgttcaaattgaagaccaccaatggaatgtgattatccatcgacagagaactagccgtagagtccatcactttaaggcctttttccaaaatatccatatatgaaagggtatcaaatttaactgcatctttgtgagttcggggatcggatgaataaatgccatccacaccgtttttagccatcaagatggcgtcagcaccaatttcggcagctcgcaacgctgcagtggtatccgttgaaaaatacggattaccggtgccggcagcaaaaatcacgacccggcccttttccagatggcgaacagccttccgacgaatataaggctcggcaatttgccgcatttcaattgaagtttgaaccctggtcggaactcccaaatgttcaaggttgtcttgaagggccagcccgttcatcgttgttccaagcatgccaatatagtctgcttgagcacgttccatgcccatctcggcaccggcttcaccacgccacatattgccgccgccaacaacgattccgatctggacacccaggttaaagatatctttgatttcttgggcgacgtttttgataacaggtggattaataccaaagccgcggtctccggccaatgcttctccacttaattttaaaataattcggttgtattttacttcagacatccaagtgcctcccatagttaatcgttactaccaattttagcatattaacgttgcaatcaacaagaaaacagggatattcaagaattcttatcaaatattctcagccagttcacagagatgtttcagaaaacagggttgagtcattcatgatggtaaataaaaagagttaggaaaagcggaatgctctgtcctaacccctattatttggttacgtcgttatctttggaaaaacgatttgtaaactaaattctgtcagcttacttcaattgatcgcgaacttcatcttcgaagctttgggtcttcttttcgatgccttcaccgacttcgtaacgaacgaatttaacaattgaaccgcccttggaagcaacgtatttggaaaccgtgacgtctgggtctttgacgaagtcttgatcttccaggcaaatttcggccaagaatttgtgtaaacggccttcaaccattttttcaacgatcttttcaggcttgccttcatttaaagcttcttgagtcaaaacttccttctcatgagctaaacggtcagcaggaacttctgcttgattcaaatattccggattagttgcagcaacgtgcatggcaacatccttggcagtttcttcatcagcgccttttaattgaaccaaagcaccaatgagtccaccattgtgcaggtatgaaccaaagacttcgtcatcatttttttcgacaacttcaaaacgacgtaaagtaaccttttcaccagtcacctgagtcgtttcaattaaatcgtctttaacagtccctttgtcggtctgcaatgccatcgctgcatcaacgtctgcaggcttattggtaacgattgcgtcactaacacgtttaactaattctttgaatggatcacttgacgcaacaaagtcggtttcggagttgatttcaacgattgcagcggtattacccttaactgcgatggttgccaaaccattggcggcaacgcgatcactcttcttctcagctttggcaactcctttttcgcgcaaaacttcaattgctttgtcgaaatcgccttcagttgcaaccaaggccttcttagcgtccatcataccgacaccggtcttcttacgtaaatccattacttgagatgctgaaatttttgccatcttagtggcctccctttaattgtgactaaaaactgactccacaccaaggccaaattggtccaaagcggtagagtcagcccgagtgctaatatttatttgttagaatcgttgctgccttctacggcgtctgcaatgtcttcaattgaatcttcttttttgtctgctttggcgccatctttaccttcaaaggtcttttcgttaacgtcatcttcgccttggcgaccttcaatgattgcgtcagccatctttgaagtgatcaaacgaacggcacgaatagcatcatcgtttgatgggataacaacgtcgatttgatctgggtcagtgttggtatcaaccattgcaacgatcggaatgttcaatttcattgcttcgtgaacagcaatttgctctttacgaggatcaacgataaacataacgtctgggatcttaggcatgtcttcaataccgcccaagaatcgttccaatttctgttcctgcttgattaaaagagaaacttccttcttaggaagaatgtcaaaagtaccgtcagttgacatcttcttcaagtccttcaaacgcttaacacgtgattgaatggtttcccaattggttaaagtaccaccaagccaacgattgttgacgtagtattgaccggcacgggttgcttcttcagcaattgaatcctgagcctgcttcttagtaccaacaaacaagacaacggcgcccttggcagcttcgtccttcatgaagttgtaagcaacatcgattaacttaacagtcttctgtaagtcaatgatgtaaataccattacgttcagtaaagatatagtccttcatctttggattccaacgacgagtttggtgaccgaaatgtactccggcttccagtaattgtttcatagaaataacagccatgatgtagcctccatattgtttttttcctccccaacgatcatttgaattaagaaccatccctggcaactctcaacccattacgtcaggtgtgtatttaaaacacctttaaaagtatataagaaaagccgcggaagcgcaagcacaaatacccggaacagattatttttttgtcaaaattgttaaatttcgatgaatcatgttagaatgatatttcgtggcgaggaggaatttatacatgattaaagccatcgttttcgatatcgacgatactttgtatgatacaaagcccgcatttgtacaggctttcgaagaaacattcaatctaaatttaccagaagaacagatgaatcagatctttgccaactataacgagcaagaacagttggcaattgcagaatccaactcagactccgatttgaaattatctgacgaagaaatcaactatcattcattacaccatacatttaaaaagtatgatctgcccggactgacacaagagtccgcaaaagccttttcggaggcctttgaaacggccagcagctccattcatctatttgatggattgaccactgtctttaataccctgactaccaaattcaagttaggcatcatcaccaacggaagcaacgatgttcaactcgccaaaatcatgaagctcaaacttcatcattggtttagccgcgaacaaatcattacctcagaagatgcgaaggctaaaaaaccggacccgcttatttttaccttgatgaaccgaaaattcaatttacggggcaatgagatgatgtacatcggcagctcctattttgaagacatcgtgcccgcaaaaaaggccggctgggaaaccgtgtggtataacagccatcaaagtccaatcgcagatcctcaaatcattcccgaccagacagtcaaaacaccggaagaattaaaagacttactcatggatttggctgctcaaatggactagcctatttaaaataaaaaggtttcaatcagagattgtctgactgaaaccttttttgtatatcaagccggtcaaattaaagttcaaccaacttgtctgatttaccagtattaattaatgatttgtttgcgtccatggcgaagtagaccatgttacgagcggcccgttttgtgtagaaggcaatatgtggacttaccaaaacattttcacgtttcatcaagttcttgagtcgttcgtcagggatcttgtcaaagctgccaaagtcagtattgaaaataccaacttcgttttcataagtatcaagggcagcaccgccaattttacctgaatcaaggccgcgaattaaagcatcagtgtcaacaagggcaccacgagctgggttaaggatgaagacaccgtctttcatttgagcgattgtcttatcgttaatcatatgttcgttttccttagttgcaggcgcatgcaatgaaaggacatctgattgagcataaagttcttcaggagtatcaacataaaccccttctttttcaagctctggattatgataaatatcataagcaattactttggcaccaaagcccttgtaaatgcgcattgcagctcggccaatccgaccagttgcaaagacaccaacagtcatttggttcaattcgtcagcaatatctggtgcccaacgaaggtcaccatttgcttgtttacggtcgaatgtgttggtccgacgaagtaatctcattaactgagttacagtaaattcggcaattgcttctggagaatatgcaggaacattggtaacttgaataccgttacgcttggcagcgtcggcatcaatattatcaacacctacgttacgaagtgaaaggtacttgataccaaagctgcccagcttatctaatacagatgcagtgtaaggcttttgttggtatgtaaccacaccatcagcaccttttgcttggtcaacagttgagtcgtcaagtaattcaccggttgaagcaacttcaacgtcgggattttcttcactccacttgtctaaataaggtttctcatcgtcacgaatgccatatgcaataattttcacgaatattacctcctaacagaatacttaaagtataacactttttgataataattttcactacttttcgtagtttgttcaataattcactctaattttatccccgcttgagctaaatgggcaattttttgagcccgactcaattgtttaaaggcgtattcagcgctcaaagcagcgtgtttgctgtcaaattgttgcttgaacaaaattttgattggtcggtgagagcgggtgtacttggcacccaagcctttcacatgctgttgaaatcttctttcaacattcgtggaaaaaccggtgtacaaagtatcatcggcacataaaagcacgtacatataatacttatctgtttgttccataaagcatcttctttacttcatcagtatagtcatcgccgtcataagtaataatatcgcggttgactttgagaccgtttgacttgccgtctttaatcgcctcaaccaagaccatgttggcgtcctctttgattcggggtctgacaaattgaagccgttttggctccagtcggtgacttcgtaacgccacgatcaaatccgtcagccgatcgggccggtacaccatgaaaagtttggcgttcattttcaacagtccggccgctgagctgacaatttcatttaaattagtggtgatttcatgccgcgcgatggccaagtatcgattcggattcttttcgctggtcttgtagttgacgaaatacggcggattgcaggcaacaacgtcaacagaatcttttggaatatattggtcggcatttttgaggtcgtcgttgaccactgatatctgctgagccaagtcattgagttcaacactccgctgtgccatatctgccagccttgtctgaatctcgatcatggtgatgtgagcagccgttttttcacttaaaaacagtccgactgccccattgccagcgcacatgtcgacaatttgtttggttctgtgttgcgtggtccgaacaaagtcggccagcaaaaccgcgtccaatgaaaacgaaaaaacgtctttgctttgaataatttggatgcctttgctgtataattggtcaattcgttcgtcttcatgtaagtttacttgcatatcgttatgttccttcacaaattagtttgccaaacgcttctattttaagttaatataattctatcagatatgaaagaaggaaatgaattgttttattcattcatgagagtccttgtccgaatcctggtgtttattatcaatggcaatgcccgttatgagcacaaggagcgactgccaaaaggcaactatattttggttggcccccatcgcacctggtttgatccaatttactttgcacttgccggcagtccgaaaaagtttagtttcatggcgaaaaaagaactattcaaaaatccaattttgcgttggattttggttcatgccaatgctttttcggttgaccgtgataaccccggtccttctgccatcaagaaaccagtccgaattctcagaaaatcagatttgtctttgatcttattcccatcaggcacccggcattccagccaattaaaaagcggtgctgcctttattgcccagctgtcaggtgttccgctggtcccggccgtttatcaaggaccactgacattcaaacagctttttactcgaaaacgggtcacgattgcctttggagaacccattacaattgaccgtaaacaaaaattgacggacgattttcaaaaacaaattgaaacggagatgcaaagcgcgttcgacgccttggattatgctgttaatccgaattttaaatacgttgatgtatcaaaaaaagaagagtaagtgaaatgacaaaaagccctcaccaagttggtggggactttttgtcattgaaacattctaatttttaccagtttggttttgcatcgaatgcatcatttgatttaatttcttttgggaaggtttttgacccatttgtatcatcagttggcgcaattgatcttcgctgaatggtgggttttctttgaggtacttttccatatacttccgtgcaccgtaaaagccaccaaccaagcccaagatcaaggctaacacaacgattaatatccaaatccaagttgccaagacaaggcctcctttatcatatcactaagtaattctacacaattatgccatagaattaaagggctaatcaacaaaatcccgattcttaggggaaaactgccccctaatcgtcccgaagacctttgtgacgttggacttccctgacttttccgggcgtcacttccttgccattcttatcataaactttcatcatttcaatctgttttttgaagttttcacggaagtgagcaacgtattttttacgcaaatcagcctgttccaacttttcaacttcagataagccctcattttttgctttgtgggccagttcattaattcttgggatgagttctttgaaaacatcgtcaccgatttttgattgcaattcttttttctcttgttcgttcattaaaattcctccatatcgactataataacacaattattgatagatacgcgaacgtgtgttttgaaatgtgaccgcggttatgatatgatttaggtattaaacaaagacttatgaggtgtctaaaatgtcaaaaacgaccaatgatccccaaagtaaacaataccagatccttcacttcatctgggaacgggttaatgagcagggctatccgccaacggtcagagaaattggtgaagccgttcatctatcatcaacctccacggtacatggccatattgctcgacttgagcggaaaggctatatcgttaaagacccggccaaaccccgcgcgctggaagtcaccagtagtggcttggatgtcctgggtatgcagccacaacaaaaacagattccggttttaggaactgtgactgccggtgaaccgatcttagctgttcaggaggccaccgactacttcccgctcccgcctgctctggcacacagtgatcaaccattatttatgctgcaaattcggggcgaaagtatgattaacgccggcattctcgatggggactatgtggttgtccgcaaacaggaaagcgccgataacggtgacattgtcattgcgatgaccgatgaaaatgaagcaacctgcaaacggttcttcaaagaaagcgatcactaccgactgcagccagaaaacgataccatggcgcccattattttgaccaaggtcagcattttgggaaaagtggtcagtttgtaccgcagcgatatttcataattatttctagctaaggactgttctgctaacagtccttttcttttaccctgagttctggtccaggacttttcggcaatgcccaacgagcccttctaccatcaatattatgcctgttgatctcgataaaccagctggtcggcctgtctgccaagcaacacgaatcgactgtcatcatcagcagcatcaaatgtaacatctccaccggcgtttgacaatccatttgcatacatcgcttcatactcaggaacagacagcctcgttcggttggcaatcacttgttcaacctggccggcaaggctctgcggttggatttcaggggcaattgtaccactgtaaaattccccttgagctcccgatccataactaaacaaaccaattcgatcacctggctgaagcgttttggagttggccagtagtgataacaagcttaggtagagtgacccggtatagagattaccgacgagggcattatactttttggaatgatcaaattctttgaggagtttttgtgagtgagcaccatcatcgataaccgtccgaagcgcctttaggcccatcttggtgaatggcagatgaaaagccaccgcggaaaaatcactcagcgtccgttgatatttcgcagagtaatctttaaatgtttggttgaagaaatcgatataaatatccgttgagtaatgcccgtcgacaattgcatcccgacggtaaaacggtcgccaaaaatccataatattttctgagtgaaatgcactttgattgtccaaagctaaaatttgtggatcctgactcatcagcatggcaactgccccgccgccttgggtgacctcaccagctgttccaatcccatatcgggcaatgtctgctgccaagaccaacactttactttcaggatgcattgcaatatgatcgaaagccatctgaacgccggccgtaccaccataacaggcttgcttaatttcaaacgatctggcggagttggatattccaagcaacgactgaacatagatggccgctgacttggagttgtcaacaccggtttcagttccaaagatcaccatatcaattgcttgtttatcgtcatcgcttaaaatcttggcggcagcattggcagccattgtgaccacgtcttgtgttggcgggattaccgcctggtccttctgtccaatcccaatcaaatatttattaggatcttcaccgcgggcatttgccaaatctgccatatccaaatagtaatcagaagtaaagaagcccattttgtcgattccaattgtcataataatctcctttaagaaagaatgagaccgaatattttaggtgcaatatccagtctcattatgtatgccgctgattgttaatgattatttattcgtaaaatgaatttggtaggtgtcattgccgttcatcgactgaatcactaagccttccagtaatggacccgcatagacgaagccttcatgctgatggccggttgagataaaggtccattgaacaacttgattaccactcaaggctgagccgaaaactctggcaccagtcaacgtcccaaccgaattatcagaaagaacaacttgttggtttcctagatttccattgacattaatagttaacattaaaattctcctagttatttcctttatacaacataataatatagcataattgcaatgcaaatgcgaattggttatagtaagcttatacttaaattaaaatatggagatgatgattatgaaaattaatatccatcgttccgcaacgaacaaggtgcttgccggcgtcattggtggcttggctgagcactttcaatggaatcccactttggcacgggtcgtatttgtcattctggcatttaccccattcttcccgggaatcatcgcatacctactgctttggattttgatgaaagcaccagaataattagtgctgcttcagtgatctgcggccaagccagtagatgactgccaacccaccaaaaaataggacaaagaacagtagaaagcattccaagaagaacgtatctggcagcatgttaatcaccggatcggtgttcgggtcaaaaatccagtcctggtttctgaataatacttcatgaaatgccacaaatacctggtcaaaattaacaaacatcaacgcgacaatcactaacgaaactgtggtgacgaccttaattggcgtcatcaacagccaagttagtgattttttgttgagccgatgcagtaggtaggcaccagtcggcactaaaatcagcccaacaaaattgttgaacaggatcaaacctttaacgtcccgaaagtgctgaagtccctttgcagaactgaagaagtaatccagctttaaagaaggaatccacggcacctgtaagtaggcaataatcctgacataatcatgatgcatctggctagcagtgcgaccagtggccgcagctaatttgagcggattaatattgaggtcaaacagccaaacactattgacagtcaaaaagatggcgagggcaaggcaccccaatatgattaaagtgccataaccaatttgttttccaagcattttcacatttataaccgccaatcatcaagtgagtcaatctggtgagtcggctgaaccgattctttggcaacctgttgctttgtcgaaagcccggtgtaaaccaggagcgtatcgactccggcattaatcccagccttaatatcagtgttgtaattatccccgaccatcacgacgtcagactgttcaaggccaatttttttaatggcactttcaataattctggctttgggcttgccaatcatgatcggttcgacttgggtggcatactcgacaaacttcacaacagaaccggctccaggcatcattccgcgctctttgggaatgtttgtatcggggttggtaccaatgaacgtcgaaccgcttcgaatagctaagacggcctctgaaagcttttcataggttaggtctgaatcaagccccacgaccacgtaatcaggatgatcggcttccaaacgataatcgttggctaagataacttgtttcaagcccatttcaccaacgatgtaaacggatgaagcatccccactacgatgctcattcatgtaatcaaccgtcgccatccctgatgtatagacattttccggtttgacgtgaatatcatggttatcagccaggttcttcaccacgtctctggggagctgagtggaattattcgtcacaaataaaaatggaatattggccttctgcaggcgctcaataaatcgtttggcagccggaatgcgttttttaccggcatacacagtcccatcaagatcaataaaatagcccttatagtttgtcatcaagtcaatccttctaattaatttttactctcacgaataataaagtggtgcttttttgatttttcttcagtcttcacgaccatattatggcgcttttcaattggcttatgggcggtaaccttcttttcttcaaaggcgtggttccgatgattgcgatgattactccggttgcgggaattatgagaccggtttgatcgatggttaccatgattattccgggattttctgatcaccggtcgggcctcaagattatgaacgacaaaataagcggcaccgaagttgacatcttccaaaatccagtcattgagtgcggaaataaacgggccggaagtttcagttcggtcatcattaaaaaatcctcgtaaacgtaatttgccgtatccccagtcgccaacaatgtaatcatactgactaaaagccggattgtaccgacgaacaaattcgttaaaatcaaagccatccgtgtgattggtatccaattcatacttatgatcattgattaagaattctgtttcactgactcggttgattcgtgccaatggctttcgattctcgtcttgttttgcaacgagttcatctaaggtttttctgtccaaagtaaccctcctttcactgattaagtggataatgtttggcgagataatccccaaacacatcccttaaattttcatcgtataaaatttcgttgtggccgataatctccaatgtcgggaagaacggaataaacaaatagtggtccggcatggcaatctggtatgttttcgccggtgaaaccaactcttcatggaaaaagagctggccggcatcttgatcataccgcaatccgccataatgtagctgaccaaaatacttgccacgaaaacccatccctttttgtgggaatttggtcaaaaagttcttgttcttttccatttctttgatgaggcgccagagattataaccgtccaaagtgacccgcatgacatgcatcgcgtggggcaacatctgatgcaattgatttcgatcaacaatcccttgaggcaggtcggttaaaaataggcccgaacttaaaatggcagcgcgagtatcggctttttccattatcgcatgcaaaccttcgtttaccaagcgcgaatggccaatgagattagttgtcattggggctttgattctggcaagtttgttgcgtgccagcagtttttcaccatgttgttgatattcctgaatttctgcatcatcttcaggcttgctgggcaaatcagcggttttaatcactttggcttgactggacacaatccgatgggaatcatcgatggtcagtgtaatctcaccaatataatgaccccatttttcggcagctgccagtagtgaatgattcactttttcaccgtgaacgagtaagtgatgcgtatgcgagccgatgatcacgtccaattgaggaaactgacgtgccaatagacggtcggttggcagccccaaatgtgatagtaacacacagatatcatatttgccggcgttatcggcgagaattttaggcagaaccgtttccggtttgagaggctcccaccccaagatcggatatgtcagtaaataaggcgctgtcagcccaatcagaagcacgcgtgtatgttgcggggtggtaataattttgctgggatgagcccattttggaattgatttggtctgctgatccaaaaggtttcccaaaatgacgtcgaaattggcatcattgtacaactcgtccaattgttcatgactattggtcaagccctcgttattgccaattgtgacggcatcataatgaatttggttgagcaactccacattggccttgccgttggttacttcagtgagtgggtggacgcgatcaaccgcatcccccaagtcgacagtgataacggaagaatcggctcgctgaagttctgctcggcgcgtggtgataaattgacgaatgcgtggccaattttcgaaatgggagtgcagatcgtttgtgtgtaaaattgttagcttctcagtcatcaaaccatccaatcttttctaaattagtgccgcttggcaaagtcttcagcttttccggcgaccatttcttcaatttcagcttgggaaaatggcgttccaaacggtggcttctttttcaaataatcagtctcgggcgtatccacaccgacattgatattttctttaatcggaactgcataatgatgaatgtgtccatgtaaattaataatttgtttaacgatgcccatcatcatcggatagtgagtcatataatactgacgatgattcatcttgatgagaacaccaacatcgtgaaattcaaacttttgatgattgcccacgggatgattatgctgctgcagatatttgaataaagcacgggaatcgtgatttcccttgatcaaaaccaagcggccattcaattgatccagcacttcaaaaattttttccagtgccactttctcaggtcgggtatgcaaaatcgcaatgtcaccaagatgataaaccacatcgtttttgcccacccgacgattccaattgttaatgatggtttcattcatatcctcgacagtcagaaatggtcgtggtgcgaactcgctaacgccaagtaaacgttcatgaaagaaatgcgtatcagcagtaaaaaattgcatgaacaggtcctctttcgtacataagttataccattaatgataccacccagcagccgtttagtaatgaaaaagtattcaaacaaagctgataacaccaatgaaaaaagccaaggcgccgatgccttggccaatcatcatttttcaacttctttaaccttatctgtcagacttttgaaaataaacagtccaattagccaaaccaccgagccgattaaagcaatcaacgtatccgtcttcatggtcaaaacaactgccacaaaagccatgaaaatcagtacgaagtaatcgctgattggaaaaagcggcatcttaaatttgagcgatttctgactgccggtttttttaacctgctttcgatacttgatatgagccaacacaatcattccccagacaaataggaaacaagttgtggcaacactggaaatgaaagagaacacatcaccgggcatcataatactcaagagcacgataaccgcgatcaccaaggtcgaaaaaagaattgcgttaaacggaatttgacgggcagaaagacgaccgacttttcgactgaattttgatttaccattataagtcaatgaaaacagcattcgaccagtggtaaataacgaactgttacaagccgaaattgccgcagttaagacgacaaagttaataatcaaagctgcggactggatgcctacaccggcaaaaacctggacaaaaggactggaagttggcgaaacgtgctgccatgggaaaatgctcatgagtgccaacagcgacccaatataaaacaagagaacccgggttggcacttcgttgatactctttggaattgtcaccaaaggatcctgagtttcagaagccgtcatcccaatcatttcgattccggcgaaactaaagagcaccatttgaaaggacaaaacaaatcctttcgcaccgttggcaaagaaaccgccatccaccacattcatcaatgatgcgtgtccgtatggtgttttaaaatggattgccaccaggacgattccaatgacaatcagtgcaacaattgcgacgatttttacaattgccagccaaaactcggtttcaccgaatgccgacacagcgacgatattgatgataaataggatcaataagaggaccagacctgtcaaccaaattggaatgtccggaaaccaaaactggacgtataatccagaggctgtcacttcggccatcgcaatggcgatccaacacatccaataggtccagccgatcacgaagcccattttttcgcctaaatattttttgatgaagaaaacaaacgaattgctttcaacatcagataccaacagttcccccagggcccgcattaataggaaacaagccaggccggcaatcccataggccaggatgattgatggtcctgctaaatggatggactgaccggcaccaagaaacagcccggttccaatcgttccaccaagggcaatcaattgaacatgtcgattcttgaggccccgggatagttggttgtcgtcttcttgattttccacaatgtgcctccgtttctaaaaaatgacaatttggtttattaaacaataaggctgggacaaaagtgcaaaacccttttgtctcagcctcgtttgtaacccgcgacgtccgaattcaaatggggctcaacggattctatgcttgaaaaagcaacgatcttcgcccgtaatgattgggtattaatgacgaccgtccaaaaattacttctgtgttttgcgtaatctttcgatatcgcgaacaatcattaactcttcatcggttgggatcaacaatgtcttaactgttgaaccagcggctgacaggtcacgttcttcgccacgaatgttatttttttcaggatcaactttgataccgaagtagcccaacttatcggtaacttcctggcgaatcataatgtcgttttcaccaattccggcagtgaagaccaaggcatcaatcccacccatttcagcaatgtaactgccaatgtagcggatgatacgattcttaaagatttcgcgagcgagcattgcccggtgattagtcttcataaccccttcaatttcacgcatatctgcggaaacacctgataaaccgacgaggcctgatttgtggttcaaaatatcaaccatatcatccatgtttttaataccggctttttgcatcacatattgtaatgcagaaggatcaacgtcccccgaacgagttgccatcgtaatgccggcaacaggtgagaagcccattgaggtatcaaatgacttgccgtctttgattgcgtcgattgaagctccggcacctaagtgaaggacgattaatttcaggtctttcagaggcttacctaaaagggcagctgctctggcagagacataacgatagctggttccgtgggcaccatacttacgaacttgatacttttgataatactcgtaaggcaagctatacatgtagttgacttctgggagtgttgtatggaatgaagtatcaaagacggcaacactaatgatatctgggagaatcttcttaaaggctttgatgccaagcaacgcagccggctcatgaagtggtgcaaactctgttaatgactcgatctttttgatgacctcgtcgtcaatcacaactgaatccgggaagagttccccaccagcaacaattcgatggccaacaccggtaatttcactatagtctttgatgatgtccaaactcaacagtttatcaaggacgagttgaatagcctgttcatgattatcaatatcttgggtatctttgaacttcttgccgtcaccgtacttgattgagatatctgatgcgcccaatccaattcggtcaatagcaccgcttgaaagaacggtttcctcaggcatttggaacaacttgtactttaaggttgaactaccagcgttaattgcaattgattttcccataataaataatgctcctctgtattttttaaaaagcttgataaacaattttataataaatcagtttgttcccaatcatcaatctcggtcaagaacttggtaaaggcttgttggtccttaaatgatggaaattcccccaacattaccggatccacctgtttggcaccgtcgccggcattttgaagaattaaaattgccttttgagccgcggcgtttgcaaagagttcttttggtaaattaagtaatccctgcaggtaaaccttcccttgcatccatttaagaagctgcttggcttcgctggtttggaaaagctgacttggcaccaggaagaaaccaaacccacccggcaaaacatgcttcatgccaaattcaatcagcaaatggtgcacgtatgaatgacccgtgtctgaatgggtagcaaatcccttggcattagcatcgattggatagtagccaatcggcaaatcactaacaactacatcgaccacgggagctaaaacattttggatcgtatcctcgtggaaaagctcagcgtgaatcttttgcagctcgactgagtctgcagccaattcaaacattgcatcgtcattttcaattccagaaatggtcggtgtaacgccaatactagtttgaagctgatgataaattgctgttagtagattggcagttcccatcgccggatcaagaatacttaattctttgcggtcatggaaaattccagcaataatatagccaatgacgttggcaatggtatcaggcgtcagttggtagttagcctgaatcgtgtcaactcgaatcgccttgagcacagccatttgaattgctttccggaaagtttcggcagtgaaatcgtccggattaaagtctgcataaatattagtcagctttttggtatcggcttcagtcagttcgtcatcttcttcatcgtcactctggataaatcccagtgtttcgatgaaagaatcaagatacgattgatccttggctttttgaatcaattctgtcgaacgattcaagatatcaaaaagctgctcaattttcccttgagccagaactctcaacccctttattcaatagttgaacactattaaatactaccagataagctgtcaataattcaagttagattgttatttcacaaccacaaaaaggccactattcgtgaccacttgtgcgttttgggtgaacatcttttttgagtggcttttcaaggaattgccgtctcatttgccgttcatgctcggtgatacgattaattgatcccaactcctgcttataagcagccagttgaaacatcaagcatgacatcaaaataccgacaaaaatcacagccaccaccgttagggatccacgcttatatttatcaatccttgaacggtaattttgaataagctgaacacttttggccattatcgaaagtaacatcagttcttagacaccccctgctctttgtccagcgtacccattgaacatttgtcaacgacggtacgtgacccttgtaggcaccggccaatcgaaccatgttttcataccgttcaattcgataagtttttttcgtgaccggactgtacatcacgcacttagagggttgacactgcttgatttcaaaccgataacggtcagattcgattatactgagataagaatgaaaattgatcacgttttgctttttttcgtttcccgcatatacgatcatcgtcatgatcgtccaaatggcgaatacaccaatcaccaaggtgatcaggccctcaattaataagtagcccggccgagtatcaaccttactcacggacaatttctgcttcatatttttgcctctcaattgtcatcactttttctgcgttggtaattgtctcattcatttgatgggtggtttggatgtagaacaaactgaaggtgcagatgatggtcagcccgattaatgaatcgatcaccgtaaaagcccgcttatttgttcctttccacatgatagccactccatcccatttgaattttttgattgtatttgacgttaccatccgaatcaagccaaataatcttagttggtgatgcaaacccatcgtcatgggcaatcatgcttcgttgtgatctcacgtgaatggaaggcggaaccgaaattcgctcctcatttacctcgtcatagtgagttttcttcaccttcatcggaaagaaaataacatctttatcccgaatggagattcgataagaaatgttctcggcctttgcgtttaatgtcatgcgggtccaggcactctgaaatgaccgccaaaacaacgcctcacttggatttccagactggacgaccttgatcagcatcaaattaatcatcaagacacctaacaccacgcctaaatataccaccagctcaataacggtaaagccctccctatttttgcacttcattatgagtaatcttcaggccttcatccttggcttgtttaacctgcttggcggtgagatagccaccttttgtcaggtctggaaaactaactgatttggcggttgggtgctggctgaaataggcgtcaatttgtgcctgaacaacttcggtcattgccgatgaatgaacagactgggcgtgttttctttgattggatagatttggaataatgattaaaattaataatgaaataataaacaagacgatggtcatttcaattaacgtaaagccttctctcattttcttaacgcgctttttcatttcaatacattcctttcactgagttataaattggaattagcagttgaaaatatgtcgaaacaatcgtcacaccgatcaccacaaacatagccggctgaataaacccgatcagtttatcggtggtcaggatcatttcgtcaaacatcaaccgtgaataggccgtcatcgaattggccatttccggaatcgtgttgccggagctcataaatttgataatctcattgggaataaaattgtgccggtctaccaattttcttaaggaccctcccgaaagtaaagtggcatgaagcctttcacctaagagatgaatcagtgatccctccttgaactcggataacgtggcataaatttctttaacactcaaaccgtttttcagaagagtggccaaattgctggccagataataagcgatatattttcgaaacaatttgccgacgacgggaattttgacaatcatttgggcctgggttatggcatcctgtcgactccagtgaactgtgctgccaatgatgccgatcaaaattgggattggcgaaagtcgaatcagctgctgccagtacgtaaccggttgctgatgattggctgtgggcattaaatcctgaatctgtggcaaaacgtagactcgaatcatcaagatcaacgttcctaagatcaggcacaaaaataatgggtacaccaacatcgctttgatctttttgagttgtttgagccgcaatcgatcaaagttggccagttcgtttaaaatgtcactgagttgaccgtgcttctccgcgattaacagctggtgataagcttgagtttcaatcaggggtcgaacactttccgaaaattcccggccggactttaacgatccaatcaccacattaacgcctcgggacaattgtttgtcagtgtcggcgataaatttcaacgcttgagtcagtgagaatccaattgacaaaagattcgccaaagagtcaaaaaaattagcttggaaaaccaccggccatttcttaaccgaactcgaatcgttgtgcagtctccggcgtaaccagttttgctttaacagctgttttgagtccatcctgccattcaccccaatcgtatgtattcatattgaccaactctgaataatcatgtcccatcaacattgcccgctgtttgccgtcggtggttggaatcagccgctgataagcgacgccggttaatgcttgggcaataaattcgtcgctgattccgagctgtttgagccgatcaatgactccaaccggatcctgagcgtgaacggtggtgtagaccaaatggccactcagagccgctttaattgctgcttcggctgtcattgcatcacggatttcgccgacgataaagacgtcaggccgatgacgcaggcccaccttaatcaagtcggtgtagtccatccctgcatcgtggttaacctgaagttgtaaaaaacgtggttccctaatttcaatcgggtcttcgatcgtcatcacaaattggtcggaaaccatctggttcaccaaattataaatggtggttgttttcccagagccggttggcccggaaaagacaatgagtccgcgttttcgactcatttcggaaattagttgaacttgtttttcatcaaaaaatgccgcgtgcacatcatcaagctgatagataatccggatgaccagtgactccaaccccgtgaaattgccgaccgaggataatcgtaaaaaatattggttatcaccaaaatgccaatccatcgacccaatttgtggccgccgttgttcacttaatgccatatctgcgatgtacttgcaatagttcatcatccgtctcgcctgtagatagccgattttatcccaaacaacgacttcgtttgcattacgaattttgaccaagtattcgtctccttcaggcaaaaaataaagatcactggcttgtgttttaatggcttcattcaaaagaccattaacttgctgactaatttccatttcattcacctcacatgtaatacatacgaatgaaaagttgaattttatttatcaaagcacaaaaaaatggccgatcaaatgatcggccattgagacattgaaatcatattaaattattcttctggtaaagtagcggcttcgtaaacgtcttggacgtcgtcgttttctgcgagttcgtcaattaaaccagtgtattgagaaatcttgtcctctggaacttctgtcgtgttttcagggaaaagacgaacttcggcagtatccaagtcgtagcctttttcctgcaaagcgtcgcggacgtcgtccattgatttgggatcagtgaagatttcgaattcatcatcactggtcttcatatcatcggcaccggcatcaagcgcgtccatcaacattgtgtcttcgtcggtgtcaagaccatcacgcagaatcacaatataaccctttcgatcaaacatgtatgaaactgatccacttgttccaagggttccgccatgatgagtgaatgcagaacgaattgcggcagcagttcggttcttgttatcagtcaaagcagaaaccatgatggctgtaccaccgggaccataaccctcgtaagtaatttcttcgaacttagctccaccaataccggaagccttatcgatcgcacgttgaacgttatcctttggcatattggcagcccgtgctttttccatcactagacgcaactgaggattgttttctggatcaggatcaccttttttagcggcttgatacaagtcacgtgatattttttggaaaatttttccacgtttagcatcctgagcgtttttacgcccctgaatgttatgccattttgaatgtcctgacataataactcctcttttctaaaatttattagctggttacaaacatacgtcaatattctaccagatacgcccccctctttcaagaaagcgcggccaaatatgtggcggcttttcaaaccagtttccagaacaaaaagagcgaatcgccacggtccactcctttgatttgatacctgattatttggtagattcacgcttcatcaaaccgtatgggagcaacacatttttttcgtcaaccggttcgttgtgcatcaatttagtcaacagacgcatggcaacggcaccaatgtcgtacaatggctgggtaattgaagacatttttggtcgaaccatttcggttaacttggtatcgttactggtgataatttcaaagtcatcaggaactttaacatcggcatctgacataccgttcataatcccggcagccaactcgtcgtcggtaaccatcgcagcggtggcgttaactgccattaatgctggttgaagcaaggttccggtcttgtatgtatcatcagtttcaaagaccagcttctcgtcgtaagggattccagcgctctttagggcctgtttgtagcctttcagacggaatttgccgttaatcgcctgctccaaggggccacaaacgaaagcaacccgccgattaccacgatcaatcaggttcttaacctcttcttggacagcggcaacgtagtcgatgttgactctcgcgtagagatcttcttcatctactgatccggcaaacacgattggcgtcttggttcgcttgaattcttcacggagcttatcgttaatttcgttacccatgaaaataatgccgtcaacttgtttggagagcaaggtatttaacaccttaacttctttttcattgttggaatctgaattggtcaggataatattgtatttatacatggtcgcaacatcatcaatcccacgggccaatgaggcaaagtacatattagtcacatctgggacaatgacgccgacagtcgtggttttcttacttgctaaacctctggcaacggcgttgggcctgtaatccaatttttcgattacgtcgagcacttttttccgggttgccggctttacattggcatttccattgactactcgagaaacggttgccatcgacacgcttgcttctctggcaacgtcataaattgtaattgtttgtttatccataaagatagccctttctttctcgttagaatatgttttcatcgattttcaaaacatcatctaatataccaaataaaaaggttttcagcaaattgaaaacgttttcagtcaaatcataaactaagattgctgaaaattcaagtgaaaacggaactttacggcgataattgaaaagaattttgtatgatatactgtggataaaataacgaaggagtgatcctatgaacaagatagaacaaattcaacggtggctggctgataacggccaagacatcgcactgattaccgaccctaaaacaatccaatacctcaccggattttatagtgatccggttgaaagagtcttactgatggccatttttaaagatcaggaaccatttatctttggcccggcactggaatcagaagccattaaagacaccggcttttcatccccagtctatggctacctcgaccacgaagacccttgggtgatgattgccgatcaaattcatgccagaaatactgacgacagtcattttgcaattgaaaaatcccagctccaggtagaacgattggaagctctccaacaagttcttcccaacgcggatttctcagcgaacctgaccccactgatcgaacaaatgcggttaattaaatcggctgacgaaattgaaaaattgaagattgccggcaagtgggacgattttgcattacaaaccgggtttgaagccgtccaggttggtaaaacagaagaccaaattgccgctgatctccaatatgcactgatgaaaaacgggatcatggaactcagtttcccttcccttgtccaagccggcccccacgccgcagaaccccatggggcaaccagtgaaaataaagtccaaaataaccagctggtcttatttgatctcggaactgtctgggacggctacattagtgatgcttcgagaactatcgcagtcggtaaacccgatgaaaagtcaatggacatctaccaagtttgtctggaagcacagctggctgcccaagaagccgctaaaccgggaataaccgctgaagaactggataagattgctcgcgatgtcatcaccaaagccggctacggggaatacttcattcatcggttgggtcatgggatgggcatgagtgagcacgaattcccatctatcatggctggcaacaagatggaacttcaaccggggatgtgcttctcaattgagcctggcatttacattccaaacgttgctggtgtcagaattgaagattgtgttcacattactgaagatggctgcgaaccatttacgcaaaccaccaaggaattacgctacattgaacaataattaacagcatcaaaaaaacaacctcatttgtgccttatctcaacagctgaagtttgactttgactgtttggataaattgcacattgaggttgttttttatttgtgatcgttgttatcggagtcgtcagtgattggaatctcattatcgccgtcatcctggtcggattgtgaatccaaatcatcagcagccttgggaattccggtatcttggaaggcatctttagcatcaacaacaatatcatcctgattgtcgtcagcatcgtcatcatcagctgcttggtcggtaccaaacgattttgctttgtcagcgaattgcgttttggcatcattgacagtccctttggtattttgcatttcatcatgaatcacatcttttaagtcgctaacggcatcgttggcgtaaaacgcgtagtcaactgcccgatcccgcaactcatcagccttttgacgggcgtctcgtttgagttgggccttctttgcttcgtccaatttttggtaggctgcatatagaccggcacccaatgcaccagcgaataagccaaatgctaattttttacccattctaatcatcccttcgattgtttatttagttgtatcctttgaaccgtgtcgattgcggtacatgttccaggcactcttgccaaacttaccggcgagccctgctgaaacaccctttttaccggtatctttgacccgtttagtgaggttttgagtagcggtatttaaacttgacacactctcacccaaatcagcggcggcttgaaagaccggtgtgacaatgttcaatttgtcatcaacatccttcagtaaatcgttggatgttgccataatattatcagtttgtttggcaatgacgtccacattactagtcattgtcttaattgtgcggttcacttctgaaatagttctgcttaccttcattaagaataagccaatgaagattaccaaaagcaaaaatgcagttgcggcgataaggccggctatttgtccagcagtcattgatcttcctccttgtgcaacatttacttaagaatagcattccagcaatggtttgacaatgaaaatgaacgaagagtggtttcttttgtagaaccaatttgctaagatgatattatacacaaagcgaggaatcccaatgataaataccttaaaattcacagttttagccattaattggcaaaaacatctcaacatggttgactgggatcagctggccatgacgattctggaaaaagtcggattattaattttattcagtctgttatttttactctttcgtcggattggtaaaggactgattaatcattttttcaaacgctatcggcgcaaatatcaaaataccgtagcagaaaaacggatcaagacctttcacaccctgacgctgaacattttgaactactgcctatggttcttctggatttactccattctctcaacggttggggtgccagttggaaccctggtcgcctcagctgggatcttcagcttggcaattggccttggtgcccaaggatttgtgactgacattgtcagtggctttttcattcttcttgaaaaggaaattgaagttggcgaatacgtccaaattggaacaattagaggaactgtaactgcagtcggactgagaacaacgcaggttgtcggggacgacggcacgttgaatttcatccccaaccgaaccatcaccaccattgccaacatgtctcgaaacaatatgacggcgatgattcaagttggcattttcccacaaacgccagttgataaagtcacccaaattatccgccaggtcaatgaagaacagatcccccactatccggatattatcggagatcccaagattcttggcaccattagcctccccaacggcaaactggttgttcaggtaaatatcaccacaaaaaacggcagccagtacgaagttgcccataactttttggccttctatctagctgcaattaatgaggccgggattcaactgccggcgagcccaacaatggtgaatggacaagccaactgatgtttgaataaagtgaccaattattagaaaaacgagattgccggcaaattttgtcagtaatctcgttttttgacttaattcatttttgtaaccatcaacgatattcacccaatggattatcgattaatcagacccttggagccttgaatcttggcgtgcttggtttcgtttttggatttgtgattatacaccggcaaagcgatgtagtgtttattaaagttgtgagccaaataattaatttctttaaatagttcccgacgggtaatgattcctttaaagtgattttcagaatcaacgtagaccagaaagttttcatccaccaaatacctgagaatggcttccaggttatcccgctcgtaaatcgttgggacatccttttgcatgatttgcttaactttcactgactcaagcggtcgactggtaatgccggtatcctgcatcatgagttcagtaatcatgggtaaagaaaccagtcccatgaaatggttatcgttatctaacacgggaatttttgcgtatttaactttcgtcaaaaccatgaagacgtgttggagatcattgtcttgattgacagttgcgaccaaatcagcggggattaaaatatcccggtgactttcacgcatcacggtctcaattggtttatcgatcatgtaatcctagactcctttttggttagaacggaaaacgaagttccaaattcgccaccggttcaaattggcggttgtaatattgaacggtgtaattgcgttgatccatgctgataatggcataggtaccgcccaacccggcgtattgcccacgtggataggcaatgcttccaggattcacaaacagcatctgatcgtcaaaaacagctcctaattgatgagtgtgcccaaaaaggacgatatcggcggataagctccgggcatataattccaaattaagcatgccaccattcacgttttgatgatgcccatgcgtcaagaggattcgtttgccgctaatttcttgaaccaggtggtcgggaaattcggcaaagtccatattcccctggacaatccgcagttgagaaactaatggatcgtccgccggtaattcagaatcgccgcaatggaaaatggcatccacttgaccggcgtatttgttcaccaattcttggataatggcgcgatctccatgactatcactaacaacaacaattttcatgagtcccacaaccccaacaatttacggatcaggttgcggatggcattgccccgatggctaatcagatttttatcatgggtgctcatctcggcgagtgttcgctgctggctgggcacatagaataatggatcatagccaaaatcgttattcccacggcgttcacgtaaaatttcgccgtcgattcgaccgttggcaaccaccttgtcaccctcaggcgttaaatagaccagaacagattcaaagtaagccgtccgatccgttttgttttgcatttccttcaaaagcttatcgttgttggcgtcatcatcgtgatcacctgcataacgggctgagtggacaccaggttggccgttgagtgctttaaccaccaggccggaatcatcagcgatcaccgcttgatgcgtaaagttcatgatgccggtggccttgagggtggcattttcttcaaatgtggtgccggtttcagcgatcgtcggcacattttcaaaatgcttcagtgatttaattgtgataccggttggtttaaaagcatcctcaaattcaatgattttatgagcgttttgtgaggcaatcacaatcgattcgggtcttttcacgttatcaaactcctttaaatatctaacttaacggcactgatcggtgttcccagtaacttgtcggcaactttggcgaaatccgccgggttcccggtggtgtaaaatcttcgaacacgctgtttttgatcgggggcaaaaccatcatgagctgctaaatctgccttgacttgctgagcagtggcgactcccgggtcaatcaacgtgacggcgttgcccatcacattttgaatttcattttttaaaattggaaaatgggtgcagcccataaccaaggtatcaatcggtttatccataaaccaagccagtcggttgttcaccgcaacctgagcttcaacggttccggcaagcccctcttcgaccatcgtaacaaattccgggcagcctaaggatgacacaactgctgatcggttggcttgtttgatcaatcgctgataatctccggagcggacggtgccgttggtggcaatcacaccaatctggccggatttagaggctttaacggccatttgggcacccggttcgattacgccgataaccggaatcggtaaaactttctttaaatattcatatgccgcagcagtagctgtgttacaggcaattacaaacattttgatattttgttcaaccagatagtctgcaattctttttgtgagttttctgacggtttcagaactcttttgcccgtacggtaaattggcctgatcgccaataaagatgtacgattcattcgggaggattttggtgatttcctttaagacggtaagcccgccgacccccgagtccataacgccaatcggccgattatccaacagaattccttcttcctttgtctcaataacattattatcttgcaaaagaatctttacttcaacttacaaaacaagattaatgattttattgtataatttatttattacattttgcattgatggagattaaaaaatggataacgaagtatacaagcattttatgactgacgatacaatgagagacctactgggccaggaattaattcgcgattcactgattcctgagattttaggcaaagacgcccacgaaatttcctattgggccggcaagcatctggcaagaaatcatcgtctggcaacctatgaagatttggaaacctttttcaaacaatttaaatttggtgatctaaagctacttaaacgctctggtaaccagatcagctggaagctaagcggcaagatcgtcgcccagcgtctcaacgcatttgatgatcctgatttttatctggaatccggattcatcgctcaaagctgtcagtatattcttaaccaacaagccgaagctgagctcgaaaaggccaatgttaataagggatttgtgcttttaagcacctatttgagccctgacaagccaactgatggtcaagaagcttctgctatatttgaaatcgttcaacccgatcccgatgacaattccaagcctgatgattaactcattggaatcaaaaagcccaccacaaaacctgatttggttttgcggtgggctttttgactgtgaaccgcttgagacaccgaagtcattctaaagactagccggcatattgatcaagcacttttttaacttgggcctttggatgatacccaacgatggtatcaacaactttgccgtcttttttaaccaacaaggttgggatactcatgataccgaatttggataaagtttccgggtttttgtcggcgtccattttagtgaacttaacattatccatttcttctgccagctcttcgatgacaggtgtctgcatccgacaagggccacaccaagttgcccaaacatcggttaaggtgacaccttcggcagtgtctttttcaaaagtttgatccgtagtttctttaagcatattaaaacactccaatcctttaatagtttaatactaacaattttttagcaaaaagcaaacagattgcacacaatcatttttattttaacttcacaaccgttgaaccatccccaccagcattcggtgcagaatagccaaaactctttacccgtgggtttcgtttcaaatattcggtgacccctttacgaagcgccccggttcccttgccgtgaataatcgtcactgaagggtagccggcaagtagggccgaatcaatgtagcgatcgacttctgtcattgcttcttcgtatcggtgaccgcgcagatccaaggtcggtgacatcccagtcgacctggtccgggacacgtgggtctgatactgattcttatcttgtttggctggagttgccttttccaaatcagattcttcaatctgcatcttcaaaatgccgatttggacgtcccacgtatggttcttatccttcctcagcaacgtcccctgttgaccataagatttgaccaaaacatcgtcgccgggatggaaatcgtgcttggccttttcttttcttaaaaccttattctttgtcagacttggagcagattccaattgattgagcgcccctttggcatcaatcagctcgttttccttaacggcaactttgccgacctgggcctgcttttgatgcagatcatcaataattcggtcggccttcttcttagcttcttcgaccacttgattagcctgttgcttagcctgttcgacgagccgttccttctgactttcgtacttggtaaacttgtcttgcaggtcatgctgaagccgggttgattctttcagttgttgatctaattcatcagcttcatcgtgagcccgcttagtttgcgctgtcagctcttcaatcatattattgatgtcttggttctcggagtcggtaaacgcccgtgcctggtcaataatggcctctggcatcccaagtttgctggcaatgttcaaggcgttactttgaccgggaattcccagtaaaaatcgataagttggctggagtgtctcaacatcaaactccatggatgcattaataatcccctgccggttgtaagcaaacgcctttaattcaggataatgagtcgtggcaatcagttcaccgccaatttgatgaaaagcatcaataattgccattgccagtgcggccccttctttggggtcggtgccggcaccaagctcatccagcaagaccaaactatctttactggtctgttttagaatactaatgatattgtccatgtgcgatgaaaaggtactcagattggcttcaattgactgctcatcaccaatatcggcaaagacgttatcaaacacgccgatctgagagtcttcattggcagtgataaacaggcctgactgccccattaactgcaggaggccgactgttttaatggtaattgttttaccaccggtattcggcccggtcacaataatcgtattgtactgatcgccaagttcaatatcgttggcaacgacttgatctctgggaattaacggatggcgcgcctttctgagattaataacatttttcggtgacactttgggcatcacactaccagtcgcatgggcaaatttggctttggcgttcacaaagtccaattggccaaccaaatccatgttggccaacaactcgttacgatgcgggcgaattaaattggttaactctgccaaaatccgccgaacttcagctctttcagcaagctgatcccgacgcaattgattgttcatttcgacaacgttgtttggttccacatacaacgtttggccagaggcactttgatcatgaatgatgccgccaaatcgctgcttatattcggccttgattggcaggacaaacctaccgtcacggacggtaataatcggctcagaaaggtatttggcatctgaacccttaatgaacttccccattttcgaacgaatattactttgagtggcagcaatggtccggcgaattgaacgtaattgcgaagaagcgccatccagaatgcggccgtcttcatcaaccgaagccaccattcgtttggtcacttcaggcatcaatgtgagccgatcgacaattgagggaacggattttaaagtcacttcttcagccgccaaacccctaaaaaattcagtgacgacctgcacagcgcgtagtaatttggtgatatgagacagctcagttccgcttaatgacgcattttcaatccgcaggcgtttcatatacggtgcaatatctgcgagttttggaatcggaatttctccctttaagcggacaatgtcagccccatcggccgtctgtgccaagcgttgagaaacggtttcaaaggaaggactgggtgtcaataaatcgacaatttgtcggccacggtcggtcgtcagatatttggccagctgctccttgatttttccatactctaatgtttctaaaactttttcgttcatacattaacctcactagaatgttgattccaaatctgaatcattttatctgagagaatcggtgtttttttcacaatccactgggaaacgtcggattgttggtactgttcttgaatgctctgatcagggaacatcagcagaaagttcagcaagatgaaaatgaacaaatacttgatgagaagatctgcggctgcacccagtagtgcgttcaattgatgtaataatggcaggcgggtgatcggagataatagatcactcagcaaacgaacaatccgccaaacaaacccaaaaaggaaggcaaagatcacccatttgataatcaactcagcagtttgattgccgccgtttttaaaaattgcctgattaataaagtcagcaattggactggttccaacgatactgacgattgttgccgccaaaaagccaatcagacttaggacttcattcacgaaacctcgatgaaggccacggaaaaagccaaatattaaaatcagaatgatcccaattgtaaaaatcatctaatgaacctctttactgtgtgcgctttcctcaacatcaaattgtttggagattgcattaaaggcaattaggattgcccgctgctcatcagtggcagttggcatagcctcatgaagttgcttgagctgctcatttaataaatcggacaccgcctgcatatgatcaaccgatcccttaccgacaagcacgtaatccttgccatcaatggttgttttgaagcgacgtttttcgttactagacattacatcacatcctaaattctttcaattaaaaaggactgagactcaacgatgcttcgcctcaatcctttcgcaatagggacaatctttaattattgattgtcgttgctgtcatcatcctgatcgtcgccatctttacccaagaaggtgttcaaaactgattcgatcatatcccattctttgtcagtttcaattgcttgaagttctccaccttgaggatcacttggatcatcaccctttggcagtgcataagcttgaatttcgacttcttcatcttcacctttgccatctggataaatcagaatgtacgaccgatcaaagtcctctgatttaaaagtgaataatacgtcgtataaagtttcatcgccgttttcgtcgactaatgtaatttgttgttgtactggttcttggtctgccataattgtttacctcgctatattttagttaatttaccattgctgtccaaataattctgaagtatcaagccagcggccagcttatcgatcacttttttgcgcttggccctggaaacatctgcttcttctgtcaacatccgctgagcctcaacagtcgttaatcgttcatcttcaaaatcaaccggcaagttaaacttatcttcaagtcgtttgccatactgttgtgaagcttcagcccgggggcctaaagaattgttcatgtttttgggaaggccgacgacaaatccatcaacttggtactttttaaccaactcggaaacccgatctaaaccaaattccttgttgtcctcgtcgattcgaattatttcaaccccttgtgaggtccagcccaactcgtcgctaacagcaaccccgacggtctttgaaccaacatctaaacccattaatctcatttttcaccttttttcgtttcggttggatgattatccaaatagaaacgaactaactcttcgattatttcatcacgttcatgtcggcggataagatttcgcgcatcaaggttacgtggaatgtatgctggatcgccagaaatcaagtacccaacaatctgattatatggattgtaacccttttcttccagtgctgcatacacagtcaacaatgtttcgcggacgtcttttggctgaccttcattaaaattaaaaaacatggttttatctaacgaactcatacaattcacctctatgacttaaggtcatttgtattaattttaactgattataagtgaaactacaatcaagtaagccaatgtaaccgacatgtaaccgtggtgtaataattatttatttgccaaccaatcaaccgctgcgctcatcgctttatcaaggccagcaggatctttgccaccagcctgagccatgtttggacgaccgccgccgccacctttaatattgcccgcgatcgatttgatcagatcaccagccttaatgcccgccttgatctgttcatctgccactgcgacaatcaagtttgctttgtcgccgctgccggttccaagaaccaagacgtcagacaaatgcttagagcgccaagtatcagctaattggcgcagctgatccattccggcatctttgatgattccggtgataatggaatacttaccggcagttttcttgtcggcgaaaacattttgagcctgttgcccagccaatttggcttccagtgactgttgtttttgggtaagatccttaatttcgcccagtagttggtcaacccgtttgggtgtgtctttaatttgggtgactttcaagtcgccggcaatttgtttcagttccttttcatgatcgttcaacaacttgaaagcatctttggctgtgaccgcttcaattcggcggacaccagccccaactccggattcagagacaatcttgaataagccaatgtcgcgggtattgttaacatgagttccgccacagaattcaactgagaagtcgccaatgctgacaacacgtactttatcgccatacttttcactaaataaggcaatggcacccatctttttaccagtcttaggatccgtgacaacggtgttgacatcgatttcattgaagatttgacggttaaccatatcttcaaccttctgtaagtcttcatccgtaacctggccaaagtggttaaaatcaaaccgcaaatagttaggttcaacgagtgaaccagcttgttgggtgtgtccacccaaaacatttcgcaatgattggtccaacaagtgggttgctgtgtgattcttctcaacgcgactgtggaataatttgtcaacaatcaagtgataggtcttgcccttttcgagtggttcctgagtttttaatgtgtgcaaattctgaccattgggtgcatgctggacgtcaacgacatcggcaaccttgtctccctcttcatcaaggacaactccccggtcagcaacttggccgcccatttctgcgtagaatggtgttctatcaaaaatcacttcaacagagccaccctttgaatgatcgaccagtttttcgttctcgacaatttccaaaagctcggcgtgatcgacatccaaggtatcgtagccaacgtactcgcttggatccttgatttcaattaagagatcacgttgaacacccattgacttggcaccacttctggcctttcgggcacgatctttttgtttttgcatttcaacctcaaagcctggcttgtcaacggataagccggcatcattggcctcttcttccgtcaactcaactgggaaaccatacgtatcgtagagtttgaaggcagttgggccatcgatggtcgtttgatgatttgctttggcgtcttttaccacttgattgaacagtttcaagccgtcagtcagcgtttcgttaaaccgatcttcttctgaacggacaactttggcaatataatccttttgcttaagaacatcaggataatatgattccaaagtctggccgacaactgggaccaatttgtataagaacgcttcgttgattccaagccgctgaccgttaacgattgctcttcggatcaagcgacggataacgtagccgcggccgacgttggaaggcaatgcgccatcgccgatagcaaccgtgattgcccgggcatgatcggcaataattctgaaggcttcgttatccttcttgttggtatcgtatttcttattgtcacttaattcttcagtcttgcgaatcatcggcaaaaagaggtcggtttcgaagttggttcgggcatgttggaaaattgaaaccactcgttcaaggcccattccggtatcaatgttttttcgaggaagtggttcgtaagtatcttggggggtgtgattaaattgtgaaaacacaatgttccaaacttccagccagcggtcattttcaccacccggataattttccgggtcatcaggagctaaattgtcaaagtccttgccgcgatcatagaagatttctgaatcggggccggatggtccctggccaatatcccagaagttatcctcaatttcaatgatatgatcaggcgcaacgcccactttttcccaatacattttggcatctttatctttcggataaaccgtcatataaagcttatcgggatcccagccaaaccatttgggtgaagttaacagttcataggcccaggtaatggcttcttttttgaaatagtcaccaactgaaaagttccctaacatttcaaataaggtatggtgccggggtgttttaccgacgttttcaatatcgttggttcgaatactcttttgtgaactggtcattcgtgggtttttcgggacaactgaaccgtcaaaatactttttcatagtggcaacacccgaattgatccaaagcaatgttgggtcgtcgactggaatgagtgaggcacttggttcaatggtatgacccttttcctggaaaaaatcgaggtacatctgtctgatttgaccactgcttaactgtttcatgttctcttctcctttgacaaaattaaaacaccgttgctcacagagacgcccattgacgcggtaccactctgattgcaacgatgtttatcgttaaccacttgatctctataacgcagagttgcgtttgataatttaacttttaagagagcaccgtttaattttcgtcgcttttctcaccaaccaaaacgtctctgaaacaaaaaattaaacggcatgttcttaacacatctcaaagtatacttttttgtgaatatggtgtcaatacagacctattgataccgtgaagaactattcttacgttgtttccgtttggcccgtgcttcctcacgtttagcaacccgacgatccatctcgtcctttcgggcaatggtatttttaattcgccgtttgtagcccggcttgatcttcttctttttcttcttgatcatgccgatcatcgttggatccagcttatcgtgtttctttcgatgagtctttcgacgatttcgatcataagaatccacaatttcgccgttcttaagggctttcggttggaaatgaatgcccatatcttcaagttcttcaacttctttttcctcatcgggagaatacaaggtaatcgaagtcccggacatcccgtttcggccggttctaccaacacgatggatgaagaattccaaatcctcggtgggaatatcatcattgataacatccgataccccttcaatatcaatccctcgagcagctaaatcagttgcgacaacgaattgaaattcgaggtttttgacccgcttcatgatttgcttacgttcacgaggcttgagaccgccatgaatcatggcgactttcaatccctggcccttcaaatattcggttaactcctcgactcgtttgcgggtattggcaaaaatcaggaccaaataaggttccccaatggtcagcaatttataaatgagttgatttttgtcctgccccttcgtcgaaatcaaccaattatcgatcgtcggactgataattgtcgacactggaatctcttcgataaaaggattaaccatatatttcttcaaaaagacgttgattttttgtgggatcgttgccgagaaaaccatcatctgaacatgtttcccgaaactggcagcaatgttatcaaccacatccaagaatcccatgtccagggtcatatctgcctcgtcgataactaactgagaagccgtgtgaacatccagtccaccgttttggatcagatcccaaattcgacccggagtgccgacaaccagttgaggctgctcatgttgaatctttttttcctgacgggccttgtcagttccaccaatgtaggcaccggtagaaattggttctggtgagtgcttagccaactgcttagcggcatcaatgatctgataggctaattcccggctgggggtggtgatcaccgcttgaacctcatcttttgcgggatcaagctggttaaaaatcggcagcagaaaagcatgggtcttaccactaccagtagcggattggcccacgacatctcttccctgcatgataacgggcatcaccttttcctggacgggtgtcgggtggctgaagttcagctccttaacagcatccaataagaatggctttaaattaaattctgaaaaattactcatataatctcctacttgtttttggcgactaaatcattcaaatcgctcacaaattccttgatgtgggcttcatcttcgacaacagcaccacttgcgagtggatggccaccgccgccatactgcttggccaattcgttgatttctggtcctttagagcgcaaccgaatccggaaggagccatctttttgttcgacgaaaattgcccaagaaaccacttgtttgatcttgccaggtaacggcacgacggcagaagtactttcgtcccctaacttgaagggctctaatactttattggacaaaaccagataagcggcaccgctatcaagaatattcaggttctcataaacataagcggacagccgtgccagtggaatgtcgatctcgtcttctattttgttgacttcactggttgagaactgatattcagcaagttttgaagcaactgccaaagtatgtggcgacgtggaaggatacatgaatctgccagtatcaccgacgatcccggcataaagcagtcgggcaccttcatcgggcaaagttaactgatcacgattggcatcataaaaatcataaatcagctcagatgtacttgatgaatcgggctcaacccacataatgtgaccaaactgatcgtcgtttgggtgatgatcaatcttaatcaattcttttcccgtcgtataacgttcgtcatccacacgcggctgattggcagtatcaacaacgatcaccaaagcatctttatattgctcgtcggcaatttcatcggtggttcccaaccaggcaaaactatcatattgtttaccagcacacaggactgtcttatcaggaaatgaccccttaattagttgagccagtcccatctgcgatccgatggcatctggatccggccgtttgtgacgatgaataataatggttttaaattttttgatttcacttaatatttgatcttgaattgacattttatttgctccataactttattgtcgaacacttaagtatacattactttgtgaataagataaaccgctggggtggtgaattaatcaaacaggtgaagaacaatgttctcgtaagttaaatcatccaggttggtaatggtgattcccaacaggcgcaccccttttgaaatatccggcatatcgaccagtaaatcgttggcaagtgtaaagtattcttcggggctatttttaagatagttatccatcgtgacccgcttggtaaacgttgaaaagtcggcataacggatcttaagaaccaatgttttaccgtgcttctttttgtcatccattgccttgaccaccatcgcagcaattcgctggagttcgtcatcgacttcggtttgtgtgtcaatcgccgggccaaatgtccgctccttgccaatcgattttcgaacccgctgatactcaactggccgatcgtcaatgcctcgagcgcgctgatagagaacgtaaccaaatttaccaaagtgcttgatcaaatccatctgcgaccactgaatcagatcctgaccgttattgatatttaattcatgcatcttgggaacggtctttttcccgacgccgcggaacttttcaattggcaaacggcttaaaaattctaatgcatctcgctgttcaatcactgtaatgcccactggtttggcgtaatcagaggcttctttggcgagaaacttattgtaagatactcccacggaacaggttaagtgggtggcatcccaaatttcattttggatcattcgggcaacttgaatcgggtctgtgagatgttttttattatgagtgacatccaaataagcctcatccaaggcaacgtactcaatcacttccgtgtactcgtgaaaaatctcgtggatttgattggaaactgagcggtaaagatcaaatccagagaaccgaaaaaccgcctgcggacaaagttccagcgctttcatgacactcattgcggaatgtaccccaaattgacgggccttatagttagccgttgcaaccactcccctgccgccggttttgcgcggatccttggcaacaatcaagggttgagacttgagagtggggtctttgcgttcctcaatcgacgcataaaaggcgtccatatccacatggatgatgtttctagccgatgttttcactgagatcaccccaatcaaacatatgttctttgccgggtaaaaaaatggtcgggattatagaaatcaacttcccaaccgacttggtcaaactatttgtcttccgactttgtttcatctttggtatcagaatcttcggtagcgtcctgatcgctctttgatgaagcagcgtcatctttgtgatcatcatttgcagtagtagttgtatcgttgtttgctgcaggcgcagcaacagcaggctgcttaaccgaagcaattgcgctcagatcaaataccaagtagataccatcacaatccaaagtcacggttttttcggcttcgttgatttcgtcaacgacaccatggagccggccaatcgtaatcacttggtcgccttccttgatctttgaaagttgatcccgacgcttttgttgttgctttctttgaggacggatcattaagaagtacatcaccgcaaacaagacaacaatcattaaaattgagtaataagattgattcaaaatttttcacccacactttccatagtaatactttaccaaataagccctgaatagtctacacctaaaagttttttggatttggtttgttatatccatactgttcaaaaacttctgcccgcaagtccaacagattatcgtcaacaatcgcctgttgaacccgtttcattaaatggattaaataataaaggttgtggtaactgcacaaccgcatcccaaacgattcgtcggtcttcatcagatgacggatgtatgcccgcgtgtagttacggcaggtgtaacagtcacactggtcatccaacggtgtgaagtcacgggcatacttggcatttttaacaaccagtcggccatgggacgtcatcaccgttccgttacgggcaattcgagtcggcagaacacaatcgaacatgtcaatgccccgaatcacaccgtcaatcagtgaatcggttgctccaacacccatcagataacgcggcttattctcaggtaaaagtggactggtggattccagaatacgattcatttcctgtttggattctcctactgacaatccgccaatcgagtaacccggaaaatccaggctgaccaaatcgcgggcggattgtttgcgaagatcttcaaaaccggccccttggacaatcccaaacaacccctgccagtcaggatttcggtgagctttcagtccacgttccgcccatcgactggttcgctcaactgactttttgacgtaatcatacgactcaaaaaatggtggacattcatcaaggctcatcatgatatcaggacccaaatcattttcaatctgaatcgccttttcgggagacagaaacatttttgaaccattaatttcatttttgaaggtcacgccttcttcggtaatatcacgattcttagccagcgaaaagacttgaaaaccaccggaatctgtcaaaattcccttgtgccaattcatgaatttgtgcagaccgccggcctctttgacgatgtcttctccgggtctcagccataaatgataggtgttcgccaaaataattgtcgaccccatttgctccaattcttccggagccagagttttcacagttgcctgagtcccaaccggcataaacatcggcgttttgaaagttccgtgaagcgtggtgatttctcccaggcgggcgccggtgtgcttctcctttttaatcaagcgataacttatcgctggttgcatataataatcctcctagtgaatgtacattgcatcgccaaaactaaagaagcgatatttctcgtcaattgcatgctgataagcgttcaggatgttttcccgtccggtaaacgatgccaccagcatcaccaaagttgatttaggcaaatggaaattggtgataaatgaatcaaccacccgccactggtatcccggtttgataaaaatatccgtccagccggagtcggggcgaatttgaccgtcaaacttggtcccgaccgtttccagcgttcgaattgacgtggttccggttgccacaatttttccgccattatcccggacagaattcaacgtggccgctgcctggtctgacaaacggtaaaattcactgtgcattttgtgatcttcaatattttcctcatcaaccggtcgaaatgtccccaagccgacatgaagggtcagataaactaaatgaacgcccttatcttcgacttttttaagtaaatctttggtccagtgtaaaccagccgtgggagcggcagccgagcccatttctttggcgtaaaccgtttgatagcgatcaggatcatctaatttttctttgatgtacggcggtaagggtgtctcaccgagccgctccagaatttcgataaaaatgccatcgtatttaaattcgatttcgcggcccccgtgatccaattccttggtcacaacagctttaagttggccatcaccaaaattgataaccgtgccgaccttggcttttttggctggcttcatcaaagtttcccagcggtcgccctcaatattatgaagcagcaacacttccatgtggccgccggtatcggctttgacaccgtatattcgagcgggcatgacctttgagtcattcatcaccagggcatccccgggattcaaataatcaatgatgttgtaaaaatgacggtcctgcatctcaccggtttctttatccaacaccagcagtcgtgattcatcgcgatctttaatcggcgtttgggcaatcaattcatgtggcagatcataatcaaagtcttcaagggtgtaatttgttttcaagattctaattcctttcgtcctgaggtggcattggataactcaaatgagcgtatcccttgggagtcacaattcttcctctggctgtccgtttgattaaaccgatctggagcagataaggctcatacatctcggcaatcgtgtcggtttcttcgccaatattggcggccagggtgtttaagccaactggtccaccatcataatacttgatcattgtcgtcaatagtttcaggtcagtggcatccaaccctaaatcgtcgacttttaactttgccaacgcgtatctgacaattgccaaatcgacttggtctttgtcggatacctgagcaaaatctcgaacccgttttaacaagcgattggcgactcgaggtgttcctcgggaccgcaaagcaatctcatgggcaccggagtcctcaatatcaatttgaaaaatatccgcagttcggcgaacaatatcctccaaatccgtcgcattgtaataattcatgtgctctacaattccaaaccgatcacgcagtggtgccgacagcattcctgcttgggtggtggcaccaatcagagtgaatggcggcagtggaaaatgaattgggtgggcgcctgaaccctgcccaacgataatatcgacaaaaaagtcctccatggctgaataaagcatttcttcaaccaccttgggcagtcgatgaatttcgtcgatgaacaagacatcgccaggctgaagttcattgagtaaagacaacagatccccaggcttatcaatggcaggaccgctggtcgttctaatattgacgcccatttcattggcaatcaccatcgccaaagttgtttttccaagcccaggaggtccgtaaagcagcacgtggtctaatgactcctcacgttgcttagcagccttgatatagactcttaactcgtttttaacatcatcctgcccaatgtactcacttaaaactcggggacgaagcgatttttcaatgctgttctcatcggcatccacattctctggtgaaaccaatcgatcatctttttcattggccaatggatcatctcctcatccctaatgcattaacagtttcaatcctaaacttaagtattcatcggttgacaaatcagcttgcttaactaaatccggctcgatggcggcaatctgtttggcaccataacccagcgcctccaatgccgataacgcatcggccaattcaggagacttttcgggactgccaagcggttgggccagcgaagcaccattagttgcaatgtcgtcgagctttccctgcatgtccaaaataatctggcgggcagttttcttaccaactccggggaacttcgtcaaaaacttgacgtcttcattattaattgcggtgatcaatccatcccggtcgttgccggccaaaattgccaaagcacttttggggccaatcccggaaaccgaaatcaacttttcaaagatctgcttgtcttcaatggtcgcaaagccaaacagcaagatagccgtatcgctcactgactgataaatatagactctgatgacttttttctcatcaacattaaaacggtacgggtctgcggtattgatcaaataaccaacgccgcccactaataaaacgatgtgggtgggtgtgatatcaacaaccgtcccttccaaaaattcaaacatcaacttctcctcttcactaaaacgtatgtttgccaataaattgtaccatatctcactcggtactgggcaacaatctagatgatttcttggtctgtatgatgggggtcttgaatccgtttgaacattttttcaatgtcctcgttagtaaatttcaccagaaccggccggccatgggggcagttatatggattctcacactccggcagccgcttcagtaaggcctttgcctggagctcatcaagatgatggttcgccttaatggctcgcttacagctcatcatgatagccgttttttcgcggaaagcggccacggaaattttatgatcggataaaatccagtcaatcatttctttaatggtgtcttcttcctgcccggctttaaaccacattgggtgctcacggacgatgaaactgttctgtccaaacggctccaaatgaattccaagtttgtccagcaggtccaaacggtcgctaatcatcaagaaatccgaggttgagtaatcgagcacaattggcaccaataatttctgttggtcatcggaaacttcgccaatttgcttacggtaaaactcatagttaatccgttcttgagctgcgtgttgatccaccagatacatattatcagctgtttcagccaccagataggtgccatgaatttgaccaatatagtcaaggtgcggaaaaccagtttcaactaccagttcagactgctcaggcttggtacttgactggtgattgtcaatcgtttttggctgggttccttcaaatgcaggcaagccactcggctcatttttaagaaagtcatcaaattgagcaacttgtgagctggcaaggtcgtctctggttttgaccaccaccggcgttacttcaggttgggaaattgaaggcgtcgttggtgtgtcgacggcaaacagcggtggattcgtttgagcctgggtggcagtcgaaacatcaaactgtcttggtgcagcttgaaccggctgtttgaaatccctggttgcatctggaatcagctgcttgtctcttagcatgtcgtaaatggcattggcaattaatttaccaatcatcggttcgtcactaatccgaacttcctgcttggttggatgaacattgacatcgatcaaagcgggatcggcgtcaattttgattacggcaatcggaaatcgtccgatcattaatttggaaccatagcccgcaatcaccgctttggttaacggaaagttgcgaataaagcgtccgtttaaaatcagtgaaatatagtttcgacttgaacgggtcaattccggtaaactcacatacccactgactttgatgtccaaatcatttcccttaattgccgccatctttgaaaccgtcttgacaccataaattgcgcccaaaacctggcgtaaatcaccacgtccggacgttcttaacaattcacggccgttactgataaatgaaaacgcaatctcaggatgactcaatgccaagcggttgacaatgtctgatatttttgaaagctctgtattcggtgagcttaaatacttcaaacgagccggcgtgttatagaacagtgatgccacttcaacagtggtccctttccgtgattcagaagccttttgagtgacaagcttgccgcctttgtattcaacttccgttccaatcgagccggttgacgttttcatccgaacgttagcgacggaactgatactggggagtgcctcgccacggaacccgagtgtccgaacgcggaacaaatcccgttgctcagaaattttgctggtggcatgtcgtaaaaaggccgtctgaacttgagagctgtcaattccgttgccgtcatcgacaactttgatcaacttcaagcccgaattttcaacggtgacatcgatttccgaactcttggcatctattgaattttcaactaattccttaaccactgatgccggtcgttcaacaacttcaccggcggcaatctggttggaaaggattgttggtagcttatgaatttcattcaaatcaatcaccttagtctccgtttatcttctgctgccatttgtaaacttgattcatcacttgcatgggagtctttcccatcaagtctaatttctttaattgtgacacaacttcggcttgtttatcatcaatttgctcaagtggaaataaagacgtctgctgctcaggcgcctgctgaggggcctgttttggtgccgaagctgtttgatgctctttgtcggcctgttgctcaaggttggttaaaatgtcgttagcgcgatgtaataacccttctggcaggcctgccaatttagccacatggattccgtatgatttatcagcagggcccggctgaatcttatgcaaaaaaaccagttcgccattggattcggtcgcgccgacatggacattttgcagtcgtttgagagattcatccaaaacagttaattcatggtaatgagttgaaaacagggttttagcaccaatgttgttatgaacatattcaataattgcttgagccaacgccatcccatcgtaggttgcagtcccccgaccaatttcatcgaacaaaatcaaactgttgggagtggcattctcaatggcatcgttggcttctttcatttcgaccatgaacgtactttggccggagatcaaatcatcagcggccccaattctggtgaaaattttgtcaaacaccggcagtttggcctgtttggcgggcacaaaacaccccatctgattcatgatgacgcatagtgccatttgacgcatataggtacttttaccagacatattgggaccggttatcagtaggatgctggtatcttcgcccagattaacgtcatttgggacgtattgctggtggcccaaaaccttttcgacaactgggtggcgaccatctttgacttcaaccacgtgatgcgtcgtaagcgttggtcgaacaaatcggtactcctcgctgacggcggcaaagctctgtaagacatcgattgacgctacggcatctgctaaatcctgaattcgtttgatggatttcttaatgtcgtcacggatcttaacgaatagcttgtattccaaagttttactttgttcctgggcctctaaaatcagcgcttctttttccttcagctccggcgtcgagaatcgctcggcgttggccaaagtttgtttgcgctgataacggtttgctggaatcttgtccaagttgaccttggtgacttcaatatagtaaccaaaaacgtgattaaaaccaacttttaagttattaatgccggtaattttacgttctttggcttccaattcagccaaccatttttgaccgttattggtagcgtcccggtaagtgtccagctgctgattgtagccatccttaatcacaccaccatcggtaactgaaattggcggttcctcgacgatcgcagaatcaatttcgtcaacgacatcatccaaaggaaccaggtttttgagcatagcctcaaaactcttgtcggcgatttgctccaaaatatatttaatcttcggaacctgcttgagcgaagccttgagttgaatcaaatcacggccattgacactgccgaaggaaatccgacctgccaatcgttccagatcgtaaaccttgattaactcgtcttggagttgatttcgttcgaaatagtgatccagtaacacggcaactgcatcatggcgttgattaatcagtttgcggttcaccaaaggccgctcaatccattgtttgagttttcggccgcccatcgcagttttggtttggtcaagcagccacaataaagtgccggcttttttacctgtgcgaatattgcggattaattccaaattgtattgagaattgtggtcgagttccaaaaaatctgagggttcataaatcactgcccgctttaaatgctgcaggcttcttttttgggttgcttggatataatccaacaggagtttgacgacccgtttcatcaagtcgtcatcaacgtcctggcttaagtaactgactgaggcattgaccggcagaaccgattgatgggaaatcaaaatccccaatttttgaatcgtatcttgaattgactccggtaaatcagtatcaacgacaatttccttagtctgcaaagaaaccaattcgttaacaaattcagcctgcgtggttaatttggcaactttaagttcaccggtggaaagatcggcgtatgagaaagcgaactcatgattcttttgatcatccaccaccgcagtcagatagttattggacttggcgttttcactgccaacatccacctgcgtccccggtgtcaccaattgaatgacttctcgtttgaccattcccttagccaatcgtggatcttccatttgttcacagattgcgactttgtatccctggtcgactagaatatcaatataattttgcaccgctttgtggggcacaccacacattggaaccggattggccgcattccggctccggttcgtcaaagttaattccaataactgtgaacccttgatggcatcctcattgaacatctcgtagaaatcaccgagacggtagaacaaaaaagcatccggatactggtccttgattttttgatattgcaccatcattggagttaattctttttttgccaactgaaagtccccttaaattctcactgaattcgatttcagtatcgtctaaactattataaaacacaattaaatttgatcatcagtcatcgacacggtttcaatatgggtcgcgtgaccggtcttatcgtcaatatcgacgaagcagccggaaatgattccgcgaccggtttccataactttaaatcgggctggtcgctgatctaagaagcgttgaatcacactgtccggctgcatgcccaacatgccgtcagccggcccggtcatcccggcatcggttaaaaaggccgtcttgccttggagaatccgtgcgtcattggtttgaacatgggtatgtgtccccaccaccgctgaaattcggccgtccaaataacgggcgattgctaatttttcgctggtggcttcggcatgaaaatccataaaaatgcaattggtcgtctttcgaatctcttcaaccagttcgtcagccagctcgaatggatcgtcaaggttgtccatgaagacgcgcccttgaaaattcaggacagccagctgtttgccgttgacattgaccatggtatacccttttccgggtgttgttcgtttgggaaaattgtacggccgaatcagccgtttagtatcatcgatgaagtcgagaatttcattattgctccaagcatggtttccaagcgtgaccacatccacaccatcactcatcaattgcttatagatactcaaagtgatgccgcgacccattgaagttgcattttcgccgttcactattgtgacctggggtttcagatcctgcttgagtcttggcagataattgccaatcattgaaacacccttgtcgccaaccacgtcaccgataaaaagaattcgcatgtatttttcctcgatactttctgaataatataaaataattctaacatttataaaagaaaaaagaccagagactctgatcttttatcttgcgtattcgactgaacgaacttccctgatcaccgttactttaatgtgtccaggatacttcatctcagtttcaatcttttgtttgatctgacgggcaagcacaattgcctgtgtgtccgttatatcttcgggctttgcaatcacacggatctctcgacctgcttgaattgcgtaactcttttgtacttcgttaaagctgtcagtgatcttctcaagactatcaagtcgatgaacaaagctttcaagtgattcactgtgtgcgcctggacgcgaaatcgcgatcttttccgcaacagcaaccaactcagaaataattgtttctggattgtggccttcttcataacctttgatagcatcaatgacaacgggactctcatgatacttcttggcgaaatcaacaccaacctgtacatgtgatccctcaacaccattattggcagctttaccgatatcgtgtaataatcctgcgcgtttagctaaagtaacatcctcacctaattctgctgcaaaagcacccgccaacttggcgacctcaattgaatgactcagcaagttctgcccatgatcaatcttaaagttgagttgtccaactaatttgatcatatctgggctcattgaatgaatcccaaggtcgaatagcgtctcttccccaatttcttggatacgctcgtcaagctctttacggctcttttcgaccatttcttcaattcgtgccggatgaatccgaccgtccttgattaacttttcaagtgtcattttggcaacttctctccgaatcggatcaaagccgctcagcacaactgcttgtggagtatcgtcaatgattaaatcaatgccggtcaacgtttcgaaagtccgaatgttacggccttcacggccaataattcgtcccttcatgtcttcgttaggaagactaacaacggaaacggttgtctctgagacaacgtccgctgaactctgttgaatagcttcaattatcagatttttggcattttcatcagcttctgtttgggcttggtaataactttcttttaccattcgagccttttcgtcagccaacttttcgctagtttctttcaaaatcaggtcccgggcttcttcttgcgttaaagcagcaactttctcaacttcggcctggcgttttgcgataagtgagtttgcttcttcttgttgtgtaactaaattctgttgttcacgattaatcttctgctcttttcggttcaacgaactttcacgacgttcgaaagccgtgtctttacgatcaagagcctcttctcgctgcagcaaacgatcctcttgtttttgaatctccgcacgccgcgtcttcagttctttttcaaccgatgaacggtaacggtggttcttctcctgagctgatagagttgcttctttcacaaccgtctcagccttcttctgggcctcggtcaaaatgttcttagccgacccattggcagagtcaagatctttctcatggatcttcttttgtgcagacttgccgattacaaagcttaaaataccaacaaaaccaacaacaattatagcgatgattgcgaggattatcccagccatggtcatggcttttcacctccaaatcatcaaaaaatgattatttgtaaaccaattagatgttatttgattattgacacaattcttattttaatgtttgttaacactagtgtcaatcatctttacgttgcggtttttggtatttgtatataacaagatttttgagtgaccatattttcttttaaaatgtttcacaaaagcccgctgtgccttgattaactcacaaaaaatgggcagctcctctgagtgcccattaacgaaatctatttgcatttggtagtgccaattacttgccaatatcaagatcgatgctatcagttttggtttcttttgaagaaccggttgccgattcctttttggaatcctttttgtcggcttttttatcggtcttcttatcggaactggctttgtcatcagaggtgtccgagtcagtttcatcaggaatgtcgtaggcagccctgactttcttcatcacctcgtcatacatatcttgatgttcttcaagataagtcttggcattctcacggccttgaccaattctttcttcaccatatgaataccatgagccggacttgttaataatgtctttttcaacagccatatcaaccaattcgccagattgagaaatacccttgccatacatgatatcaacttcagcacgtttaaatggcggtgcaaccttattcttaacgactttgatgcggacacggttaccaatgatgttggtaccgtccttaatctgttcagcccgacggatttcgagtcgaattgtcgcataaaacttcaaggcacgaccaccgggggtagtctccggattaccaaacatcacaccaactttttcacgaatctgattaatgaaaatggcaatcgtcttggtcttactgatcgttccagaaagtttccggagggcctgcgacatcagtcgagcctgcagaccaacgtgggcatcccccatttctccttcaatttcagctcgggggaccaatgcagcaactgaatcaatgacgacgatatcaattgccccactggtaaccaatgcgtcagtaatctgaagaccctgttcaccagtatctggttgtgaaagtaacagatcgtcaatattcacgcccaagtgggttgcataaaccggatccagggcgttttcggcatcaatgtaggcagccgtgccgccgcgcttttgaacttcggcaaccgcatgaagcgccacggtggtcttacctgaactttcaggtccataaatttcaacgattctgccccgtgggtatccccccactcccagtgcatcatcaagcgctaatgaaccagatggaattgtggaaatttgagtatcggctttgtcgcccattctcatgatggatcccttaccaaattctttttcaatattctttaaggctttatctaaagctacttttctttggtcagccattaaattcctcccactatccttaacggaaaagtttacttactaactatactaatgattatccaaaaaagcaatcaaaacgcgaacaaaagttcgattaatttaataacgatgaatcatgtccaacgccatctccaagccggccttgactgcagcagcccgaatctgatttcgatcccccgtgaaatgaaactgtttcgcataagtatgttgggtcccataggcaatgccaatccagaccgtgccagcaggatcgccttccaacgtgtccggcccggccactccggtaaaggatacgcccagatctttattcatgatgcttcgggcctgatttgccatccaaatggcagtcggttcactcacgacaccattttcatcaattacttcacttggtatctgcagtagttgttctttaacctgatttgagtatgtgacaaatcccccctcaaaaacttctgagacgccgggcacattaccgagagtgctctgaaattcaccggcagttaaactttcagccgctgtaattgtaatgtgtcgggataatagttcatttactaatgtctcttccaatgtcatcttagttgctccctctagttcataagtacgttaaatacttggtttttatctaacaagacacaaataccggaagactcattttcatgaaccctccggcagctgtgattaaaatgaatctgaaaatactgagcgattttttacaaagtaatcaattcctgagtaaatcgtgaagaataggcaaatgtataacagaattaagcccattggaatgttgactgcatcaaataagacgttgttcaagaacagtaaaatgatcgccagcatctgagtggttgtcttgatcttgcccggccaggccgcagcaatgacttggccttcgttctcgacaatgattagccgcagcccggttaccgccaattcacggcagacaataatcgcggcgacccatgccggaacatcccccaggccaaccaaaaacagaaatgccgtcattaccagcattttatctgccaagggatcggcgaactttccaaagttggttaccaaatgatttcgtctggcaatctgaccatctaagaaatcggttagagaggcgaccacaaaaataattgtcgcccacaatctggtcatactgatcgtggttcccgcccaaacaacgctgccggaaaagattgggaccgcgaggatcaggataaagaacggaatcaggatgattcgaaatagtgttaatttattcggtaaattcatgttaaacctccagctgactaatagccattggtggtaccggtattattattcgtaccagtgctgccagttgttgcattcgtgttgccggttgtgtcagtaccagtcgttgaggacgttccagtggtgccactcgtcccggttgtgctattggtagttgaggcacccgtcgtggcactacttgaactagagctggttgaagcagatgaacttgacttgccaaactgcaatgtgacaactctcacctgagttgaaccgccatttaacggtgccgccaacgtcaacttcttgccgcccacggtaatccgggtcgcttcagcgttgccagtattaatcgtaacggtattggtcgagcttggaagcgagattgtatgtgaattaccactggttaatgaagcttgccataaagaagtgccatctgcagaaaccgacgtccaggcactcccggaaccggttacggaaatcttcagtggcgttgtaccggaagttccggtgactcggtaagtcagattgctgccagaagcagtaaccttcttaaaggtaatccccttggccttcttagtcgtcttggctttcttcgaactggaagccttggaactggatgatttgtcgccggaaacggaaactttgctggtctcaatttgcgttttggcagtgtttcgggtacttctagccgcagccacccaaatagcaatcaaaatgattaaaacgacgacggacaccgaaataatcggaatatagcgccgcagtttatcattgcgttcttcaacctttcgttgagcagatctcgtctcagggttgtcatcattgacccgatccacatattccgggtcttcggtatcgggcaatttagtatcaaactggcttagcagctcacttccgtccagaccaaccgaatcggcatactgcttaacaaatgctcgaacataaaaatcacccggcaaggcgtcaaaatcattatcttcgatcgcaattagatagcgtttctgaatcttagtgttcttttgtaaatcatccagcgtgtaacctttggccactcgtgcgtcatgtagttttttcccaattgttaaattatctttttcgtcgctcatactcattctccattgaattttttgtattctccactaagtatatcataaggaaaaccttgattattttaagtaattcataaactataatttatcaactatccctttggctggtcggaattttgaatcatcacttcttgaactgttgcttggtccaaaaaactgtgggccgcctcaaaaacatcctccaaggttaatgatttgagaatctcaacctcatcatatattgtaacaggttcaccgataaatccgtcaaactggccactgatcgcttcttcagaatccatcatttcgatgtagttgccgaataactcgtttttttgcaactgaaattcggtttggaggtgaccaatcttggttggaatatctgcaatgatttgtttgagccggttaatgagttccaatggcttatcagtatcgccgttaatcacggcaaaatgaaagccgcgttcattttcaaattcccatgaaaacgtgtcatcaatgatttcatcatgatacagtttatcatattccacggagttttcactcaaaaacagatcaaacatcacagagatggcgatttcgtactttagtccatcccggcctgttgggacttggtcgcttccccgtagccccagcgttattttaggcctggaaacatccattttcgtgtgaagaacggtttctttggatgcctcggggagcgtcagtcggcgttgcaggctaatgggtgccggtgtcgattttcgccgttgattatcctcaatccagttcataacttcgctgggatcgagtttgccggtgataaacagactcatattttccggccggtaaaaggttcgataagccaactcaacatcttccagggtaatcttatcaaccgtctgaatgtcgccggcaatatcgtttgccaacaccgagtttggatacaaactggcaatcgttttaaagtacgcctgattgtccggatcattttgatacatattgatttcttgatcaataattcccttttcacgttggactttagcttgggtaaaatatggaatctggacaaaatccaacaaaatatccaaattttctttcacggattcggcagttgagaagaggtaattcgtcttggtaaaacttgtgaaggcattcgaacgcgctccggttttattgaacagctcaaaaacgtcgtaatcctttttatcgaacatcttatgctccaaaaaatgggcaattcctgcaggttgaacaactttttcgccattgagcatgaactgactgtcaatggagccataattcacccccaaaacagcggtcgtcttattaaaccctgctttgggttggagataaacggtcaacccatttgagagggtctgaacaaataatttttcattgtagtttggatagtcaatcaattccattatgcatcccccctgctgttcaactgataaatggctcgtaaagtcaaccgcttggcaacttgggcaatctgcgaacgcgtcacagaagcgacctgttgctcccatttggtatcactcaaactaaagcccatcatctgctggagatactgcttctcgattaatgatccgaggtgatcggcttctgaacgatgttggttaatcaatgcctgtttgacaccgtcgagcaattcatcggaatattgcccgtcgctggtctgctgcaattgatcggcgaccatctgaataacgcgatcttcatccttaaaatcaatccccgcctgaacggttaccattccgactaatgaattatagccactatgaatgtcgtaggccaaactgttcttttcacgaacgtttgtaaatagcaacgatctgcttgacccaccaaataactgattaaaaatgacggcagcaaagtagtcgtcgtccccaaaatagattggtagttcgtaagccatgctgagaactgactgagaaccggcaatcactttggttccttgttggaccttcgatattggtgccggcacaactcttaattgatagtcttccggcattcgatcagtaaatgaggtaaattctttaaatcccgttactagttggtcgtcaactaaatcgccaccagccaggatggtaatcttcgctgagttaaggacccatcgataaaatgtgtacagctcttgagcagaaatttggctcatttcttgatgactgcccatcaggaagtgaccgtggtcaggatcatttgggtaatacaaacgttgaagctccaaggttgagaaaaactccttgttatcttggatcgaatccagataatgaaccatattcccttgatgaatttgaaaatatgcttggttgaactgatcgccttcaataaatggatcctcaatcatttcctttagaaatgccaatatttcactagttagctcactttttggcggtaggtacttgtcattgggaaacgtaatcgacacctgcagggtatgctgattgccataccgtaagacagtcacaccaaaactggccccgtacatttttgacagttggcgggaaaccaacaactcactgttgtattgggcagagcaattttccagcagttcagccaacagtgccaatttggcgtagttttgatgttgggccggaaaggtgaaattcatcaccaatttattatttttgaattttgtggtgggaattgtcgtcaagctaatcccttttgcaatctcgtatttcactgagtttcctcctcaattagtcacaaattttatcataaaataaaatcattaaaatctcaatataatctgccaataataaggaaaaatagagaattgatcggcaaaggattcgaatacaaaaatagtctgttgacaaatcacatttgccacagactactaatgatcaaaattatttagcattcttaatgagcggactgtcccgatcagttccaaaccacttcatgttgattttgtgaagctcgccgtttttggctaatcgattgagaccttgatcaattttccgcttcaagacagtatcaccttttcgcatgccgacaccatattcttctttaggaaattcactgggaatcgacttaaaactggattgatttggttgatgttccaaataataaccggcataaatgctgtcaatcagcaatccctgaattcggttggcattcaaatcgatgaacgcatctgtaaaggtgtcgtataagattggctcgtggcccttgatcttatctttcagcaatttaggttggttatcaatatccatggcccctgccgacccactctggacgccggcgacttttcccttcatatctgcgaaactgttgatatgttgattctttttggaaaccaatacttgatcattaattagatagggttcgctgaaagtaatcttctttgctcgctggggattaatagagaacccattccagataagatcaatcgtgccgtttcgaagctcggtgacgttcatcgaccaatcaattggctgaaaatccactttgatgccgtattgcttaaacacggcacgggccagatcgacatcatagccgacaatcttgccgctcttggtctgaaagcccattgggacaaaactgtcatccagtccaaccacgattcttttttgcttggaaaccgtcgaccacgtatccggattttcctgtgagccttggcgactgacatagcgtaccccgcaaccggataacccaatggtcacgagtaggagactggtaatgagtaataatcgtttcaaagattttaacattttacccctcctactgaatttgtttgacctgctgaatttcatccgcaacgtttttagcaaaatccatatcatgagtgacgacgatctgggtcatttcctgcttcttaagatccaagataatttgggcaacttcatctcgtaaagcgggatcaagggccgacgttggctcatcgtaacataggatcttcggtcgcattgccagtgcccgaacgattgccacccgttgcttttggccgccggaaagctgataaggatataaattttctttgccttccaagcccaagcgactcaataattcccgcgcatattttttgacgtctgccatcgtttcttttttgaccatcgttggtgccaaagtaatgtttcccaggaccgttaagtttgggaataactgataatcttggaaaaccaccccgatgatcgtgtctttttgagtcgtgttggttggatcaaactgagtgccgttccagtaaaattccccggtattcaccgactccaaaccggtaatacaacgtaacagggtcgttttgccggcaccggaagggccaacaattgccataatttcattatctttaacggtcatcgacaagtcatcaataatggttcggctgccaaatcgtttggttaaattcttaatctctaacatcgtaatcccctcctaacgccaaacattttcacgtttctcaattaacttcaacacaatcgtacataccgcggttaatgccagatagataatcccgactaatatcagcggcaacagcgtaacatccctggccgttgcgacgtttccggctcgcagtaaatcgcccaacccgataacgtagaccaacgaggaatccttgaccaggttaatcacttcattgccaattgatggcagaacaattttgaaaacctggggaatcacgatctttcgaatcgtttgtccataactcaatcgcagcaccttggcactttcaaattggcccttgggaactgattggaaaccgcctcgaaagatttcaccgaaatatgcggtgtaattcaagatgaaagcaaacatggcagcatcgtaacgttggaacacaatgtgaacaatcggtaagccataaaagacaaaaattaattgcaatagcagtggtgtgccccgcataatccaaacgtaaaagttaagcagccaggtcagcggtttaaatttttggatgagtcctaatccgactaatgcccctaatggaattgaacaaatcaatgtccagaagaaaattgataaagtcattttggttccagataataacgccggtaaaatttcttgtatatattgaatcatttgacatccctccataaaaaaatccccttgagtacacattgactcaagaggacgatggttttcgcggttccacctcaattcgcaacagattcacacctgctgcctcgtgaagtttagtcttgttttaaaataaaaatcctcttaagccatgatgacttaagaggacgattattcgcggttccacctctgattcacctctcactcacatgaaaggcctcaatgggtttaatatgcaacatactaaacttcagcaataacgtgcttaccgctttttcctactcagcttcagaaaaatgactcccagatgtgacgattaatgctcaaatgcttaactcccaccttgataagctctctgtgatttgattcattaatcggttctgatcaacgtctttaaaaatctttaattaagttagatttataataatattaattctgcttcccgtcaaggacttttatcctttacggaaccaatgactcactttttgccagaatgaaggctgctgttcatctttgatttccatcaatggcacagattcaccgactagtcgtcgggcaatgtctcgatatccctgaccagcagggttttccgcttgaagaacaacgggttcgccgttattggaagtggtgataactgcatcatcatcaaagacaatccccaatagttcaacccctaaatgatgggtaatttcatcaacatccatcaccgaaccgtctttcatcatatgttgacgaattcggttaataatcagatgcggctgttcttgaagcggatgctgctccaagagaccaaccacccggtcagcatctcggaccgcagaaatctcaggagtcgtcacaataatggcactatcggcaccagcaattgcgttcatgaaaccctgttcaattccggcaggacaatcaattaggatgaaatcaaagtccggcttcaattcatcaacaatttcgcgaacctggtcttcatttagggccgtcttatcagtattttgagctgccggcaaaaggtaaagcaagtcatcaaaacgcttgtctttgaccagtgcttgactgagcttggctcgtccagccgcgacatcgacaatgtcgtacataatccgattgtcgagtcccaagacaacatccaagttacgcaatccaatatcaagatccaaaagaaccacttttttaccgagcatggccagtgcagtcccaatattagcagaagaagtggtcttaccgactcctcctttacctgatgttataacgtaagccttacccattgatgactcctcctatctgattgtaaaacttgggattaatctgcttaagattctcaactttaccataatccagtacatgcagatcgttcacataaatcactgtgccgctgtccatttcacgtttcatgtcagcaactatttcgaactgttcgccgatccggacttgttgtgcgttatgtacatccccaataatcatcttgtcctcaagatccggtgcgccggcttgaataattccctggacgttgcccagaacaaaaatgttaccgccgacaaacagtttgccgccctcatgaaccgtgccgagaaataagacgtcgccttggatgtgaacttcctgcccgtttctaatcacccgatcaacaatgtggacgctggactgttccaaaatccgattggattcctctttagtgatcacatctgacgtaatcttatgcactgaaaacgtcgaataatctgaaaagattttctcaagttcggaacggtcagcagctggccataaccgcattccggtataaatatcaaaagcaatggtttgcggattagttgaggccgtctgggttttcaaattatccagaagttttcgaagtgaggaaaaaatatcctttagattggcattctcatccagaatgatttcataaccatccttggtgccctttaatacagctgcatcttgcattgtctactccccttcttattgcctatgagtcctatagagtgcctcaaccggaaagtaaacaattgtcaataacaccagattgagagccagtgtaggtgccaatgtgttaactaagaactgagcaacggatgagtccgtctccccaataaagacattggccatgtatcctaggctaactaaaactgtgattcctaaaaaatacaccaaaaagccactcatgaaatttggtggcaaaatttggtaaaccaattggcataaataaacgactaatgggaaaataaacacgtataccccaagcaatccagtgtagtacatatcaaaaataaagccaatcacagcggaccaggtgtatagatgtaattttttgccattaccaaagaaggctgccaaaatcaaccagaggacggttaaatatggcaccatcgtgttgggatatttaaacaaaataccggacattgtctggctgatggaaccatcaagaaagaacgcaatgaattgaccaattacaaagtaaactgcaatgggaacttttcgtttcacttaattgtccctcccatcaatctctgattgcaactgaaacaacttcaatgtcgtttaagttggcagccggtttaatataaacttttttggcaaggccataatcgtcttgggtcacttttgaaacagtacctacgtaaatccccttgggaatgacgcccccaagcccactggttgtcacccgattgccaactgataatttggcgttcgaggtaatattccccatgataatccggttggcagccgaatcatacgaggtgataataccattaacaactttggaattatcaccaagcacttggatggcaaaccggttggagttttcggcggtgttggaaattaaaaccaccttgctgttggttttgttgacttcagcaactgtcccgatcagtccaggaccggcgatcacgggcatatccttcttaataccagaagcttgacccttattaatgatcacctgacttgcccatgatgatggtgttcgggtaatgacagctgcgttgattttttcatatccggtcaaagtgctgccgacgtttaattgacgtttcaattgtttattttctcgcgacaaaacctgatccttgacctgtgtttgggtcaattgatcaacttttgacttgagacgttggttttcctgataagtgttcaaaagattcttagttgaaacaaatccgtgatgaataccgttcattggggcggcaacaatccgatcagcaaaaccaacaatatcatttccaaattgttgtaccaacggcggtgtgctccgcttgtcccgaatggcaaccgacaacgacattaaaccaaaactgacgatcaaacagattacgacaatcacaagctttcgactggagaaaaatttttgcataattgcctccattcgttattcaataatgaatcgatataaacgattaattattgttttttcttcattacattaatgctcttcaatgattctccagtaccgatggcaacacaatcaagtggatccgatgcaatggaaaccggaacttgagtggcttccgcaatcacatcagtaatatttctgagtaatgcgccgccgcctgtcagaacaattccatgatcaataacatcggctgcaatttcaggcgatgtttcttcaagggtttccttaatcgtggcaatgatggccaacactgattcgttaattgctttgttgacgtccgttccactaatttcaactgtggttggcaaaccggttaccaaatcacggccacgaaccggaacggctttgatttctttagcttccttggcagaagcggaaccgatatcaattttaagctgttcggaagtccgttcaccaattaacaaattgtacttttgacgaacatattgagcaatcgcttcgttaagcttgtcgccagccattcgaactgaacggcttgaaacaatgccgcccaatgaaatggttgcaacgtcagtcgttccaccaccaatatcaacaaccatgctaccggttggatccatgactggaagtccagcaccgattgccgcagcgaatggttcttcaatgacataggcatctctggcaccggctacccgggtggcatcaatgacagcccgtttttccacggcagtaatgccagttggcacacaaaccatgacgtatggcttacctgatgagtgtcccaaggctttttgaatgaagtatttcatcatggcaacagtggtatcgtaatcggcaatgacaccgtctttcattggtcgaacagcttggatacttgctggtgtgcgcccaatcattgctcgcgcttctgcaccaacggcgattacctcgcctgttttagtgctcttggcaactactgaaggttcgcgaaggacaattcctttgccctcgacgtaaacgatcgtattagcggttccaagatcaattcctatgtttttttccccaaatccaaacacgttatccatcccttcgttgtctatcaacttaatttagttcgatttttatagattgatttattattgtttaacgaaacaagtatatcataacgcgtccaaaaataaataaaatcaagtgaaacgacgcccgatttaatagattatttgaaattgtgatcggcattcaacaagaactttcgagcatcggaaataaaatataacgatccggtaattaagagcatatcatccggcgccagtttccgtctcaattccctgattgcgtcttgccaatcatcaatagcggaaacattttccggttgggttttcagttgactttccaatttttctggattggctgcgagccgttttcctggtccggcgaactgggtcaagatgatcgatgcattttgaacggtggccatcttgtccaccattttatcagcctgcttgtctgccagaatgcccatcaaaatataaatgtggccctgaggaaaatcgttctgcagggtatcgacaatcaggctaactgccgagatattatgcgcaccatccaaaacgatggtcggtttggccgaaattttttcaaaccggcccgcccaccgtgttgctgcaattcccttttgaatgtttctgacatccacagagcgctttgtgagctggtggtagtcaatgtatgcctggatcgccaacgcagcgttgtgagtctgataatcaccaattaaggctgtttttaaatcatgcaattgaaagtcggcggaactaaagtcaaattgttgaacccaattgtgctcaccgcgatcattgaccttaaaattctgccccagaatctgaatcgggctttgcttttgctcagcaagatttacgatcaccttgagcggttcggggtcaactccgccgacgactacgggaacgcccggcttaataatccctgctttttggaaagcaattttgggcaaagtatcccctaaaatgtgcatgtggtcccagccaatcgacgtaataaccgagactttggggataatgacattggttgaatcatacagcccaccaaggccaacttcgatcaaaacaatatcagcgtgtccttcagcaaagtacttgaacatcatagctgtcacaatttcaaattcggttgggccgccttccggcaactcggcgtcaagtttggcaatcgtcggataaatttcctgagtgagtcttagaatttcatcgtcggaaatgccgacaccgtcaacactgattcgctcattaaatttaatcaaaaatggtgaggtgaagctgccgacggttttgccttccgcttgaaacaagttccgtaaaaatgccagggttgatcccttgccattagtgccggcaatgtggatggcattgacatgtttgtccggggcacccaattcgtctaagaatcgccgcatccgttttaaggttggaattttcttgaatttggtccgtccatgaatgaaagccaaggcttcatcatatgtgttaatcattattttctccttaaaaaacgtgggcaaaaatgcggcttatagcctggcatgtgccaggaaacagcatttagtcccacgtttttaaaaattaaagtcagttaaatcactttacatctcactggaaatttgttggagccggtctttggctgcatccaattttgattggtaatcagcctgcttggccttctcttcagcaaccactgcatccggcgcgttctccacaaaccgtttgttagccagtttcttatctgaacgggccacttcggcttcaaacttatcaacatctttttgaacccgggcctgctcatccttcaagtcaaccaattcagccaatggaacaaagacagtcgcatccgtaatcaccgcagacattgacagctttggcgcttcaatatctttgccaatttgcaattcctgggtgtggcagaaccggtcaatgtagtcgcggttggattcaaagattgatttgagggtctgattgtcagtttgaattaacatatcaattggtgaggacagcggtgcgttggcttcatttcgaatattccgcactgctgtaatcaaatcaatcagtgactgcatctgatgctcagaagttggatcgtcaaattctttgtggtccactgggtagtcggcggttaccagtgacttgccaacgtgtggcatcatctgccaaatatattcggtcacaaatggcatgatcggctgcagtaagcgcagggtttgatccaaaacgtaagccaaaatgttttgggtgttcttcttcaacttctcatcgtcactgttgagagcttccttactcatttcgatgtaccagtcacagaaatcattccagatgaagtcatacaaataacggtcggcttcaccaaaattgtacttctcgaataagtctgaaacgtggttcacagtagcgttcagtcgacttaaaatccatttgtcagataattgccactcggacttgtcgggtaattccggcttgtcaatcccatcaaggttcataataacgtaacgactggcattccaaatcttgttaatgaaattccaggcagagtccattttgtcataactgaacttcagatcttggccaggcgtcccaccgattgacaggaaccagcgaagggcatcggcaccgtatttatcaatgacatccatcggatcaataccgtttccaagagatttggacatcttgcgtccctgagaatcacggattaaaccatgaagtaagacatctttaaagggtcgttcatgagtgaattccaagctttggaaaatcattctggaaacccagaagaagatgatatcgtacccggtcaccaaggtgtcggttgggaaatagcgcttcatgtcttctgtttcatcgggccagcccatggttgaaaatggccacagggcagacgagaaccaggtatccaaaacatctggatcctgctcccagttttcggcgtctttaggcgcttccatcccaacgtaggtctcaccggtctgcttgttgtaccaagcaggaatttgatgaccccaccaaagttgacgggaaataacccagtcgtgaacgttttccatccactgttcaaaggttccttcaaaacggtctgggaaaaagttgaccttgtcgttggtatcctggttcttaatggcctgttcagccagcggcttcatcttaacgaaccactgagttgacaaacgggcttcaacttgaaccccagtccgttcagaatgtccaactgaatggacaattgggtcgattgagagcatcaagccttcatcctgcaaatccttgaccatagcttttctggcttcaaaacgatccatgcctttatacttaccggcattttcgttcattgaagcatcttcgttcatcgtattaatgcgttgtaagttgtgacgattaccaaccttaaagtcatttggatcatgggctggggtgatctttaccatccctgtcccaaagtcagggtcaacgtactgatcggctataatcggcacttcacgattaatcaatggaacgcggactttcttgccaacgatatccttataacgttcatcagaaggattaacggcaaccgcggtatcacccatcatcgtttcgggacgggtggtcgcaatttcgatgtaatctttgccgttgaaagtcgtcccgtcggtaaatgggtatttaacatggtaaaaggcacctttatcgtccttatggatcacttcaatgtctgacaaggcagttcttgcttgcggatcccagttgataatgtattcaccgcggtagatcaggcctttattgtaaagcgtaacaaagaccttacgaacagctttggacaatcctttatccaaggtgaatcgctcacgactgtagtccagggaaagacctaatttggcccactgttccttgatggttcgggcaaaatcatctttccattcccagaccttttcaacaaacttttctcggcccaaatcgtaccgggaaataccctgtttacgcagcttggcttcaactttagcttgggtagcgatcccggcatggtccattcctgggagccataaagtatcgtatccctgcattcgtttgcggcgaataatcatgtcttgaagggttgtatcccaggcatggcccaaatgcagctttccggtaacatttggcggcggcaacacaattgaaaatggtttggcctttttatccccactcggtgtaaataccccttcatcaagccattcatcatatctgcccttttcaacggcagttggatcatacttcgttgacatttcgtgcaatttgtctgacataacgtcactccttccaaaattcaaatcgtttttatgtaataaaaaaacaccccatcctgtaaattaggacgaagtgttcgcggtaccacctaaattgggctgaaaagccccacttaatatcataataacggtctgataataccgactcatcttcaattgaagataagcagctcacaagctaccttcactcaacgcccggtaaaaatctcacagcaatgattttctttctgaaaccgaaacgttggctactctcttgctcaacactttaatttaattttaatcttaactaaatatctgctaatcgtcaatacgctgagcaacttttttcaaagcatttagtgcatcatcgtaatcaggctcattcccaatttccggaacaatctgacggtaaataatcttaccggtggcgtcaataataaaaattgttcgcgccaacgcaccaaagtttggcagataaagtttcattgcgtatcccagcgagaggttttcgtcggacagcatctgcaaattggcaaccccttgagcagcgcaccaattcttctgctgttcaatcgtattgttggaaaccgttaagaactggacatcaggaaacttgtcggcttcctggttaaacttgcgggtttcaactgaacaaaccggggtatcaatatccggaaccgttgacagcagggtaattctgccaataatgtcagcagttttcaccttattgccatctgcatcctcaagtttaaactttggcagttgttcaccgacttcgggtggattgccaaacatactctcttctttaccattgatcgtgattttcataaaagcactcccttggtctaacgactttatacataatgtagcctaaacaaacggaatacgcaagtccccgatcattaaagcagctcagcgaagacgtcctggttttggtttaggaattcttcgccaggtttaatatcggtaatttcaatgttgtcgattgcttttttcatcaacccttcaacatcgatatactgttcaaacttacgtgacttggccaaatcaggccgagtctttggtgccggcggtgtaaaaatcgtacaacagtcctcaaatggcagaattgacaggtcgtaagtcttgatctgcttggaaatcttaataatctccgttttgtccattgagaccagcggccgaagaaccggcatcgtggtgacgtcgttaattgccatcatactctctaaagtctgtgaggcaacttgtcccagtgcttcgccggtaaagacgccggtacaatgacgattttgagtaatttgggcagcaatccgcagcatcattctccgctggatggtcatcaaataaccttcagggaccttttccttgatggtttcttgaatctcggtgaacggtacctgaatgaactgaatattacccgagtacttgcccaacactgaggttaactgtttggccttattcagggcttgctcgccggtatatggcggactgtaaaagtgaatcatatcaattttgacaccacgtttcattgccaaatacgtggcaaccggcgaatcaattccaccagacagcatcattgtggcccgaccaccggtaccaaccggcaacccgccggcaccatgaatcttttctgatgagagaaaggcaccattcattcgaatttctactcgaatggaaatatcggggtgtttgacatcaaccgtgattccgggaacattttcgagaatataatcgcctaactggttgttgatctgattggtatcgtattcaaaatgtttatcctgacgtcgggtgttgattttgaacgtcgctccgtcatgatactgttctttcaccatttcaagagcggtctgcttgatgattgccatatccttttcaagccgaacagaaggatagaaattttcgatcccaaaaacacccttcaggctttcgatcacctgctggtcatcctcaccgtttagagccacatgaagacgatcccgttgcggcttgacctcaagcttgggaaatgggtggagaacagcccgcacattcttgccaagctgcttaataaagtcttttttatttttgccctttgtggacagttcgccataacgaaccataatttctgtatagtgcatagttactcctaacttaatttgtcaaattcttcatacaactggtcaaatacttttacgaattgtttggcttcatcaagtgtgttgtgatctccaagtgaaattcgaacggcactggtagcaatatcatcgggaacctgcatggcattcaacgtgccggattcagtatgatcctttgatgagcaggcgctggttgttgaaatgtaaatcccctgcttttcaaaagcatgaacgatggtttctccgcgaacccccttgattgcaaaacaaagaatatgcggggcaaaagtatcatcattcttggaaaaaatggtgactttatcaaactgactgatgtgatccataattaactgcttaatctggcgctcagtatcaattgcactaggttctttttcaagcaccaatcggatcgctttggccatggcagcaattcccggcagattttcagtaccggaacgttgattcttttcctggccgccaccgttcattaacggtgcaattcgacggccacggcgaccatatataaagccggttccccgtggggcatggaatttatgcccagaaaatgctgcaaagtcagttcggtcattgaaaatctgatcctgaattcccttgccgaggccctgaacagcatcgacgtgaaaatgaattttcgggtagttcttcagcagttctcccgcttctttgatcggctgaatcgtcccaatttcattgttgaccgccataatcgataccagcgttgtatccggacgaattgccgctttcaaatcagcaatcgagatccgcccctcatcatcaaccggtaaataggtcacatcatatccgagctgtttaagttgctcaaaagagttgcgcactgctgcatgctcaactgaggtggtgatcagatgcttcccaaattcacgtttttcaattgcagtccctttgatgacccaattgtcaccctcagttccgccactcgtaaagtagatttcatctgggtgaacgtttaacaaatcagcaatctgttttctagactgttccaacagattaaacgcctgttcaccaaagttgtgtaagctcgacgggtttccccaaatctgctcactcactttgttataagtgtcaagaacttctggtaagacttttgtggtggcactattgtcaaaataaatcatttgaaaccttcttctctaaatttattggttcgactccaacaaatataactcccacgatgatacacccaaactgtgagtctcacaagcattgtcgctgggcaatcaatgatggaaaacaaaaggcgaagctgttggtaaacattcagcttcgtctcatacgtcatattatgattcatcttcatcggttttttctgtctttaaatgtttcttagcattgaaataatcatctttgatcttggcaaacatccccgacgattgtttttccaatgctttggaaataatattcaaactctgctcataatcatatttttggtcaaaatacatctgggccgttttgctggccgccgcaatttcagagttgctgccaataaaccgattggcatactgcattgtctgttcggccaaagtggcatcatcaatcaactggttggtcttttcatccaaagtgtccatatccgattgaataattgttaactgtttggaaatgtcatcgacatcaatctgcggctgattcatggcatcgtccaggtgattgatttctctaatgactgccgtaaaagcatcttgataatcgttggatagtccaggaagattgtgattgtcaattcgccgtttggtattgcgcattgccaaatcaaatttggccaatgcatttctggctgcctgctcttgctctggcaacttaactgttgcggagaacaaatccttttgttcagactcgatctgacccagctctttgatcatgtgagtttggtcggcgtcaatcgttgaataaacagccgtcccattttgcatggcgttgacttcatcctggtacttcttttcaatggtggcaatttgttgatcaaattgatgattattctcaatttcttgatggttcaaaatatagcttttattcagcgtttcaagccgcagctgcaagtcgctgttctgtttacggacatgttcgatatattggccgataatcttagtatttttctcgaccttggggcgggcttggaattctttttcgattgcatcatacaatttgtcgatccggtcggcaatatcttgagtggctttttccactgaatcaacttccaaagtctttagcttattggtgttgacttttatctgatctgaaatccccttaagcgtttcatcgaacttatcgttgggaaaattatactgttttcctttgagttccttgtaaccactggtgatttcgtcaacctgctcaacaaattcctttgaaagtagttgatatagtttgggaattcgccccatataggattccaatttgtcagtcgaattgttgagatcactcaacacttcttcggcgctgttgggatccccactctttgtgagttgtgtaaattcatcgaaagttccctcaatgtccgagagcattttttccaagctgtcgatactcgggccaaatgactcgttcttgttaaggatgtcctctcgcaagcgtttgtacttcttttcgagttcttccagcgctaatttgtgctgcttgtttaaatcatatagttgagcaaggccggcctgaatttcttttaaggtggcgtcagcgtcggcgattgcctgattggcactctgccagtcactcttggtctttaaaaagttaatgcccttaccgtcttctttgactgccgcaatcccctcatcaatattgggcagcatttggttcttgtagtgctgatacttattgtataattgatcatatttcttgtgagattcaccggttaagttcattttcttagccagcgcaaactcatcatccaacggaattttatttaagtcccgtttgttctcgtaaacatcggttgccatcttgattgttcttctttggtagaaaacaaaaccaagataacccgccccaaccaacacgataattccaatcaacaaagtaagcattcgatcccatccttcagaaataaagatatataattgaacattatggtagtaaaattgcccaaaacaatttaatatgtatgaataatcaattaatgtgctctaagttgaattatatcatagtaggtccttttcaccatattatttttgaagtgaggaaaacaattatgcaaaacgttactaatttagtgaatcaacagcttgattcacttttagaaaatgaaacagatttgatttcgaacatggctaacgccactgcattgctccaagtcagcctcgaagatatcaactgggtcggcttttatcgttatgtgcccgctaacgatgaactaatcctcggccccttccagggaaatgttgcctgcatgcatatcaaaaatggtgacggtgtctgcggaacggctctcaaacaaaagcattcactacgagtcgccgacgttcatcaatttgccggccacattgcttgtgatgccaattccaattctgaattggtcgtcccactgtttaaagacggcaaagcccttggtgtcttagatattgattcgccatcactcgatcgtttttcgagtgaagacgagcaggttcttaaccagtttgccgacatcttcgtcaaacatgttgacttacagtagaaatctttatacaatggtggttgtgtaaaataacgcagcagtagacggtaagctcgtcaacatgttgttgccattcaattggttctgcaagtaactcaatcggctgcttgagcgaaagagcaaagcaacatgcacgaatactaagtctgcaacggcttattttactccaaaaaaatattggaggattacttatgtcaagatatacaggtccaagttggagaatttcacgtcgtttgggtatctctttatcaggtactggtaaagaactctcacgtcgtccttatgctcctggtgatcacggtcaaggccgtcgttcaaaactttcagaatatggtttgcaattacacgaaaagcaaaagcttcgttacatgtacggactgactgaacgtcaattcagtaacttgttcgttcgtgccggcaagatccgtgaaggtaagcatggtgttaacttcatgatcttacttgaagagcgtttggataacatggtttatcgtttaggtttggctactacccgtcgtcaagctcgtcaattagtaaaccatggccacatcactgttgatggcaaacgtgttgatattccatcatatgaagttcaacctggtcaagtaatctctgttcgtgagaagtctaaagacctccaagttatcaaggatgctgttgaagctgttgtgggtcgtccacaatacgtcagcttcgatgcagacaagcttgaaggatcattggttcgtcttccacaacgtgaagaacttgatgctgatattgatgaatcactgattgttgaatactacaacaagttgggttaatcattcagcgagcgttttgcttatgcaaaacgctttttttgtgccctcacgatcatgttataatttataggatttgatttttaaccatcacaatttgagaggaggatgagtatgcaacaaccccttgcctatcgaatgcgaccgaccaagcttgaagaaattgtcggccagcaggatttagttggcccaggtaaaataatcgaccggatggtgcgtgccaagatgctgtcgtcaatgattttatatgggccgccgggaactgggaaaaccagcattgccagcgccattgccggctcaaccaaatatgcatttcgagttctcaacgctgctaccgacaccaaaaaagatttacaggttgtcgccgaggaagccaagatgagcggcacggtcgtcctgttgctcgatgaaattcatcgactcgataaaacgaaacaagattttctattgccattacttgaaagcggctcaattattttgattggggccaccactgagaacccctacattaacatcaatccggccattcgatcgcgaacccaaatttttgaggtacatcccctcacggcaaccgatattcaaaaagccctcaaccgcgctctaaacgacaaagaaaaaggtttgggcaattatccggtgtcgattaccaaagaagcgttgaactttttggcaactgccactaatggtgatttgcgctcatcgttaaatgccttggaacttgcagtgaagtcgacacccaaaaatgatcacggaaaaatcgccgtcacccaggcaatcgtcgaggaatgccttcagcgaaaagcactcaattccgataaaaatggtgatgcccattacgatgtcatttctgcttttcaaaaatcgattcgcggctcggatacggatgcagccctgcattatgcgggcagattgattgaatcaggcgacttggtttcgattatgcggcgtctattagtgattgcctatgaagacgtcggtctcgctaatcccagtgcctgccagcgaaccgtggctgctgttgatgctgcgcgtcaactggggcttcccgaagcacgaattccacttgctaacgcaatcattgagctttgtttaagtcccaagtccaattccgcgatggccgcaattgatggtgccttaagtgacattcgatccggtaactatggtgatgtcccactgcacctcaaagatgctcattatcaaggtgccaagaaactcggccgcggggtgacctacaaatacccccacgattttcccaacgactgggttagacaacagtacctgcctgataaaattaagaatgctcagtattaccacccgaaagaaaacggtcgaattgagaccgcgtttaaagaacaatatgccaagcttagaaaatctgccggtcataaatagtattggagtgtaatgatgataattaatattttagtagcccttgctgtgttaattgccctatatattggctactacttactttcccaccttcacaaaaccatgtttaatatttcagttcaagatgatccccgcctgaaaggagctgccaaaaacggcggcatcatgttcatcattttggcagccttgggcgttctggcattaatcattcaaaatgatattctcattttagtggttcttttgtggatgactgcacatggtttggttgttgaattcgcaattctcaacgtcattaaccataaacaacggtaatagatttattcctttgtattttgccgaaagtaaagtacaattaagttaaacagatagaaatgagggtgggcataatgttacaacaacaatataaacaaattttggtcccagttgatggttcctacgaggctgaattggcttttaaaaaaggtgtagcagttgcgatccgtaataatgcatctcttcacttagtccacgttgttgatacacgtgcatttcaaaatatttcaagttttgacacatcaatggtcgaacaagtgaccgatactgcaaaggaaactttggataaatacatcgaagatgcaaaaaaagcggggctcaacgatgttgattactcaattgaatatggtgcaccaaagaccgtgattgccagagatattcctcaaaacctcaacatcgacctcatcatgattggtgcaactggtttgaatgccgtcgaacgactcttaattggttcggttaccgaatatgttaccagaactgcggtttgcgatgtcctggtcgttagaactgatttagacaataagccggcagttaatccaagcaagcacgtttaatgcttccaatttcgatcatcaaattgattaaagcaagctaaaaaggcagttaaaacaaaagtcaaatccttttgttttaactgctttttgcggctaacatgccagccatcacttaacaaaggtcggatgcccctcactttttgcaagctcgtttttgaccatctcgacgatatgggactggttgcgcttaagaattttctcagctaattccgtgttgcctcgaagttcggcaataaacatcgctgcaaactgcttcatagtggcctggacgacctgtcctttggcatacaggcattttgattccaactccgccagcacgtccaccttataaatcaaatcctgctccgtcaattcgtgtaaaatttcatgaatgagcggcagcgcccgatcatatttacccaactcggcgtacgcggcaataatatccacatagaggtcaacaatcacgatcatatcgtgcttgccggcctttttgactttagccaaaattttggcgctggaatcaatgaacccttcggcgcgatccaatttccccagcttttgataagccagaccaatgcccaaattggaccaggcttggtaaaaggtgaattcatcagcggaatactgcgtcaattgaagattgaagttgaaaatggcctcatcaatatcatcattgatatacaattcaatgaatccccgatagcaatgatacttgcccaacatatatcgggtattcaactttttgcagtcaatccgaccaatttgtctattagcgtcggcatacaaatgattccgcatatcgtcttcaatgtaagagaagactttatcaccatatcgcgtattcttggcaacatcggtaatttttaaatccagtttttggcagaggttgaccagaatgtcaacactgctgcacgtattttgattttcgatggaactgatggttgcttgggtacaaatcccttcagcgagctgaacttgggacatccccttatcttttcttgcctttttgatcaaggccccagtaatcaccattgtcatacaacgactccctatagttaacatgcttaacatacaacctgagtatcatattatatttataatcgacaatcaagaagatttttcctcatttttggcgggtaattcctcatgaaaatcacaagtgatcagatgatcattcacaacgccaaccgcttgcaaatagctgtacacagtaattaagccaatccgttgaaggcccatatttttaaaggccttcacaaacttttcggtaaatttttgatacatttttgggtctggcgctgcttttagtaaatgatccagtgaaaccccattaactggtccccaggttgcttcaaccaacattttaggattcggttgaatgactttggcgttggcaattatcgcactgacctttgcatgattacggataattcgacgatcttggcaaaaccgttcgacatctgactggtcacacttggccaaataatccagggaaaagtggtgaaagacttcatccattcccgattcaaattttaaaatcgttgaaaaagataatcctgcctgcatcgtctcaagacacagggctttgaatagtttttgcggatccttttgtacccgcccccaaattgtatcgtgataaaccaatagttcagggctggtagttgcccaagggcatcttttaaccatcactacacctcctactataaacctacgaaaaagtcacaaataattctgcaacgagttcaaaagtagaatccaacggtccttttgatagttaacccgcaatttttgaagacgcagcgcttgatcggtgacctgcccggtgatgcccagcatttccattcgcatcattgataactgactatcatctgtccaggaatagacgggccgaccggttctgccaaccgaggaaatcaagaatggattggcggtcagatgctgcagcgtgtaaaaatcgaccttgtacttgccaatattaccaaaattaagcatagtcaccagaccaacattgatttgtggaatccgttgtttaatttgtcggagaaatggataaccaaccgaatgaacccggtgtggtaaaaccgtcaattgagaggcaaactgttgggcaaatcgagtccccatctgtgggtcactgctgttagttaccttcaattcaatgatcagcggctgctttaatcggttcgccgttcgcagataatcaccgaacatatcaacatgatggaatttggtaatttctgccagattgaggcggttaatctcctgatccccgtggcctggaattggcacatcgttatcatgggcacaaataaagtgatgatctttggtttcttgaatatccatctcaacaaatggaaagtgataatggctgttacgcttcaaagcagtaattgtgtttccctgagcgttatgattaatgaccccgcggtgaacaatgatcgtgggatggccaaccggtcggacggaaaaggcgggattgatcccggcaaacagcgctgagaagataatcagacatccgcccacaccagcaatcagcccctttcctgtcagccgggcaaactgaatccccagcaggcgaccaatcacaacgatttcaacaaatggagccaccacatcaatcgttccttgtgacaaaaagaataggaatgaattgggaagcaatctgttcaaccagcccagcccaacaatcaacaggcagatgccaaccagcatcaaaaataataagcacagcttttgggcatactttttcaacgtcattaatttaacagtctgtttcaaagcttgaatcggataatcgccatccgcagcaagcagatttagcgcaaaatgagaaaaataaatcccaaccagcaataaaccaaaatagccgacgatggcagtcagcgcaagcggatagcgattgactgtcagccaagtaaactgatccccagaaatcggcaccgaaaacttaatgaaatttgagaagccaaacaggcctaatggcaccagcagaacaaacaggtaaacaccgcttcccagcagcgccaatagtgaccacgttcggctcaaaattgtcttgtgaacggtttggacgatcccataataaaatagaccgaccaacagtaaaaacatcgttagtgagcaaaataccaccgttgcgaagctttggtaagtgtccagaaaacgtctcaacagtaaaataaggacgatcaatgcccccgttaaataatcataaagtttggtttcattattccccatcaaaaaacttccctacatgcaaaaaaaccggcagcagaattctgcgccagtttgattatgctatttgttaatattttgatcgcgtggtggcaatggcttaaagtcatataagatttttgactgacgttcaaactcatcaatggcaagttggatcaggcgatcgattaattcagaatatgaaatgccagaggcagcgaatagctgcggatacaaactgatgttggtaaatccgggcagcgtattaacctcactcatatatggcttgtcgtctttagaaaccagataatcgatccgagccatccccttgagtcccaatgcccgataagttgtcaggcccatttcagtgatctgttgggcaagttcttccgagatatccactggaacgtcaaatttaacctgactggcatcaacaaacttattgtcgtaagtataaaaggcgtcgtctttgggtacgcgaatggccccaatcttggatgcgattggatgatcattacccaggatagaaatttccagctcttccggcccctcaatcgcttcttcgatcaagactttgctgtcatatcggaaagcatcgcgaatcccttcggaatattcctcggcattttcaactttgtgaatcccaaccgaagatccctggttagccggcttgatgaacaaagtctgtcccagttcatcactgagagattcgtagctgtactgctcggccgtcagcggggtaatcacttcatagcgggtggttggtactccagccagtttgacaatcttcttggtaatgtctttatcaaatgacatggctgaccctaagattgccgtccccacatatggtttgtgcaggaggcgtaatagtccctgaatcgttccgtcttcacccaaattaccgtgaataatcgggaagaaaacgtcaatatcggattcttcagccaggttgattatccgagccaaaggattcttgagatccaatttagctaattcctgcttggcaacttcgtcttccggttctccgtcgaaaacccgagaggaagcttcatgatccaggaagtagccgttcttggtcatcaaaaacaaactcacatcgtaacgctctttatccatcgcgtcataaatgttatgagcagagcgttttgagacatcatgttccgaagagttaccgccaaaaatgaggccaatgtgttgctttttgtgtttttccatgaattctcatccttttataaattcgtatagtttccagaaacttaagtatatcacggaacttcacagttgaaaacatttacaaacgcttctcatcacatttttaggctgaattcaccgatcacaattattcacgttttaattgtttcttactgaacaagtagcgggtgatcaacaacaagatcacagaaacgatcagcatgctcacaatcatcggaaatggatcgtaggcaccagtggcccgccagccgaggacaaatttggcaaaattggcaacccaggtcatctgaaaattgcgatccaaaatgacccgggacgcggtgtacatcacggtgatgtagccgatgaccggcgtggcgatcaaaatgatccgctggacaaatttagagaacaacgttagaaagttcccgataaccatcccgctcaaagcgccaacgattaacaacaatccgctaaaaataaagttgaacaaaaatgcgacaattggattattaaagtatccagcgtacgaggacatgtagatgttggtgtctctggcatgccccaatggcatcaagacagcgtactgatacactaagttaaaggtattgccgatcaggattaacaagccattgacaatgacttgcgcattgaaaaaagtttctcgggaaatcccattttggatcaaaaacttgaagttttcataggacagcgttgaaataacaaacatatacaggccaaacgccgccgtcacccaggacccctgcatctgattggtcaaggaataatcattcagagatcctgagaagctgtttagtatcttttaagaagtaacctgataaaagctaacgaaaccatcatgagactagtgttgagcttacgctcacagttacgccataaacggtgataatttcccaaccaactaaatgaacgttcaatgagccaccgttggggga

SEQ ID NO: 171 - DNA, 1304 bp, Lactobacillus buchneri
cggcctttaaaacagactaagcttgtgatgaattaaaacccgacggggctttagttcatcactttttggtataaagtgattgtgaagttagtaatgccgtgagcatatttggcgctggacgccgtctctaaaactggctaacttcactgttcttatacaaatctgctctaagtctgttggcgtttaacgtcgtgtattgaaaattagattatataagacttgaagcaacaactttaaaggtaaggtgatattttatgcgagtaacgtttggaattgatgtcagtaaagcaacttcggaaattgccatagtcgttaatgggcaagcggttagccattttaaaattacaaataatcagccgggatttaataaactccaaaaaagtttgaatgactttcaaaaccctgagattgtttttgaagcaactgggttatattcaaggagattaagagtgttcctagatgattatggttaccgctacactcaattgaacccattagcctcaaagaagcagcttgatcgactccgtcctaataagactgacaaaaatgatgccttacacttagctgaaactcagtttgagatcaggcgtgctttaacttatcagcaagatccaatataccagcagttacttgattggagtcgcttttatgatgagattacttgtgactcagtcgcaaataagaaccgacttcataaagcccttcagtgtacatttcccgaagctgaaggcgttcttaacagtccaacagggcacttatattggcaccttttacaagcgttcccgattgcgagcatggtgcgacaaagtagttcaatggaactaagtcagcatatcagaaagttctgccagttatctgtcccaaatagccaagctttagccgctcggctacgtcaattagcctcggagtcctatccttgtgttggggaagactctggagtggttatgcaggtccgttatttggcaaccgagttacttagattagatgacttgaaaaatgacatcattcaaaaaatggctcgattagctcaagacttgccagaattggccattttggaaagtattccaggtatttccgttaatacagcagtccgcctgattggagaactgggagatatccgtcggtttacgagtgccaacaaactgaacgcgtttgtcggcattgaccttagacactttgagtctggcgaatatatcgccgtcgatcatattagtaagcgtggtaatccatatgcccgcaaaattctgtatcgaacaattctcaatatgatggtaagtgctcgcacaaagccatcccacatcaat

SEQ ID NO: 172 - DNA, 55841 bp, Lactobacillus buchneri
ccacggtaaatagtcgtggtactgatctgcaccggatacttttcgactgccaagcgattcgatatttcttccggagaccaaaggtcttcgcagaagtgttctctcaccacttcaaacacctgaggattactcaaaagagagactctgccacaattgcctttgcgctgtttgtacttctcctgagccttcgaaggtgaataggatttaccagtagaattacggcttaattctcgagaaacggttgagtaacttttcttgatatggctggcaatctcacgaagtgagtttccatgattcctcattaaaaagatagtttcccgttcatctatggtaatatgcttgtagtggtccatggctaaattcctttcatgattgttttcgcaaacatcattttacagaaatttggccatgggccattctttatttaattagtgttgcacttaaagtgtaaattcaagaacaaaaaaagcattcattgctgaatgctttcatttgtttagtctttggggaatggtatataaggtttgttttcggtattggtccgaataaccatgacatcacacttggcgttgcggtcaacaaatgaagaaactgatccttcaaggactcgctgcaggcgactcataccggtagcaccgataataattaaatcagatttgtggtctcgtgggaattccattgaaataacggtcttaggattaccaaaacgaatatggattgaaatatcatcaaggccagattccttcttaatccgatcgaccagtttgttcagataatcagtggtatcttcaacaaggttgttaatgacgtccccgtcgaccattccaccatagttataaccgtattgttgtgtgctcaaaacgtgaagaacatcgagatgggcatcattattttttgcaaattgtgcacctttcgccaatgcatcttctgattgattggatccatcgacaggcactaagatggttttataattggattccatgaagaaacctcccacaaattaatttaagttcattatatcactaattattccagcgaatggcgcttaaaaactgaaatacagaatcattttcagaaaattacggtttacttggaacaatgaattcggcagtttcaaggatatgaccgcgcatggcgtcctgtaattcgtttaaccagaagccgtctttcaagggcaactgggtgtctagtgcaaagactgataaatgatagttgtgaactttgtcgggtgggttgggaccattgtagtgccaggcagtcgtctgattggtgttgccaattagcccgccggcagtgctgttgcgtccttgaatcattggaacccttaattgctgactgttattttcagggatttcagtaacgtcaggggcaatattggcagcaatccagtgaatccatggaaacccgctaaccggaaccgcgtcccagtccaataaagtgagtgctaatgattgcgcgccctttggaacgttgctgatttgaattggaaatgaaacgatcggctcaccgtcaagcatgtcgttttttgcagcatacttactgtacttatctgctaagagaccctttgttaaaggaacttgtatatccatattgatccctcctccatctcaatgatatgtcttttaatcgtagaataaaataatatgaatccaactatttgataaaccgtaagacatagtatccctgtccgttcgaggtaatcgtgtagttgacgtaaccagccttcagccattgctgcttggtggcatttgcccagttcttggcatcctgaacagaggcaaaagtgtgggtgcttgagaattggtcaggagctttctgtggcttagccggtttatcacttttgacgccgttcaagaggttttgctcctgggacttgacggattggttctgctcttcgttgatggtttgctggaattgctgacgttcttttggattgagtccattttgctgagcatccttgagcttactgctgaatgcattcacccgattcttctcaacttgggtagtcagcgatcccttcttggaattacccgacaattctttctcggattttttgatggtcttactgatcgaattggttgaacttccctgtcgatgattgccagatgtcacaaaccaattgattgaaagtgccaagacaatcccaataatcaaaatcagcagagcaaaccaccagccgctgtattgtttgcgacgctgtcgacgtcgattttcttcggaattgaagtcatactttttatattgtggttcatcgtcatgcctattcaaattaatacctcatttagattctcttattgcatgttgatctagttgaatatattataacagatagcgaaaaacttgtatttttaaaccttaaaggatggcaaatatggacagaaatgaagttaaaacatttcctgaattgaccactcaagaattatttcagatctacaaattaagagtggcggtttttgtggttgaacaaaaatgctactaccaagaagtcgatgatgacgatttgaccgcttatcatttgatgtttaaggacgaccaaaacaacatcaccgcctatgcgcgggttattcctgaggaaaacgccacggttgcccggattggcagggttgtggttgaccccaatcatcgcggcggtggtctgggacgcgagttggtgcaaactgctcttgatcgaattccaacattgatgcccaagaccggaaaaattgtcttagctggacaggagtacctcaacggattttacaaatcgtttggttttaagaacgtcagtgacgtctatctggaagacggcattccccatattgatatggaaatgcagttgcaagattagattgacaagcaaccacggtatattataattatcacaacgaatgaatctttaactctggtcccgtgaggctggtaagaggacgatattgaacgagcaattgctcgacttggtgtctgccttgcctaacgcggggtggacaccttttttgctgcatggctttccaggtgagagtctgccacaattcgtcaaaagggccaccctgaagcggagttgaaagattcaaatactttttgagggtggcaaatatttatggcagacaagaatgaatttcatgatgatcgtgcaattctcgacatccatgacatgcccaaatttttcccgtggattggattatcattgcagcacatgttttccatgtttgggtcaacggtcattgttccactattggttggattgagcccaagcatcgcgttgttcgcatctggtgtcgggacactgttacacattatgattacccaacgtaaaattcctgcatacatgggatcaagttttgcgtttatcacgccaatgctggcacttatgaagaccactgggtatccgggaatcgctcaaggggtcattggtgtcggaattgtgtatatgattgtggcggccattatctgggcggttggctcggactgggtcgaccatattttaccgccgattgtggtggggccgatcgtgatggttattggactgtcattggctggtagcgccgctcaagatgcgatgatgaaaaatggcaagtacagcctgttgtactttatgattgccttggcaactttattcttagctattatttttaatatgttattcaaaggcttcatcggcctgattccagttttgttagcaattgtttgtggctatctcatctcagtcttctgtggcatcgttgatttaaatgcgattgccagtgccccatggttcaaaattccagcctttgatattcctggaattgattacaaatttcacattgattgggctgccatcttagcgatcacgccaattgccttcgtgacgatgaccgagcatatgggccacattatggtcttggatgaattgaccggccgggacttcttcaaggatcctggtttgaaccggacgttagccggagatggtgctgcttcgctgtttgccggtttagttggtgcacctgccatgaccagttatggtgaaaacattggtgttatggcgattaccaagatccacagtgtttatgtgctgatgggtgccgccatgtttgcgattctgtttgccttcgtaaacaaattgaatgttttgattatgcagatgccgatgccggtcatcggaggaattagcttcctgctgtttggaacgatcgcaactgccgggattcaagtgatggttgaaaataaagttgatatgggcctgaagcgcaacttgatgattgcgtccacggtcatggttatcggtgtcggtaatgcttatctccaactcggtaagttccagtttaccggcttggcatttgccacgattatcggaattgttctcaatttggttttgccacaaaaagctgccagtgaacgggagcatgaacaacagttagccgataaagctgctgaggaagaaaagcagcgcttgcttcaccaacgccatttgcataaataactcaaattttgtacactactcctaattgtcaggagggatggttacatggaacaagctcaaccagcacaactgaagtataagcatgccagtacggcggccgactttaacgccgctaagcagatttttcttgagtattccaagtcactcgggtttgacctgggattccaagacttcaatgatgaattaaatgaattagcgacccggtataaccagcccaaaggagatctcatcttagcttatgtaaatgactaattagctggtgtggtcgctgttcatgaatttgaaccggggattgctgaaatgaagcggctttacgttcgtgacgacttccgaaaactcgggattggtcaggaactggtcgccagaattttagccagtgccgagcgtttgggctatcaggcgattcgtttggacaccttgaaatcaatgaccggggctttgaaaatttatcacgccgccggttttaaaccaatcgacccgtaccgcttcaaccccttggatggcgcggagtatttagagttggattttaaataattgaatatgggatcatgatgttgattccagaaccgataaagaagaggctgagatctaacaatttgttagtcatctcagcctcttttgagtgccactgttattttgattaaacgtgtgaaagcggacagcaagcgagatttaagcaccaccagccgaaaacctgactcggtttccgggtgttttactgttatttggattaaacgcgtgaaagaggacagcaagcaagatttaagcaccatcacccgaaaacctgactcggtttccgggtgatggtgcttaaattttgcttgctaaacgtcctctttcacactctcttttattatccttgtaaataaacactattccttcgaacaaccggctgcttgagcagtgccagcagcattgggataaccaacgcaatcaccactttgacggccacgttttcaataccagcctgttctgcgatgtccagcagggcgccgtgtaaatacataataatcatggtgtgcttaccaatggttgaaagcaacaagccaatcgacagcttgctggtaagtgccgatagccccatcacaccaaatgaaaaaatcagtgggatggtggccagcatcaagattttcggctctgatgattgaatcagatgagatttcatcgaaaattcaaagctgaatttctgattaagatacaagccaatgattgccaaggaagcaccaaccagtaatccaatcggcaatggcttttcaatccagtgccaatttgtgtggaaaaacaaataaccgacgtaggtaaagaatgccgcaatcaagacgatatccaagttccagggcattgtttgataactgtacaagttcaaccaatcgattttgtcatagcaggtagagacaaataatcccaacccgacaattgtgagctgaccaattctggatttaacggtcgaaatcagcagggtcaccgccgtaattgacagcaggtagacgttcacaaaccagaacgttgacgtgtacagattcaatgtccggcccccgaccaacagtctcgagaggtggttaatcaagtaatcccagtttttgtcatacaagatgctatacaacaggatcaagccgatccccgcgataaagtagatcaggagatcccggtaaatacgtttattaaagaactttttctaatgagttaatttagttgtgtcaatcggcttcaagaagaatccgccgacaatgaagaacaggggcatgtgccaccaataaataatgttggtggtcgtgccgctggctaacgcgtggccaaacaccaccgcgataataccgtatgctttggcgatatcaatccattcaattctctttttcaacatagctgttttgcagtcaccgtccttagtaaaaataatctagtttacttatacattattgaccttaaaacagacttaaatcaaaactggggtctggcattttgcaccaattaaataagagcaaaggcaaatgcctgagctcttttgagtgggatgattagtcaacactggtaatgaaatgttgaaagattcgatttttagtaattttgccgacgactttggttggctggtccttatccaccactggcagagaatcgactttacgatccaataagagctgcccggtttggaggaccgacatatctggggtaacggtgaaaatattgggcattcgcgtcataactgtactggcaagtgtcagtgaagcgttggtattattcagggttgcccgtaacaaatccttgcgggaaattaagccgaccagttcttgacgatcgccaatcacgtaaagggaaccgacatcctcgataaacagggtgttgaccgcctcggtcaatgtggcatcttcacgaatctcagttggtttctgcagaatattagcgatcggttccgcataaagcttgtgatagcttaaaggcttggcttgagaatcattgtaggtgtaaccaactttgggcttggcttccagaatgttgaatgccgtcaggagtctgaggtcggatcgaatggtcggcatactcaaccccaactctgcagcaatttggcggctggtgatggggtctttctgtttaacaatgtcgacgatttggttttgccggtcggatagtttcaagttaatcgctcccactttcgatagtcgttggtccgtaccactagtccaattctatcatatctgatcaaatatgtatccaataaaacgtcttatttcagaaaatggattggcagtaaaattctttttcaacttgccaacccttttaaaaccaacatttcatcgtcattcaataaaacgttttttaaaatttaatttgcattattaaaacgtatcatatatgataaacgcatccaatataacatgctaattagttcagaaaggacgttatgatatgaaatacatttatcgctttgaagaaggtaacaaggatatgcgtcgtttacttgggggcaaaggggctaatttggcacaaatgacctcactggggttcccggttccgagtggatttacgattagtaccgaagcctgccaggcattctatgacaatggtaatcagttgaatgacgacacgctcgaacaaattgatcaggcactcgaccaattaagcactaaagtggggaaacgttttaacagcccggataatccgttgctggtttccgttcgttccggggcggcaatttcaatgcctgggatgatggataccatcttgaatattggtttgaatgaccagacagttaaaactttagctgcgattaccgataatgaacgatttgcctacgatagttaccgccgtctcttagcgatgtttggcaacgtggtgtacgaaatccccgaggacatttttgaccagattctcgaagatattaaaatcaccaatcattatgactccgacctggacttgacggtggcagatttgcacacaattgtcggtaagtttaaagaactctacatagccgaagccggcaaagagttcccgcaggatcccaaagttcaattgcttgctgcagtgaatgcggtctttgaatcatggaacaatcatcgcgctcaggtttatcgctgggaaaatcatattgccagtgatttgggaaccgccgttaacgttcaaatgatggttttcggcaatgccggcgaagactcggggaccggggttgcatttactcgtaatccagcaaccggggagaacaaattattcggtgagtaccttttaaacgcccaaggagaagacgttgttgccgggattcgaacaccccagccgatcagtacattagccgacacaatgcccgatctttacaacgagtttgtggccactgccaagaaactggaaattcattaccgcgacatgcaggatttggaatttaccattgaacacggaacactgtacatgctgcaagcccgaaacggcaaacgtacgccgactgcggcagttaaaattgcggttgatttagtcgaagaaggcttgatctctcggacggaagcgttgcttagaattaatccggattcaattggcgcgattctctacccagaatttgacgaggaagccttgcagcaaagccagccggctgccagtggtctgccagcctcaccgggagctgcttccggccagatctatttcaccgctgagtctgccaaagctgcccacgatgatttggaacagaaggtcatcctggttcgacaggatacgtcaccagaggacattgaagggatggtcatcagtgaagcgattgtcacttcccgtggtgggatgacttcccacgcggcggttgtcgctcgaggcatgggaaccccagcgacggttggggtgaatgatcttcaggttgactatcaaaacggggtcgccaccattgccggaactgagctgcacgaaggagactggctgtcagttgacggcactaacggtaacctatatttcgggcagattcagaccaatgattcaaaggtcaacgacgacctgtcgacaattttggattggtccaagcaggaaggggacctgggcgtgtatgccaacgccgacacccctgccgattttgcccaagccctgaaattcggtgccgacggaattggtctgactcgaacggagcacatgttcttcaaaccggagcgactgctggaaatgagacggttgatcatcgcagaagatgccgaagaacgaaaagcccccctggcagagttactgcagatgcagcagggagacttttacgaattgttccgtttatcggaaggccgttcggtcacgattcgtttgttggacccacctttgcacgaatttttaccgcacgacgccaaagaaattgctcaagtttccgatcagttgggaattgacccggaatacctggttcgtcgagtggatgccctcaaagaaatcaacccgatgctcggccatcgtggcgatcgattggccgtgaccttcccagatatctatgagatgcaggtacgggcaatcatcggggctgctttggagctgcacacccaaggactggagattcagccacacattatgattccactaactggttccaaggctgagatgagctgggttcgagacatcgttgtgaaccaggtcgaaagcttatttaacgagcagggaaccaggttgaaatacacggttggaacgatgatggaaattccgcgggcctgcttaactgccgataaagttgccgaagtatccgacttcttcagcttcggcaccaacgatttaacccagctgacctatggcttctcccgggatgatgtgggttcgttcatgccagaatacattgagaaggggcttctcaaagcagatccgttccaaacggttgatgtagacggcgtcggtgaattaatgaagatggctgttgagaaaggccggtttaccaaacccaacctgccaatcggcgtttgcggagaagttggtggggatcccaaatcaatcgagttcttcgagtcgatcaatgtttcctatgtttcctgctcaccttaccgggtaccagtggctcgcttagcagccgctcaggcgaagattaagatgagtaagaaacaggatgtgattgcgaattttgtgaagagttagcgtgtgaaaagttagagtattatatgtatgcaaaaaggctgccaaatcggcagcctttctgtgatgaaacaacttaatctcttggcgcgaatcccattggtccatgaccgcgaggatcgccgtggggaccaccaaagccgtgatggccatgagggccgccgccaaatccgcggtgagggaaatggtgtccccaacctggttcgtcgtcgtggtcagggagtttctctttgagtgacgtgttcaatttactcaacagttcgtttaattgagccaattcctcatcagagagccccgcaaaaatttggtcgagcatgtcatcagtggaatcatcgtcttcgatggctttcttgccttcgtcggtgatggccacgttggtaactcgtttgtcgttctcgtcaggagtccgggtgatcaagccgcgctcttccaacttggacaacaattcagtcattgatgatggtcggatgtccatgatttcagccaactggctttgaatcagtgtgccttccttggacaggataaccaggactctgttttggccccgcaaatggtaaggccgttcttggtgacgggcaaatcgttgggttccatgaaggaagccgaagaacttgcctaatagttctcttttattaatgtctgccatattcattctcctttgaattgttatacttaggtacctaacaataagaagtatacactgaatttttttgaacacaagcaaagtgtttcggtacctaactattataacgaattacaaattggctttaaatcagattggttatcgactgaatattagtaagtcaaaaatgtaatttcttgaattttagcctcaacgtttttacactaaaagatagtacaaattgagtatctaaagggggagtatgaatactgaactgttttaatgtatttttgtttcaaatgaaagggattacaagatttgattgattcagaaatgatcccctaaggagggataatcgtgaaagcacgtcatttaagtacgttctttattttcttctttggtgcattaggtggccttctatttggatttgatactggtattatttcaggtgcctcaccattgattgaaagcaattttaatttaggaactgaacagactgggttcattgtctcgtctgttttgattggttcatctgttggtgcgttgtcgattggttcactttcggaccggtttggtcgaaagcgcctgttggttttagcctcgatcctattcttaattggatcaggactgtcaatgtttgcccaaggatttgtatcgatggtcattgcccgaatcatcttaggctttgctgtcggatctgcgtcagctttaacgccagcctatttggcagagttggctgatgcaccgcaccgtggctcacttggtacgatgtttcagttgatgattactttaggaatcctgttagcatatgtttccaacttaggattcttacatcacaatctgctgggattacgtgattggcgttggatgcttggatccgctttgattccagctttgatgctgtttgttggttcaatcattctccccgaatcacctcgttatttggttgaaaagggtcggattgatgaggctcgggacgttcttcatgaactccgggcaaagactgatgaggatccagacaaggaattggcagggattcaagaagttgccaaccaacccaagggcggtctcaaagagctgtttacctttgcgcgcccggctgtgattgttgcgattttgctgatgctgcttcaacaattagttggaattaattcagtgatttatttcctgccgcaagtcttcattaaaggctttggtttccctgaaagtaacgccatttggatttctgttggaatcgggattgtcaacttcctctgcacgatcttagcatacaatatcatggatcgattcaaccgaagaaccattctgctatttggttcaatcgtcatggcattgtcaattggaattctctcaatcttgaacttcactttaaaagttcaagacgctgccgttccaaccatgatcctgattggaatttatatttttggtttcgcggtttcatggggcccaatttgctggttgatgatcggtgaaatcttcccattgaatgtccgtggtgtcggaacttcaatcggttccgctgccaactggattggaaacttcatcgtttcacaattcttcttggaattacttcacatgtttaacaacaatgttggtggcccatttgccgtctttaccttctttgccattgtttcaatcttcttcgtcatctacatggtgccagaaacccgtggcaagacgcttgaacaaattgaaatggatatgcgtaaaaatgccgctttgaagtcggctgctcaaaacaaataggctcgcttagattaatagagacacaaaaatgctcgagaacgattggttcccgagcactttttatatttcacgaagatcactgttaatccgtgcagagacgtttaattgcttcagcgtaaatatccattgccttgtacatactcttaagctcccaattttcattgacctgatgcataaaatcaggggttcctggcagcatggcaccataagccacgcagttgttcatagttcgggcaaatgtggcaccgccggaaatttgcggttgggtgtcatcgccggtcaaatccttgtaggttgacattaacgtcttgactaaatcactgtcggtcggcacatacagtggggcaacgtagtcaaatgcctcgtagtgcaggtcatatggttcagccgccttcttgagcttttcaatcaattcatcatgatcaactgttacaggaatccgcatgtcgacttgcatgcgagtttctttttgatcaattttgaggcttgaaatattcatggtcaaatgaccagacgcttcatcttcgacatcaccaagcaaattggtaccggtagcgtcctcttggaatttcttgccaaagaagtcgagtacggggctgtcaaagacgtcgtccaaggcaattgccaaccgcaggactgcattggtgccttgaggggcgttcatagcatgaaccgctttaccaacgacggtgatgccatcagtgccatggtcttcgtatttgaagccgtgtttgtccagggatgccttgacttcatccagctttggcccgttgtaaggggctttggcaggaacggcgttaaaagcattttccaaatcaagggacagatcatccatcccgggaccaaccaggtaggactgctccagccccttttcagcgtaaatcagtgggaattcggcatcgggtgcgattccaaaatcgattggagattccttttggttatacacagcaatcccacgccaaagggtctcttcgtcggtgccgaagataaatcgaatgcggcagttgaacttgtacccacgatcaactagggctttgacggcgaacatggctgccatcgaagggcccttgtcgtcttgggtgccacggccgtaaatgtaaccgcctttgatggttgcggtaaacggatcggaatcccaatcatttggatcaccggccgggacgacgtccatgtggccaataatcccaaagatcttctcgccggaaccaatttcagcatagccataatggccttcaggatctttaaacgtcttgaagccattttcttcagcaatctttaagacttcggttaatgcgtcgtcgattccttgaccaaatggcgtcgttttggaaacggtggctggatcattgactgaaggtttgctgaccaggcgttttaagccttcaacagcttcgttttgttctgtttctgtgactaatttttcagacatttttgttggtgcctcctaagttgaattttttggttttttggttgttgttagtggtttttgtttgaggtagatgggtgtttgtggttttctttttacctagtggaaatgcgctccgacggccctaacccctactgtgtaagccaaaaagtttaatgatggaccaaaaacgtccatcatcaaactttctggcttacactccggggccacccaggtctcgtcgcgctctgattgaaatgcgttccgacggcccagatgctaacttctaagtgcactttaactaaaatcccaagaccagggatttcagtcaaagtacccttagaaaccgcatctcccgtgcctcgtcgcgctctctacaacagtgccattacccccaggaaaatcgcagtcgccaagaacaagtaaaccatcaatttgaacatgaatttccaccaagtggtgatgttgacgtgggcaattgtcaatgctcccatcacaacacctgacgttggtgtgatcaggttaacccaaccggatgcactctggtaagctgttacaaccaagcttgggtcaacaccggcgaacttacccattggcccgatgatacccatcgtagcggctgccaggcctgacgttgatggaatcaagaaggacattgggatgtagaagatgtatgccaagatgatgaagacaaccgacccgaggttggacaagcccatttcaccccagtggagaacagttgcggtgatgtttccatcattcatgacaacttgaattccacgggcaacagcaacaacaattgctacacccatgaagtcactcattccggctaagaatgattcgataaatgtggattccttcatatggaagacgaacatcaccacgattgccatcaagaagaagagggtcgtaatttcagtgaagtaccaggaaccaaatggtaccaggttggaaccaaccagactacctaagaatggcacatcttgaacccatttggtgaaactggtaaagaaggtccagttcttgttgatctggtcccatggaatcaagcccatgatcataaccaggaatgtcaaaccaaacatccagagaacagctttttgtcggccggtcatcttagtgccgggttggtcttcatggttcaacgcaaatcgtttcaaatcttcctcacgctgttcaaagacgtaagaccttgaaggatccttttcaattttggcagcgtatcggtaaacaaacaggatactgattgccaccacgatgacaaacaggaccgcccgggaaataatcccatctccgggtgaaatgtgcagcgtttgtgaggcaacaccggtcgcaaatgggttaaccgtggatgccaaacatccgacctgcgaaccaaccaggacaattgcaacggccactagtgaatcgaagccgaccccaatcatgactggaattaacagtgggtaaaaggcaatagtttcttcagccatgccgtaagttgacccaccaagtgcaaacaaaatcatcagcaggggaatcaaaactttttccttgcctttgtattttgacacaacagtcgcaattccatcatcaagcgccttagtttgattgacgactcccaagaagcccccaatcaccaggatgaacagtgaaacggagatcgcgccttccgtcgtatcatttccgaccattccataaatcggggcggagaagacgtcccagattccctgcggattagaagccaccgctttgtaagtgtgggcaatgatattgccggctttgtcggtgctgtactgtccggcagggatgatccaagttaaaatagcaacaaaaataatgatcagaaataagatggtgtaggctgaaggcatcttaaatcgacgtttctttggagttgattgttgattttgcataatgttcacttccttttcctttactgactatagtttacaaaaaatctataaagattctgtgaagaaaaatcgaattatttacataagttaaaattatatagaaaattcacaatcacaaatgattatagacactttgtacgccctcattataaataggaagatatagaatatacaaagaaagcgctttaaaatttctcataaaccgaatgccaggtctcattttgctcagattttaaaggatttgaactttctctcaaaaatagaagcaagaaaaaaggccggtacatgcggattcgcatgcaccgaccaagttgacattttaattataaaagcaatcgtgcgttactcttcaatatcattaaagaaactcagcaactcttccttggtgagattatccttctcgtcaccggagatatcgtaagtgattcgaccgttatccaagacaattaaccgatttccgtatttcagggcatcatccaaatggtgggtgatcatcaaacaggttaaatggttgcgggtaatttgatcgttcgtggcagtcatcaattcttgcgaagtttgcggatcaagggctgcggtgtgctcatccaataacagaatgtcggggcgcttgatggtggccatcaagaaactcaaggcctgccgttggccaccggaaagtttaccagttgccgtgttcagccgatgttccaaaccgttattcatcactgaggtgatttgcttgaatttatccatgtgtgtcttgagatgccgcggtgcaaagccgcgacgctggccacgtttctcagacagcagcagattttctgccaccgtcatccgtggcgcagttcccattttgggatcctgaaatactcggcttaagaaccgggtccgcttttcaaccgacatgctcgtgatgtccttgccgttcagcagaatttggccgctggtcacagggagattgccgccaatgacgttgaacaaggtcgatttaccggccccgttggaaccgagaatcgtaatgaagtcgccagggaagacggataaattcacgtgatccatgatgttaatctgctcaggtgtgccgtggttgaccgtgaccacaatgtcatttaattcgaagattggttcagtcatgtttggtcatcccctttgctaaagtatggcggattcggaaacgtttttccaaaaccgggaacatcatgaataatgccaagacgatagctgaaatcaggttcaagtcgttggcattgaagccgagtttgagaaccagcaaaataacaaatcggtacaagatactcccgatggtcactgcgatcagccgttggttcatcgtcaaatcgccaaagacgacttcaccaataatgatggaagccaaggcaaccacgatgacaccgattcccatattgacgtcggcaaaaccattattttgagcaaccaaggcgccaccaaggccaattaaaccgttagaaacacccaagcccataatctgcattgcatctgtgctgatgccaagtgagcgggccatgttgggattatcaccggtggcaataaatgcttggccgaggttggtctggagaaagtaaacaatgagtgctgtgacgatcgcaaccacgacgatcccaagaacgacactgtcaaaatagggtggtaaggattccaaaaagtggttctttaacatggtgggtttgtcgaagagcgataaattggctctgcccatgattctcaggttgactgagtaagcagcggtcatcaccagaattccggcaagtaataccggaattttacctttggtatacagaaaaccagtcaccaaaccagccagcatgcctgccacaaaggcaatcaaagttgcgactagtggtgaggcccctgaataaatggcggcgacacaggcagctgcgcccattgggaaggttccttcaacggtcatgtcggggaaatccagaattctaaaagtcaggaataagccgataccgacaattccccaggtcaatccttggccgatggctgagacgataatactcatttgatcaattctcctttttgttgggcttcttttaagaggttggcaggaatcttgattcccaacttgttagcctgcttttcattgataattagttttccatgacggaagaatttaatgggagtggttgatggcttctttttacccttcaaaatctgggcactcatcttaccggttgcaacccctaattgatattggtcgatgccgtaagttgccacgccgccttgcttgaccatcgtatcaacagctgggaaaaccgggactttggcattattggcagcgccaaccagtgtctgcatggctccggcaatcgtgttgtcagttgggacataaatggcatccactgaacgaaccgcttgttcagcaacctgggtcaaatcgttggtgttggcgattgagtatgctttgagacggacgttttcctgtttgcataatttgacaaacatcttgtattgggcaactgccgagtcatcactggaagtgtagataattcccaaggttttcatttttggcatgaattgcttgatcaaattcagctgttcttttaaaggtgcctgatcggaaacgccggtgatgttgccgccgggtttttcgttgttcttaaccaagccagcgcctttaggatcagtgatggcccccaagatgaccggtttgtgggtaatggtgttggccaatgcctgagcagatggggtggcgatcccaattgaaagatcggcgtcctcgttggcaaacttggtgctcatggtcttcaaattactttgatcattttgggcattttgaaagtcaattttgatgttcttaccaggtttatagccctcttcttcaagaccgtggataatccctttatggatggcatctaaagctggatgggacatcaactggagaatccccacggttggtttggcctggggcttttgcttctgttgcccttggaaaaatgccacgcccaagattacgacaaaaattaacacgacacctgaaattaaatattttttcttcataatagctgtctccctcaatttgaataaatatgtaacgccatcagttagttatgcgaacaaaaaacgagcattccggtctgaccgaaatactcgtgataagtcggcctgccgaaatcatctggccagaccgttcgttttccgaaagattgccggcacagatgcgttcatgatcgcatgcttaagatcaagtcgcatctgtgtcgatgtgacttgttatcggctttgccaactgcgattaacaagtgaactcatagcaatctttcctttcgtgatagaatacctataattttaaatgattgtctacctttcgtcaacacaccaatctgaatccatcatgaaaatgaatgcattatttaacacagcagtaacttaatcatgatattctattattgaaagagggggtttcattcatgaaaaaaatcgttaagcttgtcggtgtgatgctggcttttgtcgtatttgctgtggtggccagcccacagcccgcacaggcagcccacgataattatcgggtgaagacgctgaaaacttatcaaaattacagcaactatactgaagatgttgcctttcacgcgaaggccaagaccaaggcgtcagtgtggaataaccaggaatttgacaacaacatcaaggcgaatgctttctacaaaaaaggttacaagctcgctaatcacaaaacaaccacgtggtttgtcgagaaaaaggtccgcatctatcacaaattgaagagtgcgacttattattacgttgccaaccgacttggaaacatgcaggggtatgttcggacaaatgctttgacacccggatttagcccatatggctatcaaattatcagcacaaagtggtataacaagtacgattatttccacgtaaaggattcgtacaaagcaaaaaatgtttacgtatggaattatacccatactaagaagcgggcgaacctgaaggattatcctggtgctgtgttccagaaaacccatacagttgtcatgcggcacaatggaaaagataccaagtacgtctacctgtccgggactttaaacggcaccaccaagagtaccagggggtacattgcagaatccgcgatcaccggtgggctgaatccagatcataccggaatgaattatgttaatatgcgttatttcgtgaataacacagattttaatcagtatcttcaaaccgggaaaaatcaaaaactcgccagagaaattattaagttattccctaactctcagccggatttggggttatcaaagatcgctgcctataattatgacagctttgataacgatattgatggtgatccgagtccgatcagcacaaccggctacaccgacatcaagactttcccggcaattcaaaagtggctgtacaccaaccacaacgcgtctaatgcaaccaagattgccggtgttaagaaattgctgaatgcggagggctacaccgacagtaagcgggcttccttatccggatacaaactcggcattcacattatcaataacattgtcatgccaagtggtgaatctggtgatttggcaagtcgatatggctatgtgtttattcttggaagagttgataattaaatcatggtcgactaaaggcattaacctcagtgacgttttgtcacgtaggttaatgcctttttgatgacgaactcatttcagcaggccaaatttgtccatgctttgaagagtggccagaatcgtttcctcaatactgccgattggctgccaacccaagagtttgcgagctttttgattactgacattccggttcatgtccagtaatagttggccttcttttgcctgttggttgaatagggaaccgaccctcaccatccagttgggtaaaattttatcggcaactttgttttctagttgggggtaatgctgtcggataatcgctgccatttccggcattgtaatctggccgtcggcggtggcgataaaacgttctccggcggcatttggattttccatggcgcgaatgtgcaaatcggcaacgtctctgacgtcaacaatgttgagcggaatattgggaatgcgtttcatgctgccattcatcaagttttccaaaataccgaaactccctgatatatgcccgttcattgccggtccaagaatggcgactggattgatggttgtcagggccattgaattgtcagactcattcaccagcttccaagcttctttttcagcgagtaattttgatttctcatatagggaaaggcccttttgatccggattggtccagtcattttcatccgtgatactatttttgtccagattgctgaaaccaacgccgccaaaattggcagtcatgacaagtcgctctacccctgcattttgtgcagccccgatgattcgggtgatgccatcgattgcaggtcgcatcgccgcatttttatctttggtgttaccgaagaatacgggggatgcgacgctcatgacatctgtgatgccgttcatcgcttcctgccagccttcatctctagataggtcagcttgtacaaaatccagttgattgacatttgcaatgttgttggcggctaacgtatccaataccagtgattgcttgtcgagagaacgcagcgtggttctgacgtcataacctttagtcaacaattgcgaaataattcggaggcccagaaagccattcccgccagttaccaatatttttttagtcatttatattctcctcattaatttaatatctttatcctaaaggctagagtatactctagtgcaagacattaaacttaaaagggatgatgagatgacttattcaattaaagaggtcgccgaaaagacaggcctttccatttacacgctgcggtattacgacaagcagggactgctgccgtttgtttcccgaaacgaggccggatatcgtgagttcaccgattctgacttgaattttattcacaccatttgctgtttgaagaacactgatatgaagattaaggacattaagaaatacattggttattgtatgcagggagctgcctcgattgataaccgcaaacggctgttgttaaagcatcgccaagaggtgttggcaaagcaacggctgttggcagataatctgaaagaaattgattataagctgcacgtgtatactgatccaaattctcaggcaattattgaccgggaagtcgcctatgtgcaagatgagaaggctcagaatcatttggcggatccattcgctgtgaaatagggacatccctgtgagtgcattctttgttgtggtggaaacaacgccgtgaattttagaagaaaatgcctctttagtggttactaaactccagtggttgggacgtttctccttcaacctcagacaaagtgtgtattgattaacattcattaaagtgcattgtctcgtttccgttggggttgtatgctatagatacttattttcctataaccaaattgcttggtaaaagcacgtaaaatagcaggaggacagtcgtaaatgaacgctgataagcttaagcgagttaagaaaaaatataaacagtcagggcatcataaactccaaactagaattttcaagacaaatgacccccgccttcgcctctttgattttgactatggggtagtgatgggtctaacttcgaatacagaaggcctgtcaaatgttgaaatgagtgatgcgatcggctacaattcttctcaacttggttatgatgtttatcgaatgcccgatggtcaattcttaatcgatggtgttgaaaaggaccaagtattttcccaacatgatgggtgcccagtcttgttactggctccaccaacgttgcctgaaaaaagccgaattgctcttgcaaacaaaatatttgagcacagaaacgaagggccacatccattttattagacgagggtgtaatgatgaaatggatggataaaatgaattccttttgagtggaccagcaggtgacgcttgtctactcaaaaggagttttttgtgggcttaaggcggggatcgatggttctaaagatgcggtattctacattaaatatttttataagaccttaactgcatgcaagatgaataattggatcgaaaattcccaaccaatctatgccaaaagggtttcggataattgccggttaatgcataatagatgatgtgccaaggcgatttccagggcaacaatattccaaggagtttacgagcatgaaagttaataattatcatataggtctcgatattgggacctcatcaattggttgggtcgcaattggcaaagacggaaaaccgctgcgtgttaaagggaagacagcgattggcgcccggttgtttcaggaaggcaaccccgctgccgaccgcaggatgtttcgaaccactcgacggcgtctgagtcgacggaagtggcgattgaagttattggaggaaatatttgacccatatattacacctgtcgattccacgtttttcgccaggttgaaacaatccaatttgtcaccaaaagattcacgcaaagaattcaagggttccatgcttttcccggatttgaccgacatgcagtaccacaaaaattatccaaccatttatcatttacgtcatgcattaatgacgcaagataaaaaatttgatattcggatggtttacttggccattcaccacattgtgaaatatcgcggcaatttcttaaactctacaccagtagattcctttaaggcatcgaaggttgattttgttgaccaatttaaaaagttaaacgagttatatgccgcaattaatcctgaagagtcatttaaaattaatcttgcaaatagcgaagatattggccaccagttcctcgatccatcaattcgtaaatttgacaagaaaaagcaaattccaaagattgttcctgtcatgatgaatgataaagtaacggacagacttaatggtaaaatcgcgtcagaaattattcatgctattttaggctataaagcaaaacttgatgttgtcctacagtgcaccccagttgattccaaaccatgggcacttaaattcgatgatgaggacattgatgccaaacttgaaaagattttacctgaaatggacgaaaatcaacaatcaattgttgctatcctacagaacttatattctcaagtaactttgaatcaaattgttcctaatggcatgtcattatcagaatcaatgatcgaaaagtacaatgatcatcatgaccacttgaagttgtataaaaagctaattgatcaactcgctgatccgaagaagaaagccgtcttaaagaaggcatatagtcaatacgtgggtgacgatggtaaagtcatcgaacaagccgagttctggtcaagcgtgaagaaaaatttggataattccgagctctcaaagcaaattatggatctgatcgatgcagaaaaatttatgccaaagcaacgaacatcgcaaaatggggtgattcctcatcaactgcaccaaagagaacttgatgaaatcattgaacatcaaagcaaatattacccatggcttgtcgagatcaatcccaataagcacgatctccaccttgcaaaatacaagattgaacaattggttgcttttagggttccatattatgttgggccaatgataacgccaaaagaccaggctgaatcagcagagactgttttttcttggatggagcgtaagggtacagaaactgggcagattaccccttggaattttgatgaaaaggttgaccggaaggcatccgcaaacagattcatcaagcgaatgaccaccaaagatacttatttaattggtgaggatgttcttccagatgaaagcttattatatgagaagtttaaagtcctcaatgagttgaacatggtccgggttaacggcaaattattgaaggttgctgataaacaagcgatattccaagatcttttcgaaaactacaagcatgtctcggtcaagaagctgcaaaattacattaaagccaaaacaggattacccagtgatccggagatttcaggtttatcagaccctgagcatttcaacaattctttgggaacatacaatgatttcaagaaattatttggtagtaaggttgacgaaccagatcttcaagatgattttgagaagattgttgaatggtcaactgtatttgaggacaaaaaaatcctgcgggaaaagcttaacgaaattacctggttatctgatcagcaaaaagatgttttagaatccagtcgttaccaaggttggggccggctttccaagaaactgttaactggaattgtcaatgaccaaggcgaacgaatcattgacaaactttggaataccaataaaaatttcatgcaaattcagtctgatgatgattttgccaaacggattcacgaagcgaatgctgaccaaatgcaggcagtcgacgtggaagatgtgttggcagatgcgtacacttctccacaaaataagaaggccatccgccaagtggttaaagtcgttgatgatatccaaaaggccatgggcggagttgcgcctaagtatatttctattgagtttacccgttcagaggaccgtaatccacgtcggacaatttcacgacaacggcaacttgaaaataccttaaaagatactgctaaatctttggctaaatcaatcaatcccgagttactttctgaactggacaatgcagcaaagtctaagaagggcctgactgatcggttgtacttgtacttcacgcaacttgggaaggatatctacactggagagccaatcaacattgatgaacttaataaatatgacattgatcatattttgccacaggcatttattaaagataattcactggataaccgtgtactagttttaacggcggttaacaatggtaaatcggataacgttcctctaagaatgtttggtgccaagatggggcacttctggaaacagcttgctgaagcaggcttgattagtaagcgcaaactcaagaaccttcaaacagatcccgataccattagtaagtatgcgatgcatggattcattcgtcgacagttggttgaaaccagccaagttatcaaactggtcgcgaacattttgggagacaagtatcgcaatgatgataccaagattattgaaattactgcccggatgaaccatcagatgagagatgagtttgggtttatcaagaatcgtgagatcaatgactatcatcatgcgtttgacgcctacttaacagcctttttaggtagatatttgtaccatcgatacatcaagcttcgtccatacttcgtctatggtgatttcaagaagtttagagaagataaagtcactatgcgaaattttaattttctccatgatttaactgatgatactcaagaaaagatcgctgatgctgagactggtgaagtaatatgggaccgcgaaaattcaattcagcagttaaaggatgtttaccattataaattcatgctgatttcacacgaagtttatacgcttcgcggcgcaatgttcaatcaaactgtttatcctgcatcagatgccggcaaacgaaaattgattccggtaaaagctgatcgaccggtcaatgtctatggtggatatagcggcagtgcggatgcgtatatggcaattgtcagaattcataataagaagggcgataaatatagggttgtcggtgttccaatgcgggcactggatcgtttagacgccgcgaaaaacgtcagtgatgcggactttgaccgggctctcaaagatgtattggcaccacagctcacgaagactaagaagagtcggaaaacgggagaaatcacccaagtcattgaagattttgagattgttttaggaaaagtaatgtaccgacaattgatgattgatggtgataagaagttcatgcttggaagctcaacctatcaatataacgccaagcaattggtcctctccgatcaatctgtcaagacacttgcaagcaaaggaagattagatcctctgcaagaaagtatggattacaataacgtctacactgagattttagacaaggttaatcagtatttttctttatatgatatgaataaatttcgtcacaagttgaatcttggtttcagcaaatttatctcatttcctaaccataatgtccttgatgggaatactaaggtgtcttctggcaaacgggagatcttgcaagaaatattgaatgggctacatgcaaatccaacattcgggaatttgaaggatgtcggcatcacaacgccatttggtcaattacaacagcctaatggaattctgctgtcagatgaaacaaagattcgttatcagtcaccaacaggcttattcgaaagaaccgtcagtctgaaggacttataacaaaaaaaggaaccattctccaactgaagaatggttcctttcgcatatgtaatgcccatataatgggtcaaaagttgaaactccgcgcaaagcgctttgcttgattttaacacaggatgttaaatcaataaggtcaaacatgttgggagctacccaacaaaaataataataccccaattcattaattgaggcaagggagattttattatgggatggcgatcagttgtcatatcacagcacgcaaagatgtcatattcgtcacgaaatatgattgtccaaacgatggacggcattaatcaagtgccaattgaagacattgatttattactggtatcaactactcaggcagtcattaccactgctttgatcagtgagttggtgaaaagtcaggtcaaaattatttttacagataatgccaatgagccggtttgcgaaaccgttgggtattatccgaatcgtcgggatgttgatttgattaagaaacaattttgttgggatgagaagcgccaacagtttctttggacgaggattgttgcaagcaaaatcgtcaatcaggttaatgttttatcgatttatggcgttgaaaacagtgatttgattgctgaacttgataaattggaaattgatgacatcaccaatcgggaggcggtggttgcacggaaatatttcccgctgttgtttgataataagtttagccggcgtgatttttcgccggtgaatgctgccttgaattatggctattcaattttgctatccaacgtgaatcgagagatcgtttccaatggttacctcacatacttaggaatccatcatcacagcaatgataatcaattcaacttaggctctgacctgatggagccttttagaccagttatcgattactggctggcaaatcaaaatttcaaggaattgacgccagatgtcaaatttggcttggcggacctgttaaatcttgagatgaaatttaatggcaaagaaatgttatttcgaaatattatttccgaacacgtccggaattgtttgaaatatttaagtggtgagactgacgaaattcaaattgaggtggaattgaaaaatgaggtaccgaataatgcgattaatggtaatgtttgatttgccggttgaaacaagtgagaatcgtcggaattatcggaagtttcgcaaggctttgatcaatgaaggcttcttgatgatccagttttctgtttatgtaagagtctgcgtcaacaagaaatccgctgattttatggagaagcggattgcagcaattgcccctcctgaagggttgattcaatcgttaattatgaccgagaagcaatacaacgacatgcattttattgccggcaaaccaaaggaagatgttcgaaattcttctgaaaggacgattattctatgaaaatttcgtatgccggtcatcaagaaattgagctgaattcaaagtatctcacggttattgccacgaacaacccaaccgtctatcatgatctggttgttggactaggatcttttagcgacaagattaaagtgtttgatgacaattttgagtcagtggaagttaaagatgcaattgattggcagggagatgtcggactcagcgatggtgtcagtgacaagtataattctggcatttttaagcaattagaggctgtgttgactgatgatcagcgtaaatcgataactgatattaataatcaattgtatacggtcgtccagcagtgtttgtttatgatcgacttacctctggaagtcacttatgattgggatttaaagaggctgtttaaatactgtaaaattcattttaacgctgataccatgctgaatccttatgctataattgaatcaattatcaaaattcatttagagtgtggattgaagtcggctgttggtttaactaatgtcgctcattatcttaatcagcagcaattaattgatctatccaagctcacaagttccgcggggatctcgacattattagtagaattcacagatatgaagtcacaggagctttataccaattgcgacttttactacatcgacgaggactttgttgattggcatttataatgcattaaaattcggttataaaaaatcggttttagaaggatgttaaatcaataaggttaacccccccaatcttttgcgctttcgtcattcgccggttttagaaggatgttaaatcaataaggttaaacccaaacaattgggttggtttaatattgaattggttttagaaggatgttaaatcaataaggttaaaccctgcaagaatcaacaggtttcagtcatcgctgttttagaaggatgttaaatcaataaggttaaaccccttcaggaaaaggaatcagttcagcggttggttttagaaggatgttaaatcaataaggttaaacccttcccgtgcacctttttcgctgctgtaaaagttttagaaggatgttaaatcaataaggttaaacccacgggggtggctttttgtatgccgcaacccgttttagaaggatgttaaatcaataaggttaaacccctgaagattatttgctaatgatataatatggttttagaaggatgttaaatcaataaggttaaacccattgatggatggtggtcaaccatctgtcttgttttagaaggatgttaaatcaataaggttaaacccatggatgaataaatagtgtccattttagacgttttagaaggatgttaaatcaataaggttaaacccttaatgtataagtggatcccgagattgtgggttttagaaggatgttaaatcaataaggttaaacccatgacagttctgatgatgattcagttaatgggttttagaaggatgttaaatcaataaggttaaacccccgacgatccactagctgtggaaaatgtgagttttagaaggatgtcaaatcaatcaggttagagatggcttctcaacagatcattcattctggatcatcttccaccactaaaaaataagttctccgcctagtatttgctaagcagggaacttattgtgtttatttatttaacaattgacttagccaacgcataccccagcttctgagccgtttgggcagttggatgaatctcatgatccttcaaagtgacatccttgttgctgttagtgataatgttgggtgcgatctgttggaaattgaccactttggcgcccattgacttgtagagccttgcttcagctgcccgcaagtcgtggtaggtgtagccatacatatcactcatgttgtcacgattcatgccattggcgtcaaaccgtgaaattggcaggatgccgtaaatcttggcggacggattcaacttttgaatcatcttaatgttatagcgcaggtggcgcatgacattcttcaaacttcccgaaccggaatagttggtgtaatcattggtcccgatatgaacgaagatgacgttcatcttcttgatgtcatttcggtgagccttgattgcggctgacaaatcttgtgggaccaaggttgttcccagataagcatatcgattaccaacaattcggccacttgggcaggcgaagttttcaaccgcagtgttggtgccgagatacttggctgtccagtcagggtaagaactgttcaaatagaagtgatagccgtcccaacctgcaggaattgaatcaccaaagacgccgatcttttcgccagcgtatttattgccggcggatgccaatttgacgttatatgattttgacgtaatatcggtaacagctgaattcaatacccagaatttgtacttttggttagaactgctgatccgatagacgatcttgctcttgccgccacaaatcaatttggcagcttgactccgataccaggccgtcttcaaaaacttcttggcgctgactgatttagccaaatgaacatccgtgtacagcttggcgttcttcttcagcgcaaaggcatgcggatgcgtctgcgttgtgtattcaacttgaacacttgctttgtctgcggtggggtggctataaattccaaacgaaattgatgccacaacgaaggccgcaaagaacagcttgatgtgtctattaaagaaattaatcattgaattttctccccagaaaattgatatttaggaaccattcgaattacgattagataccgctccccgtacctataataatatacctactattaactttctaattatacgacaaaatacttttgaaggttataaaaaattgcaataagcaaataaaatattccaatgtgtgggtcaaccccacgtatatcaaggaaatcaccaataataaattgttttttcaatagcaattttgccggtcaccacttatcatagaagaagaggtgattgtatgaattttaaacaagttgtatttgataaagacaaagagattaaattagacatttacgatgctgatagtgacgttgcactgcctggaatcgtggtaatccccggtggtagttacaaaacatttaaagaacgggatgctgcccgggttgccctgacttttctaaccaaaggttaccaggcattcgttgtggagtatccggttaacgaaaagaaaaattatcaagatgccaagcaaagcatctccatggcctttgattatatcacagaccatgccaaagatttgaatgtcgacaccgataaattaggggtaatcggcttctctgccggcggccaacttgccgcagcatactccaatcaaaaggataccaaagctaagtttgccatcttgggctaccctgtattaacacaggcccttgatgaaaaaattggcattcacagtgaagatgttactaagcaggttactaaaaacacaccaccaacatttctcttcggtgccagaagtgatggcttggcaccatacatcgaccacatctatccatacaccgaagcactgtttaagaatgatgttaactttgaagtccatgaatttgccactggcggtcatggcttcagcctagccaaccaatttgtcggcgtcgttaatcgcgaccggaccgatgaacactttgccaagtggttcccattgtgtcttgaatggcttcagtctttataatagattttctaccttaagtggatattaaacgagcatcaaactcagcgattgattgagtttggtgctcgttttagttagtgcgatttaatcatcataactattttcgatcaaaaagcgccttgataattcgaccaagatcggcgtcattggggttgaaagttcgttccagttgcgatcgacgaagggtttgaatttgtttaaggcacctttgtccagctttttcgtgtcagttaataaatgccttaactctaaagcaaattcctgcagtgtgaggcgttccgactgactcttcattgattttccgactgacattagttgagataaataaccatcaaattcagtactttcagtttgggtatcgtcctttggaaaatcaatggtttcagctttgctttgggcccgttttaattcctgaatataggctttgcctttgtccgtcaaccacttggttgcatgattgttgaagagcttgacaccatcaataaaatcaacgtcaaaggtgactgtcaggattttttcgtgagcatcgtccatttgattgagctgagttaataacattggcgcagtatatttgttgttcttaccataatcgatcaatttctggactgtttttagatcaacatggttaggctgcgtgtctaaaaagcttaagataaattcccgcattcgatcctcaaattccattaaatctcgccatccattctatatattattaactgtgaaatagcttcatttgaatatcttgatcataattgccaaatccttgaccaaaaatggtgcagccacctttgtgcttcgcactatctttaatcgcaaatctaaccgtgaacgttggcttcttccaatcaatgtcatcaatggaaacgtcggtaaagggttgaccgtccagataactaccatgatcggtgatgcgaaccactttaagctgaccatattggttaacgttgtcgggaacccacgcgggcgtgtacttaccccgaatatcggaaaagtcacctggactggtccacgtaccaatttcaacatcattgatgtaaaacgtgatgtcagaaggccagacattgttggagaaagggaattccgacccgagttccatggacaaatccaacatttccagtttgtccttttcttctaagtagttcgggaactggtattccacgaagccgttcgtccaccaaatcattccagccttaatccgctcagggctcataaagtacttgggattgtcgaccttgccaatatagtcatttttaccagccagaccgcacgaaggggttactgagtaatcagtgaattgaccgacagggacttgtgtctcatattctgcaaacgcgggataaatggtcgtcggaaagtggacgttgatattatcaacttttaagtaggaaattttactgtgaccttcacgttcaaatccgatgattccggcatcttccagcttactcagatgcatcaggataatggtgctgcttaattttaatttttttgacaattcttgaacactcatccgctttgatgaaagtgtttggataatttgaattcgaactggacttgccaaggctttatatacctcaagcgaatcttgagaaatatctaaatccatctttgtgacctcactctcaatctgactgaatcaaccaattaacatttattgattgattagcagtaaaaacgtttaaatcaatataaatgttaatcttatttttgtaaccggttactaatcgtctttatattagcaaaaccacggttttaagtcaaaagttaattgaacatttatgttatggcttgtaaccgttttactgaagaaatatcataaagatgtgcacaagggatatcaatactacgtagtcaatcaagaaaagaggagtttactttgacagtttatacgaatccgctcattgttcagcgggctgatccatacatctacaaacacacagacggatactattactttactgcctctgtaccggcatataacctgattgaaattcgtcgtgctaaaacactggaaggacttgctcatgcagctccacggacaatttggcggaaacatgaaagcggtcccatgagtcaattgatttgggcaccggagattcattacattgatggcaagtggttcatttacttcgcggcggcagaaaccacagccttggataagaatggcatgttccaacacagaatgttctgtattgaatgtgacaatgctgatccaatgcgcagtgaagacgattggtttgaacatggtcaagtgaagacaggtatggatagtttctcacttgatgcaacctgcttcgaagctaataacaagctttactatgtttgggcgcaaaaagatcctgacatcaagggtaattccaacttgtacattgctgaaatggaaaacccttggacgctcaaaacgaagccggtcatgctgtcaaaacctgaatttgattgggaaacgattggtttttgggttaatgaaggaccagccgtcattcatcgtaatggtcgctttttcctgacatattctgccagcgccaccgatgaacattacgcaatggggatgttaagtatcccggatgatcaagatttgttggacgcaagcaactggaccaagtccaagaagccggttttccaaagtgatatggcaacccatcaatatggacctggccacaactcctttacggttggggaagacggcaagaccgatattttggtttaccattgccgtgattacacagagattaaaggtgatccactgtacgatccaaaccgtcacaccaaggttcagccatttacttggaatgaagacgggacgcctaactttggcaagcctgttccttataattatgattaataaattttaataggaggcacatgttatggataacagtgcaaaaatgcctgaaaagaaagagaagaaggatttttggggctttccatttactcattttacctacttctttaactggcaaattattaatggttatttaaccctttggctggaacaagttgcccatttaaatggggcagaagccggagttgtattctcaatgatggccggaatgtcattactgttccaaccggcatttggtgttatttcagataagctattattcaaaaagaacttaattatcacaattgcgatcgccgcgatctttattggaccatacttccagtggctgtttataccatttgctcacataagcaatatgtttgcagccgttattactggtatcttccttagtttcatcttcaacggtggtgtttcagtaattgaacagtatgttcaacgtgcaagtttggctaacggatttgaatatggtcactcacgaatgggtggctccttagccgggatgtgtgcttcattcctgggtggacaattattcatctggaaaccatactcaatcttctgggcatgtaccgtttcagcaattatcctaactggactactgatcttcagtgataaagttcacttggaaaatgcatctgcagccggtaacacttcagacaagattgactggggtcaaatcggtaagatctttaaaattaagaacttctggtacctatcaatcttctacattggtgcttcagccatttacgatgtctttgatcaacagttcatcatcttcttcaagacattctttaatactgcagctcaaggaactcaagcatatagttacatgaccactgctcaaattggtctggaattcctgctcatgttcccaatgccatggattatcaaccggattggttcacgaaatggtttgatcgcttatggctgtatcttagctattcggatcattggtagtgcattgtcaccaagtttgatttgggtcattgttcttcgactcttagccggacttgaaatgcctttggttcttgtatcaattatgaagtatattgctggtgctttcgatattggtgtatacgcaactgtgtatgccttagcgtcgaacttcgccaagcaaatatcagtcttcatcttctcaagtgttgccggtaacttatatgatgcaattggtttccatcaaacatacctgattcttggtgccattgtagctgttgttactgtctttgcggcatttgctttgaagaaagaaaatcctgttcaagctggtgaacgtgacgaaagcggtaaacctaaagaataagcaagattttctaaatctgtgagcaccctgttaaaaccccataaaaaaagacactcagctgagtgccttttttgtgtcctaatacacctgttctccacccatccaagtctcagcaacacgaatatctttcaactcctcatgcggtacggagaaaatatcccggtcaagcacaacaaaatccccggcatatccaggagtcagctggccgttctcactaaaaccgccaatcctagccggccaattggtgtaggcaagcacagcatcaggaaccggaatggcttcttcaggattaacgacgtcaccattgaccgcggttcgagtgactgcggcgtaaatgttcacaaatgggctatccggttcagcccatggtgtgcagggggcatcggagctcagggcaaactcggctttggtgttcatcattgatttcacacggtaggcttcattgaactgctgcggggaaagatagtgacggtacgattcatcctcggcaaagaagaaaatcggttgggtcaccagggcgtagttcatggttgccatgttgatttgtttcagcatttgattgctcagaatggaagcatgctcgattctgattgacggacggtccgatagccacggttgcattttatctgtcacatccaaaatcaattggatcgctgcatcgcccatcgcgtgaatggcaacttggagatgctgctgtttggcataggtgacagcttgcttgagtttggttgcgtccgtcaggcagactccattttggccgctcggataaggttgttgattataggcggtttcaccggaaatgctgccgtccatgaacaccttgataccggcaatgcgtagctgatcatcattggtcggtttcaggttagcattgctggctacttcatcgtagacgtagtaaatggatgacttcggtttgaaaccggcctttacagcatcttggtaaagtttgagtgagtcgtacggtcgaatgcggcccatcatttcaccgatggcgacaatgccattttggaggtaatgtctggagctgttcgccatattatcgacatcgccctgataactctgggctgatttagccttgattaacaattgggtagcggcgacttccttcatgtagccgttcggccgcccgtcatcaaaatggccaatgaagccgccaaccggatccggggttgttgcagtgatccccgccagttccagcgctttggaattaccgattgatgagtggcaatctgaccgataaacaaaaatcggctgcgtggtggaaatttcatccagatcatcaacagttggcgtccggtgctcggctaatttggtttcatcaaagccccagccctcgatccaagtgtctgggccttttccaaatgccggtgactgacgcagggcagcttgcatgtctttgatgctattgacgttgggcggcgtgcaggcaaccccgtgcagggcatcggcgatgtatttgggatgggtgtggacgtcgatcaatcctggcaggacagtcttggcgtgtaggtcaattgcgttgggatcggtgatgtcactggattcaccaacccaagtgacgtgaccatcttcaattgtcatcgctgaaacaaaagtcgtctggtcaattccagtgaatatttttccgttaatgaaagttggcatgctgattctcctcgctgattcgtttgtctctattattcatgataattggtagcgattgcaagcttgatctttctggaaattaaaacggcgaaaagttatcatgatattatgagctttgagagaaggagtaactcaatggaatctttggaatcgcacaccttaaatgcattttcgaaaaatattgaactgactgaccaccagaaagctgttttaaagcaaattgacgccttttctcgccaacatttaaaagaagacgggcacgcggtgtttgttttgatgggggatgccgggaccggcaaaagtttgatcttgaatcaactgtttaccgagttggcccaagtcgttgacgatgcctattttctggtcaatcatcccgaactcctaaaagtgtatcgcgagctggctgggcaaaccccacacatgctgaaaaagtactaccagcggccgacgagctttatcaatcagatgcataagcagggcaaacaggtcaatttgacggttgtcgatgaggcccatttgttgctgagcaagccggatcactacaataactactatggtgacaaccagctgcaggacatcatcaatttaagccgggtgacaattgttgtttttgatccgcatcaagtgctgcgaaccaagagcttttggaataacgccagattggaaaaattgattgccccatatcctcacgatttggtgcatcttaagcagcagtttagaatgcaggccggcccgaagctgatggattggctggatcactttattgacggggatgttatacccgcgattcccagtgacgttggcgactatgattttcgtattttcgccgatgctgaaaagatgtttcaaacgatcatcaagaaaaacaaccagtatggcttatcgcgaatgacgtcaaccagtgggtatccatccactttagatggtgggaaacatttggtcaacgaaggcaacttccatctgccttgggatcaatataatttcaccagtaccccatgggctgagcagccacaaacgattgacgaggtcggcagcatttacacggttcaggggtttgatctgaactacattgggattatcattgggccgccgttttatttaactgctgataatcgtctgggcgtcgatcccagtaaagtcactgacgtggagatcttcaagcatcgttccgacatgtcggaaaaagattatgaagaaagcaaagttgaactgttaagaaactcgttgaacgttttgctgaggcgggggattaaagggatgtatctgcacgcccatgatccacgtctggaacgttatttggaagaaatgatgcccaaatagtgacctggcaaattgattgacaggctgattgggattagatatagtttgtccatagacagaatatgagggagatcgaccatgaagaaaagaacaattatcattttggcggttctcgttgtgcttggtgcaattggtggcatctggtatcatcacaattatgcgagaatcttttactatggccaagttggcaaattggaacgaactgagaattcgcccggcaataatccggatgttcattattatttgattaaggcttacaatgacaaaggtcagggtaagacccttgaagtgggttcagttgacggtaagtatttcgtcaagggacactatatcaagattggttactcaagatcgaagaatgtcgttgactatgaagggattccttactcacaagtgcctaaagcagctaaggaaaagttgaatcattctaattaaatagaatgggacgcgaggcgttttgatcccagaatttaagcaaaaaatcgagttattcctgttcttggaataactcgattttttgcttaaatggccgggagcggccgatcgttccacgtttaaactagataacagtggatctcaacggaggtcgaggcatagctcattgtgagctgtgttccgatctccgttttaaattgtgctttagttttatgactaaatagtgcggttcatattctcatcctatggaatcaaattgttcatcatatgaagtgcaatactataacgaatatcccggaagtgcatgtaggcaaacgataaacagcagccgagggcggaatacatgatccaagtcaggtcaaagctcatctcatgggcaaacccaaaaagcgagccgctgacgatgactgccaaaagattgttcagccggttatctttattgaagaaataattcatgaagatgccacgaaaaataagctcctcaaaaatcggtgcgagaatcccgccaaaaaagatgttccacatgggcatcttgacttcggcggcttcgacagcttgttgattgctgggtgttgtcaagacgtggttggcaatgagccactgccaaagtatctggatagccgtcatcaaaataaaaatccataacagttgggcgatccgcttggcagtcggatgccgtcggccaaaatgccgtggattgttagcagcgagctgtttaccataacgccaaccgatcaaagccagggcgccggcaatcaaaaccagtgccagtcccagaaggtgacgagcactcagagggtctttgatgtattgaccggcaatttcaaaaactgattccgctacaatataagttgccagaaaccccacgaattttaaaatttgcggtgatttagtgatgagatacctggttggattcatttatctgaactcgttaacttcgatccgattcttgtcaggatctaaaatcgtgatcgaattaacgtttctccttactttagttttttcggtcggttcactcacaatatccacaaagtagttaatcaaatgggctttgatatcggccattttgtctttagcaatcaagccaaatgagattgggttgtcgaccttgtcttcctcgtggaaatcaaggaacattttgtgcatgtccgctcccttatcaccgttgggtaaatcaacaatttgcaggtcaaagacctcgtggtaaaatctgaggctgacttccaggttggagacggggattgtaatgtattcaatttctctgatattcatttatgatcatcctttaaaagtaatgtttccattatataccaaagcgaaatcttcgcacgattagtttgactactataggaaacaagagtaacgtaacaaattgtatgtagtatttcgaattaattaaggagtgaacttttttgccattactatccgtatcaaatctttcaatgagctttgctgagaaggatctgtacaaagatgctgaatttacgcttgaaaaaggcgagcacatgggcgtggtgggtcaaaatggggttggtaaatcaacgctcatcaagatcattaccggaagtgaactgcctctttctggggacataaagtggcagaaaaacattaaaattggttatttggaccagtatgccgatgtcgaggaagatttaaccctgatcgactttttgcgcacagcatttgctgatttatacaaaaccagtgaccaattgaatgaactttataatacctatgctaagactgccgacgataaattgttggagcgggctgggaaacttcaggatatcttggattccagcgatttctataacattgacaccaggattgaacagacgattaccggcttgggattagataacattggacgtgatcacctggttggccagatgtcaggtggtcagcgttccaagatcatccttgctaaaatgttgttggcagatcccgacgtcattttactcgatgagccaaccaactatctggacaccgctcaaatcgactggttgattgactatttgaatgggtttagcggttctgcactggttgtctcacatgattatgatttcttggaaaaaatcactaactgtatcatcaacgttgcttttgggaagattaccaaataccgtggtagtttcaaacaagcgatgcgtcaacgggctgagagagaagaattccaacagcgtgagtacgataagcagcaggtcgaaatcgagaaagccgagcgctttatccgtaagaacaaggcaggttccaagtccacgatggccaaatcgcgggagaagaaactggcccatatggataaaattgacccgccttcgactaatatcaaggccagcttcaattttccttatgaagaaaccggttctcatgaagctttgaccgttgatcatttgtcggttggttacaataagccattacttaagccggtcaccttcactatttcaatgggggagaagtttggctttgcaggatttaacggggttggtaagtcaactttgatcaaatcaatcctcggtcaactgcctgccaaaggggggacggcgaagttctcgccatcatctcacatcagttatttcagccaggaactggaatgggataacaaccggatgacgccgatgcagattatttcggataaattccctaaattaaaccaacgggcaattcggacgaagcttgccaaatgcggtctggatgctgccaatgccattaaaccaattggggaactttccggaggtgaacaaaccaaggtcaaattggccatgatggagttcaccccgaccaacttcctgattatggatgagcccaccaatcatttggatgaagagactaaagaggccttgaagcgagcattggaccggttccctggcaacctgattattgtcagccatgagtccagcttctatgatggattggtcgataaagtcttgaacgtggagcaattgagcttaaaggaaaaaccagtgattcgagaagaatcgtaaaatgagataaaaatatgataccacacaaataattctttgtgtggtatttttgtaccaaaatttgtccttgatttatgtggtaaacctgttgtaagatattcacgtgttaaaagttcaaagccagcgaccttctccccttggtcgcctgtcctttggacttattttggggagctcttgtaagcggtaacaggattatttgaagggaatggtgttaagaatatgaaccattatttgagaaatttgctccttttagcagcaggtgttttgagtgtggggacactagcggcttgttcgagccagactaagtcaaaagacaacagcaagttggttcgaacggccaacttgtcggcgaactattcaatcgtgaccctggatatttcaaaagcccagggcttcgataacgccggtaatctctatgatagtttgttgtacatgaataagaatcataagccggttccggcgctggcaagtcggtatcgcgtgtcaaatgacggtaagacttatactttcacaattcgaaagaacgccaagtttagtaatggggatccaattacagctgacagctttgtctattcgtggcaacggacgttgaatcccaagaccaagtccacccatgcttatctgtttgatggcgtaaagaatgccgaaaaggtcaactttgggaaactgccgctaagcgcgctgggcgttgcggcaccgaataagcgaacgtttgttgttcacttggatcggccgattgcctacttcactaaattgatgacctatcaggccttttcaccacaagacaaaaagatcgttgacaaatacggtgccagctatggccaagctgccaataaggccgttttttccgggccatatgtcatcaaaaaatgggccccacaatccaatacttggacatttaaaaagaatccaaattactgggacaaaaagcatgtcaagatgaacacaattcatatgaattatgtgactgatccacagaccagtttgtcgttatatcaggcacacaaacttgattttacaattttaattggcgatcaggtcacacattataagaatagtgccgacctataccacggtccatactcatacatgaactatttggtttataaccaaaagatcaagaatccaaccttgcggaaagcttttaataatgtggacatccgcaaagccgtttcattgacgattgatcgcagccaaattgccaacaatctcttgaaaggtgaatcactgaagccaactggatttgttaccaaatatttggcttatgatccggccaacaataaggactttgcttctcaacaatatggcggtgaaggggttgcctataatcctaagttggccaaggattattggaacaaaggattaaaacaaattggtcaaaagaagctggcctttaacctcatggttgccaattcagataacgtgaagaaagtgagtgaatttatcaaatcatccgctgagaaacaacttcctggattgacgattaatcttcagacggtccctcaagaagttcagtatgcgcgcggagtttccggcgattttgaagcatacattaccggtcgtggagctgacattgctgatccaaccgcctttctacagccgatgatgagcaagaattcaatgaactatggctcatggcataatgcaaaatttgaccagttgatcagtcagtcaatttataccaacaacgccaacccatcgattcgttggaacaagatgttggcagctgagaagattattatgcaggatcaaggagccacacctttattccagaattacaacttatatctgaaacggccttatttgcacggcattacccacaatacaacggggtcacaatggaattataagtatatgtatattaagaagtagtctcaaagaagggatcattattcattatctagatacatccaatggaatgaaatatttgaaggacccaacagttgaacaggcctttccggaatatctgcagacaacggcgaagttttcagatgcactggtgtatttctaccacccgcaaacgccaattgtcatttgtggcgttcatcagaacgtttttgccgaggtgaatatggcttatctccaggcccacgggattgatttggttcgccgaggttctggtggtggagccgtctacgttgatcccggaaatctgacgtacgtttttattgatactgagccaactgtccaacatccccatttcagaaaatacgcccaaccagtcgttaaagcgttgcagtcccttggcgtcaatgctgagagtgacagtcgaaatgatttaacagttgatggccgcaagttttccgggatgtcagcttccaaaattggtcatcgggtgtcctatggcggcacgctgatgattgatgtcgatatcgaggctgccagctcagtgttgaaaccatcacgggcaaagttgagggctaaaggcgttcaatcggttcacagtcgggtgacaaatctccgcgagcactttgatgctgcccatcgaacagtttcaatcgatcaagttcaacaaacaattttaacccaagtgtttcaaacaactgatctggcgcaagttccaacctatcgattaaccgagaaagattggcaggcaattgtttcgttggctcatactaaatatggcagcaagacctggatttttggcgctggcaatcaacatcaatattacagagatggttattttaacggtattggaacggtcggaatcgggttctcgattcaagacaaccacgtggtcgattcaaaaatttatggagatttcttgcaaccgaattccaatcttcacgccattaccgagcggttagatgggactgaatttaatttatcagccctcacggaagcctttgcaagggctgatttgacgactagtatcgggccgattccatcgaaacgattggccgagatcatgttggatcgcttacatgatgagcagttttaaaggctgaaaaggggcgctttatgaaaattatcagtgttgatatctttcaattgcagtggtttggactcatgccagcttggcatccagttgtgattcgaattaataccgatgccggtatctcaggctttggtgaagctggactggcatatggcagtggcagtttgggagctgttggcagtctgaaagacttggtccatcgagtgattggccaagacccattgcggaatgaagccatctggaatgaactctatcaagatacgttttggggaaaaggcggcggggttgtcttttattcagctgtgagtgccattgataccgcgctttgggatattaaaggcaaatactttcataccccggtgtatcagctgctgggtggccagacccgaaaccgaattcgagcttacgccagtcaaatccagttcggctggggcaagcatgttgaatttctggcgacaccaaaggattatgctcaagcagcagaaaaagctgttcaagaaggttatacggccctcaaggttgatccatttatgatgcaggcagatggaacatttggtgtgcatgaccagcagctgctaacccaggcacaaattcaaatgtattatgaccggattgcggctgttcgccaagccgtgggggagaatgttgatataattttggaatgccacgctcgattgaacgtcgattcggcgattaagtttgccgctaaggttgagcccctgagcatttactatatggaagagcccaactcaccgaggaatccccagctaaccaaagaaatccggaacaaggtgtccattcccttagcaagcggtgagcgattggtaactcgatacgggttcaagccatttcttgatgaacgatcactgagtgtgattcagcccgacgttggcatttgtggagggattactgaagctaaaaagattagcgatatggcggcaattgacgatgtcagtgttcaacttcacgtgtgtggtagtccgattgcaacggctgccgcattacagctggaggcagtatcgcccaatgctctgattcatgagtaccatgagatttccttgaagcagcccaatatcgattccggtaaatatcatgacatgcctgagaatggctggttcacaatccctgatcgaccaggaattggccaggagttgagtacacaagccatgaaggaagcaatcacagaaacaattcaatagttagcatactgggaccatttgccgggactagacgaatggtccatttttattgccaaaaaatgaatgaatttagctgatttaatgattataatggcattaactataagacaatatttatagtaattataaccatacgtgttaaaatacaggtgtaaagagatgacaggattgatgaggaggtccccaatatgaagacgagcagacttatttatatcagctttttaacaacactcctatttggaatcggcggtattgcggtcaaagcagatacgattgactctgcaggatctaagattgaaaaggtaacgatgcaacaaaatcagacaattactttaactgacgatgatgtttccatagaggacgggatcattacagatgtcgaaaatgaagatttggcccgtcaattgcttcaaggtggtcatttggtagtcccagcaacactgcaaggtgaaacagtaactggcattggtccggatgcattctctaccgacaatttatcgacagttggaaatatcgacgaagcaggagttgggattccagaataccgcgggatcaaagcggtcacatttgaagcgcccaaccagattaagacaattgattataatgccttctatggcaatcagttgaccagcattgacttgcctggagtgaccacaattggcgacgaatcatttacgggtaacgaactgaccagcgtgtcactgcctaatgttcaaactgttggcaagtgggcatttaccaacaataaactgacacgagttgatttgcccaaggcaacccaacttgcgactggggcattttcggaaaaccgattgacgagcatctcacttggccaggcggacattgaaatgagtgcaagagcctttggtgatcaattccagattccaaccggtcctgacgagaaccatttagttcttgtttctaaagatttgctcccggtagatgtggtgaccaaggatccactgacatgggcagctttaacaaagacaattaatgcctcattcaagattgccggagttgaacaaattaaccccgaccatgttgatgtggatgtgttggcaaacgacacggatgtcactgttgccaaggttaagaacgatcagaacaaacgacagatgacagatttgccaaagcctgccgacaccccaaatcaatttacggtcattatgcactatgaagctcagcagaatgatggcttgggagagaacgccaccaatccagagccaattcatcgactgggtgggtacgacttaggtgcgtttgtcaaagttgttaaacagcctgagattccagtcgttccaccggtgaaacccagtcaaccacggccaacaaatccccaaactaccccaacaccaaatcgctcaagtgaatcgataggggccgcagagagtccaaccaccgcagtttcgcaacccggtgcaattccaaccccagatcatcccctagcacaaaagaatcaagctgtatacgcagtgaaaacgatcagcttgtacaaggacaaagacatgcagtcacgtgaccgaatcgccacctataccaagaagccacgaattaatcggccgatgtttgtggtaaccaaacaggtgaaggcaagtaacggccagattgtgtacgctgtccgagacgtcaaccatcacagcaaaacagctggcaagactggctacattactagcgattgggcattcgtccgtccagtttattaccaaagcaatcaccaacagctgacggtcattaacccaactggagtcaacgaatacacgcacaagagcttgaccgggaaggttaaaaatttgaagcaagggactaaattgaaagttaagggatttatcaaataccatctaacaacccgatacctgctttcaaatggccactatgtcaccggtaatcgtaaattggtcacggctgaaaaatatcagcaaccaaagaaagtgaagattgttaaagccacttatctttatagcaacaccaacttcgataaacatgttaaacagctcaaaatgggcaccattctcaaagtcaacaaagttgtttatgcccatccttattctctgagggtcactggaagtcaacgtttccaagtaaagggtggctacgtgacggctagtccaaagtatgttcatgtgagttattaatgaattgtcagagaagtagccggcgagctgcttccctggtacataagtatcgacagccagaagccgcgttaacgtttgaattccaaccccagaatgttattcttaagtcaaatattggtatgtgcaggcgtagccaaaaaccacggtgcctgtgatgcgaaaggaaaagtatgctttcaattatttatttggtgctcatgagtctcttagcgggagtcttaactggaattgtggggatggcatcgttgaccttgtatccggttttactgtcggttggcgtggcaccgattactgccaacgcaacgattaccgttgctcaagtcggtggcgggctgggaaccgtaacctcctcgttaagggagctgcatggtcactggaaacaggcgtttcaaattgcgattctaaatactttaggcggcgtattaggtgctctcattttaattcatagcaccaatagcggtttcaagaaattagttccagttttcatcatgttggccggaattttaatcttgacgcctaaacgccatggcaaatcggcatttgatagccgaattattaccgctgtaagctgggtaagtactttcctggtaggaatctataccggttattttggtgcggcatccggattgttaatgattgcggtgctttcaaagattgttcatgaaaactatgccatttataattcaatgcgcaattttgcttcgtttatgaataatatcgtggcagcaaccatgtttatcttcacgattccaatcgactgggcagtgattatccccttgttgctggggttatttaccggtggctacattggaccgatcatcgtgcggtatattccatccaaagttatcaaaaccgcagtgggaatatttgcggtcgtcttggcaattatcttgggttatcaagcatatttgtaacagtcaaagaacccccaaagctagcatctgtacactaacttcaggggtcctttattaattcaaatggtaagttgtggtttaagcagcttcatgtcgtgccttgaggtctgcttcaatttgcggttgcattttatcgaatttgtagaagtacatcaagattaatccaataccaaatccaatgaacggcacccaaacgaagttcatctcaatggcatttaaggcttgtgcagtctgggcgtggttggcaacgtagccgttcatgctgagcaagaacccagtgacgacaccacccattcccatgccaaggttggaggcaattccggagaatgacgtaaccagaccctcagctcgaacaccgtttttccattcgccgtaatcaacggtatcggcaagcataactggcagcagtccagcgaagaagccgttaccaaagtacccgagaatcgtcgcgcccgccagaatggggacgttcatcatcttagcaccgacgccaagaactaattgactgatgacacaaaggccaagaccaattaccatcgtgcctttcttgccaaagtggcgagttaaaaatggcgtaaagacaatcacaaccagcgaaagtgcctgcaggccaagcatgaacgaagccaagtctgcattgtgcatattgtatttaaagaaataaaccgttacttgaagcttggtttgcatcccgatccagaagaagaaatacattaaggaaataatcatccaaggccagttgcccttaagcgcccgagcggactccttgagggagagcttttcttggtgacggggatggacacgctcacgagtgtttttgaacgttaacaacagtaagaacgcagtcagaattgcgaccaaaattgcggtaatcaagaaaccctttttgtcattaccttgaccaagcagtgaaactgccggcaggaccatgattgagattaacgtggccccggtggtagctaacacttgccgaacagtactgaatcgaacccgttcctgtggattggcggtcaggctgggcagcattgaagtaattggaatgttgattcccaaatataaaatatcaattgcaatataggtgacgtatgcccaaaccaacttgcccagtggtcctagtgggacggacgagaatgccagaatgaagaagatggcgtatggaatggagaaccataagaagaagggggcgacttttaccccaacgtgtatgggtgcgatcaatcataatgccccaggttggaccggaaattgcatcgacgattctagcgataaaaaacagggttccgattgccccggcagctaagccgaaaacatccgtgtagtagtacatcaagtaggtaccgaccataccgttggcgatattgcaggcaaagtcggatgccccatagcttaaacgttctttgttggtaatgtgttcatcatttgtgagtgattgggaacccgcaggcaatgtttgtgtcattttcatttttaatcctcttttcagtgtgtgtgcttatttaacggctgacaaattactggttaatatttccttagtctcaccatcggaattggtttcggtaatggtaaaggcttgggtctgcaagttagcggacaaagttgcggaagtctgaccatcttcggatcggcgggtaaccacgatttcattgtcaccattctgttggacatcaattccaccttccaaatcaaacgccgagctctgattacggaagcggaggagatcaaacaatgctttgacgactggccgtttagtttcttcagctacttcatccaatgagtaatagtgacggttgatattgcggccttccttggtcttttccagcaagcccagatcgttcttaccggcaagcaggccgacatagtaaacctgaggaatccctggtgcaaagacttgaatggcacgggcaagcagataagcgtgatcgttatcccccagagccgagtagtaagtggtattgatctggtaaacgtcaaggttatggtaagcagtactggaatacacttttttgacgttggcgccgactttatacatttcagctttggtgtaatccagttcgtcgtccgatagaatatctttggcatccacaaccccaatgccatcgtgggtatccaaagtcgtgaactgtttcatcggactgttcttaagccagccggccaagcgatcagccttacctgagtacaaactgtacaaagttacaattggtaaggcaaagtcataactgaagtaatcatggtcggtaatctttcggacaatatggtagttttcatggatctcgggcaataaagtggtctcacgtggattagtgatgtcactgatttctttcagtagatcccaaatttccggttctacgaagaaatcgttggtgccgagtttcttgatagcgtaagcgaaggcgtccaggcgaatgatagaagcaccatggtccatcaagaagttcaaggtatctttgatgaactgtttggttaccttggaattcacattcagatcgatctgatcttcaccaaaggtgttccagacatcttcggtctgaccgtcggcaaatttaaccgtttgaacaggggcctttggcttgcgcttataaattaaatcaatatcttcttgagttggacgacccttgggccaaaattcattccagtggatgaacagatcccgataagcagactgattgtggttagcttggaaatctttaaagtatttggattgttttgaaatatggttgaccatgaagtcaaacattaaatagtatgactcggacagctttttcacgtcgtcccaattgccaaacttttcgtccactttggtataatccatcggtgcgaaaccgcgatcaccagatgacgggaagaatggcagcaggtgaacaccaccaacgacaccgtccaggtatgttgacaagactttttgcaaatctttgatattatttcccaaactatcgggataggtaatgagcattgcttgattgtttaatttcattggttatttcctttcgtatttgtaaaggtaggctgaccagggctggagcttcatggtagcgggattttgttcagccgaactgttcgtgagaattaactcgaggttccgataatccgaggtgatctggtaacttgccggcgtatcactcaaattggtgataatcaggtagccttgatgaccagattcgcggacgtaaacataaagttgatgatcgtgcgtgtcgattaagtgatacttaccagtcagtaaaattggatcgcttagtctaagagcaatcaaccgcttgtaaaaactgaggactgattgtggatcggcttgttcgttggcaacattgacggttcgatggttggggttcatttcgatctaaggttgatgattactgaagccgccggttgacgtccactgcattggcgtacgggcgttatcgcgactctttttttggagtttaaacaacgtttcatctttggttgcgcccttggccagttcctcttgataaaagcgtttggaatccagatcgcggtattgatcgatgttgtcaaagtccacgttgctcattccaagttcttggccttgatagatgaacggggtgcctttcatcaagaagtacatcattgccaaggccatggcactttgctgacgcagattgccatcattgccaaaataagaaactgctctgggtaaatcgtgattctccaggaaaagggcgttccagccgattccctcgaggccattctgccagttggttaacgcctttcgcagcatcgccacgtcgatttggccgacggtgaacttttcccagaaactgacgtggtcaaactggaagatcatgtcgaagtagccggttttgctgtttacccattcctgggcgcgggtgactggaacgccaccagcttcacccacggtcatgaggtgatcatgtttgaaatcagcactaagctcactgagaaacttgtcgattcctggaacgttattcatggctgcttcttgatcctggacgtctgcaaacgattgatttttctttaagtgagaaatggcgtccaatcggaagccgtcaacaccatgtttggcccaccagtcaataatttgtttgaccgcttcgtgaaccttgggattttcccagttaaggtcgggttgttgcttggcaaacagatgataataatattcgtctgtcgccgggttataagtccaggccgaacccccaaacaaggagacccagttattgggttccttttcggcaaccggttttcgccaaatgtaaaaatcatggtaggggttatcaaccgattttttcgcttcttggaaccagtggtgttgatcggacgtatgattgatgaccaggtcgaagacgacccgaatgtcattttgatggaactgttggatcatattaaatgtgtcatccaatgtgccatattgcgggtcaatatcttcataatctgacacgtcatagccattatcgacgtttggtgatgcgaagaatggcgacagccagacgaagttcactcccaaagatttgatgtaggggatcttttcaatgattcccggtaggtcaccgataccatcgttgttgctgtcataaaagcttttgggatagatttggtagccaactgcattccgccaccaagtcggattttgttgattattaatcaatgtgctcacctctcatgattttgaaacccctttcacaaaacacatgatacacgcttacataacgatgtgtcaatcgtttgacataaattaacataaaaagattttccaatatgctatactggtactatcaaaacgcgctgagaaggtgatttcatgcaaccaaaattagcagatgtggcaaagttggccggtgtttccgtgaccacagtttctcgggtgatcaatgagcggggctatttgtcagctgccacaaaagaaaaggtcttttctgccatgcagcagctgaattaccaacctagtttggccgcccgggtccttcaaggaaaacaatttaaattagttggcttgatctttgccagcctggagaatccattgattgcccaagtggtcgaggaaattgaaaatcggctgtttgcccgtggctataaagcgattatctgtaacagtatggacaatcccgaaaaggagcagcagtatttaaaaatgctgatggctaaccaggttgatggcattatcactggttcgcataacgaggggattaaggaatataaaatgtcggggctgccgattgtttcctatgatcgttatttccaaacgaaaattccgactgtcagcagtgataatcaggcagggggtgaattggcggctcggacgatgatcgaaaagggctccaagaagttcatggtcgtgtccggtagtttagagaagcgggctcccaataaccgccgattaaccggctttgaacaaattgccaaggaacatggctgtcctgttcaaatggtggcctttccgtttaattcgacgcccaccattcgtcgggctacgttacgtgaaaaactgctggctgatcagccggacggcattttctgtacggatgatcaaaccgcattgctatgtattcaagaagcgcgccgggcggggatgcgagtccccgaagacgttcaagtgatcggctacgatggctcggattacgtccaggagtatcatccagaattaagtacaatcgtccagccggtagaagacatcgcggatttgttggttcggttgttgttcagccgccttcagaaaaatgacgatcaactgctggataagtatgttttgccaattaaattacttcagagagattcgttgagaaaataatacaagcgccgggagagttgcaatttacatgcaattctcccggcgcttgtttggtttttgagattgttccgggctctaaccgggtctcgtcacactctgattgaaatgtgttccgagggcctgaggctaactctaagccagcttcggtcaaaacccaagcccagggtttcaaccaaagctaccttagaaaccgcctcacccagccctcgtcacactctgattaaaatgtgttccgacgcaactgatgcttgtatattaaagatgtcagcaaggtaacattaatttgtactaaactgatattaagcgctgtggattagtccatctgaggtacggatcctaacggatactggttacgttagactctaaccacagtcttttgttgtactgtt

SEQ ID NO: 173 - DNA, 195647 bp, Lactobacillus buchneri
ttttgtcttataatattcatgacgtaagtctcctttgtatcttggttttggtcgactaaagtatacaacgcaggagagcttgcgtttatttttttgccaaaaaagccaataaccacacgcctttggcgtgattattagctttcaagtttcaggatacaattaaccattacatcattcagactttaaagtaacatcctgatcaaatacaacaattaatgggaatgggattaattttccattctcatttttttcgaggaggagaagatatgactgaatgcgtacttggtgtcgatctaggcaccagttctgttaaagtaacagcggtgagtcggactggtgaaatcattgcccaggaaggaatggatttcccactacaacagccacaaccgggttacgcggaacaagaccccgaagactgggtcagtgccgcgaccgtttcaattgttcgactcattttaaaagataagctcacccccgaccaaattgtcggtatcagttattccggtcagatgcatggactcgtcttgctcgatgacaataatgaagtcctgcgtccagccatgctttggaatgacactcgttccacccaacaacgccaagaaatcatggccaaaatgggtagtcggttcgtcgacatcacccataacaagccactggaagggtttacgctgcccaaactgttgtgggtaaaagaaaatcagcccgagatctttcagaatgccaaaaccatgttactgccaaaggattacctaaggttcagaatgactgggcaattggcgattgattactcggacgcaaccggaaccgtgatgtttgatgtcgacaaacagcaatggagcaaggagattttagatgcatttgatattcccgagacaatttgtccgccattagtcagatccattgatgagacggggaatattaatgagtggtacgcagaatattctggattatccacccacaccaaaacctttggcggcggtgctgataatgcttgtggcgcagtgggtgccggcattgacggacccacaaaggtgctctccagcattggaacttccggagtgattttaaaatatgaacccgaaaaggaaaccaattatgatggcgtgattcaatacgaggaccatgccattcccaatgcctattactcaatgggcgtcaccttggccgcgggattttcactgagttggttcaaaaagacctttgccgaaaacgaggactttactgcagtcgtggatagtgccgccaaatcaacagtcggcgctaatgggttgctctttgccccgtacattgttggtgagcgggcgccatacgccgatgcggacatccgcggcagctttatcggcattgacggaatccatcagcgccacgattttgttcgcgccgtattggagggaattatcttttccttcagagatattttggatttgtatgaggcgaaaggaaaccaatttgagacagtcatctcgattggcggcggggccaagagtcccctttggcagcagatccaggccaatattttcaatgtcaaagtggtctccctgcaaaatgaacaggggcccggactgggagctgccatgctggctgcggttggtctgggctggtatcatgacatccccgagtgtgccaagacctttatccagttcaaagatgtctttttacctgagccggataacgtggaaaagtatcgtcaattacatcaaatttatcgaaaaatttatccaagtaccaaagaaatcacgcatgagctggttgatttccgacgagatcatcagcgttagcaaccattcaatggagcctcgaaactaaaggttccattttttagttaagaaagatgacacgatgtcactgccaaaaaaacaactcaaatttatgcaggaattcatcatggatatcaaattaatcgtcgcaatcatcaccatcacaatggcgctggtcttttatacaattggcgtgttctctgaacgaaagtcggacgcgcttaaactgcgccacctactattgtttggccttgggttggtgtttgacaccactgggacaacgatcatgtcatcaatcgccaacacctcgggggctgccacgcctgtcctgcatttggcaactggtttagccgcaattgctctgatggcctttcattttctgtgggctggttacgttttatggctgggaagtgaaaagtccaaacgcaatttccacaagttcagtttactggtatggctgttctggctgatcccgtacgttgccggtttggtaatgggaatgagcaactaagcacaggacgcaaaagggtccgaacaccattttgatgatgttcggaccctttgacaattagtttgaatagactattttgacgacaaatatgaaataaacaccgatgccatttttcaattaatcattttgagcttcggcaaccgccaaactgcgttgatgcaggtaggttacaccgccgaagacaactgtccagatgatggcaccgaccgcaccgataatatcttgtgggatgaagaacaaggtcacaaagataatggcgaagaaagcgatggtgagtggactggtgaaattgtaccaaggcattttgaagccatttggcagaaagtcactggattcacggtatttccgatgagccatcattgccaaggcgtataccaggatatacatgtcatttgaagaaccggcaacgatcgtaaagactgaagccgtggcgttggtgagactcatcaacggggtaatcaagaggcacagtgcggaaaagccaatcgcagcggctggaaccccatttttagaaatcttggcgaaatggcggttcataaagctgtccttgggcgtttcagttgccagctgatagaagtgacggccagccgagaagatgaagctgttcaaagaagatgaagctgacgtcaaaacaacaaagttaatgacggcggctgcagccgggaagccggctaatttgaagacctgaacaaatgggctgctggcaggcgtcaaatgggtccatgggatgattcccatgatcacgattaaagcgccgaagtagaagatcaaaattttcagcagcgtttcgttaacggcttttttgatgattcgatgcggcgtttcggcctcgccgatggtaatgctgacaaattcaattccttgaaaggcaaagaagaccattgggaaggcagagataaaactcaagccgccatgggggaacattgagaagttatggaaaatattttgaacggaagcgtggccaagtggggtggtcgagtgcgtgaacatcatgaagaccccggtggcgattaaagcgacaatcgcgatgattttgattaaggcgaaccagaattcagcctcaccaaagaccttggcggcgattaagttaacagctgccagcgttcctaagaacacaatttgaatcagccacgatgggatatttgggaaccaaaactggacatatgtagagatggcggtaatttctgccatggcacaaaatgaaagccccagccagtaggtccagccggtaaagtggccgacggtgggtcctaaatatcgggtaatgaatgagacaaatgtgtgttgtgacggatctgaataaagcatttcaccaatggcacgcatcattaagaagaaaaagatacctaacactaaatagactaataaaattgatgggccggttttactgatggtggtcccggaacctaagaataacccggttccaatcgtgcctccgatagcgatcatctgaacgttgcggttgctcaaggagcggcgggtgccgtctgcgttttcagttacttctgttttttgcatgaataaacttcctctctgttgttaatgatgaatcaaattagaggcctctaattaatttgtcattatactaacaccacggtgtctaaatcgggcattttagagaggaagttttcagatgattttgtgattttgattattttttcatgaaaaaaaggcaggattgccggtttgcctatgaaaataaaaaactttttgcagctcttgactattcgtcgtcttccggcagtttgagtgggcgagggccaatattcgttgtgaaggcaacgtttgtgtgactgtagccgaactctttaagagacgcgttgaattcattcagttcggtcatggttttgtagaaaaccttcagctgaaccgaggcgtctccggtgatgtagttgcattccaccacattgggaatttttgaaatgaagtcaacaaacttaggcatttcaacgtaactcacgtcaattcggacaaatgctttgatcaaatagcccaacttttcgtaattgacattggcagtatagccgttgatgaagccgtgattttcaagattttgcagacgaacggacgcggatggcgcggagatgaaacatttttcagcgatgctcttgatggatgcgcggccgtcttcttgaatgatatttaaaattttgcgatctaatttgtccattcgttttctccttaaaaatagtttgcgtatattataccattcaccattttgaatggttttgagaaagctcgttggtaaatgcgtcatggtattaatgataattgccacatacaatgagaatggctataatgaattttgtatctaaaattcgaatttagtaaggtcttgaaaaatgatgaaatcgaaaacaccacaatggaagaaaaacatgtgggcgctttggttcggcaactttgccaccggtgccggcgcgagtatgtcaatgccgtttctaccgctctttatctctgagatgggcaacttccccaagtggcagttaacattatatgctgggctggcattctcaggcgtgttcctgagtcaggcgattgtctcgccaatgtggggaaatctggctgataaaaccggtcgaaaaccaatgctgctgagagcggcgatcgggatgacgattagtgccacactgacagggttgtcgccaaatgtctggttcctgatcattattcgttttatccagggaactttctcgggatatatcaataatgcttacgcgctgattgccagtgaagttccaactgaagacagcggtaagacgatgggaactttgacgaccggaaatgtcggtgggcaactgattggaccgattattggcggatacctatccggtatttttggctaccggctgccattttatatgtttgggttcatgatgtttctggcatcactgtcgacttggttctttgttaaagaagacttcaccccaattaaaaagggtgccaagacgggaatgaaggatgcttttcgagggattgctcacaagcgcgtggtctgggcaatgatcatttcatcaatgctggtcatggctgccacgacctccatcaacccaattattagtttgtttgtcaaagaattaatgcatagtcatggaaacgtagcctttaccagtggggtgatcgcggcactgcccgggattgcgacgatttttgccgcaccttatctaggtaggctgggcgatcatatcgggcctgaacgaatcctgctggctgggctaatcttctcggcggtcgtcttcttcccaatgttctttgtgactacagttgtgatgttgggagtgctgcgattcttgattgggatcgccaatgcggccctgctgccgattactcaaaccgtcatgacactggaggcgccggcccgttcggtgagccgaatctttagttacaaccagtcctttcaagccatgggcgcggttgttggccccatgctggcgtcgggggttgccgggattttggactatcgatacgttttcttgatgaccacgcttttggtattaatcaacattgtggtggttgtcgttgcttataagaaggatcatgttaaggttgttgatgtttctaattcataaatgtggtgaaggcattcctgttggggaatgctttttattgtgtagaggtcattattatatgccatttctttaaccaactgatataattaaaaagtaaatgaagccaattgttttgtgttatacgagggggcatttcatgattaacaaattagttcgattggttggtatctccgttttgatgcttttggcggggttcactgtattgtcacttggaaacgctcaggtggatgccaattctgtcatttacaatggtgctaatccacaaatgacgcctacaattggtggcggaactagcggaactggcgggactccggctggattggaacactatgtttatgtgactgttggtaatgaaaagtccaattattcgtctaatggagccttacaagatggaacaaatggtcgtcaatcagtaattgattatcaaaaatataaggatgctgggtctcctgaaattattgaacatatgtacttaaagaataccaacgctgatggcactaaagacatctcatttcaacgggctttcaggtatcctgagaatattccgttgaatcaaattggaaggccaatcgtagaagaacaaaaggaagatttgaagcccgatgttacgagcaatagtgacgaggcaaagcaaaaagttaatttctgggcaaatggtgcccacatggctaatgcctatgtgactctcgcacctggccagtgggtggatatatcaatgcccctcaagattaccaatttggattctattaattatcaaaaggggactgcattccaagtttacgaaggcgagcagtattggactggtggtacgaatctagtagttagactagcagaacaaatcgatccggatacctattcagattttcaaaaaggccagtatttaatcacttatttggataaggacgggtactatcagcaggcaaaagatattcaatcattaatgccaaaatttgatttggctcgtgacattacatttagtagtttgaacacgccgttcggcacttctgattcatctctttggacaggcggaacatattttgttgatggcaataaaatggtcgcaactgatgaaaagggacaatcattaaacttcttggatatgttatacagtcatggctatgcccctgtttggagaaacggtcgattgttaacatatgaatcatttaatgcttacgagggatcaaatactcccggtaacccagattactttaagtatatgagagacgttcttggccacaatggcatcggcggtattaactggcaggttgtaaaagtactggtagctgataatgccaccgtcaatcgcggggcaaagtgggctccacttgatcacgtaactttgtttgacccaaagcaggaaaagaatggttcggcctcagaagtccctgtgaccaaagataatgttaaaatagcttctgataatggtcggatcaacgctgatgggacgttggataccagtaccccgggtgtttataacgtcacctacacctacgaggcggtctattcagattctgtccgccgaaccatcagtaaaaccatccaggtaacggttcccggaaaccctaacggcggtggcggccaggccccatcctcgaatacttcagacaacaatgccaatccgacgaataacaacggtggaaataacgcttggaatccgactaatccaactgattcaaacggcacggggctgcccaattacgcagctgtgaaaggtgctgcggtgtacgcaaccaagcgaatctatctgtatcagcacccaactttcaagaaatcacaacgattggcgacttatcccaaagtcgcccgaactgctcggccgatgtttgtggtcatcggctacgcccgctccagcaacggtgccctacgatacaaggttcgagatgtcaatcatggtaagaagatggctggtaagatcggctatatcactgccaaccgaaaatttgtcgtgaatgtttattatcaatcgttaaagggcagccacaatattatagtgatcagcaagaaaggcattcacgcatacaagcatgttaatctgactggtaaattcaaaacctacaaacgttggaccccacttaaggttaagcgactggtccaccacaacttaacgacgcgctatcaattgaaaaacggtgactatgtcacagccaacaagaaattagtttttcaaattgacggtcacttagtcgttgtgcgcggatatcaaactaaataagaccatcaaaaaagttggagttcgtctccaactttttgtgtcccttgagttacaaccgcgagtcgatttggttaattcccccgagaacagtaccatattaaattgcaaaatggtaatatttacttaatacaaattgtgcgacaaaaggatattgaggagtgaatttcatgattttgagtttcaaaaaatcattgtatcttggcctggcagcaatcgcggtagtggccgcagttgaattaacaaccactgatgccagtgccaaatcatatgcgagaatcacatccaaccaagtgatgcagacagccccgcagaaccgtaacgtgacgaccaacgggacgaatgcgctctacaccaaagcgggtaccttgcgcggtgcccggatgattgcgtctaagtatacgttgcagcgatatggcagctccaagctttccagccagtatttccgggcttaccgggtcgctacgactaatcggggtgcggtttactataaggttgtttcattcaatggtgtttaccgtggttggatctatggcgggcgagtaaacgggacctttgccggcggcttgaatccggccaacacgatggcaaatgcgaatttacctttgcaaaagaccggctacaagttgaccaatccacagaaatacacgctgtgggtggatcccaaatggtcacggtataaggccaaacaagttgacatgagcagctatagcgccaatgacacctttacaattactgatgcggctgttaagacgcgcgaacaatatttatactataaagtcattgatgataaaaattccgcgattgtcggctgggtctattcaggtggcgtggcagctcctaattcccaacaggcaactaaagataacagcgtcaagattaactatgtaaacccagccggccagtccgttggggcttacacatggattatccaaaagacagatctaaaagccggggctaacatgaccgatggagccaagctgggggatattctccaaaacagcactcaactaagtgatgtggccaccaagaacgtgccaaccgggtataagatcagtgccacccaaagcccaaccaatcaaccggcaaatgtcaccgttggatcagaggactatctggtctacgtggatccgatcaaggccaactttctatcaccggttgcctattatttgaccaacactggtcagcaaattagcccatcccagctagtgggcaatacctatccgattttgacagacgcccagatgacgattttctcaagtcaaacccagggaatcgtgccagccaaagtctttgataacgcgttgtttgcagaccctaacaaactggcttccttgaccggcgtttcggtgaagaatgccgacggtacgatgactacaccaatttattacttcaacaagcaggcgacgattgccgccaacacaacagctaggtatggcgatactttgaagctttactatacgttgccgcagagataagctaagatggcattcaaattcattgacgaatttgaatgctatttttatttataagctcaaaataccagttctgaaagctttttgcttacttttttcacctgattagcccataatataactactctaaaaagtaaagggaggcatttggatgtcgattttaactgatacctatgaattaaataatggcattaaaattcccaaagtgggcttcggtacctggcagattccaggcggccaagacacctacgacgctgtcagcacggcccttcaggctggctaccgtcacattgatactgcaaaagcctatcgaaatgaaaagagcgttggcgaggcaattcttgattcggatgtggaccgggaaaacgtcttcgtaacatcaaaattaccagccgcaaccaagtcctatgacggggcgattgcggattttcgttcaacaatgaaggccttgaacctatcttatttggatttgtacctgattcatgctccgtggccatggggcgaacggggatcgaccaactatgatgaagccaatgtggaagtctggaaagccatgcaggatatttatgccagtggtgaagtgaaggcaattggggtttccaattttaatgtccatgatcttcaaaacattttggctcatgctgatgttcagccgatggtggatcagattcgctacttcgtcggctacaccgagcctgaaacaacccaatttgccaaagataatgatatcttggtggaggcatattccccacttgccaccggcggcattctggagaacttagacattaaaaagattgctgacagatacggggtgagcgtcgcgcaattagccattaagtttgttctgcaaaatgacgtgcttccattacctaaggcaactcacaagaaccatattgaaaataatacccaattagactttacgattagtgccgaagatatgaaacttttgaatgggctcacagcaactgatatgtaatatagagaaatcttgaacggatcgcacatttgcgacccgtttttgtttgaaatttgttacagtggagttgaatcctaattgaaaaggggaaaatcatttatggcaaatgtattgattttaggtgctaatgggcaaattgcaaaattggtcgaaaaacaattgctcgatgaaacagatcaccagttaacgttgtttctgcggcaggcgaaccggatcacggtcgctgatcccaaacgtgaaaccgtcattgaaggggatgccaccaatcgacaggcaatcatcaaagccctcgacggcattgatattgtttacgcaaatttgagcggcaaaaacattgaagatcaggcgaaagcagttgtcggcgccatcgatcggaccaacgttcagcgtttgatttggatttcgaccttgggaatctatgacgaagttcccggtgcttttggcaaatggaaccatcagcagctcgacggtggctatcttgagccgtacaccgcagcggccaaggtagtcgaaaattctgatttggactacacgattatcaggccagcctggttatcgaataaagacattgtgagttacgaaaccaccgaaaaaggtgagcctttcaaagggaccgaagtctcgcggaagagtattgccgacttggttgttaagttgattaaccatccaagtcaggcaattcgccactctttgggtgtcaaccaaccgaatacggatggggacaagcccagttggtactgattgtctcgatttgcgtctgaatgttatctagtagaactgtgcgccaataagcagcttccagtgtataagggaagctgcttattggcgcacacttttttgttcaaaacttacaactctctaaaaaggtttgcgattctgttaaggaaagtgcaactttgtcacttggtttgcgtttttaagttgcgtttaagctgccaacgataatctagtgacaatcaataacgaagggagcaatgccaatgccacatcaaccattcaaacgcaggtaaatcatcaagcagcacttcaacgaacatttcaacttaacaaaatcgattcactaaaaaatgaaaccaaaaaggagatcatcaatatgaacttaaaaacaatcttatacgcaaccggtgccgcaatgggaatcttcacaacgagtgcagtgactggcgcaactgccaacgctgccgttaccccaaccccacaatctcaacaagctagtaaaacaaataccaacagccaaacagctaatggcaataagacccaatcgaacaaccagtccaagagtaacactgatcaagttgctaagaagacggatcagaataaagctgcaacgataacgccagccaaaacgcaaaccacaccggccaaaaccggaaaccaaaccactacgccagccaagtcaaattcgagcagcaatcagcaggcgaataattcaactcctgccaaaactacgaccccagctaagacaacgaatagtacagccactgcgactacgtttgatcaacgagccccaaggctaaccggttcagcttataagagtgaaaatgccgggtttaaaccaactgtccaaaataagcacgctaataaaaatgtgactgtcaaatactcaattaacacctacgaatctgacggttcagccagctccaagccgttccaaattaagatctacaaagacggcagcctttacaagacgattaacgcatcttctggtaccgcaactgggtcattcagcgctcctaaaggtacttacaccctgcgtgtctacaccagccaatcaactcattacactggcggtttatcagttgaataaaaaaatcaaataaattttagccatttaagcttcgtttaagttggctgaggtaatctatagacaatcaaataagagaggagggaaacaccaagcaagcacatcaaaccaaacccctaatatgatttctaatcagctcccagatgactgtctatgcgaaaggaaggatgaactgtacatgtcaaaaaagacccttttaaaacccaagtttaaatacgcatacggttccaaccagcatcaaagatttgtggtctggagctgctactaaaaccaagtaccgagttaattcaagaccgagcgctggaactcactaactcattgaaaggactgatgccatggagaataatcggatttactagcgtatcacaatataatattcacccctcaaataattactaagaaatacccaacaagattgacaagattcttaacttcatgaaatacccctcaatatgaattgaataagaattacccctcaatatgaaatataaaattcccttagaaagtcctgtatgcgagcagggctttctttttgtcttcattcaaatttttaacgtgcatttgattgttggaaaaagcgaagttgcgtacaattagtttagatgttttaattcctaacgaaaggcggtgacaatcttgaagtcgagtgctgaatggtcaaccaggtggcctgaacggatcagctatgggttaagcgatgccgctgacaacctgatttttcaaatgatgacgacttatttgctgtttttttacaccgatgtctatggtttgacacccagtgcggtcgccatcttgtttgtggtcgcccgagtagctgatgtcgtcgaaagttttatcatcggtatcatgattgaccacacccattcaagatttggtaagagtcggccgttctttctgtggtattcggtgccttacgtggcttttgcgattctgacgtttgtcacaccgaatttctcctatggcggcaaactgatttgggcttacgtgacctatcttggtctggggttcttatacactgccgttaatctgccaatcacttcaattctgccgacgatgtcacagaatactcgtgagctgacactgcttggggttatccgccagttctttggcagttcagtccaaatcatcgtggcagttttcacactgcctttagtttggctattcggccacggcaaccagcagatggggtttctgggaacgattatcgtgtttggaatcatttcactatttttgattatcaacaccttcgtgcacgtgcgtgaacgcttctccaatccacacattgcccaccaaccggtcaaggttgttttgaacatgttagcccacaaccagccgtggattatcatgtcgatcgtgatctttatgtattggctggtcacggcgattaagaatcagacgaccatctattacttcaagtacacccttggcaatgaaggtctggttccctgggcaaatggctttactttggcagcgttaattggcgtgttaatgattattagactgactgatcaccaaagtaagaagaaaacgatgttacatgggatcctgattgctttaaccgggcaggcgattatcgctgccggcgtgtatggtaaatggctgctggttttgtttgccggtgtctttattaactcaattggaaacggcattatcatcggtctagtctcaattatgattgccgacactatccgatacggtgccagcatggggattcaggcagaaggtattttagcttcaacggatgattttggggttaactttggtctgggaattggcggcttgattacggccggcttgtttcacgtgtcgggttacgttgccaatcagtcacagaatgcggcgactttatcgatgatcaattggaactatgtttggattccactggtgatctatgccgggatgtatttggtgttgagtttatatgatgaacagcgaattattgatgccattgaaaaataaaattatggtgaaagtcgatttgataccccaatccaaccaaacaacgcacccatttccacgtcagaaatgggtgcgttgtttaattggatgacctgttccggaaacatttatgaatgcggcgtcctcaactgcatattagcattgaaaaattgtggatacgccaaataacacgatatcgtactgccgatgctggtggccgccatgagcataaaggtgaccatgatctggtacataatcgccttcgtagggtcgacaccagcaaagatcagaccagacatcataccagggaggctgacaatccccacagtttttgccgaatcaatcgtgggactcatcccagtccgaattgcttctcgtacgaccgtaatggcggtttggtaacgcgtcgctcccaaagccaacctttccaacaacccttggcgctgatcatggaactggctgttcaagcttcggtaggccaaaccaatcgcaaccatcgcattgctggcaatcataccggaaaccggcacgatttgactgggaacaaaggcaatcgctttagccaaaaccagcaagccaattgtaacccccgtggcaacagcaatggcaagcagactgatcacaaaagcatggggaatgcctttggcacggcctcttgcattccaagccgcgttgaagacaatgatcgctaccatgagaagtgtcagccaagctcggttaactgagatgatataggtcaggacgtaaccgacaattgtcagttgaataacggcacggatgacgccggttaccaagtctttttcaagaccaattttttctttgaggctgataaaaaatgcgaccgccactaaggcaactgcaaaaaataaagcggtcggggtaacaatcaggtgattcatgctgtcacctccattctgccgtcaacaatggtgataagccgatcggctgccgccaattcagactcatcgtgcgtgaccgtgataatcgtgacgccttgtttggtgaagttagccatcacttgatggacagtgtcttttgttgctgcatccagcccagttgtaatttcatctaataacagcacttttggcgtgaagatgagattgcgaatcaacgcgacacgctgcttttcaccaccagaaagttccgtaatgttctttgtcagcatatcggcagggagattcacatctgccaaagcttttatcatccgatcgtgattgaccggcttttggcgaatttggaaaggaaaggccagattgtcttcaacggtctcaccaaaaagactgggttgctgataacaataagataccatgcgacggtacgccgtcgtttcatattcttgttgtggctgacccgaaaatataatttggccttctgtgggtgtgagcaaggtggctaataataacagtaaggtgctcttacctgacccggaaggaccggtaatggtcacaaattctcccggtgccaccttaaaagaaatattagccaatagcgttcgttgtgagactgttaaaccaacgttttgtatgttaaaaattgcctctaccatttttgattcccccatttttttctattattgattgtagaggattgcaaatacaatgtcactgataatgattattaatttataatcatactaaattagcttgtgagtcgggcgtgacagtcgagtgctcgccgccatgacctaagttgaacgctaagaaaaagtgccccaaatatcatcgtaaaatggtatctggggcaccttgatttggacattattatttattctttcgcaccagctaattcaaacagctgagccattttggcggacccatcagcgtggaagctgaaggcaacttcactgtaagttgcccaattgtttaactcggtgtctcggtgttcggcatcgcaggtcagcagttcatggctggctgtttgggcagtctttttatacgatacataaccattggagttgtacaccagaattgcgccttggccggaattgtaagtcgtgatgccatatggtgtgaaataagtcggcaaaacggccatacactctgcgtagccactccccgaggcattataggactggccatttggacgaacgtgacttagcttggtccacagttctttggaacgaacgatagttttagctttcagtgaagatcgatgcttaaaagccttgagtcctttcgtcaatcgataagcattaatttgtttcatgtactgtgtgtcaaccttgcgagccaatgttgattcctttatgtacttcacggttagcgagcttggcatgctggcataggtgtaattctgctgaatcttgtggggtaaatagcccttgattgttttgacatagccggacttagtggccggataaccgctggtcgtatacgtgtaggtggtaccaaacgcattaataccatttgaaatgcgggtatacgtaatgggcgcccgtaatgtttgccccgatgttgaaacgtaattaaccgtcatagttttggcggctttagcgttgccgccaaatacggcagccgaaaccagtcccaacgtcaaagcgatgattgataacaattgactgcttgatttcatctatatccccccaatacggatcgaaattattaagaatttcttaagtgtttgcaaattcattatagcaaattatgccggagggcgttcaagaaaaaatgaattatttcgtgattcttcgagtccggatgaaattaatgattcgggcactcgtggtaaccgttgtccgcagcgcaatcccgatgatcaccacaatgaggaagtactgcggtgcaaagtaagaaatcagcaggtatagcagactaaatccgagcatgatctgagccgatctgtattcttcgcggtcatgagccgacattttgatcccatctgcttcaccgatttcaatcacttcgtggaacatgattgcctgggtcaggttcaccaagataatgatgactgaataagccattgttggcagctggtggccaaaatcgtcatttaaccaagaggtcgcaaacggcgtcaaactgatgaaacagaggtaataaatgttggtgattgtaattaaagacgttgtatgctcgatgcgactaaatagttcctggtgataaacccaatactgagaaacaatcccaaaactaacaaaataaatcaccaaatgtttgatcagatccagcattggtccttgcgctgtactgattggcgttttgatgtccaagaccataatggttagaaccacagcgaatatcccgtccgaaataccaattaagcgtgattttgaatagtgaaacaccccgatcatccccctagattagtgtatgagctcattttacagctctttggtcggagagggtagttcggttatgaaataaatggccggttattgttcttttaatttgcaggcatattcaattattgatctgcaatgtcattaacatactgttatcaatatcaaatcaaaatagttatgtttttgaggatagtgtgataatattattttgtaaatcaaacgggaatggaattcatataggagtgatacttatgcgtgttttaggaaagcgttcatttattacacggtttcaacaggtgtgtatggccgtggtagcattcttcgcagttttaacaggccttggattttcaacaacgtccacggccagtgctgcaacaccttcaaaggatattttgcgaccgacacttgcgataactggtgatgacgttaatgggaagcagcagacgattgcttcaatccaaagtgttgctgatccaacaactactcatgccttgctgaatgtcgataaatattcaaacatatatgctcggtattcagttacaaatgacttagggtattcattgccagtttggaattttgtccatcttccgtggttgtttgatcacaccgcaaataacccaaaatccttagtttttgacccaagccgaggaaacccggaaatgaagtcaattgggtttgccagcgatctcaaagaaccaatgatggaatcatggtcatattctcaagacagcagatatgttttacaatatacaccatcagaagacttaacaagtattttttatggtggaatgactgacacaagtagtgtttggccaattcagatggctgcaaatgcaagagttgagatgacagttccattgaaactggcaccggattttgactttaatccatcacgtgtcgctcgatttagaagtgaaatgcaattctatacggacaataccagcgtggataaggtggtaaaaaatgaaattacactccaaattacccgaacccttgacgttgccgacttcgaatccgacacctacgcaacgttaaccaacgctgataaattcaaagggatcaatcatacgtttgatgccgatgggaaggaacagccggacaagaccaaagccgacgccaagatcaccccaactgatcaaaaaggcgtttacgatgttgcctacacttacgatggggttaccaagaaagtgaaggccactgtcaaagatcaatcaaccatcgaggctggcgactttaccatcgctcatggcagcaactgggacactcagaagtttaatggaattaagagtttgactgacgctaacggcaataaggttaaatcgccaggtaacgtgaagattaccaatatcaaagacgcagccggcaaggatgtcgacaaggtggacaccaacgccgcagagaaaacctataccatcacttacaccaatggtggcgcttctcaaagtgtcaaagtaaccattggcaaacgggccagtgtggtgacaccacctgccagaaatacaggttcgacaagcagcacagtgaaggttccgggacgaccagttacggataactccaaagctagcggtggcaatactgctggcaatacccagacatcaaccaaccagcagcctgccaacaattcgcaaccagaaattcagtcttccccaggggtcgctaagaaaggcgctgccgtgtacgccaagaagacaatttatctgtacaagggcgttaatttcaagaaagcggaccgactggttaaatatcacaaagcacaacgcgttgatcgaccgatgtttgtggttacaggatatgatcgctcaagcaaaggcgccttaagatataaggttcgggatgtgaaccataccaagaaatctgatgggaagatcggctacattacggctaacactaagtacgttgtcaatgtttactaccagaccatgccaaagaaaaatcagctcacagtgatctccaagaaaggcgttcatgcctataagaacgtcaacctgactgggaagacaaagacttataagaacggtacgcatcttcgggtcaagaagattgtcaaatatcatttaacgactcgttatcaacttaccaatggcgattacatcaccgccaacaagaagttaattattcaaggaaatcactaaattattttccagaaaaagtcctggcatccgctgctcaggacttttttgatgggtaaaattctcattacaaccgatttgcacacaattgtaagcgctttgtacttaagtgatcgacttccccttacataatagttatgtaataacatattaaacaaattagtactaaaagcaggaacaaagtggtactatgtgggtggagtggggaaagtatgaatatcaaattatgagggagtgtttatgatggatagtcgaattagcaactcatcaaatttgaagtttcgaacaaaacacagacggatatggaagatcctaaccgggatggttaccacaatcgcagtcgcgtgcggattgggatttatgcacgcttctgccgatgatgtgaccaacgttatccagcggaccgatgaattcaatattagtaaagtgaatccactgcaatacacatacgtccatgagagtctcagtcacttgggagggtggcagggggcagcttatgccgccgcaattcctaacgatgccaagggaactgatccgaagaccggcaactcgtacgttagtgaatggatgccggatcctggacttgagtatttcatttggcaggcagcctttgccgacaagtacaaaacggcggaaagtttttttgccaacttttcaaaaaatgatttgaaggatcttgagtcactttatagcgaaatgggcccacaaaatgccgggaccgactcaaatccaaaaccatcccagtattatatggctttaatgggaatgaattctcttgagggactgcaatatgcaacgaaactcaaacagattaatttggatcccaacgtctctgtcagtgcggtaacttatggaacagcgactaaaaatggtaatttatgggatatcagcgcgctaaaaaatttgaatcaattacagtcagtgatgatccaaatgttttcgattaatgatatttcagcgctggccaacaagcctaatttgaccaatctttcgttgaattacaatcaaattgccgatttgtcacctctggcaactaacaaaggtaacaaggggctgaatttgaagaccggattcaatcaccaacacattcttttggaaccggtcactttgcggggcagtgccgctacggctgctcaaacgtcgtttacgactccgtcctttatcatcaaggatttggaatccgccaatttaccggtgaaggcgtttgacatcaaaagtgaaaaatctgattatcccagtttgtacccaagcacctctgatggcggcaacatcaatcccaccactttgacgtggacaaacttcttaccagacaaaactaacttgtatggttcgttgtccagtcactggaccgatcccaactctgattttgaaggctggatcatggtgccttatcagtttaaccaaacggtcggcaatgtctttgtgaactatcagctgctgcagtccaatgggaatcaactgcagttggcaccgaccagcacaatggcgggaaatgttggggatgcctataatattggcaataatccaaacacggcttacaccctgaataaattaatgggagaagacaagcgggtggcaattggcgtgtttgatgggaccggcttatatgccgatttcaaagccaataacggcaaagccaacgcggttggccagtccggaacgtacaccgatcttcctcagactcggacgattgtgtttgcatcggattcatcaaccgtcacaatcaactacgaagatcaagacggcaacaagctccaagattcaacggcggttacaggaaaaaccaatactgtttttaccttaccgacaattccttcaacaatcaccaaagatgatcaggtatacactttgaaggggctcaaggaaggtcaaacagtgccagcgaaatttgattttatggacatgtcactgacctacgtgtatgaagtcaagccaaccgaaagcaaaccagtcaccgttcgatatgttgacaaggacaatatgcctcatgagattgggccgcaaaaggttttgactggcaaacgggatgacacctttaatgtgaacagtgatgattacaagttgaccattccgggctacacattcgcaggtattttaggtgatgcgacaggaaaatttggtgacaatgcgcaaacgatttacatgcagtacaccaagaatcctgcccagccaaaatcagtgaccattcggtacgtcgatattgacaacatgcctcacgagattggccctgaaaaagtgattaccggaaaaatcggtgacaactacaacaccactgaagcccagtacaaacttgcaatcgatgggtatacctttgtggatatccaaggaaatgcgacgggtcaaatcagtgaacaggggcagacggtctactatcgttataaacgggatcaagcgaaaaatgaggctaaaccgattataatccgttacgttgacgcagataacatgcctcatgaaattgcgccaaccagaaccgtagccggcatcattggtgacaaatatgatgtccgtgacaatatgtacaaactcagcattaacggatatacctttaaagatattcaaggggatgctaccggaacctttgacaccactggacacacggtctattatcgttacaccaaagataaagccaccccagtgacgccgccggttaacccaccagtaacgccggtaaccccaacgccgacaccacagccgacgccacaaccaactcctcagccgaagtcagaaccgacttcacaggagacggtgacggcaccaaatgaagccggcaagattgccaagaaaggtgaagcggtctattcactgaagaagatttacctgtatcggcacgctgatttcaagaagggcgaacgacttgccagctatgccaaaaagccgcgggtaaatcggccgatgtttgtcgtgagtgattatgccaaatcaaagaatggcgctctgcggtatgtggtgaaagatgtgaatcaccacgccaaatcagatggaatgaaggggtatatcaccgctcggtatgcttacgtccgcccagtatattaccacagcaagcaccaagttctgacaatcattaacccaaccggcgtcaatgaatataccaaccgaaatttgactggtaagattaagaatttcaagcagggcactcaactcaaagtgaagggatttgtcaaacataacctgactacccgatacctgctgagtaatggacactatattaccggtaaccggaagctggtatttgccagcaagttggttcaaccaaccaagattaaggttaaacggtcgatttacttgtacaacaacgtgaacttgaataaacgattgaagcacatcaaggcaggaactgttttgaaagtgaagaagtgggattactctcatcagtattcaacaacgacctttggtgctaaacgatatcttgtcagtggtggatatgtcaccgctaatgggcattttgtgaaagttgtgaagtaaggccatattaaaagcttcggtgtcagtagctggcatcgaagctttttgatttggacggagtcgttattttacaaattcattgatctaatcacgattttaaaactggaacttccagcgttgaatcgtttaagttcaatgtgtaagtgatggcttgattaccgtggacagtgtagaccaggtcactggcatagattaccaaccccaattgatgacctttgagtaagtgccaaaaggttggctggaaggcaaaccgtaattcatagttcgtacgcggctgcacatcatcgactcgataagaattttggcggttctgcatgttgatgtgagcttcggtgattcgtttaaagtcggttgggtctgtctgaggaagaaattcttttaaatcatcctttcgccaatggtaaccttgcaaaatcttttgggaaaccagcgtttgagggacttcagttaatcgttgcgcctcaccgtagtcgacaagggcaacgctgatttggccgacaatggaactggtttgggcaactaaagagatcctcggttggccatcaattgtgagatcgtgtgtcagtgggtcggacaagagccgaatgcagtggttgtccatggcggtgccttggcgtgaatataaatcattgcgccagtcattaaggtgctgggtgtaatgctcgaaaacctgttttggcagctgatctgagaaactgagattaccattgatgttattcaaactggcgagcgagaaagtgcgcttagttgattcagatccgccccagtcaggatagtcatgccacgtttctgcgtgggcgttgtcctgaacgattacatctggcatcacgtcgtcgacccgattttgaatcccaaatagtttgttggacagccacaggtttaccaaatcggtgtaatcaaaggagcgaaaattgttgagatactcgtgctggccttggtgaaggatcaatttttgcgtgatatcccgggtctttaacttattccgggaattccagacttgtccggtcttgacgttccaatcattcaaaccgtgaaccagtagcatatccgccttggtatgattatatttggtaatgtttcgggcgtcccaaaactggttgaagctgccggtatcgtgttcttggtcgtgggtcatttgttttaaatgtttcagccaggcgtccttgatttgagcataatctccagcagttcgttggcggctgaaagtccattcagccaacacatcggcatcatcaccatcaggggcaaccaccaggccgttttcccgataataagggtagtaatcggataagccggcctccacgatgctgatttttaacccgtcaacgccagtaaacgcggctgcggtggcaagtgttcctaaataagagcggccagtcatcccaacgttgccgctagtccaccaagcatcaatcgcaatttgatcggagcggttggtaaaggcagcgcgcttgccgttgagccactcaatgaccgccgttgcgctaagggtctcagccttggtgccggtggttcggaacccatcggagtctttggtaccgattcccgatgagtaaacaacggcgaacccccgagccagaaaataatcattgagagaatacgaccaaaatttggtaaaggtttcgccggttttagtcgtttggccgttaatttttcgcggcttaggtggggtaacgttgctgggttgtgcttcaacatcttgataggttaggtgatttggttgttttcgcttgagcggacgtttgttgtcgagggagaatttctctgaccatttttcattcatgccttgggcgtatgggtcggcagtgaagataaccggcgcttggtagccctcgttagtttcagcaggccggatgatattggtttttaacagatcccgtttaccgtcgtggtccgagtcaagggatgattcgacgtagatgacttcacggattaatttatcagtattgaaaacggcttgggctttgccgttgaagaatagtggtattttgaaatcggaatcgttgagaaactgctggtaataccctttgccagctatgtagtcgatcaggagttgaccgtatttgttccgggtattcaacaaccgataccaagcgtcgattagctgatcacggttcatcgttgactggttcagcggtttcggtaggcccagttgcgtgacggccttgaatgggtctttgagggaaaaatccaatccgtctaagaatccaagtaattggaggccaatattatagaacgctttagcggaccgggaccagttgccttggtgaatgttgctgcatcaatcgtttctgttgccattaagttgtgaatcttttccagtcgagtggttagggaagcgtgctgggagaagtattccagcaaaaaattgcgatagagttccatcggatcgcttatcttaagattggtcggattcaaaaaatgaatttctgtcagttcattgattatttgttgatggttggtggggacatacccgaattggttgattttcattaagtgacctcctgaatgtaattaatgccattatacatttgcggcttggcactgcaaaattaatttaaaaagcagcgattccgcttggtggttaaggaatcgctgcttggttattctcaagttgttgatgaagctaatctgaaatcaaatcggctggttggaaatcttttaacctgggatcctgtgctactcttcatgcttttcttggtcggactggtcagcgtcatggtcagtgggtttggaattttgacccggctcatatgattgagctttagcctgcagcttcttttgcttgacctcatgcttggcatcccggcgttctgctcgccgttgggtgcgtttttgatgctcaagaattttatcttcttcgtgggcagcccggcgcttggcctttgcctggcgttcaatatctttggctgcctgtttggcagattctttatcagcttcctgttggcgttcggtttccttggcggcttgctttgaggctttttcacgggcttcacgctgaatttcggcttcttttgcagcagcttcggcgtcatgcttgcgttgatcttgctgctgttcggcttgtcgtgctgcttgtttgacggcttctcgattggtattacgctgttctttacgaatttgctcagctgcgtcacgatatttcttggaaccgtcacggatttgcttggcaaattcttcccactgtgcttggcgctcttttctgacttcaacactgtcaggattattgctgggagcgtgtgggttgaccgaatggccggcactgtcggtggcgaccgggtgatcaagccaaccgctaaacccatgttggggatgactcgcgtttgacgttgttccgtcagttccggttgctgcctggtcctggaccatttctctaaattgattaatggcgttctgcggcaacttcaagtattcctgtcgctgctcggtggtcaattgcgaagcatcgtacatttgttgacgatcgcggctgcttaggatcatatagacgattggatagggaaggtagaaccacaagacaacctgcgggaaaaaataggccaggacaatcaagacggcgttgaaaatcaaatagtattgattgtgacgcccatagattttccgatacagctggcgcatttttgatttgtcagtgtactcaaagtgcatgactgatcttgcaagcaggcgaaatgatgctgaaaccaaaaataacaggagaccgtatgccatgaccggaatccgggtggtgttgctggccatcatgtttgtggccagtggtgtcagtgatagtgggattaagaagataaaatcatacaacatgattcgataactcatatcgtcaatatcattgaacaaggtggcatgctggtaccacatgttggccacaaaagcgaagctgataatatagatgccaatttgtttgcttaaaaacaagtaatcattcaagttgtcccgcaagactggtgttagatccaaaaccataattgtcaaaataatggcgatcaccgcatcgctaaaagcgtccagccgactcttcaactttttcatttgttttgccccccagaatcgatttagtagtatgtattatgctttaaatgtagcacagtggccgtcaataaggtgataaattgtttaagaaattttatcagtctcacaaaataattgggtggcgatataataaaactaattaaatgattgtgaaagaggtggcagtatgtttccttacttgggtctcaaagccagtaccaaccaagcccaaattgatgaacgattaaaatatcaccctgaagtatttgaatttttcaccaccgatcaggatgtgacgccaagtggcctgaatcacttgaaggcgatgattgaacacgtgaaggccgctggggtcgacagaatgtcatgcaccacccgatgaagattaacggccaacacaatgaagtggcagttgaccgattgagcaatccggatgcttaccactttttaatgcagagttctgaaaatttgattcagctggccattcagactaacacgcaagttttgattcacggggcctacaactcaccggtttcagatattctcagcaactatccttcgattgattccgcccgcaaggtggtgttcagccgattggaccattttaaatcactgggcggggaccatgtgatgttcgaaaattccatttcaccgttgtttgattacggcgatccagaaattgaaaacctgatcattgagcatcaataccggctgtgctacgataccagtcatgggttcattgtgctgcacggcgataattcgaaactcaaagccagtatggcgcatttgcgagatcaggttgtccattatcattttgtggattcaatgggccagttccacgacagcttggaactgggaaagggcgcgatcgattggcagcctttaaaatcggtcgtcaatccggacgccaccgatatttttgaaatcaatctcaaagaccaaatgaacagtcaagaaatgcgtgccagctatcagtacctaaaagcctcttggcaaacatccggttgattttgttgtaagatggaagtagttggtttgggggagttacatagtgaaatttaaaaatgtctttgcatttatcattgtttcagtattcatcgtcatggccttggccgctgctcaacattcatttgcagttcggaaggcagcaacgccaagtgatagtcagaccaccactcaaagtgtgtattggaaagcgccgtctgaagacaaagcttatccagaatggtccaaaatgagcaagccttggatttatgtgagtgttaaacaacagaaagtcttcatccatggtaatggcaaggttcaatacattatgaactgttcgactggcatccccagcagcccaacgccacggggaacgttccatatccaaaaggaacgcggctattcattttataacaagcgctcacacgaaggcgcccactactgggtttcctggttggatcacggcgtctacttattccacagtgtgccgaccaacgcccacggtcagtacgtggtttcagaagctgagaagttaggcactcccgcatcccatggttgcgttcggctatcaatcgctgatgctaaatggatgtatcaaacggtgccgtttggaactaaagttgttgttcactaatgaagtcatatcgtctttattcgatgaatgaggctgagacaaagagctaatctgtttgcctcggcctcatttaattagttaaaaaggctgggatttccacgctgacgaagaatgatcagacgttctaaataattgactgaaagaaggttctaacatgacattgcataccattttaactccagagtggattcatgaagccaaattgattgccgccgagaatcctcggctggagggctttgttcccagcgagggcggccttcatccacgaattctcttgttgggtgaagcccctggtgacaaagaggttaagattggccgcccatttatgggcccatccggcaaagaactggatcgctggctggcatcgctggggttaacccgtgaggatatctacattaccggagttgtcaattcccgtccattttcaattgggaaaacgggtcgaaaaagtgaccggcgccccaatcagaaggaagttaagcgctcggctgcgatgtttgactgggaactatcccattttcctgatgtcctcttggtgccaatggggaatgccagtcttcagcggttattaggtaccaaggccaaaatcggtgatttacatggccagttgttggaacgcccaattcaaaaatataaccagcagacagattcctttgaactctctaaggaaaaacatcaaatctttcctttgtatcatccatcgtattcgaagcggttcaagaatatgaagcccgtggtcgatgcggattcgcaaaagctcaaacaattactcgaacagcaatcaaaccgtcattgaacgccgaatatgggctggatggtgttagtctataatcaaatagtgttttgaggaaggtgaggatgatggcaaaaccgttaaatggcgttgatctctatcattcattatttggcactgagattcacgatccacgcgtgttgtttgaaatgctgacggtgaacgtttttcagccaggactaaattggcgggtggctgccagcaagattccggtgtttgataaagtcttcaagcattttgacgttcacgaaatcgccaagttcgatgaaatggatcttgaagctttggaagccgatccggagatgattcgaaatccccgcaagattcgggcggtcgttcagaatgctcaagcaaccttaaagctgcagcctgaatttaaagacttggcggactatttgtggtcgttcgagccaaaagatgatgtggttcgcggatcattgcagcgggattcccatggcttgggagctgagctggccaaggatatgaagaaacggggcttcacgttcgtcggtccgaccacgatggagttgctgctgattggcagtggcattttgaaacatgaacatgattaggaaaccttcaagcagactaaaagagagcggatcgccaagtaggctaggcaggctttcagccggccgtcgttgcacgtttaaactagataccagtggaactgaagaaaggttgaaacataacttacgattagttgtgtctcagcctttttttgcgatctaatgctcagcatcaggattaatatagttccacaatccagtttttgtcttggtcactgtcatccaaatactccggatgatcgatcaaagcagtgttaattttggccactttaccggcccttggtgaatggacttccgtgactgctttagccccttcaaaggagaggatgacgtcaccttctgcaacttcactgaggttctttgggaatgccgcaaaggaaatttcaccaatttcacctcgcgccaggtcatttaacccaattcgagtatgtgaatcatcaaccgttgcctgccagagatattttgaatcatcaattttttgtgccatattaatcttcctttcaatttgtaacgttagagtgacgagctttattgttatggtagcctccgggttgacagatgaaataatataattcatctatcaatctggaggcttttgttatgccaagaagcaagtaccgtgcagaagaaaaactggactttataactaagtttcaacaagaagatttaagtatcgaaaaatttattagtaaatactctgtatccgtttcacggcccacctttagtcactggctggattgttatactcgtgacggtcttgatggattaaaagagagtaagaagtggcaacattattctaccgagttaaagcaacaggtggtaattgattatctatctggtaaaggatcctttcgttcaatagccaataagtatggattacggtcaaaacgtcaggtggaggtatgggtttccaagtataatgggattgagaaattgacagcaactccgtcacgaaagccaggtcccgataatgacacggaaaaccacgtttgatgaacgcgtcaaaataactgaatatgccctagctcatgatcgtaattacaatgaaactgccgcgaagtttcaggtatcgtaccagcaagtgcgatcctgggttctgaaagttgatcaagggggttttcctgcccttaaggaccaccgtgggcaccataaggcgccgtcagagctggatgaagttgataaactaaagcttgaggtccgccgacttaaggctgagctcaatgataagaaggcaatcgaggctttcgcaaaaaaattgctcgccctgaaacggaaaccgtagaagggcgtcaggctaacttcgatgcctatcaattaattaaaccgatttcaaaaaaatacggctgtcgcaaggcaattcttttaaagatgatgggtgtctcacgacaggcatattggaaatggttaaagcgttctgctagtgatcgagaggctttcaatcacatgttagaagagaaaattaaggttttagatagcgaaaatcggcatacatttggcagccgccagctggcatttaatctgaatctcgatccagaagtgactgaacatattggccgtcgtcgggtaactagattgatgcgaaaactcgggattgagtgttgtgtccgaaggaagagacataatcgaatgaaacaatcagagcagcatatcaaggataatgtgctcaaccaagaattcgatcaagctaaacaaccagatcaagtttggctgtctgatttcactcaactggcctacggttcgcatggtgaatacagtgttaagctatcaggcgttttagacgtctatagtgggtacttggttgcccatcacattagtgcgacagaaactaaggaagccgcaatcgaaacctttgaaaaagcctttaaagtcgctggtaatcccagtccactagtgcatactgaccggggatcggcttatgtttctggcgacttcaatgactttatgtttcagcataatgtccggcgcagtatgtcgcgccctgggacaccctatgataattcaatgatggaacgatactggaatgaatttaaagtgtgctggatcaggacacatccacgaccaacgacttaccaggaattagagagtttaattgaatcaggtatcaactatttcaattcagaacgacgttcggcaaaaagaaatggccttaccccggaagaataccggaataaagccatttctaaacaagtaactgcatagttaattttatattatttcaaatgtcaacttgacaggccacagtgcatatagagcttgagaatctgttctgtttttgaaatggcattgttaaggtggccgtccggcctcattagtgtgtcaaggtcatcggaacttaaatacttggcaatggtgggatcggcgtaaaacaagtcccttaaagtggcgtgttcacgatcagcttggtcacgcagtttcactagtaatcggtgggcgttttctctgcccatgtgcttggcgagggccatcatcaatgatccggagtacattgtgccatcgtcagcggataagttctgtcgcatgcgctgggcattaaattggccaaatttaagaatattaatggcgtagttcaactggccggaaaggtacattgtcatttcagggagggcaacatataaatcacgccacacggtggtgtccttctcaccatcaactgacattgtgtcgtacatcagacccatctcgtttcgaatgaccgttgccaaattgacgaccgcttcgaccatatatgggtttcgcacggtgggcacaacagttgatccttggcggccgggcgcataggtttcctgaaattcaccaacaattgtctgactcatatagagtaaattcttgcctaatcggcccagtgcctgggcaatcatcgtttcgacatggcagtattcagtgaatcgttcccgctgcgtgtgccaatacatttccggttttgataatcccaagcgatcacaaaaatcctgttcgatctgatcatagtcatcacccagcattgaagatgtcccgtcggcacccgctaagctgccagcgaaggtaaatggcgccagtgaatcaagcttgcgcatgaggtagtccaattcattcaaaacaatcccgagcttgaatcccagcgtggtgggggaggcgtatgttttgtgggcgacggcagcagtgacagtgctcttgtatcgttcacacaagtcataaaggaccgaaccaagttgatcaagataatccttcagcacccggtcagactccttaagttgaagaacaaacgcggtgtcttcgacatcctcactggcagctccatagtgaatgtattgcccgctgtcgtcatcaaaaagtgactgacaaactgtgacaaatcccgccagaaagtgtccagctctggctgactcaatttttaactgcaccctatcaatattttccggaaccaatttggcttggatttcttggtaggctttatcagggatcttaccgtttttggccattgcgtaagccaccgccgtttcaacttggcaaatgactttcactcgattttggtcagaccagatatttcgcattcgagccgttgaataaccattttgattgtacagcgaacctagcatttcaccactcatgttagttcacctcctgaaaattaggattaagcattaggtcggccatttcagctgctgaaatggggccaatgttagctgataaatttgtcgttctgaaggcttcttccaggttgtctttcttaaaaggcgttccgatcagcttatcctcgattactttcaagtgaccattggcctgattaaagtcgccaaagatgcgtgcatgggtcacgatgccatcatctactgaaaaactgatttcgaccgtgccgagaccatcaaagtgattcccgtggaagaaatcatcgtcgcgtttggttcccataatgaaatccggatcggtgaacttgttctgagcgatttgttcaacctgcagccaatcctcttcagacattgtgtaggtgggaatagttgtcaagtcagtcgtttgaaagacttcttgaagaagcagccggcgcatttcatcaaaagtgatttggcgatattgtggtaggaaatactgacgaatgttggtaacccggctgtgaaccgacttgattcctttggaggccaacttggttttgggtggggttagcgcttctgcagcctgatccagatcgacgtctatcattaatgttccgccgcacgagaatcggttgccgattttgagcgatgacatccccgaaaactttttgccgtcgactgtgaggtcatttcgaccggtcatttccgcgtccaccccgagcttatgcagtacatgaatggctggtgttgcatattttttgaagttgaggtaattcgtgccatcgtcattatcgataaaggcatatgtcaaattacccggatcaacgtaaaccgcaccgccaccggcgccacgacgcgccaaacgaatatcgtgggtcttaatataatctaaattaacttcggagtatgcgtcctggttgacgcccagaacaactgatgcggccgctggttgtgaaaaatgaaagatcgtgtcggtaaatttaggcgaagtgataaaaaacgtcgagagactgccgctgactcccgggtcgcgcaaatgccgttgtgaatttggatcagataagtcgacaaaaataatgattctcagtcccttcaaaaaaattcccctgttaacgattacatagaaaagtatagcacgtccgggttaaaataaaaaagagcggaatagcccatcacaatggctatttccagctccctattgaactaaaacgataaaccgattatttttaaaaaagttccacaatccaagttctatcccgattatcctcgtttaaaagctcgggatgctcaattaaatccgagttcactttggcgaccttgccgctcattggtgaatggatttcagtcacggctttggcaccttcgaatgacagcattggatcgccgacacttaattcagtcatcttttccggaaattcggcgaaggtaacctgaccgatttcactacgggccaagtcgtttaagccgattcgagtgtgtctttcactggttttttcttcccataaatatttggaatcatctgctttatctgtcatgataatcatcctttcattatttaagatcgtacttctcttttaacattaaatctgccatgtcaggtggcgttattttgccgatgttagcttcaagattgctgattctaaaggcctcttccaagctgtccttggcaaatggcacgttggtaatgtgattttcaatggctgccaaatcaccattgggattgttgaaatcaccatagatttttgcgtgagtcacgacatcgtttttgactgagaaactgatttcaacagttcccacgccgtcaaaatgacgaccgcggaagtaatcatcattgggtttggtgcccatgacgaagtcgtcaccggtataggcttgatcagcgatttttaagacatccttccaatcatcatcagtcatcgtataggttggtacatcacgaatatcggtgactctaaagacggtcagcaggatacgtttttccagttcttcaaacgtgatatttttgtatttcggatcaaaatactgacgaatgttggtgacccgactatggacagatttgatgcctttggattgcagttttactttcggcggggtgagggctttggccgctttggccaggtcaacatctgccatcagagtaccgccgcataaaaagcgatccccgatttttaatgctgacattcctgagacctttttgccgtccacggttaaatcatttcggccggtcattttggcgtcgacacctaatttcttcagggttgaaatcactggttgggcatagcgtttgaaatcgccgtaatttgagccgtcgtcgttgtcaataaagacgtacgtcaaattgccgggatcaacaaacacggcaccgccaccggcaaaccgtctggagagttgaattttttgatcacggataaagtttaaattaacctcggaataaacatcttgattcaacccaatgaccactgatgcctgtgggggcctggaaaagtagaaaatcggttcagtaaattttggactggtgatgaagaattttgagagactgtcggtgatgatcggccggttcaaatagtctttaccactggaaatatcaacataacggataataatcagctcctctgattgaagtaagcggttacaaaagaattcaaaaaacaatgcaaccggaccttgactctgtctaattgcattgtaacccattattgggggagttgctcgaaagttaactgaaacgtgcgggtcacccagcccacgtggcactgtggttgaaatgtgctgcgagcaactgacactgcgatctaagtcactttgattcaaatccaaacccgggatttcaatcaaagcgatcttagctctctgtgtcaaaacgttgctctccgcactctaatcaaaatgtgctccgccgagcagcaacctgcacctaagccaacttcggacaaaatcaaaagcgattttgtccaaagtcagcttaggctccggttactaaccgctcggctccgcactctatctcatgtctaatggttgtttagatgttggctttggaaattcaacatccaattgagccaactcattatcagttaacgtaatatctgcggctttaacattatcgaccgcatgcttgggatctcccgattgagggatggccaaggtattgccatcacggattgcccaggccaaaataatttgccaggcagttgccgaatggttgtcggcaatttgtttgacgaccgggtcattagtcaaacgacctcgggcatcaccagctgcaacaggtgtgtaggcaatcagtggaatatgccgttgcctcatccaaggcagcaggctgtattcaatgccccggctgccgagattgtacagatcttcattggcggcaacctgatcggcattcggcaaatccatcagttcttccatatcagaaatatcgaagtttgagaccccccaatgcttaatttttcctttttgctgcaattgttggagcgtcgcgatggtttcactcaaaggaacggcaccacgccaatgatacaggtataaatcaaaatagtcggtcccaactaatttcaggctggtatccaggctgtgttccattctggaagctgaggcatttgacggcaggactttgtcgatgataaacaaatcatcacgctgcatgtccttgatggcctcgccaactaagcgttcgctgcggccgttaccgtacatttcagcggtgtcgattactctggcaccggcagcaataccatcttgaattgctttaatttcatcagcccgggtgctggcactgtctcccatgtgccaggttcccaaaccaattgcgggtactgttgaaccacctatgttcaattctctcatagactgtcatacctcctaattttcattagttaatagtataaccctgataatggcattcatcatctaatttttaaccactcaaaaatttgttggccgactgcttcgggtaaatagcgaatttcaatcagttgattgccattgccatggcggacgttgactctgatatgcgctaatttggtatgggtcatccagattgattggacaaataaaaatgactggatattcttgtggggaatcacgtattgcgagcgggtgaagaaatggccatcttggagaatcagctggtcgttgacaatcttccagccggtattggcagctgaataccagcccatcaaagccgcgatgacaaccaccggcaggctcagtaatccccacaatttaaagagatatagacaaggcaggacgatcactaggctgatcaaagtggcattgcggatgaaataccagtaagctcgtttcgctaaatgatccaattggctgaagtgagtgggcgcccaattgacgaacggatgcagggtgtcaaatacgcgatcggttttcaccacgggtaagatcattaaatcattgcttttctcatcatcccccgccgatgacgccgccagtgcttggacggttgaaatgtgacaccactggcgaatcacgttttgtttaattcggagcgcttgaatccgggcaatcggaatagtgactgaattgcgttggaatagaccctgctcagttttaagctggtcgtttgtggaattcagccgaaaccgatagtacttttgaacgatggttaaataggaaccggcaatactgataatcacaattaacaagccaatggcgcccagaatgattgcagactgatgaattaatttggcggtcaacgaatcaattaacttttgcggaatggcttcttgaattttgccgtagaccgcaaaaccggccccaataatcgggaagacccccagtgaagtcagtgcgaagatgtttagttcatgcgggttgatttcgtagtcggcatgttcagggattggttttaactgttcggttaagtgttcagctgcaggtgcaggttcggcgtttccggtgcgctgacgttcaatttctgctctgacccgttcgttaactaatggcaaaaccgcttccgggccgtgctcatcgtgaccggcggtttcaatttgaagcttttccagatgaaatgggaccaaaaagaaccactgagtgtgctgaattgtttgaatccgggtgtatggaatgtgcgtgtgccgtttgacgaagatgccgctgttaattgtcagcatgtccgagtcgatttcaaatgtaaagcacaggtaacgaacggtatgccaaagaatgatgagcaggacaagaacactgaatcccaggagtggcgcgatcccaatggctgttgaccagcgggtaatcggcccggatccaataatcagcagaagcagcgtatcccaagaatgccggaagataaagtagatgattgacaatgggttgagatgctgttgattagacgtcattgttccgcacctccaccgccaacttcataatttgtttccggagttgttcgccaacttccggtttgacaccatcaattttgtgggacgttgaggccgtggtgatgcggacttcttgaagcttttgcgactgtaaaattggcccggcagaaagggtcacgtcctggacgcgggcgatgggaatcgatactaacttgcgaaagataaatccggaccgcagttcgacggcatcatcggacaaggtgtacagccaaaaagaataccgatacggaaccaggctcatttcgaccacaaaatcaatgatggcaacgacaaaaaagaatccggcagcgtacagtagccattgatagttgaaaaaatagtgaatgatgaccccagcgaccccgacgccggctgacaacagtgtgttgaagatggccgagattcgccaaacggttttgatttgggcgggtaaatgatttgattcattcatgtgatttgcctccttaacggggaatacgatatgtcgtgtgttaagtttacaaaagaatgacgacaattaccatccgatgagttttgaataagggaatcaatccggtagacataacgcggtttatagcgttatacttacttttatgcttttcacgaaaatcgaaagggggctatcaattgtcgaaaaaagttagaaacgcgataattgtcctgatatttggaaactttctggtctgtattgggatgagtctgatcttcccggtcatgccatttattaagaacgaactgcatttatccgccaccgatatggggatcatgaactcgctgtttgcaatcgcacagttggttgcctccccaattgttggtcaaatctcggataaaattggtcgcaaaccaattctggttgccggcctgctattatatatggtttcagaaattctctttgccatgaccaactggttgtggatgtttgatatttcccggacaatcgggggcctgtctgccgccatggtggtaccgaccaccaatgcattggctgccgacctgaccacgccacggcagcgagcccgagtgattggtttgttgtccgcggcatttagtggcggcttgattttgggacccgggattggcggtattttggccaagtttgattataaaacaccattctggttcgcagccggattaggtttcttgagtatgctgtcgttgtggttaatgctgccgaacgaaaaagaaattgagaagattgctgccaaccatcaagttcccgcgcaaagcaggccacccaagcgggcgtcttggactcaggcaaagaagctgtttgcagggccgatgggactactgtttcttctgattttaatttcttcatttggattagttggcttcgaaagtatttatagtctgtatgtcaacgaagtttttggcttcacaatgggcaatatcgctttggtattgacgttaaacggactgacctcgctgacatttcaagcgttgctgttcgacagactggtcgtttggctgactgaaaaacgcttgattcgctactgcttcttactctcgtttctgggtaccggctggattattctggcgcactccaaattagaagtgattattgcaactttaatcgtgttcacagcgtatgacttgattcgcccggcgattacgactctgctgaccaaagcaagtgccactaaacaaggtttaatcaatggcgttaacatgtctttgaccagtgtcggcaacatcgttggcccaatcgtttccggcgcgttgttggatgcaagttatcacctgccatacttggtcgtgatcgtcttcctgttcatttcatggatcatgacgtattggattcgggatcatttctcagttgatttgactgagactaactaggcttttcctgctgtgagtgggagaagcctttttttgctgaacggaatcggtagccaacttttttgaaatttagacgacattttcctatcatcgcctctcataatcagttacaatgaaagcgcatactggatatgcacaaatgattttcacaaatggaggtaacaattatggcaaagcaagttgcattagttactggagcaggtcagggaattggtgaagccatcgcgactcgtcttcacgatgatggattcaatgttgccgttgttgatttgaacatcgacaatgccaacaaggtagccaagaagctttcaccagatggttctgaagcgattggcatcaaggccgatgtttccgaccgtgattcagttatcgctgctgtaaacaaagccgtaaatgaattcggcgacttcaacgtaatcgtcaataacgctggtctggggccaacgacaccaatcgatacgattacccccgatcaatttaaactcgtgtatggtgtcaacgtaggtggtgttctgtggggcatccaagctgcacatcaagcatttaagaaattaggccatggcggcaagattatcaacgctacttcacaagctggagtggttggtaatccaaacttggcattgtactcaggcaccaagtttgcggttcgaggcatcacccaggtggctgcccgtgacttggcagaagaaggcatcaccgcaaatgcttatgcaccaggaatcgtgaaaacaccaatgatgtttgatatcgcgcatcaagtcggtaagaacgccggcaaggacgatgagtggggcatgcagacatttgcaaaggacattgccctcaaacgtttgtcggagccggaagatgtggcagcagctgtatcattcttggcaggtaaggattcaaattatgttaccggacaaacgctgatcgtggatggcggaatgcaattccagtaagagcgcgacgagccccgggttgaccccagagtataaggaagaacggtcaatgatgaacgtactttgttcatcgttgaccgttctttcttatacggccgggatcaggggcgtcggagcgtattttcaaggcagaagggagctgttagtaaaataagtgcctcaaaacctgtagccttttcgctaaagtaattgtgcagctcaacaaacggtcaatgatgaacgggctttgttcatcgttggccgttttttcttgtacattagggccctgggtcgtcggagcatagctcaaaagcagaagggagcagaaaataaaataagtgctgccaaacttgtagcctctttgaaaaggtattagtggagtcgaaaaaaggaccagtgatgaacggtttttgttcatcactggtccttttgacttgtgtagcaggggtcaggggcgtcgcacacggggctaggcaggctttcagccggccgtcggagcatgtgtataaggcagaagggaggcgtaactccaataagttcattcaaagctgtagcctctcttaagcaccactgctatcgagcctaaacgtgcggcaaccggctgatcccggccatttaagcgacgaaaacgcctcgtcccagaaacaggaataactcgtttcgtcgcttaaattctgggatgaaaacgcctcgtcccctactcagggcataatcatcttaataaaaatcggcgtaatataagtttccacgatcgcagccacaaacagcagcggcatcaccaggaccagcgtatccgtcagcgtctgcttcagcagctcaatgtatttaatatcctcgcgtttacgttttaagaatttattcatcccataccatgccaaccgtgcactgatcgcagcggcaatcacctgggcagaaatttcaaaaattccgtgtggcaggacaccaccgacaaacatcaggaaaggactaccaacgatcgaaatcaccaaaccgacactataggcattttgcaaaacataataccaataaatcggtaatggaatcacacccaaggcgatgacaacggcggcaccagcgaagttccagaaaaataatggcaaaaaattagttttgctgggtgctgtcttatcgattccattcgtaaagtgatggactagactgccggtgtccatgaagttcttggcatagatcaacacgatgatccagacgattgccatgacgatcagatattcaacggctttcttaaaatagatgcttttaaaacgatcaatacttcctctaatcataacctgtcccccttgttttctataatgaaagtatacagttaaattgtccacaaaccaattaatgtgtcattgcaatttcccttcaacaaatcattttcattggccgcgggcggtatggtatgctaaaggagtaccaacattaaagattggagatgtttgttcttggacggattacaatcaacaattaaattaaataatggtgtcgagatgccacgcttaggtctcggcgtttggaaaaccagtaacaacgattcacgagacgcagtcattacagctatcaagcatgggtatcgggcaattgataccgcacgtgaatatgggaatgaacccggtaccggtgaaggtatccgtgaaggtatgcaacaggctggattaaagcgtgaggacatgttcgtcaccaccaagctgtataacggtgaacagggcgactatgacaaggtttccaaggtgttggacaaacagctgtccgacttgggactcgattatgttgatttatatctgattcactggccggttgatgccacttatttggaaagttatcatgcacttgaacgcctctataaagaaggaaaagttcgggccattggggtatccaacttcgataatgaccgcatgagtaaattgctggaagaatctgaaattgtcccggcaatcaaccaaatggaatttaacccgacccaacaagaaaaagacattttgaactttgacagcagccatggcattcaacttgaagcctggtcaccacttggtgctggtaaagcattgaagaacccggttatcgacgaattagccaaaaagtacagtcgttccgctgcccaaattattctccggtgggaatggcagcgtgacattgtcacggttgtgaagtcagtccatgaaaagcgaatcgtcgaaaatagtgatatttttgactttaagctgagcgatgaagatgttcaacgaattaatcagttggatgaaaataagcgtgatctttggtatgacgactttacctggcataatccaaacgggcgttatggcaatgaaattgaaaaggttccggatattcaaaagtagcccgaaaccagatttatcaggagttttcgactcctgattttttattgtttaataatgactgcgtggttattgactccccagtcatttatgatagacttaaggcgaatttgaaatagcaagactttggctgctcgaaaggagtgggcatcatggaaaatcaattaatcttagatgtacaggggcttaaaaaatcatttggcaaggtgcaggcattaacagacgtgaatcttcaacttcatcgtggtgaagtattggggtttattggacccaacggtgctggtaagtcgacaacaattcgggtgattttggggctcatcaaggaatcgggcggatctgcgacggtctttggtgaagatgcttggaaagattcggtcaaaattcacaagaacctcgcatatgtaccaggggatgtttatctgtggccgaatttaaccggcggccaaacgattgatatgctgctgcatatgtctgggcaaacccatactgccaaaacggacgaattaatcaaagaattcaagctggataccagcaagaagaatcgaacctactcaaaaggaaaccgccagaagatcgccttaatcgcggcgttttcaaccgatgttgacctctatattttcgatgaaccgacctctgggctggatccgttgaacgagctcattttccagcagcgggtagccgaactcaaagatcatggtaagagtgtcttattgtcgagtcatatcttatctgaagtcgaaaagatgtgcgatacgattgccatcattcgagaaggcaaagtgatcgaaaccggttcactggaatcgatgcagcacttgacccgaaacgtggtggcaatcacaactgcttcaccaatggacgggctggacaaagctaaaggcgttcatcaattgaactttaaaaatgatcagcataccattgccgagtttacggttgattccgatgaaatcggcgctgtgatggatctgctgaccaagagctcaatcgttcaattgaagacgacgccgccaactttggaagatctgttcctacgttactatcattcagatgcgggtcaaaaagtaggtgagtaagatggcacaatacacacaaactttaacgttattaaaggccaatttgaagcgggactggcttaaaatcacgatttggctggccgctctggtcggcgttttcgtggcagtggctgctaagtttgaaggcatttacggcaccagtaaacaaattgccgccattggatccactttgcggtccaaggcgatggtcgctttgatcggcagcgttccagacggtcagctgacgacagccttgattttcgcatcggaaatggcggtattctggggattgtttatcattatcttcaactattcattagctgtcagcgccagttgcggtcaagaggaatccggcttgacagaaatggtcctcgggggtcatccggttggtcgcttggcaccactattggcggcagctttggaattgctgattgccaatggcttgtttgccctgattaccggcatcggcacaatgattgccgacatgccggggagtgatactaacggcacttggctgtcggcagttgccattgccgctgttggttgggcgtttggcatgattgcactgatattcgctcagctggttgctgacagccacaacgtttcgatgtacaattacgccttcttgggaattgcttatctcattagaatgatggctgacgtctccaaacctgattacacctggatttcaccactaggctggctggaaaagactgaaatttacgccaacaataattggtggcctgtcctgatgcttttggccttgggaatcctggcatttgctgccgcagttgccttaaacagcaaccgggacatcgatgccggggtcatccacgtcaatccgggcagtgaaaagagccatttcctccgtggaccggcaaccttattggtctggaatcaaaaatcattgacgatattctggattgttggcatggccattttgggcgccagctatggatcggtcttcaatagtatcagtaaaattttcaacacctcaccgaccattcaaaaagtcttgggtcaaagtggcatccgccatattgagcagacccaagtattgtcgtttgtcggtttgctgggaatcatctttagcttgctggcagtgattgctggagtgatgattgttaatcacctgataaccgaagaacgtcggggttatctccagatggtcatgaccaagccacaaagcagaccttatctgctgggagtttatgtggccttcggcttgattttggcagcactcctgcttttcgtagcgttaataagtgccatggccgccggaaatgttgtgatgactcatccaattgcttttaaatacttctggcaaacgttcgtcgctaatttgccgtcaatcgcattgtttatggccttgatggtgggcttgattggtgtttacccacgactgcggacactggtctgggcttatttgggcctttcatttctcattacctactttggtaacctgatggatctgccaaaatggacgctcaaaatttcaccgttttattggacgaaaaaagtcccgatcgacgcgattaataccacgcctttgatctggatgctggtaatcgctgccattttgataatggttggctttgttggttacaagaaccgcgatttggaaagttaaggaggactaatatggtgaaaagactgccacgtgatccgaaaaaagaacatgcaattttgaacgccgctgtggtccagtttggcaaggacggctttaatgccagtaccgataagattgccgaagcggccggtgtttccaaaggatcggtttttagatattttgataataaaaagaaactctatgtagctgccgttaagcaggccatggcaacactggttgagacggtcgatttgagtgtgtggaccgattcggacgatttggtgaccatgattattaatgcgaccaaatataaaacagagctctcccatcaatttccaaacgaatttgccttgttgacccgcgtgtatgcccaggataatttgattccccaaaaggtgcgtcaggaagtatttgcgattttcaccaaatggcaggcagaagtagaagataccgtcgtgacccgcgtagttgataagatgacaattcgcaaagatctggataaaggccaagtaaaaaaatatttgacgctggttctaggaacgatttcagcggaggtccaaaaagaacttgaggagcatcctgaaatgaaacggattgaggatatgggcgacctgattgccaccgtgaagaattatctggaaatggcggagtttggcgtcgttgaatctagacgggattaaatcggttagaggaatatttgaaacacgtcacacaccgtcttttccggcaaacaacgtgcgtgacgtgactagttactttggtgaatttaacgttgtctgccaaacacttaccaggacccagcaagcaaatggcatggcactaaggaataatccaataaagattaatccaggggcgtcgccggacttggcccagatgtaggcaaacgtcagactggtggtggcgatgattaccgtgataatgccaagcagccattgcaagcgatgaacagcaagcacgacttgttggggtcgttgaatgagccgccagagaatgacgatgccgaaaaccgtacagaaaagaaccacccagccgccacctaggaccaggattaacgccaagttgatcttggtggttaagaccaggaggactgttgcccagatgcccactgttaagagtgcgaggcacagcaatgccaggctggcgtgcagaagttgatggctttggttagggttagatttcattttgaagacctcctattattttgagtttagactattcttgttgggggaggttggttgttgggtgatctttggaaaaacgtaaataggtatgtggatgaaaaaataccagctgggccttctttttggaggctttgctggtattttttggttgttgtttgatgatgtttttctattatctagtggaaacgtgctccgagggcctgtccctaacttctaagtaagctttggtcaaaacccaagttcagggttttaaccaaagctcacttagaaaacgggtcacccagccctcgtcgcactctgattgaaatgtgctccgatgaccctgacccctaacatgtaaaacaaggattgtatcgatgaacaaaatgcgttcatcaatacaatccttgctttacataccggggtcaacccgggtctcgtcgcactctacggcattaccaaatcataatgatttcccacgatcgctgtcccacggtcatggaccacgccttcaccaagtggtgtttggacatgggtgccaaatgggacgtttgatggggctgccacgattaagtagccgtctgcatcgtagccgccatgattagtggtgccatccgcaaatgctgcgcccgtgtagtacgtccactttttaccatcttggtaaatcacaccttgtgattggaaggctgccggtgttgtggttgcactgctggttgcgtcattggtggagttgtccgaccctgattgggaagtgacgacagctgcatgggcggaaccctttttgattgaagttgatgtcttgaaatgttttttgttaactttcttagcggtcgttttcttagcagatttgccaatttcaagtttttgaccgaccatgatcaagttcttgtcagcaattttgttttgcttaacaagcgtgtcaacgctggagttgtgcttagcagcaatttcagccaaagtgtcgccggatttaacggtgtaagtacttgcgctggcagcgactccggtgaaacctaagaaacctgcaacgacggataatgttaatagactctttttgattgtaataaccaccttttagattactgtgtctagaattacgttcacgattgaaacgaaagcccgacttccaaaattgataaaatgattgcttgaatgttaatgtgtgtgttccggaacacaacttggaaatgttgagtgaattttggaagatgattgattagtaatgtgaacgtggaacaatcaatcacgcaagtataatatcagatctgaactaaccgtcaaccgccattacaaataagacaaaagtgtgacaatgaacgtccgtggtaattcagtaaatgaggcagcatgttacaaacacgttaaagttaaaagagactgtttcccattaaatgaatgtaatgattgtgtaaatggtgaataaatacctgtatatgccaattaacttgagtggagtggtgaatggcggaacttttatataatcattaggcgaatttgaggttcgccggtataatgaaattaacaagaaaagtgagtggtgaacaaaatggttaaacaaggcagatttgccagatccagtaaaatgaagcaaattaaagcgattcgcaaacgaatgcatcaaccggcgggacggacaattcacccggaccaatttcaagattttgttttggtccgttatgggctgacgctgaagaaacgattgacggggattgataaagaaacggttcaacgatttattcaggagttgttggtggtgacgccgattgatcagacatggcaattgaaccagattttgcgggacacgcttcgaagtattggcaacaaagtcccatatcaattttatcgaatcgtgaccaacaactggccggagattcagcacttcctccagcgagaaattccggcggttccattggctaatcggatcttggtgaccaatccggtttccgatagtcaactgcaggaaattgtctcagccgaactggcgggaaataccatgattgaaatggttcatgagaatccggcaatggagaaaatgattaccgacgagccgtatacgacactgcagacaaatttactgagtgatgggaaaattgattggcaaaaagttgccgctgttttcacgcctgttcattttaatcccaatattgctgaagacgcgggcacgaaacaatggctggaagccttaatcaaggaatagtgaggtcatgacgatggatttacagcaagcattagaatgcgttaatttagtaccgatgtttcagtcacttccggaagatcaaaagaccgaggttgccaaattggtggtccaacatcactatccaaagggaaccatcatctatctggctggcgacaaagtcgggcacttcatgatcctcgaagcaggccaggttaaactttctcaagtggctgccaatggtaaggagcagctgttgaaagtccttcaaccgggtgattttgatggggaggccgctttgtttaacggcgatcagagaaacatggcggcgaccgccttggtggactccaacgtctgtcaaattgagcaggatgcctttcaaaaattactccagaagagtccccaactctcggtgagtctgctggcaaccatgagtcagcagattaatagcctccaggaagaaaagacgctttcgtctacggcggatatggccggcaaactggctaagtacctggttgaaaccggtgcggccctggatgaaaatccatttaaacttccattaaagaagaaagatattgcgacctatttagggacgaccccggaaacgatcagtcgaaccttcaagcagctcacgagcaaagggttgattgaagctaaaggatctcaggttaaaattatcgatgaagacggcttagacatgttagtctaagctttttctttttagtaaatatttattgcataaatttagaaaagaattgatttatacgtacgaatattttacaatgagagagtaaacgaaaactaaacgtagctacgttggaggaaaaaacgatggacgaaagtcgagtacgaaatgaaattgtaagcggaaacatttcgttgggaattgaactgggatcaactcgaatcaaagctgttctggtttctgacgatttccaaacaattgcttcaggcgattatctttgggagaacgaattagataacggcatctggacttacccacttgaaaaagtttgggatggcattcagaccagttatgcaaacctggcattagaagtgcatgacaaattcggggttgatatcaagaaaattggttcgattggtgtcagtgccatgatgcatggttacatggcatttgataagaatgatgaaatcctggtaccgtttagaacttggcggaacaacattaccggcgacgctgccgaagcattgaccaagctgttcaacttcaacattccagaacggtggagtatcgctcatttataccaagctattttaaatgacgaaaagcacgttaaagatgttgacttcatcaccactcttgcaggatacgttacctggaagttatctggcgaaaaggtcattggagttggggatgcttcagggatattcccaattgacgaatcaaccgtcaactacaataaggaaatggctgacaagtttagttcattacctgacgttaagaaatatccgtggaatctactcgacattttgccaactgttttacctgccggcaagaaagccggtgagctgactgatgaaggtgccaaattgcttgaccaaagcggcacccttcaaggcggttcactgattgcgccaccagaaggtgatgcgggtactggaatggttgctaccaacagtgtcaagaagcggactggtaacatttctgccggtacgtcagccttctcaatggttgtccttgattcaccaatgaaggccgttcatcgtgatatcgacatggtaacgacaccggatggtgcaccggttgccatggttcataccaacaacagctcttcagacatcaacgcctgggtcggcttgtttggtgaatttgccaaggcattgggtcttcaactaaagccggatgatctctatggcacattgtttgccgaatccgttaagggtgatcaagatgctggtggattggttaacttcgcctatctttcaggcgaaaacattaccagaatgcctgaaggccgaccattgtttgttcgcaagcctgacagcaagctcaacttggccaactttatcaaagagcagatttattcagcctttgccccacttaaaatcgggatggatattttgcttcgagaagaacacattaagaccaacgttttggttgcacaaggtgggatcttcaagaccccggttgttgcgcaacaagtcttggccgatgccctgaacaccccaattgccgttatggaaaatgccggtgagggtggcccttggggaatggctgttttggcactcttctgtgttaaccgtaagaatggcgaagctttggaagattaccttgccaaccgggtcttcaaagactcgacgacggcaacgttgtatcctgaagaagccagtgttcaaggttatgacaagtttatcgacaactacaaggcagctttgcctgtagaagccgaagctgttaaatcaatgaaaatgaaaaactagaggtgcgagagaatgttagaagatcttaaaaaagaagtttatgacgctaatatgcgtttaccccaacttggtttggtaacgttcacttggggaaatgtttccgcaatcgatcgtgacaagggcttattcgttatcaagccttccggtgttgaatacgacaaaatgaagccatccgacatggtggttgttgatttggacggtaaagtcgttgaaggggacatgaacccatcaagtgacacgccgacccatacttacctgtacaatcatttccccaatattggcggcattgtgcatacccattcaccttgggctgtgtcattcgctgcagctaaaatggatatcccagctgtcagcacgactcatgccgacactttctatggcgacatcccatgtgcccctgctttaactaagaagcagattgaagaagcttacgagttaaacactggtaaagtgatcgttgatgaattcgaacgtcgcggtgttgaccctgacgctgttccggctgttttggtcagccaacacggaccatttgcctggggcccaacagctgataaagctgtctataatgccaaggtattggaagtctcagctgaaatcagttatcacgctttacaattaacccgtgatgaaacccatgtcccacaatacttgttggacaagcattattaccgtaagcatggtaagaacgcttactatggtcaaaataatgctaaatcaaagtcacatgctgaacatgaataatctgctttaacgaatagggcagtttattaagaagagaaaagtcgagacaaaaccatccgttttgtctcgacttttttgtagtcttcatattacttggcggaaaagtgggaaaatcagtatgagcaaactatttgcgtcggcctaacttcagccttatactcaccaaaaagcaattttggaggcgattacattggctgagaatccattaattacgatttccattccggcgtacaacttgggatcatacttgtccaagactttggatagtattttgaaccaaacttatcaaaattttgaggtcattttggtagatgatgcttcaactgaccacaccccagacacaatggccaaatatgcagataaagaccaacgcatccacacccactattttcagtcccatgaaggggtctcaaaagcccgcaattacgcgattgataacgctaaaggcgacatcattgtctttgttgatggcgatgatttattggagccgcaatatctggaagtcatggcccgcgggttggctgatccgtcggttgatttagtggccgttggctacaactggggctggcgcggcggcagcggtaccggcaaccagttccgcgaagtttccaagaccaacgcatatgcctcaatcaatcgccgaggcggcgattttggcggctatacctggaataaaggattcaagatgtcaattattcgcgatcatcaaattcaatttgacgaatcgttggacttggcagaagatctgctgttcacggcagattatattttcgtgtcccatcgtttcctattctacccaggggcactctacacaaaagtcagtcgttccaatagcatcattcactctgcgacttgggagatgcgaagtaaagagcaggttgttcgcagacacatcgatgaaatggcaagaaagatgcagccgtaaaatttatgtaaagattgtggataagcttccatttagcagtcagtttgaggtaatatagcttcatctgaggaaatctatttttggaggttactctggtttgccaagttttaccaaatctcgccagcaaaaattaaataaactcattttgttcatgatgacgcttgtttcgatcctgacaatgagcgccattagtgtgtccgcaaagtcagccaatcaacaaaagtttcaggccaaagaggcctatgtgatggatgcagaaaccgggcaggttctctaccaaaagaatgggaacaccaaacggccaattgccagtctgtccaaactgatgaccctttatctgaccaaaaaagcaattgataatcaccaaatcacttggaaccaaaaagtgccggtggacgaccaacttcgtcgaatgagtaaaagttatgaagttggcggctttcggatcaagcgttccaaggaatataccgtccgcgatttgtacaaagccgcattaattgcgtcgtccaacccttcagcgatcgccttggggaaattagtcggtggcggcaataacactgaatttatcaaaatgatgaacgaacaggcgcacgcctggggcatagatgccacttttgtcagcagttccggcctggacaataccgatttgagcaagtatcattaccaggttccccacacgacatcaaaagctcagaacatggtgagcgccaaggccatttcgacggtggctgccaaggtgctggcgatttttcccaccattacccaatggagtaagcagccctcgatgaaggttggtacccaagtgttggttaattctaatcgcctgctgccaggctcggcattttatcacaagagtactcatgtcgatgggctcaagactggttttaccgtgaacgccggcctctgtattacggtgacgtactggcatgacggtcgccacttgattgcaacaattattgacagtaacacgctgtatacttcgatgaataagctgatctcgacggtcaaccagcaatatcagcccaccaaggtcgccttaaagtcgcatgctttctcaattgacggccatcagttgaccgccacacctaaagaccctgaagcagtcatttggcagcgcaaagggaccgatggctcgcatgtgaccaattattcagcaaccaaaacggcgttgccgattaccaaaggccaaccgattggcaacgcgatcgtcaaactggcagataactccagtacggctgtggtgccaatgctggcagcgactagcattaagcagccagctaaaaaagtgaaacatgcgactcacaaaccctcgttgctcaaacgcatttttggttttgtcggcagtatttttggcggcatttatcggctgtttgtggatttcgtgaagtttatgacgccataatcatttcgtacacgttccagctatataaaatgagacaagtaatggaggccggaacataaatcgtaaagatggctgtcattgcaactttgattaccacttgtatattgataaaacttgcgacaaacggctgatcccagaatttaacgcataaaaccagtcattccaaaatccggaatgactggttttatgcgttaaattctgggatcaaatcgcctttcgtcccaatctcctttgttttccatgccaaagttgacgtatgataggggcaaatccttggaggcaaccatcgtgaaaaattatcaaatcgttcaaatatcagacacccatttaacaccacagaatgcgcaacctgcgaacaaccaacaaattgatccgatgctcaagctgatgcaggtctttcatgacatcgaggcaactcaagttcaccctgacatgattgtaatcagcggtgacctgattcatgaaggaaaagccgtagattatcgccaattcaagacgctggtcgaccgagaacaagtccgatttggtgtgccgattcaagtcctactgggtaatcatgatcgcacgtccgccttttataccggctatctggataaaccagttcagccccgatattattacagtttgtcagataacggctgggatttttactttttggataccaaatgcggagacttggaacccggctaccttgacgagcagcagttgcgctggctgaaggagaagctgggtgaatccaatcgaccagccttgatctttatgcatcacccactcctgggagcacccttggaaaacatgaagtacagtattttgcaaaatggcgatcaattgcaatctatcctaaagggcagccaagtcaaagcgattttcaccggtcacgtgcattttgccaatatgttcatcaaaaatggcatcttaaatgtgtcagctgattccaccgcttatcatattaattgttccaatcctaaacgccatctaatttcagaaggcaccggctataacgtgatcactttgtctgaccaacaaacgagtgtcgaacaacgaccgttattgctgggaaatacgaccatcaaggcctttaacattccgtcaaccgacttcgttgacccccagattgttgcccaggaaatgaaacgggttttccggtaaactttcaagtgtttttaatagtctgatgggccatcctggcgtacactaatacagaatttaccttacaaaaaggggtgagctgtatggataagcaaccagttgaaccaattggcccatatgaaagactgctcagcgggtcactattggttatggccgcaggggtgctggactcgtacacctatctgcaggatggcggcgtcttcgccggcttgcagacgggaaacttaattttaacaggattgaggatcggccgcggcgattacgccagcatcggccaagccttggtgtcactggtaatgtttgcggttggcgttgccatcatccgggtgattcagtaccattatcccagtgagcgggcagtgacacgcaagcgggtgacgttagtgtttgaaattttaattttgatcgtcgtgagtttgattgccggccgtgtatccattttggtcacaactgggctgttggcgctggctgcagcctcccaactgcaagagttccgccggatgaagaacgccccgtttaccccactgatgatgaccggcaacgtccgcaccttatctgaaagtgtcttggactttgttgcccaaggggatatgaaggcactcaaaaaagccggtgacattgtgacaatcatcggctccttcttcattggtgcgctgttaaatggctatttaattcagtttttccatgggcagaccattttaatcgctgccgttattttgttggcaaccatcttgtttgccaagtaagctattctgatttgagttttgaatacatggccacgtcatggaattgaccattatataagagatattcctttaaaatgccatcttcatgaaagcctcgtcgtgttgccacggcgcggcttttgttgtttttaacatcggcgattaactccaggcgatttaacccgagttcagtgaaggcaatttgttccacatgggccaagcagagcgtcatcacgcccattccctggtattgatcagctagccagtaaccaatttgagcccgctgattttcatggctgaattcatggaggtcaatcatgccggccggttcattgtcgaccagaataatggtgaaccaaaaatcaccacgagccattttttcgattccgtattgcagaaatttttgctcgtcactgactgctaccatccctttggcccatggcagccactccgccagctgcatgcggttgctgttgatgagatccaaaatgccgttcgcatcggtcgctgccggtaattttaaggaaatatggtcgttcacttgatcaataaacatagagtccctcctcgtcaaactgttacaattaagtataacctttttgagggaggaagacttgttgaatgaaagacatacgttggaattgcccgacgcgctaaaagcacagttgggcgttaaatctggtgagcaagtggaggtccgaatcggtgctgatgaattgaaaatttccactcctagaccagtggaagtcaaaaagcggcgctgggggatgatgattttaaccttcgtaatgagctgcgtctttttgggatacttcatggtccgaaaaatctatcaggtttccttggtcggtagtgaatcagtggcgacaatggtgttactattgacgacactcagcggcctgatgagctttatggtcgtcttcgtccggttgaaacggcagtctggctcggcagtcgaagccgtttcgtggcgaaacctgccaacggtcgcgctggcatttgcgctgatcagcttcatgctgatggcgggattgttttggattgccggtcgactgtttaaaggtgccagttttgatttggtgacgtcaacggcattatttgccttgatgaccagtgttgaaattcaagctatcaatagtcttgttcctcagctatcttcacgccttttgaccaacatctttattgccgtgattgtcagcggagtcattttggcgatgatcagtaatcaaaacttgtattggtggaaacacaatctcagctttttgggtaccaacaaagcggttgattcttgggagtttaacctggcactatttttttcggggttaattttgttagctttggtggattatttatttgcttctttgaaacgaatcttccctaaaagccggcagttgctggtgttaagaatcttattgactttgctggcgattgatttggggatggttggagccttccccaacaacttggaaatccattcgttgcatactcggctggccggctatttgattttcctgatattaggactgatttttggtattcgctggctgctgcctgatatttccaccgattttcagcacatctcctggatgattgctgcagcattgctggctggcgagatattatttcaggtggttggctatttgtcgctgacagcgtttgaaatcatggcgtttttactggcctttagttggctggtgatgctgtttgaacgtttgaacgactatctggagccaattcagaatcaacggtatgtcattaaataattgtgaggttatttcgatgtttcaaatgaaagcaaacaaggcaaatcaggcacccatggcaagatatatgcggaatcagtttcattttcttggcctcaaaacaccacagcgaaaagcggcctcgaaagcctttatccaggcttccaaaaccgttcctgttgctaaaatgatggaagaaattgctgaactctatgaccgtgacgagcgtgagtaccagtacgtggcgattgatgttgctgatgccaatgtgaaacgattatcttttaaagacgtcaagacgttaactaagtatattcaggtgaaatcctggtgggatacagttgacacttggcgaaaagtgtttggggatttcgtggtattgcatccggacgaaaagcgggcggtctttgatttgttctatcagcacgacaacttttggatgcggcgagtcgccattcttttgcagttgctggagaaggacacgttggataccgagctgctggccaaagccatcgaatatgatattgacaccgatgagttttttattcaaaaggccattggttgggcattgaggaattatagtaaattcaatcctgcttgggtgcgtcgatttgtggctgagcatcatttgtcgaagttggcggttagggaagggacgaagtatttgtgaggggtgtgggtgtttttgagatcattcattatcgagcaccacttttacttggaataaacgtgctgcttacggctgatccctgctatttaaacaaattgggcaattattccaaaaaggaataactgcccaattcgcttaaattctgggatcaaaacgcctaaagcaccactctaatgctttgaagccaaatgatgatccgtgaatctgaaaccagtgacgacaataatagctgcgacaaggaatgaggacaagccgaggatcatgttagtaaagccgatgcttgccaagattgatgcaaaaattgtaccaaacactaaagttaacaaaccgatcaaagtgatttttaaattctcatccatgagatcgcgcccccatactattaattgttgtaaaaatcgcaagcaattctttgtcaaatcagtggttatatttagtagtcattagcaaattgtttgcgctttctttacaacttcattgtaacgtactcaggtttaaaatacagcttttttctcatatttaaatcgttttatttcgagggaataattaggggcatgaatgttcaaaatgaccggtgctggacaagttatgaattgtgtgtaaaaatattggtaacagaaattcgaaatgaaaaggaagtgaagcccattgaagattgcaaatcgttaagacagaatttgataatgaatcactgttcagaacaggggttcttctgtgcgattttgcaattttagtgggttttaagttcgatacttttagtgtctcagaacacccaattagtttatcaaaatcgcctgcgtgccgatgtgcacagcaggcttttatattgcgcaggaacccatctgaacctttaatgaggtgagattatgggaaccattcagattaaaaatttatcgtttagatatgacgggatgctgaccaatctttttgatcagttgaacttaaacattgatgaaagttggaagctgggattgattggccgcaacggccgggggaagactacttttctcaaactactgttgggaaagtatacctaccagggagaactaaacagcagcgttgactttaactattttccacaaagaatcccggatcctactcaactgacaaagcatgtcttattgaagattgccggacttgatgacagtgagttatggcgaattcaagttgaaatggataaactgcagttgactgacagcgtcttggggcggccatttgagaccctgagtcccggcgaacggaccaaggcactacttgcagtcatgtttaccgataatcagacttttcaactcattgatgaaccgaccaaccatctggatattgaaggtcgagaagtggtcgctgactatttaaagcacaaacgcggctttatcgtggtgagccacgaccggcactttatcgatcaggtcatcgatcatgtgctgtcgattgatcgcgcaaaaatccaattatttgctggtaattacgaaacttgggcggccgagtatcaaagggaaaatcagtcggaactcgctgaaaaacatcaccttcaaaaggaaattggccgactgaaggccaccgccaacacaatggaacgttgggcgggtcatgcagaaggccagaaacagaaaagccgacaaagtgaccaacatgctaatatcgataagggattcgttagccataaagctgccaaggtcatgaaacgctccaaaaatacgctgcggcgcactgaaaaagatattgaggtcaaacagtctttgctgaaaaatgtcgatgaagtcgcgccactgaagttgaatagtattcaaccaccgcaaaaatatttgctgcaagtggaagatttgcaggtccaacgagccggcacaattttgaaccaacccctgagcttcgatttaaagcgcggccaacgcttgatcctgtttggccctaatggaatgggcaaaacgaccatcgttaaagtgattatgggcgacaaagagttgctcgctggcggaacagtcaataagcccgccagcctcagaatctcatacctgagtcaaaactttgaagatctcaatggatcgattcaaagctacgccgatcagtttggaattgaattaaacgacttactgaataccttgagaaaattgggctttgagcgagcggcatttgatgaagacttgaaggatttaagtatggggcaaaaacgtaaggtctcgttggcaaggtcgctgtgtgagccagccagtctttatatttgggatgaacctctgaactatctcgatgtgatcactcgaaagcaaatccaagacctgatcttgcgcaagcagccgtcaatgcttatcatagaccacgatgaggcctttattgaagcagttaaaacggcgcccttgttaaaaattacgccgattgattcacaataaggtgtacttattgatgactttgttataagatgtgctagatattgttgtgaatttttagaggggttaagatgccaaaacattcattgaagaaacattcggtcaatcgatcgttattattgagcctcggggcaattatcgttgtgggtttgctgatggttaccgtcggcaaagtgtcccagggcaacaacagccattcgacggctacccgcagcgccaagcagatcaaaaaagccaagattgccaagctgaatgctaagattcatttgacgaagcgcgagaagaagattgccagtcattacaagctgaccaagctggagacacgaacagcctccaagacctatatcaccgcgattggtgattcggtgatgattgacgttaaaccggatgtcaaacgagtctttcaccacagcgctgtgagtgggtctgtcggccgccagttttattcgctgccggggattgtccgccacttgaaggcgactggtcatttgtccaaatacatcgtcattaacttggggattaacggaccgccaacccagcacgatattaattcagtattgaagaccctgggtaagaaacgacaggttttctggattaataccagggtgccacgtcattggcagaacacgactaatcggatgatcgccaagacagccaagaagcattcaaacgtgcatttggtgaactggtatcaagccagccgtggtcataaaggttggtatgccagtgatcgggttcatttggatttgaccggtgaaaaatactatactcggacgctggccaaacgtgtttcggaaattttaaattagtcagaaaaaacactttgaatcaagttaatagctcaaaaaaatcagcagtcgcatttttgcgattgctgattttttagtatgctgtgtatttgcatgccaataagacacgtatttatttgatgagttgcttgagttcctcaaaaacgatcggcagctgcttgtccttaccggtatctgtgaaatggtgaccggatggcatcaaaacaaacttggcgtgtaggtgccgggctagcgttaatgtgtacgggtacggtacactatcgtcattaatagctgaaataaccgctaccttacggatctttggcagaattccagtataatccaccggatgttccgtgaaggaatcaagttccggcagtgtccaaatgggttcgtcaaagcctgatactaataagacattgacgttgtggatgtcgtgctggtcaaggtagtggaggacttgaatgcagccgaggctgtgaccaacaagggtcatgccgtcctctgggtcaatatttgcgtcacagtactggtcccaagcctgttccaccggatggtcggaatccggaaagttcagttttttaaatggtcggtggagttctgtttccactcgattttccaaccaaggaaaccaatgatcgttggcattggacgtatagccgtggaacatgtagatggtcatctatgctaccttctttcccagtattaaagcgcggttaccattgctcatgcttgtaagccatttcccaaaagtgcagttcgaaatagctgcttcgcaaaaacgccgtctgcatctgttcctgttcttcagcgtcggcagcctcaccaagttggtcgacaatggttttcattttgtcagttgcagtggtaaatgcggggctgtcataagtctcaataaattgctgataaattttaattggtgaacctgcttttatcaatcgctgaccgatctcattatataaccagtagcagggcagcaatgccgcggcggcgcgagaaggggtgccttcattgagttcatggtacatatgggtcacataactgtaggcattgggggcaatttcagtttgatcaatctctttttgggtgatgttcaactcttggaaaaattcagtccggacttctttttcgctgtcattgaagcctttggctccagcatagagaaattctttgatatccggatcgtccatttgatcggcaattttgccatggagggcggcaaaattctgcaaataataacggtcttgtttgaggtaataacgaaatgtttgttggggaagtgatccgcctgaaagctgcttgatgaagggatggttaaaactggcttcccaaagtggttctgattgttcacgcattgtgtcggtgatttttgccattacgcttaactccttaggttagttagggacatgtttgagataattttaccatgattattaagcgataacgacttgaattggcaacttctaaggttctggaactttcattgttcgatccactcgtgagcgaccagtggcataatcaaactggatgccgggctgaacattgaacaaatagacgttgaagttcagtgtccgatccgttgaaattgcttcaaggtgaatgccgcgggccattaattcatttccccgaaaaattggcttggcaaagaagatcactttgttcccacgtcgcagggattctctgattttactttcaaaaatcgtttgaacccgctgattggagaagctggtctgggtgaataggttcttgggattgttttggtcgcctgacgtgtcggttggattatactggccggatgaactgataccaccggagatcgaataggcaattaaatgaccgcgattgataatcggctggccatcgaggaatttttggtgccaagcggttggctccacatactgacggacccggttatcgtcagaaaccacatttctaggttccaagtaagccaaattgccggtgctggtccgattaaagttgtccagatcggaataaatcaccttattggttttccaagaatttggatccagctgtgctttattgtggttcacaaagatgcagctgggatctcctgaatgataatccagcttcgccagttgatctgattcgacacttttgttcgaatggaacaaagaactggtcagattgttgaccattgaagcgaggttactaggctgttggtcgacccccagccacatgccgacaaggatgattgccaaggcaaagattgtctttagaccggtgttgcgtctttttcctcgagattttctgggatattttttatgttgactcatgatcatgcctcaattctatatgtaagctctgccttcaaacataccagaagggaatggatgaaggcaagagtataaggagagtatgcacacctgtgtgcaatttgccggggaaagcaaagatggctttgcggccatcactttatatatacggtgaaatggttggagaatatttttattttttgaaattttttggaaaaggtttttattttacacttttatctaacgaaaacgtgctcaaagacccaggacccggccacacaagcaattaaagccaacgatgaacaaaaggcgttcatcattggctttaattgcttgtgctctgggtcctaaccaggtcttttcgcactctgattattaaataaatgctcaaaagctaaccggtttggtccgcactctgatctttatggcaaatcatttcccgccgcgaagaacaggtcgtaccactcctgctttgtgagttcgacatctgctccggctgcgctgtccttaatgtgttccgggttcattgttcccagcagtacttggacctttgccggatgtcttaagatccacgctgtggcaatcgcgttctttgaaacgccatactttttgcccagctcttccaatttatcatttaactttttgaactttggatcgttgatgtacatgccggcaaacaaaccataattgaatggtgaccaagcttggatcgtcatgttcttacgacgtgagtattccataatgccgccatctctcatgatgctggcatcgtcgatcatgttgacgtgcatgccttctttaaccattccggaatgaaccacgttgaattgtagttggttaatcaataagcgttggctgatccaggattggaccatttcaacttgttggggattaaaattcgatacaccgaagtggcgaacttttccttcccgctgcagggtgtcaaatgcatcggcgatgtcgtctgcttccattaacggatctggacggtgcagcaagaatgaatccaaataatcgatacccattcgttgtaaaatcccgtcaaccgagtcaatcaggtgttgtttggagaagtcgtaacgttggccgaatactaagccgtcatgacttctggccggatccaaaatgatgccgcctttagattgaataaataatttatcccgagaaattccagaagctttcaaggcttctttgaatttggtttccgattgtccgtcaccgtagatgtcagctgagtcaataaaattaatgccagcatcaacagcggcttccaatgtcttggcagcgtcagcggtttccataccagccatgcgcataattcccaaggcaactgcggaagcttcaaaatttgtattaccaatctttacagttttcatgatcgtcctccttcattgattaccttaattatacggcattctgagggcggttccaaaggtcttgtaaaaaagaatatgttataattcgaatacttacaaaacgaaatgaggaaccaatttgagcgaaaatacaattactgaattaattaatcagtatggctacctcggcattgcttttctaatcgcaatcgaaaatatttttccgccaattccttctgaactggtgctggtcttcaccggttatttaaccgttaccagcaagatgaccatttgggggtcgattctggctgccacggctggcgcactgatcggggcaatcgctttatatggcgttggccgtttgttgagcgtccaacaaattgaaaaattggtttctgggcgatttggcaaaatcatgcggttgaaaccggcagatattgaaaaagcggccaggtactttaacaaccatgggggtaaggcgatcctgcttggtcgctgcatcccggttgtccgcagtttgatttccattccggcggggatgaccggctatccgtttaatcgattttgtttactgacgactaccggaacgctgatttggaacacgattttgattctgatcggccattttgccggtcgggcttgggatcagattctggggatgatcgatcagtggctgatgatcattttggtagtgattgttgtgatcgtgggatgttatttgtattatcgattttctcggaaggcggattaagatcgggcagctgtttgttgagtattgatgtttttgcctaataggattactcttccttgggtgtcattttacctagcggaaacgtgcaaatgaaggctgatcccggccatacaaaggacttactcatttattccaagatcaggaataaatgagtaagtcctttatattctgggatcaaagcgccttcatttgcactctcttttacttttccttaaaattccccaaactttccaataaactcctaacaaacttcacaaattactcggcaaaatttgttatgatatttataagtaatgcaccacgacagctgaacccccacaaggaggcccactatgaaatggtacagtcatgaagcagaaacaatattacaagaacttgatacaagtcggatccacggtctgagtgaagcgcaagctcaacaacggcttgccgaatttggacccaacgagttggccaaagaagaacgcgaacccgcttggaaaatgttgctcaagagctttaaagaacccctgatcattatcctgcttatcgcgattggtctggcattagcaagtgccgcctatgacttttttgttagcggtgattctgggcatgcgatggcttctgtgtacgaagcgattgccattgtcttaattgtaattatcaacagcggtttgacctttcatcagacccggaccgcgcaaaaatcactggacgcgctttctgatatgcgtcagcactacatgaaaatccttcgggacaacaactggacgtcggtggctgccaatcatttggttcccggcgacatcgtcagcgttaagtctggtgattttatcgaaggcgatttgcgctggctaaagacgtcagaactgcagattaacgaatctcatttgaccggggagtctgatgccatccaaaaaaataccgtctctctccctgaggataccgagttggcagatcgtaccaacatgggatactccggttcgatggtggtcaatggaaatggaattggtgtggttgtggcaactgggatggcaaccgaactgggtaagatttctggactgatgcagcaggttgacgaccaaaagacaccgattgaaaaatcagtccacgggttgagtaagaaattgatgatcatcgctgcagttatcatcgccgtgacgattggctatgacttagtaaaacaattaattcaggtcggcagtatttcaatggacagctttggcgggatttcagccacggccatcgcgattgctgttgcctcaattcccgatgcaatgccggtggtgctgtcaactgtgttgacgatcggagccaagatgatggccagccaaaagggcttggttaagtcgttgagcagtgtcgaaacgctgggctcaaccacctatattgcctcggataagacgggaactttaactaaaaatgaaatggccgtgacccgctttttggcaaatggccaagtctacaatgttgaaggaaatggctacacaccaattggcgatttcatcagggatgatggcactccaagcgattctaaagattaccagcggttcttagaagtcgctgtcttaaataacgaagctgaaattaaaccggataccaagcaaaattggcggccgtttggtaatccaaccgatgtttccttagtcgtgctgggagctaaagataacgtcaaacgcgacgtgctgttggaagataagggtgatcgggacatcgatattgtccgaattctcccatttgacagtacccggaagatgatgaccgttgtgattaaagaaaatggccggtactacagtttgaccaagggcgcaccggatgtgatcaagccattgaccaaatcggcactgattgatgggcagccggttccaattgcttcggtggccgcaaatattgaaaaaacgatgctggcgtttgccaaggatgccttacggacgatctcaattactcaacgtgagatttgcaaagaagatgccttgaatgcatccagtgccgaattggaacgtgaactgacctttcttgggctggtggggatcattgatccgccgcgtgaggaagtcaaagcgtctgttcgcaaattaactcaagcatcggtcaacgttgtcatgatcacaggtgaccacgcgatgaccgccaaggcaattgccaaacagctgggaattatcgactccgatgatgcccgggtgattaccggccgtgacttggaggaaatggatgaccaacagctggcagacgtggtgttggacacgcgggtatacgccagggtaacgccagaacacaagcagcggattattaaacagctgcaggcccatgagcaagttgttgggatgaccggtgacggcattaacgacgctccggcactgaaagccgctgatattggtatcgcgatggggatcaatgggaccgaagtgaccaaagatgctgccgatttgatcttgctggacgataaatttaccaccattgagaagtcggttgagtcgggtagaacgatttttgccaacattttgaattttatgaggcatgagttgacgaccaacgtagctgaagtgctgtcattattgctgggagtcttcttgattacttcttccattggaaatatcaccgaagtgacaccaactctgacagcgttgatggttctgtgggtcaatatgatcagtgattcactgccatcgtttgcactgggctatgatgaagccgaatcagatgtgatgcagcagcgtccccgtgatactaaacaatccattttggcaaatgggatgctgcggcgggttctgttccgtggtggcgtgatgggcgcaatggtctttctggctttcatttgggcagcttcacaaggctatacggtggctcaaagtcagacgattgcctttctaacgttggtattcggacagttatggcacgtttatgatgccagaagtgtgaatacgttgtttgatcgaaatccgttttccaactccagattaacgttggcggttgggtttgcggcgacatcctcaatcctggtaacgttaatgccatttttcaataatgtgatgggaaccgcgccattgacgatgacgatgtacgtgttgattatcttgatttctgccgtaccaacttttgtgatttctggaattaagaaattcatgggtcgaaatcgtaccgaatcagtggctgttactcaagcaaattaatatagaacaaaaaacaatctaagattaagtctggtaagaaagctgacagccgtcagtttctcactggaactaatcttagattgtttagattgagatggaaatgattttaattttgtaagtgacttgcggcgcggagacagtgacaatgtcgccggaatggtggttcagtagtgccgaaccgatgggagaggcgatcgaaatcttaccgtggtcaatatcaacttccggagtgccgacaatttcatacgtttcagttgagtggtcatccagaaattcaaatttgacggtcttgccgacttccacggtatcgttgtttgagggggtgtaaacctgagcgtactggagttgttttcgtaagaatcgcaatcggctctccaggtggcgaaggtctcgcttggcggcactgtactcggcgttttcggaaagatcaccaagcgctcttgcatccgccaaacttttgatcttggcgggccgagaattttcgagctcacgaatttcagattcaatttgttcgtagccaaacttggtaattttgttgaaatgaggttccatgaatgtatccctcctgacatttttaagtatacaacatgtctaaattatagccaattaaactaattacttataaaaatcggcgaaatttccaacatttttattgaaaataacggcgatttagtcgcaaaattgccgaactgaaaccttgatctataagcgtttgttgatgatatgttatggaaatattaccaaatccctatttggtttaacaaggttgtaattttctggacacgtctctgtaaataggttggagtatatttttcactgttgattaaacacgaaaggaaaaatatatttcatgagacttaaaaagatcattatcgcattaatgactgcattaactttctacggcacaatgaacgttgccgcatccactgaaatcgctgaagctaagactactaaagtatacaaatcaaacttatcaaaggctaaccaaaaagccaagaactggatcgcctaccacgaatcacgcggttcataccatgccagaaatggtcgttacatcggccgttaccaattaagtgcttcatatcttcacggtaactactcaaagaacaaccaggaaaaagtggctgaccattatgtcagccaacgctacggcagctgggtcaatgctaagaagcattggaaggcttatggctggtactaagctataatacgaatatgttaagagatcaaacaatgaacaacacttgttcattgtttggtctttctttttgcttattgattgaatttgagctaccttcaaaattgtaaccgctgtaatgaaccattattcggaatctccgttgtgattcctcaaaattcatgttaatataaaattattgttttaaacacgaataaaaaggagaacataatggaaaatgtttctgttccaggcaagaaatcacctgttcgtaatgcaattttaggttttcaacacttactcgccatgtattctggcgatattttggttccgttattaattggtggggcactgggctttaatgccgctcagatgacctacttggtttccatggatattttcatgtgtggtgtggcgacattacttcagattcgcagaacacagattaccgggattgggttgccggttgttctagggtgtgcagtcgagtacgttgcaccgctgcagtcgattgggaagaattttggcttgggttatatgtacggcggaattattgtcgctgggttatttattatcctcattgccaagccatttgcgcacatgcgtaagtacttcccattggttgtgaccggttctttgatcacactgattggttttaccctgatgccggtggcttttcaaaacatcggtggtggggatgccactgccaaagcatttggtaatccgacgcacctattccttggcttcttcacagcgcttgtcattattgtcttaaacatttgggctaagggatttttgaagcaaatttcaattttaattggtatcttggtgggttcaattgttgccattttgatggggacggttgatttcgcagccgttggccaagctcactgggcacagttgccacagttcttctactttggtgtgccgaagtttgaatggtcgtcgattgccaccctgattttggccgccttcacctgtatgatcgaatcaaccggcgtttactttgctttaagtgacattaccggccggaagttggaagaccgcgatcttgaacacggttaccgttcagaaggaattgctgccattttgggtggggtcttcaataccttcccatactccaccttctctcagaacgtcggaattgttcaactttcaggaatcaaaaagttaacgccaatttattactcagcattcatgctgatgattttgggactgatccccaagtttggtgccattgccactctcatcccagcatctgtattgggcggcgcaatgctcgtcatgtttggaatggtgggtgctcaagggatcaagatgctctcacaagttaagctcaacaacaagaatctgctgatcattgccgtttcgattgggcttggcttgggagttaccacgcaacccaatttgttccagtacttacctgcaaccgtccaagtgatcatgagtaacggaatggtggtcggaagctttaccgctgtgattttaaacatcttattgaatcacacagctttgagcaaaaaagttgaagaataatttaatcaaatcaataataaaaggccagcgagttaatcgctggtcttttctgggttaacgactgtctcagaaattatcgttttggaacgtattcttcgacatattcagaaatgatattaagcaaatcagtcactggttctgacgtctgcttgttcttgatgaatgaaataccaaagttggctgtcaggacatccgttggaatctcgatgacgttgatgtgcttcttctgttcatcagtcaaacgacgtgggttggcaaatggttccggcgtgatgattgccccgacatgttccaatgcgagatcggaagccaagtgcagatcgggaacttcgacgctgatttcagctgaaacgccaatgtcgttcaggaagctggtgaccaatcgttggtagttatcttcctgcggtgtaccgataaattcttcacctgacagcttggtaaggtcaagatcctcataattcaagaagactttatcaggatcatacagcttggaagtttcaggaataattaaaaccaatggtaactgagcgattggtttgtattcgaccttgtggctttgaagtgcatggccaatgaaaaagtcgagggttcctgacaagagccgtttttcggcgtctcgactggtcattctggtgatttgcgcatgaatattagggtacttgttatagaaccggaccagaaccggtttgtataagtcgttggtcacaacttcattggaagcaatggttaagtggccgtatttgaactgtgacaggtgcgtcatttcgcgatccaagttggctcgcagtcggttttcttcctgtaaaaaagccagaagtcgttcgccggcgtacgtcagctggattggatgagatgatcgatcaatcaatttaacgccaaagttcacttcggcatttttgataacccgactgatataaggctgggtaacaaataatgcttgggcagctttggacatatttccttgtgccttgatttcttcaagaaacgaaagtaatttgctgttcataatgtaattctcctttgaagacctctcgcctttagtttatcttctaaccagattatatgatattctagtaatatatgcatgaatagtgacttctaatgttggtattccacaaaaaagctacaaccaagtatagcaattccccgtgcgccagtaaaggacatgaaccttttagcccgggtattatagtaatcttaagatttcatcatttatattaccattaggtactagtacccaatcgttatcagtgaagaaacaaatcatgcttttttctcgttgaatggtaaaatagtgtcataacttttatcccttaaatggatacatagcctactagaagggagttatcacattgagaattgaacaatcacctgaatttcaaattcatttacaaaccttaagaagcaaggaagaattatttctcgaaactatttataatgtcggcaacggtcactttggcgtccgcgactccaatccgctccagggaaacaaccatgattatattggctccccgggcttatttattaatggcttctttgattacgaagaagtcgcctatggtgagaagtatcgtgggtacccggacaataaccaggtaattaaccggttatttgatccacgctttattcgtatcaaggtcggtaacgaagattcgttgaccgatcatttcaaagttgaaaatattgataagaacctggacatgcagactggactgctgcacgagcttttcagcgtcacgactcctggcaaccggaattttaatctggtggttgaaagctttgccagtctgagcaagctgaatgtatacggagtccgatattctgtgattccaaccaacttttccgatgaaatcgaagtgatcaaagttcatgattacgtcaaccaaactgttcaccagcaggatgaagatgtccgggtcagcactgatctggggcaaatgcagctggactttattccagataatggccaacccagttacttggtaaccacttttcgaagccaacagggggcgattatcacctatcaagccagtgagaattttgccccgaatccgccgattgaatacttcagagacgacaatcaccactatggctaccggagtaaatattacgccaaaccaggcagtgccaaggactttgaatttttatttgcgatcggcgatatccatccactcgtcaatgccaatatgtattccgatcagtacctgtcatcgctgaataattacattaatgacaccacgtttaaatcagaattgatggcttcggcacaagtttggcagactttttggctccacagcgatgttgaaatcgatggcgatcctgctttgcagctgtgcgtgcgcttcaatttgtttgagcttaaccagtcagctgggcgagatgctttaaccagtattccagccaaagggttgactggtaatggctatggcggtcatttcttctgggacaccgagatctttatgctgccgtttttcacctacacccaacccgaagttgccaaggatctattgatgtttcgctatcacacgcttcaaattgccaaggagcaggccagtgactttggccttggcaaaggcgccatgtatccctggcggacaatcaacggttatgaatccagtgcatactggctggcaggccaggcgcagttccacattaacgctgatatcgcctttgccgtcgaacaatattatgagattaccagtgacgatgactttatccgtgattatggatttgaaattattttggaaactgcccgattctggatggagtacggcaactatgccgaacttgacggcaagcgccaattcgtccttaaccgggtaaccggtccggatgaatatagcgccctagttgacaataactactacaccaacgtattggcccagagtaacctccgtttggcagtcaaatatgttcgcaagttcaagggcgacgacggcattttgagtcgacttcacgttactgacgacgagatcgacgctatggaaaaggccgccaatgccatgtatctgccttatgacaaggagaagaacgttaagctgcagttccaaaactttgaacagctgccgaaaatggatatttctgccattgatcaaagcatgttcccattgctcttacactatcacccattaatgttgtaccgtcaccaagttaataagcaggctgatacgatcatggttgattttatgttccctgaaggcaacaccttggatcagctaaaagccgactatgaattctatgaaccaatcactacccacgattccagcctctctaaggcgatctacgcgattatcgcggctcggatcggtaaggatcagcaagcctacaacttcttctctcaggccgttcagacggatctgatggatgttcatcataatactaaaaatggcattcacgctgggagtttgggcgctgcatgggaagggatcatgtacggcttcgcaggaatcgtcaataatgcgacgagttttagcctcgagccccatttaccatccacttggaactgcctgaagttcaaggttcatctctatgggaatgaatttaaatttacgatttatcaagactcggttgaagtcgagctgctgagcggtgaggggacggacatcaccgtttatagccatcgcaaacacctcaccccggacaataaccgggaaacttggcaatactaaatttttttgaagaaagtctgaaatattaacgtcttttttggaaaacaggcgaactttggtttatgatttgttatgatagtgttatgcaaattcatcgttgattgctgaatatttaaacaagcccttgatcgttttgggcgagtcaatttatctgatgtgaaagggatgcactttataatgaagaaggaagctcgtcaatccaaaattgagcagattattaatcaatataccattacaacacaggacgaactgatggagaaactgaaggtggctggtattagcgtcactcaggccactttgtccagggatatccgcgagatgcagattgttaaacagccggatagttcaggcaactcacgctacatgatttttaagtcgggtaaccaaaatgaaatcgagcggatgtatcggatgattaacggcacggtaaccgacattcgccagattcagtttgtgaacgtgattcacactcaacccagttatgccaatccattggctgcggtgatcgatgatctccacatggaaaatgtttccggaacgttggccggctacgataccattgtgactttcagcccgtctgtagactctgcccgtgagattaatgatttgtttactaagcacgccaatccagacttgctggtttcttccattcaggatggggaataggcattcataatataaaaaataaggctttctcagctttgaggaagtcttattttttgtgctggtaattattttgcgaattgtcgataaatgcgtcgaccaatcgccccaatcagaaatgctagccaccaaatgatgccgactgcggtgaccagtttgccaagcgcgagtcccggcgtttgatatttcagtgaaacaaagtggcggccaactgggattctggcacccacaaagccgtgattgaccttgaagatgtctccggcctggccatcgatctttagatgccaaccggtggagtagggaattgaggtggtcaacacgcgggtgcgctccgttgcatccgtatagccactcaccgaattattggtgactttttggctggtcaaaccagctttttgaagttgttggatgcgggtgttgtactgccggttaaatggtacggccatcaacttgacactcttgaacttcagttgcttaacgccattaaagtgaatcgtcattgatttttgcagcttgttggcgtaacccagattcaaaacaatgtgctgtctgtcctcgtaatcggagaggttgttctccggtaattgacggacgtaagtgaaattgttgggggcttgaaccgacaatgtgtaagcaccgagatcgggatgctgcagagcagttctaatgcgatcaattttttgcagtttggaaaccggggtgccatcaataatcgaatcggcagtcaggctgttcagtctgtctgcagtggaatgagtggtgtgggagataccgtcgatcaccagatacaactctgaatgacgatatttttctggctgattaatgtttaattgataggaaagatggcgtccctgcgcatcgttatccatcaaatgaaggccgttggcatttgcggcctgattttcggcaacgatccggtgattcttagccagcacactttgaagcggcttggcattgggattaatgccagtggccttttcccagatcctgactttgttagccggtaaagtggtcttatatttcttcgcggtatcccggtagcgggcgtttggtgaaatccgcagccgatccaagacagccttgacggggttattggcgatatgttcgtcaaataatcgagtcgtgtacggcacgttttgaatgttgttctgcggttcggtcatcgaaacgccatcaaccggcttttcaaccacagcccctgataacatagcctgttcacgttgaagcggtgacatgttgcggtagttggcagctgaaatgacatatttttgtgtatagactaacggcaaagccaaattggattttaacaaaatcgtcccggaatggttgcttaacccgctcaccggttgttccgggaagtcgacaattttgccgtttttcccgcgaacataatggaaaccatatggaatggcttggggctttttgacaatatccgttttggcaaacatgtatttaacacccagtaggttcagcagggtggttctaccatctgcttcaccaagcacggagttgaccaccgcctgtgaattatccagtgatctgctgaattgaaacaggctgccgttttggatggagtaataagcccctaagtcatgggttcccagcaccatcgggatgttgttgccggcggttcggtgaggatagtagttgtggatggtggttgttcgatagaagccgccgttttttgccaacccattttgagcaccgtcataatacttgtggagccactgttcggctgacccggatgccaggttggaattgatattcttactattattgggactgaaccagccttgtccggcactaatgacgttaatgaagacgagtccgaccaaaatggtgccaacgtgcttgggagatattttaagcgacgtttgacaggcaaacaatagtagaaaactcagcaataatccgtaagataccaaatcgttttgcggtagtttgagggtaaagcctttggtgatccacacgagcacaatcaagccggcactggcaccaatcaaccagcgcaaatcgttttgagtcaggttcttgagttgatcaaccagaatcatcgttgccaagctcattggcaacacgatcaggaacaaccagcgattggacggtgttgacattgcgttggccaccgcactaaactgcggcagcatcaacgcaatgatcgtcaacgtgataatggttgccagtgatcggtagcgtttgaaatgtctgaggacatacactgctccgagaaatgtcaatccgcagaaattcagtaccagccaataatccttggtggtggtactggtaatcagttgattgggcatcgccagatagtatttgagtggataaagaatcagcccgttggcaaacttggcatggtaggcaattcgagttgattggaaaacggccaataaagttggaatcaagatgacgccggctgtcaacaggccagtcacgacaccttgcaccaaaccatagataattctgccgtttttcaactgttcggggtggttgtgacggatgttgaagtatctggttaataggtagacaaacgtcccgattgccagcatataagcgaagtaaaagttactgatgagggccaaggcaacggcaaccgccaacggcagccagttctgcttgtggagaaccttttcaatccccattgccaacagtggaaacagaatcattggaattaagaaaaatgggtgatgcatcgagacatagaagttgtagccggaaaatgtataaatcaacgtcccaatcaatttactgtgagtgctgaaatcccgctcattggcccaagccagaaatgacagcccgacacagtaaagacgaagcaagattaagacttgaaagccgagctccagcttggcagccggaaaaagagcaatcaggtagctgaatggatcaccaattatgtaaaaggcaaaggtggtgagttgatcggcaccagccccaaggttccacgaccagccactcattgcctgatgggcggttccttgaagcattcgctgaaattgcgccataattggaaaatgttgggcaatgccatcgacgttccagatcaaagttttgccggccagccagggaatcgtgtaggtggcgaggcagacaagtagaaaagcgatggaatagatcaaataagttcgaaactgaaaagactttctgcgagtatcaattctcggttccatgaaattacctccaatacatatcccattttgcctgcattgaggccgatagacaaggctattgacagatttttaatgtttgtaacattgatgccctcaagttgaaacaatgtgcatgaacattcatcgatgaattttagtaagctgagtaaaacgcttacataatcaatggtttgtctaaatccagtctcagcaaaagtgaattttcttttaccaaactgtgaatattttatgaagtcgaaacatatttataccaaacagatgagaacaaagtatgaatgttgtgaagaaagtgttatagttagagcattcttaaatctaatcaaattcttatgttctaatttaaacattttattttgcataattaaccgctaaaagccttttgtgaaaggaataattagcaggataatttataaaatgaaaccgcaatcattttcgaccttaattgtgtgagttttttcacgttcacaatgtccaaaaatgtacggtaacctttttcaaaggggttatgatgtacttgtattaatggaagaggaggtaacaaaatgacaagtccaattcatgtaacatcggaaatcggtaagttgaaaacagttttactgaaacgtccgggtagagaaattgaaaactttacacctgacatgatgccccggttattattcgatgacattccatatttaccaattgcccaaaaggaacatgactactttgccgatactttacgcgacaacggtgtcgaagtattgtacctcgaaaaattagctgctgaagctttagacgcagctggtgacaaagttcgtaatgacttcttagagcaaatgctgactgaatccggatatgcaacaggtaccattcatgatgcattgaaagaatatctcggcagcatgaacaaccaagacatggtcaacaagatcatggaaggtatccgtaagaatgaagtagatttcgtgccaacagacttagtaagtgctgctgaaaccgagaactacgaattctacatggatccaatgcctaacttatacttcacccgtgacccttcggcatgtatcggtgaaggtttgagtatcaaccacatgacattccctgcaagacaacgtgagtcactctttaacgagattgtcatcaagtatcatccacgttttgctgacaaaggggttcatgtatggcgtgaccgtaaccacgatacccgtatcgaaggtggagacgaattagtcttgaacgatcacgtaatggcaatcggtgtttctcaacgaacttccgctgacgccattcaagatattgctaagagcttatttaaagaaggtcactttgacacagttattgcgattaagattccgcataaccatgcaatgatgcatttggatactgtgtttacaatgattaactacgatcaatttacggttcatccaggaatccttggtgagggcggccatatcgacacttggacaattactccaggtaagaacggcgacttgaacttggaccacagaactgacctcaagcaagtcttgaaggatgcgcttaagctggatgatttggacttgatcccaaccggtaatggcgacccaattatcgccggccgtgaacaatggaacgatggttcaaacactttggcaattgctccaggcgttgtggtaacttataaccggaactacgtttcaaatgacttactcagaaagcacggcttaaaagtgctggaggttatctcaagtgagttgtcaagaggacgtgggggtccacgttgcatgagctgcccaattgttagagaggatatctgaatcagagcgtgacgagggctgggtgacgcggtttctaagggtactttgactaaaatccccggttttgggattttagtcaaagtgcacttagaagttagcgtcaggcccgtcggagcgtgtttacgaagctgcctcgttcagaaggctgccaaaaaatatccaaccaactctacaatccagtgtaccgtacccaaaaacaatcatcatcaaggagaattcgattatgacaaaagatttcaagcaaaacgtatttcaaggacgcagcgtattagccgaaaaagacttcacagcagccgaactcgaatatttgatcgactttggtctccatttgaaggcacttaaaaaggctggcgttccacaccactatttggaaggtaaaaacattgccttactcttcgaaaagtcatcaactcgtactcgttcagcatttaccactgctgcgattgaccttggtgcccacccggaatacttgggttcaggcgacattcaattaggtaagaaggaatcaacttcagacactgccaaagttcttggcagcatgttcgatggaattgaattccgtggcttcaaacaaagtgatgctgaaattcttgccagagacagtggcgttccagtatggaatggtttgaccgatgaatggcacccaactcaaatgttggctgacttcatgactgttaaggaaaactttggcaaacttcaaggtttaactttgacatttatgggtgacggccgtaacaacgttgccaactcattactggtaaccggtgccatcttgggggttaacatccacatcgtttcacctaaagaattgttcccaactgacgaaattcaaagcatcgctaagggctttgctgaaaaatctggtgccaaactgttgattaccgacgaccttgatgaaggtatgaagggctcaaacattgtttataccgacgtttgggtatcaatgggcgaaagcaactgggaagaacgcgttaagttgttaacaccatatcaagttaacatggaagccttgaagaagaccggcacacctgacgatcaattaatcttcatgcactgcctgccagcattccacaatactgaaaccgaatacggcaaggatattgaaaagaaatatggcattactgaaatggaagttactgatgaagtgttcaccagcaagtatgctcgtcaatttgaagaagcagaaaacagaatgcactcaatcaaggctatgatggccgcaacacttgggaatttgtttattccacgtgtataggacaaagtaaaatttcagcctagtacccaccttgaaaaatagctcaacaatacaagggactggcaacaaaacatttgttttgtcccagtcccttattattttctaagacggaggagaattattatgggacgtaaaattgtggttgccctcggaggtaacgccatcctatcaaaagatgcttcagctgccgcgcaacaacaagcgttgcgcgataccgccgagcacctggttaaattcattgaaaatggtgaccaactgatcatttctcacggaaatggtcctcaagttggtaacctgttattacaacaagctggtggcagcaccagtgataacccggaaatgccgctcgattcctgtgttgctatgacccaaggcagcattggctattggatgcaaaacgccatggaccaagtgattaaagaaaaaggcttggacaagactgttgcgacagttgttacccaagttgaggtcagtgctgacgatccggcatttgccaacccaaccaagccaattgggccattcatgagcgaagaagatgccgatctcgctaagaaacagaatccggacttcagcttcgtggaagacgccggccgtggctatcggcgggtcgttccttcaccaaagccgattggggtcgttgagacaaaagcggtcaacgccttggttgacgccggcatcgtgccgatttcagttggtggcggcggtgttccagtagtcagtgatggtagtcgactggctggtaaggaagcagttatcgataaggatttcgccagtgaaaaacttgctgagttggttggtgctgacgcattgattatcttgaccgcggttccaaatatctttgtcaacttcaacaagcctgatcaaaagaaattggagcatgtgtcagttgctgatttgcatcaatacatcggtgaaaagcaatttgctccgggaagtatgctgcctaaggtgcaagcagcaattgactttgttgaagcaaccggcaacgaggccgttgttaccgctctggataacatcgaaggatttattaatgatgggtcggggacaattatttcggcaaaataacacataatcccgattttgtccttaaaatcatcttagactttgtttaatgtacaatctggttatttgaggtacacttctaatgagaacacaattatgtaaccgtttttgggagtgtatttatgattttaaagaataagagtgattatgagtattatgctaaaaaactgcgccgccatcctgaatttagtccgctgagtgataagtatatcaatcagctgattgatgagatgactgttaaaacctatcatcgcggtcaaatcttgtttgaccagggagacacccgcgatcggttctattatttgatcgatggtgtttgtaaatcctttcactgggacaaagacggcggcgaacagctgtatctgtatattcgacccgaaaaggcattcccatatattggtttgtttgaagacgatcgctatgcatacacggtccagacaatgtccgaggtcaaattagccgagttcccgatgccgatttatgaggaaattttgcgtgagaaccctgagttgatggtcaatgctgtcaaagaaatgagtcaaattatcaacacctctgagactcagcttcaacgcatggtgaccaccagtgcaaaatgccgggtttggaacgcaattctcttcattggtcaacaaattggtgattatcaagaagatgagacaatccttgttccgtatccaattacattggttgaactgtccaaggtgagtgggacaacgagggaaacgaccagccagatggttcagcagttggttgccgagaacaaggttcaatataatcgcaaatatttcaaaattttagagattgacgatgattcatattaattgaatattattcaagggagtgagctaaatgaaagagcatgatggtaaattagggctgctcgaactgatcggattggttgttggatcaatcatcggtggtggtgtgttcaacctgatgcacgacatggccgtaggagccggtgccggtgcgatcatcattggttgggttattaccgccattggaatggtgatgttagccttgacgttccagaatttgaccatgaagcgtccagatctggatgccggcgtctatagctacgccgaagccggttttgggaagtacatgggatttaattctgcatggggctactggttgtccgcctggcttggaaacgttggttatgcgacactgttaatgagtgccgtggcctactttctgccggtatttggggatggccaaaacatctggtcaatcattgcagcatcatttattttatgggcctgccattttatgattttacgcggggtcgaatctgcatcgtttgttaacacaattattaccattgccaaattgattccaatcttcctattcatcattatcgtattgtttgcgtttaagatgaatatgtttaccagtgatttctggtttacaccaagtgggaaatttgaatttggcagtgttatggcacaagccaagagtacgatgttagtaactgtttgggtcttcatcggaatcgaaggggcggtcgtcttctctggccgtgcccggaaacgttctgacgttggtaaggcaacagttcttggaattatcaccgttattttgatttatatgttaatcacattgctatcatttggtgttatgagccgcgccgggttggcacacttaactcaacctgcgatggccgaattgcttcaaagcctggttggcaaatggggcgcgatggttgttaacggcgggttaatcatttccgttgtgggtgcctggctgtcatggaccatgttcgccggtcaattgccatacgaagctgccaaagaaggatcgttcccgaagatgtttgccaaggaaaataagaatggggcaccaattacctcattgaccgttaccaacatctgtgtggaaatcttcatgttctcgtacctgattacggcttctgcttataacttcttctattcaattgccagtgctgcaattttaattccttacgcattttcagcattctatcaattgaaatattcattcctggaagatcatggcaaaggacgaaccggcaacatcattgttggaattatttccagtctgtatgcctgctggctgttgtttgctgccggagccaacttccttctcttgatgtcgctgctctttgctgccggaattccagtgttctggatcttgcagaagaaggacaaccacgccgagaaggtctttggaccgattgaaatgttgctggcaatcttcattgtgctggctgcaatttatgcgatttatggattgattgttggacaaattactttctaattgtaattcgtgacggagaatgaatttgaacagccgtatatttgtaactaagggagcagctcaaatgagccgctcccttagttattgattcttttaaaaataagcagtcacaaacaaatacccagccaaaccaaatgcagctaatgaaatcaaaatccgcagcaaatggatgtttgaatgacggacgatgatcggtccggtgtagccgccaattagtaggccaaatccaagcgggatcaccaatagccaatcaatccgggacttgaaaataaaaatgaccgtcgcaatcaagttaccgccaaaggcaatgacgttcttcatggcgttgaccacggtaaaacgatcatcagtgatgattgataaaattgcgaggaagataacaccaccggcagcaccaaagtaccccgtgtaagctccgactaggacaattccggtcaggctgatcagtgatacccagaagtgcttggttggcgtttggtgtgcctgcttcaatttggcagtggaaacgtccttttttcgaccggacatgaataacagaatgcccgcgaagaggatgaagaaggggaccactttttcaaacgacgaagccggtgcaatcagcaacagcacactaccaccgatgcttccgattagcgaaaggatgacgtagagagtcaattttttccaatgccctctgagttcctttagcgaagaagccgttgcaccgattcctgagaagatcagggcagtggtattggtaacattggcaataactggcggaagccccaccgccaacaaggctggataggagacaagtgaagccagcccggcaactgaggcgagcaatcccgccgcaaagccggcaatgattaggaaaataaatgtaagcaccatgagttgggctgacctcttttcaattttttgatacttctaatatactacattttacaaagtagtcgaattcatcttgtgaggggcttgatttctgatgcccaacccttgataatatttaactatcaactcaagatgaaagcaggttacccatgacacaattattttttgactttgacgggacgatcgccgactcggaagccggcattctcaaatcgctgaagtacgcagtcgacaaaatgaaattgccggaactaacacatgatcaatacttgaaatttattggcccggcactcaagaccagcctccaaaaattttatcctgaactgtctgaagctgatcagatgcaggctttaaaatactacgccgattattatcgcagtgaggggatgttccaactcgatctctaccccggtattgtccaagagttgcaggtcttgaacgaacagggctacggcgtcaatatcgcctctgccaagccggaagatttgattcatgaattgacggatcaactagatttgacgcaatactttaccggtcgatttggtgcggggactgacgagaaaacccggatgaccaagacagcggttctcaaatatgctttggaacaaactcatgccaacgccaacgacagcatcatgatcggcgaccgtgacaccgatatgcttggcgggtatcacaatcaggtcaagacactgggagttacttatggatttggcgacgttgccgaactgttgggcgcccatgcgaatacgttggtggataagcccgagcagattcaaggtggagtagagaaattaatcagctaaatatactaaaacggatcgaggaaatcttcctcgatccgctttttgttagttactggatgttcaattggaaaagcgtgctcccagataacgacgatgatcgttgggttcactttaaggcttgatataggcaaaaccctgttcctgcagtgaaaccaaatcagcgacaccggcagcgacaatttcaacgtttgccggtaactggttttccttaatcgaatggctattcatcgaattattgcaggcgtggaatctaaccccttctcggctgaattgctcgacggcatttcgcagatgttcgtccaaatagcccttgatggcatcgccgttgactaagacgacaatatggtattcttccttattcacgcgtccataatccagcaggttactaatattgctcagtgtgtgatcccacttatccaattcatcaatgtgaaagacaactttatgcatcattattccctcgtttcatccgcgtccaacgaatccaaaaattcctggtaatcctcgtggacctgttttgaatattcgtttgcccaattaattaaagcggagactaatttcttcttggtgccgacatacccgtgaacgattgcggcggtcgggctttgggcgtggccccgtgccagcaggagcccacagattttagcgtaggtagcaaaatcatcggcatctaatttgtccaagttaatcgattctttcatatcccagaactgacggacatagaagctgcggccggtatcatcgttgtgatagaagcctagcagtggatcggatgcccgctgcaaaatctgctggcaggtgacgattcgctcaccattatccggcttgctctggctaaatggggtcgtcacatcaaagcctctaaaacgccgagtctgcaaggcctccttgatttggagaaccaggtggctgccgtcaatcgcggttaacaagaccaggtagcaccgggtgccaaaactaccaacgccgacgctatggcggacaatatcactgatatgaaattgtgagaggaggacagtgacgtccgggctgaccgagcgggtgtaactccgcaagtgctcgcgaatttcgttgaagcggcgatcactgacatggacggtccgtggagcgttttctttaaagacaagatgtccccgggaatccaatgtcgtgaattttttgaccactttacccgagttccgttgttcggcactatcccgaattttgcgccaaacctttggtagtttgtgatcggaatcctccgactgcaggaaggattcaacttctgtggagaagtagtagcgttccattgctgagtgatcatcaaaacattggctgagaatctgctggtaggtttcaactgctccctgcataatctcgttaatttggtcgctgtctagtcccagctgctctccttggaggacaatgctgacaagcaggcgccggaggtcccagtcccatgagccgatggtggattcgtcgaagtcgttgaggtcgaacagaagttttcgctcaggagacgcataaaaaccaaagttccccaaatgagcgtcaccggaaatgaccaccggaatattggtggaagtttgtttcgacaggtcgaaagccatcaattcgtccgtgccgcggaaaaatgcgaaggccgaggcagccagacgcttgtggcgcagcggcattaaatctccgatcatcttttcttcaacgtgagaaattccttcaaccacgttacgcttaaccgggacaaattttcccagctggtcaaatgagatccggtcacgaatcttttttccgtcatcaatcagttcgtgaatcgatttattaatattaattttacttaagtcgtagtgcaagcccgtggtcgttcgggtaaaagtcttgctggtgtctgccatttaagtcggctcctttattttgacaatctataatatcattgtggcaattcccggtccgtgagtcaagcgaagccaactcatccgccggcttgatatgttacaataatggaaatagacgatttgtaggtaatggagaattagatttatgaaaaaattgtattgggaaagcatcgaagtgaataatcaaaaattcttcttcacagtcactgaaaaagggttgaactttgtctccagccccgggaagtacttgtctgagctttttgatttttaccctgatcgttatgatgaccaatttatgtacgacgactcggtgaccgccgattatttaactgaattcaccgattactttgatcaaaaacgtcaagactttgatttgccactggatttagagaatatcggcaccgacttgcagcatcaggtctgggcagaaattcaaaagattccatatgggcagacagtcacatataagcagttggccgaaaatatcggtaaacccaaggcaattcgcccagtggcccatgccgtggccatgaatccggacctaatcgtgattccgtgtcatcgggtggtccgcagcagcggcgacatcggcgagtaccgtggcggtaaagaaactaaaaaagcccttctcgagttggagaagaagccgattgaaaagcatgctttgattagcaagttaccgttgcctaagcttagtcaactaggtaaatctgatctttaattaaatcaaatggttggtgatgtcggttcagctgtttggcagtctcgggcttgataaaatgggcttgttgccagaaagctttggagtcggtagcgccatttttttcgccgataacgattaattccaaatcgttgtcggcttttctaatggcattgaggacgtcgacatcaatcgtttgtttgtccggtgaccagctcatgataacgtatttcacctggctctgatatttggcgattgcagccagcgcatccagcttttcgacgcgaatcagctgatgcttgccggtttgattttcgtcaacccactcaagactgtcggttgggaagacttttacgccaagatcattcagtcctttggaaatatatccgttgccggccatcacttccaacaccggtgagtcaccgatgtagtcggcgagatccttgataaacggggcagagatataggcccacatcccgtattgactctctaagtaatcccggaatgagcgcaattgtttatcaagtttgggcagcgcatccgacagttcgttccaaagctggtcgccttttggatcaccgggcttgaatcgaccgttgatatctttgaaaatttgatcttggatatcatcggggagcattaattccggcaagtcctgcggtaggagtccttgtttgattaaatggtcactttcaatgacattattgatgagaaatttaacctgtggataggcagcaaattgatcacggaattttagcatctgggcgatatagttagattcagccggttgggtagtggggtgctttttcttgagcaactttttcttttgtttattggttagcatactggactccttttgagtttcttttttggttagcactaaatgtgacggtacgtaaatacgctcaccaagccaacttcgaccgcattatccaataacaaggctcgatgctcgaaaacacatcaaacctcgttattgaataaatcctcagaagttaaaccgcttgcttgatacattaaagatctaattctccttgttccgtccgtggcccttgatcatgcggggcattgcttcttccgtggacgtaacctgagattaactgatagatttcatatcggtccttggaactcaaatcttgaccattaaattgcaaggttttatctgaaataaatagtcgcgccaagtcataggtattattttcagataaccccgtcaaataatccatggtcgcgtcgaagaacttggcaaggcgctggatttcgatgtagttgggcgttctgatgccacgttcccagttaccgatttgagatccggtactttcatgctccttatcagtcggggaatctttgttgatcgcgcgggctagttcttccaaagttaattgttgaccttttcttaatgctcgtaatctttctggaaacatgtgatcaccgtcctgttcgttacttatattatacgacttttttgctaatcaccaaatttcggcgttaaaattcagaatgtggtatatttatcacgagaaaaattgaattggtgggatggatgaatgaaacgaaaaacaaaagtctttattgggttggcttctgcagtggtgattatctgcggcggtctatttggtgccgggatgtatttttacaatgttgccgtggtaccggctcccaaatcatttttaagcaagactgagccaatcaagcccggcaactcgcgctatccggcctacaaatggtatcagggggctgacaagcagcattggtttgaaatgtctgctactcggcaccttaaattagatgccaattacatatcagctgacaagaccaccaagaagaccatcattattgctcatggcttcatgtccaacaagaaccgcatgttcgactatgcctacctgttccacaacctgggctacaacgtcttattgccggatgcccgcggccacggcgacagtcagggaaactatatcggctatggctggccggatcgcttggactacgttaaatgggtcaaaaaggtcatccaccacaccggtcagaagtctgaaattgcgatttttggaaccagtatgggtggtgcgacgacgatgatggtcagcggagtcaaaggtctgcccacccaagtgaaggcgtttattgaagactgtggctacacggatgtttattccgagattgcctaccaggccaaggaaatgtatcatttgcctaaattcccgttggtcgacattgtgagtgggattaatcatgtgaaaaatggttattcgttcaaaaaagccagcgctttgaatcaagttgcgaagaacaaacggccaatgctgtttattcatggtgccaaagaccaatttgtcccgaccaaaatggtttacccactgtatcgggctgataaggggccaaagcagctgctgattgttccaggagccgctcattcacgttcatttagtacccacccgaaactctatacggataccgtcaaaaagtttttaaatcgctatttgaactaactataaactttggcgacttcaatcagtgagtatgttaaactactattaggactgtttttagaaaggaggtccgcacttgttactaatcataattctaggaattttggccgccatcgtgggtgttgcttgcggcgtgcagctgcaaaagcgtcacttccagcaggagattcaaaatgcgaaagccactgctgaaaagctgttgaacaacgccaatgaagacgccaagaaacaatctgccaagattattgccgatggcaagcaacaaacgattgactaccaggattcaattgaagaagaacttgacagctaccaagccgataacgttacccgacagacccgaatccaacagcgggaaaccggtttgaagcaaaccgaatctcgtctggatcagctgcattcaaagctggctgaagaaagtcatgaaattaatcagcaaaaagctgaaattgaacagcttcaccacaccgcaaatgatttgtcccaggaacgattaaagacgttgcaggaacgcggctcaatcagtttagccgaggctaaacaacaaattctcgatgaattgaagacggcgttaaagcgtgaaaaagatattgaattgaaatatcaagatgacgaagcacaggtcaacgcgccaaagatggccaaaattttggctgacgacgccatccaacgcggacccgtcgacatgccgcgtgaacacattgagcattcagtgcaaattaacgacaacaataccaaacagaagttaattggtcgcgaggcctctaatattcgctacatcgaaagtttgacgggtaccgatttggtgttcgatccagatgatccgcatctattacacgtggtcacccaagatccgctgagaagagaagttgccaagacggtgattaccaacttggcagtcaccaagcagattaatccgcaatcaattgagcaccaggttgagaccgctcagttggatttgatgaacgagcttcggcgcaccggtgaaaaagtggtcggttcgcttcacatcggctggatgcatccggatctgttgaagattgttggtcgactgaagtatcggaccagttatggccaaaacgttttgaatcactcgattgaagtcgccgatatttcagggatgctggctgccgaattgggcttgaacgtcaagattgccaagcgggccggcttactccatgatattggtaaggcaattgatagagaagtagatggtacccacgtcgagttgggtgtcaagattgccgaaacctatggcgaggacccacaagtcatcaattccatcgcctctcaccatggggatgttgaagtgacaaccccaatcgctcatctggttgcggctggagattcaatttccggtgggcgcccaggtgctcgaagcgagtctgttgaagagtatgtcaaccgactcaaaaatctggaacgcattgccagctccaagcagggtgtcaaagaaagttatgccatccaagcgggccgggaaatccggattgtggttgatccaaagaaactggacgatcaacagaaccaacagttagctaatgaagttaaggatgagattgaaaatgagttaacttatccaggtaagatcaaagttacttcaatccgtgactttaaagcggtggcttatgttggcgctgagaagaaaaaagtgcataaacgattgaagaaagcataattaaaaaaagacggggacaagggaccttttgattcctaccatttaacacaaaagtgcaatcattctaaaaccaagaatgattgcacttttatgttaaatggcaggaattggcctattgttccagtttcttttagggtgcgatggaacagtttctaatttcatttaataaagtttgtcgctaaggcataaaccaagaaaagcagaacaccgacaatactgatattcctgaccaaacgcgggattttgtatgccggaacattcctgtacggtggcattatttcgcttgcccatagataaaagccaatgatagcaagaaagcaaaatgagagttgatatgaaaaacttaggccaatccggacgagcggcatgaggacgaatatcaaaccgcaaaacaccagatataatctaatttggattttaaatgatcgattgataattacagaccctttcttcatttagttggggttataagagcattttaaaaataacaggagccttttgatcttgccgaataaattaattgcgcttctcagaatcagaaataatttcaaaattatgattgacggtggcttcaatcaccggatgcttctgtaagtattccataatcacgtggctgattgtcatatcacttgatttgacgatcttatcgctggtatacatgggatagtggccgccgccgcttgctcgataacggttaagggcgatggtcaggacttgatcgtcttggacatccttgccatgatacttcaatcgggtgactcgatgaccaaccggtttggaaatattcagggtataatcaatcccttcatacatatcgtagttataaaaacgttcctttggaaaaacaaatttctcgttcaccacgacgtcaccgtgccggaccgtgaagtattgagcggtcacttccaaagcgccgcgcaaatcggcgccggtaatctttgaggcgaccaacgtgtttggatacacgtagttagtaatgatgttgcgcatggtaatgggatcttcaaatccgtgggcctcattgttgtaaagggcggttgccgaaaggtcagttcccatcttatccatttgaattttttggattaattcgataaatgctgattcgtgaattcgggccttgaatgggtcatcgaaagttaagctgcccttgattcgtgaaagcggcttgtccagccacgcttccaaatgtttggataaatccgtgactgttgatttgattgtctggtcgggttcactgtctttgacgttcagcagttccgcgtcacttctggtgaccgtgtggttcttggtctcaatcgaaatcttggccacatattgcccgcgagaacctggctgaacaattggcacgttaaataattggctggcaattttgcggtgttggtgcccagagatgagcgcatcgatcccagaaatattctttaagatatcgtagccgcggttttcgcctgggttgatatcgttccagttaccggtatgatcacgttcaaagccgccgtgatacacgacgacgaccacatctgccttcttgcgcatttccgggacgtagcgtctgcacgcgtccaactctgaaatgagattaaaatcgttgagatcattgacgttcttccattttttagtggaagtggttgtcaggcccaagaaaccgattttgacaccggcgacatccataatcgtgtatgggtcggccaacagcggttcgttattgttatcaacgatattggcgcacacaaaatggcggtctgaattcttcatcatgtagttgagataatccagtccgtaatcaaattcatggttgccgatggtgccgagttggtagccgacttggttataagcagtaaaaaacgcttcctggtcctgcttatctgctcgcttagccacgtaataagccatcggtgatccctcaagaaagtcgccgttatctaacacgatgatcttttcatcgggatgggtcttttgataatttttaatcgtcgaacacgccttctcaataccgaagggtttatcaagacctgaatcaacgtagttggtaggttcaataaacccgtgcgtgtcgctggtcgctagtagcgtaattttcatattttcacccacacaaaatcaagtatatcgtcaagtatagtcaattatgccatgattgtaaattagggttggccaaagtagttaagccaacaggaaatcggttccggatccctgctccatgtaagccatctgatcagtggaaatactttggctgagctggtctgacaggcttctggaaatcttaccggctttgaaggcatctgccacgtaggcgtattcatattggaatgatttaatcaacaggctatttctgtcactggtttgggtgtcacctgcagaacggctctggcggaagctgtacgagctgcggacgaagttgactgcattgctgttttgatcgtcttcaatttggtctaaatagctgttggcactggtaaacatggcgtctttgatcaatagattagtctgttggcgctggtcatgaatctgctggcggttttgcttaggaatggctgcttggattcgttgtttgatttgtttggttttcttccgcgacttaaatcggcgcagttggtatttaaaaatatacttaacccttgtccaaaagcccaagtggttgctgggtgcagtgatcatccgtcgtgaaaacaaattggcaatcttttggtcgattttgccctcggcggctaaatcaaccactgcctggacgctgacttgctgggcaccggccataatttcctggacctgtttgcggtcgacttccggattatttttctggctgttcaacatgtcaatgacatagttgcggtccaaaagtgcgatcgtcgagtcttgcttgacctgggaaatggcgtagttgaccatttcaccacggtattgattgaactgaccctgatcctcaacttgctttttcggacataacaggggcagggtgattgttgggacaatcaggcttaataagatgacaattgtggcaatgtagatcaactggtcgcggaatggaaacggctggccaagggacgtcagcggaattgacagtgccatggccaaggtaatcgttccatgaaccccaccgatagcactgaccagggcttcgcgtgtcgttgggactttatcttggacgccaaacagattggtccgcatccaaatataccgaatgagtaacataaccagataaattgccagtgcatcaaagaccaatttgataattaaggtatttgaatagggaatcattcgtttgatgactttcggcagggtaacgcctaagaggacgaacaccaccccatttaagaggctggtgatcacaccccaggtcgcattggtgaccagccgcacactggtcgaagtgagctttaaacggctttgattgatgccgtagatgatgccggcggccacgactgccaaaattccggaacatcccagttcctcggaaaataaatagatggcaatcggggtcatgatactaaatggcacgatcacgctggcagtatccattgatttattgaccaatagcgtttgaatttttacgaagatcaaacctgcgactgcgccaaccaccaggccgccgaagaagctgatcaaaaaccgcgtcagcccctgagcaaatgagaagtccccagagataaaggatgccagggctaaattgaagataacgattccggaagcatcgttgaataaggattcattttccagtgcaccggaaacgtttgtcggcagttcgatatctttagtaattgatttgaaggccacagagtccgttggggtcacgattgcggccaccgcaaagcaaagtgccagaggaattagtggcagcagcaagtgggcgactaggccaatgatgacggcggtcaccaccgccaggatgactgccagattcagaatttgtctgattgaatggcgaaaatagcttgcgctcgtgttttggccgtcattgaacatcaacggcgcaatcaccatcagcatgaaaatttccggctccaaagaataattctggaagaatggcagtaatgataataagaagccgcaaccaatttgatagaaggtcaatgggaggctgggaaagattgtgtacaagatgttcgcaatgatcgcagccacgattaacagggtgagtgaatagaagactagcatttttttctcctttaaatgattttaataccaatattatagttgattgagtagataaacggtgtataattaatttcacaagtaagttactataagtaagtaaccgtattgacaaatattgtcagtatgataatatagtaatcgaaggatgttgtttctcgtttgtattttttgttactgagcaggggggaattgtaatgctgaatttatatgtagcacaaagcagcgcttcaagtcggaaggcacgtgcatggttgaagagccatcacattgattttaaggaaagaaatatcaattccaaccctcttaacgctgatgaggtaaaacaaattttacgtttaaccgaaaacggcagtgaagacattatttctacacggtctaacatctacaagaagttgaatttggacctggacaacttaactgtttcacagttggttgatcttgtcgttaagtaccccgatttgattaaacgtccgattatatttgacgatcatcgtcttgaggttggatttaacgaagaagaaatcagaagattcttgccacgaagtgttcgtgaagcagaacttcgtgaactggaatcacaaattagttaattcataaaaataactaatcagttatacggatcaattgaggaacttgggtaatatcttactcaagttccttttttagtttgtgaaatcggcccaaatcattactctcccacgcggataaaattatcgataactttggggcaaatttaatttgtacggaacaacattaaaagcaattaaggaactgtttattattctcacataatgtaaggacgacggaaaattcctagtgttgtgtttcacgtgattgttgcttaaaatcaaatcagataaacaaaggagacggacaagttgattaaaatggtcgcacttgatttagatggtaccttgttaaccagtgacaaaacaatttccaaaggcaatgagcaggctttaaaagccattcatgacgccggcgtgaaggtggtgctctgcaccggccggccgattaatgccatttggcggttcattgaacagttaggattaactgaagacaccgattatacaataactttcaacggtgcactagtggttcataacaatgataaggccgagttggcaaaaagtgggattgagaaggccgatttggtgccgctgcacaattttgtcaaagccgagaatgcaccattagacatcttggacttccagcaggtctatccaatgaccgacttgaagccatcgatgtatcagcagcagttcaagggaaatattgactttgttccccgggccttttctgatttgagcacgactgatgaatactccaaagccatcgtcagtgacaagcctgaattattggatcagtatcagagcgccattgatgacaccttacgcagccactaccacattgtccggtcacaaccgcagatcatggaatttttggcggccggtatggataaagttgtcggcttgaaggcattgttggctcactttgacatggacttcagcaatttaatggcctttggcgatgctgaaaatgatctgggaatgatcaaaaatgccgagatcggcgtggtcatggaaaatggccaagacccagtcaaacaagcgggggatgtcattaccggcaacaacgacgctgacggggtggctcagtacgttaatcactattttcactaacctgaaccagctcccggtaaaatgtttaagattgatctgacagtcttttttcgatttttcatttgtattatgataaatgtaattcaaatcaacaatcatgaatgggggaatcgttatgaaacaaagacaaggcatcatgacattaatttttgctgcggtcctttcaatcgggctgctcggcggctttacttcgacagctgacgtgagtgccaagcagaccgtcaaagtggtcaaagttcagaaggttgcgaccaaagcttatcgggcaaccaagggttacatgtataattcacccaagctcaccaagaaaattcataacttaaaaaattatccgaagacgactttttattctaaaaagcgggtcaccattaagaccaccaataacaagaccgcatactacacttacgttgccaataagagcggcaaaatcaaaggttatgtctactcgaaatacttaaaactgtatcagccaaccaagacgacatcgaccagttcatccaattctcaatccgataactcgatttccactccccaagtcatttccaaatcgtcattgtcgtccttaattgcggcttctccggacttggatccgacgggagagttactgagtctgacctcagctgattacaagacctatcaatcggttttcaataagaatttcaatgttgggaactatgccgatgagggtgtctttacagatgatcaggcctcaatttatgtcaaatcaccaaccctgcagccttacgtgcaaaaggcaatcgacaaatggaacactgctttgggcaccactgtctttacacttgggacggcacaaaaccacagcttgacgttgggatttggtaacggccaatcagaaggctgggatggtgtctttgacggcgacagtgtccaggtcgattattacgacttccacgatcggacttatccatatggtccgatgccattgtcctcatcgcaaaccatccagattaaattgtcgactgatgataccgatgttgacggggccgctgaagggatggcagcaacccgtgtcaaacagtcagctgccactcatcgtgatactagcgcccattatctgaccaccacagtcagcggtacgccaaccgaactgttggaaaattactgggtcggcgtgattacccatgagttgggccacgctctcggtctggatcataccccatatttccaagatattatggcagctccggccagcaccgaagatggccagagccaggaaaatgccaaatatgactggacgacttacaaagattccgacaacgtccaaggtggcgctttaaccgcgacactgagtcagcgagacattgatcgtgccaagctgaccaagctactagggtattggtgagatgaagttaaatgcatcatcaattagatcattcggttcatagacacaaacaaaccgcttattcctgtttggggaataggcggtttgtttgtgttaattatcaaggcgcttcatttttgcattaatgtttactgaacaatccagtcaagtgcgtcatgaatgcatccaggtaggctggaacatcagcattgacagccactttgacgttggtgtttggatcatccagtcttgccgggtctccggtcgttcggccgtaatacttttcgtcggtggtgacatacatgttcaaatcgatggtttggacgaagctggggttaattgccacgccaaccgcaaacggatcgtgaagggcacagccgtgaagatcggggctggtgacttcataagccttgatgtagtaatcgacgatgtcggcgaaggcttcaccagatttggtgtgaagatcacgccatttctgggtttctttgtaagttaatagggttctgagggtcacgtccaagccaacttgagtcagtggggcctttctaaaaacgtgatcagcggcagttgcatcctgttgaatgttagcctcggcgacgttggtcacatttccaggaaccgtaacagcgccacccatgatggtgatattgccgatttccttggtaatttccggagccttcttaatggcagcgtccaagttggtcaatggaccagttggaaccaagatgagatccttgccgtattgcttaacggcatcaataaagaaatcaatggcatcgcctttttcaggttgacgtttgggatcgggtaattggacatcgccgatgccgttttcaccatgaatctgagcactaaccggcattctgtcgaagtgatcggattcggatgagtgtgacagtccttgataaaccggaacgtccgttgcgcccaagagttccaaaatcttcagtgaattttgaaccccgtcttcaacgtacacattaccgtaggaaccgataataccaattaaatcaacatcgggatcggcgaccgcataagcaattgccattgcgtcatcaataccggtgtccaggtcgagaatcatttttttctgagccattaagaactacctccgtttgtgtattatcaaggatgaaaaccctttacctaatcataaccgaattttattggaaactcaattccgcttcgaacttgaaaccgattaatttgtaagttacgcttaatggtatcaaccttaggagtaaattatgaaaaaaagtgttaaaacaattggtagtcattttttctctttggtgtggaccggtgttcgtcgaaattatgataatttggatgataacatcgccaaacatctgggagagtccgagcccaacagtccggttgagattcatttatcacggatgttttcggaagtctttaaacggcattccagagacgaagccgaccgtttattcatcgtcggcactaaaacaacgactcccagcctgcggaaagtatccagccggccggtcacgccgtggttttttacccgcgtctttttagttctggcagtcagctttgtcatgttaatggccttactgtttgtcttcaaaagtaacaaggtcattcccggaattatttttatcgggtccttggcagtgccattctcacttttgatgatgttctttgagattaacgtctatcaaaatatttctgtccggcagaccatggtgatctttttagtcggcgggattctgtcattgattgtaacgatgaccttttatctcatcctgccgattcgaaccgaggttagtattgaatctgctttgattgttgggattgttgaagaactggctaaatgtgtcgtcattattttgttcattaatacctataaagccaactacattttcaatggcgtcttaatcggcgcggccattggtgccgggttctcagttttcgaaagttccggttatgtcagtgaatacggtctggccacaatttttacccgtagttttcaagccatcggcacccatgcgatttgggcggcgattattggtggggccgtgattctcggcaagacgcggaaaaagcaatttaccgtgcgggacttctttacgaaacccaaatttttcatattctttctcgtggtcatctgcctgcacacattttgggattgggatatccccaacaccggaattggcgtatcattactgcaggaattaattgatattgcgatcgggtggttcctgatttttgtgatgatcgatgccgggttaagagaagtcaagacattgcagggacaacagattatcattcatcgaagtaaacagaagaagttcgttaataaacgctaggaggatcctgatgacagaagttgattcattttatgacattacgattatcggcggcggtccggcggggatgtttgccggtttttacgccggtttgcggaatgccaagacccaaattatcgaaagcttggcagaaatgggtggtcaggtgacggcattgtaccctgaaaagacgatattagacgttggcggctatccaaacatcaaagccagaacattagtcgacgaactggaaaaacagctcagcggctctgatacggccgttaaattaaatcagacggtgatcgatgttcaacagattgacggcggctatcaggtcaccaccaatcaagaagttaccaagacgaaatcaattattattgccaccggggtcggcgcctttaatccccgtaaggtggcggttgataacagtgaagattttgagggcaagagcctattttatagtgtcaaacatctggatcagttccgcgaccaaaccgtcttagttgccggcggtggtgactctgccattgatgaggccctgcttctgcacggtgtcgccaaaaaagtgtacctgctgcatcgccgcgataagttccgtgcccttgagcacaacgttgaacgattgatccagtcgaccattgaaccggtgaccccttatctgattaaaggcttaacccaattggataatggtcaagtggaagttgaagcaaagaaaatgaagactgaagagatcaagaagctgaccgttgacaagattgtcgtcaattacggctttattgctcaagatgatgccttgaacaaatggcaggctcatccggaaatcaaccggggcaccattgaagttcaaccaagcagcaaaaccaatttacagaacgtctttgcgattggggatgtttccaagtacgaaggcaaacagccactgatcgccacagcctttggcgaggcgcccattgccgttaattcgattatgaaaagcttgtatccggatcgcagaggtccgattcacagtacatcgattagaaaataagacacataaagacggttatcctcaattttgtggatagccgtctttatgtgtcttattttctatctaaattatattgtttcaaagcctgaccagtccgagattgtgattcttgttgggaatcttttggcaatccggagaacaaaatccgaccaccgtaaatcccggcatccggaccaacgtcgatcagccaatcagccttactaatgacttccaggttgtgttcgacgatgatcagggtgttgccggctgccaccagctcatcaaacagtttgatgagcttggcgacatctttcatgtgcaggccggcagttggttcatccagtaagtaaatggttccggtttggttcaattgaactgccagctttaatcgctgcagctcaccaccggacaatgttgtgagcggctggccgagggtgaggtagtccaagccgactttttgcatgttgattagtttgtcataaattttggtcgtatctttgaagaaatcaatcgccgattcaattggcatattgaggacttcactgatgttcttgccttgatacaggtagctgagagcctcgttattgtaacgtttgccgtcacacatttcacatttttggacgactgggtccatgaatgccatgttggtgatcgtaacgccttttcctttacagcggggacaggcgcctttgccgttataactgaacagactggtggaggccccggaaactttggcaaaaatttttcgaatatcatccaaaatatcgaggtaggtgacaggcgtcgagcggatattcgttccaattgctccctgcgccaagtcgatatacggttcgtggagctttggccgtaaggcatccactaacgaactttttcctgaaccggcaactcctgaaatgaccgtttcaacacccagcgggatgtcgacgctgacgtcttttaggttatgagttgtaacattttgcagtggaatagttgatttaaatggtcttggcttccgatatgtcagtggttgtttcaggtattcaccggtcatcgtgtgcccattgagcagttggtcataagtaccggtaaaggtcacctgaccgcccccacggccagctttgggaccaatttcgaccacataatccgcaattggcatcaactcggggttatgctcaacgaccatgatcgtgttgcctttattcttcaaattgatcagggcatttttaatcagctgaatgtcatggggatgcaggccgacgctgggttcgtccaagatgtagaccatatctaccagtgaactggtcaaaaatttggcgattttaatccgttgcgtctcgccaccagaaagggtttcggtgctgcggtccaaagtcaggtagcccaagccaatgtcgatcaacgactgaatcttggttgcaacttcacgaatgacgtccgtaaccaacggaaccttgatttcgtggagaaactttagtgcatgaaccaggtccattgccaaaacatcggcaatatttttgccgttgattttgcaagtgagcacctcaggacgaaggcgggtcccatgacattcaggacaaggccttctggtgacaattttagccagggcttctttgtggtgctgagcttcctttttgccgataattgatcgacgaattctgggaatcaagccttcgtaaagagcggttcggtgccaggcggctggtgcgtccttcaacgtttgttgaggtgcatacaacaaggtatccatttcttttttagtgtagtctttcaaaggcttatcattgtcaaataggccgctgtccgtgtaccgccgccagcgccaagtgttgggaccaaagctgacaaaagtgattgccccttggttcagtgacttttccgggtcaattaacgcattggcatcaatatcatcaacgtagcccaatccctgacatttttggcacattccttggggcaggttaaatgaaaaagtgtctgaatagccgacaaagggttgaccagcccttgaaaacagtaatctcaacaacgagtaaatccccgtgtaggttgaaagagtcgagcgggcatttttaccaatgcgcttttgttcaatcacaatggcaaccggcaggtactcgatacttttaacgtgcggctgcccatattttggcagatactgttgggtaaaactgggaaaagtttcgttcaattcccgccttgaggctgcagcaatcgtatcaaataccaacgaggatttccctgatccggacagaccagcgaagactgtaatggcgtacttgggaatctttaggtcaacgtgctttaagttgttttgataagcatcgtgaacttcaattgcaccatgttcgaacatataaatttatgacctcctatttttttgatgatttttagcagttgggagctttttgggaccggcttctttcttaagttctttttgcagctgattgacctgtctggacagccgggtgacttgtttggttaaatctttcagcgcatcggtttcgtcattgtgtttatcctgagaagtgaaaaagtcggtgatggtggaagttaacaaaccaataaaaccgattccacccagcatcaggacggccgaaatgattttgccgccatcggtcttgggggtaatgtcaccatagccaacggtggtcgccgtcgaaatggcccaccagagtgaattctgcagtgaatcatgctcaaaagacgcaaagattagcgagctgaagatgaggattaccagactgattgataacaggtagataaagccggtatcatagagaaacttgtgaagggcgttggttaatttgccagagagaccaaatcgccacagcaggttgtaataccggacaatcgaataaatcctggcaatccggaagaagataaaaattggatgcgagggaatcagcgcaatcaagtcaaatagattggagattaggaaatctttttttgacttggcccgtttgaaacgaattaaataatcgatcaggaaaaagagccatatgagtccaaagatcactcggtatggcccttcattgagggtgattttagtcacgagggcaagaactgccaagacaaaggaaaccagtgccaatgaaacgacaaggatattgtaaagcaaaattggcatgttcttggtggcttgtttcatctcagatttcccccttagcgactgctgtcgttgttattcgcatctggattggtaatcttgattcggttgctgtcggttgtcttgtggtgaatttccggcgcatcggtgaagtattctttccaagtcgacttgtcaccgttcttggaatagatactagtggacttcttacccaaacgtttttcaatccgcttttctttttgataaaggtcggcgtaattgtaattccgtggatcaattgccttaaagccctttggatggtagaagcgcaacagattcttttcgttcaacgaatctgataatgaaagctccgtttgaacccgctccttatccttcttgacttgagcctgttggcgtttggttaatttcaacagttggccggtcttattggagtaaatgccgccactcagggaggtaaacgccgggctgacccagtcctgatttctgaaggcaacgacttgatcgtgctgcttggataaaatgtcggtcccaaattggacgtagcgcttgctgctgatacctaggagatgcatcaaagtcggcaggacgtcaatttctccggcatattttttcgaaacgaagccgttcttttggccgggcacatcaataattaacggtacccgctgcagctgggcgttatcaaaatcgtcccagtcgtcaggattcttgcctaatgccttggccaaattggtgttttccgaattggaaatgccatagtggtcaccataaagcagaatcaaggaatgtttgagcaggccggttttgcggaggtagttgtagaactcatggacggcctggtccagatagtgggcggttaagaagtagttgtccaccacgtcatcaccggtattggtggtcttgaaattagtatcttctttatccaaatcgtatgggaaatggttggtgaccgtaatgtatttaacgtagaacggctgttggagattctggaggtatttgaccgaatccctgaataacaatttatcctttaaaccatagcccaaggagcggtcaccggtggtgttgtagtaactggcatcaaagaagtattgataacccatgttcttgtaaacgttattgcggttccagaaactggcaatatttccatggaagaccgcagaagtatagccacgacgctgatttaagatagctggagcggcttggaaggtattgtcactgccaagttgggcgaacaaggatccctgcggcaaaccgtaagtgctggtctccagcatgttttcggcgtcagaagtttttccttggccaacctggtggaagaaattcttgaaagcataagaggatttactcttatagagtttgtttaaaaatggggtcacttcttggccgttgattttcttgccaatcaggaattgttggaaactttccaagtgaatgacgatgacgtttttacccttggcaatcccatagaactttttattcggtttggcataatgcttgcgggtgaacttcaagacgtcgtttaattccgatttggtagcggtggcccgtaaatcattgttgtgctgggatttgaggccatcgtagactgtaaaggcatccaggccgaggtacttcactatgtaagcccgatcaaatgtccgcgtcagcagctgcggccgatccatttcggccagtgacaggttaacaacgaaaaaaaggaccgaaaacgaggtcactgccaggccaattcggcgattcagcggccgggggtcgattttgattttgcgaaggaccaacagcaaaatgatgaccaccagatcaatccagtaaaagatatcgtggaaattggtcagggcaagtgagctgccgctgagcccttggttgaccttggagtagccggtcattgtgctgacggtcataaaatcggtgaactcacggaagtaaatcacgttaaggtacagcaaaacggtgtttaaaattgaaattaagatcgccagcggataaaagaaccgactttttttgaaataaagggcgatactgagtaacaaagtcgtcgttgccaacgggttaattaagacaatcaggaactgaaagggattggtaattcccagcccgaggtcgacaaaataggccaacatggttttggcccaaaagcaaacaattaataaaatgatgaagcccttgcgagtgctgcatttttccaggacccaattaatatatttcaaaacagtgtgctccttacaataattacttgctttatcttatcaaaaaaacgcgcagaaataaccattgtcaagagattttgcagaaatcttaagttgattggtgtgcgcggattctcaaaaaattgttatactttagatattaagggtaaaggatgtgtcatcatgagtaaatttaatttgtacatggttcgtcacggtcaaacctactttaacatttataacaaacttcaggggtggagcaattcgccactgacggaaaagggcattcaaaacgcggtcgataccggtgagaaattgaaggacaccaagtttgcggctgcatattgcagtgataccaccagggcggagcaaactgctcaaaccattttagatgaaaatgacgcctcggatattgatgcgccgattacgtcaatgtttttccgtgaggagttttatggctactttgaaggaaatgatatgagccaagcttggtatttggcaggcgccccacacggcttgccgaccttccgggatatcgttgaaaaatattccattggcaaagcgaaagattacctaaaagaagccgatccgttccatcaagctgaaaacaatcaggaatactggaaacgtttggatcaggggtttgacctgattaaacagaacccagaaatcaaagacggcgacaacgtcttattaatcagtcatggtaacacattgctgagcgttgtggaacgctatggcaatggtcaatttgatgtgactgagcggccagccaacggcagtttgaccaaattgaccgttgacggtgatgacatccatgtggtggcctttaaccaacaataataacaagttaggcgggtatgaatttggagattaaattaactgatcaattggatcaaatttatcaagacgcaagaaccattcgccatcatgtcttcgttgaggagcagggaattgctgaaaccgacgaatttgacggtactgattccgacgccattcattttgttggctatgtgaatggggaaccggtggtaactgctagaacgaccgttaccaaaaagggcgttcatattcaacgagtggcaactgaaaaagccgcccggcatcaagcttatgccaagcagctcctggaatacctgctggaccaaccaatgtttgaagacgccccaatgttttatttgggggcccagaaaacggcgattggcttttatcaaacgctgggatttgagaagtatggggagccatttgaagaagtcggcatcccgcacgtcaatatgcggcgaacgcactcagccgccgatcaccacgatcgataaaatgatagttggttgtatgtaaatattaacagagagatccaagcggaattcaggtaccgcttgggtctctttttgctttgcggtccgtggtcacacaaggccatgacattaaagtgacattttacttgacaaaattggcagataaaacagaataagagtgattaaatgaacgattccaggggggattggcatggatcaattaatggcccgttcaatgaaagcctatcagagcaagtttgcccgtgtgattcaggatactttggcgctgctgtttccaattatgttactgggaagttttgctgaggtcctgaaatattctttcttgacgcccagtgggtttgttgccaccgtattcggggtgactaagtggctgcccgctgcgaggcagatttcacagttattggggctgattgtccactgtacggttgacatgattgccttatacggcgcttacgggatcacctactgtacggtaaaagcctatggtcgccaaacatcggcgatgtcaggtgctatcggcctgctggcattcttgatggctgcctatcagccccatagccacgggcgattgctgtttaacagcactttgatgggtcagggactgttaattgccctgataattggctatatcgttggacggatcattgttgccttcgagaaacgccgggcgttacgatcctaccaaatcatttggcccttgctgctggtggttgtgttttcaattgtggtcaatgttgttgtcagccttaccagaagtccggaggttcaatcgttcatctcgtcaactgccttgcatgcggttcaggccagcgcgctttcctatgttatcggcatgggattgttgacggatctgctgtcttggatggcggttggcggaccgttttctgcgagtccgacctttaccgatccagccgcgttgaccaatttgaatcacgctctcaaaacagggtcagccttcaatgcgccattcaaatataccgatgtgaccctctttcacagttttgccaattttggcggcaatggtgcggtactggcgatgattattgcgattttagtcttctctaaacgacagcgctttttgaccgtctcgaagtggtcaattttcccagcgctgtttaataataattacgcgatgatgttggggatcccaatcgtttataacccgatttttctgattccctttctgctggcaccactggtgaacatgctggttgctgcttcttttctggcgctcaaatggattccggcagccgtttatccggtaccttcagggacgccggggcctttgattggtttcttgggcaccaatggcaattggttggcgctcattctcggagcggttctgattttcgtggatgtgctgatctatatgccatttgtcaaactgtatgatcggcttgatcgaaaccggggtgagcaatgatgaaacggacagttaaaatctggttatggagtcttcttgcggtgttgctgtcagttggcttgattatcgcgtcactccagtggtcacaccaaaatgtcagtgagttaacccggcaccacaactctcagttatcgccagtcatcatgattccggggagttcggccaccgaaaaccgctttgatggtttagtcagtgagatcaaccacaaccgcacgaatccgcatagtttattgaaggttaaaattaccaacgatgacaaactccacttcaccggccgtctgagaccgggggacaacgagccgttcattgtggttggctttcaaaataacaaggacggttatagtaatatcaagcaacaggcccgccaatttaacgtcattttccataccttggtcagtcgattgaattttaataattttaaggcgattggacattctaatggcggcttaatttacactgtatttttggaaaattattttgaccaatattctaatgatgttcggatgactaagttgatgacaattgggtcgccgtttaacttcaatgaacggtcgattgataataagacgcaaatgttatcggatttcatcaaaaatcgcaacaagttgcccaataatttgagtgtctactcagttgccggcaccaagaattacacgtccgatggattggtcccgctggtaagtgttgctgctggccggtatgtttttcaaggcgccgttcgtcactttacaacgatcacagtgtctggttccaacgcccagcactctgatttaccggaaaacaagcagattgttgatttgattaaccgatacattctccactcgactcgggttccaagagcaagacaaaacgaaccacggttacattaaccgtcgtcgaaaatgtctgttaagccacgaccagctttggtgaatcgtaatcgctgaggcaaatgacagtagccaagttccaatgtagacggagaaaatgcctaaaactggttggcgactcatcaacccttggccaaatgttcgccaaagcagttgattccaaaagacgttggacaaaaaggctggataggcaaagttggccaagcggtgaatcagatgagtgaccgggagtttccgcgtaagttcggagtcgcctaaagcagcaatcaaactaatgatgctgaggtcataaatggtcatcgatggtttgtagtatggggcgttagtcagttgaacggggaacttgaaggcaaataattcatagttaatccaaacgaacgatcccagagcaaaaacggttatcagcccgtgtttttggagccagcgatgggccacttggcgatactgccaagccagagtcccgacaactgcatataataagaaactgacaaatagtctgtccagcaggtaccagtccttggcatgtgggccgtgaaagacttgggtgtcatagaaaattaaccagaccaactggaccaccgaagtcagcagcagaaccaaccggccacgctgttgattatggccacaccaattggccagccaccagaaaagcggcatcagaatgatgaattgcaacatcatcgaattgtaccaaaggtggggtgcagcattcccgttgatgaattgccaggcaaagtcgccaatcgtgtggtaatgctcgacttgctggacatttggcatgattaataagtagaccagggtccaagcaatggtggggatgaatgacgcgtgccacatttgctggagatagccccggtagcttaaattggtgtcgtgagtgactcgcatggtcgtatacaggatcccggtaatgaacgcgggtgccgtgaatttgatgaagttgtaacaaatgccaatgccgatctggatattgacggtcggatgagtttgcagggcttgaccaagaatgatttgcagcatgacggccgcgcaggcaaataccttgaggtaatcgcccatgtctggggtactgggagatttgattttgcgatccatatctgtagctcctttgaagaattatctactaccaatataccaagtgaagccgaaattacaaaaagaggctggaaacaaatgaatgtttccagcctcttcaggtgatagttgattgaattgttgttatgttgctatgtgttaaaaagattaatcgtcggtagcgtcatctgagtcaaagttaacgatatgagcggaaccaacgtaattccaccatggggctttgacagtttcggtgatgacaccgcggttttgagcatcgatcatcttaccgttgccgatgtataaaccaacgtgagaaattgatgctgcgctccaaccgaagaataccaaatcacctttttgcaggttcttgtatgacaccttctggccggcgttgtattgtgcttgggcagtacgaggaagggtgacactcgcagcctttttgtaaacgtaactggtaaagcctgagcaatcaaatgctgaaggaccagtggcaccataaacatatggcttgccgaggttttgcttggcaactttataaacggctgaatatgaaacatcagtgtcggcagctttggatgcttgagcatcttggaaaccggcaaatgataatgtgaagaatgctactagcgtaagtaatatttttgtatgtaatttcattttttatcaacaactccctatcaaatctacagtgataacaataccaatgaattgttgcaaaagtgtaacaaacaatttgcaatgcagttaaatgtcatatggcagttgaaacattggtaacctggcttgtgaataaccgtttccacaagctgatttgagggtgtttataactgagcaattaaaaaagccacccaatgtgaattgagtgacctttttgaaaaatatccccatgatttggattaaatttgtctgaagatgacgtggcaaaaatagaaatcttaataaattatttatttattcttcaaaagattgtctttattgggcaaggttacggccaatttacccatcgaagtgacgatcatcggcaagatcaggtagtagacgcagaccgtgtaaatgacgatcaatgccgtttcaatcattgcaaacgatgcaccaaatgtgaggccaattgccaaggcaatgacgactagcagaatgtagcggacaatcttgccgtaactggccatggttggccgaatccattccagcagtgacaattccgtgtatctgaatgacaagcccaacgcaatgatctgccaggcggcaatcgcggtcaggatgctgattgcaagaattggcacctgccagtcaaattgattggtgcccgtgacataatgcatggtcagataggttaattgaaagccggtgatcgcagacatgataaacgcaacggtccaatacagcggttggagaatcgaacgactgacaacgaagacagtcaccaaaatcccgataatcactattgccaataaagtaatgaaatgatggttaagtttggactggttaatggattgtgtaatcggttcgccggtgaaggcaacctggtctgacgacagcggagttccccgcagctgcaagccaacttgagcttcgagcatcttaacctgcttgaggttggttttgctggatggggcgttgttcatgacaacttgaatggtggtaatcttcttgtcctggctggtgtagttaagcatcgtctgtaggaagtcggtgtccaccagctgcgctttggtaatgtaatagacgttggccgcaccggacttttggagaccattcaaataatcatagatgttgtttaactgatcggtcgaggaattaacctgggaactgacctgttttaattgcttttggacttggctaatttgttgactgtaactctcaagattattggcgctgttttgaccataattttgaatgaccgatccttcggcgttcagttggctgatgcctgacgaaacactttgtaaggactgattcaattcgttaatcttctgttgatacatgcggactctgcgtgaagcaccctgctgaacggcgacactggagttggcagcaacactgttaacttgtgaggctaagctggagctgtcttccacaatttgattactctttttaaccaggctctgcatgtctttgacctgttgcttgaggccggacaaattcaggttgctgccgctggtttcgatcccattggaggcctgtgaaagttgcccggttgcctgcttggcgtttagtccgatcgattcaagttgattggaaacgtaatacttttcgatcggcatcccacttggctgcgttaatgaataagcggcgctaacccctttggtatgctgaagtttagtggttaactggtccaaatgctgcaggtatttttcattatccaagggctgatcgtttttaaggtaaatcgtgatcggcgttgctttaccctgtgaaaaatgtgcctggagaacatgggctcctttaacggcttgattagtctgcgttaggttggtcattggagaaaaattcaggctggtatggtagaagtaaatgaacggtagggtcagatataaaacgaccagaaaggcggcaattggctgccagagtgaaaagtcggttgcccggttccagaagtgggatttcatcgcactcaatggggcgctagacggccagaaaatactttcccctagagcagccaggaaaacagcgttcagggtcaagacggccagcattaagacaacgtaggtgatgccaagaacccacagtgattgtaattggtcatagttaatgaagccgcagcaggcgaagatgatagctaaagcactgccgacaatggtgattggaaagcgtaggtcggcaattgtctgctgggtggcataacgcgcttctcgttggagggccagcacgcttctgagcttgcggtagatgtagatgttccaaatggtgccgatcaccacggtggcaattccgatttcaagtggcgtgtattgagtgaaggcaaagttaaaatgtttggccaatgccgttgagatactaaatgaagtcgtaaatgccgcaaataatgtaatgaaagaaatgaccggtgcaaataacgaccggaagtaaattcccacaatcagcattgaaaccacaaataatgtgatcaaaatgatgttggtaacttgcgcggttttttcattgttgacgtcgcggacaatttccggactggtgacgtaggactttaatccaggcacctggacttcaccaaccaattcattggtcaaaacgcgcagggtactgcttttggcgtcgatatccaagctggcaatttgagtagaaccatctttggacaacagctgctgtttgccggccacgttggtgttgatggtgacgatcttcttgatactataaaatgattgatgggctttgagtttattcaaggcattgtcaatcttcgtctgctgcttagcggtgatcttgccgtttgggttcgtgtagaccacgttaatggtagacgcttttcccagattgtatccccaatcatttcgcagctgctgagcctgcgccggttgtgagtctttggaaaaggtgggctggctgtatgactgcagtgtatcggtcacgtttggagcggttataattgcaataaatgtaataatcagccatactaacagcgtgaataagcgatttttgtgtaattttgcgatagtttccttcattgattcgtcccctaaatatgtatgtatgaaaaaggctcatatattaagagtttaccattttataaaggctagtgcgatacgttttgggcgttttgtggtatattgggaaaattgttgtgaaatttagtcgaccatttttgatgggaggttcttaacgtgtgtacaagtatttttcaaattggccaagaagacggcgcccatgtgttgtcacggacgatggactggccgcagctgggagctcatcccgtctttgtgccccgcaactacggttggcactcggtatatgacgacaaacgttacgtcactaaatatgcgacgcttgggtccggccaccagcacgctaaacgaattgatatgtctgacggggttaatgaatttggtctggcggttcaaaaattgacctttaccaacggcagccagctggtcgaaacgccgggtgagaacaaaatccatctggcaccgtttgagctgtcgttctttttgctgtccaattatcgatcagttaaagacatcgaggaccatattgaagaaattgaattgatggctgacaagtacagcttaatgaagtatggacacagcgaattgcactttgctgcctgtgatccgactggtcgaatcgtcgtcatcgaaccggtcaccaccccaattgaaatcattgaaaatccattgggaatcttgaccaacagcaatcattttgatcggcaaatcgataagttaaataagtatttggattttaccccggattttgtcaacggaacggttcccctcaatacaccgcgggtgactaccggcaatgtgtccggcaagtcaattccgcccggctcatattcaccaggatcgcgatttattcgggcagcatacctgaaggaaagaattgacatcccccaaaatgaaaatgaggcggtggataattgctggcacctgttggactcagtgaatgttcccaagagtaaggagcaccagccgacttattccgtctaccgggcagccgtctgctgtgagagccggaattactactatcagccatatcacgctaaatcagttgccaaaattcaattgacggatgacctgatcaaatcgaatgaagtaaagtttttcaaagtagctgatcaaatcaccttcaatgagttaaactaatgtattgaggatatgagcggggagaaatcaagttgcgaaaacaaagttggcgggttattgtcatattattagtgacgtttgcggtgttgatcgtgggcgtttccctgcgtgggcagttaagtcaccatgcacagcgaaattccgtgccaactttggttcaaaaaaggcctgatcatttctcgactcgccaaaaacgaagctttatcaaccgcgttggcacgccggctgtcaagctgtacttgaagaatcggcaagtgttaccgagcgtcgtgatcgctcaagccattttggaatctcagtttggcacttctgaactgacaaccaccgccaataatttatttggcatcaaggggacttaccacggtcagtcggtccagttctatacccgagaggtcgagaacggtaaatcaatcaaagtcctggctcagttcagaaagtatccgaatttggcgtcctcaattgctgatcacaatcaactggtcagcgagaagtttatcaaagctaaaaatattttgagttatcgaaagtcgacgcgcttgctgcaggccaatgggtacgcaaccgatccccattatgccgccaaattaaaccgcctaattgtcaaatatcagctgagccgttatgatttaaaagcaattaatgaacgtgtgtgaccagcgattacattgttgacgcacgtttaaatgaaaatttgttgaggtgaatgccacattgttgaattgggtttctaatttatatggtccattttttgatcctcataattgggaaacggtgattaccagcggtagtgactggctgattattctgtcactagtcacgattgagtgtttgctgtcggtcgataacgcggtggttctcgctgcccagacacaggcgctgccgactaaagttcagcgggaaaagtccctgttctatggcttatggggcgcctacctgttccgtttcctgatcattggggtggggacttacctgattcatttttgggaaattaaagttattggctcgctgtacttgttctatctggtttaccaatttttccgaaaaaccaagattgttcgaactaagaaattggccggcagcaaacgccacggcatttcactgttctggtcggtggtcgcccagattgagttcatggatgtggtcttttcaatcgactcggttctggcttcactggcgatttcgtccaacccggtgattgtcctgcttggtgggatgatcggaattctggccatgcggggcgtcgctgaagtcatcatgaagttgatggggattatccctgagcttcagccgatggcctacgtgttaattgccattattgccttgaaattattcctgtcgattccggcaattgacattgaaattccagcgacggcttttggcgggatcgtgatagcagcggttatcattactttgattattcactatgtaagaaaaaagcggaggattaacgatgagcacggaaataacgccgaataatttagcggccgaaaccaacaatccactcaccgtgatcgatttctgggcgccttggtgcggtccctgcaagattttggaccccatattggccgacttggaagcagattacggtgatcaaattcactttggcaggatgaatgtcgacggcaaccaggaaattgctgagaagtaccatgtcttaagcgttcccagcttggtcattttcaaaaatggcaaagctgctgaaaaggtgagtggcatttaccccaaagataaactaagaaaatatttcgatcaaaaaatatcagaagttcaatcaatttgacgggcagtctaccgaaatggtttgatgcccttttgttttgccattggtgtcaatttggcatttaggatgtccaagccttgaagcggaaagttaaatatcggcgcgataatggctcgtttggcaggatcgggaaccacttggctttctttgagattgggcagcattttcgccaagtcggtttgggtgagatgaagtgccttgctgtaatgcatgactcgctgaaaaaccagatttttgaaccacaggtagtagatgattccagcggcggcaatataccaaaagattgtccaagtgatgccaattttggctggggacaggatattggtgaagaaagccaagataataaaggcacaatatgttaaaatgctaattatggttagtttagattttgttgacatgattgaccaactttcataacgaaatttgtgataccatttagatataattatagacaagttggaaaaatatagatagtgagatgaaattgtgaaattttcagtagagacaattgatcgcaaagattatgcggctgtacgaggtattatcgcagatagttatcaaaatgacggacccaacacagatggtgacgaggttgatatggttgatcgtctgcgcggcagtgaatcctatcatgatcaatttgaagtggtggccaaagatcacgatcatcgagtggttggccatgcattgatggtccccgccgaggtccgttccgcgacaggcaaatttccaattgtttccattgttgagattggcgttttgcatggttatcgaaacgacgggattggtcaggaaatggtcatcgaattagaaactcgggcccgcttagccggctatcacgctgtcagcgcaattgatcattctgatttcttctttaaaaacaactatgtgcctgctgacaatttcaatatcttgccaacggtggcggttgatttcaatgataatttgatcaagccactgttcgatggggccctgtatcaaaagggcggcaagatttactatcccgaagaattctttgggattcgcagcaccaactattaatttaatcattcaacgccacatgaagtagttcattcatctgagggtcagaaagccggtgggagatgcgaatcggtcaggatggattgacgaaataccgtggcggaatttaacggataataactagagccgatatcatctagtgagtgagctgtacatgtgcagttaatctgggtggtaccgcgctgaagcgtcccttagtctatttttggactgagggacgcttttttatatggaggagtatatgtaatggaaaatgatgttaaagaaccaacgattagtttaaccgagggcattgttgttctactgatgatgctattgattatgggcttcagtgtgatcaagctgcagatttcaccgcaaattccaattctgtttgtgattctgctgttgattgcctgggctaaagttcgccgcttttcttgggactctgttaatcagggcatcatcaacgggatttcaaccgggattattccgatgtttatttttattctgatcggggcactgattagctcgtggatcgctgccggggtgattccatcactgatggtctatggttttcatttgattagtgccgagtggttcctgccatcggtctttctggtttgtacgattgttggtaccgccattgggagtgcctttacggttgtctcgaccatcgggatcgcctttcttgggatggggctcaccatggggattaatccggccatgattgccggggcggtcatttccggcgccatctttggcgataagacctcgccgttgtcggattcaactaacttggccgctgcggtagtgggcgctgatttattcagtcacattcgcaatctgatgtggtcaacgattccggctttcttcacatcattgattgtcttctttttgattggccgtaccaatgcgcaactcaataccgcttcaattgaccgaacaatcaacgttttgacccagcatttcagcatttccttgtgggcatttgttcctattgtcttgatgttcttatgtgcctggcgaaaaattccggccattccaacactgtttatcaatattttggtagcggtcgggatgctgtacgtggagcagcccaagaccaagattcaagcagttgtcaacacgttgaccaatggctatgtgtcccatactggcaataaaaatgtcgatcaattattgactcgtggcggaattgccagcatgatggcgaccattgccttgatcatttcagccttggccctgggtggtttgctcatgaaattcggcgtgattgatgctgtgatggggccactgtcacggaagctgcagtcaaatggctcgctcattttggccgttatcctcagtggcattggtgtcaatgtctttgttggtgaacagtatttatcggtcattttacctgggaatgcctttaaatcaacttttgataaggcaaaattagcgccggttgccctgagtcgggctcttgaggatggcggcacggtgattaattacttgattccgtggggcgtggcaggtgtttttgccgccaatacgcttcaagtttccacgatttcttacctgccatttgcgatatttagtctttcttcaccaattttttcgatcatcagcggcttcaccggcatcggtttgaaacatttgaaaatgcatgaaaacggttagcattgctactttaacaacgttttacctaaatactggtcattcttaatttaacaaacattacttactcgttacattagttacgcggagacggtttttcttaatacgcgtgatattggatggtaacttcgtaactatacactatgtattgttgatcgacgaggtcaacaaaaattctagacacagaacacagatataggagtgtgtaattttgaaaaaagtattatctatgatcttcgctacttcagccgcagctattggtttattcttcgcaggatccgcatatgcttcagcaagcacagtagttacagttaagtcaggcgacaccgtttggggaatctcacaacaatataattcctcagtaaaggctatcgagagcgcaaacaaccttcaggatgcaaacgtcattcaagttggtcagcaattaacaattccttcagctgacaccgcatcaaatactcaaggtagtgcacatgcagcaaccgcaacgactcaacagactcagagttacagccaaccagctcaaactcaaaccaaccaagcacagactagccaagcatcaacttcaactagcactgctaccagcggttcagttgctgaacaagcagctcaattgatggaacaaaagactggtgtttcagcatcaacttggatggctatcagttaccgtgaatcaagaaacaacccaacagcacaaaacccaagctcaactgctcacggtttgtaccaatcactttacacaacaagtaatgactggcgcgaacaagtaaacgacgcagcacggatttaccattcacaaggaatgggtgcttgggcattaaattaagagcgtgaagagccccgggttgatcccggagcacaagggaaggcggccaatgatgaacttgttcatcgttggtcgtcttttcttgtgcagtagggatcaggggcgtcagaacgcatttccactagatagcagtggtaaggacctcaatggcgaacttgttcgtcgttggggctttttctttatacgttaggggttgggctgtcggagtgtatttgaacaaggtggcaccagtacaaagtcaaagatgccaatcacccaataaaaaagatatccgcagtgaggcggatatctttcctacataaaaattcaattatccccgtaccaacaactcgatttgacctttttgaggcgcgaaattaattccgacaagtggttcgcgcaaaatctttccatactcatccaaaacatcggatggcagtggggtgtgggccttgagggacgcaaccacgtcaccggcatcgtgagcttcagataagtcgatgaataaattgactttgttaaccacgtcgcggaacaggtcggttaaaatcccgttaggtttcccctcaacatcggtgataacgacctgcgaagaatcgaacgctaaatggttaaagcgcaccatttgtaaaacgtcaaacaggttatccattgacaacaagtcccttcatgatgattcatttaatattaagtgtagccgtttgcatattcaaaaggcaagtattatatcgttctgttgataaatttgatctaaaaaaggtgccgtgacgcagccattcagctgtatcacggcaccttattaccatctaaacggtgttagtcaccattcatgattgaatttttaacgatcacgtaatcaactttggtaatatcattcaacttgcggccaccggcatatgaaatcgacgactgcaggtcctgttgcatttcgttcaaagtatctgagatgtgaccacggtaaggaaccaacatttgtcggccttcaacgttacggtaggcacctttttgacgctcagatgctgaaccccagtattgcttgtatttcttgccatcaatactgatcaggttaccaggcgtttcttcatgaccggcaaacaatgaaccgatcatcaccattgaagcaccaaaccgaacagacttggcgatatcgccattgtaacgaataccaccgtcggcgatcattggttttcgagctgctttggagcacaaccgcagtgcagctaactgccagcccccggtaccaaacccggtcttgagcttggtgatacatgctttaccaggtcccacaccaattttggtagcgtcagcgccggcattttcaatttcgcggacagcttcaggtgttcccaggtttccggcaatcaagaaactatctggtaattgttccttgatgtagtgaatcatctggataacgtagtctgaatgaccgtgagcaacgtcaatcgtgatatattcaggcttctcgttgtcggcaaccaacttgtcgatgaattcatattcttctggcttgattccaacactgatagaagcataaagatcctttgaatgcatcattttgatgaaaccttcacgcttttcaggttgaaatctatgcatgatgtagaagtaaccgttttgtgccagccaaacggccaggtcatcatcgataacggtttccatattggcgggaacaacggggatcttaaatgtcttaggtccgaattttactgaagtgtcagcttcactccgactcttaatgatgttcttgttagggatgagttgaatatcttcgtaatcaaatacttccatgatttacctccgaggttttaggacagctccgtcaggtagcaattgttgctacagtttataagcgcctgactcttcttgcgactttaggacagctgcgcaaagcagaagtctgcgcctaagcacctctaacaaaattctaaaagcgggaattctgttagaggagacttaggcactgacttctagccgcttggacccgctcactgttttttaccaaactttttccacgacgttcgtctgttctctgtcaggaccgactgagaaggttgcgtaagggactccgactgctttttgaacatggttcaaataattttgagcgttggttggtagttcatcaaatgtcttgcacttcgtgatgtcttcgtcccatcccggcaattcgtcgtaaacaggcttgcaggcatcgagttcttttaaggttgcgggataatggtcaatcttcttgccgtttaattcataagcaacgcagattttcaaagttttaataccggttaggatatccaaacagttcagtgccaaatgggtgtagccgctgacacgcgctgagtggcgtaaaaccacactgtcgaaccagccgattcggcgtgggcgcttggttacaacaccatattcatggccaacttcccggatatgatcaccaatctcatcgtggagttcggttgggaagggtccttcaccgacacgtgaagtataggccttgcagacaccgatcacgtggtcgatccgattagggccaaccccggttccaacggcggcaccaccagcacttgggttcgatgaagtgacaaacggataagttccgtggtcaacatcaagcatgaccccttgagcgccttcaaataaaacatttttgtgattgtccagcgcgttgttaataatataggaagcatcaacaacgtatgggcggatgcggtcggcgtattcgttatattcattgaagatcggttcaaattctaatggttcatggtcatagattttagtgagtaattcgttcttaacttgtagattgcttcgaagtttttcttcaaagatatccttatcaagcaaatcggcaattcggatgccaattctctcgtatttgtccatgtaagcagggccgatccctttgttggttgtcccaatcttagaatccttcttttgctcctggagaccatcgaagagaatgtggtatggcatgataacttgagcacggttggaaattctcaaattatcggtactgattccatcctttttcaaattgtccatttcgttgatcagggatttggggttaacgacaacaccgttaccaattacactgtacttttcctgatcaaaaatacctgatggaatcagttgtaaatgatagctgttgccgttaaatacaatggtgtggccggcattgtcgccgccttgatagcgggcaataatatcagcactttgaccgaagaaatcggtaatcttacctttcccttcgtcgccccattgacttccaacaatcacaatagatgacatatgaacacctctaaattttattgccaggaatctacccagcatttttaataataccaacttgtattccattaatcaaccaaaaggctaataatttttacaagtaaaacgtttaatattcgactttgaaaccgaatacgaacgaaaggtaattattattctcataatatagtcaaaaagtgaacaatatggtattattatcctgtcattatttagtagaaaggactcgttatgatagatagatattctttacctgaaatgagcaacatctggtcactgcaaaaccaatacgcttcatggctcaaagttgaaattgccattgatgaagcctggtccaagctggggaagatccccgctgaggacgttgagaagattaagaagaacgccaagtttgacgttgatggcatcgccgaaatcgaagcggtgacccatcacgatatcgtggcatttacccgcgacgtctccaaatcacttggcccagagaaaaaatggatccactatggggttaccagtaccgatgtcgttgatactgcctggggtgtccgaatcaagcaggccaacgaaattattcgaaaagatattgatgcatttattgatgtgattgccaaacaagctaaaaaatacaaggatactgtcatgattggccggacccacggtgttcaagccgaaccaaccacctttgggttaaagctggcgcgttggtattctgaaatgaaccgtaacaagcgtcggtttgcgactgcttctaaggaactggaagccggccaaatttccggtgctgtgggaacctttgccaatgtgccgccgtttgttgaacagtacgtgtgtgactcacttggtttacgcgcccaggaaattaccagtcaaattctcccgcgtgatctgcacgccgattatatttcaaccttggcactgattgccaccagcttggaagaatttgccactgaaattcgtggattgcagcgttccgagattcacgaagttgaagaacatttcgatgccggccaaaagggctcttctgcgatgccgcataagaagaatccaattggatccgaaaacatttgcggattggcacgagttgttcgcggccacatggtgactgcttacgaagacgttgctttatggcatgaacgagatatctcacattcatcagctgaacggatcattattcctgacaccttgacactgttggattacatgctgcaccgcttcaccaggatcctggatcgactaaccgttttcccagaacggatgaagagcaacatgggcctgacctacggcttgatttacagccagcgggtgatgttgaagttaatcgatgccggaatgacccgtgaacaggcatacgacttggttcaaccattgactaaacaatcatgggataagggcattcagttccgtgacttggttgaaggcgataagaagatcactgatgctttgagtgaagatcaaatcaacgatgcttttgattaccattaccacattcgccatgttggtgaaatctttgcccgagttggcttggaataaccaacggacggtgattttaaattgaattaacctgaaatcgattagtgctaaatgacaagggcttggacaagacgatctgttttgtccaagccctcgtttagttttttcacttttacctagcggaattgtgaaaaaataagcgcttattttttcacactgatatttatggcagaaataccaatcgattatcgccataatcattccatttttcagcaatctgactgagtgggaaagcggtcaacggcaccgcgattttgccatcagtaatcatcttcaataaggccggcatatcgtccgccaagttggctgcggtgaacgagccgaagccactgccgattaaatggaagtcaatacttcgaaataagctgcctttcagcggggagctctggccggccatggagccgatttgaacccaggttaaagtgtgctgcggatcttggcgctgggcaatcatatcggtaatcatagtggccgcaatgtcgccccataaatagtccaaaaccacgtcgacgtcgccaatcttggccaagtcagcttttagttgatcatcgttatcagttaatttgatggttgaggtgacaccaaattggctcaattttgctagtttttctggattgcggccgacaccgattacttcggtcgcaccaaaactaatgctgatggggatagcaagttggcctgaagcgccggttgcgcccagcactaagactcgcttgccgcggatcttgtcttcgcccaagcgttccttgatcgccataaacgacgacattgccgggttagctgtagcggcgacaaccgccggatcagcggtattatcgattgggaacagtgctcgtcggttgacgactgctttttcggccaaagtcccataaacgttattgctgctgttgaagtagacgtgttcaccgtcggccgtttcaccaacggcatctacgccggggacgatcggtagggtgctggctgcggaatagtgagtgccgtttgccctggcgcgggcgagttggctgactgcggccgccaagacgtggacctcaacttcaccatcttcgactttgggatcagggaaatcgccgtactccgggccacgagtaaaatcattaataattgctgctttcatgtgaatgctccttaattgtcatttaaatggaatcattgaatgtgtgctttcaatatggcctttatgatgattgatgacggttggttttgcaacgatattgactttcgaattggcgggggtcgatttggcgcacgttccagctaatcaaaacgcctctcattccactctcaactatatttcaccatggcggccagtatccaaaaagcgcactgtcttgccgacaatctcataaattaataaccaactgcccttgatgaacagagcccgttgaggctttctgctcttaatgacgtgatcatcatacttttcggcaactggctgaccacttaaaatctgctcctctactgttttgaaatcagcctcagtgtatcggttggcgcgaatcatattttgataatgtttcttgaatctggactggtacttgggttgatatttgcgcattaattgactccctctcgaatgatgatagcttttattatagcttttttgactggatctggggacagaaaaaaggcccggcgggggagccggacctttcagttcaatattctgaggggaatatgaatatgataatctggacaacaaatcaatggggggattgatttgctgctcaatgttattggggggtgagtagaaataaatctcgtttatctcttgctcatggttataatagacatgataaatataaaaaaagttggacgaaagtgtgaactttttgtgaattttagcaaacttattttggcggataaaaaaggctgcggcgaaagtttgtgaccttcgcgacagtccattttatacctaatctttttttgagggggagataaggtttaaatcaaattgattttatcatttctgacaaatatgaggtgaagagaagccttaacttctattcgaaataagcatacaggaaaagttaggctaaagtatgaattaattgtgaagattttgtgaactttttcaatcggttggcttttgggtacaaaaaaagataagacacggggatgccttacctcaagttacctatattctaggggaagaatatgaatacaaaagtaataaattaaagggggatttaatttattgccacataaaatgacgtatcactttatgtttatatctacactatatagaatgaatatgaccaaagtttgaaaaaagtgtgaagattttgtgaacttttgcgaatttcaccacaatttgtccgataaatttccaaaagattaaaattgaccgtaagaaaccgcgagatgaggaggattttaaatgagctttatggctaaacggtttatcaagaaatttagggctgaaaactacaagaaaagcgtcgcccacagcttcttgaagcctaatcagaagatcaatatttttcgtcaaagtgctgatcagtacaaaattcgtccggtcaaaaatggccagttggtcacaattcaaccaattcaaaaccccaccagccagattctctatttccatggtggggcatttacagtgccaatgaatgaagaccagctggaaatgattaccaagattgccacagaatcaaatagtctgatccaagtggctgattttccactgttgcctaaacacagtgcagacgaaatcctacaatttgcccaggcggcatttgacttggtgattgaatcggaactgccgacattcattgttgccgattcggctggagcgaagatcgctttgcagctgctggtggataatccaggaaaagcagctggcagcagtttcatctcgccgtggttggacaccaagttgaccagcccagcgattgccgagcgggctgatgaggacatcttattggatctaccaacattgcaggagattggccgttggtttgaccaaggggccacgcctgaaaaatgggtcgattatactgatgctgctcaattaaaaggagtcggcccagttcaaatcttctatggtgaaaatgaaatgctggtcccctgcgatcttcagttcattgaggcattacagaatgccgaaggtgccaatccagaagtcattgcctttaaggatgggtaccatgattacaccctttggttcaaattgtccgaaacaaaaaagacctttaaacgaattgctgaattcattaaagatcaacgtggtgcttaagcttggggaaggcatgggtgtcggaccatttcatcattgtgccttggaacagtaaggcaaagatggttccaaaaccaattgcataaagtttcccggtaaataaataggatgccgagatgatgacgaccggtggaatgtagctcaaccactgggataacacggcactgccgtgaatgtatttgaaacggatgatgtaggccaagtcatcgttggggtgcataatcaagttggcccgagcgtacatcgaaactgccatggccacgcagtacaggccgatgatatccaaaatgaggcggacgtagaagtccattgccgggactcctagtgaattaaagatgaatgtgaacagcgctaccaggtaactgaacggcacggtgtaaagcaggttggagaaaaaccggcggcggtcaaaggaccccagtagtaactgattgctcaaagtaacaatgatgccgtagataaacagcgtcgttcccagggggatgttgacccatttggaaaggttaacagcggatccggtccataccgcgcttcccaggtttgaggaaattgccagggcgtttcctgcagagttaataataattgacagccccaggtaataaaggcgctgcttgaagtctttcattttagccattatgtattcaaattctccttcaattgatcatgaattccattgtataatatttaatttggtttgaacatctttactgaaagccccctcggtcaaattgatactgttctttcacaaatcgtgttaatattcacggtagaggaggcggtcttgtggaacgagaatattcggaagtagaagctgagaagcatttcgaaaataatcgtctgtggtttcggcgattccaaacaacccgctcatttcgaaagttaaccaaacccgaaagagcagcagctggatacattactcaggcatttgttggcttagcatataaatatcaattacgaagtccgcgccaatattctgcaaagtcggtcaaagaagttgtcatggatttatttccggaaaaaattgcagcaaccaacgtctttttcacatccgttatcccagtgatgcaccgctactttgtgttcctgggcgtgcagcacaaaattagcaacgcaaaaacgctgatcaaagcgttggaaagcatcaaggtgcgtcagctgttggatggccatcgggatgccagtaactgggatgcccacaagaaactgggcatgcaggtgctgatgggctataagcaggatgtggatcccaagaaggtctcggcgtacgaagaagattataatatgggcgttccactgaggttctgtttcgacttcagcgtcaaccggccgccaaagaatattattttgctgacggagaagttaagaaagaaattcgaaaatgtgatgtatgagaacaacaaataagagcgcgacgagccccgggtgaccccggagcacaagtcaaaaggaccagtgatgaacggttttcgttcatcactggtccttttgacttgtgtagcaggggtcaggggcgtcggagcgtattttgaaagcagaagggagcagtagataaactaagtgctgttactctgtcgcatttaccatatagaaaaagtgctctaggaacgaattttgttcatcattggtccttttgacttgtgtagcaggggtcaggggcgtcgcccacaggactaggcaggctttcagccggccgtcggagcgtattttcaatgctggtaggcgcagatgataaacgagtggattcagttcgtgaatttcggcttaaccaaacaaactcagcttgccgataaacccacatcgttttatcctgaaattaatatcagttttaggagatgaacagaatcaaaaaaatattaatcataaccacatcactcgtcctactggtaggctcgtacttcttatggacaatggtcactttcgatgagcatgctgaaagctacatccaaagagatctcaacaagaatatccgcgaccatcaataccacaagctaaggaaaatgagtaactcggccgcctatgaatggctgagaaaagcaaatcatgtgaaattaacttttgctacggataatcaaggaagtggaaatttatattattatgctgcaaggatcaatcaccaatacaattttttcgtcaccttcaaagtgaaatcatttattccaagtcgattcacgttgactcggatcacctattatcctaactatcatccgcgctgattcaattcatcaaacaaaaaaagccctccgcagccaaccagccgcaaagcgcccacaaaaaatattcttcaaacaacaactaatttaaaacctgaacgtgatcaatgctccccaacttgaccaccgtgacgcctttagcaggacgttcgatgaaagcctgatcgtcattaactgcagcgacacttcctgtcagcgtgccgtcgccggtttgaatgcgcactaattttttattcttataagcattcatcaattcatttgaaatttcttttgtcgcaatagtcaacattgtcacctcttatgataaaattaattatagttcacaattctgctggatgtaaacaatttttctcacaagcataagcttaagaataatttattaacatttttttgcatttagcgctaaagtggatatataggtaagtgaaaggggtattgaaatgactgaacgccaaatgattcaagaaattttaaataccgttgatgttatttatagttttgtcaacaccgacgatgacaagaaggaatacgaaattgtgatcaaccgccaagacggagataatcgtccgcttgagaacgtcaacaaggaaatcaaacattacttcactgatgccaactttagttatgatgaagagctcaatgacaatggcgacgacattcacgtgcaggtaaaacgttaattggtctagttgagtattacttcacaaaaagtgattgaaccagcaatttgaattgtaatgcacgttatggtatagttcataatgtgcttttttaatataatcaaaaggctataaattgatttgaaaattcgagttaccgaaaaaattttaatggaatatgtaatcgctttctagtgtttggagggaatctaatgttaacagacagaccaaaatatgttttatcaattgatcaaggtacgacttcgactcgagcaatgattttcgatcacagcggtcggaaagttattgaagcttcaaagcccgttaagcaggcaatcccacataatggctgggttgaaacagaccccaatgagatttggacatccgttttgaatgtgatttcttcggcgttcattgatgccggcattcatccagaagatattgagggaatcggcatcgttaaccaacgtgaaaccacccttatttgggacaaggagaccggtgaaccaatttataatgcaattggctggcagtctaagcaaaccgccgctttggcccgaaaattaaagaatgacggctattctggtatgattcacaagaagaccggcttgattattgactcatacttctcagcaaccaaggttcgctggattttggatcacattgatggtgctcaagagcgtgccgaaaaaggtgagttgatgtttggaacggttgatacgtggctggtttggaaactttccggtggcgagtatcacgttacagactactcaaacgccagtcgtaccatgctgtttaacatccacacccttcaatgggatgatgatattttaaaattgctcaacattccaaaggcgatgctgccggaagtaaagacttccagtgaactatatgggacgacgaagaattatcagttctatggcattgaagtgccaattgccgggatcgccggtgaccagtcggccgctttgattgggcagctggcgtttgaaccgggcatgattaaaaatacttatggtgatggtgccttcattatgatgaataccggctccaaaccagagatttcagatgataacctgctgacgacgattgcctataatttcaatggcaaagtcacttacgcccttgaagggtcaatctttgctgccggaacagctttgtcctggctggcagatagcctgcagttaattgacaacgttcccgaatcccgtcaggcggccatgaattccgaagacgatgatgaagtctatgttgtcccggcattcaacgggttaggagccccctactgggaacaagatgttcgtggggcggtctttggcttgactcgcggaacgaccaaggacgactttgtgaaggcaaccttgcagtcgatcgcatacggtaccaaggacatcattcagaccatggaaaaagataccagcatgcacatccctgaactgatggctgacggtggcgcttcacggaacagttacctgatgcagttccaagctgatattttaaatatcccaatccagcgggccgctgacgaaaacaccactgcatttggtgccgccatcttggctggactggcagtcggtttctggaaggatattgatgaaatcaagagcctccaagaacctggccgaactttcacgccgaacatggaagattcacgccgacaaaagctgtatcgcggctggcaggctgctgtgcaggctactcgggggtatcgagttaaaatttagacttacagtttaatagcgtacaaaaatagaccactcagccaaaaaatcactttttgtctgagcggtctatttatattattcatttttatcctttggttctttccaataattagcgttactgagcagttccttggaccgttcatccgcgggaacaaagccaatgttgaacaggtgcttgaagtacatcatgttatagatcagcatccaaacgatgccgagaccatatgagccaagggtgtaggcaacttggaacggttggcccattccaagtgacagcgccattccggcaataatttccactccagccatacacaacaggttataccagtctgatcggaaaattggcacccagaggttgaatagaagggcggtgaatgacggaccaactttggcgatccgaatctgaccgttttctttgttcacgacagtagcaaagttcggtggaatcgggagtccagttggattgttaggatcattttggttattgtcatcattattgccattaccaaatgggttttgcatggggagcctcctttcgaactaatggttacttcttcttgaatttaacaacacattcacaacgggaggtttgcggcatcaaatccactgattgaatatattcaacgttatacttctcagttaattttactaaatcctgcgccaaagtcgatgggttacaggaaatatagacgaatttcttcggcacgatatctaaaatcgtgtcgatcagcgaatccgctaaaccagtccgtgggggatcgacgattaatgcggttggtgtccagccgtcgtcaacccactcgggaagcagttcctcagcttcaccgacttcatataaacagttaaagatgccgttacgcactgaattggcgttggcgtcttgaaccgcttcggcaatcgtatccatcccgaggacttcgcggacctgctttgccaccgaaaggccgatggtgccgacacctgagtaggcatcaaccaatttttcgttgcccttgagatccagtgctttgaaggcctcatcataaagaaccgaggtcatttcaggattggcctggagaaatgcccgggcagacaaatcaaacttcaggccgttaagcacttctgtgatggtttcccggccagccaggtgaatcatttcatcgccccaaatcagtgaggttctgccaggattaacattttgcatgactgaaacgacttccggtaattccgccttgatgcgttccaatagctggtgcttcttgagcagtttcttgctttgagtgataaaggtgacctggacttgatcggttgcgatggcggctcggacaacgaccgttttgatgatcccggcgtttttctcctcatcatatgcggggatgcccagttcatcaatcatcgtcacaattgcccgcatgactttcatcgtcaatgggtactgtaatgctgaggtcttgaggtcaacaacgtcatggctgcgggctttgtacaagccggcaatcgtgttgccgttctcgtcgtggcggatttggaatgtcgccttgttccggtaatgggtcggatcatccataccgatggttggcagcagcttaaagcggcgataaccggtgggctggtatttttccagcgactggcggacaacgtctcgtttgaactccaattgctttgggtaggccaaattttctaactcaaaaccgccaacgtcatttgcgtagtcgtccactggttgaatccggtccttactcttggtcaaaatttcgacgagcttggcgcggataaagttatttaaatcattggtcacttcaacgatgactttttcggttgggagcgcaccgggaacgaaaaccagtttgcgttcgtagtaaccgatgccttcgccgttgattcccattcgtttaatttcaattgttaattgttcaccttcgttaacgtgaaccgtattattatcgttatacattgaaccgtccttaatattcttagttactagtatgatagcacatcacgagggctattcgcatgtgaagcaggcggacgcgaggtgtttcgtcaaagaatttaaggcaatcaatcgattatccttaattgtggacaaaagattgattgccttaaatggctggcggccacagttaccgccgattgggggtaacaaaagtggcgcaccaaatgaattgatctttttctaaaataaattctgaattgaatcaatcgacttaccaggttgcagtatcaggatcggttgccaaacctgcttgaccatggaagccgtcaatggtcttcatatcggtatttgacaagttaaagtcgaagatatcggcattttctttaatgtacttctcgtggattgattttggcagcggcaggaatccatgctgcagtgaccagcggagaaccacctgagccggcgtcttgtcatactttcgaccaattgtggccaattctggaatcttgaaaatttcaccggttccaagaggactgtaagcttcggttaaaatatcgtggtcatcattatattccacgaccgccggctgcatgtccgaagggttgatgaacatttggttcaccattggcttgactttagccgtttccaataacgcatccagatgcttgggccggaagttggaaacgccgattgccttggcagtcccggctgcataaaattcttccatggcccgccaggattcggcgttggcttcctgccagttgtctcgaaaggcaaccgggtttggccaatgaattaagtagagattgacatagtccaatcccaatttctccaaggatcggccaaaggcttccttggtcttctcataaccgtgatcagcattccagagcttggtcgtcacaaataaatcttcccggggaacgccgctatctttgatggcttgaccgacactttcctcgttgccgtaagctgcagctgtgtcaatgtgacgatagccggcgttaagggctgctaaaacggcatggtaagcttcatcgccattggcggattgccaagtaccaaagccgacttggggaatcttgactccgttatataaggtgtacgtatctgttaatgacatattctggcctcctattgtgtctctaacactattttatagaaattaaatatgaagtacaaagaatttatccattgaggagtgctcaccgttattcaggggatgccccaaatcggtaaagccgtattcagtgtacaggtgaattgcttctttcaaagcgtggtgggtttccaggtagaccgtctgatagccggcccccttggcaaacccgaccgctgtgtccaacaatctgtagctgagatggtggccgcgggccgagtcagttaaatacagtttctgaagttccgccacatgattggcatgatcgaactcagcgatgccgttgccacccaggacgttgccggcgtcatcgacagcaacgaagtattcccggtcatccttttggtcatagaagctgctcaaatggtcaagttctttgtcgaaatatgcggtccccggaatgtccagtccgtatgattttaaaattgtccgaataatttttgccagctcgaagtcatcttgttgtttaatcggccgtatttttaccattctatcagctcctgtccttaacgtttgattagcatattaccacttttggaattgcagagtaaagcccatgtgaacgctttatcgtgatatactggaactaatttggaacaagttcgggagggatcactatggatcaaagagttgcgattgtgacgggcgcttcatcaggaatcggcatgcagattgccaagaacctctatcgaaacggtatggaagtctatgcactggctcgcagagtgtatgcaatgaacgagctggatgatttgggtatccacaccatgcatttggatgttaccgaccacgatgaaatcgatcgggtcgtcagtgagattgtggccaaaaccggccggattgatgtcttagtcaataacgccggcatcgggtcgtttggctcggttgaagaagtcaccttgacggaaggcgagtacgaattcaaagtcaacgtctttggtttagtcaaaatgattcaagcggttctgccgattatgcgaaagcagcacagcggccggattatcaacatgtcctcaatggccggcaagattggcaacatgctattaggcagctggtacatcggctccaaatttgcggttgaggggatcagtgattcactgcgacaggaattgaaaccatttggcattgacgtagcaatcatcgagcctggtgcgattcagtccgagtggaaggatggtgccatggatcggatgatggatgcgtccggcagcggcccttatgccaaattggcccggcgatcggcagctttctttgcgatttcctacaagtttgccgctgcaccaagagtggtagccagagctgtcgaccgggcagtcttttccagacgaccgaagaccaggtatgcgattggaacgggcgctaaaccggcaatgttaatgaagcgcttcatgccggacaagtgcctggacgccttctttgaggccttgaataagtacgctcagcaagttgtcaaccgagaaacgggtcaaaacagatagcaattgaccactgaaattaaataaagtaccattaacttagaaacactgggggaactgctatgtagcagctgagaccgacctgaaccaggccgaaaccctttgaacctgtcagctaggactggggtagggaagcagagtgcgatcaggggcggttagtgaccggagtctaagggactttggacggaaatcgagttagattttcggccgaagttccttagatgcaggccactgccccttggagcacgtttccgctagataacagcagaaaccaccaaccaaaaccaatcacccaggagctgcagacaccaagtgtctcagctcctatttttgtcaacaagcaaaacaacaaaggagaacaatcaaatgaaaatcgatttattaggcacattacgaaagaagaatcccatcgcttttaacatctccaactttgtgaccgtccaagatgttgccaatggcattaatgcgttgggtgcatcaccaattatgtctgaagaaaagaatgaagctgagccaatggtccaaatggctgattctgtgacggtcaacctgggtgcgtttaccgagggtcagttggaacagatcagtgcggtaacgactttcgctaatcagtacaagaaacccatcatcatcgacccagtggccgtgggtgccgttgactaccgcaaggaacgctgcaatgaattattggatcagattgatgtcgcggtcattcgtggtaacgcgggtgagattgctgcattggcagacgttgagtggaatgccaaggggattgatgccggtgaaggcagcggtgatctggaagaaatcgctaagaaattagccaagaagcgcaattgtgtcgtggttgaaagcggcaagaccgatatcattaccgatggcgaggcagtggtccgaatctacaacgaaacggatttgttcaaactccatgttggttccggggatatgctgtccagtaccatcggctgtttctgtggcgttgagcacgactatttcgaagcagctcagactgccacggcggtctttgatgtggccggagaagtcgttgccaaatcaatgcccaaaccactggccggatcatttggtgttcagttgatcgatgagcttcatttgattgataccaagaccgttgagaagtatgcgaattttgaatgatacagagtgcgacgaggcccggtttgaccccggagtgtaaggtggaaatttaaaggatgaacgggctttgttcatcgtttgaatttttgccttacacagtaggggtcagggccgtcggagcacgtttccacaaagtataatgcatgtgaaaaaatccaagtaatcacaagctcaacaaagaaaggtaggactcaaaataatggttaacgaaacagttcaaactttaacaatcgctggaactgacagtggtggtggtgccggtgtcatggccgacattaaaaccatgcagatgcgccacgttttctcggcggcagtgattgtggccgttacggcgcaaaacacgattggcgtccaggactttatgccgattcccaagaaattgattgatgaacagtttgcctcagtcgccgatgatttgaaaattcgcgcttgtaagacgggaatgttggcggatgtcgccacggttgaagcagtggttgagaatttgaaaaaatatgatttggggactctcacggttgatccggtgatggttgccaaaggtggtgcccgcttgctttcagaagatgcgattaagacggttcgtgagcagttgttgccgctggccgatattttgacacccaatttgcccgaagcggaagaattaaccggcatgaagattgaagataaggatcagatgatcgatgccgccaagaagctgcaggatctgggggttaaaaacgttttgatcaagggcggccaccaaactgaatcaaaagagtcctcagacttcattctccttgagagcggcaaatcattctgggtcagctcaccgcggatcgacacggttcgaactcacggaaccggcgatacgctttcttcctgcattactgcagagattgccaaaggcgccgatgttgaaacggccatccggattggtaagaagtacgttcaagcaaccattgccaatgggattcaagtcggtcatgggcatgggccactaaaccactgggccacatttgaaggggacggtgactaagatgggcatgcaatttgaaccggggatgctgcgagcttactttattgccggcacccaagatgtgaaggataaatctaagacgctgcaagaaattgccaaacaagccatggaggccggcatcaccgcctttcaatatcgtgagaaggggcccggctccttatctggtgccaagcgggacgaaatggcagctgacttgcgggaaatgtgcagtgattatgagatcccatttatcgtcgatgatgacgttgacttggcaatcaagacccatgcggacggcattcatgtcggccaaaaggatgagcgggtcactaaggtcatcgaagcagttggtcagtcgatgtttgtcggcttgtcctgtgatactcaagagcaggttaacatcgccaatcacattgacggtatcagctatcttggcagcggcccagtctttccaaccgggtctaaagccgacgctgatccggtgattggcgtcgatggattggcaaaattggttcaagccagccagctgccggtggtcgcaattggcggcattactgagcaaaacatcgtcgagcttccccaaaccggagtagccggcgtttcggtgatttccatgattgcccaaagtgatgatatctttagaacagttaaagtaatgaacgaaacctttgaaaagtaagggcttcgcaatcagttgaaatagacaattaagcgggtagcgcactcctgggattttccaggattgtgctatccgcttacgtgctgctattgagtgatgctggacaattattccatgttaaagccctcaacggttgcgtggggcaggtggttaacttcgccggtcatggtcttcatgacgtcggtattgttgcgggtgtaatacgagacttgataagggccgggaccacttaccttacccttgtaggtttccagaaccggttgaacaaaaccggccacatctttgctggtgacccgtgccaaattaacgtcgctggtgttgggcgttccaaacgccttccagtcagtcgtcgacgtcgggccaaagacaaagtagctgccggaccgatcataagaagtctggtcagaatgaattttgacactgtgcttaccaaaataaatgttagattggttgccataccaggcaccgcgaaatggttgggccacttcgcttggatttgaagccgaggcatcttctcgatggtgggagacgacacctgaaagcccgatggtgcctacaaaaatcagcgttaagataatcgtggttgtcgattttttcatgataaacgctccccaaatatgcttatctattaccatctaaagggtactccggcaatgtaaattaagtgtaaacattgggtatcaaatatgtacaaaattgatattactcgaagattacctccaagttacaattattaggtttggataaaatccatgcataaaacttgtgattttggcggaaagccgttttaatagaacatgaacacgtttttattttcaaaatatttaattggggtgagattgaatgaaaggacattttaagttagcccttgcggctgcgttcctgttcgtgtccgccggcatttttggtgtcgctgcaccaactgccagcgccgacgtgatcgccaatcctgggactgcgggttcgattccgcaggtcaatgcagggaacgtattgaaagactacgatgagaattcactcaacgtggttaacaactcaacaccgcagggtaacacaagcaagaagtataccaagtattcattggatccaactggttacaactacggcaactcgtacaatacaattgccggcagttcacaaagcaatacatttaagacgaagttcttcttaccagatggcttcaatgtttccaactatcaacatggtaacttccaaagtgtcacacttgatggcgatggcaacatttacttcatcgaatcaaatggtaccaacaccaaccagggggcaattgttaagttcaacatggctaagcttcaacagttaggcgttggatcggatgttttactgttgtggcgggcatttgattacttcaacccgtacacgacagacggtcaagctcataatgatgagtacaaccaagtcaacgcacaattacaaggtgcatttgacaaggttcagactttgacgacgactttgaaccagaataagtcctggcagaacaaccagaacaactggaagaagaacgctcaaaagtggtattactactggaagaacaagaaagccaagtataccaagatttccaagtcatataagtattcttacaatacccgggccaaggccaagaagactgtgaagacagctacttcaaagatggccacttggatgaaatcttatcagtcacacaaggctaagattgccaagtacaataccaagatcaatagtattcaatctcaaatcgatacttatcaaggacaaattgacgacgccaaggcgcagaaccctgacatgttcaaatacgttgatattgcccaaacagcgcagttgtctccagaagttgatattggccatggtcaaacattgtcatacaacccacaaaacaagcacatttatttagctgaagataacacgttgactgatttggcatcacgggatgataacaacacggttcttgaaatggatccggataccttgaaaccaatccgtgagtacaactttaagatgtatcatggtgactccgctaacctgcagctccacacattggcatttgacagtaaaggaaatgcttattggggccgtaagttgaacggtggttacatgttcttctacggacgtcttgatgaaaatggtgtcagcttccaggcttcatcatcaatggtcggcaagcgtggcggttccacgaaccaaggagttgccgttaaccctgccaataaccgcttgtacttcgtttctgatgatatcttgacttcagtgccaacatcaggcgttcaaagcggaaacttctcggcagacgatatccactatcaagccttcgattccggtcgtgagtttgaaagcctagcgtttgaccaagacggttacggatacttgctggcattgtggccacctgagttgatgcaatcgactaatccattgaattaatttaaatagatgagagcaggaatttcctgtttgatgcttttgagtagcagtcgcgagtttgcggctgctattttttgttgggacaaaatcgtcatctcaaaggttacattaccactcagtaggtctaatttgtcaaaacaattaaataggccgccaatcaaaaaaagtcacgagccgaaaagttcgtgactttttattactctgcgtatgcctgagccaaaccggcaatgtctgccgaagtgatgtcgttgtcggcaaccgtgggatacatgatgctgtccatatcctcagaatgctgcaatcccaatgcatgcccgagttcgtgctcgccgacgtggactctttctgtcgtcgtgtatgtgaatagactgcagttattggcgtaaatcgttgaggtggacggcgccaataagaacaaattgttcttctgtttctgataatacttgacggtcgtcatcccagcgtagtccaaattatccgtattatcaacggctagcatgatgtcaggatcctggcttgctgcaattaaatgaacaatgttggtatcgttccacttgttaatagcctgttgccaaacgttttgataatacgctgacccagtatcaatcttatatgtaatggtcgtgtccgcccaccgatatttggcaggtgtggtgttggaatcgttggtagccatgacggaaccttgggccgatgattctgtctgctgggttgtcgttttaacacgtttgacgtattcaatggccgtgttgatctgcggggtgtcatcggtggtttcggccacaactggatgggaaagaccaaaggttaaagtgacggtgaacatagtgagcagtaggatgatcgttcttttcatgagcatttctccggattaaaatttgtaacctgatatatcaaaacagttactttaatatagcattatagcatcatattattaaaacacaatactgctataacgataaagtgataatcaaacaggtcatttatcaatcaccttctcaatcaatgatgcctcaaagtgccagcatacaccacgactaatgcggcatccaaaaaagggctgcggcacaattttcattctgtcgcagcctgatgactcgctattcaatttggtaatcagaagaaataccagtcagccagataaaggcccaagacactggtcaacgcgaacacaaccaccagcgtccagacgatattacttgccaggttatgatgactcttgcgggcaaagccgatttccaataatgcgatgacggccaggcccaagatgaccttcagactgcccagcaccggatctcgtggtacccgataaagggccagcatgaagccggaaaccaggatcggaatgtacagcacgcgggtaatcatcatgaaaatcattgaaagcttatctttcagaacaaatgccaaaattgcggtaatcattaataggatccatgaaatgagatggatattcatataaagcaaaatgtaacctcctcagttgtgtttctattttagtatagtattttgccgacaaaaagaaaaagtaatttcttgattaggttctgcaaataggctattttttaggtagttgaaacaatcgaaacgagggggttgtcatcatggacgggctgaattatacccaggaatttgtgctgtgcgtgctgaatcaaaagccaaaattgagtgcattcaaggaccgtaaagtcgctgcgtgtttgttattatcagaaattgtcgaactgttgcgtgctggggcgatggaattgacgcctgtcaatcgaatggtggttgcccaagtgactaaggcaccggcggattatttagtgccgctcactgaagacatcaagaaacggcagccggagtcagtcaacaattatgttcgcgacgcggttctgtcggtccggaaacgccgggtcaccaagattgccgaagcgatttgtgactcattggttaaagcaggctatctggaagttgaccacaagacctattacgataatcaaacactgacggatcgcatcttaacgcaactgtatcaagatgcgatcgctaaaaaagaaccgtcggagaagaattccatgttggcaattttgctcgtcaattcgggtttggtgcaccaaatttttcccaagcaggaagccgaaaccatcgaactgcggcttaaagaagtcatgaagtccgatcagtatcatttgatttcagatgtgaccaaacggatcaataaagatctggctgggattattgacgcggtctcatttgccaggtgagatcaatcaaaaacactgcatcatataacctaaaaagtcgagataaagttttctttatcccggctttttcgtgtttattatttatgtgaatattgcgcctgcagtgcattaagcgctgtgacgtagttcatcgttggcaagttgccggccttgaaatctgctagtttgtcgtcatcaattgccatcactttgaaagcatccgcctcagaaaccccggcactttcccttacttcattgattcgcttcagtaactcagccggtgtgaggctcaacaggtaaagacgtttgatctgcgtcaaagtctgctggtaagcactttccggtgcggttccagcgtagtaggccttgatttcgtccgggtcgaattcgacgatattgaaaagataatcgtctgccaagtgtagttttgcttgatatgatttgatttcagccaacatttcgttaattgtcatgattcaactccattgcgttattttcaatctttcctatctatgatatgacaaatcaacgcagaattctaatcgaattaatatttggcagccaagttagcgtattcctgtggggttaaggccatgatcgaaccgtgacgcttcttgagttggccgaagtcatagtctggcgcgacctcccagtcggtgggattgctgctggtcagatcagacgtcaaaatcggcaggtagccgcggccattgtgaaattggtcgacgtagatgcaccatttctgctgatcagccagccaaacaatttccgggccttctaccgtatcgccttgaatgcccaagtccaaatcttggagagcagtgacatgctgccaattgccattgagtgaaggtgactgttcaattggaattgttccgtcacgggatgcacggacgaattggccgccagctttgaccatggtcatgtcgatcaaatcattttttggattcttggcaacggcgtaagttgcggttgattcgaagtgctggaagtctttagtgtatgcccgccagatttccattttgtgggtttgctggttgggggatgaccaaaagacaaagtaggcttcatgagccggatcataaattgcttccggtgcccaaacacagccggtattctcgccgaccatttgaatggcgcggggagctgaccagtttactaaatcagccgaatcccagaaaatcaaatccttggacccggtggtagtggctttggcctgaccccagccgccgcgatgataaatggacaggtcggtggccatgatggtaaagtggccgtcttgccggcgcatgatgaagggatccctgacgccgcgctcaccaatcgtcgatgttagaaccggctggccgtgattgatgtcagtccagtgaagaccgtctggacttaaggcaaagtaaagttgttcagcggatgggctgtcttctgttccagtaaaaaatacgaagaggtagccgccgttggtggattgattgttcaatgtcaaatgctcctttttagcttgttttagtaaaaactcgttgtgaataatatagcgcttacaggtggggatgtaaatgctgttttgttgtgtgaggttgatgcctatggtaaaattattgttaccatagagtaacggatggaattttgaaaatgcaatttaacagagaatatgcaaaattggcaatcaatcagattgaaagtgcatatcgtaaaggtgatattttaaggcgccctggacgacatggatacggacctcattctgagaagacagaagcttacttgcgagaccacggaattacctttcaaaaggcactaaaagatgctgttcaggctctgagtacctcgaagttaacaagatttcgtggcccatctcccagttattttccgggacaatcaggtggggttgtgtatgactttttggggccgctttatgattctaatatgtacatcaagttttcactcgtcgtccgcaatgatcaacaattcataattttcgaatcatttcatgagtctgatagaaacgactttggaaattttattgagttgaatgtatgacaggggaggcaactaatatgaatcctgtaaaagtaaattcagtcattactgaatatgatccgatttctgaccaaaagatcaaatatcagaaaattcaaatttctgaatccgtgactgtgagaaatatatctttcaatagtccacactactaccttgtcgaagaagggatggacattcatgatcctcagaactttgaagtcccatttgacaatcctgatgtgaatttgcgggctgattatcaggtctatcgtgaaaaagctggtttcctgcaaccaaaagagattaaaaaaatcagagaacatctgagattgagtttacgtgaagtgtcagccattttaggaataagttatagtacattatctgaaattgagaatggattagtattacattctcaaattcaagatacactgttacgaatgcttgaacacacctacactttgtcgacgattgtcgaacagcataaaggcttgattattaacagtcatgggctgaaagcgtaccagcgaattattgacaagttaaatgctgagaaaaattgggattcatgaagattcgatgtggctttatttttgcttaactgatgtaaatcatttcccggatatgatacgatgaaagcgtagtacattcgaataaatataaggtggtaaataaattggcagaaaatgataattggcagttaatgggtgttcgtttggatggtttgagctttgacaggagtaattttaatccgcaaaagggcccgcagatcaatgctgaaacccgtttggcattgcctaacgacccggcagacaaatcaacaatgagtgtcgttcaagttgtctcgactttcaaattgtatgacgatgaactggcaaaaagctatttcacggcaaccattgccggtgtgtaccaggtgccgggcagcttgacggataacgatgctattcaaaagacaattgacgatgacaaaaacttgcgagacagcttcgctcaaccggttgtcgattacttaatcgcaaccctggcagacttgagcttaaaggcatttggcacgccaaccattttaaagcgcgagcaattgattgatactttgtttggtgcaaagcagcagtagtaggcgactatctcaatattaaaagacaaatcaacagtcggagcaaaggtgaatactttgcgccgattttttgcactcataattaccactatgaggaatcacactgtattcaaagctagtaaattgcgttagaatgtacaaatatgttaaatgaacgtcacgaattggaggaccacatgagctacttagagctgcataacattaaaaaatcctattacctcgccaaccaggaattcccggttctgactgggatcgacctttcctttaaccaaggggaattcgtctcgatcgtcggagaatccggtggtgggaaaacgacgttgatgaacatcatcggcggcttggacagtaattatgccggcgacgtcgttttgaacggcaaatcgctgcgccacgatactgccaagcaattggatgcctaccggagacaaacgattggctttatttttcaaaactttgatctgatcagtcacttgactgtttttaacaacgtcatggtgtcactgcagatgaccaaactcagccataagcagcaggaggcccgcgcccgtcagctgttggaacaagttggcttgaaagaccacatgaaaaaatatcccaatcagctttccggcggccaaaagcagcgggttgcgattgcccgcgcgttggcatcggatccggaaattatcatcgctgacgagccaaccggtgcgttggacagtcaaaacacccaagagattctggccttgctggaccaaattgccaaagacggcaagctggtgatcaccgtcacccactcggagacggttgccaaccacgggacgcggattgtccgcctagctgatgggaagatcagcgaagacaccaccttaaagccaggttatgagaagtctcaagccaatgagctggcaactcacaccttgagatttggggcaaccttgaagatggccttggaaaacatgcgctataacctcaagcgaaacctgctgattgtctttggcgccgccattggaatctttagtgtgattgtcatgctgggactgggaaatggcgtccagggatacatcaaccatgaaatatactcgcaggtgaaccccaacgccgttcaggtcactaaaaacgtgtcggctgatgccagtaccgatccaagcaagattaacgtgaccaccaaggacaagaatcgattcaaggacattaagaatgtgaagagcatcgacgatggttactttgtccagggtggcactcagctgcgccgtgggcataaaacggcttcaatctcatttatgcagacccataataaaacgatgctgactaagagtattgccaaggggcatgcgccaaagaacggcgagattatgctgaccaaggaatacgccgaaaagcttaataaaaagcatccgtattcgctgatcggtaagcgggtcacattttatcagaacacgcttaataagaagaagcgtccggttatgctgacgaaatcactgaaggtcagcggaattgccaaagcaaataccgggtcgacctcggtcacatacagcacgatgaagtcactttacagctcaaagggtatcaagattcagcctaattttgtgaccatcgaaatcgccggcaacgttaagaacgtcaaaccggtcgagaacaagatcaaggcctacaagaacgacaagaaaaaggccgcttatcaaatcaccggtgtcggcggcttcgttgatacgctgaacacctatatcaccctcgcagttaatgtcttggcaacgattgccggaatctcgctgttggtatccgccatcatgatcattgtggtgctctacatcagcgtctccgagcgaaccaaagaaattgggattctccgagctctgggatcctcaaagggaagtatccggaacctgttcttctcagaagccttcttcattggcttgttctcatcggctttggcgattgcgttggcggaactgctgcaggtagtggccaataacatcgctcagcggggaatcaattattcaatcatgcaaatcaccccgggaaatgtcatcttcggttttgtcgttgccattgtcatttccttgctggcagcactagccccagcggcctcggctgctcgattggatccaattgagagtttgagttacgaataatagtttgaatgacaatttttaagtcctcctgcgaacaaacgggagggcttttttcgtatatcatgaatgtgctgatcgaaccatcctcatgttataattatgttataacatcagttgggaggagatcgaatggctaaagttaaggttcgaaaaattggcaactcactcggggttcttctacctaaggaaagcggtgtccacgagggcgatgagttggagtatgctcaagagggggacaagatcattttagacacacaagaagcgcaaaacgcgagagttagagagattgttgaaaatagcttcaaagattttgaaacaggaaatgttttgactgaagatgatatggtccggatctttggcaagtacggttggcataaataatggatccatatgaattgtcgttctcaaacgattttcaaataagcctaaaacagacaattgccacttgggagagcattggaattgatgccagcaagattcagacctttgtatcagacattaataccgcggtggcttcactcaaggtatttccaaatcgttttgccaacgttgatgaaaaatatcgcattccagtaccgactaggcaaattattatcggcgaccattacgcgatcttgtaccgagtaaaggaagcgacacacacagttgagattgggccaatttataatttgaaacaaatgggtattactttttagattctcctgagagatcagcactttaagaggcgtggaaataactgattgtcagtcatttctgcgcctttttgagttccactgccttctagcctaaacgtgcagcaatcggctgatcccggtcatgtaaacgccttgtgctgcactctggtattgacaacccacgcatgtagtatacaatactacatgaatagtattgaaaactacgtaaatatcaaaggagattcaaaatgtccgaaaagattgccattctcgctgattccggttccgatgtgccggcagaattgctgaaacaatatgataatattgaagttgccccaatgctggtgaccatggccggcgaggaataccgcgacaatgtcgatattacccccgaagaattttatgcccgcctcggccaagccgatcagtttcccaagaccgctgcaccaactcaagggagtgtggaagcgcacgttgccagcttgaaggaacgcggtttcaatcgaattatcggcatcaccgtttcggcacatctctcaacgacatttggcattttcaccaatgtggctagggaaaacaccgatatcaagatggacgtgatcaataccagaaatattgggattggcagtggcttgttcgcggtctacgctgaagaaatgattgacagcggtcagacgtttgacgaaaccatcaagtttctcaagcagtcggttgaggacagccggacatttttctatattcccagcttgaaatatttgcgggcaggtgggcgtatcggtcgagttgccgggttgatcggttcggtgctcaacattaagccggtgatcgcgaccgactctgaagggatctatttcccggttgccaaagcccgttccgagcagaaagccatctcgaaaatggtccagttggtctctgatataattgccagccacaagagtgtccgggtcggcgtcgctaatggtgccgatgtacccttgcaggaaaaagtctatgaccgcttgcactcggccttcccacaacttagaatatatcgaggaagcgtttcgcctgcgttaggggttcacaccggtcctggattggttggggttggcgtgcaggtaggtgaaggcgaataacgaaggaggggttcgatgccaaaaacgaccaccgagcttcagattagactgccaatgtgggaagaattgccggcattttcgctgcacttggaccagctgctggatttaactaacgagtatctggaaccaatcatcggcgataaaattaccaagacgatgctccacaactatttcaaagctaaaattctcgtgccgccggtcaaaaagaagtatcagcgtacccagctggctggtgcaattgtggtggggctgctgaagaatattttcacgttaaatgaggtgaaggccggcttgatcacactcttgggaaatggcacgcccaagaccggctacaataattttgtagttatgtttaacgagcaggctgccaaggccggcaaggaattgtcggatcccaccagcttggaattggcttcagccggccagccaactttgatgcagtatgatgccgtccagtcgattttgttttggctgtcggcgaagaatcgattacatgaaatgatggatcagcaagaccgtgatggcgcttaggcgtttgtcacggttttttattatagcgacatctactcataatgagttagtcaataactttattacaaatgtgtggaaatcgagtttgccgtgaactaagatagtcgtgtatgaattgaattcgttttcaattattattgaatgtttttggaggggtaaatttgaatagtaatcataaaatgttattgagggaattctctattggggcagcagttctggcagcagttgcattaagtacacccaccttgacgaccaaggcaagtattccaaataatcaaaacatgtcaacgttaaactcaagtacctcagctcaatctggtcattacaccgaagataattccgaggacaattatcaatttgactggtctctcagtgatgatggaacattgacgttatctaatgcaagttttgtatttggcggtaacaattcgccgattaattcccacatctctaatcaattacctgccgatgtggtgagtgccgtcaagaagattgttctgactggtagccccgttgcaagtgggaatatccaatacttgttttgtaactttgccaatgttgacaatattgatgttcacaatttgaatgtttctggtgtaaccagcatgcaggccttgttctgtgaaaatcaaaagctcgattcggtgaacatctcatcatgggataccagcaatgtttcaaacatggctacgatgttctgggaagaccctatcacgaccattactggtttgaatgatttgaaaactggtcaggttaccgatatgcatgaactttttgcgacaagtaactctgcagacaactcgaaggtgactcagctggcccaaagttttattaacactgcagatgtacacaatgtaaaaaactttgaaggattattcgataacagcaacatgaccaacctggacatcagttcgtggcacatggacgctgccactgacacctcaaacatgtttggagattaccaaattgccgttccaagcccattggcaagttacaccggctctaaaatgaccactttaactttgggacccgatgacaagtttgtaccggtttctgagccaactgctgttgtagcaccgacctttaacccctttggatccacacaaacatacgttccaattaacttgccttcaggaacaaccatcaacatgcctgtcgataaatcaggtaactggcaggccgtcggtagcggaacagtaacgaatccacaaggtgccacttggacaagtgctgattttgacaccaaatacgctccaaccgccacaccgcgccccgccaaggaaacctatgtctggaagcacacggcaccaaagctcaacatcaatttgaaatcgccagttactttgaaacagggcgccaaatttgatgctgacagctactttgtttccctgactgatgctggtgaaaatgccattagtgccccgattaccagtcttaaagacgctgaagcattggggatgaccatttctggcgctgacaaagtcaacactaaggttccgggaacttacaacgtcactttcaagttaggcagtcaatccgcaactttaaaggttacaattcccggttcttcaagcaacggtggcaattccagcaacagtagctcatcaactaccccaaccaacaccaccccaagcaccaacaactcatggaacccaacgacaccatcccaagccaccggcaacacgggcttaccgaactacgcggccgtaaaaggtgacgccgtttacgccaccaaagccatctacatgtacagctcaccgaccttcaccaagcacaaccgaattgccaaatacaccaagaaggcccgggccaaccggccgatgtttgttgtgaccggctatgacaagtccaacaacggtgctttgcgctacaaggttcgcgatgttaataagggatcgaagacttatggtaagaccggctacgttactgccaataacaactatgtcggcggcgcttattatcagactatgcccaagaacaagaagcttaccgtgattgctaagcacgggatcaattcctatcgctcagccagcttgaccggcaaatccaaacactacaagaagggtgctcgactgcacgttaagaagcttgtgaagcataatttgaccacccgttatcagttaaccaatggtcattatgtcacaggcaataaaaagtttgtcattcaaggaaattactaatatctgaacgcaaaaggacttgaagccaaattggcttcaagtcctttttgtatctgatttatttaattcgcagcaacaccaaaccatgcccggcaatcgtccagagcgccggcatgtgctgaacggccctgggaaattgatcccagtggcctgctggactcttcaatttgtcagttagtgcctgatcagctggtgttaaccgcaggtgccttttgtccacattgtcgattgtgtagagcatgtacaagtcaaattcgtttttggggatgttggtctcgccggtcatcggatcatactggtaggttcccggttccacttctacgtcaaattgcggggtggcgccctcatacaagcggggttcttcgggcgcgtggggcttcatggggtcctggtcgccgctaatcaggctgaaacaaattaacgccagtccaaaacagccaattgcgatgacaaataatagtccatatgtttgcatgcccattcccccaagtgttcattagtccttaattatagaacaattcgttggtaaatagctaactgactttgacaaactggtttggcaaggtcaagtccgccatttgaatgtgcataaaataataccgatccgagcccattcccctagggtaataaaaccgaggtgaatcatgcctaaacccaacagccagttgaattagagaccattatccatcgcttttgcctgtaggactgatataatataatcggcattaaagaaataacatattcgttgggctatggaggggattcatatgaataacttaaaaattatgggcgcacttgcaggagcatttgccattggtacaatgatccttacaactcaagccgacgcagctaagaaggttaaagtgacgtcaaacgtgcctattacggcaaccaaagtcaccaataggaacgttgcaattaccggcaagaacaagatctataacaaagccggcgtcttgaaacacgccaaggcggtaacatccaccaaacagattaagcaactcggcaattctcagcggtcaaaagacttcttcaatgtctaccgcatggcaacgaccaacaaaggccaagtttactacaaagtcgtctcctttgaaggcaaatggcggggctggatctacgggggaaagaccaaggccgactatcaaggtgggatccgcagcgttcagaccaccaaagacgtccagttaccagatgatgttaaaaacgctaaatttaccctggaaaatccaggcgtttcggggacaaacaactcctggacggcgattccgtggtctcagtacggtgctcgcttaaagacgacagactccagcccatacgctaatgatgaattgcgggtgacggccgccaaacagctcaccagacaatactacggcactttctactatgtggttgatgacactcatcctgagttcagtggttggctgaacagcagcagcctgaaagccgtcgcaaccccaccaaccaataccaccaccgtcaccaattatgtgcaatcgccgcctgaagtcgtgaccaacacggtgacaaatacggtcacgaaaaccgtcgaagtcccagccaaaaatccattgacaattaattacaatgtttatgagttgggaacctcccagaatcaagccgtttcaaatcaaattttgaagatgtatcaagaccagtacgccagccccttgagtgaattgaccaagaatcccgataccgcggcctctaagctcaaggatcttggtgacgggcagacgttgaaatctaatgacccaactccgatgaactatgcctcaattgcagttagttttgataaagacaagaatgtgatcacgatcactttgaattgggttcaaccaataatagttgccagtgatgctctgtttcatgctggggacgattatgatccagaaagttacctctggtctgtgactgatggaaccggtgtgagctatccgagaggggattggttggatcgagttcaaatatctactgacgtaaataataatcttcatggaacgttccacaccacatatactttcaaactgatggacggcatgaccgccacgacaacggcgactgtcactgttatgaagtgacctgtcatcttcctgaccaggggtattaaattcccggttgtattccaccctgaacccgttataatcaaaactgtaacacaatataatacgtggtctggggtgccccaacggctgagatgatacccatggaacctgatacagttaggactgtcgcaggaagaccgatccaaaatgtttttaataacgcaaatgaggatcatcaaacacgcaaagaccaggggcaatttagctgccgctggtctttttttgccggtccccgccacgacaggaggaaataccatgtcattatcccaagatatcttgtttgaagctcaaccctatttgattgccaacgagaaacacccatttgttcaaggaatcatcaaaggggagttgtcaccggaacagctccgttactacgacaagcaggacatcgcctttgagtataacgaagttgcggtcatcaatgcgctgataaacaacagtacgaccaccgaccaggcactgctgtttcacaaacggcaggacatgcagctgcatatgctggacgattggctcaaacgggaaccggagtcgatgccccacgactgggaatcactgaagcaaacgaccattcagccgattaaccaactctatcgccagcacatggcaagcaccattcagacccacagcgtcctacagattttgccgtcgtttgcggccggggagtggatgtacgttgaattggggaaatttgttgcgactcagaccagagttaaagaagaacccttccaaagttttctttcaatgagtggggatgattttctggggcctaaaggctatatccagcaattctttgatatcatcgatcacgaagccgagtcagcgaccccacgtgagcaggagcaagctaagcagacatttttgaagagctgcctgttggagtggtatttctgggatgcggcttataagctgattacttgggatgactggaagaaaaatgcattaggtggtaaaggcggagtgacgttgtaatgaagcagataaattgcttgacgatatgtgtgaatcgaatataattattgtaagacgcaggtattacacaatcaaaagaggtgatttcattggcagtggatatgaagaataagacaatttctacccgagtcaacgaaaaaatagcagaaaaggcaaaacaaaatttagccaatgtcggaattacagtctcggaatatcttcgattggcattgatctcagccgcagaagatggtgtgagcgatctattgaactccccagaagcaatgcaagcgaagtttgaagctgaacacggtcagaccctcaacattggaagtgttgaagattacaaacggtggtcggaaaaattgtgactcaacttcaaattaaggcaactggacaatatgtacgaagtttaaaacgattgaaaaagaagcattatcctgttgagttgattgaggactgtctccgtgcaattcttaataaagatcacgatactttgatcaaaattcacgatcatccattggttgggcaatggcgtgggtatcgtgagtttcatcctgcacgcattggaaaggcgagtagtcaacttgataagtgggtcgtggtttatcaaatcgatagcgatgaattagtgcttatcttgattgaaacgggcaatcataatgtgctgaaatgattcttcgcaaaacctttaaaacataaaaatgagctgtatctcctaatggtaattggaggtacagctcatttttagctggtcttggtgctattaagttagctcggaatgcataaggccgaaaaggtatttgactaatgctcaaagtctaaccaatttactacgcacgctatccgttcacatgcccagcgaaactcggcataaacgcactactgatcgtctcaacatcgacattctgtcctggttgcggtgcggcgacgaattggttattgccgatatagatggcaacatgatgcgtggcaccttcatcaccccagaataacaggtcgcccggttgtgcttcagagacagcttccttggtaacgtggctttcctgagtcaccgtgtagtggccgaggctgatgccggctgctttttggtagacatagtcggtcaaaccggagcagtccatgccttggagcgattcgccgccccagacataggggatgttttgggttgccagctgcttggccaggctaaccacggcgtcggctcttgaatcgttgctgttgaccgttgccttgggtgtgccggcatttggattgtaatagttggtgctggcttgttggttgtaagttgcattggtgttgttgtaagtatccgcgctggcggttgtcgcaacgccgcccatgatggcaccggctaccgcaaagctcagaatgaatttcgtgaatttcaatgaagacacctcgttattagatttggtagggtcatcataagcccgcaacttttcaggaaggttacaggaattttgtgatctattgacgaaagatgtcaggctgaaatagtgttaaagatttggtagcgaaaggttaaagaattttctgggagcgttgactttgttggttgagatccgctgggaatcattaaaataaccaggttgggttataaaatatactcaaatctttatactttttactaaaattggtgaataccaccccaaaagtattgattaccagtaagaaaacgcttacactataaaataaatttaactggttactatacttttaacaaagagggaaatgtcatggaaaaaagtaggttcaaagtactcgcagaaacgggcatcatgtcacggccggcaacccggttggtcatggctgcccaggaatatacatcagacgtcacgttaacgtacaacgaccgcacggtgaatctcaagtcaatcatgggtgtcatgtcactgggaattccccaggacagctacattgaaattgaaattaatggcgatgatgaaaaagaagcgatggcaggcatcgaggactacctccaaaaagaagggatcgtcgaaaaggtcacgatggacgcggacgcataacgtcgattagaatccagcacttccaatccagtggtcggacaatccagtttgtcgaccactttttatgtggcttcaaagactaaattccagtaatcaccgcactggattggtataataaatgcatactatattaaaagaaaagagtgattcatttgaggggaaagcaaattgtgatcacagcgttaagcagcctgctggtactgggtaccgggttggcaatcagcgccgatcaagccaaagctgccgagaagaaatcggttgtcaacgtgacctttaagcccagcgatgagaacgagctgaccgactacgtctacaacacggttgatccaaccagcagccagtatcaccaatatttgacaccgagtgccttcgcagacaaattcggccagtcagacagttacatacaagcatttcaagattatttagccaaatatcacgtccaggcccaggcgtttcctggcaacctgtcgatgaaattgaccgggacttcgaccaacctgcagaaggctttcaaggccaagtacgtcccagccaagaagaaggggtatcatccaaccacgtcgtacaaattaccgggacagttgtctgataaagtcgtggctgtgattggcctgtattcgacgaacccaaataagaagactaagaagacgaccaagaccgcaaccaaggccaagaagaccactaagaagtctgccacccacagtgacacgaccactttatcgacgaccgacgctaagccgaacatcaagtacaccggcaatgccttctcgaagaagtacggtgctgccaaatttgccaaggcttaccaagtcgatgatttgtacgatcaaggtcttgaagggtccggtcagcgcatcggaattatcaatgatagtgatgtgcgggatgctgacatgctgacctactggaagcaagccggcgttaacgacgacatcagccgggttcaccacatttacaccgtggcgacccaggctcaggcccaagctgatttgaataagtccatcagtgccgctcagatggaagccactttggatgctcaatctgcttcagccattgccccagaggcccagatcgacctttacacggctgttcagtacggcaccaagacgactttgacatcagccttttacaacaacttcatgaccgcggtttcagacaataacgacaagcagattaccaccagtatggcgccggcctttgaaaccaaatccaactggcctgacccaagtgcttcgctgagtcaatatagtcacgcatttaatctcctgctggaacaggcggccgttcaagggattaccgtgtttaaagccagcggtgaccgtggcccatatgccctttcaggtgccaaagagaaccacatcatgtccacttcaccatacgaggttgaagtcggcggaaccactttgccatatcaaaagattatcgatggcaatctgatctccgtgaacaaggaacgggcttggggcgacacttactccagacctgcttatgataccaaatacagcagctttgccggtggtggcggtggcttctcagacatcaacccaactccgagatatcaaatcggtgttccaggtgtcaacacctttagagccatgaactatctgacattcaagaatggtaaatactcgatcaccaagaatcctcacgtcatcacaggtaccaagaccggccggaacttacctgacgttgccggtaacgctgatccattgactggttatgcctcaattgtttccggaccaaagtacactttcaaccctgagactaagaaggctactaaggccaacggtattctgtggcggatcgatggtggaaccagcttcaccgcaccacaaatggccgctgcgaatgcggttatgaatagtggccgccagacgccaatcggtttctggaacccacagatttacaagtacgcccaagagtccgacagtccatttaacgtccttgacgacgcggacttcaacgacaacttgtactacaccggccaaccaggcaagctgtataaccaggcaaccgggcttgggacaatcaacttcgacaagctgtacaacaagttcaacaataccaacaattaggcggtggcttgtcgcaatcacttgattgacctatgatgaaggtgattgattcaatattttatgaatgcgggatgtgagatacatgcaaaatgaagatcacagtaaaattgatcgcaaacaattagcagaaatcgtgccggatctaaccaacgttatcagtgaccctgacggcaccttctcagtctttgactggggccacggggaaatcattggggttatccagcaccaccaggattatcctgacacggcacttgaagaagtcttaaccggcgctgtgccatctggtcttggttattcctacgacccggtagacgagacccacttccaagttgacggcaaggaccgccgattggagaagggcatcattgcctcgagaaacgccgctgtcctggtggcgccggatgtgccggaaggaattctcgattacttgggcattgacatgattaatactctccagataccaggcgttcattatgagtatccagatatcttggattaagcgaaattaaaaagtctagcgtcaccttcgattgaattcgaatggtggcgctagatttttttgattgatgactcagaaatcagtgggagatgttattcaatcatcgtcggcaccttccccatggcggccaacaccttcaccaaatcagcataggacatcaaaatcgtcgcggtattgacattcggatgagcagagatttccggcatcgtctgcagtgacttgttaatcagcaccttcacctggtcgtccgtatcgtgcaccaacgccagtggggtgaccatcccggaaacgacgccgagcagggattccaattctttctcgctggcgaatttcagtcggctgtggcccaaccccagttgctcagccaacgacttaaagtcgacccggtgattatcgaccagatacaaatagaactgatcgctctttcgatccttcagcagcagattcttcacctcaggcaggcctttgggcgcattgggatcatccatcgtccaaatggcagggtggtccacccgccgatagtgcacgccaacccgtgccagcaaatccaacgcttcttgttccgtcgccattttcatccaatcacctcgttgaatacatattatacgcaaaagttgctataagtttgccttttagcaaaaagtcaccagcgccaaacatagccaaattccacaaacccaggattaccaggcgctaagatgccaaaatctcccgcgttgttccgtcaccaccttccatctatactcattgcttgtgacattggccaatggatcaccaatctaatcaaaggtggattcataatgaaacgtaacaacaagcaaatcgaactgtaccaagatgcatttgacttcctattagacggcgaccatgagctggtggtctatggggtgctgaagaagctgcatattcgccgggataatccatattatgaggatctggttcaagaggggatgatggccttcgtcgagaaatacattcaggcaatcaacctcaaaaaagaaccgggttcctacctgctattcatctatcaaggagtctattggtacattctcgactgtctccgcaaagaaatgcgtcaccgagccggcatcgaagaaccaaccgatgaaaaagatctcatgcttgaactggaagataagaagaaatccgtcggcttctacgatgcgcacatcatttctgatgaattaagaaaccagttatcccaggaagaggcccgctatctaaccttggcctacgactacgggatgaatatcagcgaaatcgccagggaatgccacgcttcacggacgaccgtctacaagtggcgccgcggggttatcaaccaattccaaaaataatctgaacactttggccccttcgtttcgttactattacatgtaagggttggcgccaacgacttacaaattaagcagaatagaggagaaagacaatgcaaaaagattggatgaaatcaaatgttacctatacgttggttaatgaggatcacaagaagggcgttaagcactcttttgcgtatgttactcaaaatgtaaccgcagaaaaagtggccgctttcggcaagatccttgaaagcctgatcgacggtaacatcactgacgcagccgtatcttcaaccgaccacgttgaattaagcgacgcaccaaaagccccggccgcacctcaagcaccacaagcgtaattatcacggactaataggaggaaacacagatgcgtaaattagaattggtattcaagacttcagacgagaagcttaagaccctgtccatcaactatgccaacggggaattaaacggcgacactgttaacaaagcgatgactgaaatcgccaaactcaagatgtttgaccgcgacggcatcgatccatacgccacaccaattgccgctcagtatcgtaagactgagatcgacaagttgttcgacacacgcggagaataattgcataagggtaattagctacagttaccgaccaggccgacaatgggaaactttcctgttgtcggcctttttgtgcatcgtttactaaatgtagaagtcaaggaactcacttacaaaaagttactgacaaacgcctgcatgatgcttaacggcggtacttgtgttacagaattgttgcaactatttcaattaaaagttatcagtacaattatgttgcgatatcagttataagaagctatcattaggactgtagaaagtttaggttagctctgcttgaagcacctcttgttatggggtaaactaagggtacgggttacataaacctagtgaactacaaaatattttattcatattggaggagacgcaataatgaaatctagtttgaagaaatcattatttgtaggcttagctgctttaggcttcgtcgcagttgcaggttcagcaaacgctaacactgcatcagcaaagagttatgctaaggttacatcgaacaaaacattaactactgacgctactactcgtaacgttaatgttaatggaactaacgcactttatactaaggctggtaccttgaaaggtgccaaaaccgttgctaccaagagtactttagctgctcttaaagactctaagcaaggccaaaagaactggcgtgcttatcgtgttgctactactaaccgtggttctgtttactacaaggttgtttcatttgatggtgcttaccgtggctggatctacggtggcaaatcaactggtgcatttggcggtggtgttgcgcaatacaacacaaccactgatccacaagcatcaactgataccagttcatcagtgaactcaagtgcctcaattaacactcaaggccaaacaactggtttgagtgctactcaaaaggctgcaacctataagattgccaaccctggtacttcaaacgatggtactgaagtaacttatacttacccagcatggactcaatacaagaagggccgggtaattaccgactcaacaccttataaggacgctactttcaaggtgaccgatcaaacaactcggacccgtgaaggcgacctttgggttaagatcgaagcaactgacgctgccaacagcaaagctaatggttggattctttacagtggcttgaagcaagctactcctgctacaccagctgagaactttaacgctgatactagtgttaagattgcttaccgtgatgctactactggtaagacattggataagactaatacttggaccactgcttctactggtaccaagcaaggcaatgccgttaacgctttagttaacagtgctggttacaatcttactcaatatcttgtaaatactggtgcaccatcgggttatacctttaagaacctgtttagagtctcttgaggagtaatgccagaaaagccagcaccaccatttgtagactggtattaaggtgacgttcgcagttcttccagaggcgccgacatttatccagccagctgaaggagcgttcaataatccagcgttgcggcatcacggtaaagttatgtaattcattgcgtttagcaacctgaacggttgcttttaaattcgttttaacatcaatggcgaagttggtgccggtataaccaccatcaaccaggacactacgaacattttttaaatgatcggcatgaagagccaacattgcgctggcaccgtcccggtcagaaacattggctcgagtaatatggatggcttgtggaagcccgttaatatcaacggctaaatggcgcttaatcccagagattttcttaccgccatcatagcctttattttgagcagtatcggtatttttaacactctgagcatcgacaataataaatgaggttagcgccgagcgatcctgttgggatcgtagggtaaagacaatttttttaaaacctgttccaacaaagattcttgaaagccaggccctttagctgaccaaattcggtagtaataataaaccgtcgaccattttggaaaatcgtgaggtaattgacgccattgacacccagtttttagtagatacaacagtgcattaaatacttgataaaggtcttgggttcgaggtgcggtgcgtttccgggctgtttccaattcaggccgaatcatttcaaactgggaacgagagatttggttaagataattagtcatcaaagcgggtctcatttcttttttatcaagattgtagcaaattattcgggcctttgtaagactctaaacaggttctaagactactgatggcaaagatgtagctaaggatgcttctaacttaacaattagtcctgttatcactggtgccaagtttggtgatactttgactgttgatgttacaccaacggctgctcaaactaaagttgctctctactacgaaacaacttcaggatctgctatttcacctttgactgcaaatgactttgcatatggttatccagcaatgactgccgatcagcaagcaaaggcacttccagacactaagactaacccagctacattcaatgtttcaaactacttcgatgattatgatttaggtggtaacaataacgcccaatttatcaatcaattcagatctgcaacaaatgcttataccgcagctcctggccaattgactgatccaaccaccggtagaacaactggtttatcaaagactggattctttggccaaccattgaataatggtactcaacgttacttctatgtatttgatggtgctgctaccaaagctaacaacgctgatcaacaaactaagggagcaaccgttaaagtcgttatgcaacgatttgtaaccactcttcaattaccagctcaacaaagtaatgccaacgctaacaccgactacattgctaagtaatcagtattagtagtttcacttgattcatagttttacccattccagctctacaaacttaatatgtaatgtcgaccaaagtgatttggccgtccgctttatggaatcaccgttccgtcaatatgatttgtagttgcacacaggtaacgaataaattgctgggcggaagagatacttcaagcatatttcttccaggcaatttgaaaataaaccagcgatccgatttacttcgggtcgctggttttttgtctgaatacagttaagggttcatttgattgattctgtgttcgatttggaattttccaataaattggtggagttcttttaattcgttacttttctccaagggttagtcggtatggaaaaacggattgggattggccgttggacccaaaaactcgtaatctgtatatagataaggaacgttattattcatattgtgctcgatgccggcgttgtagactttccagcgcagttcgtcgatttccttcattattttgtcgtaatctctcaatgacaaaagaaccccgagcatttggtcgtgtttgataacaaacacaccggtttgattccactttgcccgttggaaagctttagttggtgactttttcaattcggaaacagatatgagtggcgtatttaaaactgtcattgtatccctcctcgtatttgttcttatgatatcaattttccccaagagatactagtttggtggctctcgatcaatggacaagaagatgctttcatgggctgaatacaaaaaatgcctgaaacataaattaacagtcatgtttcgggcatttttcgtagttttagtaatcagcagccgttttagtagaagtcgttttcttcgtagcggttgtcttactggtggtcgttgtcttcttagtagaagtggtcttcttaatctgatcctttgggaaattatcaatcataaagttggcgatgtctctggccatcagttgataagtcttggcagccggatgcaagcggccgtcgttaaagcggtcgatgtggttggcgtcggtgatcaaattaggatcgacgtcctgccagttgaggtatggcacgtcattttgctgatagacttcagcttcggcactcctcaactcgttcatggtgtagccgccttggccgacaacgtcatcagagttctggttgttgtcgtaacgggtgattggcaaaatgccatagatgatcaggctcttattttccgctttcatctttttaatattggtatccaaagtgttcttgatttggtcaatggtcgaatcggtatgaccgtaatcattggtcccataagcgatggtggccacgttgtatttggcaaaattggtatcttcaaccgtggtggttaagtcccccggtgtcgacatgtcgccagcgtcacacaagaaggcaccgttataggcggcgttatcaactttcacattcaggtaacgggccagccaggtcgggtagccggcatccaaggtctcgtagccgtcataaccggcggtaatggagtcgcccatggtgatgagcttgtctgatttgaagtagtcactatttttcattgcgatgtcaaacgttccttccgaaatatcttgtaagttgccgcgccagacccagccgttttgtttgccggaaccactcttcacgtaataccaaacggagttgcccttgccttgggcggatcggtcgatgacagcttttttataagtgtaccaggttaccttggcaaagtctttagcagatcccaaagtcttgttcaaaccggaagtcgtgtagacgtagccgccctttaaatggtagggaagtggttggtcgtagtcttcggtagaaacaatggaagcagctggaatcgtttttttagtggtgtcattagttgatttggatttggtgcttgatgaactcgtggaagtcggcgtcgttggtgtcgttgtggcagcactggcaggtgccatgatcgccgcgatccccaaagcggctgtgatggcagtcgttatgtaaaaacgtttattcatatcaattatctcctcataatttcgaactatgtattactttagcatgatattgttacgaaacccttacatgccgcttacactcaaatgaagagttcgtgcacaacttgcttatttttagtaaatcaattatgattacttttagcaagatactaatagaacgatttgactagaatgcaagcgggggagtcaataaatgaatatcaaagtaaaatgcaggttaacactgttattttcattgatggtttttggcggtttggggatgaatactcaagtcaatgccgccactgatgattcaaccacggctgcgcctcagattcaatcagtcagcaaagccgattcatcggtcacggtgaatccggctgaggggacctcatccaacgtttcggtggatgagtcaagcgacagcgcagcggcaaagattgacgattcaaaagtgaacaaggattctggcagtagcgtcacaactacatatggggatgccaaggataaccaggttaaggctaacagcgatagtgataaggatgcggctaagggtgactcttcaacggctgcaagtgacacctccactgatgtgtctcaggattcatctgctcaaaaggatagttcatctgaccagaatgccaccagtgattcgtccagcccaaccgatgatgccattgacaccgatactgacatggcggacgtgactgaggatactgactcgagcaaggttgtgaagccagcctctgccaaggcggacgctgatgcggataaatccagcacagatgctcaaccaacaacggctgccagtgacgctgatgccccggatgatagtccagcggtcttggaatcactgacccaggatgcatccaaagccgaccaggcgccagagacactggttgtgccggatcaaccgattattgaaagccaaaatgttcacaacgatatcgttggggatacatttgccgacaaagtgacgaagagtgatcccaaggcagttaaggaagcaaccgcgattgccaataacaagaccaagctgttgaccttcaatgccttctcggacaaaatttaccgtcacgtattgaagacagctcagaagccggggacggtcacgacgacctctggccataaagtcaccttgaccacgcctgttaagcacgtgaaatacaccgagcatgattcaacaggggtttcagagaccctgccagtcatggccaccttggcgattatcggggtagccggtattacgtttatagcgtttgacccgcttagatttctctttaaataaatgattagacgaagcacggtcgggtttgtcggccgtgctttttgctgtctaaaggcgcgtcaatttaacgtttagaaataagttcaaaaaagagtatttaatacttgcaaacgcttacagatatgatattatatagtcaaggaagggaaaagaagttcgaagcatagggggtttcagcctactttgaatgttcttcgatccaagattaatatgttgttatgtcacaggattattttcaaatgtttcacgtgtagaacgcatagttgtttattttaagttttaagagtttgaggttcacgattcacagaagcatggatgtttgaataaatgatgttttatttagccgattgtttcagagattcatagagtttcaaattgttacagtttaaaataacagaaggttaattcaggtgattaagtgtttgaatataatgttatgagtcacacatgttcaaatatgaattcgatgattcgctattgaaaacctggtggagtaattgaaaagggttatgtacagaggtcacttgtagtgaatctgagagattcattcgaatatcaaattgatgtgatatcaagttgatgaaagatccaatgaaataggttaaggttcacaggttttaagtaccatgcaccttaggtttatgtatcacgtatcaagcagttgcaccaagtatgatagtttcacgtagaaccaaaatgttgaccacacggcaaatttatcaataaagtaaaaacgtgaaaatgattaaagtttgcggcagttggatcaacaaatagttagattgaggcgataagacattaaagttttaatgaagtggggattaaccccaaagttcccttccgtataggatttaagcttgcagtacttagatgcgagtttgaatcctatttttttgtagagtgcgacgagcaacgggtgatgcggtgtgtaagagtgcggactggggcggttagtaaccggagtctaaggtgcttcgaacggaaatcgagtttgattttcgtttgaagttccttagatgcaggttgctgccccagggagcagatttccactagagaaaagggaaccacaaaataaccaatacataaaagaaagaccaccaagaaggacagccaacaagcaccaccaccagccaccccggcaccaacccaaaaccaaacaaatttcataaatcccccacggtcgaaaattccctatttacgccagcaaaacactttgatataatgaaagcgcaatcaagaaagtaaaaggtattacttaacgccatttcttgatttctatttacaggactttctgcaatgaggtattctattcacatagaatatttttttctgagcaaagttttgatctggaaaggaagtttctcatgaactttcgtcgtgtcattgtacttgatctggcatctttgggtgtcggcgaggccagcgacgctaatcgatttgaatcggttggcgccgatactttaggtcacatcgcaactcttgaaggaactgactttcaactgccgacattaagtcgactggggttgggcaacatccgctacagcgacccggttgtcggtctgccgccagtggaggaaccgatcggcttttttggcaagattagaagccagagccgggagaattcgcaattaagtggtttgcgggagatgtttgactttcagacacccacccgaacgaccagcgtgattgacggcatcgtcggccttttaggggttcactcgattttgatcagcaattaccagagctacctttccaatcagaaccaagcggaagtcattccggtcaatacggatgagggtggcttggagcagcttcaccagcaggtgattgcgccgaataacggcctgctttattttcgggcattagggttgtccgaacacgcacaaacggggaaccgcaaaggctgcatcgattcacttaaattggtggatcagcatttggcacggttgatgcgggaactatacagcaccgaccttttaattatcacgtcttcgtatgccaatgatccggccatggacgttacgccaacgcgcgaatacctgccgttgattgcctacacgtcctcacttcctgagggcaaggccttgggaattcggcggacccttgcagacattggggcctcaatcggggagatatttggccttgaagtgtccaatgaatccattggcagcagttttctcggcgaattgaagtaagtcgccgcattatttagggtttaattcataaaaccaattccattacagagggggatagctagccatcttcatcgttgtttagcaattattgtcgttaaaattcagaaaagaggatttcagaatatgcaattatcatatttactggtcaatattctgggtgtcgccgtataccttggaattgctttcttgttttcaaataacaaaaaaggtatcaactggcgttcagttggtgttgttttagtaattaaccttgttctggcatggatattgactagcttctcctggggccgtgatgcggttaaagccgctgccgacggatttaactggttggtccaagtcgcttaccaagggatcaacttcgccctgcctaactgggttaccccacaatttggcggaactgccaaatcaatgaactttgtcacgagtgcgttattgccaatcctgatgattgttccattgtttgatacgcttacatatattggcgtattgccatggatcatcaagtgggtcggccgtggactttcatttgttaccggcgctccaaagttcgaatcattcttcgccgttgaaatgatgttcttaggtaacactgaagcacttgccgtttcatcactccaattaaaacaaatgtcagcaaaacgtaacctgactctggctttgatgtcaatgtcatgtgtcaccgcgtcaatcatcggggcttatacccaaatggttcctggccaatttgttttgactgccgttccactgaacgtgttaaacgccttgattattaccagcttattgaaccctgttaaagtcactcctgaagaagatacggttgctaaaatgggtggctcaggttccagtgaagccgctgttgaagctggcgacgttcaagctaatggtaaacgtgaaccatacttctcattcttaggcgactcaatcttgggtgccggtcgtttgatcttaatcatcgctgccaacgttatcgcctttgttgccttggctgctttgattgacaagattttggctttgttcaacccatggttgtctttggaacatatcttaggaatcatcatgttcccatttgcatggttaatgggtctggatgtcagtcaggcattccaattcgcccaattcatggggatgaagttggttaccaacgaattcgttgttatgggtaagattgccggcaccattcacaacctcagcatcttcccagctcactaccaagcacaattaacagttttcatcacttcattcgccaacttctcaaccaccggtatgattatcggtgccttcaagggcttggttgataaggaaaagaacgatttgatcagtaaaaacgttggtaccatgctgctttcaggtattctggtatccttaatgtctgctggaattgttggtctgtttgtttggtaaaatcagttctagaaagttaggttttatgtttggataagttacaaagagaagaagaggcggctaaccggctgcctcttcgtgaggctatacgggataaagccaccgtcaaacgggaaatcattgctgggatcaccggctttttcgcgatttcatatatcatcattgttaatccaatgatcttaaaagatgccgggattcccactgatttgagcgtctttgcgacgatcatttcttcgttgatcggctgcttgattatgggcttttgggccaatgcaccagtaattttgacgccgggaatgggcgtgaatgccttcttcacttataccgtggttgttgccatgggtctgtcctggcaagaagcgctggcaatctcgattgtctccagtatcatttatgtgattatcgcattcacgaagttgagtgagattttggccaagggaattccagagactttgaaagcggggattaccgccggcattgggctgtttttagtcgaaattggactggagaaggcgcagttgattcagcaggggaagaactcgattctggctctgggtgatttaaccaagccggcgacgctgctggcgttgtttgggttactgctcacgctatttctgttcgtccgcaatgttaccggcggcttctttatcggcattttggtcacgtcggtggtcggaattctgtttggcatcaaagatcaggcctcaccgtcagttggaattggcgatatcactcgttactcggggattgtcgccaaaggaaattttgacaacgcgttaaccattccgttcgttctggcagtcttctcaatgaccatgattttggtatttgaatcgatggggctgctggaagggattatgcctaatcccggcaagtttaagaaggcgtttcaggccagttcggtgaccagctttctttccgggattcttgggaccagtcccacggttgctgcagcggaaagtgcttcggcaattgaaagtggcggtcggaccgggttaacatcgattgttgccggactgatgtttgcggtttcgttgttctttatcccgttgctggcatttgtgccccaggcagcgatcgcacccgtgattatcattaccggtgcgttgatgatgaaccagctcagccgcattaatatgtttgatttttccgattggttcccggcatttctcatcgttgttctgattccatttaccagtagtatttcgactggtttggcgtttggatttgtcgcttacccaattttaaaaattgccgctggcaggcaacacgagctgactgtcgcgacatacgtcttaggatttttattcttgtgtgatttggtgctcagtgcactattatagaagtaacaagcgggcggacttcaggttcgcttcttgttaggaactaattgtaagcgtttgatattaacaaatattgtttggaaaggaacttatcatgaccatcaaaattattatggataccgatcctggaattgatgatgctgctgccttaaccatggcgttgaacgatcccgagattgacctgaagttgattaccagtgttgccggcaacgttaccgtggacaagacgactaagaatgcccaaaagattgtccgcttcttcaataaaaaggtgccagttgcagccggtgccaagcagccgttgatcaaggaatttgaagacgctgccagaatccacggtgaatcggggatgccgggttacgatttcccggaggatctgccaaagccattggatgtcagcgcggttgaagctttaagagaaacgatcatgagcagtgacgaaaagattaccttggtcccaactggttcttataccaacgtggccttgctgttcagtgaatatcctgaagtgaaggatcacatcgaacggatcgtcgcaatgggtggttcacttggtaagggcaacatgacttctgctgccgagtttaacgtcttcaccgatccggatgccgcacgaattatgtacaattctggaattccgattacgatggttggcctggatattaccatgaaggccctgattaccccggattctctcagcaagcttgagcacatgaacgagaccggcaagatgctgcatgacatcatcattcatgatggtgataacagcgctgaaggaattgccatgcacgacgtcaacaccatcttctacctgcttcacccagaagcgattaccaccaagaagatgtggatcgacattgttactgacggcccagccattggcgaaaccgtcggcgatatccgtggtgcttaccatgatggtaagaccaacgctaatgtttgtgtggatattgacgctgaggcctttaacaagtggttcttggatgaagtttctaagattaataagtaaattttctaggcagtcagatattttttctggctgtttttttgttggacggctgtaatagtttttctgcaccctacgtcttgacactttcccagtagattggcataatgaatctaacattaaaaacacatgagaacaatgcgatgacgagaagagtagtgatcgaggcgatctaaagagaagggccatttggtgagaggcttgattgtcaagatgatgaagatgagctccgagcaggtgaccggtagaagccggtgatccgtcagcaaacgttattttgccgggtatcgattttaaatggtaccgtcgaggtgtattttagatacacgaagatagggtggtaacgcgcatgagcgtcccttagtccgtaaccgggctaagggacgctttttgttttctcataatccaacatacattgcaaagtaggtgaaatcattgagcaaaataactgattatgattctaaattaatcgagtcactgttcatcaaatatgccaaagtcaacacgagatctgatgccaacagtcacacagtgccaaccactgtcggccaggtcaaactcgccaagatggtggaaaaggatcttcatgacttgggaatcaaggatgccaagtacgagccggaaaattcttacgtgcttgggagcttgccgagtaattctgataaggatttgagtgcgattggatttattgcccacttggataccgccgattataatgccgaaaacattcaacctcaggttcatccaaactatgatggcggcgagatcgtcttgaatgccgagaagcagatcgtgttgagcccgaaagaatttccactgcttaagcactatgtcggccagcgggtcatcacgactgatggcaccaccttgcttggcgcagatgacaaggccggggttgcagccatctttggcgccctcaaatattttctaacccatccagatgttgaacatggagaagtgaaagtagcgtttggccccgatgaagaaattggccgtggcgctaaacggttccctgccaaagaatttggaacggaatttgcctataccttggataacggccagccgggacaaatcgaagcggagacctttaatgcttccgaggccaaaattgatatccgcggcactgcagttcatcccggggatgcatacggcttgatggtcaatgccgttaccttggccaatgaaattgtgagtgcattgccaaaagacgaggttcctgaaaagagtcgcgatcaccaaggcttcattttggtcaccgacatgactgcaacagtgggggaggcccatctcaatctcattattcgcgagtttgatacgcagaagtactatcgcaatttggcactgttacatcagattgttgacggaattaatgatcggtatgattctccaagagtcagtctgaagattaatgaacagtatcaaaacattggcgatacggtcaaacagcatccatacatcgtcaatctggcattgaacgtctatcatcagctgggaataacgcccaacattacaccgtttagaggcggcaccgacggtaatgcgattaccgctaaaggtattccaactcctaatctatttaacggtggtgacaattttcatggcccttatgaatatgtcagtaccgaagcgatgaccaagactgcccaggtggtcagcgagattgttcaggaacacgtccgcgaatatggacaccgcgacgagagcccagttaaattaaattaacaccagacatcagcaaccagtcaatccgactggttgtttttatttgcggattgatcaggttgacaacttcaataacctcgatttacaggtgaatttactaaacccaataaattcatggcaaaacatgttaaaatcttatatgtatgcaaccgacaaatgtctttggacaccttgtcagtcaagctattttaggttaaagtataataagacgtgaaacagattgtttcacatatcaggagaaatcaagcatgaacaatgatcaattcaaaaaggcgcttttggataaaggtatcgaagtcactgatcagcagatggatcagttcgatgcctattttaagctgttagtggccgttaacgaacacgttaatttgaccacaattacagaaaagcctgaagtgtatctcaaacatttctacgattcgattacaccagccttttttgtttcacagattaaaacagcgccattgtcgatttgtgatgtgggagcgggagctggatttccatcattaccgttaaaaattcttttcccacaactcaaagtgacgatcgttgattcattgaataagcggattaactttttgacaaccttggtcaaagaattaaacttgaccggagttgagctgtttcatgcccgcgccgaagaatttggcggtaaaaaatctgagcatcgtgagcagtacgatctcgtgaccgcccgtgccgtggccagattaaccgtcttgagtgaactttgcctgccattggctaaagtcggcggcaaaatggttgccttaaaggctgccaaagctgaaggggaactatcagatgctcagccagcgattcaactgcttggcggtcaggtctcgggggactttgaattttcactgccggtttctgacgaagaacggcacatcattgtgattgataaggttaaggaaacccctaagaaatatccacgaaagccagggacacccaatcgtgaacccctggatcaaatcaaacgatgaggagggatgaaagatgacatacgtaatcgcgcttgcgaaccaaaagggcggcgtcggcaagaccacgacggccgtcaatttgggtgccgggatggcttcgatggggaagaaaattctcctggtagatgccgacgctcaggggaatgcgaccagtggagttggcgtctcaaaggcagacatcaccaaagatatttatgatgtcttggtgaatgaagaaccgatggcagaaacaattgtccacacctcacatgagggtttggacattgtcccggcaaccattcaactgtctggtgcagagattgaattaacaccccagatggcccgagagacccgtttgaaggccgccctggatgccgtcaaagaccaatatgatttcgtattgattgattgtccaccgtcgcttggtttgattactatcaatgctttcacagccagtgactcgattctcattccggtgcagagtgaatactatgccctggaagggttgagccaattattgaacaccattcaattggtcaagaagcatttcaatccaaatttgaagatcgaaggggtattattaaccatgtttgacgcccggaccaatctgggcgaacaggtcaataccgaggtccgcaaattcttcaaggatgaggtttacgacaccattatcccaagaaacgtccgcttatcggaagcaccaagctatggtctgccaatcatggattacgacccaaagtcaaagggtgctgagaaatatatgaatctggcaaaagaggtgctggcaaaccatggctaataagaaaaaactaaccggtcttggcaaggggattgaagccttgttccaagataataatgtcgatacgagcaaagaagatgtcgttgacctgaaagtcagcaccatcaagcccaacccgtaccagccccgccaccgttttgaccaaaaagcgttggaagatctggccctttcaattaagaactccggtgtcttccagccaatcattgtcaggcagcccgatccggaagttgactcatttgaactgttaactggagaacgccggctgcgggcatccaaaatcgccaagcaggagacaattccggccatcatccgcagtgtcaatgaagagcagatgatggaaatcgctgtcatggaaaacctgcagcgagaggatttgaccacgcttgaagaggcggaagcctataacatgttaatgagtcgactggacctgactcaggcacaggttgctgcacgactgggtaagagtcggccgtatattgccaactacttaagaattctgggcctgccgaccgaagttaagaaaatgctcgaagacaagaaactctcaatgggccaggccagaaccctgctttccgttaataacaagcaggagcttattaaattagcccgcaaatcggtcaacgaatcgctaaccgtccgccagctggagcaggctgctgccaagatcaacggtaacaagccggccaaaaagaaaaaggcccccagaaaatcaccatttgtcagggcgtcagaaggtcaactccaagaaaaatttggcacatcggtttcgattgtcaattcatcacgcaagaagggtaaaggtaagattgaaattgagtatacctccacagacgatctcaaccggatcctggaaatgtttggggtcgatttggactagtcacgttgccgaaaggagacttcatttatgtatgatttaaacgatttagttgaaatgaaaaagcctcatccatgcggcaccaaccgctggcagatcattcgaatgggtgcggatatcaaaattcaatgtaccggctgcggccacattgtgatgatgccccgaagagaatttgatcataaattaaaaaagatccttgaaaaagctgaaaaataaaccagaaagaagcgtttaagttatgtctttaacagcaggaatcgtcggcttaccaaacgtcggcaagtctactttgttcaatgcgattaccaaggccggagctgaaatggccaactacccatttgcgaccatcgaccccaacgtcgggatggttgaagttcccgacaagcgccttgaccgaattcaagaattaattccagccaagaaagtggttccgaccaccttcgaatttaccgacattgccggtatcgttaagggtgccagcaagggtgaaggacttggtaacaagttcttggaaaatatccgtcaagtggatgcgattgtccacgttgtccgtgcatttgacgatgacaacattaccacggtctccggcaaggttgacccactggacgatatcgacacgattaatttggaattgggcattgccgatctggactccgtcaacaagcggttaggtaaggttcaacgcgctgccaagggtaatgacaaggaagccaaagcagaattggccgttcttgagaaaatcaagccggttttagaagatggcggttcggttcgttcaatcgactttgatgaggatgaacaaaagattgttaagggtctattcttgttgaccagcaaaccggttctctacgttgccaatatcgctgaagacgacatggctgacccggagaactccaagtatttcccagaaatcaaggaattcgctgccaaagagggtgccgaagcaattgcggtcgctgccggtcccgaagaagaaattgctcaattagatgatgacgaaaaggctgaatttctggaggctgaaggcgttaaggagcctggtttaaataggcttatcagagcctcatacaagcttttgggcctgcagacgttcttcactgcaggtggtaaggaaacccgtgcctggacctttaagaagggtaccaaggcccctcaagctgccgggatcatccattcagactttgagcggggcttcatccgtgccgaagtcatggcctttgatgatttggacaaattggagacaccagcagcagtcaaggaagcaggtaaattgcgccttgaaggaaaagactacgtcatgcaagatggcgatattgttgaatttaggtttaacgtttagacgttattttaaggagtgaagctagtgagtagcaacgatgacacacagcgcaatgccaacagcaaagcccgtcagaagaatgcccaggtgcatcaggatcgggatcatgcggccaaaattgtccattcccagttcgataacatcgggttaactaagcggaatgctgagtacatgttcaagttcaatcaggcacttggggctaccaaactgtctgcagataagaagaacgaagccgtccagacgatggttcaagaattgctggagggtcaaaagtcaggcaaaactgccagaaatatgtgggggactgtcgaccaaaagattgaaacgacggttcatccaccggcaagacctgctgatccacgcagagactattggaagaatgccgggtacaatgctgtcctgtttttgacgatcttcttcttgatgtatggggttctgtggttcctgccaactaagggcggccaacactcaccaatgatgggcatcactggaattctcattagtgcggcagttgccggcttggggattccaattgtgacgatgatgttcacaccaggtgttaagcatcgattctcaatttggattcgcatcatcctggtcgtcttgttcctgatcgtgtggatgggaatcttcacgctgtcatcaattctgccgccagttttgaacccagtcttgaatccaatcgtctacatcgtgttgggtgtgttgtcaggagtggcagccttcttcgtcaagcgccgattcaacattaccggtggtgtgttctaaaactaataatgcatttaacgatatggtttggtcagatgagttgtcatttgatcgagccattttttgtccatgctccaaacacgaacaataaaatgtaaatttttgaaataaatgccagacgacgaaaaaagatgaacaatggtctttatttattcggaagagtcgtgtataatcaatacaatttcagaaaacgatttgcttaaggggcttgtcatttttatgagaagcgtatgagaattctttcagatacgttgaataactaaaatgaaaatgataagttattagacaatcaacatttaaaaggagcgagatagatggttagttgggatgaaaaattcggtaaaaaaggtttgacgtttgatgatgtgctgttgattcctgcagcgagcgatgttttaccaaatgatgtggatttatcagtacaattggcagacaacttaaagttgaatgttccttttctaagtgccggaatggacactgttaccgaatcgaagatggcgattgcgttagccaagcttggtggcatgggtgtggttcataagaatttgagtattgaagatcaagccgctgagattgccaaggtgaaggcagttaagaagactgctgacactcctaaagctgcggtggatgacaacgatgcgttgttggttgccgccgctgttggggtttcatccgatacttttgaccgggcatccgctttactaaaagccggtgccgatgcgatcgtgatcgataccgcccatggccattcagccggagttcttcgcaagattgctgaaatccgtgaccactatcctcacaccactttaattgccggcaacgttgccactgcagccggaaccgaagcccttttccaagccggcgttgacgttgtcaaagttggaattggccccggctcgatttgtacgactcgggttgttgctggcgttggggtccctcaaattacagctgtctatgatgcagccagtgttgcccgcaaatggggcaaggcaatcatcgctgatggcggaatccagtattcaggcgacatcgtgaaggccttggctgccggtggtagtgccgtcatgctcggcagcgtcttctccggaactgacgaagctcctggtgaagtctttgaagatcatggtaagaagtacaagtcataccgtggcatgggcagtgttgctgccatggaacaacaacatggttcagctgaccgttacttccaaggcggtgtcagtgaagccaacaaattagttcctgaaggtattgaaggcgaaaccgaatacaaaggcagcatcaacgacatcgttttccagatggtcggtggcctgcgttcaggaatgggttacactggttcagcaaccatcaaagatctcaacgacagtgcccaattcgtgcaaatcaccaatgccggcttgagagaatctcatccgcatgatgtcaacattactaaagaagcacctaactacaaaccagaagattaatgcatctcaaacacctgcaggtcaaccgctatccgcgattgacctgttttttgtcttcaaactgagtttggttaaaatgtcgccgggttccagttcaccggctccgcctgctgtagtggcttggatttcgagcctgtagtctcgaaatgccaagatgctgtaatcacgacttgcagtcgtttcaacagcatggacactacagctggcaatgccggtaaactggaacccggctactggcagcatatctatgagtttggataaaagtgattgaaagggaactgcatgattcgcaaatcaaacggaatgaggccgaattttgctggtttggcattgacagccatagtgaaagtgttgttgaagccgatgaaatcggcaattacaacacctttgtatttcaagactacaggcttgaaatcaaagccactatggcaggcagagccaaaccagcaaaattttccacttaagcagcctcttagcacttacaggacgagaggaatgctaagttttcatcaatatcgacaacaattatcatttttattactaaataggagtattatgattctgttagcaacattaatcatcaaggcaggaggcataccgttggactcacaaaacattcttgaacggccatttatcaccatcactaatttaatctggagcttcgaccacgccaccaatcgggtcaatattctgctggtcaaacgcgataacgatccttacaacaactactgggcattaccggaaacctttatgcgctcccaggaaagtgccgaagagactgcgttgcgcctagtccgagaaaagattggcatggatttgtcaggcagtcacactgaacagctggcaacctttaccaatcctctgcggacacctggcgatcgggcactgtctttggggtacatgacatttttacctgataaaccacaactcaaggcggggtatggcgcctccgatgcccggtggttcaccatgggatatactgataaaacatacacctttagcgattcggatcatattttccaatccaccgattgtccggttcaacggacgtactatgcagaatttggcgggaccaacgctgatcctgacaaacacttggcatttgatcatgaatggattttgaaggttgcctgtgagcgaattcgcaacaaactggattatcagcctaatatcctgttgatccttggacgtcaattcacactcaaagatgctcggcgagtctattcgccatttttaaaacttcgggttgaacaaattgacaactcgaatttcaagaaaagtcaccaagatctctttactgacattggttccagcgagattaacggtcccggtcgtccggctcggttgtacaaattagcccatttgcgggcgtaaacgcttgaaatgttatcggagtcgttgtaacgtagaataaaagtttggaacacttttattttaagaatataaaagttaaaggtacttttaatcccaatgaaaagagtcgaaacataatgagtaacttatcaatgttgacagatttatacgaattttcaatggctaacggctatcggcagacgattaccgacgagcagggggtctttgatgtcttcttccggaaagttccggataacggtagttttgtgattgccgccggcttggagcaggccgtcaaagcgctgcagaacttccactttgacgatagtgacatcgagtatctccgatcattgaacctgtttcaagagaattttttgacgtatttaaaagatttcaaattcgattgtcaggtatccgccattccggaagggacgcctgtctttccacgagagccactgctgacaattcggggacctttgctgcaaacgcaattatttgaaacgatgattctcaacattttgaaccaccagtctctcatcgccactaaggcccgccggattacctattctgctgatggccggccggtgatggagtttggtgcccgacgcgcgcaaggccccgacagtgccacgtatggtgcccgagctgctgtgattggcggctgttccagcacctccaacgtgttggcagccgaagcctttggtatcccggccgccggcaccatggcccatgcctggatcgaatcgttcccagatgaattgacctcttttgaaaaatgggccgaagtttatccagacaatgctgccttactggtcgatacctatgatgtgctaaaatctggcgtgccgaatgcgattaaagtcttcaaagaattgaaagccaacggccacaaaccagttggtatccgaattgattccggtgacatcagtcaactttccaaggctgcccgcaagatgctcgacgatgccgggttgccggaagtcaagattacggcttcaaatgccttggatgagcacgtggtcgcttcactccttaatgagggcgcgccgttggataactttgggattggtgagaagctgatcactagtgcctcttcaccggtcctcagcggggtttacaaacttgctgccgttattgagaacggtaaaatgattcctaagatcaaagtcagtgccagccgggaaaaggttaccctgcctggtctcaagcaggtctaccggctttatcaaccgggaactgataaggcctttgcggatgtcatcgccctcagtgatgaatccttggatcaaccgattacggtggtgaaggctaacccactagctaccaaacgggaacagcgaatcgagaagtttgacgccaagccactccaaaatgaagttttggccggcacagatttgaagatggcttttccaagtgtctttgatattcaaaagtattccaaacaaaaactaaccgagattccagctgccactcagcggttggtcaacccggacgaatttccaatctatgtgaccaccaagctggctgccttgcaggagagtctgctggaagcggatgctcagtagttgcatgacattttaataaagaattagagctgttggtaaagttggagctttgccggcagctttttttcacatatcggtccgggtaaatttgaccctcctgaggtgggatgggtttataatacccctgtaaacggttacatgacggatgtgctttagaagggggcatatttatgtattattctaatggcaattatgaggcctttgccaaacccaagaaacccgcaggtgttgccaacaagtcagcctatttaatcggttcgggtctggcgtcactggcagccgcagtctttctggttcgtgatgcgcaaatgccgggggaaaatattcacgtcttagaagaactgtcactgccaggtggcagtatggatggcatttataatcctgacaagggttatattgtccgtggcggccgggaaatggaacagcactttgaaaccttgtgggacctgtttcggtcaattccaagcttggagaatcccgacgtctcagtcttggacgaattttattggctgaacaaggatgacccgagtttctcacatgcccgagcaatcgagaagcgcggccagcgaattccaactgacggcaaattcaccctgtccagaaaagcagtggaagaaatcgccaagttagtgatgacgcctgaagaccaattggataatttaaagatcaacgacgtcttttccgatgacttcttcaagtctaatttctggctggattggtcaacgatgtttgcctttgaaccatgggccagtgctgcagaaatgcggcgctacctgatgagatttgttcaccacgttggcacgctgccaaatatgtcgtcactgaaattcaccaaatacaatcagtatgagtccctgatcaaaccgatggtcaagtacctggaagatcggggtgtcagtttccagttcaataccacagttgaaaatgtgattgtcgacactactgatgggaagaagaccgctaccaagctggagattattgaagacggggtggagaaaggcattgatttgacgccaaatgacttcgtcttcattaccaacgggtcgattactgaaagcacgacctatggagataacgatcatccggcagctaaggagcatgcggttggcgcggcttggacgctttgggagaacctggccaaacaggatcctgcattcggtcacccgaagaaattttaccagaacattcctccggccaactgggtgatttcagccacgaccacatttactgatgatcgaattgtgccatacattgagcggattaccaagaaagatccgcacagcggccagttggttaccagcgggccagtgtcgattcgggattccaactggttgatgggcctaacagttagtcgtcagccacacttcgctcagcaaaagccaaatgagctggttgtctggacttatggcttgttctcagatttacctggaaactatgttcaaaagaagattgccgactgctcagggattgaaatttgcgaggagttcttataccacattggcgttcctgttgatcagatcgaagagattgcccaatcagccaacacgattccggcccacatgccgtacattacctcgtacttcatgccgcggcaggcaggcgatcggccgctggttgtcccagccggttcaaccaacttggcatttatcggtaacttcgctgaaacaaagcgcgacacggtctttaccactgaatattcagtccggacggcgatggaggcggtctatcaactgctgaatgtcgaccgtggtgttccggaggtcttcgattcatcatttgatattcgatcaattcttagttctgtgtactatttgaatgacgaaaagtccttattggaattaccgttgacaccaccggaaaaaatggttattcagcgattactgaaacatgttaagggaacttacttggaagaaattttgaaggatcaaaaactcatctagggagatggcaggtatgaaagcaagatcagtcatttgcggtggtttattgtttgcagtcggcgtagcagcggggatgcacgtggatcattgggcacatgaaatgcaccatatgcatcatcacggccatggtccgcatatgggtccgggtcatttccacgaccaaccttttgaagatattggtgatctaccttatgttcgcgagacgcggactgatgggggtggattgaggaatgaagtttagagtgcggaacaagccgtttagcttttgagcattagtgtgataacgggcgttaacgctggtcctgcgttaacgcccgttatcggactaagcggagaaagctggcttgtggagcacatttctgctaggtaagagaagatcttaaaagagaatcgtcaacatggtagaaccaccaaataaacccactaagtagcctgaagcctacttcctggaattacttggtggtttttgtttgaggatgattttactgtgctattgtccttgttttctagcggaaacgtgctccaagcaactgatgcttgtatattaaagatgtcagcaaggtaacattaatttgtactaaactgatattaagcgctgtggattagtccatctgaggtacggatcctaacggatactggttacgttagactctaaccacagtcttttgttgtactgtt

SEQ ID NO: 174 - DNA, 7104 bp, Lactobacillus buchneri
ttcaattttgttttttaactatccgaaccttgtcctcatgggctggtctgcggtataattaccttacaaagttaaaagcaatattcagtcgattttttccgggaagtcaaaatcgactgaatctaagtagctggtatgagctacttgctaatactataaaagagatcccaatcccaaatggattgggatctcttttatttattagcctgatcttttaatatttgattgttaaattaactatagtctagcatagcgattactaaccggtaaaccttaatttacaaatagacgatctaagaaattgatacttagcttaaaaaaacggcaagaacgacaacatgtttaagccttgcttgtcgtttggtgttcttgtcgtttttagcttataatttaaggcggattaattaggtggtgaatctattgggcaagactattcgacaactttcagaagaattgagattatcaaagcaagctattaatcaacgtattaatagcattaatggttttcgaagcaaacacactcacaaagttaaaaaccatctagaaatagacaaccaaggcgttaaaatgcttgctaatttcgacaagcaaaaacgacaagaacgacaaccaaatcggcaagctgaaaacgacaaggacaaaaatattgatcatatcttgctgaaacaacttgatgttaaagatcaacaaattgcaaatttacaacaagctttagatcagcagcaaaaattgcagatagcaacggttgcagaaaaccatcgattaaaagaacacgttcagaaattgagtggtttgcttgaaccttctagtgcaactcaacaacaatcaaacgacaaggacgataccttgtcgaatagtgataattccaggcacatcaaggataaaaagtacaaaaataaacctaataaaagttggtggcatttttggaaaacaaagtgaagtggggtggacaaattaatttgtgaactattcagactaataatccgaattgttgtatgcaactaagctagcatttataaaaaattgaagtattaaacacataatggatactaaaatagactatcctaaatacataagagacgaacaacttacttggataaataaattgaataaatagcgttaacaaactagtgacggctttggttcaactgcgaacgtaaatttaaacactagtaaagtcatggcttcaatggtatttataggaatcttgcttgctcgttaataaggatctaaaataagttcttaaagagttaatatgctaattaaagcgattagaaattttgtgaggtgttattgtgaatgataaaaatgaaataattaaaaagccatctgatgagtcggggaaccaacttaaagttgttagtaattttgagatttttttaaaacagttggggttaccttctgacaatattttggctagcgatgaggacaaacagatagttgcgaataatattcaatcgttaatattaaatatccccccctcacagagagagaatgcatcttatttggcaaagtttgtctcaagtgtggcaattggtagatttgattctgcacttaatgatctttggaatgaagtcgtcaatcaattaagaaaatcggttgttctttatggtattgatatattttttgatactgctgttcccaataaggatagagatgattattcaaaagaagaggatctttcaagtattaaggatcgaacccttctagacgtatgtttgaagcttgaaattttaagtgacattgtttataaaaaattagtatatattcttgatatgagaaacaatattggaggctcgcatcctaacaatggaacaataaatgcatatgaattgttaggatggctgcaggttagtgttcaagaggttatttcggttaaaccttctgaaggcgctataaaagtcaaaaaatttgttagtaatcttaaaaaacaaacgtcagaattttcagaaacggatgttcaggtaattaaattgtctttaagcaggttatcaacggttttgtcagggaatttgctaaaaacgttgtttggaatgtatacagatccaaagatttcaaatgaagttaaaattaatatcattaaatttgcacccacaatatggaatctagcaacgaatcaagttaaatatgatcttggtgcaaaattagaaactttttctataaatctcgaaacagaacgtgactcttttgggcaacaattttttgcaagcgttggaggtaataaatataaaacaccgactagaaggagtcttgagatttctaatatatcggcagacttacttacagcacatttttcttgggataactatatgggagaaacgccgaaagcacggcaacttatgagttatattgatgactcaagtaacattcctattgagcgacaagaagacctaatcaaaactttattgatttgtcgaattggtaaagaagtaaactatctgcatggtgtttctgatggaggaaggccttactataataaattttttaaattactcaatagtgatcaaataaggataatgttaaagcttattcaagatcaggatatattaattaatttatctacaacgattcgaagggagaattttttggaaattttggaaatgttaccgaaatctttaaccgacgaaagagttcaagaaacgcttgattatcttaagcagggatctttatcctttgataaaaaaataagggatagtagatttaaagatctagttaaggggttttaagtcattgaaattttaatgtgttttagaaaaattttacgaaactcttcactaaccttgaggggtgttacacgttgatttaacggaagtatactttttggggttctggcgcaggaatgatttcaaaggaagaaatggttctaattattgctcaaattgttttttcggctaaattattatcaagtaatagttattccgcgatcattggagctattatcataaccacgatcgcagcaccatttatattaacgcaacaaattaatcacgctaaactgataatcaaaaaacacggtctataattgacaaatcgcccctcaaaaacattgttaaaataacccccaatatctataatgtagatgttgggggttatttgtctttatatggtataaatgacttcttttattcgtcattttttcgataccttttggaacgattttgaccaggaaataaacgatcatgcgatccgactcgaattccaattaagactagttcatctgtatcaatcgtataaacaaccagaacatcgttagtttcgcttggtgttttgtttttcggggtgtctcgtaaatgaaattcattatagccgctcattcgccgattaagctcatgatcttcaaattctggtggtaattgttgttgctcaagcaacaggtcaatggctgctcgaacttcatcaataatagatttgtctaaactggctaaccgttttagatcagcattaaaggttgcacgtggtttaaatcttagttttttcattatttaaactgaccccaataatcatcatttgattcaacaatttcatcatcaggtaaaacatgtcgtttaattaactgatcacgcgcaatcgcatattctaacgaaccttctttcgcttttaatgctctttctagccagtccattttttcttgtgaaacgatggccactgctcgactatttgaacgagcaatataaacggtttcgtcttcgtcattaacttgatctaaatatttttttaggttagcgcgaaaatcgctctgtgttagtgctaatgtcatatttaccaccctttctttgtactcaatattgtactttaacttgtactaaaaatcaattttttgaggagttaaaactatgcaacaagttgtcttacccatcaaagattcaaatgttctcaaggaggtgcaagataccttactcaacaactttaaagctggccggcgtaactatacagtttttcaagttggcaaagcgacactgctgcgagtcagtgatgtcatgcgcttaaaacaggccgatatttttaatccggacggttctattaaacaaaatgcgtttattcacgaccgaaaaactggtaaacctaataccttgtaccttaaaccggttcaaacagagctcttattgtaccgtcaatggctgcttgatcatcagctggattctgaatggctctttccttcaattcagcacccagaacgccatatcacagaaaaacagttctacaaaatcatgagcaaggttggcgatctgttaggaattaattatctagggacccatacgatgcgcaaaaccggggcttatcgggtctacacgcaatcaaattataatattggcttagtcatgaatttgctcaatcattccagtgaagcaatgactttagcttatttaggcttagaccaggctagtactgaaacgatgctggataaaattgatttttgttaggaggctggctttatggatttagattttgaaaccaacaagtatgatctttttgatgattggcatcaaaacaagactaaacaagcctttacacaaaagttgcaacaacaagctcaaattgaaaaaacacaattaccgcaattattgtcgcgtgaagatttaaaaattcgttggcagatgaactctcgtcaaagtgtccatcaagttgctagtaagcctgattttccgcaacccgtttttgcttttaatcatggtaagacgccactttacttagcaactgaaattcaaattttcgaaattaatcacccttgggtaataactcccggtgctcgtcttgcttatagtcattggatccttcgtaatgtgattgattaatcttgagatttggctctaggatttttatcgttggcgctagccttctaatacaaataatccccatcaaaatggggattaaatctacccttgacaagtgtcaagggtgtaagtgcgcattgacctcgtttcactcggtctgctgattacccatcactaattttagtgttctttatctagtttcattactaggcctgctttaaacacactctttagccataatagctctcattgattcgttattaattttaactagataattaaagcaattaacaacatgagatacactgaaaaatggccagatgagtatctttttacaagaatatcaattttatatatcccttaaactattttttgcttttggtcttatggctaaatggaataatagcaaggccaagacatatagcaaaaacaagagtcgatctaatcaaatcatgatcttgattatcaaatattgcactataggctaaaaacaagccaatcgctaacaaataacgaaaaataacaatccaaatttttttgctcataaaccccgcctcctagaacaagttgctcatactcagtttaatcaatattaaaaaactattcttgctaattcatgtagctaaaaaagagcatagttccccctggagactgctaagcgcattttttagccaaactagtaatcaatgatcattttaaatgattagcccaatgactcaggttggctaagccggtcaaaaatgctcactgattattcgtataagcagttttatcgctattttaatataaatatacggataacggctaaaatggctgagaaacgattttagagctaattaaaggggactacttgctggctgcttgtttcaggatgttcagcttgatatttagcgttggcttttttgttccagtaaatgccaaacagattttgcatggtgccgtataagtagttctctacgttcttgatatgtttctcgttgcttctcagggcattgaagtagcgtcttaacgtcttggtcattagaggctttagttcgggatcatctaaagtaatccaaacgccgaggtctttgtgggctttttcaatggcatacttagcatttaagataatgccaatgaagcgccgcatttgttgcggagtgcggcaccagaaacttagtaattgcacggcttcgggttctaagaaaaccggtaagccactgtcttcatcagttaagaagtcattagcatggttcaccaaatcctggttttgcttttgaatttctgctggtgaaaaatgggctgtggaaaagtccaacttttgagtatctatattgtatctattagtatctatgtttttaaagtctttatatagatcgtgtccgattttcggattttcgctcgtagcaagggtttgcgggttgtcgtcaacgaactttcgcgaatgtccgattttcggattttcgctcgtagcaagggtttgagcggtctcccgcgaacgtccgattttcggattttcgctcgtagcaagggtttgcggctctttttgagcatattcaccgcgtaaatagacgtcagttgactgcatatctagttcggccaggtaaagtcgattgggttcatttttccctgttttgggattaaaatgcatggctttttgataaagtagtcctgcacgttccaagtcttttttcacggctgctaacttatcatttgagcagtcgaataaatctttaagttcttgattggtaaaaataaagtagacgtgcccttcctcatcaatccagtgattgcgtaaagaatactctagccggtcttttagtaccatgtaagctagcttagcggcatcacttaatcctcgatattgctggctatacatcaatacttttggaaactggaagaacaaggccccataaacgttatcagcttgataaaacttgaaatttgtttgatccattataaaaactccctttctatgtccgacccatgctggctcaaaagagagttgctaaaacatctgatttgttttaaaatacaaatctgatatgctctaactgaattacaaagtattcattggttgtgagaactttgtaatttatcagcatggatcttgcttggttgcccattcggcaacttttttaatttgaacaataaaataaaaatggactaggtagcttctactagctacttagtccattggtttcaattttgttttttaactatccgaaccttgtcctcatgggctggtctgcggtataattaccttacaaagttaaaagcaatattcagtcgattttttccgggaagtcaaaatcgactgaatctaagtagctggtatgagctacttgctaat

SEQ ID NO: 175 - DNA, 9243 bp, Lactobacillus buchneri
ggactcgttttgagcacattagtgctcaagatttaacgacgacgttactccaaattaaccagcgaccgcttaaaatactcgactggcaaacaccgtatcaggttatgctgacaaatttgtccaaaaattcggattaaatttgcaatctaccaaatatcctttttcatgatctttcacctgtcttagattttagaagtatcacttggtttctcaattaacttaaaccgtcgctgctgcgtgcgtttactaatccccgtctttcgttcaatcatcttgtaggtcatgccttgttttcgcagctcataagcgaatctgatttgttcatcagaatacgttttcggtcgcccttcccgaaacaacggatcatgttgcttggcatacaatttaccttcttgtgtgcgcgtgacaatcatatcgcgttcaaactgggcaaaggcgctaaatattgtaaagactaattggccagtcggcgtattgtcaattaagcccatattcaaaatgttgactttgacattttctttaaacaactcttggataatggctaaggcctcgcgcgtgttccgtgcaaaccgatccagcttagtgacaatcaaagtatcacctgtttttagagcgcgcaacagtttttgaaactccggtcgttcggtagttgtgccggtaaacttttcttgaaagattttttctgctcctgccaattttagtaactcaatttgatttgctaatttttgatcagtggtactgacccgcgcatagccatatttcatctttttatctccttacttatgtcattaagtaatgacacggttctaaccctttaattatacagtatcaaaaaagaggccacaactgttaagttgtggcctggctagttctattaattataaaatttgttagtaaacaatcaaaaatcattgtgaagtgaacctaatttattttgtacgaacagcattcagattaattttacaatctaacttttaaaaatcggaataagtaatgagaatcctgatcggattcttttttgccattcatgtgataaaaatatctaaattaataacattcaatttttttgaatgttattttttggggctaaaaatacatcatcagggtatgatgaaaatctctgcgtcaagtgttacgcactgtttctagattggaatttttacaaatacagttcaaacaatggatatgaatggggttgacttaatataccgctggtggtatatttttttgtgaaaagaataacaaaataataaatgaggtgttcaatatggcaaagaaaatacttatcattggtggtgttgcaggaggcgctactgcagcgacacgtcttcgtcgtttaaatgaggatgatgaaattattttattcgacaagggggaatacatttcgttcgcaaactgcggcttgccttattatattggtggtactatcaaagagcgtgatagtctaatggtccaaaccgtagagggtatggaaaaacaatatggcttagatgtccgtaatttttctgatgttactaagatcgatcctgaaaaaaataccgttaccgttcataatacgcaatcaggtgagacttatgatgaaagttttgatgaattgatcatctctactggtgctaagccaatcgtgcctaaaatcaaaggtttagctgatgccaagaatacttttactttgagaaatattcccgacatggatcagatcaagaaatatattgctgatcacaatgtgcaaactgccacgatcattggcggtggttttatcggtctagaaatgatggaaaatttcaagcagctgggcttgaatgttcagttagttgaaatgtcatctcaagtaatgccgaacttagatttcgaaatggcacaacaattacattcacaaatcaatttacataacgtcaacttgtatttgaatgacggactagcagaattccaaaatgatggcaaaaaattaattttgcaaagtggcaaagaacttgagacggatatgacaattttgtctatcggtattactccagctaacgatttagccaaggatgctaagatcgagctgggattcaagaatgcaatcaaagtcaataaacagcttcaaactaactatcctaatatttatgccattggtgacgtgatccaagtcaataacttagtggatggttcagagaccaatatcccattggcttggccagctaatcgtcaaggtcgtttagtggctgacattattaatggcattccggcagaatatccgggaacacagggtacatctgttgccaaagtatttgaactgacggcagcttcaacaggtgacaacgaaaaaaccttgcaacgtcaaaatattccttatcacgtcattcacattcatccaaattcaagtgctggctattatcctggcgctagtcccatcaatctaaaactactttataacgatgacaagcagatattgggagcacaagcagttggaacaaaaggcgttgagaaacggatcgatgtcatttccacagcaatgagatttggagccaaagttgacgaattgagctcgatcgaattgtcatatgctccaccatattcaagtgcaaaagacccagtaaatatgttaggttacgtggctgataacgagatcaatcatcggactaagactatcgaatgggatcaagttgatcgtttggtggatgagaaagctacgatcattgatgttagaaatgactttgaattaactaccggtaagattccaagtagtaaattgatcccgctcaatcaattacgcgatcgtctcaatgaattaccaaaggacaagacgatttatgtctattgccaggttgggttgagaggatacaatgcctcaagagttttagctaatgatggttttgacgtggtcaatattgatggtggtttcaaaacttacaagatcgctaaatatgagatcaagaataaacctttttcaaaaaataaagtcaaaacatccagtggttccagttcgaacaatttaaaaacactacaagtagatgcctgtggcttacaatgcccaggtcccattttaaaagttaaacaacacatggataaaatggacgatggtcaaaaaatggtagtcaaagcgagcgattttggctttagcgccgatatcgagtcatgggccaaaaataccggaaataaagttctttccaatgatattgatggtgatacagtagttgctacggttcagaaggggcaaggagcaagcactccagttaaacaagatcctgaattagctgccgaattagctttaaacgatggtcagcttcatgaaactaaagaaggagcgactatggtagtctttgatggtgatctcgacaaagcactagcttctttgataatcgctaccggagcggcagctatgggtaaaaaagtaaccatgttcttcactttttggggcttgaatgttttgaagaaaaacaaagtcaagaagcacggtgtagcaaagatgttcgacatgatgctaccaagtggagcagacaaattaccactttcaaccatgaatatgggcggtttaggctcaaaaatgataaaatcagttatgaagaaaaataacgtcgatccactcccagtcatgatcagaaaagcaaacgacttgggtatcaaattcgtagcttgcacaatgagcatgggactaatgggcgttaaaaaagaagagctttatagtttcgttgagtatggcggtgtcgccacatatcttggagacacagaaaactccaacctaaacttattcatttaagtagaaagtaggaaaatcatggatacagttcgcagtgaagaagaaacaaagaaagtcatcaatcgtttaagccgggctgaaggccagatccgtggcatccaaaaaatgatcaacgatgacaaagattgcatggacgtaatgacacagttaagcgccgtcagatcaagcatcgatcgcgtaatgggcatggtagtagccaacaacttgaaagattgcgtagaaaatccagaaggtgacccagcagctcaatcgaaaaaactcaaacaagctatcaacatgatcatcaaaaaataaaaagtcaatcaaaaaagtcatcaagaataatttgatttgaattgacgaaataattaatcaaaacagttaactactataaaacaaactacaaccacaaaaaggacctgaagcacccaatgcttcaagtccttttttaataaacctttaatttacaatccaagtgcaacactaattgaataaaaaaagacccataacgggtatgaagggctccgataaagttagacaaaaatctaattgaatcggagtccttttctgtatgtcaaaatatactttagaatttaaaatgaaaattgttaatgagtatttagagggtaattatagttataaagatttggcaagtatgaatggcctgaatcattcaatcattgtcagatgggtccaacgtgcaaaaatcaatggaatgtcagcactggcatccaaaaaggcaaaacgaagttttagtggtcaagataaggttaatatattagactacatgttaactaatggcttaagtttcaatgaaacaggtgctcattttgatgtggagcccagtttgatttatcagtggaaaaggaaatttgatgaacatggcattgatgccttacaagccaaacgaggaaggccatcaaaacaaatgataaaaaagaaagcaatcccgaaaaataaattagatgcgttgaaacaagagaacttggaactaaagcaacagcttcagacagctaaaatggagctagccgtctcaaaaaaattagaagccttagcgatcaagaaaagacgacgaaagaacaacttacccaagtagtacaatcgttaaggcagcaattcgacctaacggtcctcttagcagttgtaggattaaatcgcaaaactttttattatcatttaaagcattcccacgatgataaatatcgtgaagtaaaagatgtcatccaatggctttacgatggtagcgaggagacttatggctatcgtcgaatgcatgtagaactattgaaaatgcagtttacgtatgatgacgatacggttcgtaaaatcatgcgcagcatggatttaatgcctacgtgctattggataagatctggtaagttttcttcgtatcgtggtgaacaaggaaaagttgctaaaaatatagttcgagaaaaatatgtcatcaaacagaaaaagtcgtttaaatttgttgtagaacagccgtacgatgtattgacgaccgatgttacccaaattaatatacttggtactaaactctatttgtccgccgttatcgacatgtacagtaaagaagtattagcatttgacatacgaaactcaccaaatgctgcccaagtaattgcgtgtttagatcagctaaaagaggtcttgcctgaagatgtaactccagtactccatagtgatcaggggaccttataccaattagatggatatcaaaataagttaaaagaaattggtttatctcaaagtatgtcccgtaagggaaattgtctcgataatgcaccaatggaaagctttttcagtttagcaaaaagagaattcatctggcgtaaaaatttcaaatcagtcgaagaatttaagcaagcttttgctaaatacatctcaagattcaacaacgtgcgaatttctagaaaaagtaagggcctgactcctgtcgaaattaggaatcaagcccttacagcctaaaaatattaatataagtgtctaacttttttagagcccatcaaattaatgagtagtgctttttgatatgcaattggcataaagatctgaataaatagaaagttaactatattttagagagcgtaaaataacttgtgtaaacgcataaaaagatttctaaattgtatagaactagggaatgaacttaccacagaaattatcgctacgctagtccaaaaacaagatttagacgaagtttttcggcaccacctcgaaattgcgattaaccagctgcttcaaaccgaactggcagcttttttaggctatgagcgccactcgtatgctggaattaacactagaaataaccgcaatggcagttatgaacgctcgtttgatacgaagtatggtcaactcaacttaaccattccgcgggatcgcaatggtattttccacaaccacatcttgccagcctacggtcggcacagtgacagcttggaaacaacggttattcagctatacaccaagggaattaccaccaccgaaatcgcctaactcattgagaaaatgtacggtgctcattactccaaagccacggtttccaacatgaccaaagtcgttgatgaacaagttcaagctttccagcaacggcgactgccttcgcaatatgcggccatcttcttagatgccaattacctgcctttaaagcgggacaccgtccaaaaagaagcggttcattgtattcaaccaacttgattgcgaactttaacaagcatctcaaacgcaaccccaaccacaaagaacaatttccaacggaagattcactgaatcgattcctggtttctcagtttaacgtctacaacgagaagtccatgaagcgaatccatcgcggattcaacggacttcaggacaccctggaatcatcctttacttaaattaactacatattatatgtacgtaggtatttaatttacacaagattcttgacgatatccacatttactcaatagattaatatcaaatggtgaaaatcaacgaaaaaaggagatctatcaagcgatctcctgcccaataaatctcctcttacataaagttatttatgaacactgatttaagctaagctgccgatatcacaatctcaccatccactaaatcagccttcaagtttttgacatctaagtggtcaaggtagaaatccgttaccttatcacgaatttgctgttcaattactcgccgtaatggccgcgcacccattgcttcatcatagccttgttccatcagccaatctttggccgctttagttacctcaagtttgatggattttttggctaacgttttttgtacatccgccaacatcaaatcgacaatttgacttaagtcttgcttagtcagatgtgaaaattccacgattccattaaaacggttcagaaattctgggcggaaaaatggtgctaacttatccattaatgactgatctcgttgcttgtcaccacttaatgcttcattaccaaagccagcattagaagtagcaataataatcgtatttttgaaactaatgacattgccttgtccatccgttaagcgcccatcatccatcacttgtaatagtaacgttaatacttgtggatcagccttttcaatttcatctaataatacaatggaatatggattacgccgcacccgttcagttagagtattagcattatcttcatagcctacgtatccagccgaggtaccaattaatttcgacacagctgtacgatcagcatattcactcatatctagccgaataatcgcattttcatttccaaacatatctaaggctaattgcttagctaattcagtctttcctacgccagttgggcccacaaacagaaaacttccaatcggctgatcaccctctgaaaagcccgcacggttacgccgaattgcttttgctaccatttcaaccgcttcatcttgaccgattaccttacttttcagacgcttatcaagatttttcaaatgctcaatatcattagcgcccatatcagaaactggtataccagttaaacgttcaaccgattgtgccacatcatcaatcgtggcagtgattttttctttttgatccgtttctttaattttttgcttggtttcctcgatcgacttcttgatatcagcggcttttttaaagtcctccgatttaacggcggcctccttagctgcctctaattttttaacgcgttgatccaatgtctcaacatcagtttgcgaatttttagccgctaaatgagccgcagtcatgtcgatcaaatcgatagctttatctggcaaagtgcgttgtggtatatattggattgaataatccacagccgccttcaaaacatcatctggtaatacaacatgatgatgcttttcgtacagctttttaacaccttgtaatatacgtaaagtgtcagcggccgtcggttcattaatcacaacctcattgaatcgccgtgccaaagccgcatttttcaaaatagtattgcgatattcatcttgagtcgtagccccgattacagtcagctcgccacgtgacaaagcaggtttaatgatatcagccaatcccttgccaccgtcttcaccaccagtggcacccgtgccgataatctgatgaatttcatcgaagaatagaataatattaccagctgctttaacttcctttaccagctgtttaatattctcttcaaaagaaccgcgatattgagttcctgcttccaaagacgataaatcaatcgaatagatttctttatcttgaatcgtttctggaactttaccagccacaattgcttgtgccagaccttcgacgactgcagttttacctacaccggcatcaccaactaagattggattatttttcgttctacgactcaaaatttctgcagtttcttgaatctcattctcacgtccaatcactggatctagtaatccatcacgagcctgttccgtcaaattagtccctaacttttctaaaatccctccttttttaacagcctgtttaccatctttagatacttctattgttttattattttggggtagcttaccagttgctcggtattgagcaaactcatctggtgtcaacgattttccattaactaagtaccgtgcacgctccgaattttgattatccatgcgccgaaataattgattgaaaacatcatccatatcattgttgaaaaaaggatcattttcgtagaaattcgccatagtacaacacctccataaaaatttacacgtgtgacttagtgaccataatatcctttaaaacttcagctaattgtatcacgatttttatgtatcattaagtaaagtgcttatcggtgtattaaacgagatactttgaaataccattacaacaaaccctttcaggataaattgccgttaattagtatatcaaaatataatatgtggtagattgcaaatttaatccgaatttttggacaaatttgtcagcataacctgatacggtgtttgccagtcgagtattttaagcggtcgctggttaatttggagtaacgtcgtcgttaaatcttgagcactaatgtgctcaaaacgagtcc

SEQ ID NO: 176 - DNA, 34500 bp, Lactobacillus buchneri
tgaagcttccagatcctggcggatcaaatcgaattgttgccgagaaatatcgctttggtaatgatgactaaaatgttgcatatgatcaccaacttttttgacagtagtttatcaaattattgggtcaaaatcaaagatactaaacagcttctgagatggcggaaaacagaaacggcagtaccaaaaaggcggcaaacaagaacagatacatttccgctaagccgataatctgtcgtcgaaacaggaatttggtgactttatttgtcttcattcttggcactcccctcatattgattggttagaaaaataaacagtttctgcaagtcaaagttggacagctggactgtgtcgggcaggatgcggtcgtcaaggtcaccatagacgtagttagcccggatggtgcccatcatgtcgtggccaatgacgtttaagcccttggtatattgctcgacgtctttttctggtcccacgaccgaatgagtcttggccaagacgtcttcaaccggctggtttaaaatcacccgcccctgatccaagacgatcacgtcactgataatattggcaacctcttcgataaggtgggtggaaacgataaatgtccgcgggttatcggaataggattgaatcaattcactgtaaaagagttctcgatggttggcgtccaaccccagaaccggctcatccagcaagacgtatttgactggaaggcacaaggccaaaatgagtttaaaaatcgagttgtaaccggtggataatttaccaaatttttgattgatatccaagccaaattctttgatcaagtgatccgctaattcatggttgaatccgccatacaaggattcggaatccttgagaatttgggtcaacttccagccgtcagcgtaaagattggcctcgctcatcaaatacatcaaacccagctttgagtcgttatcgctgacatcctcagaatcaatcttaacttcgccgctgtcggcaaaaatccggtcggtaataatactgagcagtgtgcttttcccggcaccatttcgcccaagtaagccgtagattttgttgccgtcaaatgacaaattaatgtctgacaagacgtgcttagacccaaatgatttcgagacgtgactgacttccaatacgctcattgctggtaacctcttttcactaaattcaataactcatcttcagaaatatccagattctgggcttcccgaaccagattttcgacaaactcgtcaaaaaagccattccgcttttctgccaagattcgctgcctggcgcctgcttggacaaacatccccagcccccgccgtttttcgatcaaattcttagcagcaacgatgttcatcccttttaaaacggttgccgggttaatatgaaactccttggaaatttctgtcgtcgacggaatctggtcgccttcagcaaaccctcccgaagcaatcgcgtcctcaatttgttcggcaacctggcggtagatgggctctgaactattaaactcaaacttcatatttatcaacccattctataatttctttcatttaacgctccaccttcgtctttggaaccacaattcgggaataaatcaggacggtcaaggcaaagtaaatcaagtagaggaccaagaagccgactgtcgtcagtccaaaggtttggtaggcgccacccatcaatagaccactcttggcgaacatttgaagtccgaaggcaacgtcgacgattcccaaaattcccggcagtgcaaacaagcccagaatttgaacaacaattgagtgatttaagaccgatcggcgagttccaatcttattgagcatatcaaagcggatcttgtcactggctgccccactcaaaatcttaaacattaggcagctggcgagcatggccagaaaggcaattcctaagaagattcccataaactcaagactgccaaagacactcttcagggattgatacatcgtaaacgaaccgccgacctgttccccgtttcgatagccgtactgcgtggactgaatgttggtaattttggtgagtggcgttgcggcagcgtccatatcatttgcgcgaaccaacaataattgattggtcttggcattaatttgattgaatgcctgagaactgaccactttgatttggtaggctttaatcgttggtacctgcagtccccacagctcttggtatgccaatgaatcactccgtttgaactgggaaattttggcggtaaaagcctttgatgccagtgtctttcgactcacaaacgccgcgtacttcaagggttggcgctgaagctggtcactccggtaataaacccgcttggtcgtcggatcaactttttgttggtaagtgacagtggatttatcttgaatctggccaaccagtgaacgcatttcctgattggggttggtaatagcaactgaatagtagccatttccggaagctaatttgggtaccatgtgttgaaaaccggttcccacagtaattgcccctagtgacaacgcaaacagcagcgagacaactgaaaggattttggtataatcacgaattctaaatttaagctgggccaatgtgaaactgttcaggcccttggtgctcatattagaacgttgaaatgcctggagcagcatcacaaaaaatgagttgaagacaaagtaggtccctagaacaatcgtgatgagcgcgattggaatggacatgactttcagtttttgaatgtcatacatcgcataatatccaccggccaagagaacaactccaagaattgcttgaacgccaagtgtcaaggccttaggctgctgccaatcactttgctgtccggaacgcaaaagctgcagggcggaggtcttggtgaatgtcctggcatttaagaaaccagcaaccaggaacaaaatcgcaaacaggataatcgttgcaatgacagctggcatataaaatgccgagaaattagtcaatgacatgtgaatgaggctggccagaaaatggctgagcacttgggtaaagccaatgccaatgacaatcccgacaactgtggaaattaaaccgatcgcaatggtctcaaggatgatcaatttactgatgacccctgatttggcccccagcatcatgaagagtccataatcatgttcacgcatactcatcaagaaattattcgcgtaaaaaacatataccagtgtgatgattgccagtaagatggatccgaagatgaaaacgatcttggcattttgtcccaccgcactgctggtggtaaatttatcatttgttgaaattgcttcaaacatgtagaaaatggctgtggtaatgatcatcccggaaaacagaaccagataatctttccaacgagccttgattcctgagattgaaattttaaataacatcgctaagctcctttgattgattactgttcaaatgtaccgagtttttcgaggatttcctgatagaattcatttctcggcttatcgccggcgtctacctcatcgccaatttttccgtctttgataaataaaattcgtttacagaaactagcggagaacgggtcatgggtcactaagagaattgagaccccctgttgattgatgttcgttaaggtgtccagtaattcacgggcgttggttgagtcaagcgctccggttggttcatccccaaaaataattgacggatttgacactaaggctctggcagcggcgacccgttgcttttgcccaccggataattgcgttgggtacttactcagcaagtcatcaattcccaacttgctggcggcttccttgacagcagtttggatggtggccgccttggcattttgaagcgacaacggcaaagcaatattttcttgggcggttaaggtttccaataagttaaagtcttggaagatgaaacccaattttttagaacgaaaatctgccatctggttcgcagttaaatgagttacatcttggccgtcaatttcgaccgaaccgctggttggttgatcgagagttgccaaaatatttagcaaagtcgtctttccggaaccggacgcgcccatgattccgacaaattcgccctcgttaaccgacaagctgatccctttcagagcttcatatggttttgcgctgtctttatcgtaggttttgtgtaaatcttctgtttgaacgattttagttgtcataagtgttcctccgtgcgttagttaattacttatgtaactaactatatatgctaagaatccggatgtcaaccaaaaacaaaaaagcgtgggccaataagtggttagcttccagagtataaggggattacccgaatatccggaatttggatgtttgggtaatccccttatacggccggaagctgcttattggcccacagttctgctagataacattcagcctcttaatcgtctaaaagcgttaattaatctagattatcagtattaatgacattctgggtccctcgttcagtgatgatggagactaagacgttattgatcattttcatccgctgttcatctgtaatcgatgatcccaaatccttttgcagctgggaaacggcatcctcggaaatcgccacggctccttgaacaataatttttcgggccgacaaaatggcggttgcttgttgtcgctgcagcatggcgttagcaatttcagttgcatatgccaaatgcgtcaaccgggtctcaatgatctgcagaccggccacatccaaacggtcctggagttctttttgcaacgccacggaaacttcggttgcgttcccccgcaaggtcaatttgtcggtactgtcgtcaaaactatcataaggatactggctggcaatatgtcgaatagcggactcactttgaatctcaacaaactgttcataatcttccacactaaaaattgctttggcagaatcaacaactttgtagacaatgacagcggcaatttcgactgggtttcctttggaatcgttcactttgataattgaactattaaaattgcgaacccgcagtgaaatcgtctgcttgctggtcaatggcacggtcatgaataatccggaagttcgaattgtcccaatatagcgaccaaagaatgtcaacactttggcttcgttaggctggataatcgttaatgaacttgcaaataacaaatccaaaacaatgatgattgtcccaaaaacgatcgagccaattgagctgccttcaccgccaatccaaagcagataaccgccaactcccagcaaaatcaaggcaataattaagcccacataaccattaacatgaaatacatttttctctttcaaaaaagccgccccctataaactcggattcgtaaacaattactaattcaagtatatagcggacggcttttaattgatattaattacttaacattcttctcgggtaaaacggcacctttatagtgatgcaagatccatttttgagtcttggttgattgaagaaccttgactaccttcttgatggctggcttgttctgatcacctttacgggtggcgatgatgttcacgtatggtgaattccgtttttcaatcgcaattgactgcttaattggattcaacccggcaccaacagcgtagttggcgttgatgacaactgcatctccttcaccattcttataaatggttggcagtaattttggttcatagctgtgcttgaatttcagatgacgtgggtttgaagcaatgtcactgaagttggcagaagtaatgtcaatgccctttttcagagtaattaagccggcgtctttgaagatctgaaggattcggccatagtcgggaacattgctgctgacgatgattgtggcccccttcttgaggtcttgaagcctcttaactttcttcgagaaaacagcgatcggttccaagtgaacgccaccggcattgactaatgtcccgtggttctgcttgttccaaagtttcaggaatgggacatgctggaagtaattggcatccagttcgccgttggccaaagccttgttaggcattgtgtagtcttggaaagtggtaatcttcagattgacgccttcttttttaagttctggggccacgtggcgcaaaatttgtgcatggggcacggctgaagcaccaatttttaaagtggtggtctttttgctggaattagacgatgatgaacaccccaccaacaaaaaggcggtaaagacaactgcgaataaactcaataatttcttcttcatttgaaaccctcccaaatattataatgtccgtttgtcggtaatcttgacaaagacatctccgacaaattggacgacaaatacaaataaacaaatgatgaccgttgcgactaaggtcactgtgttgttgcttgcctgaaacccatcttgataagccaagtttccaaggccaccggcaccaatggcacctgccatagcggtgtaaccaatcaacgaaatggtggtaacagtagctccggcgatcaatgccggcttgctttctggtaacaggaccttggtgataatttcccaggttgtggcacccatagattcggcagcttccaagaccccggaatcaacctcacggaagtaggactcaaccatccgagcgtaaaaaggtgccgccgaaataatcaaggatggtaacgcggcccgcggcccaatgatcgttccagccaacttcatggtaattggcagtaacaaaatgatcaggatgataaatggaattgaccggaagatgttaacgaacaacccgaccagccaattgagaattcgatagccaatgcccggcttgttgcgagtctcgtataagatcaaccccaaaataattcctaaaataacaattgcaaccattgataacaaggtcatccaaacggtttcccaagttgccgacatcatcgaaccccaatcgacgttatgaaactggaagtaagatttgaatccagttgaattagccatgatgaatcacctccgttccaacccgcatcttcttcaggtattccaaggcatcgttaatttgattgtcatcgccgacaaattgcagatccagcgaccccaacgcgccttcttgagtttgatgaatcgcccctgaaataatgctgatggttaattccgggaaccgtttgacaacatccgaaacaattggcagttccgcctgtggtccatggaaaatcagtcggatgatttgcccatcaggatatttcttaactaattcatcaagggtcatcgtgttgtcactttgttgtggtgtaaattcttcactgacaaactttttggtgatttcttgttgtggatgacggaaaacctcaaacactgatccggtttcaacaactttgccgctgtccataactgccacccgttcacaaaccttggcaatggcgtgcatctcatgggtgattaataaaatcgtgaggttcatttctttattaatcttcagtaataaatcgagaacttcattagttgtgtcaggatccaaggcactggttgcctcgtctgaaattaagattgttggctcgtttgccaaggctcttgcgatgccaacccgctgcttttgaccaccggataactcggaaggataggaatgctcacggccctccaaaccaactaacttaattaattcctctgcgcgttgctttcgtttggctttgggaactttggcaatctcaagcggtaaagcaatgttgtccagcaccgttcgtgaccacaataagttgaaatgctgaaagatcataccaattttttggcgttgctttcttaattggcttccgtggagcttggaaacatccgtgccgttgatgtcaatctcaccggttgatggcgcttcaagtccgtccagcattctcaccaaggtgcttttcccggcgcctgaatagccgacaatcccgaagatctcaccatcgttaatctcaatgttgacatcattgaccgcggttagaccgccatccttggtactgtactgtttggatacatctttaaatcgaatcaatcttttcaccccttattagacaaaaaaagcttttcatcctccataagtcttaattgacttatgaaaggacgaaaagcttcgcggtaccacctttattcgcgattgtctttcaacaatcgcctcatgagtatcttcatactcaacgaaataatggtcgttacccattatcggcttgcaattgctcaccgacacatttttaaccaagaccatcttcaataacgatgattgaccctttcccaccagccgggctctcttgacaatctctaattatctactcatcttgtaatttttctatcatcaaactatcagttagtgtacctaaaaaaggtcctagcgtcaagaacttttattttttaatcttagcaatccatgaagttgccttgtcagtcccgtttagtactgaagggtcattaacggcattactgttgacagcagtcactttcccggcaactggacttgggatatccgaaacggctttgtcagcttcaacgtttaataaagtatcgctggtggttaattgagcaccaacctttggaagggaaacaaaagtgatgttacccagttcgttcttacctgcttcggtcaagccaactgtgacttccccgttattttcttcagtccaataatattttgtatccatcattaattccaccttttctaaaaattatgagaattctttgtcttctccaaacatgtaactcttattatgatactgcattgacataattaagccaatcccaatcatgttcccaatcaacgccgatcccccggcactaacgaagggcaatggaataccggtcaatggcaacaggccaatactcatcccgacattttcaaaaacatgaaacagaatcatcataatcacgccagtggaaatgtaagcgtaaaaaacattcctcgtatcgaatgtaaccttaatcatttgataaatcaacaggaaatacaataaaatcaaaatacagctgccaataaatccaaagttctcgccaataaccgagaaaatcatatcagattctcgcaccggcacatacacatgtgactgattaaatccggttccaaaaatcccaccagatccgatggccttcatactctgccacaactgatacccctgattagaagtatcggctgacgggttgagccaagtgtcaactcgggcaaactggtaggcttgaaaaccaaacttctccaacagatgacgcccggactccggaataaccaaagccaagatggttccggcaaatccaaagatggtaatcaccgctggcagaataatccgccatgtcactcctgaaacgatgatcaagccacctaagatggcgaagaaaaccaacatcgttccaaaatcattttgcagctttaacaagacggctaccggaactgtccacagcaacattttcccaattaataggaaatcacttcgaacagtcctgattgggtaattatcgttatgttgaacaatcacccgccccatcatcaaaatataggccggtttcatcacttcagacggctgaaaggtcaacccaaatagggagaaccaacttttggcacccgtattaatgtaataggtccgactgtataacaccaggacactcgccagcagggcaatccccagccagtaagtaatcggggcaactttccataactgctcggaatcaaactgcataataatgacaacggcgataattccgatgacgtaccaaaccaattgcgaaaccacctgtctcatgacgctggtagagcttgaatcatgagtggctgcaacgtaaatcgatgccagcccaatcaacgccagcattaagacacagaaaataattccccagtcaattcgcgattggtcgtctttagaggttctgcgactgctatccaaattagaccctcctcgttttcgatcgccaaattaatggtgaagatgaaaatctttgattaattgtgtcacaccctcatcgaaggttttaacatgaaacgcttcgtcgtgagtgttgactgcttgaaatttagtttcgctcaactgcttaattgagccaatcaatttcttgccgataaataattcggagatcgattctccattttgatccgttcgatctttaatttcaacgttgatacttttatttgctttactcatcatattctccttgttcaaagatcatttcaggtgcatggatttccggtattcatcgcgtgcgtccttattccgaaaaatggtgaagtgatccggaaccggatcatagccacccttaacaaacggatggcaacgcagaatccgggcaatgcccataacggcccccttgaacgcaccatgctttttaagggcagttaccatataactgctgcaagttggataataacggcaggtaggcgggaataagggcgaaataaagcgctgataaccatgaacaagactaatcagaatgtttttcactttgactcctgttatttttgatcttttgccttcaacttagggttcttaatatagtgttccaaaaggataccggcacccttggcaacattatccaaaggattttcggaaataatcacgggaactgttagtgcatcggcaattacttgatcgatgtttcttaataaggcacccccaccggtcagcatgattccacggtcaacaatgtccgacgccaattcgggtggaatcacttcgagaacttctttggcaccactgatgatcaattgaacggtatcgttaattgcttcggcgatctcattgctatcaatcgtaactgcccgaggcatcccggaaacagcgtcccggccacgaacttccaatgttttgacgtctgaatcgtctttcttagcggttccaatttcaatcttaatcttttcggcagtatgctcaccaataatcaggttgtgcttttgcttgatatagctggcaatctcggtgttcatcttatcaccggcaactcgaatggacttgctggcaacaatatcgcccaatgaaatgatggcgatatcactggttccaccacccatatcgatgaccatgttaccacgaggctggaagatatccattccggcaccaacagcggccaccttaggttcttcttccagatagacttgtccgccgccagccttttcagcagcctgcatgatcgcattccgctcaatttccgtcacgttggttggtgcacagatcataatttttggcttggacataaatcctttaacgtccaatttgttaatgaagtatgtcagcatttcttcagtaatatcaaaatcagagataacgccgtcttttaatgggcggatcgcacgaatgttacttggcgtccgaccaaccatccgataggcttcggagccaactgccaagactttaccagtccgagtatcgactgcgacaactgatggttcgtttaatacaattcccttcccggcaacgtaaatgagtacgttggcagttcctaaatcaattccaatgtcttttgccatctgtgtaggttcctcctgaaaaactttaatctcaaaaaataattataccacataaagtttgcgtttctaataagtctccaaacaataaagggttgagatcaagtaacgatcccaaccccgaaaaattatgaacgattcttgagcgattgattcaagacgattgagtcgtcttcaacgttgactcttttaatttcagcacctaaattagcgagcttcttgtggaaatcgtggtaaccacgatccaagtactgtaagttggtaacggtggtatagccactagcggccaagccggcaatcaccaaggatgcggcggcccgcagatcggtggccgcaacttcggcaccattaaaatcagtagggccatccataatgactgttcgaccagagatcgtatattgagcattcatccgacgcagctcttccatgtgcatgaaacgattttcaaaaacggtttcagtcattgagctgctgccgttagcggtcaactgtaaaatggtcatttgcggctgcatgtcggttggaaagcctggatgcggcattgtcttaacgtcaaccggtttgagattgtcatggccgatgacttgaatgccatcatcgctttcgttgatggtaacgcccatctcgcgcattttgagaattagtggtttgttatgctcgggaatagcgccatcaatcatcacgttaccacgagtaaccgcagcagcgatcatgaacgttccggcttcaattcgatcttgaaccaccgcgtgatcagtcccatgaagttcaggcaccccttccacgcgaatctgttcggttccggcgccgacaactttggcccccatcttgtttaaaacgttggccaaatcaacaatttccggctcgcgggcagcattctgaatgactgttttgccctttgctaacgttgcagccatcataatgttttgagtggcaccaacgcttggaaaatccagatagatttcagctccggtaagtccatccggggcgtaagcttcaacgtagccgtcatgttgttcgatccgagcacctaaagcttcaaatccttttaaatgcagatcaatcggtcgtgacccaattgcacacccaccgggtaaagcaacctttgcgtgcccgagtcgagccaaaagcggccccatgacaacaattgaagcacgcatctttgagacatactcaaaaggtgcttcactggagatatcttttgaagcatcaaacgtaatttcgttattggcttcatcaaaatcaacctttacatttaagaaccgcaacactttattcatggtatacacatcagacaacaatggcacatttgagataaccgtctttccctcaccggctaaaatagttgcagcttggattggtaaaacggcattcttggccccatcaatatgtactgtccctcgaagtggcttaccaccatgtacaataattttttccacaagaacgcctcctacatcacttaattagatacatcaaattctgaatgttaaatattacagagaggaaaaatgaactgcatgcgtacccaatcgcaattgaaacgagcacgatcagtaatttccccggcattgccctcaatgggatataacgctcgatgtggatttcttgaactgtccaaaacgccatagcgataaacaaaatgtatgtaatcaatgtaatcagcgcttgaatgccaatcgtattcatttgagtcttcccccaattcacagacaactatatcataaagacgcgaacttgtcttaccttttcggtttcttttacaaaaatataagcagaattgctatctaatcggcacattcggataacaatgactgtatatgattccgacaaaacgggagaaaaacgcaaacataaatacatcattcacaaatcacgataaaggaattctaacctgattcaccggtaatttcaaggattaactccaaccaaccaaaaaagctgcaacccaaatgggcgcagcttttgaagtaccgtgttcagtttccggaaaccgcaatcagaaataacggttatttcccggcaacgttgattctgttaattgcacggcgaagagcaacttgagcacgatcaagagcagccttatcctgtcgttgacgggcttcggcaattctttgttgcgcgttcttctttgctttttcagcacgggcaatatcaatatcattttgagtttcggcactatcagccacaattgtcgcaacgttgtttgagaattcgataaagccaccgttgacagcaatatcatcttccttgtcgtcgtatttaactcgcgtttcatcaacgtcaagtgttgcaataatcggaacgtgattagccataattcctagttgtcccgactgagttgaaacaactatcatactagcagtatgctcgtaaacttttccatcgggagtaacgatactaacggtaataactgaattatcagccaattagaatccctccttagtttgcagcacgctgcttttcattgtctgattcctgtttcatagccttggctttttcaacaacatcttcgatagggccacagttacggaaggcatcttctggaatatcatcgtatttaccttcaaggatttccttaaagcctttaacagtatcctgaactgatacgtatttaccaggtaagccggtaaactgttcagcaactgagaaactttgagataagaagaattggatccgacgagcacggttaacaaccgtcttctcttcgtctgacaattcatccataccaagaattgaaatgatatcctgcagttcacgatatcgttgcaaaacatgttggacttcagtggcaacttcgtaatgttcttgaccaacaattgctggatccaaagctgatgatgttgaagccaaaggatcaacggcagggtaaataccttgttgagtcaatgaacgttccaagttggttgtggcatccaaatgggcaaatgtcgttgcaggagcagggtcggtataatcatcggcaggcacataaacagcctggattgatgtaatggcacccttcttggttgaagtaattcgttcctgcagttgacccatttcagtagccaacgttggctgataaccaacggctgatggaatacggccgagcaaggcggaaacttcagaaccagcctgagtgaatcggaagatattatcaatgaacaacagaacgtcttggccttcttcatcacggaagtattccgcaattgtcaaaccagtcagggcaacacgcatacgcgcaccaggaggctcattcatctgaccataaaccatggccgtcttctcgagaacccctgaccctttcatttcgtagtacatatcattaccttcacgagtccgttcaccaacaccggtaaacacagaaataccattgtgtccctgtgcaatgttgtgaattaactcctgaatcaagacggttttaccaactccggcaccaccgaacaatccaactttaccaccacgagtgtatggttccaataaatcaatcaccttaatccctgtttcaaggatttcagttgatgggtttaattgatcatacttaggagcatcgcggtgaattggccaacgctcagcgtcagggccaaattctgggccgccatcgattggatctccaagaacattgaatactcgaccaagagtatctttaccaaccggaacactgattgaagattcggtgttttcaacgtccataccgcgacgaagaccatcggttccatccatagcaattgtccgaacaacgccatcacccaaatcaagggcaacttcgacaatcaaattcttgtcttcgctgacgtgaattgctaaagcagtgttaatttctggtaatttatcgtccaaggagaattcaacatcaacaactggtccaataacttgtataactttaccagtagaactcatgttagttaattcctccattcaaatctttctagtgactaagagcctcttgaccaccagtaatttcagtaatttcagtggtgatggcagcctgtcgagcacggttatactgcaattccaatgaggaaatcaaatcgtcagcattatcagatgccgacttcattgcagtcgaacttgaagcatgttctgaagtcttggcatcaaggattgcaccataaaccaagctttcagaatactgtggtaatacaacatccaagacttctttttcagaaggctcaacatcgtattcagcactcatcggcttaacttcaatgtcctggctggcagctgacgcaatggcttcatcatcgattggcagcatcttctcagctctgaaacgggaaataagacggttaacgaaatgctcgtaacaaacgtacaattcatcgaattgacctttatcgtacattgatgtcaccatcttgacgatttgacgaacctcgttaaaggttggcacatcgctaacgccccggtattcataagaaacattgtcgccgcgtttcttataaaagtcggatccggttccaccaacagcgagaatttgataatcattcgatcccgaatgcttctcaataaactcattggcttcacggataacgttactattataactaccaaccatcccacgatcagaggtgataattaaatatgcgcttctcttagtcttagattgatcttgatcagctgaatgacctgaggatttgtttagcccatctaaaatgtgagattgggctaaatgcaatacaacagatttgatttggcttgcatattccgcataactaaccgtatgcttttggatctggttcagttttgcctgagaaaccatttccatggcattggtaatttgtcgcgtcttcttagtagaagtaatccgatgtttaacatcgtttagcgaagcacccatgtaatctcaccctccttaaaactagtcatttgaagcagctgattgatcatcgtttgattgttgatcatcgtgcttacttggttggaaagtttgttcaaagtctttaattgcagcatccattttacttgtatcaggcaattgaccggtcttagcgatatcttccaacaaatctttgtgattttgatcgaagtaatcgaagatctcggtttgatatctcaaaatatcatcaattgcaattttatccaagaatccatgggtcaagcagtaaagaatgacaacctgtttttcaacggaaattggcgaatgaagtggttgcttcaaaacttcaaccgttcgggcaccacgatttaatttgctttgagttgcttcatcaagatctgaaccaaattgtgcaaatgattccaattcatgatatgaagccaaatcaagacgcaaagtaccagaaactttcttcatagccttaacctgcgcatcaccaccaacacgagaaacagaagtaccagcgtcaacggctggacgaacaccagaatagaaactatcggcatccaagaagatctgtccatcggtaatggaaataacgttagttgggatataagctgaaacgtcccctgcttgagtctcaacaattggcatcgcggtcattgaaccgccacccaacttatcacttaacttagcagcccgttccaacaaacgtgagtgggtatagaaaatatcaccaggataagcttcacgacctggaggacgacgaagaataagtgacaactcacgataagcatcagcctgctttgataaatcatcgtagataatcaaaacgtgttgacccttgtgcatgaagtactcacccatcgttgcgccggcataaggtgcaatgtaaagcaatgatgcaggttcggatggcccagctgaaataacagttgtgtaatccatggcaccgtacttttcaagggtacttacggcagttcgaacagttgattgtttctgtccaattgcaacgtaaatacatttcatattctgacccttttggttcaaaatcgtatcaatggcaattgaagtcttaccagttttacggtctccaatgatcaactcacgctgacctctaccaattggaatcaatgaatcgatcgctttaataccagtttgtaatggttcgaaaacagattgacggtccataacacctggggccttatgttcaatcgctttgtgatcgtcggctttaattgggcctttaccatcgattggttcaccgagtgaattaacaactcgtccaatcatctcgtccccaacaggaacttccataattcggccggttctctttacagaatcaccttcacgaatattcgtgtcatcacctaaaatcatgataccaacatcattggtttccaggttttgtaccattccataaacgccgtggccgaagtcgagcaactctccagacaacgcattttcgagcccatgagcacgagcaataccatcaccaacatatgtaacgatacctgtttcttgaacgtcgagctcgttcttatagccttgtaattgttgcttaataagagcactgatttcctcagctttaatgctcataagtttcacctctttaaatagatatcgttaattcaacaataattctttaaccttattaatgcgagtttgaacacttccgtcgataatcacatcggatgatcgaatcacgatcccgccgatgagtgatttatcaactttggtatcaaaaatggctttaaccgcacctacccgcttctcaaatgctgttgccaaacgatcaagctgatcatcgtcaagcggcgttgccgaaacaacctgcgcccggacaatcttcttgtcatcttcgtaaaccttttggaactgatcaataatgctcagaacctgtgggaaacggcgatagctggcaacaacctttaaaaagttattaataaagtctgatgcattttgggtgataggagccagcagagactttttctcgtcatctgaaactcgaatatcatcgagaatttcaatcaaccttggattagcagcaaaaattttacgtaattcaagcaaatcagcgtaaccagattcaagttcattagaatcactcagaacttcaaacatggcttttgcgtatttttttgaagcgctcatatcatctaatgtcatttctgcttacccaacccttcaatataagagtcaacaagtcctttttgatcatcttcgtttaattcttttgaaataatcttggatgcaatttcaacagaaagacttgccacatcttttcgagaattagccaaagcttcttgtcgctcttgttcaatgtccttttcagcagaactcttaagattcgatgcttcatttctagcatcttcaacaatctgttcttgttgtctttgtccattctgtttggcagtgttaataatggtatttgcgtcatcacgcgttttgtctaattcagcctgacgtttttgagcaagttcagctgctttagtccgtgattccttggcagaatcaatatcattaacaatcttgtctgaacggtcttgcatcatcttcgtaattggcttccatgcaacgatcttgaccaaccacattaaaacaagaaatgtgatcatgacaaacagcatatcaccaacataaagctgagctccaactactgaatatgaaaacatcaattggcacctccttctttgtgtatttgactaaaccggttattacttgttcataaccagcaaagcaacaacgaaggcgatgataggcatagcttcaaccaaaccaacaccgatgaacatgttactacgcagttgtccggataattctggctgacgtgccattccttccaacatcttagaaattaaaataccatcaccaacagctccaccgatagcggcaccggccattgcaatacctgcagcaattgctcccataattaaaaatcctccttatagtctccaaaaatatttttgctaatcttcaagctcgagctttcgtgaaatgtatacggatgataatgtcacaaaaacataggcttggatacatccgataaagactgagaaacctgtccaggccaattcaagaatgaatgaaacgacccacataactgctccaccatgcgacatgccaaggattattccaagaagcatttcacctgaaaggatgttcccaaatagtcgcaatcccaacgttaagaaattagtaaactcttcgaataagttaattggcaggaaaaatacgaatggctttaaataattctgaaaatgtcccttgtaacctaactgccgaattccaaggaattgtgcaagcgttagagtcatcagagacagagtcatagtaacaaccggatcagaagttggacttttgacatatgttacaccagaaatgtcgatatgcaagaagagtccctgcaaattcgcaataatgatgaacataaacagagtaaagccccataaacctagtgttctacttgtttcaccggaaatcgagcttcggacaataccattggtaaagtccaccgcatattctaaaacgttttgtgccttgcccggtttgattgtcaagtgccttgataaagcatacaccagaacaaaaaccacacaagcagccagtaatatcgaaattaaattaccaacgttaaacgtcagtcctaagaattcaaaagtagaagcagctccttccacaaaatctcacctctttcctccacataatcacgcatgcaaatcaatctggttttggtccagaagacagtaataccaaagtgaaacattgcgatggtactgaacacagaaccgtgttcaaatacaattgaaatcataccaccatttattacaaaattcaaaacaatcttgacagggaaacttcgcgtgagcagtagtgttcaacggcatgcacaacgaatgtcacccaagggtctttgattagacttaattcgttggctatcaaagccagaatccttttgtaaataaaataaaaagctgacgacaaaattttcattttgtctcagcttcaatcaattatttggttccaaacaaacggtcaccagcgtcaccgagtccaggaacaatgtagcccttatcatttaatttttcatcaagtgcagcagtatagatatccacatcaggatgagccttttgaagtgccttgaccccttccggagcagctactaagcaaacgaacttgatgttggatgcgccgcgcttcttcaaggcatcaatcgccatgattgatgagcctccggtcgcaagcattggatcaacgacaaaaatctgccgctggccaatgtctgatggcagctttacaaaatattcgtgaggttcgagggtcttttcgtcacgatacataccgatatgaccaactttggctgctggaatcaaatcaagcatcccatcaaccattccgatacctgcccgtaagattggtacgatggcgacctttttaccggaaatctgcttggcatgcgcaataccctctggtgtctcaatatcaacatcttccaaaggcatatcccgcgaaacttcaaaagccattaaagtggcaatttcgttgacgatttcccgaaactctttagtcccgcaattcttgtccctaatcattgacagcttgtgttgaatcaacggatgatccataacttgaaacttacccattattttccaactcctttttgtattccgaaataattgtatcacatatacgcgatcggaaagtatacaaaaaggcttgaaaccacaattagtttcaagccagtcaaaattattgattaattgggtgagctgcagttaattgttcaactttggcagcgacatcctttaagttttggtcatcatttggtttgtcaatcacttgtaaaatcaaattggcaaccgctttggcatcgtcttccttgaagcctcgggtggtaatggctggcgttcccaaccgcaacccgctggtcttcgaaggtggcaatggatcatttggaatcgactctttattagtagtgatgtgaacagtatccagcaggttttgcagctctttaccattcaatgaggtctgcgttaaattaagcgtcattaaatgattgtcagttccaccggtaagaacggagactgacttggaattctggaatacgtcggccattgctttggcatttttaatgatctgctcgccgtattctttgaatgccggctgcaaatcttcgtagaaggccgccgcttttccggcaattacgtgttccaaaggaccaccctggctgccagggaaaacagctgagttcagcttcttggcatacttttctttggccaaaatcaatccaccacgaggtccccggagtgtcttatgcgtcgtcgtggtgacaacgtcagcaaccggaactgggcttggatgcaatccaaccgcaaccaaaccggcaatgtgggccatgtcaaccatcagataagccccaacagaatcggcaatgtcgcggaacttctgccagtcaatgattcgactgtatgcggaggctccggcaatgatcaattttggttgaacgatctgggcaattctggcaacttcatcataatcgatcaattgcgtctttggatcaagcccatacgagaaagagtcgtagagcttgcctgaaaagctgactttggcaccgtggctcaaatggccgccggcgtctaaccccatccctaaaatccgatcaccaggctttaggaatgcggcataaacctcttggttcgcttgtgaacctgagtgaggctgcacgttggcatattcggcaccaaacaattctttggcacggtcaatcgccaattgttcaacaacatcaatgtactcacagccgccataatatctccggcccgggtatccttcagcgtacttgttggtaagcacggaaccctgagcggcacgaacagcgtttgatacgatattttcagacgcgatcagttcgatattatgctcctgacggttctcttcgttggcaatggcatcccaaagttctggatcctgctgtttataatcgtagttcaactgcaacacctcactaatttatttggtacaaataaattataactgcttgaaatgcatttgcccagctgatttattcaaacgattcatgtaagcctcaccaattccctttggatcaattccttgggtaaaaataattttataggcagggtggttatcaaaatcccgtagttcggcaaacaaatcatgcgctgctgtgcgggcatcattgccaagtgaaatcacatcgacattatccggccaattaattgttttgatgacgtcatcaaaagccatcaccccaattggctgtgggtgctgcttgatccaggcgaccacatcgtgccaatcgtcgtcaggatcgacaatgtagacctgagcattgggagcatagtgcttgtacttcattccaggggctttaggggtttgtttggcgcccacatgatggagttcatcaatcaccggtcgatgaataacggcttcaatatcctctttggtcacagcacccgggcgcaaaatcgacggggttgccacagacatgtcaagaatcgtcgattcgacaccaaccgtggtcggtccatcatcgacaattgcagcaatcttgccatttaaatcatgataaacgtgttgtgcagtcgttggacttggcttaccggaagtattggctgatggaccgacaattggtacgccggcctttgaaatcaaatccagcgtggcttggtttttcgggaacctgaacgctgcggtgtccaaaccaccagtaaccgccttagataaagcgtttggcttcagcttaaaaatcatcgtcaaagaacccggccaaaatttggccatcaatgctttggcgtcgtcggaaaatggctgggtgtatttttcaaccatcgcgatgtcagatacggtaacgatcagcggattatcactgggacgtcccttagcggcataaactttcttgaccgccgtttcattggtcgcatcagcccccaatccatagacggtttcggtgggaaatgccaccagttcgccttgacggataaagtccgccgcttggtctagttgctgctgttttaaaattaaagtttccatattatatagccttcatttctttacttgaatcatccgttgatgaccggagacatcgtgtttggcaattactcgagcgttgggcatggctgcttggaagatctcggtcacagccgattgttgctgaaacccgatttccaagtacaacctgccctttgaagttaagtgactctccgcatcggcagcaatttgtttgtaaatagcaagtccctggtctttcgcatatagtgccaagtcaggttcgcttttgatcacgctggcatccatataggtctgctcatctttggcaatgtatggcggatttgacacgatgacgtcaaatgactcatcaattgctgcaaaaacatcactcgccataaaatgaattgccgtgtgattagcaatcgcattttgccgagccacttcaattgccggcagggaaatatcactggcaaatacctgccagtggggtctggaatgcttgagggcaatcgcaatcgccccactgccggtaccaatatccaagaccttcaactcagaatctgagttttcagccaatatccagtcaaccaactcctcggtttcaactcggggaatcagcacatctggtgtgaccttcaatgataaaccgtaaaaatctgcctcgccaacaatgtactgtggcggcacccctttcagcaattgaccgatcgcgtcttgaaatacttgccactgcttgtctggcatctgagtgtggtaatgaatcaacagatcggtagccgacatcttaaatagtttctctaacaaaaaatcgacgtcgtacatgtcaatgtcattagattccttaatacgaaaagaagcccactttcgggcttcaaagtaggtcacgttttcttgattattcattggtcaaattctcaagtttcttggcttgatcagaaacaatcaaggcatcaataatttcgtccaactcaccgttcatgatccggtctaacttgtttaaagtcaagccaatccgatgatcggtcacccgattttgcgggtaattgtaagttctgatccgctcggaccgatcaccggttccaatggccgatttacgttcagcgttgtattgatcctgttcttgttgggcatagtaatcataaacccgggcctttaaaatcttcatggccttctggcggttctgctgctgggatcgttcatcctgcatcgcaactacaatgccggttggcaagtgggtcattcggacagctgaggaagtcttgttaatatgctgaccgccggcaccagatgaacggtaaacatccacccggatatctttgggatcgatatcaatatcaacatcctcttcttcaggcatcacaccaaccgtcgccgtggaagtgtgcacccggccggcagattcggttaccggcacccgttgaactcggtgggcaccgttttcatacttgagctttgaatagaccttgtcaccggtaatcattaaaacgatttctttgaaaccgccaacttcagtttcgttcttatcgatgatttccactttccagccctgacgctcagcatatttggaatacatgctgaataaatcggcagcaaataagctgccttcatcaccaccggcggcgccgtggatttccataatgatgtttttatcatcattggggtcttttggcagcagcataaccttcatttggtcttcgagcttgtctttttcgtcggttaggctggtaatctcatctttgaccatcgcttcaagatcatcatcaatcttttctcgaagcatctctttgtcatcgtcgagctgcttgctgactttttggtacttcttaaaagcggccacagtgtctcgaaggtcggcttcttccttagatagtttcatgaatttttgagtatcggcaatcacttccggatcactgattaactcgtttaactcatcatatcgatcaacgaccgattgtaatttgtcgaaaatttcgtccatttaatattcctcacttttgttacttaataggtggattgtaataatgctttctgcagaccggataataggattcgttcccacccatttggatttgttcaccctcatacaccggctcgccgttgtgaaaacgcaggttcatgatagccttcttgccgcagaaccagcaaatggttttcatttcttctattttatctgcgtataacagaaggtatttggaaccctcaaacaagttgttttgaaagtcgttcttcaagccaaatgccatcaccggcacgttcagctcatcgacgatccgggccagttccatgacgtgctttttctttaagaattgtgcctcgtcaattaagatacaactggcatggggatttagttcctgtaccaaatcaaagacattggtatcctcgcgaatcggttcggcttttcgttccaaaccgatgcgcgattcaatcatgccctgcttttctcgggtgtccaacgcactggtcataatgataacacttttattttgctcttcataattatgagcaaccttgataatttcgattgttttgccgctattcattgcaccgtaccgataaaatagttgagccaaaatatccacctttttccttaagagcttctcttccattatacagaaaaagttttgaaaatcgataataatgagaaaattcgccagcaccctcattattatcgaccccttaaagaacgagcgtatatatgttcaaacagttgagcatatgctacacttaatgtttgattaggttcattatgtacttcattttaagggagtaaagtttatgtcattaaaaagttcaattgcgactgcggccggtaagtcgtcttactggtttctgcatacatttttcaagggcggcagttcgcttcccggtaaaatcaccaaacggctcgatccagaaattctggcaaccctgggccgtgactacgacgtgatcgtcatcaccggtaccaacggtaaaacgctgacgaccgctctgacggttcaagtgctcaaagaaaagtacgataacattttgaccaaccccaccggctcgaacatggagcaaggcatcattaccactttccttcatgcaccaaagtcaaagggcaagcggccattggcagtgttggaagtcgatgaagccaatgtcatcatggttaccaaatacatcaaaccaaaagcgtttgttttcaccaacattttccgagatcaaatggatcgttatggcgaaatctatacgacctataataaaattttgaatggggtcgccttagcgcccaacgcaaccattatcgctaatggtgacgcgccgattttccattcaaaacaactgccgaacccgatcgtctactacggcttcgacaatcaaaaagatggcgacatcaaggcgacgcccaacacggacggcgttctctgtccccaatgtcagcatgtcctgcactaccatttcatcagctattccaatctgggcaagtacttctgccccaactgtggttttgagcggcccgaattgaattttgcgctgaacaaaatcaacgacttgacccccaaatcatctacctttgaaatcgatggtgagccgattaaaattgggatcggtggggtttacaacatctacaatgccctggcagcttattcagttggccgattcatgggagtctcccctgctcagactaagaaagcctttgaaaaaggaaaacagatctttggccgccaagaagagatcaacgttgacggcaaactggtgacactgattctggttaaaaacccggtcggcctcaatcaggtgatcgacatgatttccactgacaaggacccgtttaccttcattgggcttctcaatgccaattacgcagatgggattgataccagctggatttgggatggcgattttgaacggctgcccaagatgaacatcaaacagttcattactggcggtgagcgatacaaagatatcacctaccgcctccaagttgccggagtcgacccaaagaaacatttggttgaaccggatttggacaaagttgtcgaaatgatccccaaggcaccaaccaaaaaggtttatatcctcgcaacttacacggctatgctacacttaaggaaagtatttgcagccaaaggctttatcaagggaggaatggattaatgacctattctttaaacgtctgtcacctttacggcgatctgatgaacacttacggtgacctagggaacattttggtcctcaagtatctggccaacaaaatgggcgttgacctgacgtctgaagttgtcagcttggatcaaccatttgatcctgacaaatatgacatcgtcgtcttcggcggtggccaagatttcgaacaatcaattatttctaaagatatccaaaccaaaaagcaggctttaaccgactttattgaagataatggctccgtggtcgcaatttgtggcggctaccaattgctgggtcactactatatcggggctaacggtgaaaagctgatgggcatcggtgcattggatcactataccgacaaacaaaaggaccaccgttttattggtaacgtcgtgattgaaaatgaagaaaccggcgaaaagtatcacggctttgaaaatcatcagggaattaccttcttgggtcgcggtgaacgcccactgggaaaggttctggagggtcacggcaataacggccaggataagactgaaggggcaatttacaaaaacgtctactgcacctatttccatggtccaattcttgccagaaacaatgatattgctaaacacgttttgatgaacgcgctgaagcgaaaatatcctgacgccgatttaacagcacaagagaatctgaaagttggcgcaacattttaatatagaaatagaggctgggacaaaactaaaaattttgttccagcctctatttgcgcctgaatgttatctagcagaactgtgcgccaataagcagcttccggccgtataaggggattacccaaacatccaagttctggatattcgggtaatccccttatactctggaagctaaccgcttattgtcccacgcttattttgtctgaaaattattggtgtgcaatctcgttttctttcacaaaggttcgaatcagttggctgcgatatggcaaaaacaactggttgcttggatccgggtggactcggttggacaaaaagaccaacgccttatgcgaatagcggtcgaccacgatcagggtgcccgtgtagcctgtgtggagaatgtatggatgaccattataatgacgcaggatccagccaaacgaacgattcttcatgtgtcccggcgtttggtcaacgaagagctggtcaacccagtctgccggcagaaagttgggatatctgatatcgcccaacaaccactttgaaaaatgaatcagatcgctgagcggcgcaaacaagccggcagagccacagtcaggaccaaggattcgcgctttggggtcgtgaacggtgccgcggatcaaccccttactgggaattaattcggtcgggacaacattattaacctgatccggggtgaatgtcgcttggtttagttccaacggtcttaacacaaactcactaatcagctgttgaacaggctcgcccatcacccttgaggcaatccagcctaaaaagataaaattgtagtcttgatagtgaacaactttgccgatatctgaaccgcttttcagggccaacaacgccggcatcagttccgacttgggcagttgattgcggttagggatatagccgacaatgtctgaggtatgcgtcagcaaatgtctgatggtgacctggggcgactgccattgaggaaaatacttggtcaaggaatcatctagtgagattttcccggaagccagtagtcgtaaaattaaattggtggtcccaatcactttggtcaaggaggccagatcgtacaattcaccactgtgaagcggcaatctttccggtaacagttcctgttgaccaaaaacgtctgtttgaaggccatcccgatcaataatcccgtaactcacgccggggacaattccggcatccacaaactgatgaattcttgtgaccgtgtttggataatccatggacagcatcctttcgcattgagatgcattcattgtaccgctaatccacaactggataaagaagcgcaccggcggttgcttgaaaacattttccccactctgctcagatttgttacaataggaacgtaggatttttaagatcggaggaagttcaagtggcaagtaactcagacacaatttatcacgtcttatcatacattaaggcccatccggataaagtattcaccaagccggacacctatgacaacgtcgtggaaatgtaccttgatgacaccgttaaattaggaaatccagagatttatttccctgaacaaaaactcgaggttaatcgaatgtcgtcagattttctgtcaatgtacagtgatttgctggactattttcatgagatgacccaggtcaaagacgccaattatcacgaattgtggatcaccacctcgcatttagtagaccaacacaaatacctggttgacctgtcatttgaataaccagccaaataaaggagaccttcactttgattagcacgatgtttgatgtcattaccaagctgtcgtcttatgcgatggtgatttttttcgccatgtttgtctactttaagaccaccggcaaacacggtaaatatccatacggcaagtatgcgctgatttcattggtgctgatggctgtgttcggcacgttgttttttaattcgcccaaaggaaaagaagtcatcaaaaaaggcaatgccgagcaggctgagcggaccgaaaagaccgtgaaaaagccggccagaaagtcgactcaaaatactgaaactgccgtcaagaaagaactgaacaccaccaatacgcttctatttgatcatcaagtcaagctgcatgccagccagacggcactcacagtgaccgttaccgataaaagcgatacaaccgagtcctttcggttaaccacgattggtattttgaaggcgattaaaaagaccgactatgaccgttatgatcaattcaccattatcttcaatcgaaatgttggcaacggtcggaaacgaaccattgtcaaaaccatggttaccaaacagacgctgcggaagctggatctcaacaagcttgagactaatcagttaaaatctaaggccgatgattactatgaaattaaataaaccctcactaaaatgaggcatccctccaaggaacaatttaccttggcggatgcctcatttttgattattgagttaactgataactagcttcgattaggtcgtgaatttgctttggatccacctggttcaaccgaatggctaaccagttggttttgttcatatgataagctggcagaaaccccaaactagtttgtcgaaactcaacttctttgggatccaatttgacatccaggatgtcttccttaccctgcccatcaagtccaagttgcgacttttcaacctgcatgactaagccgaaccattttcggttctccttgtgacgcagaacggcaaagctcggatactttttccacaggtattcagggtgaacatgatatttttcaatcacatagttggtaacatcttggtatttcattcgtaacctctctgattaatcaaaggattccaagtcaaggatctggtagtcatagcccatttccttcacgaattttaaaacatccttggaagcaacaaaaattgttctggtgttgacattgggatggaaggtcattgtcttttcatctaaaatggcccgatcgaaataaacatgaatattcttctcttgattgttaatcaatccaaaaatcgagacgatccccggctccaaccccatttgttctttaagtgattccgctgaggccatcttgatctgtttagtgttggtcaagtcttgaaattcatgaaagtctagacgtttggcatcgtccatcaccaacagataaaactcggttttcttcttgttggtcataaacattgttttggtccgaacgccctctttgcccttaatgaactcatcggcttcctcagtagtgtgggcagcaggatgttcaacaatctcatagggaattcccatcttatccagcgtttctttgactaacgtaaattgatccatacatatcggctcctatctgcatgaatatgcgtgaatcattaaccatttaattctagattagcacactttgggtcactgtggtgtaagcaattccaatctgggacgagtaagaacgggtaacggttaaagatccccttctgcacaggatgatagtgggatttatggaatataaaaaggtctgttacattgtctctgattagagagaaacataacagaccttgcaaaagattgggtatactggggtcgaaccagtaaattacggattcagagtccgttgccttaccatttggcgaatacccaatgaatatcacaactaaatatattaaagatttttctgcgttttgtcaactttatatttcagtttcctttgttgacaaatctttctgatttagatacactattatagtgagtttgatagcattgcccgctggtcaaactggtttaagacgtcgccctctcaaggcggagttacgggttcgagccccgtgcgggtgataatcgttgatttaacaaggatcagcaaggtgttagccatttttttggctaacaccttttttgttgcaaaatccgctagacagtttcaataaattgtctaacaaaaaatgccacaacaaaaatttcacactgatgcaatttctggtcgcagaaaaataatgaggttcggacattaattgctacggtggatttgattaccacttttgtattgatacaacgtgcagcgacggccggctgaaagcctgcctggcctacttggcgatcgactgatccccaaaaagcgagccactccaaaataggaatagcccgcttctttgcttaaattctgggatcaaaacgcctctcgtcgcactgtctaatgtaaattatcgaataattctgacatatttagagttaccggtgatatacccaccagccacacggtatcgcaaggcaccgtgcttttgtagattatggccacgggaataatcataattggatactttgatgatctggcccttcttaatcgtgtgaggccgtccgctcaagttcacgttttgataacgatgaatggttgtcttcgcccgaactttcttaacggtccgatgccgacccatgttaaccagctttcggttagcggtgacatacctgccattcgtcaagatataacgggtggtcagattgtgcttcacgatccctttaactttgaggatggttccctgttgataacttctgaccttaccagtcaagtctttgtgcttataggcattaacccctgccggagaaatgaccgtaatgtgtttgtgcagagtagcgtaataaattggacggacatatcgccaattgccggtgatgtagccggtcttgcccgccgtcttcgataagtggttgacatcacggactttgtaacgcatcttcccacttgtggaacgagcataccccgtcaccacaaacatcggccggtaaatgcgcggtttcttgatatatttggcaattcgctggcctttggtgaagttaaccgttcgatacaaatagacattgttaatggcagcgactgccgcgccctttgtccccgcgtaatcaggaagctttggattagttggttgagttggaaccgttggctgcgttggtgtgactggattgatggggttaggcgtcggtgatggttgcggatttggcacaggctgaggggttggcaatggagacggtgttggcgtcggctgggtaaccgtcaattgaacgtcctttgaagctgacccattactgtaatggattgtgtaaacgcctggcgttttatacagattactcaggtctgagatgatctttccagagctgtctttcgccgtcaccaaaatatctttaaaggctaggtcttttccactggcatctttggcattatcaaatgcatctgccggtttccatgcctgattgacggggattgtcagcttgccatacttgagattgagggtactgctgtcagtcacgttgatggtgagcttcccttccaggggctcgtgaccacttagcagctgattggtaacaatgtcgaccgtgtattgaccaacctttgatttgacgtcatcaagcgaaacagttttgccagttgcatctttgatggtgtaagtgtacggaagagcctggccatcggaattgaccgccaaaattttacttttcaacgcatcttcagtgaacgcctggtttaaataaagatcaatatccgtcgtcttcaagctggcctgatcggccttaattgttaaggtaaatggttgtttctgatcaccattctgataagtcagcgagtaggttccaggagccagtgctgcaatagttgcctgggtaaccggctgaccattagcatcagtaatcgtaacagcattcttatcatcggttccattgtgagtcgctaattgaatcacactggtcggatcccaattcttagcttgaaggccctcatatactgaagccgaactattagtcaggttcagcatatattgattaatgggcgtggtgtcttgctgccagacataggtttcgtcttcagcaggccgcttagccacaaagtcctcaagggttggatagagctcgccctgtggattgttgaccgttccattggcaccaactgcttgccatcctggaccggtggcgtccttcaagggatcaatggggatttcatcgcctttttgatgcggcgggagagtggccaaagctgaatttttaaaggttggccccagtttcagattcgatagtaacgtatcctcggaaaacatactgccaatagccgtgacattggtcatgtcaaagtctgaaaggtccaatgttttcaatgagtgattcccgtaaaacatatccagcatattatcaatcttagaagctttcgaatgaggaaaagtgatattcgttaatacataatcccccccaaacatgtgatccgtattttttaattgagaaaaatcaaaattagaaagatcgacttgttcaagcttccaatcaccaaaaaacaggccactcatcgtgatgacattgggtgtccgaaagctggagacatcaacggatgttaagttgccatcttgagcaaacatataattcagcgtttcggtctttgacgtatcaacgtttcttagaagctgtttagtatcttttaagaagtaacctgataaaagctaacgaaaccatcatgagactagtgttgagcttacgctcacagttacgccataaacggtgataatttcccaaccaactaaatgaacgttcaatgagccaccgttggggga

SEQ ID NO: 177 - DNA, 103550 bp, Lactobacillus buchneri
tgagagaacgaagttctttcaaggaaaaatagtgtggtggcgatagccagaaggatacacctgttcccatgccgaacacagaagttaagcttctgcacgccaagagtagttgggggatcgccccctgcgagggtaggacgttgccacgcaatttagaaagtcttcaatggtatttactattgaaggcttttgttttatattgaaatagtacatatttttgggaaaatgggtgaaattatgaaacgatacagagcttaccggctgagcctcggctggcagattcttattggtctattacttggtgtcttttttggtgtgatcttctacaaaaacaataccgcgataacggccatgcagaatattggaaccatgtttatcaacttgattcaaatgattgttttaccgattgtcgtttcatgtttaacagttggaattgctagtatgggagatattaagaagctcggccgagttggtctcaagacgattatctattttgagttgatgacgaccatcgccatcgcccttggaatggttgtcgcaaacgtccttcatcctgggacactgattgatattcactcgctgcacggatctgatatcagccaatatatggcgaccgccaagactgctcagcatacaggtatctgggggacactgctgggaattattcccaccaacatcttcaagtccctagcaaatggggatatgatgccagtcattttcttctcagttttctttggtttaggaattgccgccattggtgaaaagggacagattctaattgacggtttgaatgcagttgccgaagtcatgtttaaagtgactaactgggtcatgcatgccgcacccattggagtctgtgctttgattggagttgccttggctgaaatggggattggtgcattaatcccacttggctactttgtggcgattgcctacgccacgatggtagccttcattctcatcattatgggaattgttgccaagatctttggctttagtatttttgatctcttgctggtcattaaggatgaaattgttttggcattttcaacggctagttctgaagccgttttgcctaagatgattgagaaaatggacaaatttgggagtagtcaaggaatcgtctcgtttgtcattcccacaggctatacttttaacctggatgggtcggcaatctatcaatcgattgctgccttgttcctcgctcaggcttatcatattaacctctcgatcggccaacagatcactttgctggtggtgctgatgattacttctaaaggaatggccggcgttccaggggcctcatttgtggttttgctggcaactatttcgaccatcggggtaccagttaccggactcacttttattgccggaattgaccgaattgtcgacatgggtcggactgccgtgaacgtggtggggaactcactcgctacggttgtcattggtaaatctgaaaaagagtttgacgaagagaaatccaagaaatatattgcatcatttaaaaagaaaaaacctgtcgaagaagctggataggttgctaagataatggccgggacaaaactgaatgttttgctccggcctttttgtaaagtaacgacaaattaaaagccgtcaacgaatttacgttgacggctttataatgttattggtcgataagatagcagtcatctttcaagaatcagtttccaccggattcttggaggtatggtcctcataattactattattatcgctttatgtgtggcaatttaacacgattaattgatttctccccaattagtttcctaaaaggtgaagcgtttttcgactatgagtagtcgaccggacacaagtacgccagtaccaacgtgttcgagaccaccgagaaattgcattaaccgaattcccaaaagttgactcatctaaacaaacgaagtcgggaaatttcttgtgatgcgtttagctgtaaagctagtaagcaagaaacaaaacgtttagagtcgtcaaacaattattcaattcgggaagatcggttacaacaatttctcgttaacgattaagtcgtgagagagttatcacaaccgggcttcccttggtagactgatgcttcgtcgctcctgggtctataaattctgctgtcataactctcacctcttcaaagttttatttggtaatgaaaagtgtccagccgttcaacgactggacacatcaaaaatacttctcgccagtcgttgagctttagcactatgtgatgtagttaaaaattaacagctacgttagtccaagccttactttgacttggacagctgactcattggcgtttttcgacgtttctgagcagtagcattttccacataggagcctcacctaacagctttattcatttttcattccacaatttataatatcacgtcaaccaattatgcgcaacaattaggcttacatatccattccaggaatattcagatcttcaaccttgacgccccgctctttagcaaaggcattcatcaaagtatccatatccattagcttgtattgctttggatgatccggatcataaacctcaaattgcgccatcataccaccatcttcatgctcgataatgtggcaatggttcatgaagacgcctagatgattgaaccaaactttcagccgaacggtttcgccagggttgacgccgaccgtatctttcaatccattttcatttggataaggcgcatggccgtttctggaaaccaccctgaactgtgtcccgtgcatgtggtaggggtggaccatcccgttactcatatcgttggtgttgctgatgtcccaatattcaacgttgccgagcttttgtttgtcgtcgatccgctgcatatcaaatttcttcccgttcatcatgacttcttcatccattccagacataacaaccttgtggactggtgcacctggggtgacatcgggatcaggaatgtccaccagatgatcaggcaaggtggtgttgtccggcgcaaattcatggattctaaagcgcatgattggcacgtcgtcacagaacaaggtgacctcatcgccgggcttgtattggccaaagtcgacgatgacttctgcccgctcagcacaagtgagcatcagatgggtaaaatcaactggttcagggagaataccaccgtctgaagcgatttgggtaaatttcaaattatcactaaaatgtagccgccattcacggcggttagcaccatccaggaagcgtaatctgagccgctgggtcgttacatcaaagtatggattaatggtcccattgatcatcgcagtcggcccctggacgccgtcagggtcatagtcggccatgtaatcccactgattgtcttcgtggaagcggcgatcctgcaaaatgacgggaatgtcgtcaaccccataatttcttggaaatggtagtgcggcctcaacgtcatctttgacaacgacagccgtagctaatcccttccaaacatgttcggccgttgctgggcatgggtgagcgtgaagccacaaggttgccgcaacttggtcgcatttaaaatcaatttgggtgctttcacctggataaaccggtgcgtggcagccaccatccgtaatgggaccgggaacatttaaaccgtgccaatggaaagtcgtgagttcaggtaattcattttttaaagtaatatgaatcattttgccctttttgaacaaaatggttttaccaagtaaatcagtattatagccccatgtcttggtcttcttaccaggcatcagctgtgcttcaccggtttgggcgatgaccgtgtagtacatgtcagtatcggtctctttatccggcttgagcaattccggaatcttcagcggctgttgcggtgtcttaggttcctcaaggggaacaaagccgccgtcatgggtattgtaagctggttcgtcaaaaaaataatctgtgtaaacttttcgttctgacattttatccgcatcctttgtttatattggattcaatttaataatactactaaattagacgccaatacaggatttgtggcataatggaaatacaagaggaggtggcactgtggcagatgtagtatctttcgataagttagatgagacagcaaccaatcaagcagtggaagactttatcgatttttaccttcgatggttcaagaaaaatgatttggaaattttggctgagtacaagattgactattacttggctgacattaaccattacattttcgaaaacaagtccttcacgccagaacagatgagaaaagatttattggaacaacgcggaaacgaccttaaacacgtgatttcagtgatcaacccagagtatgatgagaacgggagcctgaaggcaggttcttgggatcaatggtaccaggcaaagtttgaaaaagttcctgatcgcgactaggcttttgaatatacattcaattgtgaatttgctattattgagctatacagagtagtggggagggattttcatggctaaaggaaagaccgaaaaatcaaagaaaaagcaaagttccaagaaattgcaatataagactgacgttgatgtccatcaaatggttatcaacaaatcagtcatgtctttgaaggtaccgacgattcttgcacaaaaggaagcccaggggttgttaaccaaggccattgatgacgggattaccccttactacctcaagcaagaaacgattgaacgattaggtggcattagtcaccacgaataaaacagcgggcgttcattacctggtcgagtaggctgggactgatggacgtcgggtaacgcatttcacaaaagaccagcacgctgagacgtctagtaatctcaggtgctggtctttttttgtggtagaaaagtgttgcaggttttcctgcatgaatctatggtacttaaatcgaagaagtgatctcacaagttgttttttggtgccattttgtcgacatgtagtttgtaaagatcccggttgagcaatttttcgtcagaggccactgcaatcgcggttgtcgtatctccaaccacgttgaggaccgttcgaaacattcctgagaaccagtcaatgccggctaaaatggcaatgctttgcaatggcagccccaaagttgggacaacgattgtcaatgcaaccaggccgccgccgggaacgacaaccgttcccaggcaggcgatcactgacagcaggacaattttaaccatcgacattggtgaaacggacattccgtagagttgggtgagcgtcaagcatgacagcgacaaatacattgccaaaccattgctgttcaacgccattcccagcggtaataccagttggctgatcgatttttcgacccccaaccggttttcagcatcttccatttcaattggaagtgaaattgctgaagaagtcgttgtaaacgcaactaaaataattcttgaaaagccgcggaccaatcctctcagcggtactttggcgtaccagctgatgaagctgaacaggacaatcaagaaagcgatcgagcccagcccaaatgcggttaggaacttgagcaggggcaggatgactttaatcccgctggtagcggtgacccaggccatcaaggcggcaattccgattggagcgagcttcatcaccagcatgaccagcttgacagttagctggttcatctgtttgacgaaactcaatacttgattgaatttgccgtcagtattggcacggttcaaaacaatcccaaacagaatcgcgaaaataatcacctgaatcacattacctttggcgagggcgtcaaaaatgttcgtcggaaagaagtccaagaccgtttggctaaaactagttcctgccttggcgaccgttgccgacgtgctgaccgaagccagcttgatgccgctgcccggattgactgcgtagccaatggctaagccgaggactgctgcaattaaggttgtgatcaagaaccacatggcagttttgccacccaatcttcccagttgatcggatttcaagctgcccagtgcttcgatgaccgccccgaaaatgagcaggacgaccgccatttgaatcaggcgaaggaaaatatttcccagtaattggatgccggcgatttttggaccaaatgccaatccaagaagcgccccgccaatcatgccgattccaatttgtgcagttatactaatgtgtttcaaaatggttcccccaaacttaataggcttgttggtggaggctggcggctaacagctcaacgccgcgaagtaaatcttcttggctggtgttttccgctggtgcatggctgatgccgttgatgcttggaacaaaaatcattgtcgtccgagtgtgcttggccatgatttgactgtcatgaccggcaccggaggccagctgaatggatttgaaccccagttgattggcaattgcctgattattctcgagcaactggcgatctagtagggtcacgtcgcttttcgcccagcgatcggccgaactggtaatctgcgggttgccaggagccgtaacggtttgctgaaggagtcgttcaaattgatccaaaacggcttcatcactattccggcagtcaaccgtaaacgtgaccaggccggggataacgttagacgtattgggcgaaatgtgcatttccccaaccgtgaaagttaaatccggattcaatcgacgagcctgttctcgcagggtgacgatgagatccacagcgtgctgcagggcatccgctcggtcattcatcggcgtggtgccggcgtgattggcgattcccttaacggtgacggtgtaacggcgttggccaacaatgcctgtgaccaagccaatttgtaggccatggtcaattaatcgcggtccctgttcgatgtgcagttcggtaaaggtatccggtaaatccggcagttggtggtgaaccccagcgagcatcaatttggtaaccgcctgttgtcgagcatcatcaaattgaatgccggcaggatccttcatcgtcaaatccacctgttggccggtatagtgcttcgagccggtaaaggtatccggaaagcggctgccctcttcttcgctgaatgaaatcagtcgaagcgttttctgcggacggccgaattctgttaccagattttcaattgcctgaaggccgccaagaaccccgtacaagccgtcatattgaccgccttgcgcaacggtatcaatgtgtgagccggtcgcaatgaccgcttccggttcggtggttccaggcatgtccagataggcggtcccaaagtcatcaacgtttacctgaaagccaagctcaagcccccatttaatgacttgtctttgagcctcaacccaggttggtgaatagaccagccggttttgaccggcttcattggtcttaaattggttaattgttgctaatcgatgtgcgagttcggttaattgggttgttgtcatatgaccgcccctatttcaccgcgctgacaccagtaagtggcgatgaggcaaccgcaccgtgttcgatgacccggcctggttttgccaaatatgctttgcggccagcttcaacggccagcttgaaggcttcggccattagcggaatgttgccggcggtcgccattgaggtgttggccatgacagctgcggcacccatttccatggcttcggcagcttgacttggtcgaccaatgccggcgtcaacgataattggcaggtcaatttcgtcaatcaaaatttggatcaagtctttggtggacaatcctttgttggtaccgattggtgcgcccaaaggcatgacggtggcagctccggcatcgaccaattggtgagcgacattcaagtccggcagcatgtaaggcatgacgatgaagccttcattggccaaaacttcggttgccttgagggtttcgtagttgtccggcatcaagtatttcttatcgggaacgacttccaatttgatgaaattgctgccgcttagttcgcgggcaattcgcgctgtccgaatggcttcttcagcgttggtcgagcctgacgtgttaggcaaaatggtgatcccttcaggaatgtagtttaagatgttttccttgccggtcttgttgcggcgcagggccatggtgatgatttgggccttggcattattgatggctgaatcaatcaaatcgtatgaatattttcctgaacctaaaataaatcgagatgtgaaggcgtgtccgccaatcattaactcatctttttcgtttgccatgaataaatcctcctcagatttctgtatctcctaaaattagccgggtaatcatattggcttcgtggccggctgcaatcatgacccgcggtgccattaagccctcagcccccatggattcaccgtcaccggcgatgtataaattcttgcggggatgcttggtggtaatcgtgttagaactgtgaatgccggccatcccggtgcccatcacaattggcttgtcgggatagaactcggatgcggcatccagcagcatcgccttggcagcagggttatcgaacgcttcagtgatgatgtcagcgtcttgaaataattctttgacgttgtcatgggtcactttggtttggtgaatgttaatttccacaaacgggttaaattcctgcaggttttgctttaaggccacaacttttggcatgtccacctggctgagtttaaattgctgacggttgaggttactgagctcaacggtgtcaaagtcaatcaacgtcaagtggccgacaccaatgcgggtcagcgcaatggcaatgttggaacctaagccaccggccccggcaatggtgatgtgagcggcagctaatttgtcagttgaccccttgacattgcgttctttcatgccgagataaacgtcatcgtaactcattccttgaatttctggttcttgcatgttgtcaatcgactccttttatatcagtgagcggatccaagcggttagaaatcggagtgtaagtctcctcagagagaaattcccgggtttggaatttttctctgaggtgcttacacggagatttctgcttggaggagctgtcctaatcagtgagcggatccaagcggttacggttacccgcagacttccacttggaaccaccattctagccgccaccaacaaacgagattaactccagtttgtcgttgtcggcaattttagttgtgtcaaattcagagcggtggacgatcttgccgttctgttcgacgacgatgttttcaattggtgcttctctttgtttcaagaactcggtgattgtttgaccaaccatgccggattcttgttcaccgttaaccatcaccatacaaaaagacccctttcttcagattccgaagaaagaggtcggtggatgtcttttcaacattaaggtcgattcacagaaaagaaaaaccttcttttccgcaaaaagaaggtttaaggtcaaaataaattcaacattaaattcgctcttccttcggcagtacaaactacatcaggttcgatgggtgtaatctcagccgtttcaggcaccccagacgaaatattcaattaggcttgaaactttgctcaagctcataatctatttataaccgcttacaatctgaaagtcaagtgagaaatacttctatactttttgccaaggttcatttacactgatggcaaatgacaaaatattggaggaaatgattgtgaaactaacaaatcgaccactctatttggtgacggaccacaccggattgactgatgaacaattctttggcgcgattgaagcgggtgtgcaaaatggggttggcttggtccaactcagacaaaaagagggcagtagccgcaaaatttttgaacttgctctaaaggtaaaggccattaccgatcggtacaagattcccctgattattgatgaccgattggatattgcccaggcagttgatgcggccggtgttcatcttggccaaagtgatttgcctgtggacattgctcgccgaatcttaggacccaaaaagattatcggtgcaacggccaagacattgaagcaggctaaagcagctgaagagatgggtgctgattacctgggaaccggagccattttcccaaccacgacacacgttaagaccgttcatacgacggtagaaacccttggtaagatcaaacgattggtggatattcccgtgtatgcaattggcggcttgaaagctgataatgtcgaggcaattgatggtgcgcacgttgatggagtggctgtggtttctgcgattatgaaggctgccgatccggccagtgctacccgggagttgcgggatgcggttgaggaagccattgggtaaattatatcgggccacgaatcgtgttctagaagcaacgtacgttcagcgtggcaggatcattgacacgcactgtaatctctaatacgattcatttatcgatcaagttcagagggcccgaggaataggttctggactaacaaaaccccagttgctgtgttttcacaggctgaggtttttgttttggaggggaaaatgtgaagaatgaaaacaccaagtcgtttcggacctagaatcggcaatatcttcccagagttttcaccagattccaaaaagctgttgggctgccgaccttcagataagcggagaacggtcagctggcataaatagactttcccatcaagaaaatagctgaataatcgtttgcggcgtttcggcgctcatcaaaactcataagttagtcccataaaatacccgtggcgatggtctaacatttcccataacagtcaacaaatcagtcgcccgcggattccaaccagccattccaaaaagcacgattttgccctttttgtttgctaattttaaacttaaaggatggtgctgccaataccattttgtctaacatgcttaaaaaagtgtcagtaattctttgatttatgaacgcgcttgaagaaagcaaaattttcttcatgcatgtctccttaaataatatgagatcaaccaattaagctgattagatgggtgcctgtacttccgcaaacgacccatcccaaatcccttcatgatgtttaataatttgttgggcagtcaaatcgtccgtatcgaatgttgaattaaggcctgaggtggtgatcatcctgaatccacgatcgtgtcccacacggatggcagtgtcgatacaatattctgtctgaagtccgcagacatcaagggtattgaccgtttgatgtcgtaagtatgattctaaaacagtctcataaaacgaatcactgtgatattttaaaaagacgcgatcggtttctaaccggtgagttccactgacgatctgccagctgtcagtgccatagacaagttcatcatcaacgtgttgcatgaaaacaaccggcaaatttgcttgatgataggcatcaattttccgattaatttttgccaccagttcagggaagttgaataccttattgagaccattttggagatcaatgacgattaaagctgatttgttcataatgaagtgcctctttctgtcttggcaattgtctggaaaatgcccagcaattgctaagcttttttgaccagttgaaccaaatccattcctggttggatgtgatatacagattcatgggttgtctgatatccacaatgcgtatagaaggctagtaaatgctgctcttggacaattgtatctaccgaccaaatttttacgcgtgaatagagcccctctaattgtaataatgtgctgctgccaaagccatttccttgaaattctggcagaattgataacggtgaaattcttgcttcttggccactatcagaaacaatcacccggacgagtccaacaacgtgtttgctagttttgatatagtaataagttgaacgtggatccctcatcttcttgacgaggttgcttttctgttctagataggggctcgtattgacatcatgatatttcataaagagttgcttgaatgcagccttgtacataactaagattgtttcggtatcggttattggaacttgaattaattgaatattaggtaccatgttttgtgtccccctaatcatacagattgttaataaccaactaattataccaatattcatattgtctgcttcgacatttaggattatgatatgtctgattttataatcatctccatgaagggaagatcaatcatgaaaagttgggtacaatttgccgttttatgtatgagtgtatctgccgttgggataggtggacgttctgctcatgcaaaaggaacgcaagtgattagcaaagtgtatggtgctgttacttcggctccgctgctgaaacctagtcctgttaagtcaagttcatcaacaacaattgatattgttttaaagccaacgaatactcaagaattatataagcaagccatggccgtgaatactccaggtgattcacagtttagaaattatctaaccccaagtgggattcgtaatgcatatgggcaatccaaaagtgtgactaatagttggaaagcttatttaagcaaacaccacttaagcacgtttgtctatgataacgggataattttaagcgtatctggcaaagctaaatacatagataaattatttaaagttgatatgaaccatgcaacgtatcattctaatccactccagtttgggaagtcagcaccacgatttccggctcaactacaaaaatctgtctatacggtattaggcatgggcgaccacaatcgtaagtttgtcattccagacgcagatgtccagatgattgataaaacaaaaagagttccaaataatatgtacgatcttcaatcgtttgcaaaagattataatgcaaagccactatatcagcaaggactaacgggtaaaggccaaaccgttgggataattgcctttggcaatgtcgttaagtctaatgtgtttcatttctggaaatctcaaggagccagcaccaataaaaatcgactctccgttgagtctgttcctacaagcgtttttaaaaatggctttgtcagtaaagacgaatcagaaacaactatggatgcggagtatgctggtgctgttgcacctcaggcaaatgtaaaagtttatttggagaacagcccattagcgaccttcacaaatacaattaatgcttattcaactgtcttcaacgaaaacaaagttggctcggtttctaatagttgggggatcgggcccaattcaatttcacaaatgttagtaaaacggcgggtcttgactcccaaatatcttcaagtgcttaaccttgtattggcgcaaggcgcacttcaaggtatttctaatttcacggcgtcaggggataccggcgcacttattaatacattgcgtggtgtatctggaaatcagggattactcgatcgagcaacaactgattcagaccctattagttcaagtccatggattacgtcgtgcgggggaactatccctgcttcaactcataccatcaaaacacctcttaacttaggcaaagtaacaattccaaaggaacgcgcttggggatccgactgggcttggaactcacttaagagtcaagacggaaacaccacgacggttctaaagtcaattcatggctttgggggtagtggcgggggctttagccatttggaagcaacaccttcataccagcagggagtgccaggggttaataccttcaatgcccgagaatatatatccaatcttgcgcaacccgttttcgacacaccgctaatgcatggaactgatacaggccgaaattatccagatgtctctgctaatgcaggtggattgaatggatatttgatgtatcaaaaggaaaaaggtgagagcccttggactggcggcgccgggacaagtattgttgcaccgcagtatgccggcatgaccgcactgattaatagcgagcaagggcgaccacgaatgggattttggaatgcggaaatctatcgtttagctcagcaatcagattcaccatttcatccattgaatgatacaactgacaactcgaacttattctatacgggacaacctggtacggtatataaccaggcaagcgggttggggacgactgattttgccaagttggcagaggtttacaagtaaattgatgatggggatatctaatgcagccagcactgtagaagaagtctcaaaaactcttttgattcattgttgacttgaaatgtatttcttgcaggatcataagtgacagctacaattggcctcatttagaattaaaattccagcttaagaaaccaaaaacagctactcgtaatgagtagctgttttatcgaaggcaccaagggaactgccgccttgtggccttaaggccctatttatttctctgtacatttaatttaccatctattactaacactgtcaacgcaggcggcttttaacgctttatatgatggggcgccaatatcctgcagtattctggaatttaaatcataactatttttcgagaagtttttattgttttggtatatcaaactcttgaaaatctttcccaaaggccttaaatcaacaaacattcctaggacttttaaagaatcgaacaattttagcctagacggaaagacgctattaccgcctttgtgatagggatcgagtgataatttagccactaaattacggttgagcttaatatattctggtgttgaaaatctttcaataaggaagccatgtgcacacttatttcgaagctccttgattacgtcgagtgcacttagaaacgcaaatctcgagctcggtttgaagttaaaatcacttagaataccggtcatatcagccggttttaaatagtgagtcatttttattaatgtgccgaaatcgagtgtttgcactgtaacccatagagggacggcaacttggttattcttatgatagggggtaactcctggtggttgcacatagtttggatcttgataaaatttgggatctataaagtcattgtttcggattaatttatcaatgaagtttggcttaaatagttcaaacttgtcgaaattttcatacgtatatttgtattgataacgagtaaagggatactgatagtcattcttgatgttgtaataattgttcttattggtgtattgcattgtatcattcagagttcggcaatgatttgcgctgaaattatgtgcaagggatgtttttaactgatcttcaaaatcttcaatcaggctaaatattgcactttcaagttgcttattgaatttgtataaacgtttaaagtcatcaaaagtttcggtacgaaaacgtttcgggaccttttgagataagagatcattttctaatccattgatcagttgaaaataattcatcttttttaatgtggattcaatctcttcaacattagtattttgtaggtgtcgttcatcaatcagtgttttggcaagctcatatcggcttttccaaggctttatagtcatttgatgtccctctgtcttattctgcctctcggttctttcagttaaaattgtggttatctctggatcttcatattattttatcttaaagatcggcagttggctacttaaaatgggataaattcgatttagtgggtcaaaaaattgatcgctgttaacacgttatttgaaagtcgtgaaccccaactgtctttaactgtaaatgtgcccattttctggggttttagggggactttacgtatgaattaatttattcaatggcggcttcaatcctttttccaacagtttgaatatgatttgaactaactttcagccttgcctgttattgtgcgagtcctaatttctgcctttagacttttgaagccaattccccagctattttagttgcaatttcccccaaattactataatctattatcatacttacaaaaagtaagcagcaggaggaaaaagcatgagcatggttgatgtagacaaattacaatttggccttgaaacgtttggcgatatcgttcggggagaagacggcgagctgttgacggctggccaatccattcgccaaatcgtgaaggaaggcgagctggctgacaagctgggcgtcgatgtctttgggatcggcgaacatcaccggcccgattacagtgtctcaagccctgaaattgtcctgggcgcactcgcctcggtgactgaccgcatcaagctggcgaccgcggtgactgtgttaagctccgacgatccggtcagagtctatgaacggtttgctacgcttgaaggcttatcccaaggccgcgctcaagtgatgcttggccggggatccttcacggaatcatttccactctttggctatgatttaaccgactatgatgatttattcaatgaaaaattagagatgtacagccaactgattaaggaaaagccgattacttgggatggcaagttcacccaatccttgaaggatcaggatgtctatccaaagaccgattataatggcattgaaacttacatcggtatcggcggctcacccgaatcaattattcggaccgcccggtatggttacaaggtcatcttggcaattatcggcggccaggcggatcgctttgtgccgtatttgaatttgtacaagaaggctgctgaaaaatacaatatgccggttcaacccgttgccgtccattctcacggctttattgcggacgatgagaatcaggccgttgaagttgcttggaagaatatcaaggccaacttcgaccgcatcggtttgacccgtggctgggccccgatgagtcgggaacaatttgatggtgaaaccaaggtcggctcattttacgttggcaatccggaacacgtcgcccagcgaatggcccgcaccattaatctgatgaacctgggtcgatttgacttggtctacggtgccggcaaccagacggctgcccagcgtgaacgcatgattgagctttacgcgaccacggtgattcctcgtgtcaaagaaattttgtctgaggagggctaagcatggctgaaattaaaaatgtgggcatcctgggtgccggcaaggtgggaatcgtgttagctcagctagcgttaaaggctggctaccacgtgcgaatttccggatccgggtcggtcgaaaagattgccatgaccatcgagactttggtaccgggggcagttccggcgaccaatcaaggggttgttgccaaaagtgacctgattatcttagcaattccactgagccgctacaagaacatcaaatccaagctcttaaagggcaaattggtgatcgatgccatgaactattggtgggaaactgacgggattcgagaagaagtgctggacccatcgtcgacttccagtgaacaggttcagcagtatttcaataagagtaccgtggtgaaaacatttaaccacatgggctatcacaacctgcaggaagaggccaaaccagctggagcagacaatcgcaaagcgttgtttgtgaccggcgataaccaagccgccgttgatcaagtggccgagtttgtcgacagcatgggctttgacactgtggttcattacaacattgctgacggcatcatgacggagcccggcagcgagctgtttggtgctagtttgaccaaggcggatcttcaaaacgtgattgatcattttgatgaaactgcctttggcaagaagattaaggctggcgagcagggctagcgtttagctaactgttgaccagtgaaataaaaatttatacaaaaaatggcccatggtcaaatcccggtaacatgatgtttgtgagaacaatcatgatcggaatttggccatgggccattttaagcatctgaagatttatgaaatgttgaacttacgtgatttattcaaaattaattaatcacgcttacgccgtttgaaaatcatggcgccggaaatgacaatgacggccaatgaaacgtcacccagaatactgagccaattttgctgcttatcacctgtttgtggtaagacggatgctttttcaatcggtgtcttgccagttatatctcgggaattccgcgatgtgcggttagtagtggttcccgttgagtgatttggcttagtcggccaattggagtgagtcgacttggttggctggttaggctgatttggccgacttggtttattcggcgtatttggtcgattagattgtgtcggtttatttggcttattcggctgattcggtcgatttggtttatttggcttattcggctgattaggccgatttggtttatttggtttatttggctgattaggttgcgttggttgattaggttgcgttggttgattaggttgcgttggttggttaggttgcgttggctggttaggctgagttggttggttaggctgagttggttggttaggctgagttggttggttaggttgcgtcggctggtttggctgagttggttggttaggttcagttggctggttaggtccagttggctgattaggtgtggatggagtaacccacagaatgattccagggacgtcagaaagtattgggtactgcagttcaccaagaatggtggttactacggaatgaaagagctggccaatatcacccacgatagattgaccggaaacacttgcggccgctaagtttgtcatttcactttgattagaattagttataggtgcgctggtagcggtggatccgctgttaatccccaacccatccttcaaggcattccaaatatcccaaggggaagaccacagtccaccagttaaaaactgaagaactcgtccaggaatcacgattggttctgatgatgagttaattgggtacagtgatattgtcccaccgccaagaattgcaggtgccgaaatggccgcgccggcaatagcttggggaataatagttgctagttgaaagacctgttcccaaaaatcactggaatttgggtccgccagtgattgggtatcaataggcgtctgagctaacgaagcggtttgatcggctgttgtcgatgaatcggttggatccgtggtagtggctgtctttgcggaatcagcggttgcatcagtgttttcagtagtggccgtgttcggatcatcggttgtggttgggtcagaggctttgttctggtcgtcagccgcattttgatcaggttggtcgcttgtctgattcgatgggtcagtcgtggtggcatcattgtcagtgccagttgcagacggatcattagtcgtagtcgttgcgggttgattattgtcttgatcagtcccagtcgtttgggtcgagtcgttcgtccctgttgttgtaggatccgcggtcggtgtttgatcagttccctgatcgtcggctgtcgttgttgtagtggttgtgccacttgtttgactggcatcaggagtcgtggtggttgcaccacttgtttgactagcgtcagaagtggttgtcgctccggtgttctgagactgggctggcgtctggctattatccgttgtggctgtcgagttgtcagctgaactggtttgagcagcggcttgcgtatcggtactcggttgagtagtcgcagcggtcgtagttgttgccggtgcctgattatcgttggcatcggcttcgactgagctagcgccaaacgcgccgccggccatcaagccaacggtgagtagtgaagcgtacagccaatgtttcccggccttatacattttgtaatgaacctttgaattggttctatttaattttgtcatggtattatttcccctcgaataatgtattttgtaaaaatgaacttaattgagttgttcaattagtttgtcattcattgattttgaataaaattgtgccacatctgctgcacatggcttgcggaatacttctcaacagatgccggcgcattttgcccgtaccgttgaaggatctctcggtgtgtcagtaggtgcagcagtcggcgataaagttcacgttcatcgcctgcagtgatcagttccccgttatgcttgtcttgaatcatttctgccggcccgtaattgatatcgtagctaagaaccggacatccgtaaccaagggcttctaagatcgccattgcaaacccttcgtatgaactggtcagggttaacaagtcagcgtgctgatagactgacgccaaatcgtgaacgtagcctttgaaggtgatatagctctcagccccagatgttttgacgagttggcgcagtttgttgccttcctggaagtcattgacattttcgtacccataaatatccagagtaacgaagggcaggtgttgatgaactaagataatggcttgaataatgtggctcagctgttttaacggtgtgatccgcgcgacagcaatcacttttccgggaatccggtcgctaaatgattccgactgatgaatcagctggtcgtcaaggtaactgaccggaataacggtcgtttgaaccatcgggaaccgtgactgaatgtcactggcttcctgctgagtggaaacgatgatgccggataacttgtccttcaggtcaatcgcttgctggaaatatggaaatagctcaccatcgcgcttggcattttgcgtaaaaatagaatgcaaaatgagatagcgtttggcgggcttggtcatcaatttaaatgcggggatggcaacgtcctcgcggtcactataaaacgtggcgttcgaatcgtctgctgccaggcagtcaagaaagtagcccattaatgcgtcctgattatcgaactgccagagccggccgttatgccgtaagtgaatcagcgtcagcaccggttggttgccagggccacctcgatagtattcagtcatgacgatgtgcccatctttttgatagaatacccgcgtgatcaatttggcatgatcgtcaaaatactctgaagacacgcgctgattgaaatcgtacaggtcgcgacggtcggtgaagccgaactggtccaaataatcgatgttattgatccagccattctgttcattgactcgaacccggagcttgccatccttatatcccagatcattttcaatcggaatgttagtgaaatcgtgcaacacatcttcagctttgggaatcggctcggcttggttgggaagctcagtaaagtattggtagaggttaatgacttgatgattgtcgattagctgctgtaacacccgattactaccacgattgcggttgcgggtcacaatcgtggcaggaaccttgagtttcgaaaataaatgtaatcgttgaatctccgcaatttcgatcgcagatgtgttctcatcaatctgcgacgtcaaaaaatagtgcgttatcatcaccccccctgttggttatatataacaatataggcatgaatattatgtcgaagcattgaaacaatctgttttcaaaattgatttgagcacgctgaagtgctttgctgaaggcatccttgtcaatggtgtgagccaagttggccatcatgtctacttggaaacagtcaattcaagagccctcactctataactgttttcctatctataattattataacaataaatatagtattttaatatgattgcgagcaatttttattaatgggattttgaatttgaatcctgtgaggggatttggcgttaatttgacagtggttgagtgggtatgttatctgagtgcttgagtgaacaaatttgatgctcaaatatcaagatcagctcatcttaaaggatgagtatttaccaaggtaagtacttgtaataacattgtaattacgatatacttagctcaaattttagggaggaattgatcatgaataacttaaaaattgcaaacacaaaaacgcataaaactggcaattcggtcagcgtaaccttgcctaaaagcacaggattttcgagcaacgagccggtggtaatcgaaaaagtggatgaagatactttgattatccggcgcgcccacagccataaaaacccgtggatatcgggcgcatataacaatgttgattttcgtagccagattgacgagattggtttcaatgttggaaacgagtcaaggaaaggtcgggaattatgagtacatcctttcctgaacaaggcgatattatcgttttagatttcgaaccccacagtgggcatgaaatgggcggacatacgactggccacccgcgacgaccagcagtggtggtatcgaacgcccaatataatcggttgacaggatttgttgtcgtgatgcctatcatgcacggcactggtcaaattcaaaagggattcgaaccgattcttgacccaagtagtcgtaccaatggctatattgtgacttggcaaacacccaattatgattatgttgcccgtaacggcgcgatcattggtcaagttcctgataaacttcgtaaacgcttatgtgccttggcggtcgacattgtggctgccaattaagtgaaataccaagagctggtgtgttagtgccagctctttttgtaaaaagtcggaattcccgcttagtctaataaggaccgtcaacgtaaaagcagcgttaacggtccttattaaactaatgctcaaaagatgattggcatttatggttatttttcagatttggctgcctttgaggacagctccgacaaccctgacccctaccacataagccaaaaaaatcatggatgaacaagaagcgttcatccatgatttttctgtcttatgttccggggtcaacccgggtttcgtcgcgcactactgttcttcataccaagtataatggaaactccctggacggtcgacacgctcgtacgtgtgggcaccgaagtagtcacgttgtgcttggagcaagtttgctgggacaacttctgaacgatatgagtcgtagtatgagacagcggctgccaatgatggtactgggacgccggccttggttgccaatgcgacgacgtcacgtgctgattcctggtacttcttggcaatatccgtgaagtatggatccagcagcaggttttgcagatctgggttcttgtcatatgcgtcggtaatattttgaaggaagcgggcccgaataatgcagccggctctccaaatcttagccatttcgcctaacttgatatcccacttgtattgttctgaagcagcctttaattgagcaaagccttgggcgtaactcataactttaccgaagtagagggcttcacgaactttttcaacgatttctttcttatcaaaatcaactttgccttctggcttaggaagaactttggatgctgcgacacgttcgttcttaatcattgaaatgtaacgagcgtagacggcttcggtgatcactgattggtcaacaccgacttcaagggcatcttgtgagctccacttaccagttcctttgttggcaccacggtcaagaatcatgtcaacgattggcttggtcttgtcatcaccaatatcatccttatgagtcaaaatgtcggcggtaatttcgattaagtagctgtcgagttcacctttgttccaatctttaaagatgtcagctaattcatcaactgagtagccggcaaggtttcttaaaatgttgtaactttcatcaattaactcttcatcaccatattcgataccgttgtgcaccatcttaacgtagtgtccggcaccatttggtccaatgtaagtaacacatggttcgccgtcagcaggtgctttggcagcgatttgcttgagaattggttctaccaaatcataagcttctttttggccgcctggcatcagtgatggtccttgtaaggcaccaagttcaccacctgagacacccatgccgataaagttgattcctgatttatcgagacgggcatttcgagccatcgtatcgtggaagtttgtgttaccaccatcgatcaagacatcgcctttatcgaggagtggcagtaattcatcaataacagcatcggttggtttaccagccttaaccattaaaataattcgacgaggcgtttcaagtgatttaacaaagtcttcaatcttgtaacttggaactagtttcttgtctccatgatccttcataactgcttcagtcttggagccggttctgttgaaaataccaacagtgtaaccgcggctttcgatgttaagggctaagttcttacccataacagccataccaacaacaccaatgtttgctttttgatcagccatttcaaaaccatccttttctatataagaattactacacaattagtgtaccatctcacaagtggaaagtgaaacaaaaacgcgttggaacagtatgccgaatttgttagatgagagattgtgaaaatgaaaagccgtttcgtggggagcgcttacataattcaaaatgaccgattttcaatcattaagggattttgttgcttgaaaaatgtaaatctggatccatggactttcagcaaaatggtaaaaattttcaatttatttcaaatattaacccaaacaaaaagctgaccggaaacgaattggttttcggtcagctaaattggttagatgttacttattcaatttgtatacccattcacggtgatcgcgggcaagcaattcatcagctgaaactgggcccattgatcctggaatgtagttagggaacattggttgttgaatatcccaaactcgacggatttgatcaacaaacttccatgcactggcaacttctggccagctggcgaagttggtaccgtcgcccttcaaaacgtcgtggattaaacgttcgtaaggttgtggggtttcgcgggtccgctttgaatcttcaaggtattgcaactgaacgggttcagtgtggaatccttgttcggagttcttggcgttaaccatcaatgagaagccttggtttggttcgatgaagatggtcaaaacgttggcactcaatggtgcactgccgctttgtgggaaggcgaagatgtcaactaatggcttcttgaagacaacatcaactcgggtgaacttgtcagcgagtttcttaccggttctaatgtagaacggtgtgcctgaccaacggtagttatcgaataacaacttgccggcaacaaaggtttcagtgttggaatcctttggaacaccgtcttcttctcggtattctttatcgttaccaacggcagcgtattgaccacggacaaagttgcttgatgcttcggcaacgttgtaaacccgcaggctacgcaaagccttaactttttcagcacggatatcggtatctttgaacgcaaccggttgttccatcgcaagcaaactgacaatctgcataatgtggttttgaaccatgtcacgaagggcaccggagttgtcgtagtagccggcacgctcttcaacacccagcttttcagcaagggtgacttgaatgttgtcgatgtaacggttgttccagagggcttcgaaaatggtgttaccgaaacgaatagcttcgatgttttggatcatttccttacctaagtaatggtcaattcggaagatttggtcttcttcaaaggcattgcttaagtcgtcgtttaattgtttggctgattcgaaatcacggccaaatggcttttcaatgactaagcggttaaagccgtttccttcggagagaaggtgttgagccttcaagtttttagcaacggttccgaagaagttgggtgccattgaaatgtagaacacgcggttcccgttcaattcatacttcttgtcgagttcgttagctttgtttttcagtacagaatagtgttcaaggtcagtcacattgtgggtcacaaagtagaaatggctggcgaaatcagcaatttgttttttattagtagattctttagaaacagacttgatgaccatttcacggtatttttcatcatcgaacttgtaacgggaagttccaatcacagcaaagtgatcgcgaatgtttcccttctcgaaaagctttaacattgcgggataaagtttacgagtggcaaggtcaccagttgctccgaagagcataatcaaagaacgtctttcagttggcaaaatgttcactcctatcagaatattaactaagtaatttggtatatgtctataccagttccccaacattatataacacatgagaccccaacaaaagcgaattgccaatgtaaatgaataaaatttacaggcatgttcttttcataattagccgcctaaaagcgatgcctaaacagtgacggttttcttaagaaaaggataaatgaaggccgacttgacggctttttttgcccatatcctttataatgagtcatgcaaaataaagattagggagcaatatcaaatgaagaaatttaagtttatcgcgttctttgctgtcctcgcatcatttttgattgggttcagtgtcaacgcttctgcaagttctccgtcacttaaagtcaataacatttatacgacctcaaaggcagtgactggaactgccaccaaaggtgttgccattattgttcgaaacaccaacaaaaccaccattgccagcaccacggctgacagttcaactggcaagttcagcgccgagctgcacaccagtgttaaagccaaccagaagctttatgtatacgcacggaagtcatcaacctcatacttctatcgaattatgaccgttaagacacctaagactgccacggcaacgaccacgactggttcaagcaccaaatcaaccagcagtaagatcaacatttcagaaccaactggtcgttggcaatcaggcaacaacaatggttacagcgttgtcaccaacttcagccaaaagggtggtttgaaccaaggcctgtataagaatggcaagtatcaaaagaagctgatcaacttcgccaactacaaagtcacgacttactcaaagaccttctggggaattacttaccgtgaacgcggcagcaagacttatcacaagttctacttgagatttactgacaatacgcatttcatcattgtcaacaaagccaaccacgccatcaaggttcaatatggcaacacgccgcttcactactacaaatttgctttagttaaataattttaaccagctatttgattcggggctgggacttaactgcttgtcagttatgttccagtcccttttgagttctactgttatccttgattaaacgtggaacgatcggctgatcccggccatttaaggcacaaatcgagtcattccaaggacaggaataactcgatttgtgccttaaattctgggatcaaaacgcctcgtgtccactctgcctatgctatgataactgtaacccaaaggtttggaggccttaatgatgaatgaagatcaacgaatgcttgccggcaaattgagcaatccccgcgaccctgaattattggcgcgtcagcgattggcccatcggctggtcaaacaatataacgacacctttgacgatgaacgcgagaagcgggctgatttattgaagcaactgctgcccaattcatctgaacggatttatctgcagggaccgatctttgtggattatggtactcatatcaagattggcgatcatttctacggtaacactaacattacttttttggataccggcatgattaccatcggcgacaacgttttatttgggccgaacatcagcttggtcacaccgatgcatccactgcgctaccaagaccgaaactttgccgccaataatgatttacccggaaaagagtacagcaagccaatcacaattgaggataactgctggttggccagtaacgtaaccgtgatcggcggagtgacgatcggcaacgggtcagtgattggcgccggtagtgtggtcaccagagatatcccagccgattcccttgcggtgggcaatccttgtcgtgtgctccgaaagattaccgaccaggacgatattaggctgaaaaaggaattattttaaataatcttcagtaataaatacagtttctgttgttaatatgcgaaaatggacgtagaagattttgtggttaaaaatgagtgtaagaggggactgagcaattgataaaacaacggagtgaaattagatttaattcggtcattgtgtattcactgattttaaacgccggggcggctttcatgtggccgctggtgacggtgtatctgcataactacctacataagtcgttgacgctagccggaatggtcctgctggcgatgtcgtgttgtatgatgctggggaattatcttggcggctatttatttgatcgctggtctccctacaaggcaacgattatcggttcgctgatttcaacgacggccattgtcacgttggtcttcttccatggctggccgatgtttgggattatgctgctgttcgttggctttggtgacggtgcttgtttgacgctgctgaattcatatgccgccagtatcaaaacccgttcgacacgggatatctttaacatcttgtacattggccaaaacgtcgggattgtgattgggactttaatggttggcttcctgttaaagcatggggtcaccctggtgtttaccgttacggcagcattttatgcggcactggtcctcatcacgattttggaattcaatgttcacgttgatcggcgggcacctgggaaaccagttaagcctggggcaccagttgaagccaaagttggcgggatgattctggcaatttgtggcgtggtcctgtcagtctatctggcgtatgccttatgggaaagtgtcctgccggtgcacatgaccagcctgcacattccttttgaaaattacagtttactgtggacgttaaacgggttgatgattgtcatcggtcagccatttgtgaaccgaatcgggactcacttcaagctgagcactcagacgtatgttggagtggcaatctttgcggcatcgtttgtgtggttaatctttgcccgcgattatactgcctttgttttggtgatgatcgtgacgacaattggggagatgattggctttcctgggattccagcgtggattgacagcttatcgacgcctcaacaacggggaaagttccaaggcttgtataacctgttcatgtcgtgcggccgggcagttgggccgttgattggcggcattgtgctggactttgcgtcctataaagagctgttctcgctggccgccggcttgatcattatttttgtggtcattttatgggcgatgaatcgacgaaggactcggcaacggctcgttgaaacgaaataatgtagaaatcaatccagttagcaattggcttagtttagctgctaactggatttttttgacgatgatataaaaaagcaactgattattctcagggtgaggtaaccagttgctttatattaattcagaatcatttgattcctgttaatttaattgtggaacccgtttagctttgcgccaatagtttataaatccgctcaacatcccggccggttccgcggagctcgtagtcggcaagaaaaggtttattaaactgtgaggcgtaacgcttggcggtcagacaatactgctcgttgaaatttttattcccgctgccgacaattccgtgacacaatttggcattgtcatcgtaggcaatgtattcccccaaggcattggtcatcagttctttaacgccgttgtcaatgccgttgccgccgtccaaatacgtcgggacaaaagcaaagaatggttccgtttcgtcagcaaaatctgtctgttcactgatttcctttgagaccaccaatggattggcagggtcttggtcgtgcatgccagtcgcataactggtcaagtttttaacgaatgaacgcgtatttccctcaattgaaatgaatagaatttttattgggctcacaatggacctcctcagattagatggaaatgatttttgaaaaatttgtttgttatcctaactttaacgattgggcgaccagttggcaacctcaatttgactggctcttgccatgttttggcttgtgctgttgaccggttcgttccggtaagaatttaccgatgatcgcaaatcccagtaggatgataaatgccaaccagctaatacctgaaaccaacttgccgactttaatgcctggcgtcgtatagtcaagcttgatctggtgctggccagcaggcaggttggcaccgacaaagcccttattaacaacgaaggtcttcgtcggtttgccatcaatggttaatttccagccggtggagtatggaatcgaggtaaccatcgtgccggagcgttggttgttggtcgtgccgctgacgtgattgccgttgactttcaaattggcaggcttagtctgcttgagtttctgcatttgagtgtcataagtcttattgaacggcatggcaaccagcttggccgacttgaacttgatgtttttgacctgattgaagttgaggtcaatgttcttgcgttggtgagttgagtaacccagattaaggacgatattactgatctgacggtaattggatagattattgttgtcatattggttatacccattttgatgatctttagcgaaggcattgaaaatgtaaccgccaaaggttggcttcaaaatgctgtgacgatactcgtccatcttgcccatccgcgagtagagtttattatccaacaggaactggttagccatccactgtctgtgttcggcaggggtaccatccgtttgcttaatcccggagagaaccaggaacaattcagtgttcttggtggccttggggttcttaaccttcaaggtatagtcgattggattaccaacaacgtctgaggtcatctcttttaggccattaatgttcttgtagtggttagtctcgatgatcgagcggttggttgccaagaggtccttggtcttttgcaggttggcacccaggctgacctgttcgtggggttgatcgaccagctggtccgagttggctttattgataatgccaagtcgatacttggtgagttgacggccgttatagacaatcttggaggtatccattttgacggtataatcaatgtttttcttgggtgactggtaattaaggggatgggtattatactttgatttattcaccaccgccccttgagtcatgacccgctcccgatcgacagcactcattttgtcataagcactgggagaaacggtgttgtactgcgtataaaccagcggcagtgcgttattggatttataaattgtcgtcccatacatattttcgattgcctggacggcatctgtccgcgccttggcagggaagaccttgatttgaccattcttgtcacgaaccggtttgtagccataagggacaaccggtggattcttggtgttggctttggcaaacatgtacttgacgcccagcaggttgttaaaggcggttcgataatcaccttgagcaatcggggtgttcattgaaaattggctgttgccgactgattgtgagaatttacccagataaccattctgcagggtcagatagactgacgtgtcgttgagcccgctattgatcgggaagtcggtattggtattcgaatagttggctaaattttgaatgtgggtattgtagtgataccgcggattcatggaaactctgaagaagccgggcatctttttgaggtatttctgtgcgccactaaagtaatcgttgctaaaccgggttgcgagaccgcggttcagctgctgcagcgctaatttgctggagtgcggactgtaaatgccgatgatgttggcggataagttcagcatgaagacggtcgagaccaggatgactttagtcgatcgtttccaatcaaagacgacacagcccatcaccacaatcaccgtcagcagtaagaagccatagacgatgaaatcgtggggctggagattcattaagaagccgccaaatgcccagactaagacaatcaggccaatcgaagcccaaccgaaccaggcgatatcctgcttcgtaaaatcgctgatatgttcaataaagaccattgttgcaaacccaaacaggatgtttaccaggaagacccagcggttggaaggcgtcgaaatcgcgttcataatggcgccgacagccggcaataggatcccgatgaacatggtaatcagggcgacattttgccataaatagcgtttaaagtgcctcagcatgtacaccaggccgagatatgacaacccggaaatcccgatgaccagccaaaagttcatcgcccgaccagtcggtagaattgccccaggaatatctaagtaatactggagcggaaagaaagtcatgccattggcaaagttgtcattgagtcgggtggagcccgtcgccaaaataatcgttggcaaaaagacgatagcagccatcccaaggccaatcactgctgaaaggaccaatttaccaaaggacttgaggggcgtaaaatcaggccattttctcaggctcagcattctcagaatgacataagcaattgaaccaaacccaagaatccaggcaaagtagaaattacttaaaaagaccaggaagacggcaaagatcaatggcagccacgacttgttatgtaaaacgcgatcgatgccgtagcaaagcagtgggaagaaaatcaaaggcagaataaagaatgggtggtgcaaggcagttgccaaggcgtaaccgttaaatgcataagcgatcgacccgatgatccggctggacttcttaaattgatacaatgaagcccacaacataaagctcagaccggaaaaatacattcggagaaagaccagcaaggcaaagacattttcgatctgactctttggaaacagtgcgattaggtaattgaacgggtcgccaatcacataataagcaagattggtcagctgatcggaccctaagctgatgttccaagcccaatgggtaaagccaccacttggattatgcagaaatgacagtatcatgtgcctgagctgcactaaaatgggatagtgctgggccattccgtccagctcccaaatcattgatcgacctgttaagaacaagcaaccgactaaaacacagatcagcgcggtaaacagcaccgtgtatgtgatccacgttggtgttttttgccatagctttttcacttgttagatcccccttaaacgttatgatgtctaaatcgtctctaatatgtaaaaagactgctcgcaaaacaattgtcttgtcacagtcttattgaaattttaaccattagttgtcatggtgatcgtcatcatcgtcaggctttggcacaaccttgtgcttggttacctcaaaccaattgataaatgagttttcgtagtcaacaattttgaaatcgaagttctcaaatgagatcacatcgccggccttgatatccgggtagttatccaagaagtatccggccagggtaacggcgtctgaattggtaaactctgggaaatcagcatcaaagtatcgctcaaagtcatgagtggttaattttccgttcacctgataggtgccgtttggctgtttgaagatatagtcggtaattgatggatcaatttcatcccgaacagttccaaacaactcttcgtaaatgtccttgtcagtaatgattccggaagttccaccgtattcgtcaacaacgacgacaattggggtccgcttctgaatcatttggtggagaacatcagtgatcggcgtcatttccggcgtggttgaaatatctctgagcaggcggtcgatcttgatggtggggtcaacttgagattgacgaatcaggtcatagttgtagacatagcccagaatcttatccttatcgccattggcaaccacaggaattcggctgaacttctgctgcagatagacttgaacggcttctttaaccgtggttgtaatgtcgatgacgaccaattgggtccggtcaatcataatgtctttggcaaccttatcatttaactggaaggcccgctgcatgtacagataatcgttctgttcaagggcaccgctcttaacggcatttctcgacaggttcaagatttctgcctgcgagaacgactcgtcgttttcgttggcaacttttaagcccagcatcttaacgattccgttggctgaaatattgagcaaccagacaaacggataaaagatgacatggaaataatgcagcggcgtgctgataaaggacagcacctgcattggcatatcaatactaatgtttttgggaataatttcagttaacacaacttccaaataagttaagatgatgatccccagtacagcgcccacagcgtgagcagcggttggatcgattggcgagttgtggatttccatcacatcaaccaaaattgtgaccacaaatgattcacccagataacctaggataattccggccaagctgacaccaacttgggtggtcgaaagatattcattcaggttggtgaccatgtgaatctcacggtcgagcttctttaaccccttggctttattgcctttggcttcttctagatttttcttgcgttcttccagcgcacttgtccgtgtttgaaccagggcaaattcacttgccacgaagaaagcagcgaacaaaaacgttactatcacaataattagattagtcagtatctggctatcgtccaaaattcaattcctcatttcaaaaatgatatattcaaattagatcaatctgtaacctacagattacatctaattatacgcccccacaaggtattttttaaagtgtttgaaatattattgatggaaatggtcgtttttcttaactattgtcttcaatcagtgctagcattaagatagatcaaaataaaggggatgttatcatggctgaaaaggtaaaggaaagtgctgccgaaaagaaagccgatgccgaagaacgagataatgataaagacctcaaatacaccgacgaacaaattaaaaaagcagttgatctgattaacgagcaaggttacgtgaccaagaaggatattccagaaatggatgacgatgactggtcaaagggatttgccgacaagatcgataatgtatttaaagacagcgacaaggatccttacatctattatgaaaagtttgactatgccggaggtgaaatcgacacaatcatttggaatatggatgtgattaagactcgtgacgatgcgttgaagaaattagctgacgtaatgggtcaaaagatcgttcgttaatttttaattgagttgcttagtgaatttaacaatccagttacgattgcgaatttcactaaagctaaaaggattgatgccgattccccggaagtggggatgagggtcaatccttttttgaataatattggatgccaaaagaggaggaaacacaagcgcaatgctttgtttccccctcttcttgcgcacgcttatcaaatttaaaatgccatcattaaagcaaacactaacggaatggtcgccaaactcaaaatggtcgataaactcatcaacgcaactgccgggctggcatctccgtatgcctgtaaggtgaacaaaaccaccaggccagcggttgggcaggcagccatcaatacagtcgtatccaaggcaacaccggaaacggtcagtgcttggagaatgaacatcgccacgattgggaataacaggttgcgaaagaagattgccagccataggtgccagtcaatcagttgacggctgatgcgaatatttcccaagctgttcccaatgacgatcattgacaatggtgtgttaatcgagctgacgtagtgaatgacgcggtcgaccggtgtcggcagctgaaatgatagtaggaaaataaccaagccaacaaagatcgcaatgatgttgggattgatgatgatttcacgaaaattctgccagtggtcgggatgcttcttggtcgtcttaaatagtgaaacaccgtgggtccagctaaaaatgttgaaaccagccagtgacgcgacggcaaagaagacccctgtgttgccaaataatgcggaggtcaggggaatgcccatgaacccggcgttggagtaaatgctgccatatttggtaattcgctgcaggttgatgttgctgatgcggccaaaggaaaatttggcgatgaggatttcaattatgtaaaagaagcagatgccgacacataccagcatcaattgcttcatgcgagctgcagaataggtttgttcaaatgccccaatgatcaggcagggcgaaacgatatacagcagaatgttagtgagatcgttggaagtctgggtatgcatgaacccgactttgttgatgaggacaccgattaacatcaatacaaacatcaacacaatttgattcgtcagttgtccaagggccatgccatcacttccttattaagatttgaaatattattttaaagattcccggtattcagtttcctgattttcccattcagctttatcagcagcagtgattggtcgaatgacccggcagggatttcccgccgccacagaattggcagggatatcgtgagtgaccaccgatccggaaccgatgaccacattactgccgatggtcacaccgggattcagggtggcgttgccgccgatccagacatcatcgccgattgtaattggcttggcgaacccgagccattgattgcgaacaccggcatcaattgggtggccggcagcaaataagttgacccgtggcccaatcaggacgcgactgccgatggtaatcttgccggagtccaagaagacgccgttggtattgcagtagacatcatcgcccacggtaatgtttccgccaaagtcgcagaaaaacggcggttcaaaatagacgttgttaccggttcgacccagcagttgtctgaagagcttttgaacgtcggtcccttcttcggcaaaattaatctgatgaagcaaatgatctttttgggcgtacttcttggccaagtccttaccgtaaacgttatagagtttaccggacagcatccgttgttcttctgtggacatggtaaaagcctcctttttgcgagcccaaattagtattggtggcccagttcatagaccaattcaggctcattgccagttcgctggttcttattcatgacgtcaatcatgctcatctcgtccgggctgagttcaaagtccaattgggtattttctttgactctcgccggcgtctttgacttggggatgatggagattccgcgttggaggtcccatcttaaaataatttgggccggcgttttgccatgatgcttggccatcttattgagcatcggattatccaagacaatgcctcttcccaacggactccacgcctgggtcacgatcgacatcttcttgtcgaaatcgatcaaaggctgctgagttagatatgggtgggtttcaatctggttgaccaccggcatttcgttggcctgggtcttcagtaattccaattgggaacgtgtgaaattgctgacaccgattgatttggccttgccctgcttcttcaattcctccattgcctgccaagtttcaaagaagtgttctgcgaccggccagtgaattaataggagatcaacgtagtcggtgcccagctgctggagtgaaaaatcggtgctgttaatggtcaaatcatggccctggttcatttccatgaccttatcgataatgaaaacatcttctcttctggcaacttttttgatggcgtcgccgagctgtttttcgttgcggtagagttgcgcggtatcaaacattcggtagccgctgtcataggcggtcgcaatcgtttgatccattaattcgggattatcgattttataagtgccgaaaccaagctttggcatttgatggccgtcggctaattgataggtacttttatctggttgaaacatttcatttcccccttgcgagttagttagattcattttagcatacccgccagtcgatgtttggcaacgttttggcctgaaaatcataaaaatccgataaacttaatttgttgcgtccaaataaatgtgattttcggccgtaattttgtacaattatggtaaagcgaggtgttaagcgatggcagacggaaatagtcaacaggtcgaccccgaagttggattgagtgacgctcaagttgagcaactcattaaagacggccacaaaaatactggcgaggaatcacttacccgaagtgtttcggatattttgcgcgacaatacgttcacgctttttaacttgattaacgtgattttgggggcactggttttctacaccggcagctacaaaaatctgctttttctggggattgccatctttaacaccgcgattgggattatccaagaaatccgttccaaacgccaagtcgacaaaatggtcttattggcggaaggaaaaattaacgtgattagaaacggtgaggatctgcaggtccactccaacgatattgtcctgggcgatattatccagttgggacgaggcgaccagatcccggttgacggcatcgtcgtccgatcacgggggattgaagtcgatgaatccccgattaccggtgagtcggtaaccatttccaaaaatattggggatccattaacctccggtacgtatttggtcggcggttccggcaaaatgcaggtgacaactgttggcgcggacacctttgttaaccatttatccaacgaagccaagcagggcgaggacgcctccagcattctgttaaatacgattaatcggattatcaaagttttgacgtacgtcatcattccattgggaattattttatttgttgccaaattatatggcggcaccggcatcaatcgggcaattctgggtgctgccgcagcgatgattggcatgattccggaaggcttggtgctgttaacctcaatgacactggcggtttcggcgatgcatttggcccgtaagaaaacgctggtgcgggacctgccagccattgaaaccttggcccgagttgacgtgatttgtttggacaaaaccgggacgattaccagcggcgatttaaaatttgttgaagcaattcccatgatgaagaatgtttctgccgcggaagttgaaaaagtggttgccgggattacgtatggtaccggggatgcgaatgaaacggccaacgcgatcaaagatgccgttgatgatcctgagctaaagaccgaaaagatcatcccattctcctcggatcgaaagtggagtggcgttggtttgagtgatggccacgactatgtgtttggggcaccgcagtttatttttgaacacttggatgaacaggttcaagccgtgattactcaaaatgcccggaaagggtaccgagtcctggcggttgcccaagtggatgatttggatccacgaaagccacttgacgcaccaaagttgattggcctggtattgatttctgatgtcatacggcccaatgctgccaacactttcgaatatttccgcaatcaagatgtcaatattaaggtgatttccggggatgacccgaccaccgtttccacaattgctcaacaggccggcattcaggatgctgccaacagcgttgatatgacaacggttaaggatgaggacgactttggggaaattgctgccaacaataccgtttttggccgggtaacccctgaccaaaagaagcggctgattgccggtctccagtccaaaaaacataccgttgccatgactggcgacggggttaacgatttacttgctttaagacaggccgactgtgggatcgccatggcttccggaagtgaaagcaccaagagtattgctgactttgtactgattaattctaattttgacgccatgattgatgtcttgaaagaaggccgccgggttattaataacatcgagcgggttgcttccatgtatctgattaagacgatgtactccgttgcgttgtcatttatctttgttttctttgccacggggtatccctttgaaccgattcagctgactccaatcacttcattaatggtgggaatcccatcattcttcttggctttggagcctaacttcaacaagattaccaatcagttcatgaagcaggtgctgattatttctactccggcagcaatttgtattgtcggctacgtgatgttaattgaaatcatcggccagctttttggactccaatacgagttcacctcaacgctgtgtgtcctgttgaccggggcaatctgttggttggcattagtgatggtatcacggccactgaaccggctgaagattgggatggacatcttggtactggtggcatttttgacgatcatcatcttctttaataatattttctcgttggtctccttctttaataaagacatttggctgtatgccattccacttatcgcaacggcctatccgctctacatgttcatgcagggggttattgccactgtcttggataagcgggagaagagacgactgcgcaaacaagcggagggtaagtagagcaccactgttatctagctgaaacgtgcagcaatcggctgatcccgccatttaagccggcaaaccaattattccaaaccctggaataattaatttgccggcttaaattctgagatcaaagcgcctcttactccactccaagttagattatctagtgccccacactagctaacgtggtataataaactcgaaggagtgataacatggcatacaatgaagaacaatacgagcagtgggaacaaaaactcaagcaggtggaactgccgctgtgggcagatttacccaaatttgaattgtacatggatcaactcgtggcactggtgaacgagacgctggggccaatcggaattgataaagtcactccggcaatgatcaacaattacgtcaagaacaaggcgatcatggcaccggtcaagcggaagtatcagaccatgcaggttgccgatctgattttgatcagtttattgaagccagccttttccctggaaacgattcgtcacgggatcgatcaggtgacggccaacatttatccgcagcaggcttacgacacctttatcaaacggctcttgttctcattcaagaacatggatagccggaatagtcgggcattggaagaaaagaatttgaatgataaattaatgcaggtggccgtcaatgtcattattgaccgaatccaatccgagaaacttttggcgattattcaaaagccactcacaaaagtgaccaaatagccaaagtcgtgaaatcattcacatataaataatggaaccgctttcatagaaaaaggacttgctgaacaagtcctttttgttttggatattgttatatcagtgtgcaagcacttacaaaaaataaattgtgattttttgaacaaaactgtttacatttcaaaaatccgtgatattattaatattgtgaaaaagataacaaagcacaaacaacctataaacttttcattggaggaaaatcaatgattgataataaagtaaaagaaaccaaagcagctaagacgaacacaactgatgttgacactgtcatcaacggcttggtatcaaaagcgcaaaaagcactcgaaattatggattcatttgaccaagaaaaagttgaccacattactcaccaaatggtaatggccggccaagacaaacatatggacctggcactcatggcttatgaagaaaccggccgtggggttgctgaagacaaggccatcaagaatatgtacgccactgaagaagtttggcacagcattcgcgaccacaagacggtcggtgtcattaaagacgataaagaacgtcaattgatcaccgtcgctgaacctttgggtgtcctggccggaattacaccagttaccaacccaacttcaaccaccttattcaaatcaattatttcaatgaagactcgaaacccaatcatcttcagtttccacccacaagcattgaagtcatcaattgcagccgctaagattgttcgcgacgctgcgattgctgccggcgcacccgaaggctgcattcaatggattgaagaaccaagtatcgaagccacaacgaaattaatcaaccaccctggtgtcgcaagtaccttggcaactggtggcccaggcatggttaaagctgcctactcaactggtaagccggcgttgggtgttggtcctggtaacggtccggtttacatcgaaaagactgccaacatcctgcgtgccgttaacgacttggtgctctcaaagacctttgataatggtatgatctgtgccactgaaaacagtgcggttatcgattctgatatctacgctgaagttaagaaggaattagttaagaacggtgtcttctttgttgataagaaggaccatgacaaattagccgaagcaatgtttaaccctaagactggcagtgttaagggtccaatcgccggcaaatcagctaaagggattgctaaactggctggaatcaaagttcctgacaacaccaaagttctggctgctgaaattactggcgttggtcctaagtacccactttcagctgaaaaactcagcccagtgatcagtatttacaaagctaagaaccatgaagaaggtttcaagctctgtgacgaattacttcacttcggtggaatggggcatactgccggcatccaaactctggacgacgacttggccttggaatttggtaagcagatgaaagcagcccgggttctggttaacacaccaggcggcttcggtggaattggtaacctttataacgaaatgaccccatcattgacattgggaactggctcatggggtgccaactcaatttctcataacgttaccgactatgaccttttgaacatcaaaactatcgcaaagagacgaaataatatgcaatggattaagttacctcgggtttactttgaaaagacttcagttcgttacctcatggacatgcctggcattaacaaggtattcatcgttaccagtccagaaatggttgaattcggttacgttgacaaggtgcttgatgaattgaaacgccgtccaaacccaatcgaatactcactgttctcaggcgttgagccagatccaaccactgacacagttgaaaagggtgttcgtcaaatgaacgcattcaagcctgacacaattatcgccttgggtggtggttcaccattggatgctgccaagaacatgtggttattctacgaggatcctaagacgagtttcttcggcgccaagcagaagttcatcgatatcagaaagcgggcataccgtttcaacaagcctaagaaggcacaaatgatcgctatcccaacgacttccggtactggttcagaagtaaccccattcgctgttatcactgactcaaagacccacgttaagtacccattggctgactatgctttgacacctgatgtagcgattgttgacccacaatttgtggaaactgttccaaagggtaacattgcggcttccggattggatactttatgccacggaatcgaatcattcgtttcaaccatggcttctgattacacccgtccattgtcactgcaagccatcaagctggtatttgacaacttggcagactcatacaatggcaacatgcacgccaaagaagaaatgcataatgccgcaaccttagccggaatggcatttggtaacgcgttcctgggaattaaccattcaatcgcccacaaactgggtggggaattcggcttaacccacggaattgccattgcaatcacgatgccacacgttatcagatacaatgccaaattaccggaaaagattgccgtatggcctaagtacgagtacttccgtgccaacaaggactacgcagaaattgccagatacgttgggatccaaggtaagaacgacgatgagttaatcgaaggattagttcaaagaattatcaagttggctcatgaagttggcgttaccttaagcttgaaggcttggggcgttgacaaggccaaattcgatgcagcagttgaccgtcttgcagtattagcatacgaagaccaatgcacgactgcgaaccctaaggaacctttgattgccgatttgaaacagttgatgattgatgattatgaggggactaatgtggagaagtagtgagcgaaacaaaccgtttagcagtatctaaataagaacaataccccagttgcgcgattgctcgcgtggctggggtattgttcttatttagatactgctggtttgtggagctgtcctcaaaggcagactgaacctggagaaatccttaaattgacaagcagagacgtagcctcattaactttgcagtcgtggaaaacaaccccagttgcgcgattactcgcgtggctggggctcttcgcttatttagattctgctggtttgcgtagctgtcctcaaaagcagactgaacctggagaaatccttaaattgacaagcagagacgtagcctcattaactttgcagtcgtggaaaacactcccagttgcgcgattactcgcgtggctgggaatcttttcttatttaggtatcgctgatttgcgcagctgtcctcaaaagcagactcaaactgggagaatccttaaataaacaaacaattaaatagcattctcaacttggtaaccgtggaaaacaaccccagttgcgcgattactcgcgtggctggggctcttctcttatttagattccgctggtttgcgtagctgtccacaaaaataacccagtcctcgcagaaaccaatatctctccagcaaaaaaagaggagcgtcaccttcccaaaccaggaaacaattagcaccattatcaataaatttctcaattaccctaaatccacccaaattccatgctataattttcatgttaagaagcataataaaacggaaaaaggtgaaaatcctttacagccccttcgctactgtaagattgacgaagctgtcacaactcactgggacaccctggaaagaggacagttgtaggacgagatcaagtcaggatacgtttgttatgccgattgcaaagcttcttagggtcggctttgtcaattaatagcgtatttctcggatatttttgtgtgctctgattcaatatctgaatttaggttattagtgattgagaaacggccctggctagtctaactagccgggcttttttgttgtgttcatttttttgttgagggtaccatcactatttcatgatttggaggagcgcacaggtatgaagaagaaacagtttatttattgggtatcactggtagtcgggatgttcctggtatttgttggtggcgaaaacttcgcccaagctgataccgccgctgatgttgattcggcgattacgaccggtgttaagctgaccgctcaaaaggacaccttggatgcttgggatgccatgattttggcgacgagtgataatggcatcactgatgctcaggcccaaaatgcttatcaggatatcatcaccactaatggattcttaagcggaactgtgcaagatccgagcggtgtctcagatgttgccggggtcattggcttaagagcactgggcaacgacccagctaatgttgaaaagaaggaccttgtgggtcaagttatcaatgatccattggccaaaattgccaaaccgagtttgtacaccttggttaacgatcttgaagcattgagtaccggcagttatggtaaagccagcgaaacggcgcgggcaactttgaccaaacagatcttggaagaccgcgattcagcatccggcatctggacggcttcatggggaaacgttgatttgaccgcccgggcgattcagtccctttccatgaatatggatcagcccggtgtcccagccgccattcaaaaagcggttagtgtgattgaaaatgactattatcaacaaaatggcggctttgggaatcagagcaataaggaagatcagtacaataacgtcacaatggtcaatgctctggctgttgccggcgttgacgtctacacgtcattaaacggcaaatctgattatcaagcaccggttcaacggttattggaccagaaagatattagtgctgacagtaactccatgctgctccagcaggcaacttacacgttggagcaggcgaaatttaccaaagacggcggccaggggtggatctttaattttgcccaaaatccaacctttagagcgcgggaactggcaaaacttaatgcggctgcaacgactaaacggcaagcagtcaataatgattcacaatcgtcagctaccgacaaagcaactgcgatcagcacgattaaccaaacgcttgagaactacattaccaagattaatgctgatacaactgatgaagcagcgattgccgatcgggcagttggtgttgcggaaattaacaatgtcaaagtcgttgattcaagtgcagcttcgtccagcagtggcacgacgattaccaacaactacacgacaattattaacagcgcaccaagttcatcaagttcttcagtagcttccagttcatcatctgcggtaccggtcactaaaccgaccacaaccaagaaggccaagagtgccaagggatcggttgtttatgctttaacgaccgttaagctttacaagagtaccgattttaataagcgtcagctgactaaaatctacaagaagcaggcccgcattaatcgaccaatgtttttggtcctcaagcagacgactaacaaacagggtcatgccatttatcgggttaaagatctgaagagccgcaagatcggctacatgctttcggcttcgaaatatttgaccggcgcctactactcagccaaagtcacccggattaaggttcttaatccaaggggcatcaatgaatacagtaatcgacaactaagcgggcgaaagaaacacgttaaaaagaatcggtcgttaaacgttgaaaaagtggtcgactatgggcacacgtcccgattgcaactcaccagtggtcggtacgtgtcagccaataaacggttggttctggcaaccaagattgccaagaccagcggccagaataccgatgcagctggaacgccggttgccacgacgccatcaccgacgacttcaacatccagctcgtcgtccaccacaactactactccgactccaagtgtgccaaccacgacgccaactgggtccaacaatgctagctcttcgtcgaccaacacttccgggaccactaacgacaattcaaatccggataccaataccaacacagaaacggtcacggtaagtgtcaatgccaacggatcagtgctggccagtggcagcattaccctttccaaaggcgccactgcgctggatgctttgaatgcgttggcttctcagcacagcatgtcgatcacaacggtcggctccggcatcacggcatatgtgaaagggatcaacggctataacgccggccctgcaggtacgatgaccggctggctttactcgattaatggcaaccagcccaatacatcgattggtgcctatgtggtggccaatggtgaccggatttctctgaactacaataaataaaagaggtattcaaaatgaatcaattaacgaaaaatattttagcttcgattagtgcagtggtcatgaccgttaccttgacagccaacgccggtgcggcctctattcataaggccagcacatcaacgattcaccgccggactgcactgacatacacttacgcaaagaagatgcttaaagaaaacaagacggggttgtctggtaagaccagctcgattttcagccggaaactgtactcagaaaccggagcctcatctgggtattctgactttttactggggttaaagggaaatcattatcaatttaccacaggcgaaaagaatctcctgcggaaaaatttggttattaagagcaatagcaccgccgcaactttggccaatgccgtgatggccgtccaagccatggggatgaacgcgcagaactacaagccgtatggccataaaacgggcataaacttggtgtcacgactgtatcgaagcagcgttgccaagcagacggccagttctcaggccgaaaccttgattgccgtatcgatgagcaatcatttcaaacgtcccagcaatgccaaatttagcaaggccagcttgagttcccggttggttaaggttcaactgaacaataatggctggacttacaacaacgcgcaaggagccaaggatgccgatacgacgagcatggttttgactggactatcacgaggcaaatcagcaaccggctcggttgaatcaagcatcaagaaaggccagcagttcttgtacagtctggcacaaagtaatggtgcttttggatacacatttaacggcaagaccacccccaatgccaattcaacggctgaggcgatcattgccttggcgaatgggtcaagcacgaaaaaatatgttaacagcacagctatgcacgctggccaaaaggcaactccgttgtatgctatgttgacgtatgtgaacaaaaccggctcgattaaaaatgccactagtcagttgtatggcgtcggccaggtcaacttggcagttgcagcttataaggcggccttgaagggccagtcagtctattcaattcaataaagtgacatgcttaatgaagccgtcaatccatgagcgttctcggattgacggctttttgtggttgagcagagaataaccgtttctagcacggctatttcagctttgacggtgcaagggtatactaatagttgtttgaataaagtagggggatttcaaattggggaatactcgttccaatcttaaaacacagctgttctcgatcgcgacggcctaccggaagaatttttttgtgattgtctgggcagttgcggcagtcgtcttctttttgggtacgcggtttcaatttggtgctagtgaaattcaggttatgccatctattcagtcattaatcggtgcgattccctcaataactgcccaagagctggtcagtgatacccggctgatcctgccgctgcttttgctatcactgattccgacctacattctctcatctgtttggttaagtttggctggggcgctaaacgttgccggactgggttccctggttacttcatcatttcagattgcttcaagcggtgttcgatggtatttggcgacagcctacgtcattgacttacttctgttgatgatgctgcacttgttgcttttcgtgatgattgcagaaattagcgacttttatggccaaaatcgcagtcgggtccactggtggacattttttgccacctggttcgcctcattgactcatacatatctgcgctattggcagttattctgggggattttgattcttcgagtgatttttagcatcttgataaatatttaaaaggagttttcgaatgattattggactaagacaaatccgcgggtttgttcaaaaggagctcgggtacgaaaccactggccacgattacacgcacattgagcgggtggtcagtttggccaagttgattttaaaaggtgaggatgctgatgagtcattggtaatcattgcggcttacctgcatgatgttagcgatgataaagtcaccaccaatccggctgccaaacgcaaggcaattgctgatgaattgattggcgttggttatgatgaggcgtttgttaagcaagtattcgaaatcattgataacatgtcatacagtgccaatctgaagacccaccaccacttgtcgattgaagggcagatcgttcaggatgccgaccgtcttgacgcaattggcgcgattgggattgcccggaccttttattttggcggccacttcggtgaaattatgtataatccacggattatgccgcggacgggaatggataaggctgaataccgtaagcgcgggacggtcattaaccatttttacgagaaattattcaaactcaaagatcagatgaacacgccaaccgccaaaaaaatcgccgaacaccgccaacaggtcatgcaagactttgtgggcgaatttgtcgacgaatggaatggcactaaataaaccgaaaaatcaggttcatcacgactgaaatcagtaaattaaatagcgaaatcaccacgataatcaccgtcaaacggattagtaagctgaaaagcgtcgcttgtagcggggtgagcgagatgatgatggctaacaaggttaagcagatgaccgcctgccagaatccctgcttggaattttcaaagtcggcggggcttaaatcaaaaccaccaatacagatgttggcagcaattattagaaatagacccatcgaaagccagttaaaagttggcagtaccacgactagttgactcagcggctgttcggcagttgtcatcaatgattggtagacttcggggacaaagtattttgccagcagcaggacagataaacagcagccaaagatgggcgcgacgccgatgaataggttacccatattttggtagagattgcgtttgttccaggtgtggtggacgtatcccagggtgtcgttgtctgccgacggcactcgcaacaggcgaaactggtcgatatgatggccgaagattaacgccaccaataagtggctggcttcatgaataataatccccagaaagccaaagccaatttgtccgccaataccaaattgattggcaatccgttgcttggtgccgtggttgatggatgacaatagatagataaaaagaaatggtactccgatcattaatccgagtaccaaaccaatatttgttagaatatctttgagcattcaatcattcctttatgtcggcgaatttgccgccgatcaggtcgaccatctgctgggaatcaaccttaaccgaccggccgatttgcccagatgagacgatgatttcccccatctctttggcttcttgatcgacataaatggggtagtggaacttttcccaaatcccgattggcgtgttggcgccgtgctggtagccggtcgtcttcagcaggtcctttaaaggtaccaaattaactttcttgttgccggaaactttggcgagctttttttcgtccaagtgttcgtcgactggaaccacaccgacaactgggccggtggttttgccggagaagaccagggttttaaaaatctggtgctcgtcagtatccacgtggtcgacgctgatttgttcgacgtcgccttctttgtgggtgggaaattccatctgttcaaagggaattttgtgcttatcgagaatttgttcgactaatgttttatgaactttatttttcttcttttttgacatttgataacacctcaggtatattttagcacaatcggcaaaacgattctgtctgaacaaaagatgataatctgttatactttattgataatagatcaatttaacgatttaataaggagcacaaatggctgatttagtatatcgcaatatcatgaaggatttgaaggagcgcattcaggccaatgaatttgcctcaaagaagctgccggatgaacgaagcctcagcgaatcctatggtgttagccgcagttcaattaaacgcgcgttgaatgttttggcaaaccaaggcattatttttaaaaagcggggttctggaacctttattaacccgctatatcagaagaatcagacgatttttcaatacgagggatccaacctgggggttactgacagctttaagagtgacggtcagacgcctaaaattaagttgttggattttaaggtcgttcccgcaagcgaagagcttcaaaccgaattgtttttaaatccgggtgaatttgtgtacgaaattaagcggctgcgatcctttgacgacaaacccttcatgattgaactcggctacatcccaattcgagtggcgccggaactcaacagcgaacgagtggagggctcaatcttcaactattttgaagacgcaaccggcaactcggtcaccaagtcatttatgactattacagcggatccatcgaccaaagaagaccagcagttgttgggcttgaagcccgtcgaaccagttggcgtgatggaaggtattttcttcttggatgatggcacgccgtttgaagtttccaatatgcgcattcattataagtatttgaattataatacctttgtgaatttggatgaggacaagtagtagagggcgacaagggctgggagatgcggtttctaagccagctttggttgaaaccctgggcttgggtttgaaccaaagctcgcttagaagttagcatctggcccgtcggagcccatttcggctcggtaaaaggcgtgttcatggtcatcggcatcttactgctgatctttgcggcgattgttgccacgccaatgggcaccgaagttatgtcacatatgtttcattaaatttttattctactgcagtgagtcacacagtgattcctgcagtatttttgtgagcaaattttccaaccacgccactgaaaaagcctatcctatagatgaaagctttgaatcttctggaggaggcacgcagcatggctaggcaagtcaatcagcaaaatcaatggtggattttcaccgccgtcgtcttattgtcattcatgtcgacactcaccagcagcatcgtcaacattgcattgccggtcatgtcccgagcaatggcggtgccgactgcccaagtgacgtgggtggcctcaagttacctaattgtgacgtgcatgttcttattgccatttggcaagttgggtgacgtgttgggcaaagcccgggtttttaagattggcaccgtgatttttactatcgcttccctattctgcggcatcaatctggggtttgtctggatcttgatcatgcgggcaattcaagctttgggtgccagcatgacgttgagcaccaacgccgggattatcaccgagaccttttctaaagaacagcggggcttggcacttggcagctttggttcggtggtcgcccttgggagtatcgccggtccgggtttgggtggtctcattctgacttgtcttccctggaactacatcttttgggtcaatgtgccggtggggattgtggcaattatccttggccaaattgtgctgcccaaagcagaagcaacagctgccggtagaattgacacttgggggatgctggttttgatttttatggccggcagtttatttatgggactcatcttaggtcaacaagctgggtttatgagtttgatttttctcagcttgatgattgcgacaatcattttactgatcatgtttattaatctggaaaaacgggcagccgatccggtcatgaattttcatttattcagcaatattgacttttcgctgagcctgttagcgacgattttagtttatggaattaattttgtcgtcaacatcatcgaaccaatctatttggagcaaaatcgattcatcaccaccgacctggccggcttgattttgatcagttttcccatcattcaaattatcgtctcaccgtttgccgggtggctcagcgaccgattcggatcacaccggattgcggcgatttccttggcgatgctcatcataagtcaggcggggttggcgagcgttaaccatacaacacctctattgatcttatgtctctggcttggttttgttggcttgggcaacggcctgtttcaagcaccaaccaacgtgctggttatgaactcggtgtcaaaagatcagctgggcgttgccagtggactgctggggttctcgcggaatactgggatgacagttggagcgattttcgcaaacattctactatttactggtatcagtatgaatctcggccactcaaccaatgattatccggttgcccaaccaggagcattcatttttggaatgcgattcacattttggatcacaacggcgatttttgttctattgtttatcgtccaaattgtcgttaatttcaaacggaaaaatgcctgagtaaaatgttcgaaaattttgttacaaaatattaataatagtggactaaatatttgttagcgtccataatggcacataagtataggattttcgcccactaaatattggaccgtatcaattttctaaaaggttgactttttgaaaatatcgtttagtattagtgatgtaaattgatcaagaaacagttggtgaattttacggacattctatacagaagtttgttgctaaatcgaagaaggagtgttaattaatgacagtagattacgattccaaagaatatttggaacttgttgacaagtactggcgtgccgctaactacctttcagtaggtcagttgttcttgcgcgacaacccattacttaagcgacctcttgaagccaaagacgttaaagttaagcctattggtcactggggaactatcgtatcacaaaaccttatctatgcagaattgaaccgtgttatcaacaaatacgatttgaacatgttctacatcgaaggatcaggtcatggtggccaagttatggtttccaactcatatcttgacggtagctactcagatatctatccaaacatcagccaagatgaaaaaggtatggctaaattattcaagcaattctcattcccaggtggagttgcttctcatgccgcaccagagacaccaggttcaatccatgaaggtggagaacttggttactcactttcacatggtaccggtgctatcttagacaacccagatgtaatcgctgctgttgaaattggtgatggtgaatcagaaaccggcccattggctgcttcatggttctctgacaagttcatcaacccaattaccgatggtgctgttcttcctatcattaacatgaacggtttcaagatttcaaaccctactatcctttcacgtatgagtgacgaagacttaactagttactttaaaggaatgggctgggatccatactttgttgaagcaactgctgatacagaccatgccaaggttgaagaagaatttgccaagacccttgaccatgttattgaagagattaagtcaattcaaaagaatgctcgtgaaaacgaaacaccagataacgttaagttacctaactggccaatgattatcttccgttcacctaaaggctggactggtcctaagaaggatctcgatggtaaccctatcgaaggttcattccgtgctcaccaagttccaattcctgttgccgcaggttcaatggaacataaagacttgctgattgactggttgaagtcatacaagcctgaagaattatttgatgaaaatggtactgttaaaccagaaatccgtgccgttgcacctaagggcgacaagcggatgtcagttaacccaatcactaacggtggtatcaagccagaaccattgaagctccctgatgttcgcgacttcgaagttaaattcgatcgtggtgtaactcagaagcaagatatgattgaatggtcaaactggttggaaaaggttgcagaacttaaccctaccagcttccgtggattcggtcctgacgaaactaagtcaaaccgtctttacagcttgcttgatgactctaagcgtcaatggatggaagacattcacgaaccatttgatgaagatctttcaaaccacggccgtgttatcgattcacaactttcagaacaccaagcagaaggttggcttgaaggttatgtattgactggtcgtcatggattctttgctacttacgaatcattcggacgagtagttgactcaatgttgactcaacacttcaagtggttacgtaaagcttcagaacaatactggagaaagcaatatccttcattgaactttgttgatacttcaacagtattccagcaagatcacaatggttatacccaccaagatccaggtatgttaactcacttagctgagaagaagcctgaattcatccgtgagtatctcccagctgatgctaacgaattgttagctgttggtgatgttgcattcagaacttacgagaagattaacttaatcgttacttcaaagcacccacgtcgtcaatggtacacaatggatgaagctcaaaacctcgttaagaatggtcttggctacatcgattgggcatcaactgaccaaggtcaagaaccagatgttgtctttgctgccgcaggctcagaacctaacttggaagcattggctgctatctcaatcttgaacaaggaattcccagaaatgaagattcgtttcatcaacgttgttgatctcttgaagcttcgttcacctaaggttgaccctcgtggtttgagtgatgaagaatttgacaacttgttcactactgacaagccagttatcttcgcattccatggcttcgaagaccttatcaaggatatcttcttcgatcgtcacaaccataaccttcacgttcatggctaccgtgaaaatggtgatatcactacaccattcgacatgcgtgtcttgaaccaattggatcgtttcgaccttgcaaaggaagctgttcaagatattccagcttacactgttaagggtggttacttcatccaacgtatgaacgacatggttgataagcacaatgcttacatccgtcaagaaggtactgatcttccagaagttgttgactggaagtgggaaggccttaagaagtaatttcattacgacttaatgcctactaaaaccttaaaggagctcgaaatcagaaatgatttcgggctccttttttgatacatatatatatttgagaattactcgcgggtgacggtaattgtttttgtgatttgattaccggtttcatcaacggcagaaacctggaagatatttgttccctgattcaggttaaaggtctgagtgaattgatgaggaccgtggggattgggattggcacctaaatcttggtgattcacccaacccgcgttattttgctcatggaaaagattgttgccattgatcaagaggcgataaccatcaacgttatcattcacagtcccactgatggtgaattgatcattcgaagttgtcaattgatagtggttctgtgaggtttcggaaacattgtcaggcatcgataaattcagcgtaggggcggttgtgtcggtaataaccacaagagtccctttggctgtcgtccactgatgcttcttgggtacttttaggatgtagccgatcccttgctgggtcgttggattaattggcatctcaaatttgaaggacccagtttttgaaattttcacttggttaattttcgcattttggttggggcttcgtaaaatggttaacctcgacttcgggttagccactttcccggcaatcgttagttgatgggtctgcggatcatacactttgctggctgcgttgattaaggtgaagtcattgtcctttaaccctttaaatgtaatgcccttagttggtgaaaaacgggtggtcaccgcatacttatcgtgactcatcgttgattccagatcgtcagttttcaatgtccagacaagcttggaaccaggggttgatgacgtttgaacgtggttatacgtctttggactgactttgatcgaacgcttggtttggttaccggcaacgtcggccaacgtcatcttcagttttcctttggcctgcttgagggcgtgttgcttggacgccgacagtttgtagaccaggctgccggtatttgattgaccagaattgttcaggctaacgccggcggactgatgaccaatttggacggcaagtgttgatattgaagtgaagccaaccccaacgtcggagtagttcaccgccagtcggccgtcccgataagttgccttggtaatctttggcgccaccgtatcgactttgaccggaagactgtattgttgctgctgcttggcgccattgttgaaattggtggtttgtaagacgtagtggtactgaccatctggaaccaccgccatcttaccggttgactgatcataagtcatcccattccaattcaatgctttggggttcaagcgcatcgaaggtgaaagggttaaatcgtcaatgtagccggaaccgccttcttcaattgatttctgggtgttggtttcattgtcgacggttctgatgaccttgccactggcatcggtaatctcagcagtgacgttttggaggttctgggtggtgaacacgtagggactgatggcatctgaatgaccatcaccatttggcgagaaggccactttgtcagattggattttttccggcatatcgtctcgcagttcgtccggatccttcaaggtgttcaaccaactggccaacgacgtccggtcgctcaatcccagtggcatatcctgagtgtccatcaggtagccgccgttgaaaatactgtcggcctgattggcgggtttatcgacaacctgctcatcagttggatcgccatagtagccgaaatagggaactgtcaaattttgatttgaatcagcattttcaaaagttagataaccttcagcgacgctgttcaaattagcttggctgcccaaatcgagggtaaaaggaaccagctgcgttttgccggggtcaacggtgacggtatcattggcggattgcagtgtggccccagggatcgcagtgtcatgaaccggcccaacattatgattgttggtttttcggctttctgtaaacggcccatttgtcgtgttgatatggtaggtcaacggctctgaaatttgattggtcagggcaacgttgaacttggtcgtttggccaactgttttcagtgaaattgatccttggttaccacttggatcggtggcggatgcctttagattagcggcgttgttgacattcacctgaccggcaccttgaagccggggtgaaatcagttcccctttgaatttgtcgttggccattggttgggcggcattcatcagagccactttgacggccttaaccagcttggcaccggttaacgttggctgatattttttaaatttctgcatgagtagagctgccgaaccggcaatgtatggcgaggcaaatgaggtcccggtgttggtcgtaaagtgattgttctgatctaaaacggcgatttgctgcccaggtgcactgacgtccggttttaacttaaaatccggtgtcggtccccaagccgagaaagaatccatctcgcttttgtcaccctgcttggtgttttcatcgccaaccgtggtggcaaatggtgaaatggcaggatcactgatggtgccagagttagccggttcataagtcgtaatcgttgaattggattgctcattataatcggtggtgatactgcccgcatgcccatagttgctgccggcgacagccacaaagacaccgtgatcggtcgcatattttacggccgcttgttcctgatcgtcgagtgattcattaccgacgccgatccccagggacatattaatcacatctgccccgagatcaaccgcgtcataaatcgcccgggcaacgtcgtttggtgattcatcagagaaaccaccgtagactttcagattgagaatctgggcttccggagccactccctggacaaatttggctttgttccttcgtgcgacaccatttgctgcggcaacgccggcgaccattagaccatggaaaccggaaacactgtctgcggaactgtcatcgttattattgttgacgtaatcgtaggcgaaggggatcttcgggctgatgtatttgccgtaacccctttgagcgataaacttttgggcctgggatttggaaattttggctgcggtgttactagataattgaaattcctgattattctgcacgccactatcgatgaccgcaaccaccattccctggccttgataaccttgcgaccaaagcttgggaacatttcccttggctaaggcgttttggttggccggctgggtggttgcttttttaactgcggtggtttttggattttgtttggcgaggactggatttgaggatgtgattgaaacaacaccgagtgtcccggtaattgtcagtaagccgattagtttgcgaatattaatcatgcgatctcctcctcaaatgttgtgaaactggttagtccttaagtaaatgaaattgttgattatcctcgaagaatttgcccatctgcaggagtagatcttcacggccttttctggccatgaattgaattcccagtggtagaccattttctccgacataggttggcaggctgatggctggttggccgctgatgttcgccagttgagtgaacggcgacaaggtcagggcaggtagccattggtcccaaatcaactgcatttgttcttctggatttaattcttcaatgtgcttcattttagttaaattctcagctgagactaatggttgatcgattcggggtgcttgatgggcagtcgttggcgtcaggtaaaggtcaaattcctgctggaaggcatccatatcactgacgatattatcccaaaaagtcagtgcttgactgtactgaacggccgtcactgctcgcccggcataaccgagcgcccaggttaacggttcaacgttttccttaatgacgtcatctttgagatgcatgttggcaaacatcgttgctgtttcaccagcgttcatcaaatagtagcttttcattaacccgacaccgtcgatgggcgcgtctgccggaatcaaatcgtatccttcatctgtcaaaaactgaacggcatccataactgcttgtttggcctcgtcggaaactggcgtcccaactggcgattctgtggaataagcaattgtcaaggttttgggcaggctgttcaaggtctcagtgaaagaggctgctggaagtggaacttggaatggggcggccatttggaccgttgatatggcatccagtaagcgggcggtgtcattcatatcccgggtaatcgcaaagttgattgatgcgccttgccaaccccgccactcgcctgggccggttggtacccggccacgggttggctttaggccaatggtgccggagaatgacgatgggattcgaattgaaccgccgccatcatttccaccagcgattggcagccaatcagcgccgactgcagctgccgaaccacctgaggagccgccgggttgataatcggtattccacgggttgtgagcatcaccatataatcttgagtcggtgacgttcttgaacccaaattctggcgcattggtttcaccgactgggatgaggccggccttcaagaaagcttgaacgaagttgttggtaatgtttgccttgtaatccttgagcagcattgagctgccggtatcaggttcgcccttgaatgattggccaaggccctttaataaaatgggcacccctgcaaatggttgaccggtatcattaaattgactggccatctttttagcgcgatcgccccataaggtagtgaccgcgttgagctttggattgttctgctccacggtatcgattagttcttggaccagtgccacccggtccaacttcccttggcgaattaattctgataattcagttgccgagtaactggataaatgtgtttctgtcatattcgactcctctctaaggcacggttaacgacgggataattcttgctcaaacttgataaaatgactcggaatgggtgcctcaattaattttcgttgtttagtgaatggcattaataaatcaaccttccaagaatgcagcatcaagaaagggctaccattacttgaattatacagcggatccccaactaaagggtgaccaagtgcggcaaaatgaacccggatctgatgagttctcccggtttccagggaaatctggacgagtgcgtacccggactgtttgcgcagtacgcgataacgagttaaggcaggagccgcgtgaggcccattgatttttcgcttacgtttatcatctgggtcacggccgattggcagattgattgtgccttcgtcaggtatgtcggttccctcaacccaggccaaataagtccgtttgatttgtttgttggcgatgttggccaccaaaattggcacaaccaccggatttttgccgaaaataatcgccccactggtctcctgatctaatcggtgaatcatgtagggaacggtcttttcggttgccaaataagccgctaaatggttaatcgtcgccccaacttcaccaggttggttgggatgggtcttatcgccacgccgcttatccatgacgattaaattttggtcctcatagagaatcgcaaccgtggccgctgaatcagccgcgacatttggaaatggtctggcaaaatcggccggcacaaacgtcagctggacctgactgccagctttaacgggaaaattaaccggctgataatggccgtctaccagcacccgttcggcatgacggatgctgtaaactagatgcttgggcagctgccaataattacttaaaagcgcctttaaggggcgaccgttcatggcttccggtacggtctcgttgaagcgccactgaatatctttcatcttcattgtccttaatcgttgatagcaaaaaggcgtcgacataattgccgccgcccacatgctgttcttgttatttgtttggtgttactttgtcttttggtcgaacgatcaaaacatcgcatttagcggttcgggtcacataactggtaaccgagccgataatcaaccgctcaacggcgcttagaccggtggagccgatcacgataacatcgttattgtggtctttaggaaattcacgtgcaatgattggtttcgggttgccaaatcggatgtggatgtcgacgcttttgacgccggcgtcctcagccttcttttgatatttctttagctgatcgtccgtattttcagttaacttgaaaacaacgtccccacttacagcacttccataagtttggttaaattggtttacttccaaaatgtttaagatatccaaatgggcatcgttgtcccgagctacctcaattgctcgattcagcactttttcggttgcttttgagccatctaccggtaccaagacattttcatatttttgctgttgcatgtcaatcaccccgtattcgtattgtccttacctaaactataccattctcttcgatgcttgtaatcaattaaaattttcaactttttgcttgtgattgtaatcgctttcctaacgtgctaatattcaagttgatcaactaaatgaaaagaggctgttattttatgtactattatgtcatgaaatccaatgatatcaggcgcaatttggctactgaacagtatttgatgaacgagatcaaatttgatgaaccgttacttttattctacattgaaggaccatgtatcatcgttggccgtaatcaaaacactcttgaagaaattaataaaaaatatgttgatgaacacggaattgttgttacccgtcgtctttccggcggtggggctgtctaccaagatttaggcaacctttgcttcagcttcgtggttgacagtgacagtgaagagtttggtgacttcaagtcattcgttcaaccaatcgttgatgctcttcacgacatgggcgctaagtccgttgaagttagtggtcgtaacgacattttggttgacggcaagaaattctctggcaatgcaatgtacaccaagggcggcaagacgttctcccatggtacattgatgctggatgttgatttgtcagtcattccaaaggctttggacgttcctgaagacaagatcaagtcaaagggaatcaagtcagtcagctcacgggttaccaacttgaaaccatacttgtcaccgaagtatcaagacttaaccactcctgaattccgtgatcgtttactgaaagagttgttccacgtggatgacctcgaccagatcaaggacaaggaatatcatttaaccgatgacgatcaaaagggcatcgataagatttttgatgattactacaacaactgggattgggtatatggcaattcaccagaattcaccgttaagaagcgtcaacacttcactaacggaaccattgatgcccgtctgcaagttgatgacggcaaggtatccaacgttaaattctttggggattactttggcccacaagattcaactgaagttgccgacaaattaaagggtgttcgtttcgaacgtaaagacttcgaagatgccttgaaagacgttgatttgaaccagtacttcaccggaatttctcgtgacgatttctttgatatgcttttctaaaccgctttaataaggtacactaaaactggtaataaaaagataaattccatcatcgaatttatctttttttgttggaattctggagggtaaaacgttaaatgaaaaaagaagaaaagcagaccattttctgggcaatcatctcgttggtggttttcctggcagtgacttggttgatgacattgcctttcatggcactgaaagcaccggccaccactggagaagcattgcaggtgacttggattgcgatcgccttttacgcggccacgttgattttggcggcactgcgggttaaaatcagctattatctgctggcagtggtgatcgccatttattcagtcggcttcgtggggatgatttcgacgatgttcctgaacagtgacgcgacgattctggttaagctgtttgtatcggcggttgccgcatttgggattgtcgtcaacgtctattggtatattttagcgttcagattgagagcagcgcttcaacacgatacatttcaacggcggattaacaagcaaaaaggattaagaagataggtgactaatttggaaaaagatgcagcaagtttcgtggatgatttggttaatgaaaagattgaaggcaaatctttcaccaagaagctcgacgacatcatgaaagatccggccaaagtgatgcagccggtgtatgactacgttgagggacaactgaacttaggcaagcttgcatatggcgaggtcaaggcgtccgatgaagatgttgcgattcgtttggaaaccaacttgatcaatttaccattccaagatgccaaagttatcagtaaaatgatgcaggatcaagagacattaccggtgaatgtgtacctggtgatcagttcaccatgggtcaataaatccagtttgcggattgatgaggtcgccagtgccgatgactacgtgggcaacgtcgccaactacttggatcagatgaacaactgggtggctgagcatttggatatggtcaaagaaaaccttgaaaagcagcctgaagaaaaataggcggataaaagataccttgatgttttcatggaaacgtggcataatacttgtatgcgatgagtcgagaaatcacacagcatttatgctgtcgcgcaagcgattaatgtgaattcgagcgggacacaatttaaggcacagatttgctggtgtttgactttagcggattgtggaatccaagaagtccatctactttggtaggtgccgtaataaagaaggtcaactggagaaatccggttgaccttctttttttgctaatttttatgaacaaatcggcaaaacatcaattgtttatactgatggcttgatcgttttgacttcgcactgattgggactaaacattcaagattaattttccaactatatgcccagtttcactgagcttatgcatttcgcggacgttttcggcattgaacttgagctgggtggcaatcgatactttgagtttaccggcgccgagcttattgcttagagtggtgatcacgtccttatcgggatgggcgttgatcttttcgaatgacacaccatatttttgactgagttcttctgcctgatcagtggtttcaacaatggaaatgatgcgcccaccaggcttgacgactttgaaagcatccagttggttttgaccgcctaatgtgtcaaagactaaatcaacttctggcgagactttggcgaaatcctgtgttttgtaatcaatgactttatcagcacccagacctctgacatagttgtcgttagcggcgcttgtggttgtaatgacatgagcgccgatgtgtttggcgagttggattgccatggaaccgacaccgcctgagccggccagtattaagacagtttggccaactttgaggtgcccggcatcaaataaggcctgccaagccgttgtgccggcaagtcccagcccagcagcttcttgaaaggagaccgtaattggtttgtgggcggcttgatctgcgtcaatcgcataaaattcagcataggttccgcggttgctgggcgtaccgtaaccgatcacggcatcaccgactttgaaacccgtcaccttggcaccgatttttgagacgacaccagccatttcttgtcccaaaataattggaaaatcaaatgggtagcgtgctttcctcaggcctttacgagttttccagtcaatcggattgaccccgatactaacaacttttactaagagttgatcatctttaatgttaggaattggcatttgagtttcagttagttgatctcgatcgccgtaatcgttaatcacgacggcgttcatttgatttgtcatttaatcacctcgacaatatcataacaggtaatgaagttgatgaaaaattaaaaggattgtgtacaatctaattgacattttgtctcaggagtttaggatgataggagaggtgagaaaatgaaattaacaattacagatgcagcattagcacaactcaagaaagtctttcctgccaatagcaagctgttgctcagctttgacgatggcgttggtccattttcaaaagttggcgtttgctcgttggacaccagttatgacgtgattgccgttgacaaggacgccaaggtgccggattatgacaccaaattgtcagccaattccggcgactggtacttcaagggttacagcaagatttacctcgatgaagatatgaaactcgactacaagaacaaccaagttgttttgagtggtgagagtggaattatggatagtaatattgaattgaaggatctgacaaagcagagtgtggaataataagcgcttagcttccagagtataaggggctcagccaaatacccagggtttggatgcttggctgagccccttatacggccggaagctgcttgttattccacgattcggataggtagccatgaggtggaaaaaagggccaaggtatcgctaacaagcagcgttaccttggctctttctgtgttttaaatagtcacccgagcacattcaagttcaaatccgcttagcggcatcctcaatcttccgataaggcatcacccaaagcaacatgacgatgaacgttccgatcatcccaaattcgtgccagtaaaatgagatgagaaagaccgcaatgaatgcgaccagcgtgtaaatactttttggatctcgtttaagcgatgcgaccagcggcttgactgacttgttggcccgcaccagactgacccgcaataggttccacgaaaggttaatacagatgaataacagcgtgtaaagttgggagccaaacaggctgttgggatcattgtcaacgattgcagtcgtaaacggcacaaaggataagaagaataataaaacggtgtttgaccaaatcacaaatccgtcaattgatttgaccagtaagaacatgtgatgatggttcccccagacgattgccagcaagaagaatgaaatggcataggacatcaattcttcgcgaattccccagaatccatgccagctgagcttttctggcggattcaattccagaaccagaacggtcataataatcggtacaatggcgtcagtgaatgcttccagccgattctttttcaaattcgtcccccctcgaagtctctttagtacaaggatacaataatttcgcagtgaatggttctttggcgacttcgattaaatatgcaattatttttcgataaaccggttacatcaagggaatgaaattgactttatgcaggttgaaaagttaaaatagaataagtattttaatcgagaattcatttaactgtggaggcacgtttatgtcattattagctcgtatttttcgccgagagcaattggaccgttatcttgagactgacaagaaattcattaagaccatgtcagcctttgatctgattgccctggggattggtgccgtgattggtaccggtatttttattcttcccgggacggttgccgcaaccaaagccggtcctggtattattatttcattcatcgttgctgcaattgtctgttcaactgccgccatgtgttacgcagaatttgcttcggccctgccggttgccggaagtgcctattcttatgggaacctggtctttggtgaaatcattggctggatcctcggctgggcgttaattctggagtatgtcttagccgtagctgcggtttccagtgcttggggtgcctacttccagtcgtttttggcaggctttcacatcggctttccaaaagcgatctcggggccgttcgtcccaagtcaggggacatatgggaatctgattgccatcattattgtggtgctgatttcgtggatgttgaaccaagggatgcgttcatcggttcggctcaacaacatcatcgtggttgttaaaattggcattatcctgttattcatcgtggttggcctattctacattaagccatcaaattggcacccatttttaccgtttggctggcatagtgcccacggtggtgtgcttggtggagcagccgccgtcttctttgcctaccttggttttgacgcggtttccagttccgcagctgaagtgaagaaccctaagaagaacatgccgattggaattattgggacattgattgttgccacgatcctttatgtcggggtgtcaatcgttctgacagggatggtttcttacaccaagttaaacgtttctgatccggttgcctttgcattgcaatttgtccatttgaactgggtcgccgggattatttcccttggtgccctggctggaatgttcaccatgatggtcacgatgatctatagttcatcacggttaatttattccatcggtcgagatggtctcctgccaaaattcctgggcaagcttgataaaaagggcagtcccagaaatagcatgatcaccattacaatcaccattgctttcatgggcggcttcgtgccgttggagcaactgaccaacctggttaacattgggacgttgattgcctttctgttcgtttcatttgggattattccattacgacgcaacaaagaaattcaaaaccatcatggctaccaagtgccatggtacccagtattgccaatcgtttccggtctgttgtgcatgctgatgctgtcacaactgcaggctgagacgtggattgcttctggcatctggttcgcctttggactggttctttacttcagttatggaatccgtcatagtcaacttggtaaaaataattaaaaatttgcatcaaaaagagcttgcgacaagatattgtcagcaagctcttttttatacatccagattattggtcaaaactcatcgatacatgaccagatttttgtgcagggtgttccacaagacaattaaccccatcagaactaataaaacggcgctggtggcgatgataaacagggcggtgtacgaagacatctcaattatcaaaccaccaaacagcggccccaatgcccggcctgcggaggcccaggattgaatcagtccctggtaacgtcctttggcctcaaccggggtcagcgtgttaaccaacgctggaatagtcggcagggcagtggcttcgccaattgtcaaagtgaccattgccagcacgaagaaggggtaggttttggcaaaaatcagcacgacaaacgacatcgacatcaagaaaacgccgagaaagacttcaaaaatcatgttttcatggtagcgggaaatccaattgatgatgatttgactgatgacaatcacgccaccgttgatcgtccacaggaagctgtagttgcgcagtgggatgccgataccggtcatatagacggacaggttggaaacccattgctggtacatgatccaaataatgaataatgacaggaaaaaagcaaacagcataatggcattgggctttggcaaattcttggagctccaagtggtcttttcggtgtcggaaacttttttacgtgatttgttggcagctggtttgaatttgagcagaacgatgagcaggaagacgacgaacaaggccgtggcgacgacgaacatcaaagttacactgatgctgtagatgaagccgaccaaagaggtcccgataacgattcccaaattctgggcgaagtatagcatgttaaaaacatagcggctgtcttgagattgaatactggttccaatggagttgaccacggccacgttccagccaccggaaatcccgttgaaaaataggatgattccaaatgccggccaaccatggaaaaagaccagcagaatcaaagtcagcgtggttgcggcaacgccaccaatcagtaggtgataggggttcttgcggtcatataggtacccgccaaggtaactgccaagcacactggcaagggaattaaacaacaggacaacaccgatcagggtaagtgaaaccccgagccgatcgtgcaggtacacactggttaacggccagacaaagctcatcccgacactactgaacatggccccgatgattagccattttaaattcatttcttttgcgggcatgtagttgaccttctttcattcgaatttttgcgccaacgtccagtgtatcaaaaaagtgacctgaatggggaaataattactatagtaagcgttaacaattgtaagtgctgtttgatggacttaccgatttaaatcacatatcattaagttgttggatgaaggattggatttgttaaataggaggaattatatatggctgttgacggatcactttatcatactgaagttgttaatgaacatggattagttggtgaaagtttcgtccggggcaacgaaggattagctcttggcgtaagcagttcattgattaacagtccaggaaccaaccctgagcaatttatcggctttgcgttgagtacctgctttaacgcaaccatcggtttagtggagcggggacataatctcaaaccggatacagttattcatactgcagtcgataacctgaaggataccaccggttataaatttgtggtacgctgtcaaattctgttccatgaattagataacgaacaggcacaacaaatggtcgacgaagcattggatacctgcccagttgctaaattacttaaggctaatgagaatgttacttttgaagtggttgataaattcagcttctaagagtgcgacaagagccggttagcttttgagcattagtgtgataacggcagtcaacgctggttttgcgttgactgccgttatcggactaagcggagaaagctggctctgggagcacgttttcactatagaaaagtaaattactttcaagcatcaatcacaaccaaacaccacaacaaaaatgggccaagacatagctatttgtcagctgtgcctcggcccttattgagttccactgttatctagccaaaacgtggaacgatcggctgatcccggccatttaagcaaagaagcgagccattccaaaaacaggaataactcgcttctttgcttaaattctgggatcaaaacgcctggtgttccactctagtcatcataactcaaagtagctgggcgtgaaaatccaaccacatgccaccatggtgagtaaactttttcagtaatcacaccgcggttttgtgaatcgatcatcttaccgttaccaatgtacataccaacgtgtgagatgctgtgcttgctgccgccgaagtatactaaatcaccttttttaatgttgctctttgaaactttcttggtaccattgtattgtgcttgggcagttcttggaattgacttctgaattgagtgcttataaacatacttggtgaaacctgagcaatcaaagtgagtaggaccaactgcaccgtaaacatagctggcaccgagatgtttcttggcaaccttcaagacctttgaatatgattggtctgaagagcttgcactggctgtattagctgaagtataagcagatacagcgaatgcgaacaaggctgcgagcaacaataatggttttaaagctgatttaataatactgtgtgacaagatgagtactcctttatatttcgtcgtttagttaaattagtcagttacgtatgctttattagctgtgatgtaatttccattagtgagttggaagcgataagcgccgccgtttgaacgagtgattgatttaactgaaagcttcttgccagcagtaatctttgaaacccgagttttgaaattaacatcgtgatattgatagatgtttttggaagctgtgacttctttatcacttggcagtgatgtgaagtaggttggcttagccgcatccgctgatgaagtcttgagccaggaattaacagttgaactgtcgacgaccttgctcaaatcaacattgccgctgattccgcttaagcttccctttgaagtgtattgccaaaggtcggttgaaacgtttggcttagcggaataatttgcaatccatgatccatcaaacttggaatagttgattttgtgaacgttgacgtagttttgatatgagtagtaaaccaaaggcttattggttaactttctcatctgtgccagccaagcgttgacgtaggattgttccgaacccttaccttttcgatgttcgttgtccaaaacgtagaaacgtgctttggaacttgatcgcttgtaaaagtccttggcttcttttttggcatcggccacgctgctgaactctgcgtaaccatattgaccaaatggtactttatatttatatgcgccgttagcgttgatatctttttgagtatcgattctgaaatctgcatcgccggtgtcaccatgttggacccggatgatcgcaaattttaattgcttggaggctttgctccaattgatgcttccttgatactgagaaacatcagcaatctttgtcttggcagccgatgcgtttgtcgcaaaagtaaatgctgccagggcacccattaataggccggctatttttttaaatttcaatgtcatgaatagtcctcctctaaaaacttacaagaacaattatatgaaatgaatgctaccaaccagtatcaggattgtttcataaatgttaagaaaaatttcacactttcttcgtatttgtgtgagtcgcgtggtgacggcaatggttacggtaatctaatttgaaaaaagcggctaatttattggatatatttgtcaatttgcccgcattacagaacaaattcagtgcaatcggctgctttgttacaggttaagggggtcaagtgtaacaaaagattgacgttttttaatagttcctaaaatcaatccctctaatgaaagatttatccaagcaaacagttataattggaaatgaattcaagttcgaaatcgattttcggcgcatcgaaaatcaaatttgaggtggacggatatgctgtcacaacgtggtcgtcagacaaaacgatcgttttatattttggcggtgctgattccaattttgttggtcagtgccttatttgtggtgattggaattgccccgtttggcagccacaatctactggtcagtgacctgtcgacgcaatacctgcagttcttcgctgaattaaagcaccagctggcccacttcagcttctctgggtattcctttttaatgtcgattggtgacagcctggtaccaatctatgcctactatttgttgagcccacttaatttaatcatcatgctgtttggaacagctcagctgccgatcgccattgatttgattatttgggttaaattgattctgtgttccatttccatgagtgttttcttggctaaaaaatatcaaaactatgacttgatggctgtctatggcggcctggcatacggcttgtgcggttttgtggccatgtacttttatgatctgatgtggctggatgccttgatctggctgccggtgatggtctatggattggaaaagctctattaccatgggaagcctgcgctatatgttgttagtttgatcatgattattttcaccaacttttacatgggatacatcatctgcatcttcaatgttctgtatatggcctacttacttaaaaagaaccaaccgtattcattgccatttttccaaaacttgaaggccaattggcaaaagattagttggtttatttggtattcattgttagctgggatgagtgttgccgtgattctgatccccactgccatcgcgatgatggctactgggaagaaggacttgctggccgcgaactttctggtcaaaggaacgtttggccttagttttccggtcaatctcggcgtcggtggcaatgattttgccggccggctggtacataatcccagtttcttcaccgggtcgttgtttatcattggagcgattgtctacttcttctccaagttggttagtcagcgcgataagcaggctgccggcattttgattggcggtatctttgttggcatgtggtttttaccgttaaataccatttggcatatgatgcagcagccggccggttttccgtttagaatggtctttctgttcagctttgcgatcatcatggtgacttatgagggttacctgcaggggatgtttgccgaagagaagttgttgattcgttcggcggtcggccttggagcagcgattttgattgggtatatttttgccaatattgaagggcaaaaattaatggaattccgttttgatattccccaactgtctgtccgtaatatcatctttgcttttgtggtcggactgatttttctgacgacgattgccatgattggcgtcggcagacaacgggggaccagtcgaatctttttgggtgtcgtcttggcatttgagttgagcttgaactttatgattgccactgatggtgcgccgcttggcaaccaaaaggcttttgaacggacttacgcgcaatccaccagattaatcgggagcgttgaaaagcgatatcaatcagatgatggcttctatcgtttcttgattattgataaaccgttccgagatttgttcaaggtgccctatagcgggtataacgattcattcctataccgaaatcatggcatcagttcgtatagttccactttgaatgcccacacccaccatgttttaggcgacttgggattttcgacccgcaacattcgccggatcgatatgttgggcggaacggcgattaccaactatttctttggtctgaagtattatgatgtcctggggcgttatgggaatcatttaacggttagaaaacgcacgtctgggctgggatttatggccaaccgacagatagaagacctcaagttgaaacggggccaagcctttgacaacttgaatgattttgttcaagcaacggcgggaaaccaacgtcagtatgtgtacgcgccgacgatcattagcagcgccaagttcgttcatcgcgactattttgaatataaagtcaagttctgggccaatacaaccggaccgcactacttatacattccacgggtcagattgataaacgtgtcgttctatatcaacggccaaaaactttccaagttgtatagtggcttggggacggaaatgattccgatggggtacatgcaaaaggggcaaatttcaaccctgacgattcattcaaccaaggaactgcaccacgttgccggcgaccttggcggaatcgatctcgccaagcttaggcaggttgaaaactatcaggacaaccataaatttaaattgcaaaacccaagcctgctcaacgaacatggagcacattttaaggggcatgtaacggttggcaaacgagctcaaacactggtgttaaccattccatttgataaaggttggcaggccaaagttgatgggcaccagcggccgattaaaaaggttgctggcggcttggtgggtgtccgtgtgacgcctggcaagcaccaaattgcctttaactatcacatcagaggactactagccggagcattgctgacgattgtcggactgctggggctgactgggactgccatctggcggcggttgaaatcaaatatgtaaaacattttcaacaatgaagttatttaacgggcatccgggttaaaaatgattttcatgatgaaccccaatatgtcggcgtttagaaagggctttcatgatatttccaaagaatatcgcactttttgaaaataattatcaataatgcttgcgaaaattcttttcaaaatatataataagcatcgtagacaagtaactaactaatatataagacgaaagaggtacaatacttatgcaaattggtatgattggtctcggaaaaatgggtcttaacctggttaagaacatgatccgtaacggtaacgaagttgttgcatttgatttggacgaagcaaacatcaaattagctcaagaagcaggcgcaactcctgcatcaagcaacgctgaccttgtcagcaagttggacgcaccacgcactgtttggatcatggttccagcaggcaagccaactgactcaactgttactgaactggttggccttctttcaaagggcgactacctgatcgatggtggtaactcattctatcaagattcaattcgtcacggtaagattgccgaagacaaagacattaacttcttcgactgtggtacttcaggcggtaagaacggtgccctcaacggtggtaacttcatgatcggtggtaccagtgccgaagccttcgagcacatcaaaccattatttgacggtatttcacaaaaagacggctacctttacactggcaagccaggttcaggtcactacttgaagatggttcataacggtatcgaatacggtatgatggaagccatcggtgaaggatacgacgtcttggaccacagcccatatgactatgacaacgaagccgttgccaaagtttgggttaacggatcagttatccgtggctggctcatggaattggcacaagaagcattcgctaacgatgctaacttggaccaaatcagcggcaagatgttctcatcaggtgaaggtaagtggactgttcaagaagccctcaaacaaggcatcccagttccagttatcacggacgcattgttcgcccgtaaccgttcaatggaacaagatacattcacaggtaaagtcgtatcagcattgcgtcacggattcggtggccatgcgatggatatgaaaaaataagtgagcgactaagcccgggttgaccccggagtgtaacgcggaaaagccaatgatggacgttctttgtccatcgttggcttttttgtgttacacggtaggggtcagggctgtaggagctgtcctcaaaggctgaggtaattcagtattaaagcatgaacggaataacgggtagtaatgtgcgggttgtgcacattactacccgttatttggttaagcggaaaaagctggcttgaatagcacatccaatatgtagacaagagaaacatttgttatttttaatagattatattaaaaaatgttgttttcaaatacagatgtacaaatgatacataattaaagtgacacgttttgcaattgccttttcaaaacagataattaatagaccgggctgtatatatgatacttatataataaatgtcgattttctccttacataagaaagaggttcgtcgacaatatcaatatgttaattcttttgaatgcgttatcataggatagcaatatcacctgaaggggaacgaataatatgcttgataccattctaaatacactcatgaagccgacaaagctggaaaaagaacagctgaaaagcctggaatttcataatgatctgccaatagacgtctatgatacaaccttatctgaacaggaaaaaacgccgatcatcagcgatgctttgttcaaaaacaagagcatttacgtgagtaagcataatcggtatgcgccgtacccaactcatgcccatacttttttggaaattaactatatgctccgaggttcttgtgatgaggttgttgagggacaacagattcacttggagcagggggatgttttactccttgatgttggttgcaaacattcagttggttatctaggaaccaatgatctattaattaatgtcttgttccgcgacaaggaaatcaacctggatttgttaagcgacctgcgaagtagtaaaagcgttttgtacgaatttttattgaatcggcgaatcggcgatgacagtccgattcattacttggtctttgggcacgaagatgagagcgaggttcaagagaccttggatcggatcatcgaggaatactatttacagcgggactttgccgataccatcatcagctcctatctttcgattctgattgctcagctggtacgcaactacaaagtagatatgaataagccaatgtcaaaatctcaggagattgctgtccaaatgctcaaagaaattaacggtaattataaggatacctctcttgaaaaattatctgcgaagtacgactacaaccgaaactacttgagtaacctgtttaagaaagaggtgggtgatacattctcaaatgttctcacaaagcagcggctgatcaacgctaatatcctaattaagtcaactactctaccagtttccaagattatcaaggaggtagggattaaaaaccggacctttttctataagaaatatatcagttactacaaaatggcacctggatccagtcggaaagaaaattcaaactaaatagttttacgaattaagacgtctgtttaaccgttgatttaccaatatttactagttttttagtaaataaataacggtgttaagcagccgtcttttcatttacccagaaaatagatcggattgtccaagagtcaaaaaagattgtgaagtcgtatcgctttctgcctagtttatgtatcaaatgtacatatctgttgctaactgaataatttctcaaatcccgaataattccctacatatcaaggcttacccccgatataccaaatttttattatagagattgtaaacgctttattgaccgatctgggttcacaagataaccttaatacagttgatatatcagattgatataccagataactatttttgcaaaggaggttacgaggttcgtttagttaacgaattcagaataggagatttaagcaatggcaaaacaaagtaaagtttataccccacgaaagatcaccgtctggcgtgggattggttatgggattgttgattttgtcggtggtggttcgatgaccatcatcggcgcgtggatgctatttttctatacatcgtattgtaatttaactgccgttcaaggggcctcaattattggtgccgcccgggtagctgacgcaatctgtagtttattgatggggagtctgaccgataatttttataagacgaagttggggcaacgatttggtcgccggcacttcttcttactaatcggttcgccacttatgttgctctatattacgctgtggatcgcagggatgaattattggtattacttcgccacttatatgatttttgaagtcatttccagtgcgatgatgattccttatgaaacattaccaaatgaaatgacggatgattataatcagcgaaccaaattatcatctgctagaatgttcatctcggctggagcaactttcttggcaacctttattccgggacaattgtttgccatcatgggtcagcatagccccatcccgttcttagtaaacggaacgttatttgcgattatttttgcgattggcgtttacgtttgttacgcggttacttgggaaaagccagttacccctcaaatgcgcgcagagcttgagaaagattcagtcaatgaaggctcattgcttcatcgcttctggggactcctgtgtgactatgggtcaacgcttcgaattaagagcttcagaaagcatctgttgatctatttattctcgtttactggaaaagataccttcaacactgtgtttgcttacttctgcatttattgtttgggactctcagcaacggttgcagccaacatgctatcactgtcattaattgggttggtcgttacaatcgttgccggatttggaatggtcaaatacggaccgaagttcttgtatgaagtcggttacgggttaatgctgttgatgcttgtgggttactatctgatattccagctgcacgtcaccaaccatgtgatcttgattttattcttcatttcactgttctatcaaattgggcgggcaaccttggaattcacaccgtggaacgtctttccattcattcccgacttggatgaaattgtcactaaacgtcgacgtgccggtgtctttgccgctgtcatgagcttcactcgtaaatcaactgtcgcagtcgcaacgattgcagttggatttattttggacagtaacggctttgccaagaatgccgccagccagtcgcctcaagctcagcacgccattgcagcgatcctgctctttgggactggcggactgattatcctggcattgttggaagctttgaccttcaaacttaacaaacagacacatcaaattgtccttgaagagattaccaggcttcgaaatggtggtaaaaaggcagatgttgagccaaaggttgctcagactgttactgatctaaccggtgttccttatgacaaggtttggcccgacgataaatgaagttttagagaggaaaataattgatgactaacaatcaacaagaattattaattcctactcacctgaacgtgaacttattacggtttccctacaacgtcgataagtccccaagattcagctggtgggatcacagcaatatttcaaatagccaacaaacggcctatcaggtggtgatttccaaacgccttcatcaattggccaatcaagaatatatctttgatacgggctgggtacaatcctccgaaaatacgggtgttgcaattcctcaaattgagcgggtcttggatgctggggagctgtattattggcaagttcggatcaaggataatttcaacaatatcagtgatttttcccaacccgaaaaattcatcagtactgataagcctcaagtagagccgatccatgggatttgggcagatcgtgggcctaagtcggataatgaactgcccaagttaggaaacgttgtttttattcgtagtccacgctttgatcttaacctggtagatgttgatacggcggttatcaccgcattttccaggggtaatgagccactgtttatccaagggtttgacttgctggtgaacggtaccaacgttggtgttggatcggctcaccgtcaagtccattatcaaggaactgacaagactgggatttactataacaaatacgatgtcactgaagaattgatcaatggtgaaaacgtcatttctgtcatggcaactgccaagtcgaatcgaaaagccttctggtgcaaactcgaagtctacctaacagatgggactaagaagaagataatcgtgaccgacaaaaattggcacgttttagacggtagcacggcctttggcgattatggtgtcaaaatccgcagcttgtatttcggcatggtgtctgaaaatgttgatttgtgctactacccacaaggctggtcggaggtcgaatataacgatgacaactggccggcagcatgggttaatccacaatcgatggtttccgatgaggaagtttttattccttaccgtagtgaaaatacccggcgatttgaaacccatgagccaagtaaaaaggtgatcaagttaggtgatcaggattacctggttgacttgggaaaagaaattattggaagtcttaaggttaatcttcaaagtccacttaatcaacgggtcacgattttgatgggtgagcagcttcaagatgatggacatgttcgtcatcatctagcggccggtcccgattatgtcgaaaactggacgtttgtgaagggacagaatcaattcactactcttcaggttaaaaactttcgctatattgaattggttggcttccaaggcaacctaaatgaaaatgatattaatggatgggcgattgagcaaccatttgaatctcaagaatccgcctttgacagtgataatgacctactcaaccgcgaatatgagatgtccaagtatacgatcaaagcaactaaccaggatgtttacgttgattcccaagcccgtgagcgacggccgtacgaaggtgatctgttagtcaacggcaataccagtttcgttgtttcatctaaatactcgctcaatcgccatagtatggattacttaattgataatccaacgtggcccgaagattacaagctctacagtattgaaatggcttggcaagattatctctacaccggtaatgatgagttcttgaagaatcgatatactgatttgacttacaagcttaatcgcggcaaaaacgaggaaagttttgacggggcttcacaagactttaaaggatctttgaaaaataccaaaggcgttgacaactttgacgaagaagttggccttgttaccaacgatgggttgattgattggccgattcctgaacgcgatggttttgtcgaaggtgagtacaatacaccattcaacgcaattttctatggcgcttatctgagcatgagtaaaattgccgacgttgttgggcatcacacagatgccgaccattaccgaagtcgggctgctcgcattaaaaaggaattaattaatcgaatgtatgaccccgaaactggtcgtttctacgactcgatgaataaagacctttcgattaataagcatacatctcatcacgcaacagcttatgcactgtgctatggcgtttatgccgatcagcagatggccgataagatgagccgatttgtcgctaatgatggcaaatttgttggcagcatctacttcatttactttatgctcaaaggtttaatcgacagcggtcatgccgatgaggcggtgcgtctcctaactaacccagacgaccgtaaagatcaaaagacgtttgcggccatcttgaatactttgaaggcgacgattgcccctgaagcttggagcaatcactataaacctaatatgacgatgtctcatccgtggggagcgaccccaggattgacgatcgtgcaagggattatgggaatcaacccaaccaagccgggattcgaaaactttagtgtcaaaattcggccgggcagcctccaccgtgtgagcgttgaaacgccatcagcaaaagggattattaaggccactctaacagtgggaaccgatgaacagattgtcactgtccacgttccaatgaatgcaaagggaacagtgatgttgcctgatggtagtcatttaatgacgattcaagatcgtaatggaactgatttggaggggatgcttacgaaggctggtcagattgttttaggatccggcaattatcaaatctcatatcgtaccaactaatattgttgtaagttaaatattttgatgcgtccttggaatggacgataaggagaacaggattatgaaaaatctaggaagatattggaacttgagtgtctcggctggtctggggtcgatgcttggttcaggaattattgttggtttggcaagtacgattaccgtctggcagatgggactgaatttaaccaatggtcaagtcgggattatttccggtgcgttaacctttgccattgcttttggatcaatttttgggagtcgatttgccgataaagtcgggattgtggcaatctttgattgggtgaatttcctttatgcaattggtgccggtatttgtgtcttcgcaaacgggtatctcatgctgcttgcgggagttgtgatttgtggggttgcttctggaactgacctgcccgtatcgttgacggtgatttccagggatgcacctaaccagaagatggcttctgaaatggttgcttcaactcaaattttctggcaagttggtcaatttgtttcaactggtgctgccttcgttgtttctacgatgagtgttactggtggacgaattgtgtttggcttcttcgccatcactgctttgattctttgggtatggcggacattcaccaaaggaattcgtgttctccacaaagaagctgcagaacgattagctgccaaagaagcacaactggacgaaaagccaaccgaaaaagcttcagttattcaggtactctttagaagttcacgaagcaagatttacatccgattatttgctgcaattgctatctactacattttctggaactttgttgccaacacgttcggtcaattcacaaccttcatgttcgttaaagccggtgcctcacagacattatcgactggtattggtttgggactgcacatcgctgcgctgtttatcttaggcttctacgtaacgattgctggttccgcaaaacgaaatacttggttcacccttggcgttatctttgcactgatcgcaatgggtggtctggcaatctttggagccacttcgattgccttgatcgttgccttcatgctcgtttggggtgttggaagtatgctctccggtgaagctatttacaaagtttggacacaggaatcattccctgaagaaattcgtgcaagtatccaaggatttatcaatggggtttcacgtttcctttgtggaattttagcaatgttcacaccattgttggtcctcccaagtactatcaagatgacaatgtggggattcgttggtatcgttgcaatcttcggtcttgctggatttacaatgatccattatgaaaagaaatacaacatgattaatggtgacgaagctagcaaagctgccgctgctaaagaagcagataacacagctgctgccaagtaactcatttttataattgaaagcaaacaagcgcccagattaaattctgagcgcttgtttttggatcggattctattgtaagtactggtcataccacccagctgaatgattcaaataagtcatcatttcagcatcggcattcgccccagttaacgtggctatcgtttgtggatcaccaacggtttttggatggttaagtgttccagatagctgatggatggtgactttcacatcaccgttcttttgaaaatcgaagctgagaccaaatttaggattccaactgttgttctcgtacttgtattgggtgaaaccgttcggagtcacataccgataatcagtcgactttgacgtatcaatcaaatttcgtaatttctgctcatgaccgccaatgctgacgaattggtaggatggtgctacgtaccagatgccatcgcgtaaagttggctggttgttggaaatactgatgatatttttggttgtgacataacgtaggcgatcccgacaatccaccagggaaagatcatggttcgggccatagccgttgccatataccttagtgatagggccttcctccatattcgaggtggattgggcggttggatcttcaaagtcgtaggtccgagaaccaaagaccgttgtgaccgtcttggcatcgctgtaggtcttgatcggctttgctcgatttggcagtttggagagttggagaactggatagaatgaattaacgtccatccaataatgataaggatacgtttcaatcatcggcagttcaacagcttggccgctaatatatagtttcatcattgagatgcggacacctctggaaacgcggttttcaatcatcttgggaacgttttgattcttctttttaaggaaattgatgacctgcttttgttgactggtggttggcaccttgaggtatggtttcatcgaagtcgcattcatgacgccaaatatccgtccagtttgaccaatgtcgctggaagtggaccagtctttcttattgtatggggtactcgacattaaaacatgtttggttggatagcgatagccgccacctttaatgtaggagccgggaactaagctcccatgccaaacgtaacctttgatcttatggttggcacttttgacatagtaataactaccgtaatagctactcgtgcgaattgtgacccgctttgtcgaataaagattggtgtgcgggtagttcttcagattggcgagcttcttggtgtaactcccattccagacatagacagattttggagtgttggtcaaaaatgatgtctttttaaatgttttgttagtggtaattttggtcttggcactggcggtcggtgcggactgaattgaaacaattgacccagtcagcagcccggcagccaggatggccagcgtgaatttcttgtgcatgataatcccccttcaattattgattatagcgtatcactcacttgaggcccacatatccggttcgattgattaaagtttggccatcatcagttctcaaccagctgattagccgttgagaatttttggatggttggtcacgtgaaatggcgtagaaatgggcgatgaggggatatttcccattgcggatgttctttgcagttggcgcaatgccatcgacttttaataatttcacctggtgggaggctgttttggggtggaagttactgggctttctgtttttgagctattctccgacgacctagggacctactgtacaaaagaatcagaccacgatgaataaaacgttcatcacggtctgattctctttggtttcaatcatgtttatgtcgatctttttccaaggaatatcctgtcataggtagggaggggttatggaattgacaggtcccttcggctttcgagctatgctccgacgcaactgatgctaacttctaagagggctttgattaaatccccagaaacaggggttttaatcaaagccctcttagaaaccgcatcacccgttgctcgtcgcacactaataagtttgtttcataacagtctttctttgatttccaacgtgctataccgcattttccacaacggacatcctgtcatatgtatggaggtgtcatgacaattacaagtcccttctgcttttgagctatgctccgacgacccagggacctactgtacaaaaagaatcagaccacgatgaacaaagaacgttcatcatggtctgattctctttgtactccggtccctaaccgggtctcgtcgcacactaatttttgaaataatccggatacgcatcgacaaccttttgcttctccagcagcatcaaatgcaaatgctgggtaaccaggaagctcaaatcgtcgatatccttattcttaacggcattaaaaattgcggtatgttggttggttaacgtatcccaatccaattcagtttccttcaaccgtagtcggcggaatcggttgagctgggtgttattaatctgcagccagttccaaaccgtatccttatcaactactttatagaacgcgtgatgaaattcctggtccagatcaaagaagttatccggctcattcttgagggcggtctgctgttgctgatctaaatttttctgaatagtggcgatggcctcatcagaaatattgacagcggcgtccaccataatcttgggctcaatgcagctacgaacaaagcgggcatttttggcatctgccatatcaattttagtgatgtaggtgccactctgaggtatcacttcgatcaaaccttcacgttcaatacggatgatggcttccctgactggggttcggccaagatttaactcttgggagatcagcttttcggaaatcttctgtcccggtacgtagtcgaagtggatgatgcgatatttaatttcattgtaagcgtcactgcgcatattatccaacataataagtctcctttagatatcatcatattagcatattttggtgaaaaagttaacgaagatccttgaaaaaactggggtattgacaatctgatatatcagaatataataaaaccgaaagcgtattcaacggactggtgtactagtttattttaagccagctggcatacgttcatgtttggctcacgcaacgcaatacaggaggtttaattaatggtaaaaattactgacgattacctgaacaatcaacaagagtttgctgacgctggaattaaggttccaacttatgatattaaacaaaaaacgggcgccacaaaatgggttcacttcggtggcggtaacttgttccgagctttccacgctgctattgccgatcgactgcttgaatccggtgatttggatgccggcgtggtcgttgctgaaacgcatgacaaagacgttgtccaagacgcctataaaaaatttaacgataaaattctccgggtgatcacccacgaggatgggaactttgaaaaagaattatttgcttcagttgccgatgcgttgttctttgaccaaagcaatcccgatggctggaacaaactattcaagatttttgaaaatcctgctcttcaattggcgactttctcaattactgaaaaagggtacaacttgtgggacagcaagggtaacttattgccagccatcgaagatgatatcaagaacggtccagaggcccccaagaataacatggcttccctgactgcattgatgtttgcccgctttaaagccggcaaatacccaatggccttactgagcactgataacttctctcaaaatggtgaaaagcttgaaaaaagtgttttgactatcgctgaaggctgggaggaaaacgggttggtgcctgaagccttcgttgattatttaaaagacgatcacaaggttagcttcccattgtcaatgatcgaccgaattacgcctaatccttcagaagccgtttcagaaaagctcaaggctgacggctttgaagactatcaaattttccatacccctggccacaccaatatcgctgccttcaccaacactgaagaagttcattatctggtgattgaagacgactttccaaatggccggccagccttggacaaagtcgctggtgtcaccctgactgatcgtgacaccgtcaatgatgccgatgaaatgaaagttaccacctgtttgaatccattgcacaccgcgttggctgtgaacggcagcctacttggctttgactcaattgccaaagaagtcagcgatccagacatgctgaacctgatcaaacaaattggttacgttgaggggctgccggttgttaaggatcctaaggttatcaaccccaagacctttatcgaccagttggtcaacaagcggctgcctaacccatacattccggatatgccgcagcgaatcgccgccgacacgtcacagaagctgtcaatccgttatggtgtcaccatccagcattacattgatgatcccaaacgtgatcccaaagacctccacttcattccgttagttctcgcaacctggtgtcgttacctgatggccattgacgaccaaggtaaaccatttgaaccaagccgcgatccactcttgtcagaacttcaaccaaaggtccaagacattaagctcggcgaaaagaccgacgttcatgcccacctgaaagatatcttatccaatcagaagattttcggtcatgacttgtacgaaattggcctgggcgacgttgtggaaggctacttcacttcacaaatcagcggggttggtgctgttcgcaagacgcttgaagacacgttatcaaagtacgctaaacaaattaactaaggagacaaaccatgtcattattgaatgatgatttcttattgaccacgccaatggccaaaaagctgttccatgatcatgctgaaaaaatgccgatcatcgatttccattgtcatttggatccaaaggaaatctatgaaaacaagaattacaagaacatcagtcgaatttggattaacgaaggcaacttcggcgaccattataagtggcggttaatgcgcgcaaatggtgtgccagaagatttgattaccggtgacggtgatgattaccagaagttccttgcctgggccggcacgattgaaaaagccctcggcaatccactgttcgagtggactcatctcgaactgcgccgtttctttgggattaatgatgtctttaataccaagacagcgcctgctatttgggaaaaggccaaccagctgttagccaccgatgattttaaaccacgcaatttgattaaacgctcaaacgttcaagttgtttgcaccaccgatgaccccgcttctgatttgaagtaccacaagttgctcaaaaaagaagaggaccaaaatggcttcaaagtattgccggcaatgcgtccggacaaggcattcaacttgactgacgacggttacggcgactatctggatcaacttgcaaaagtttccggcaaaaagattacgtcatttaagagcctggttggcgcccttcggcaacggttccagtactttgaaagcctgggcggccgattgtcagaccacggactcaacttcttccactttgtaaaggcttcagacgatgaaatgaacgagatcatcgacaaagcccgcaataataagcaactcaccaagactgaaattgaccagtatcaaaccatgttggttgaagccctgatgcatctgaacaaggaattcaactggacgatgcagttccacatgaatgtcatccgaaacgctaacaagccaatgctgaagagctttgggactgatgggggctttgattccatgggaacccagcctgatttggcccaggaattcatgaaactcttgatggatgcgcaggaagaggaccaaatccctaagatgatcatttactcattgaatccaaatgactggatggaattagcaaccggaatgggtgatttccaacaggacggcgttcaaaagctgcagttgggagctgcctggtggtttaacgacaccttcagcgggatgaagaaacagttgacaatcatggctgaagaaagtcttctgcctaacttcgtcggcatgctgaccgattcccggagtttcctgtcatatccacgtcacgagtacttccgccgcgtcttatgtaatgtcattggtgagtgggctgaacgtggccaagcacctgatgatgaagattacttgggcaagattgtagaagatatttcatataataatgcccacgatcagttccatttctttgatcaagattaaccaaatcgcagaactagtatgttagtgcaccaacaattatgatttaaaattaaggagagaacatcatggaatacaatatcgcagttgttaattcaaatagtttcggtcaggtcttcacagagcattggaaagaattggaaggcattgggactgttaagcggttcatgctgccaaccgacattgatggtaaattattagctgaaaagcttcacggctttaacgtcattattgccagtgtgaccccgttctttaacaaagaattcttcgataacaaagatgaacttttgttaatttcccgtcacggaatcggctttaacaacgtggatttacacgctgccaaagaacatggcacccaagttgccatcgtcccacaaaaggttgaacgaaactccgttgctgaaaacgagcttgccaatttgatggccttggttcgccaagttgttccttcatcagaacgcgaacgtgccggccgttatgaagaccgtgcccaattcatgggtaacgaattcagtggtaagacatttggtgtgattggctgtggtaacatcggcagccgagttgctgaattgttcagtatttttggcggaccagtcttggtcaacgatccacatccggcaactgaaccggaatggtttaccaacaacaacgttgaacgcgttgaccttgaaactttgcttagccgctgtgattatatttcattgaatgcttctttggatgacaccagccttcatatgattaactccaagaccatcaagagcctcaagaagggtgcttacatctgtaacaatgcccgtggtgccctggttgaagaagacgccatcagcgccgccatcaagtcgggtcagctctccggctacgctgccgatgcaatggaagttgagcccgttaaggcagaccatccattcttgaagaacgaccggatcctggttacgccacatacttctgcttatacttatgaatgtcttcacggcatgggcgaaaaatgtgtcagcgatgttaaggcaattgttgccggcaaacgtccgggacgtgagttgactcataacttggacgattaacgcgttccggttatataaatgacaacccgagaacctgaaacggagaatgtgatgatggattatattattggaattgacgttgggacgaccagcaccaaagcgctgatttatgataccgacggcaatatttatggcaaggccaataagggctatccgctttatcaagacacccctgatatggccgaagaagatccggatgagattttcaacgcgacggtttctgccatgcaggaagtggtggcaaaagccaacataacggatggcaaagtgattgccatttcctggtctgcccaacagcacagtctaattgccttggataaggactttaagccgctgaccaggtcgttgacgtgggctgacaaccgttcccagaagtatgcggcggaatacaagcagaatggccgcgggatggaaatgtacaaacgaaccggtttgccaatccacccgatgggacccttctacaaattgctttattttaaaaatgaacgaccggaaatctttgaccaggccgcctattgggtgggcatcaaagaatatatcatctggaagtataccggggtgctcaaagaagaagtctcaatggctgccgcaaccggcctattgaacatgaattctgcccaatgggacgaggaagcactcaaagaaaccggcctcactgaaagacaactgcctgagttggtggatacgaccgataaattccaaggaattaagtcagagtatgccaaagtgattggcattgacaaggatgtctactttgtcatgggcgctactgatggcgcattatcaacgattggtgtcggcgcgattcaaaccggcgtcctggcaatcaacatcggaacttcggctgccgttcggaccttcgtcgataaaccgcgagtggatcccaaagcccgtttgtactgctatccagtcatgaagggtaaatatctagttggcgggccgatcaacaatggcggcattgttctcaactgggcccatgattcactgtttggcggtgaagttgaagcagcaaaactgctgcacatcgactcttacgacatgctttcaaagattgctgccacggtgccagctggctctgatggcttaattttccatccataccttggcggtgaacgtgccccattatgggatgccaatgcccgcgggtcgttcttcggccttaaccgcaaacatacccgcgcccacatgattcgtgccgttatggaaggcattatgtacaatctgtactcagttaccttggcactgaaagaagttaccggcgaacccaaggcagttttggctgccggcggattcgcgcggtcaactctttggacccagatgatggccgatatcttcgagcacaatattgtcattcctgaatcttacgagagtggtagtttggcagcgatgtttctcgccaaaatggctttgggattggaagacaaccttgaagacattaagaagtatatgggcaaggaaaccgtgtatgaaccaaacgaggacgtctttaaacgttatcggactctaatgccgatttatctgcggctcagtcgcgatctttctaaagaatatgaaggaatcgccgagtatcaacgtgaattttcagatactgatgaataattgaattgaagcgccaattcgttcctgccggttgcggtgaaatggattggcgcttttttggttgcgcgatgattcacccagtttggtaatgattttggaaaattaaaatagctaatattgtcacaaactcctaacaaatagtatacttttagttgtggttacgttttcatttcgaatggaaatatccaataaaaacaacggaggtactgattatgtccaaagttctgattgtcaacgcaggaagttcatcattaaaattcaaattgtttgaaatgccccaagaaaaggtgctcgctgacggtgaggttgagcggttgaacatgcccggctccaaagtcaaaatcaagtatggcgacggtgaagtctataaagccgaagaagataagattgattacgagcgttcggcggggattatgttgaacaatcttaaagatcttggcgtcatcgatcatttacgggatattgacgcaatcggtaaccgagttgtggctggaagtgacatctttgataaagtcgtcaaaatcgacgatgatagtttgtcacaaattgttgagttgggcgatattgcgccgattcataatccagtcgaagctgaatacattgaaattatccgcagaattttgccggacactgatcagtacgcaatttttgacagtgccttctttaaagatgttccggaagtcaattcgatttacgggattccctatgaactgacccagaaatttaccattcgtcgctacggtgaacatgggattaaccatggcttcattacacaagaagctgagaaggcgttgggcaatgaccacgctaaattagtgacccttcatttgggctcaggggcctctgtcgctgctgaaaaagatggcaagtgttacgatacttcaatggggttcacaccgatgaatggccttgtgatgggaactcgttcgggggatgtcgacccagccttggtacctttctttatgaagaaaatgggggctagtgctgaagaagtcatcgacatgtttaacaaacgctctggcctactgggcgtctccggagtttcctctgacatgcgtgatttggaagactccgatgatgaccgtgccaaattagcgttggatatgtttgtcaaccgaacggttaagtatgctgccagctacattactgaactcggtggtgtcgatgccatcgtcttctctggtgggattggtgagcatgacaaatgggttcgtgaacaggttgttaagaagctggaaatttttggcatcaaattggacggcgacctcaacgagcagcaaaagcccggcgacttaggcaccaaagattcatcagccagaattctcttgattccagctaatgaagagttggcaatggtccgggatgtggctgcagcgctttaaggctcatagttcagttgattgtttcaaacattgcaatgaaattctcttcaagttaaaggaagtcctttagcttggggagattttttgggtttttgaataaaaataaaaatcacgaaagaaaattgcgtaattactaattatggcatgcaaggcgagggggaactcagcatgcgcaacggtggcagattctgttacaccgggctgcctgctgatacctttaaacattttggcaggtagtcaacattttttgagaaagtagtgattttattgattatcaaaagccgccgctcatggattgaacaaatcgtgatggcgattttcttcctgattgtctacgtcattgagatgctggcatttcaacataccgcaccaattgtcttttcaacgatccaactggtatatggtttgattgtttttgccttcgtgtacctggaggtgggaacgtataaggtaacaaccacccggttgaaattaaccactaatttgaaggtgtggttcgcaatttttgccgccacggtgatcgggatgctgttactggaagagttgccagcgaccgtcgtcaccactttgacgacccgacacgttgtggttaacactctgattgctctgacagccggattctttgaagaaagtctggtccgaggattggtgttttctgccttcctacaaaacgccaagaaccaccggcgttccctgaaattcaccaaagctgccatctattcctcactggtgtttggcggcctgcacatgatgaatatgagtcaggacaacatcgaaggcgtggttcagcaagtcgtttacacagtcgtgctaggcctcttgttggttgtgattcgcgtgacgaccaatactttgatctggccgattgccctgcacttcttgattgattggcaacctgatattgcctcgggtgcagtacctgatgcaacgaactggttggtgattatcggcgtctttggcgtcattctggtcgctagtgtgatttatctcgtaaaatttgatcgtgaatatgagaagcaacagtcgctaagtacaattggataacaagtgaatttttccatcaataaagagctccagataaggacagtttcgttcttacctggagctctttgagttgtttgagaaatgtttgattaatgatgggtctagaattcaaccttgtacttaatgctgtaggtcttttcctcaccagctggcaatatgacatcaccgaagtctgcgtggttaggggtgtctggcaagttttgggcttccaaagcaattgccatgtatgggccgccttttccgcggagatagttggtgccggttagatcatccggtgtgaagacaaccaatgcatttcgcttggaactgatcgaaacgctgcggccgctttcgggatcggataaggttgcgaccggttcgtcgtcttgatggtcattgatttcaaagacttcatcataactgtgaccaacttcggccttcatgtcggcgataccgaccttgaggttttggttatcgcggaagtcgtatggggtgtcatccacggcgactttcttaccggttggtgtcttgtccttgttcaattcaaggtacttgtcggcgttgatttgaagtgattggccgttaatgctgtcaccttcactcaagttgaagtacatatgctgggttgggttgaacaaagtgtcggcgtcactcttggcactgtaagtagcggttaattcattatcgttattgagtgagaaagtaatcttgacgtcgatgttgccggggaatgaatcctcagaagagtcgatatgcttggtgaagacgatggtgtcaccatcaaatgatccgtcccagatttgggtgttgaacccgtgggggccaccatgcaaagtcgtggtgccttcgtttgaatcaacgtggtattcctgacccttgatcttgaaagtaccgttggtgattcggccggcagttcgaccgattgcctggcagaagtattgattcttcatcaattcttcactgctgggcacgctgaccaaaatattggttggtttgccgtcgggtccgggaacgttgaattcttccaaggttgccccaaaggtaattgctgaaacagaaacgttgtgatcgttggtaatggtgaacttttcaatgtcttgaccatctaacttatcgaacaattctttcttggtattcatagcatctttctccttacgaaaataaattacggtcgtgaaaccgcttttatctgtattataatatgtttttgtacggtgatgcaataccaattttttaatttatccgtataattctatataaattttactcaaagtatgatacttttattactggagtattttatttaaattcgagaggttatattatgacgacaattttgtatgttttatcggggattaccgatttattaattattgcttttatctttatggcaatgtatgaattcgccagaaaagatcagacgaagcccaatcaccattttggtatctgggcaatcgtttgtgtcttcattacttttggcttgttaatgttaacgtagaacacttatcaatttgaacgcggggggatctcatcatggaaacaaagtacgtcatggtcaagaagaacattaaatcacacatcattaacgggaaatacaagattaacgataaaatccctaccgagtccgagttgatggcaatgtataaggtcagccgctacacggtccgccgtgctgtcggtgatttggaacatgaaggatatatttatcgggttcaaggcggcgggatgtacgtgaacgactggatcaacaataaggtctcttctgaccgatccaatcaaaacgtcggcgtggtcacaacccacattgccaattatattttcccaagcatcatcagcggcatcgaccaggtgatctctgatgaaggcttgtcgattctcattgggaatacccatgatgaatatgaaaaagaacgccataacttattgaatatgctggacaatgatgtggttggcttcattattgaaccaaccagaagtaccctggacaacccgaacctcgatgtctaccagatgattgtcgattccggcaagccggcggtgttcattaacgctcattatccacaactgaatttcccatacgttgaaaccaacgatacggatgccgaaaagactttggtcgactatttgttggatcatggtcatgaacgggttttgggggtctttcaagttgatgatctccaaggcgtccatcgaatgaacggcttcatcaagtcctaccagacccatcccaacgtctcaacttcaggcgatatcatgatgtatcgttccagcgatgacattcatgacgtcttggataagatcaagacccgggtccaggttgagatgaatgccctgccgacggcgattgtctgctataacgaccaattggcaattgaagtcattgggatgttaagcaaagagggtattcaagttccagatcaaatctcggtagcgggatttgatgattatcaaatttctcagtatattgatccaacgctgaccacgatggatcatcccaaacgaaaaatgggccacacggctgcccaactattattagatatgttggatggcaaggatggcagttcaaaaattttagactcggatctgattgttcgagcctccactaaaagcatttaatccggcttttagaaaataaattccaagatcacttcgcttgaaaggaggtgatgcacggcggatttcccgtccgtgttttattttccagaaaaattttgtgctaacaaataaaatatatcttgatttatgcgtataaatattttatactctttttgtaagcgatgtcagaaaccgtttacaggtgcgcacaaagtttttgcaataattggtttaataaaatacgaatggggtgctcgttttgaaaaaggtcacaaataatggctttatatatacgtttggagccttaggtggtttgctcttcggttacgatattgcgtcagtttctggtgcgattctgtttattgaaaagcaacttcacttaggaccatggcaacaaggttgggttgttagttccgtattaatcggtgcgattatcggtgctttggcaacaagtaagttcttggatacttatggacgtcgtaaattattgatctgggcttcagttatcttcttcattggagctttaacatcaggatttgcgcctgacttctgggtacttgtttctacccgtgtggtattaggtattggtgttggtattacatcagcattgattccagcttacttgcatgaattggcaccaaagagcatgcatggtgcggttgctacaatgttccagctgatgattatgattggtatcttgttggcatacatcttgaactactcatttgctcatctgtataccggctggcgttggatgttaggattcgctgcattgcctgccttcattcttttcttcggagcccttttccttccggaaagtcctcgattcttagttaagattggtaagactgacgaagctcgcgaagtcctgatggacaccaacaagcatgatgccaaagccgttgatgttgctcttactgaaattgaagaaactgccaaagcaccagttggcggctggaaagaattatttggtaagggtgttcgtcctgcattgattactggacttggcgttgccatcttccagcaggttattggtagtaacagtgttatcttctatgcgccaaccatctttactgatgttggctggggagttatcgccgcattacttgcccatatcggaatcggtgttgttaacgttatcgtaactgttgttgctatgttactgatggataaagttgatcgtaagaagatgcttgagtttggtgctgcaggaatgggcctttcactggtcgttatgtatgctgtcctcaagtttgataatggatcacacgttgccgctattgtgagtgccttggcactgaccgtttacattgccttttatgcaacaacttgggcaccagttacctgggttctgattggtgaagtcttcccattgaacattcgtgggttgggaacatcactttgttcagcaaccaactgggcagctgatatggtcgtttcattgaccttcccaatgatgcttagctcatggggcttggacaatgccttcctgttctacgcagttatctgtggaattgccatttgggtatgccacagcaagttccttgaaactcgtggtaagtcacttgaagagatcgaacttgaccttcataaggctgccggagaagacgttgcgtcaaacgttacaaaatagttaaccaattttagacattttgtctaaaaataataaatcatcaagaggagagaaaactatgttacaagtacctgattatgaattttggtttgttactggtagtcaacatctttacggagaagaacaactgaaatccgttgaaaaagatgcacgagacatggttgataagttaaatgcttctggcaaattaccttacccaatcgtgttcaagatggttgcaaccactgcagacagcatcactcaattaatgaaagatgttaactacaatgataaagtagccggaattatcacttggatgcacacattctcaccagctaagaactggatccgtggtactaagttacttcaaaagccattactccacttggcaactcaatacttggatcacattccatatgacaccattgattttgactacatgaaccttaaccaaagtgctcatggtgaccgtgaatacggctttatcaatgctcgtcttcgtaagaacaacaagatcgtttacggctactggggtgatccagaagttcaagacgaaattgctgactgggaaaatgttgctgtcgcttatgacgaaagcttcaagatcaaagttgcccgcttcggtgataacatgcgtaatgttgctgttactgaaggtgacaaagttgaagcccaaatccaatttggctggaccgttgattactacgcacttggcgacttggtagaatcagttaacgctgtttctgaaagtgatattgatgctaagtacaaggaattacaagacaagtacgaatttgttcaaggcgacaatgacaaggacaagtacgagcactcagttcgttaccaaatccgtgaatacttcggaatcaagaacttcttggacaaaggtaactattcagcattcacaaccaacttcgaagacctttatggtttggaacaattacctggcctggcagctcaattgctcatggctgatggctatggcttcggtgctgaaggtgactggaagacatctgcccttgaccgcttagttaaaatcatgactcataatcaggctactgcattcatggaagactacactcttgaattacaaaagggtcaagaagctatccttggatcacatatgctcgaagttgaccctggtattgccagtgacaagcctcgtgttgaagttcatccattggacattggtggtaaagcagatcctgcacgtttggtattctcaggccgtgccggtgacgcaatggacatcacgatttcagactttggtaatgaataccgcatgattggttatgccgttgaaggtaacaaagcacctaaggaaacaccacatctgccagttgctaagcaaatgtggactccaaaggtcggcttaaaggccggtgctacccagtggatccatgatggtggcggacaccacacggttttgacattctcagcaagtgaaacacaaattcaagatcttgcccaaatgtttggtttaccatttgaggatattaagtaatagagtgtgaagagcaacgggtgaggcgttttcgaagggtactttgattgaagtccctgggtttgggactttaattaaagtgcacttagaagttagcatctggctcacggaacacatttcagcagagtgtgagctggggcggttaacaaccggtgcctaagtcggctttgggggaaatcttgatttctcccaaagttggcttaggtgtgggttgttgccccagggaacacgtttcgactaggtagcctaaaactactaccacccgagtaaccccgagagattactcaacataaagtccaccaacaaagcctccgagaggcttcggacgggacttcataaaactaaaatgaggttgagacaaatttgcgtttgcctcgacctcgttttgtacatagcggttatatataggaggaaattgatgatgcgcagtgaaaaagagaaaatgctagctggagaacggtacctgaatacggatgacgaattggcggcggaccggcaccgtaaccgattgctggtagataaatttaaccgggttgcccgccaagatcctgagcaagggagccaattgattaagcaaatttttcatcaaactggtgaaaaggtggatattcaatccccctttcaatgtgattatggttacactgtttcagtcggggagaacttttttgccaattacggttgtacgtttatcgacgttggtaagattacaattggtaagaacgccatgctgggaccgaacacttcgatttattctgtcaatcatccgcttggagccaaggaacggatcgccaattatgaatatcctgggaatgttacaataggagataatctctgggttggcggcaacacgacaatcgttccaggagtcacattaggagataacgttgtggtggcagccggagcggtggttacaaaatcgtttggtgacaacgtcctgattggcggcaatccagccagaatcttaaaacatcttaattaatactggaggattttgatgagtaaagagaatattggcagtagaatcaaattagcagacggtcatacgatgccccaagaaggactgggtgtttatcggatgactgatgaagatgaattaattaagtcggttaaatccgcatatgatgatggttaccggttgtttgataccgctcaaatgtacggcaacgaagctgcggttggcaaagccatcaaagacttggatgttgcccgggatgacatttttgtcacaaccaaggttgctgaagagaatcaaggatatgatcagaccattgcttcagtcgaagaatcattgaagaaactgcagttggattacgtggacctactactggttcactggccgattcacacccacttctttgaaacctggcgggcatttgaaagccttaaagagcaggggttggtcaagtcgattggcactagcaactatggcatgctgcatctgcagtatttggcaaccaaagctaatgaaatgccagtcgtcaaccaattggaagttcatccatacctctcacagcaggctatgattgattttgaccgtgaaaatcacattgtcactcaagcatgggcaccgttgggtcgcggccggatttttgatgatccagtgattgtcagaattgccaaccagcacggtaaatcagctgcccaggtcattttgcgctggcatttccaacgaggagattcattcattcccaagtcagttcatcctgaacggatcaagcagaacgctgacatctatgattttgagctgagcgaagatgaaatgaaacaggtggataggttgaaccggaacactcggattagccaggagcctgagatggtttatgagattggacatcagtatccgcatcattaatatcttagaatgaataaagcgccaaactgacgaactcgggttaattgagttcgtcggcttggcactttttagtttaatttggaatttaatgtaagattgcagtgacctttgagactctggtggctgtgctgcgacagtagtaagaagggtaatgtttgaggctttgattaatcggaagatgggtataaccaatcttaatctttgtccaatttttattgggctcaatgaatatccaataggccattgaaagatccttggtatccgagccgttcaatatgtaatcgttatcttccatttggcggtaaatcatccatttagcagtaaagttgccatcctttgtatgttttgcgacaaagccgtctttagtcgtataaaagtattcatgggtgggctgaacattcttactacccctgatagtaacggcccagtattttccctgcaatacgggaggtacaccatcctgaacttttgagttggcacttgcaatcgttgattcccccaagcagatggtcataagcatgactgaaagcaaagatataagcaattttgtaaatcgattcataacaattccccctgttggtaactttttagtacctaaagtgagattagttctaattatttaacttgtcaattattttttggacaaaattgtgaataaaaacatttaaaatatttatttagtttggctgtcctgtcgcatatatagaagaaaaaatctgacagaatccaacatgtcgttatatattacacaaagtcattgtaatatatttgtaaagtgctataaccagaaatgggtacaacaaatgttacct

SEQ ID NO: 178 - DNA, 5336 bp, Lactobacillus buchneri
taaggcgtatccgtttgagtgttagggctatactgaacccgagctaattgagttccccaattttctgatccaccattaggtttggtaactacccaccaataatcttcaccattatggctaaaatattcccaagtttgaccatgaccaaagttattaagatacatttgttcaccagaagaaaaatccaagtcataggtgctggtaacattggtcttgggaattcgagaaatgaccacatttgtattgctattgattaattgtaaagcgtaaacataagttgcaccgacataaactttttgaaccacattagtggatgggaggtttaataaccgatattttaaataggctggttgtgccattttaaagacttctttcgttatttttttaatcaccacaattccggaatttttgtttatcaaatcgatttgataattatagtgtaaatcagttttctcacgaaaaactgccatattgctgccactttactgccaaaccactgccatttatctcatagcttttttaccaacaaattttgtggacaaactccagcaaatttccataatgcttgcttctgatcacgaaaaaaggttcggtcagccaaataatccaagtcgtatttctgagcgagaaattgacttgtttttgaagtcgaccagcgttttaaaaaacgagctcttaataaatcggcagcaaacgcctcttgtgaacctaacttgcccagtgcctgtaatggctgttctcataaatgacattctttgagtgccttctggtaacgcctctgaaccagctgtcgattatctaattgcggttgttgcaataataaaatagctttgttgagttgaaattgccatcgttgataattcattaaaaaatctttagtagctcgttcagtggctcgatcatcgattaaagttgattgattagttggaaacattatcttcacctagcctttgttcaagaacacacgttttcttaaattatacgaacgtgtgttcgaacctgtcaagtgacttttgtttatcctcacgcccattgattgccaatcagtaccccgttttagttgacacataatacaaaaattcagttcaaaagtgtttaagcaattgaactgaatctatactaggaaaatcctaggatgctttttcaaaaattaagaatcccaatttaataacatttactcgacttaaacgtcctaggattttgctactatgcccctgattttgcacaaatattacaagaagcaattgtagcattttcctaggactaaatattgcagttatcacaagggtttggatgccgacactgtcgactcatttttttacaaaattgacccgttttgtaaaaaaatgcacagtccctttatgctctttagtatttttatagtttgagcacagcgaaatctaagaccgtttttaaaaagacaccacatgaaaatgtgatgtgtaagtgcgcattgatctcgttccactcggtctgctgattacccaccactaattttagtgtcctttctctagtatcattactaggcctgctttaaacacactctttagccataatggggctcactgagccgttattaattttaactagataattaacaacatgagatacactaaaaaaatagccagataagtatctttttataagcatatcaagcttatatatctcctaaactatttcttgtctttatcttcattcttaaccggaaaagcagcaatcccaacaccgacagcaacagccaaaacagtctcaattaaatcatgattttgattttcaaacactgcataataaataacgaaaaataacaattcaaatttttttgctcataaagccacgcctcctagaacaagttgctcatactcagtttaatcaatataaaaaactattcttgctaattcatgtagctaaaaaagagcatagttccccctggagactgctaagcgcatttttaaactaaactagtcaggcagtgatcatttaaaatgattagcccgctgattcaagttggctaagccggctaaaattgtccgctgtttgttcgtataggcaattcaagcgctattttaatataaatatatagcccatggttaaaacggctgagaaacgattttagagctaattaaaggggactacttgctggctgcttgtttcaggatgttcagcttgatatttagcgttggcttttttgttccaccaaacgccaaataagttttgcatggtgccgtacaagtagttttccacgttcttgatgtgcttctcattgcttctaagggcgttaaagtagcgtctcaaggctttagtcatcaaaggtttaagttcttcatcgtccagtgggattagaaccccaatatctttgtgatctttctcaactcggtacttagcatttaagataatgccaatgaagcgccgcatttgttgtggggtacggcaccaaaaactaagtagttgcacagcttcgggttctaagaaaaccggtaagccactgtcttcatcagttaagaaatcattagcatggttcaccaaatcctggttttgcttttgaatttctgctggtgagaaattggctgtggaaaagtccaacttttgagtatctatattgtatctattagtatctctttctttaagttctttatctagatcgtgtctattttttagactttcgctcgtagcaagggtttgcggggtgtcatcaacggactttcgcgaaggtctattttttagactttcgctcgtagcaagggtttcaacggtctcccgcgaaggtctattttttagactttcgctcgtagcaagggtttgcggctctttttggccatattcaccgcgtaaatagacgtccgttgatcgcatatctagttcggccaggtaaagtcggttgggttcatttttccctgttttgggattaaaatgcatggctttttgataaagcaagccagctttttcgagttctttcttaacggtggctaattttccctttgaacaattgaatagatccattaattcttgattggtaaaaataaagtagacgtggtcttcctcatcaacccagtgattgcgtaaggaatactcgagccggtctttcagcaccatataggctaatttggcttcactacttaaataccgatattgttcgccgtacatcaatactttgggaaactggaaaaataaggccccataaacattgtcagcttgataaaacttgaaatttgtttgctccattataaaaactccctttctatatccaacccacgctgactcaaaagagagttgctaaaacataagacttgttttaaaatacaaatctgatatgctctaaccgaatcacaaaacgttcattgtgtgaggctttgttattcggtagcgtgtgttgttttctagttgcctaacggcaacttcttttatttttaacagctaaataaaaatggactaggcagctccttgctagctacttagtccattggttttaatttatttttttaactatccttaacttgtcctggcggactagtctgcggtataattaatctataaattagatctcaatgttcagtcgatttagacggccaagttaaaatcgactgaatctaagtagctgggtgatagctacttgctaataagcaaaaaatctcaatcccaagtggattgggattttttgcttattaacgtgatctattaatattcggttgttaaattagctttagtttagcacaccgtttttaacgcaacaataactattttaactatttttgctgattgaagttgtattttagatagattgacttcaaaatagagaaagagcatttctaattcaaactgggtggtgattaaccttggtcaaaacaattaaacaacttgcagatgaattaaaggctccaaacaaactactcaatatcactaccaaagactaccagcaaagaatcaacaaaagaacagtcagaagctgtttagtatctttgctgctgattatccaaagtggtctaccgtttatggcacaactgtgagcgtaagctcaataccagtcttataatggtttcattagcttttatcaggtcacttcttaaaagatactaaacaacttctataaatttgctctacatttaattacaaattatttaggggcaaataatcgactccaaaaattactatgcttttcattatttgcctctctcgtatccatagagggactttttgattcttggttagtatttatattgctttcatttttatcgctcttagaagtgctctcagaggcttttatgtccttattttctaatttattcaatttattttggacatctaactgcagtctttgagattgatcaagcaattgtgttaagtctttaatgtgttcatctttgtttgttaactgttctttaagagtttgcacttcattttctagagccttatttgcaattttatattcattttcaccattattgtcttgtttaagttttaaagaactatttgtaaagtattctttaattgacttaacatctttattttctattcggtagtgcccattgactttattaggctgtaagtcctcgggaagctttgcaataatttggtaaactcttacacgactaacatttaattctttagctatttcatttattgtcgccatatatttcttaaacctcctttattaaacgtttatttaatattatcatgtatttgtaaaagattaaaacattgtaataagaggggattcattgtgaagaaattatttgtatcaatattatttgtaatttcattatttacactatttattgttagtccaaacaatgctagtgccaagaatttaaaatatggctttagaactgccacacttccaacacactatctaggaatttgggataatcatttatatggtcatagatacgttttaatgtacgttaaaaatcggcatactatttattacaaagatgattatgaaacaaataaatcaataacatggaatgaaaaaaatggctttcttcattttattgttgctaaaaataaaagtttagataaaagttcaaaacgtttctatatgtataatcccaaagaaaattttggtgccttatatactaaacatggccacgtctacgttggtgaaggtagctctaatttgaaaatgcatagattaaagaaataacattaaggtctaccctattgtaatcactaaagatgctgctttttgctagtaacaaataagtgttccgcagcttgtctgaagaactgattgtgagtagagatctattaggttaggttgccaagttacagcagggttaaattaagcggttcagttggttgacatcgattacccggttatactgttaaatgaaacaatgatc

SEQ ID NO: 179 - DNA, 527 bp, Lactobacillus buchneri
aaaaagaccgccataactaatttgccgtgtaccagccaaagcatactctagatcattaatcacttctaagttacggtcatcatcggcagtcatatagtcagacgacttaacttcatacttagcagtttcttccgcactagcttgcagagaaccagtacctttgcgtttattagccttaactatttcaacatgcacaactggctcataatcaacttttaaggctctctgccacaatttagtccactctgcttgtttgatatagttagtattattaccagtaaaatagctcgattttacaaacaataaaacatgcaaatgttgattatatgacctatcttcatcattgaccgtgatttcagttgaacgcagataaccaagtaaatttttggtaactttcttataacgggtaagcttattaaacgccttggttaaaactcgtaatgaacttcttaactcttctgcaccataagcattcttaactgtcagtgttaaaaataaaaaacggcccttaggctgtctgctaacag

SEQ ID NO: 180 - DNA, 305 bp, Lactobacillus buchneri
aagtaaatttttggtaactttcttataacgggtaagcttattaaacgccttggttaaaactcgtaatgaacttcttaactcttctgcaccataagcattcttaactgtcagtgttaaaaataaaaaacggcccttaggctgtctgctaacagcttccgcaataatttgttttaattgacttgaatttttcatactctttctccaattacacaacggacataagcgtttctgacaaaaccaagtctggtagagttttaactgattattgatcttacgaaaacgcaaagtttccccacaacccctaa

SEQ ID NO: 181 - DNA, 1551 bp, Lactobacillus buchneri
ccattaatggaggaagcaatcatgaaaaaaatcattttaaccgccttagccttaggggctttagcgggtggcgtaggcttttcaaataatcagtcaaccttatcggtacaggctagtaccacctatacatgggggaaaactaagacctacccgaatccacaaccattttattatgcaggaaaatcatccgtttatttatggagcaaatatcacacaacgaaactccataatttaaagaattacccgaagaccacttggtacctttccaagagtgtgcaaatgaaacataatgggaaatcagcgatttattacgctgtaaccagtggtaatggaaaagtcagtggttacgtttggcgtggttatttaaccaagggaattaatccaatcgtcactaattccacaaaagctgcagaatccgcaattatggatttatttacaggagctactcatgactcacaactacaaactatcgctaataaaaacgttagtattgatagctataatgactaccaatccatgctggatccgtctgaacaaaaccgttttgtcttactatctatcgctggaccatcaaatagtacggtgtctaaggaattaataaatggtgagttaagttacaaagattacgctaaagaacaaataactaatgctttaactaattttgatcaacgagataccgatgaatataatttgattaaaggaaaaagcttagctgactttaatgattggaagattgctgtcaaagctttgcccattacttctgctgcttacggaggagcttttattctgctaattgccccagctagctaaaaatgacattagtatcctttttagggggttgctaatcaaaaaacgaaaggttcttgtaaaatcaacgttctaaagattaattttacaagaacctttcgttttttaaaatctattttgaataactttaatcccaaaaacttttatcagccgtataaattctattttccaaggtttttgtagcataaggaagatcatggtaggaaataccaatatacaaatccgaagatccaatttgaattccttcggtttcgacattttggtctgcccaattggtatttcttaactcaacctgagttccagttgtatgcccccaagcaaatttagttactccgggagtatcttgattcggatgatcgtcactggcagcttggccgctagaaacgtccacggcatagccgtttgacagatcatagccttgaactgaggaactcgttaaaacactgcggaagttagcaattgaataatacggagttgttacaccagtagaaagcatactagtggcttcatccaagcgaacgtagccatgattagcatctactttgtccatggcgttattcaaggcttcgttatcatataaggtaaaatgtgaggtgccattcgtatcaagacccgcaattaataaagtggcccgatcactggaaagtgctccctcaactcgttcaagtgtgccatacgaactaccatccaaagtggcatgattcagcaaggctaagcgggtcacactagtatttccgttataag

SEQ ID NO: 182 - DNA, 33688 bp, Lactobacillus buchneri
attagagattaaccaagcctaaaaaccatgtaattatcaaattcaaaaaataactatttttgaagcttatttcttatacgctcaaaaatggggtaataaacttcaataaagtcattatttttccttgacgtaatatagtttgtctaacgtgtgtttgattcaccgggatgaagatttgttattttatttcctgttcccttcggcttttaaaatacgttccgacgcccctgacccctgctacacaaagaaagccagccaatgatgaacaaagatcgttcatcattggctggctttctttgtgctccggggtcacccggggctcgtcacgatctaaaaaggaacccgcacactatttgcgagttcccttctcaaatgcatcaactattttaattcgttctccacagctgatgccttaagagatattccactattcaaaaagcatcacctccttttttgattggtaatagaatacaaccaatcaaaataaaatgcaagctgtttgaatcatcagtcattatagtcattttcatgatcgttttgcaggacatcatcgcctacccaatactgcttgccggactgattgcccaacgtaattcgatagaaatcctcatgatcgtactcgttatcatcgtcatctttgaaggtcgcaatcgccttttgattgacgtgaaccttggtgttttctgaaacgtttaagttatcccacgaataaactttgtttgaatcaacagttcccgggacattctgatacaaatattcttcccgatactcccggtccaaggtggttgtaaaattggccttttcatagcggactttgactgcccgcttggcgtgagtaatcgtcgtcgaagtcgatgccgaattagtagttgaagaagtcgtcgagctggactgctctgtcttcgtgctgctggaactttcactgctcgaattatttgactgattcgaacagccaaacaatcccaacggcagaatgaataacagcaacccggtggtaagtgcttttttcatacgcgggcctcctaacgaagtcgtttgttataatatctgtctttattataaatgatcaggtaacgaaattctaacaaaccgcttcgaagagaccgtctcatcagtctaagacagtgtaggaatatttgtgttcatatttatggtttggaaacacatgataagtgccaatgccatgatacttgattaagactttcttgtaggatccgccaatcaacttcttagtggtcttgtactgacccaggtcttttttcgaagactttgatttattgaagaggtaccaagatccccatttgctgacctgaagcttacggtcatccttttttgaaggggtgtaagatttgccattggtggtgaaactgtgcgtggtaatcttgatgacattaaacttaccgctgccacgatattcgtaccaggtgccccgcaatgctttgggggtcgtggttgaagtgctggcatccgccttggctggaagagctgctaactgaattccgaaaacgattgccagtgcaaacataaaaattttgaattgtttcattattccgcctcccatgagttataacaagtatatcatcgattaccgaaaagttatttttccatccgactacaattactttacagaaaaagcctttgacaaaaaggttctgtcaaaggcaatagggcactgaattgggaaactatttgtttgatcagttttcactgaatcaaccggcagatgactatttttgtaaacaatgttacgaactcacgacaaccttttacactttaatcgtcaaagcggctttcaattgctctggcgtgggcttcgagaccttcaacccgtgccagagtcgtgatggcatccttttcttttttcagggcatccctagtataggaaacaaattgtgtccgtttaacaaaatcctgaactccaagcggcgagaagaaccgtgccgtgcccccggttggtaagatgtgattagggcctgcgaggtagtcgcccaagggctcggaagctgaaaatccgaggaagaccgagccggcgtttttgatttggttcaagtattcaatggcatcgggtaattggacttccaaatgttccggggcaacggcattcatcagggtaaaggcatcgtcaatatcgtctacgacggcaatgaagccttcattttccatcgctgctttggcaatttcctttctgggcagtaaatcaacttgacgatccatctccttgctgacagcttcggcgagtgaacggtcgtcggtgactaaaattggtcgggccaatttgtcatgttcagcctgggacaacaagtctgcggcaacctggctgggaaccgcctgggaaccggcaatcacgccaatttctgaggggccggcaatcatatcgatgtcaacctgaccaaacacctgcttcttcgcagttgcgacaaacacattaccgggtccggtaatcttatccacccgtggcaccgtttcagttccgtaggccagactggcaatggcttgagcaccgccaaccgtataaatttcatcaacgccggcaattttagcagccgccaggaccgctttatttaacccgtccttttgtggtggtgtaaccatgacaattcgtgaaaccccagcaatcttggctggaatgacgttcatcaaaatggaagacggataagcggccgtcccacctggaacgtagagtccaacagctgccagtggggcaatcttttcgccgcgaataacgcctttctttttcgcatcaataaaactatcttccacttccatttggtgaaatgacgtaatattggctttggcaagttccaaggctttaattacggtgtcatcagtcgcttcataggcatcgtcaatttcccgctgggtgaccttcaaactctccagctcgacattatcaaatttctgttcgtacattttcactgcctgatcaccatctttgatgacattggcgataatttcccgcactgatttttcaacttcttcgcggttggcaacggcgttcgtcctgatggcaacctgtttcaataattggtctaaggaatcttcaataatttgcatataagccactctccatttcagataaccaaacattcattacaatcaaatcctatgaaataaaaaagtccccagacattgccgaagcaatatctgaggacgatctttcgcggttccacctcacgttcatcgttttcttacaaaaacgaccttacgctgctcgtaactagtcgtccaaattggagaacagttacagtagccgtggtaacgctcactagcgggatagcctacttggttcagctaaccagttcatagatgtgtgttcactgccactcacatccccttctcaccagcggggctctctttatgtgagttaagcaattacttttctaatcgtaacttcatgtttattatttatttttaatttgttgatacatgtaatttaccaccactgagaaataagtcaagcctaatttgataatatctaaatattaaagaaaatcgagagaaacatggtcagtgtgccgcccatcacgaagaagtgccagattaagtgcatccctggaactctgggaatgctgtaaatcaatgctcccacggtaaaagtcacgccgccggcaaccagcagccaaaaaccgttggtgctcaaattgtcatatagcgctttgcccaagaacatacataaccagcccatcaccacataaatggtggtttcagtcttctgaaatctgccatgaaagaccacgtggctgataatccccccaattgccaacacccagacactggccaacagaatgttgccagcccagttgtggacaaaaatgacacaataaggagtgtacgttccggcaatcaaaatgaaaatattgctatgatccaagatctgaaagacgcgtttggctttggtgaaaacaaaacagtggagcaacgttgatgccaaatagagtgagagaactgtcgcactgtagatgatcaagctgacaattgcccccattgaaagcccatcacgtaaagctttgttcactaataaaatggacaaccaaatcgccacaaaaaacgaaacaccgtgggtgacagcatttaatacctcatagataatttgttgatgacgccttttagccattaattcattcatcacgatgcctccttagcatcataataagctattctattttctaagtcaagataacatagttttaaagtctacgtactttatttttcaactatcctatgcaataatactagtattcaattcgaaggggaataccatgactaaagataattttaccaaaaaattagcggcgatgaccatgccgcactttgaagatttacctaatttggatttgtatatggatcaagtgattgacgaggtcaaccaatatttggcaccaatcacccacactgagattaccaaatccatgatcaacagttacgttaaaaaaggcctggttgaccgcccgaccaagaagcgctactcacgggttcacttggccaaaatactggtggtgagtctgctcaaaccaattttatcgctggataccatcgaccaggcaatgaaaattgccctcaaactcgactccgcccccaaagcttatgatcagttcattgacctgttcaatcaggagctgactgatgtggacgctgatcatttgtcagctaaacagtaccaatcaatggcgattaagtcactgctgtacaaattagtggtggatgatcttatccagacgagtaagcaagcataaaggacgttttactaagtgaattcaacaggttgcactataattaacttgtaaagatattttaaattgacgggggttgtgattatggatagaaaagcgttaaaactagactctaagagcctattaaatgctcattttaaatttttctttttgctatttttaccagtatttattcttgaatttgttggcggctatatctatgcgccaaaagaagagctttacgatattaacggtgaaccaatctggaccggtgctcagactttcggcatgattctaattctgctcgggtctctggtcgcgattggcgtcgcctttatctgtatcgacgcgatgcgacaaaagttgacctatgatcagcccctgcaaaagtcgatgaccatcttaaacaacgttgactatttcttgggaaccattgtcatttacatcattgagcaggttttgattattctttggatgattctgttaatcattcctgggcttattaaagccgtcgcctactcccaggcattatacatctaccgcgatgccgttgaccggggcgaaaaaatcagttatttggatgccattacccgtagtcgtcaattaatggacggccataagtgggattattttgtaatggccctcagcttcattggctggggcttgctggttggcattaccctggggattgcggccatctgggttcagccttatatgcaactcagttttgccaatttctatcgtgagttggtggatgaacacgaagcgcaggtccatcaagaagccgatcgaatcaatgttacaccggcagccacttctggaaatcaacccacaaccaccaacgattcaagccatcaatccgacaatgaatccaatgacgattcggataactcatcaaatcaataaccatctaaataaggtccggccttctctaactgagtggccggaccttttattatctcaattaattctgtcacaatcagtttaaaagtgtcaacgtccgcatcagtcgcgcgttttggcaccaattaatatggtattatacagatacaagtaatgataacgattggagatttttgcgatgcgggtgacaacttttggagagatcatgttaaggctgacggttccggataatcagaagttggttcaggcgacttcgtttaatgccaattatggcggtgcggaagccaacgttgccgtttcactggctttgctgggggatcaagcggcctttatcaccaaactccccaacaacgaaatcggcgacaccgccatttcaaaattaaaggcgttctgcgtcgacaccagccgcattcgtcgcggcggcagccgaatcggtctgtattttctccagcaaggcgtcggtcaacgagccagtgacgtgatttatgatcgggcgaccagtgcctttgcaacatcagaagcggctgattatccgtggaatcaactactggatcagacggatgtcttctacatttcggggatcaccgctgccctgtctgccgaactccaagcggttttgctatccgccgttgagttctgtcaccatcacgatattcaagtcgtttacgatgctaatttccgcggaaaactgtggacgtcggctcaagccgttgcctttaacaagcggatattgccattcgtcgatgtttgtctggtccacgacgaagatattgagcaggcctttggcatcaaagcctttcaggcggccaatcgccaagcaattgatcaaaaagctacctttcaacaggcaatgaccagcctcacggataaatatcctaacatccaaaccgtcgccagcatcttacgaaacatccaacgtccccaaagtagccaatggatgggaatcatgaatcatcagggacgattctatgagagtccgatttacgatgtcgagattctcccagaagtcgctggcggtgacgcattcggcgcagccattgtccacgggatcggccacaatttcaatcctcaatatcagcttgattatgcgatggcggctgcagttttgaagctgaccatccctggggactttaacctttcttcagatgccgagatcaaggcggcgatgatttctaacaatggcaaagggaagaatccagttaatagataaaaataagcgtgggaaaatacgcgcttagcttccagagtataaggggattatccaaaaatcccgggcttggatctttggataatccccttatatggccggaagctgcgtattttcccacagttcggccaggaaatcgatatacatttacagaaaacaaaaggggtcgccattttgccggcaacccctttaatatatcctcgttcatagttaaaacaaatataattaagctcatctgtccaaagtcctattgattcttccggattgcttcccacaacccattcaaataggtcactcccagtgcccggtcgtacaaaccgtaccccggacgtccctgttctccccaaatatttcgcccatgatctggtcggagataaccctcataatcgttgtctgccagcgccttgacaatctcatacatatccagtgatccggccgacgacaaatgagcagactcatggaatgctgtttttgtctggttcatgaagcggatattgcgggcgtgaataaacggcgcccgatccttttggacaaattcgcggatgattgccggcacatcattttgtggattctctcccaggctcccggtacaaatcgtgaaggcgttatagggtgattcgtacagctgctcaattttgagcatatcatcgcggtttttataaatccgtggtaagccaaacaatagaaatggcgggtcgtcgggatgcattgccattcggacgtcatacttctcacaagtgggcatgatggcgtccagaaaatatttcaaatttgcccgtaattggtctgcgtccacatgccgatatttggcaaataattgttggacatgagccaaacgttcaggttcccagcctggcatttcaaagcccttggagcccgacataatttggtgaatcagttcattcggatcatcaggtaacatttcaggctggtaagccatggcattcgagccatccggcaactgataggttagatcggtccgcagccagtcaaataccggcataaaattgtagcaaatcaccttcacgccggcttcagccaggttcttgatggtctgctgataattttcaatatattgatcccgtccagattgtccagtcttgatatcatcatgaacattgaccgattcaatcacttcaaaacctaaaccggcactggtgaccgcttgcttcagctgagcaattcgatcctttggccacacctgaccgacagggacgtcataaagtgccgtgacggcctgagaaacccctggtatttggcgaatctccgccagttgaaccggatcattctgctcgccgaaccatctgaaccccattttcaagacaatcgtcctttccaaaccattaatgtgctactaatatatcacttttaaaattcccggtcaaagtcgctgctgccccatttcattcactttgacgattcaggaaaataattaatatggtaacatattctcagtggatcgattttaaaaaaagaaagatgagatgacatggaaagtttacaagataaggcctataacgcaatctataccaaaatcatgaatctggatttgtaccctggtcaacaagtctccgataaacaatttgaagaagaaattggggttagccggacccctgttagagaagccatgctccgtttgcggcgggacgacatgctgtactcgcttccccaaagcggcacttacgtcactcgaattgacctgaaaaaatcattggatgcccgctatgcccgccaattgttggaatcagacatcgccaagtcaattggtagcactgtgtccgatgaccaaatcgatcagctgtcagctgtggtcgaagaacagcaaacggcctccaaacgtgatcagatccaacgattctttcaaatggataaccattttcatcaaaagatttacgagtttgccaacaaacaaaatatttggaattggctaatcagtttcagtaccgacctgaatcgctatcggctgctcagagtttatgacgccaacctgcccatgaacagactgacccaagaacatcgagatattatcaatgccttcagtgaccacgatgcggcaaaggtacaccaactggtttatagccatctcaatttaatgctcagtgaacaacaatccgtgcttgataaatttccagactatttcaccaatattaattagaactcacagaattactccgatcaaacagttcttttacagttctgttaaaaagacaaagtgggcaaaggttgaatgttacactttttattgaatgaggaggagattatatatgaaaatgaatcaatttttgcggctggcactggttacctgtgcaaccacaatcacaattgggatgggactttgggggcagacgccgacggtcaacgccagttcaagttcctataaaactgtctcaaccacagcgataaagaagacgccctatcacaaaagttcgaccaagggcgcggtgtataacgcttcacacaccaagaaggttgcaaacttaaagacctacccgtacaccacctggtacgcgacggccaaggtaactttgaagcatggcagttcaaaagcactctactataaagtgaaaaatggttccggaacagtttctggcattgtttggcacaagtacttaaaggccggcacctcaccatttggtctcaaatatgccaagtcagccgtcgctttggatgtcaataccaataataacgtttggacgaagaacgccaacactgctcgacccatcgcttctctttccaaactgatgaccctctacctggttcgtcaaaagatttctcaaggcaagggtacttggtccagtaaggtcaccacgagtaatgccggtttgaagaaattaggtaaatccaatgtctttggcggctttaaattcaaccacaacagctacactgttcgtcagttgtacctggcaggtctgattgaatcatccaataacgccgcaattgcccttggacaatgggttgccggcggttcaacgcctgcttacaacaaaaaattcattggcatgatgaataatcaagccaaggaatggggattgaagcactcatcatttgtttcggcttccgggatggaacagaatagtttggctccttatggttacagtattggtgcttccaagaatgccaattacgtttcagccagcgatattgctcaaatttcccgtcacttcgttgttgattacaacgatattttgaccgacgcttcagttaaatcaatgaaggtcgatggtcaaacgcttcacaactacaataacctgctcccgggacgaaagtattatcaaaagtccctgaacgttgacggcttaaagaccggttacaccgatccggccggttactgcttcgttggaacgggtcgcaagtcaggccatgaccggattatcacggttgtcctgcatgacgaaaacgagtttaccgaaacccggtccttgatgaattacgtttataaccagaatctggcttagtactatgtggatgcagcatcttgagtaaaggatcagacaattatttccctttaggaatgattgcctgatcctttttgaattggtacaaaccccaattgacttattggcgaaaaaatcataatcttatagatagtgatttcattatacaaatagttgagtttcgggggagcgtctacataatcatggaaaatgaaagcaattatgacctatacacacggctcagtccgcgttgctggtcggaagcactggtcgccaaagcagctgaaaacgaattgaagtatcgcgccattcatggtgatggtgaggctcgaatgctgttagagctgcatcaactggaaccggccaaaaagcctttattcggccacgcagtccattccagagctgaaaagatgcgttcgtataaattcatttatacgttgcatttgaagtttggtcattaaacaatctaaaaagccgttgagacaaaagttgatttcttttgtccaacggcttttttgaatccagttaaatgttaacatcccaacacgaccgcattcagttacatcgctgtcattccaccatcaatcacgaattcagatcctgttgagtagctagcgtcatctgatgctaagaagagcaccatcttggaaacttcttctggttctgccactctttgtagcggaattgattttgcaaactgcttgatgacttcttcactatcaccttggtgaatcattggggtggaaattacccctgggtgaaccgagttaacccggatgtgagaaccggccaactgcaatgctgcagctttagtcatcccacgaacggcaaacttggtatcggtgtaaccaatcgcaccaccaaccagtccgttcattgatgaaatattaacgatactgccgctgccattcttcttcatggcttcagctgcgtatttcatccccaagaagacggaaagctggttgatcttaaagatcttcatgtagtcatcgagagtgatatcggaaagcggtttgttaaaactgattccggcattattaaccagaatatccagcttaccaaatttcttcaccgtctcatcaatgacgtttttccagtcatcttcgctggaaacatcctgcttgataaaaataacgttatcgcctaattcatcagccagagcgttccctttttctgcgttaatatcggtaatcgcaactttagcgccttcgttaacgaacatcttggcgtgactggcacccattccttgagatgcaccagtaataattgcaactttgttatctaatttccccatatgtcatacctccttgtaagcgtttcctatctacaagtacagtataactgatttattttaatttcctaaatgttttgcttattaaaatttgaggagaatctttttcttcttggcattcttttccaacttcttgtgagcccacgctgcatcctcgtaggacttctccaaaaccgggtcctccagaagatagccgtcagccatcagccgattaataaacttagccgcatcttgaatttgatccagtggtgcgttgctgatcacaaatccgctgattgtctttgactgggtgtaaaactgacggacgtcaaacgagaattgattgctctttggtgcggtaatcaagcagactttgccgcccggcttcaatgcccgtaaattatcctggagttgaacttgcccagaggtatcaactacatagtcaactttttgagtttcagccttggagagttgtttctttaatgacttatcgtaattcagacattgatcactccccaagcggtccagcaggtcaaagtcgctggtgttggaagtcgtgaccaccttgagccccatgatgtgggccatctggacaaatttggttccgacgtggccggcggcgccttcaaccaggattgatgccccggagacggccccaaacactttggtcaacacgattgcggcagttgctgctgaatgaacggcggccaccaattgagtcggctcaacgtgttcgggcacatggaatagtctggccgcgggaatggcggcgtactcgctggtcactccttggcggccggcatagcccatgctgttggtccaaacccagttgcctttggaaaaaccggtgacgtcagccccgacttcttcaacttgaccaacggcatccctgccgatcacaaacggaaaattggtatcggttttaaaagatcccgaacggacaaacgtgtcgacatggttgacggccaccgcattcactttaattaacacttcatcattggtaatttcaggcttcggcaactcaccaatcttgatgtcctttgcctcgccattttgtgtaatatatgctgctcgcataataatgcctcccatccagatagctgattcttaacaccttgattataaggccaaaacgataagtgaacaggaataagaaccatgaaaaaatggtcgtaaaaaagagagtgaggataacggagtttgatcccagaatttaagagcatagatcgattattcctggttttggaatgattgatctgtgctcttaaatagccgggatcagccgattgccatgtaagctaggcaagcatgctggccgtcgtcgcacgtttttgataaataatatgggatcacaagaaataaagaccgaggcaaaagcggatacttttgtctcagcctccctgaaagtgagaattgattcaattcagccggattctcagttaaaacgtcgagttcgacaaccagtcagtatttaagcaaataaagccattatttcaagccggaaataatcgatttagtcccttaaatctgtcagccaagctgcctgctaactgaaaaatcacttgctcaaccactgaatcttaaactgctgctcgccgtcaatcgaatgaacggtttcttcatccccattaaccggtgcatgcgggattctgaagctggggtgcatgtggctggtaaagtcaaactcataaccaatcccagacttttgcttttcagctttcatcaaaccaaacgtgccatcagacagtttaacgatctgttccttctttttggaagggtcaacataaattgttgtcataatctgcacctccacttacattatagcagtggttattggtactgatgacattaatcaaaagttatcgctgaaacgcccttgacttagagtccacttcaaagtttatagtgaaaccaatcccatttaaatcccggtcaccaatttgttggaaacgagtatactgaaattaagtccttttcagaaaacaatcaattaatcaaactaataaggagtcataatgaaacaatacacaaatcaatattttgacggtgaacgaccactgtttgccgaaaccaacgcggacatttccggcaccacatttggcaccggggaatcccctctcaaagaaagtcgcaacattcacttaaccgattcaatttttacctacaaatacccactgtggtacagcaaacacgtcaaggttgaccactcgatcttagaaaccatggctcgttcaggaatctggtacactcacgacattgaaatcaacgacagtgcgattcaggcacccaaaattttcaggcgctgcagtgatatcacgctgaataacgaccacttttccgacgccaaagaaaccctttggaactgtcaaaacatcaagatcaacaacgtccaggccaacggagattatttggcatgaatagtgaaaacatttccgttgaccatctgaatctaattggcaactatgtctttgacggtgccaaaaatgtcgaggtccatcattcaactctcgtgtccaaagatgctttctggaactgcgaaaacgtcaagatcgtcgattccacaattaacggtgaatatctggcatggaatacgaaaaacctcacgctgatcaactgtaccattgaaagcgatcaggggttatgctacatcgatcacctcacgatgcgtaactgccgcttactgcggaccgatttggcatttgaatactgttctgacattgacgcagaaatcaactcgaacatcatgagtgttaagaacccaatcagcggcaccattcacgcccgttcaatcggtgaggttatgattgaccctaccaaagtcgatccaagtaaaacgactatcattactgataacaaaacttctaaaaaggagacagcctaatgtatgactttacttcaatgatttcgcggcgcaataccgattcagttaaatgggatgtcaaacctaatgagctgccaatgtgggtcgccgacatggacttcaaagtcgccccggaaattctcgatgcaatgcgtcaaaaagtcgacttcggcatcttcggatacgaggaaccgcacaccgattattttgatgcagttgcccactggtaccaaacggaacatcatgcgactatcaaacgggattggatgttcttttcgactggcgttgtgccgacgatatcctcagctgttcgccgcgtcaccaatgtgggtgataacgtcctggttcaagcgccggtttacaatattttctataattcgattgtgaacaatggtcgccatgtgttgtcatccgatctggtctatgatcaaaaagcccaccagtatcagattgattgggatgatttggacaccaaacttgccgagccgctgaccaccatgatgatcttgtgcaacccacacaacccaattgggaaagtgtggaccaaagcggaacttgttaaaattaatcagctttgcctcaaacacagcgtcaccctactgtcagatgaaattcacggtgatctggtgtttaagggcgctgactacacgccggtattctcgttgccaagtgatctgctgcaaaacgtcatcgtctgcgtctcacccagcaaaacctttaatgttgccgccctgcacgccgcaacggtcatcgttccaaacgaagccctgcgcagcaaagtgaaccggggaattaacaccgatgaactcggcgagcccaacctcttggcaattccgggcaccattgctgcctataccaaggcaggcgactgggtccatgaactgagaaaccaaattcgggcaaattacgaaatggtcgtcaaattctgccaggcaaacattcacgaaattgtcgtagttccgtcaaccgccacctatctggtctggatcgacgtcagccaactgaccgacgactcagcaaaattagccaccttcatccgaacccaaaccggcctgtatctttcggcgggtgacgtctatggcggtgatggcaaccacttcctgcggatgaatattgccagtccgaaaaccatggttgaagatggcttgaaccggctgcaacaagggattaaagaatttaaagccgccaactaactacttatttgaataatcaaatcattcagccccaatcaaaaatcccgaagaatttttgattggggctgaattggttataaatgacagttattgaaattcaatgccatataaacaattatcgtatgtccactgcatgatggcctgtaaatcaccagtttcgtcataattggccagtaatgtgttaaaggtttctaattggttttcattgatattaacaattccggcaccggcattaatcaaaatataattagcagacaaaatagcagtccgcttgttaccatcccagaagatctgctgccgcataatctcatacattatttgaagcgctttttcagtggcagtctgatcatcacccattatttcttgaattgcgcttttgacattactggcttctggaactggcggtacgtactgaacaccgccaatctgaacacttccagtccgaatttgtccggggacgagggcatcttcggccgcgacgattcgattaatttgccgacaaatatctaatcgaaatggttcactgtgacttaatacaaattccaacccttttttgagattaatgatgatctgaatatcatcaatcgaaacaccagcgacactcatgccgtcaataatcgtcttggtttgcggcagggtcgtattaacgccctcaaattttgaattggaatacaccatgttgacaagattctttttcgtaagaaagcgattttgtttgagagtaagattgaatttattttccataatcggcgctcttttctatatgatcaattttattatctcaaacattcttaagcctgtatacctgtgcatcaattgccaaaacgatcgtaaatggcagacttgctgctggctggaggaagcaatcaaaaaagatctattcagtagtcgaatcatttcaacttctgaatagatcttaattaatttaggcttcaacaatcttgccaacggcaatcggtaacgtcgtatgttgatcatatttaccaacggcaccttggatggtatcaggtaaatccatcgactggggaaccccgtgaatgtaaaccacccgcttctcaaggtggaggtcgtcgtcattaaagacttccttgaacttctcgctgatttcagccaacgggactgtcttcgtgtagtggaagtgaccgtccgcatcagaagttgggtaggtatcagttgggatatccatcttctctggggcgtcgttaaacgggaccattgtcgttccggacactggttcggtttccggcagatcaacatagccgtcatggttggtgtcttgagcaatcgttgccggttgagcatccttgccatctgggaaaccgtggaaatgcatccagtgttgggtgtttggtgacgtatgatccatggtaatttcaacggtgagtgtatcgccatcaatcgtaaatgttgcctcaccagttggatgagtaccaatcttgtcgccattcaatgaagtaatttctgctttgtatgtttttgtcatgagaaacgcttcccttgtataatttgttgatccaacttaactatacgcgctatataggttgcgtacaatgtatttatccaaattttccagaaaactaatggggttggttaaccggccactgtggctgctggccattcaagacccgaaccacttcacttgccgcatccgtggccattctggaaaagctttcaaccgtactggaaccaatgtggggtgtcaataacacattgttcaatttgaataactcactgttcatcggtaagggctcttcgtcaaagacgtcaagagcagcaccactaatcgagccgcttttaagcgcatcaatcagcgcagcggtatcaaccagagcaccacgacccaagttgatcaaaacactggtcggcttcatctcggctaattgttttcgaccgatgacgtgtcgggtctgagaattggcagctagatgcagcgtcaaaatatccgcagatttcactaaggtatcgagagcgacaaattccccgtatggtgattcccgcggggtccggttatgaatcaaaattcgcatccccagcgcactggcttttttggccaccagacggccaattttgccgtaaccaagaatccccaaagttttcccttcaagatcgaatcccaaatgagccaacgggtatgcaaagttgccatcccgcatttccatcgagtttttggtgatgtgcttagacacgtccatgatttctgccaaagtggtttctgctaccgttgctgcattggcattgggcgtgttggtcacccaaacaccgtgattggcgctggcgtccaagtcaacactgtcatagccgacgccgtgacgggcaataatcttcaaattgggcatctgagaaatgacattctcgccgactggatccaaaaataaaatcagtgcggcagcatccttgccattcttcaaaatattttcagcgttagcccgcatcaattccacgacttccaggccgtgctcacgtaaataacgttttccgtccggatgcaattgagccggaacgagtactttatcagccatcatcaagtccccctatgcattttctttggcaaatgccagcatcttttccgtctgctgattcagcagtggcggtaggtcatcaaaatcgaaataatccagtcgaatggtctcgtcagtctcagcggacaacaattggccaccaactttcctaactaaaaacaaccgatcaatcgtctgcacctgatcaccatttggatacgtgaagattccctggtcgaacaatccgagcggccggacaatctcaacttttacgccgctatcttcttgatactcacgcacacaagtctgggcataagtttcaccgaactccatgtagcctcccggcaaactccagttatgactatcggttcttaaatttaagagtacttggtgctgatcatttaataggattccagcggccgtattcaaaattaaaggcatgtggcccacgcgttttcgaatccgaccaatatagcctgttgccattttatcaccactttctcgaaaaaatctgaatctatgctgttatgttcttacaaaacggctcacaaagcaagccaatcgcgtattgatctatgaaactcccagcaggatactaacatatcagtggtgttttttgatgattcagctcattccggtgaaaataacgcttccaatcaacaaattaaaacaaatgcataactgtcaacattttcattgatgttttcacttgtattaatttgaggagtgtttagaataacaattgaagcaagagagaaaaatcagctctaatatgttagttgtccgccgcttaccccattttgaaattgattgagacacgaaaggaagtttgactatgacaaacacagattggaaagcatcattaaaatcaccaaaggcattcaacgattttatcatcaactattttaaggaccacaaggaactgaccggtaattacgaaacaccttcatactatgagtactatactgtcaccttgaacagtgaaaagggcctagtgatcaccctggtcagctcaattaatccgacggttaacgccgatgcgccgacaattcctttcaaagatgttgaaaccatctcggttgaagaattccgccagcttatcctcaacaagaaattcgctgacatgcatacctcattggctgacgtctttcagacggttgccggggtgccaggatccacaaaataagctgggcaaatcaaattgcccgctaacgccgattgcttttgaacggcacaatacgctaagaggccggaacaaatgtccgacctcttttttcgtgctaatttccacaactatcaacgaataatttttttattaggatctaaaatattgattaccaagacaactaccaacatcgcgaccaccccgacaaacaccatatgaagggctgtcaggatgattggatcaatcagcgaccgattggccaccacggctgcccctttggaactaatgacgttattgacccttgaaaaggtgattccgccatgcaactgcaatcgaatgactaaattcaagatcgcaccatacaccccagccatcaccgtttggcccaaggaacggccaagggttaggactgaagtcgccgaaccgaccatttcattggggaccaaatgctggctaagaatcgtattcatactgacaacgatccccataccaatcccattaatcatggcaatcacataaaatgcccagaccggaaatgcttgactggcaaagatcagtgataaataactgagcagcatcacaccaatcaacgtcaccgcaatttgtttgggaacaaagcgggcaatcaatttaccaacaaaaaacgaggcgaccagccacatgattgagctggaggtcacgactaacccggcagtggttgcggatacccgatacaacgactgcagccaaattgggaaatacatttgataaccaattaagaccccactcaaaattgttgctgtgataatttgaatcgtaaaggttttggaatgaaacatttttggtgaaattaacgggtctgcgaaatgcttttcatggcgaaggaataaccaagttgccacaatcgtcactaccaacaggctgcctgcaaccaacggcagcgtgtccaatgcctgaatccccagcaataagctcaccagtgaaattgccagccagataatccccagccaatcaatgatcagctgattcttgagctcaatattttcctgataccccagccagatcagcagggcgacgatgatgcccaagggcacgttgacgaagaatacccagtgccaggaaagatggtccactaaaaaaccgccaattagcgggccgaccagggctgacagtccccaagctgtattattgagtgccagcacatttgcccgctgttcaaacgaaaaaatatcggcgatgatcgtaaacgtcagtggcatgaccgcacccgccccaattccctgaattgcccgggcgacgatcaagaataaaatcgaaggtgacaatccgcttaaaagcgagccgatggtgaagacggtcacaccccactgaaatacttttcgtcggcccaacgtatcggccaacttgccgtagattggtgtcgtgatcgcagtcgtcaacagataggcactcataatccagctttgataagccagcccatgaagttcgctaataattgaaggcagtgccgtcgtcacgatggtcacttcaacggaagtcatgaacgtcgcgataaagactgcgatcaggatcaccccgcgattacgatgcccgatatttgaatgattcattttgtgaagacccctatcgtgttatgataattattattaataaaatggtacgcaattaatgataccacaagctaatggaggtccgaattgaaattacattatcaaccggcaaggatggatgaattagcagcaattatggtgatcgaagaagcgggcttttctccggccgaagcggccaccaaaactgcgatggcggaaagaatccggttgtatccggacacatttattgtcgcaacagatgaggccaatcaagtagtcggttacatcgtcggtccggcattttcacaacggtatctgacagatgaactatttgaacaggcccacgccaaccgtcgagatgatccgtatcaaacggtcctcagcctggcggtccatcccgatttccgcggccatggcattggcagtcagcttctagctgaattggctcaggttgccaaagcgcagggaagagtggccatcaccctgacctgtctggcagacctgatcccattttatgaaagcaatgactatcaaaacgaaggcatttcagcatccagtcatgccggggaaacttggtacaatttagtctatcccctgcaataattcataagccttcattaagaccgcttggtttgaagcaagatttcttgaacgatcttgattggaatgctattattcaggcaaaatgattttatgtaacttcaagagagggttccttatgaaaaaaagaagtttcattctcgctgcagtcgccagtgccacctttgctttaacggtgccattgacgttgaacatgcctcaaagtccgattacttatgccaaatcaactcagcggattgccggcaaaacggttgccaaggccattaaaagcacccctgatttgaatccaacatcaagtgtccgcaaataccccgcttatatctatgacaaatattggcaggtctttgaccgctggtacaatgtccagccaatgagtgcccagggcatcttcaaaaatcatacggcaaaggtctacgtggccaatcaatcattgaagtcttatacctacgccgcgatgcagaattggaacaaggccctcaaaaccaaagcgtttaaattaggcaccaaagccgaccacacgattacagtgggctttaagaatgctggaaccggtcagggcagctgggatggttattacattaccagcaagctttacatcaactataatttcttcgacaacaccaagtacctgccggccgtctacaaagcagagaccggccatgcactgccatcagctgatcagccaaacagtgcagattaccaggcactctatgacacctactggaaatcagtgatcacccatgaactgggccacagcctgggtctggatcacaccccgtattccaatgatattatggaagctgattcgggaactaagagcggtgacgccaagtactcgtggagtcaatccaaagtcgtcaacgatgattacgcgattttccaggataaattatcctcaagagatattaatcgtgccaagttaaccaaggttttgggttattggtaaagatcaaagcagcttaaaaatttcctcaacaaaatgcggctgggcaaaaggtgatccttttgttcagccgcattttattatgtcgtcaacttaacgacagttgtcgtttagaactaatatcaaacgaaatcagaaaaatcacggtcacgaccagaatcgttccccaaactgccagaaaaaccagccacgacgccagtgaactaaccgtatgagtcaccgaaatccccggctgccaatcgattaacgcatgaatgaggaccacccaggttaaggtattggtcgtcaacctgattgatgcaaagatcgcgccaatcacaaaagcgtaggtcgcctgttgaagggttggtaaaaagccctgtcctgagatcaaattcatgaaatgaaagaggccgaagaagattccggaagccaacgcggcctcggtaaatttgtatttggtctgtttaaaggccgacaggaatgccgagaataataacccccgacacaagaattcttcaaagattcccgctgacaatgccatcatggtatcggcaaccaccgttttggcatgcatcatcaaagccgtgtgaccgagaatgctaatcaataggaataatccacccaagcaaatgccaaaaatgaatccccagattttggcaaaagtccccaatttgattttagtctgaaaaattttcatcgttcccagtacatagaagacaattccggcaacgaccagggcaaaaatcagtcgggcaccaccgcgaaccagcggacctgccccccggaccgaaaagtcgacacccatcaagaggaccagaaaaagggctgccaaccagaattcctttccccaagacattctattcttaatcatccattgtgaccccgtttcattatgtataaaagtggccgaacaaaagcaaaactttcgtttcggccacttttgcgtacactgattatttcgtgatgacgtcagttaccagctgaacctggtcatccaggtaaacagctgtcaccgcgctcctattaagtgtaccgcattataaggtttgagcaaagaacccaaccacgtcatcccagacatcatccaggtatcccttagcgtgacgactaccggttaacattcgggttcgataaggaatttggtgtttggtcagcgcttgggccatatccaagactccgctggttggcacgaattcattcagtgaattggccaaatacatctgaccagtctggtcggttactcgatgaaccggagtggcttcggtgtattggtcggtccggccgttaaagtagttggtcacaaaccacttataaaacggatcgttggccccagtctggttaatattcgagctggcggttgagttaaagccactggtgtcaccttctgcagcaaccacatcttcatgttcgctcaaccacttatcaatatccaaaatgcccgatagcgaggcaatcggaatgccatatttgattgccaattcgacggtcatgttgccaccggcagaggagccaaaagcgccgatatggtcgtggttgaacggcaagtcggatttctttaaccattcatacaagtgatccatatcctccaaaggtgccggataaaaagccgctggcgtaattcgataggccggcgttacaaccaggtagccggcttccacaaaccggatcgaggaatcctcatctttagacttgttgccgcggaaccagccgccaccatggatatcaatgattgcgcctttgctttgggctttttcaccatcataataaatgtcagttaactggtggttaacagaatcatattcaacgtcttttttaatcactaaatttgtcatgtgaatcctccccaaatagataacttgttatttcaacaaaagtatctacccgaagcaggttgtggtcaatcaaatcgacttgaggagatttaatcccaaaaacggctaaccccgtgatttattttgcggttggtcatctttcttccaaacctcaattgaatcatatttaacgccggtcaaatcctcacagactgccttggtgtgtggatccacatcactcatactaccgcccttttgcagacgaacaagttctgcagaaagaaccatgaatgtcttcttgctgagatgaaagcggccgacaaacagcattgccaagacgatcatcaagccaacgccacccgatacgataaagataatcatattaatggcactctggggttgaaggactgccccgcttgccgactcccgaaaataggcaaagtccagcaaatatccggcaaccacaccggcaacaccgacactgatttgattaacaaaggtcatcacggaggcaaacaggccggcccggttccttcctgtcaccaatgtagccagatcgggaataaacggaaacgcgttccatggggcaaagtacaaaatgtacaaccccacttcccaaaaaatcataaaaataaccaaccaaatcattttggttcatttaactatttttggataactatggttttctttgcggtgacatagtggacgttggttagttacccgtaatcaaaaaatgggccccagaaaatctgaagcccatcaggttcaatatttattattaaaattcatcgaaactagcgctaaccgtatgatcattaaatgaaattgtcagcttattgccatccaacttcacttctggaatcacaatattgccatcatcatccaggctctcaagctcacgatcgccaagatacaatgagatcaaggtgtacttacctggcgccaagacaccggtttgcagcggaatcttggtcttattgaagtagagattggtgttgggttccggcgttgacaattcagttgtcaattcctttgataagccgactaatccggtaatgccgactcttgaatgatagaagatggcgttatccactccagttttcatttcatattcgtcaggtgctccactatcaggggctgagaaactgccttcagccaaatgaagctctcggccagtattgacttcatgaacccgcacatgccaaggcattgccggcacaacaaagttcttgatttcaacatcatcgtacggcttccagtctgagtagacgtagttgtcgtggattgcgtaatcatcgtacttgaaggcggtttgccagaagttttccgattcggcaactgccagggtattatcataagcaccctgtttcaaaagaacggatcctttaggcgtactgaaaccaaaggtggttgagtagacatacttctcatacttggcttcaccatgggcatgttcgtgggagtgctggccggcggtgaatgattgaacttccaaaccattttgactgtgagcgatcagcattctaggttccggctgcttcttcaaagcttcaaacttgaagtcatcactttctttggtggtccagaatggatcatcatcaggtaaggcaaagaagataaaggtcttcaaagcccagtaagcagaagccggcccgttgtaaccttcagcaaaattcatattgggataagcatagccgattggaatcaacccatccgtttggaagatgttttgttggaaccaccaacgcaggttgttcaacagcaagtgcttgatatcacctaggctatagccttcaggcatatcaacgtgcgcataggcataagctgcccaaaaggctgcctgggcaaaccggtaatccaaactgcgcccgtatggcagggccgccccgtcagcggcaaaccagttggcataacttgggacaaatttctgggcccgttctttcaataattgactttgcttattatcagtgtgtgccaagccaaccgttaggatcgtaaagaactggtaggcaaacggaatgtagttatcgatctggttgacataaccatcgtaggaccagccatgacccaggtaatgtttattggtgatcgcataatcagcatcgatcaactctgaattatccatgtaaccagaatcagtgataaattggttgaccatcgcacggaagaataaccagttggtctttggaatcaccttgtggttcacctgatccatccatttcacaatcgttttttgctttttaacggtcaaattatcccagaaataatcttttgtttcatacaagaaggcagtcaaagcgcccatttccacgaagacctggtcatagtcaccaagatctccgccccagtaatcaggatcatcaggatcagttccggctaagatgccttgcgtcaccaactcgtaccagtctggacgttcgtatacccgctttttatcactaaagaatggccctaagccccaaagcaggcgcatgaaaccttccacttcggtcttgtcttggaggtaaacggccccactgtcactcatccggaagcggccctttcgtttttgttgcgccaaaacttccatggcaggcgccaaaatgtcgaccaaggcagctttgacatccgctttactgcggagtgggttgtctttaatttgttcattaaataattttcgtttcaatgttaaaatcacctcatcattgtattttgaaagcgcttttacagtgttaatcatactgcatattttactaaaacacaagtaaatttggcactgattttcctaattcaattgtgctttatggtaaataaagaggctgagacaaaagtatacactttcgcctcggcctctatttcttgtgatcccatattatttatcaaaaacgtgcgacgacggccagcatgcttgcctagcctacatggcaatcggctgatcccggccagttaagagcacagatcaatcattccaaaaccaggaataatcgatctgtgctcttaaattctgggatcaaaacgcctttagtcccactctacaaacaattaagctttcgtaatcttaaaaccaaaatcaatatcttttcctgcgggaatgtgatactgctcttcaacatcccgcccccagctgtcaatgccgccaacaccacgaactgcgcccaagattgaaacgactgtccgtcttggcagtggcaattcttcttgatgagtggcgttttccagctcttcagccgtatatggcaggcagctaaaggcaaacggcgtgccatcattttcgaatttaatgctaaacggcgtatccgagtgatccgagctgactttggtggcgttgcgggtcactgtgacccagtcagtcttcatgtgcaccccacagtcctggggaaccatgtagttggtgactggcaagccatcaattcgatactcgccaggaatcccgccagccatgcgatccggataggtttcaccggacaagccagcatattcgtagccggttgcggcagttggcaaaatgaagcgcatcccaaagactggcaaatccggcaattgatcattaccggcataatgggcatggatgctgatcacaccatcacctgtcaccgtataatgaacctcgacatccgtacttggaattgtcagggttgcaaaatgataaatcacttccactttgtcggcatattcatggttggaatactgattattccgcggtgcactgggaaattcaatcaactggtcgttaattttaatatcgactttatcggcactggcaaacatatcggcgccataccattgaacagcttgtttcgagaaaccattaccacggtcattatcggtggttgcccgccagaaagttggcttgggctcacgatacatccactcacgaccatcgacgaccattgattccatgccgccgcgggtgtaattgaagatgtaatggaaattggcgccgccaacgccgaggccaccatcgccatataccaagtgcaattgtttatttgtgttgtccataatagtatttcacctcctgcattgccggcttctcggtccgatcagcaaacattaatccatcaccggaaaattcgtagtcagacatccggtcatcgaaatcgccgccatatctgagaactttttggccggtgacttcgtcattgacttcaattgcctgatcgataaagtcccaaataaacccaccagcgtacattggatacttgtcaatcagatcaatgtaggatttcatcccaccaagtgagttacccatgtcatgcatgtattcgcacaagaggaatggtttcttcggattatgatccaggtaatcttgaatttcgtctggggaagcatacatccgactttcaacgtctgagatcacatcttcatacttgcggttttgaacaaccccttcatagtgaaccagtctggttgggtcagcctgcttgtagaattgttccatcgccgcaatgtcatcgccggcatatgattcattacccaatgaccagaagagaatgctggcgtgattcttcagcatttcatagttgttgcgggcgcggtcgatcacggcagctttccactgcgggaccgatccaggcacgttgtaagatggttccactgcacctagtttctgccaagtaccgtgagattccaaattattctcggccatgacataaattccattaatgtcacacaagtgataccacagcgtgtgatcaggataatgacaggtccgcaccgcgttaatgttattctgcttgaaagttcgaatgtcggctttcatatcgtcaacggaaaccacccggcctgaatgacaatcccattcgtggcggttgacgccgttgatgaccaagcgcttaccattaagggtaatgaccttgtcttgattgatttcaatttttctaaagccaaatttgtaaggcacgatttctaaaacgttgccatcttgatcatcaatttcaatcgtcaactgatacaaatatggatcgtggttatcatacaaatgaacgtttttaaatgaaacatcactcaaagtgatggcgtcatccaccggctgggaatccgcgtacaattcattgccgtctgcatcggtaactgacactttggcggtggcacccgatttgttaactgtcatttttgtggtgacattcaaagtgccatctttcaaattgtcgctcaaggttggtttgatggacaggtcttcaatgtgggcttctggttgggcaatcaaggaaacatccctaaaaatcccaaagaaacggaacatgtcctgatcttccagccatgtcgccgtgctgagtttgaagacttccacggccaacgtattcttaccgtcttgaagatatggggttaaatcgaattctgacggtgtaaaactatcctcggcatatcctaagaaatggccgttgagccaaacatacatcgccttttcaacgccatcaaaacggacgcgaacctttttatctttgaatgctgagttcaaagtgaatttcttaatgtagtggccgacaggattgtcgactgcttcactgaattgaccggcttcctgatcattttgatcaagtgcatatgcaggacggcggtatatcttgccttcccagggatacatcgtgttaatgtagtgaaaatcgtcataaccggcaaattcaatatgctgtggtacctggatcgcatcaaagtcaccgctctcaaaatcagcagcgtaaaagtttttgatccggtgcattggatccttggcataggcgaattgccactggccgttcaagctttgcacgtaactgctgtgatcatttcgaatctcatcagcactctgataaaattgatgatcgctgtgggctggcagcataccgaccctgaaagtttcaggatcgtctaaccatttaatgtctggttccatgaatttatcacactcctcttgcttagtctgaacactaattctaatgtaagcgctttacagcattttgtcaataaacatttagattattcattaaacatttcattaattttactaaatatttaatcggtcataaaaaaacaggccccaaaatacgggacctgattctaattcatttgagcaaagctatttcccatcttgaccgcggttaaagcgggcgttgggctctgaagctaacatcttggagaatacgtcagtcaaactctcgctttgatcttcaaatttcttgttcaagaccagttgacggaagtcttcgactgaaatatgttcaacatccttgaatggtagcggcgcattgatatcaccagtattttggtttaacccagtcttcaatgtgataatcaagccttccttgctatccaaagtgacaacgtagtactcgtaatagctgggagtctcatagtttccggttaaatctttgtggtccttgaagtaatcgtaaataaaatcggcgaacgcgtctttggactgtaaagcttgtttccaatcttctgaattaacagacattatttatccttctttcatcaaacagtgattacttaacccgtttaatcatggcaatcgcaattccaccaatcagttccatcccaatggcgaagataaagattgcgccgtaaccaaaggcttcaacaattgctgaagcaaccatggcaccaagcatttgacctaatgtgttggccaaattaatcaaacctaaatcttttccggcagtatcggatgatggcaaaacatccatgttcaaggcaccatcaacagagttgtacaagccattaccaaacgcagcgataacagcgtaagcaaacattgcccatggttctttgacaaagagtgggaataatgcggcagcacccaaggcgaaggtggcaatcacaactggggctttaactcgaccaagtttatcggcaagtgggccaccaaccaaagcaaagaagacaccgatgaagagcatgatcgaactaaagattgaaattgatgttccggcttggccagtactttgaccaatgtagtcggtaaagatgaacagcaggaaggtcgtgacaatggttgaaccaacaaccatgaagaacttaccaaataaggccaggtagaagtcgcgggcatcatgggttgggaagaagaaatatttcttcaggctgtccttgtcaaacttgactttaggctcgtccaaattacccttttcttgaatcagcagctcgtggatcagggccaaaataacggtacatccggccatgaagtaaataccaaatttaacgttgccgaggaactgggccgctaacaacgcaaacccttgctgggcaatggtaaagccaacaccgtagaaagtagaaaccgtcccacgccattttggcgcaacccgatcagaaatctgcgggtaaatcgccgcggcaattgcgttttcggccgctgccgcaacgatccaaatggcaataatggcaacaattgatttcatgttggcaattaagaccaacgaaatcgcgatggcaatcgttcctaagacaatgtatggtttccgtttaccaaatcgtgtccgggtaacatctgaaagggcaccaaacagtaagttggtaaccgcaccggtaattgaggcaatcgttgccaaaataccaactgcccaaactttatgtgccggatccaattgagcaaacaattgcggaattaacacgcttcgagttgatccgattggaccataccaacaaagcggtgctaaaaacattgcggatgaaatcatccaaggtagcttgggttgttgttcatccttaattttggcgttggtaacaactccaacagttgttttgacagcgtctttttcttcatctttcttagccatgaatttcactcccgataaaatattattgtggtaccaaaagttttacgcaaacttcaatcaatcacttactggtcacgcctcctcagttcaatcatgcgataagcgattagtcggtggaacggcattaaccgcttacatttcacttcaaatataaaagcattcatttcccaaagttcacccagcaattgataatggttgataataaatggctgtatgtctgtgccggtgcgacattcaaagattttgaacgtcctgagaaaatttgaacacttatatatcagtgactttataataacgtcataggaaagcgctgtcaatatgtttttcctaacttttactaaaatatttttggcaaaaggttttaattccctataccattagttcctgcattggaacaacgttgtatgcgcttatattatttagtgtggacgatttacataggtttgcaaattgatatgtcagttaggatttattgtacttcctgaaaagatcggttattctttcattattttttagtaaagtaaaaggctatcggacgataactgcccaatagcctgattcaacacctattcaattgttatgccaagtacatttcttgtagtcgtgcctgttgttctttggtaatgtgcaacccatttgtgatgaaatcagcaaccgagccataatcacgtttaacttcatcgatcgcagctttcaagtaggacaaatcaacaccgccatcgacttttgcaaacttaatttctgaacgggtggcacccttttctttgagccgggcgattcgggcgtcaatccgtggcttgagaaaatcgttggaggccacgtaatctttaaaaatggtcctggaatcaacgcctaacacgtagaggatcaaagaagcagcgacaccggtgcggtccttcccagatgcacagtgccagaggagcgatttccccataggcttctccagtaaagccataaataaattgtgatagacctttcttgcatgttcggacgtgacataagtccggtagtgcttccggttgttttcagcattaatgtgataatagtaagtctcacgggtatcaacggaatcgttaatgtatttcacgcccggcaaaaaacggtcgggcaactcactgacttcttcggggcgacgcagatcaaagtcgacgcccaaattataagtattaataagtgtgttgacgtctgcggaggttaaagcattcaacctggcggatcgcaggagtaagtggctcttaacaaccagaccgtctttggttggatagccgcccatatcgcggacgttgaaagccccttgcaagtggatttcatgttctttcacacttttcagggttcgcaaagcaggctgactaacggaaaaagtgttggtggcctccccggcagcggggattgctccttctgataaggccgaagcggcaaatgattcattttgttctttcatgtaaaaccctcccaacattgtcaatctcgcaacttccaatgtaacacttttagtatagaagggtaatgtttttgcttggtattgattcggtaaagaaatggtaaaaatgagagcgcgacgagacccgagttgaccccagaacataaggcagaacctccagtggcgaacgggttttgttcgttactggaggttctgccttatgttctggggtcagggtcgtcggagcgtattttctacctatagtcaagttataccggcaatttaagaccattctttttctgtcgggcatggctgtgccgtaaattaattgtttttctggttaggtaaagtggctttgagggtaaactaaataagccttaacaatt

SEQ ID NO: 183 - DNA, 3166 bp, Lactobacillus buchneri
gtcaacgataatgaaggaagttaacgccgaacgatcctgcttggatcgtaaggtagcgacaatttttttaaaacctgatctaacagtgatggctctgctggcgttggttgccgagaccataagcgaaaatacgtgtagaccgtttgccacttaggaaaatcatgcggtaatgcccgccattgagcgccggtctttaagatatatagaatggcacagaaaacgtcatataaatcaacctgccgtggcttcgtccgttgacaaaagttttctagttctgagcgaatgacttcaaactgttggcgagtaatattactgggataattaggcataacaatttccttttttgcaaaagtataccaaaactcaatttagatctcaaacagtttcttagtcacatcttcaccaaccgcatgtttaattaaggtgctgtttttccaattaaatagcatgcgccgcttatcatctaagttctccaaactgatataagttttcagttcatggcttaactctttaactacccgtttttcattaaacgagaagtgtttacttaggctatctaaatgacctctattgattactttttcttggttgtttttataactggctttggccttgcgatagttcttaacttgttgattaaatgcctttcttttatgccgtttgctattgattccctcgtgttgcattggtgtgtcagctattccctgttccacaaatgatttttcactgatccgatccggaatgtttttttgctctaaaacctgattgacacttgccgcccaattatgacgccattcaattattttttctttcttatcccaatcaaccaaccaaatttttcggtttctcacattccctgcaggggtcttagttttattaccatgactatctaaaatgtattcggtttttgttttctgtccccaagtaccatcggggttaaatgggcgattggtcaacatcacatgagcgtgcggattatctgggtggtcgcgatgaattgccacgtcggctaccatgccctcatcaacaaaattttcttgcacatattttgtcagtaattctttctgttcggattcacttaattctaccggtaaagccacgttaaactcttttgcataccgtgagtttaatttacgatctttcgtttcaacttcattccacaactgctctcgatcactggcccattctggtgcatttttgggggttaaaataaagctttctggcataaccgagcgggcataaaaatagtggcgaccttcctgatcatcaaataatttttcaccacttcgataagcggcactggcaatggcgctgcgtcctttaccagcactaatattactaaaactcatatgaaaaattgccatgtcagtcaccacctttcttggggtctatggttttgattttgttgtcgccatcggcgacttctaatacaggttttaatgggtttagcacaacgtcatcaaagatgacgtgtaagtgcgcattgacctcgtttcactcggtcttctgattctcttaactttaatttagtgtatgccttccgcttcgctatttcaaattttatactttgacttaacgtttcctatatgatatagtttcggtgattatttctaatatgattggagggatcgttatgtctcaaagtaacttagaaaaacaagaagctaaattaaaagcccttaatcaaaaaattaaggacgaaaaaaataagattgaacaacggctaggtaaacaaatcatcagtcaagccaatttagattatgctaatttatctaacgatcagattaagtttttagccaagcaattttctgaatttttaaaggtaaagtccgtagatcattagtcataggaaatggggaattccatgcctaatcaatatgaaaaactaattgagaagcaagcgcgtttaaaacaaaaaattgagcgggaagattttaaattacggcaatctaaatactatgaaaatcggcaagcccgcaaagcccgttctcgccgattaattcaaaaaggggctttattagaaaagtactttcaagctaataacctctcggtcgaacaaaccgaagaacttttaaaaacatttgctgactatgttaacgcccataaaccggataaattaaaaaacgatcaacctaataactaggccgatcgtttttattttctggatcatttttaggctttacttctgggttttgatctgcaaaattttgtaactgcttttgcaccttttctggataagtaatattttggtttatccaaggaaaatgcctcaaatcgttcttaaaaacttgtcccttctctcttgcataaacagaggtaaacttttcgctattatcatagatcatgaccttatcagatttaaaggccactaatggcaaattatgtttggattgctgataacgtttcttgatcgttgctactggaacaccgtggccacctttttgtacccgttcgttgaccctttggatagctaaattttcatctcgcaaagcaacatataataaagtcacttcaaagccatttttgtgagctttgtcaatcaaattgagttgagctttgcctctacctgccagtgttgtttctacgtgaatactttgctggtgatctaaagcatagtgtagttgtttgatttcttctttcatggcttttaagttgtcactatctttatgccaatcgccacccatttgtcttaaaagttcatcagcgttaatccgttttgttttgtcaaataagctgggaaatgtatcgtatagcgtactttttcctgctccgttaataccagcaacaattatatattggggtttatctatcaacggacaaagtcctttcgcttaataacctcatcttgccttttatctaaaaagtaggtatataaagcgtcatatactttgcgcttttctggatctggctcatgtaatgacttatcaagtaaatcttttaaatcagtttctttggcaatttcaaaaaagtcattaattctgattgtatctttcatgttcatcacacttcccagttattagggtccgtctgaaaactttatttcaggcgaatcagaatcgccgccaagtaaacgcgttctaaataaacgtgagctaacttgtcatagcgggtcgcaattcgccagaagttcttcagttgattgaagaagttttcaattaagtgccgt

SEQ ID NO: 184 - DNA, 12963 bp, Lactobacillus buchneri
gagcccaaattattcagataatgaatcagttcttcacatttttgccgaaacggttagtttcgctgttaacagcaagctaaatggttaaattaattaaaatatgccctgtgataccaagggatcagtctgtcttcatactttcaagtttcagactaagatacttaatatttgaagttaaccaatttctactatttcttgcacctgtgcttttttcactatctatatttatgttttctgaaacataattgctaaaccaagaatctacagtcataaacacattctccttttttatcatcatcttcagcttgtgtttttctagcgaattttctacttactcatcttttttgacatgattatctcatgtaaacatcatctttgcacattgaatttctttcgatatctgataaaggtcgtccgtttaatccctgtattacgggcaacatctacatcactcatacccgtttgataaagcttaaaagcatgttgcaagcggggatcgtcttgggtgtattggggtttgcgcccatgatatttaccctgctgcttagctaaggcaatcccttgctgctggcgctcaatgattcgcttacgttcactttcggcctgatacttatagagttcaataatcaagttggtcatcagttgacgtaaatttgggtcagcaattcccgtcatggacggcaaattcaacacatctagggtggcccccttattttgaatggagttcatgatcttagtcaaatcatggttgtttctgcctaagcgatctaattcagtgaccattacaatatcgccttcacggatataggccagcatttttcgcagttcaggtcgcttggtgttaaccccacttaacttatctgaaaatagtttatcaacgccttttaaagccgctaactgtcgatctaaatgttgctccttggaactcacacgcgcataaccgattttagccattttcagccctccttttggacagttctaatgaacacttgtaattcctagtatagcacagaatcaaaaacggccaatagggtataccctagtggacgtcacgctaatttattgaaaagggaaaaattctccttcccctagattatctgtatttaatcttgaatttataacgttttgatttccatttaccatttttgataaatcttctggggctgtaaaatttgaatgcaaaggagcttcttgataggcgatttcccaatctctcaaaatattataatcttttgaaaattctatgttcttttttacaccctcaaaatccggaaataatttggtactgatggctccgttttcttttcccgcgtttacaatctaagtgcaacacataattaaatagaccaaaaaggccatgatgacctattcttataagcaaccaagcacataagaaaggcacatcatgaccaacatcaagcgtaccatctctaaggcttaccaacaactatcaaattttgatcgcgttcgcattgaaactctgctcaatcagggattctcccaagcacggattgcccgcgaactcaaccgctctcgtagtactatttcgcgtgagatcactcgtggctccgttctacagcgaattcccgggcataaggtagcgttgatttactttgctgatacggcagcttatctgcacgctcagcggcgggagcggtgtcgccccaagacgatgcttgagaagaaccccgagttctacgccgcctgtgccgctgccatcaagcaacgtccacgcgtacacagtgtggacagcttcgtgcacaccttcaaacgggaacacgcagacgaggttgttccttcaacaccaacggtttaccgggatattgaggccggtagattcgaactacggacccacgacttaccgcgcaaacccagcttgcgaattaaacgaagccattcccatacccgcaccaataagacgaagcttggtacctcgattgatgaaagacccattgaagttcaagaccgtcggcaagggggccattgggaaggagatttagtgaaaggtaagcgcgttgatagcgaacctgcattgctggttttgacagagcggacgagtcgcttcgaaatcatcatcaagctcgctaactacaaagcaagtacctgtaaggtgggacttcagtccatcattgatgattacggtgcggaatacttcaccaccatcacctttgataacggcagtgagttcgcacaactagattcagtagaaggaactgatgtctactttgctcatccgtactcaccatgggagcgcggaacaaatgagaaccagaacggccttctacgagagtttattccgaaaggtcgctcactccaccattacgacatcattgatattcagagcttccaggacgcactcaacagccggcctcgtcgtatcttgggctaccggagtgcggcggaactgatgccggaactctaagctgtgtaccacttataggattggactagaaactgttgcacttagattgacaatacggggaataaagctgaaaaagataaacaactaaaaaatagaaaactaatattgagctaaccattaaattcgaaacctctgttccaataaatttaatatgaacctcataatgtaaattaaaaaaatatatcgcaatgttcttgcttgcagtatgtctcgctcttatctgaataagatgacattcaatcttatcaacaatataactaatataacaaaagcaaattaaaacattcacgaaacagaatttgaaaataacaccagagaaaaaatattttcaagctactagaaatttcaactatttatcatgacttttttattttttagctcaaaaatgattgacagatgtctcgaaattgtgtacattaatcacaataaaaatttcggaggtgtcatgatgagtcaatcaatgtttaatgcgattaattgttgctgtcgaacaacgcgtttttggcgatgttcggcctgttagcattgacgttttttgggaaatcatgacctaaaaagagttcaatgtccacttggctggagttgaactaagggcgcgaaaattctggatttcagaatttcgcgccctttttctatctattgcggccatttcccctagcatcccgccagctaaacactgctccaaatgattagaaaggatcttatttatgcttattcattccatttcagaactgatcggtcatacgccactgattgatctgcaaatcaacattccaaatcacagtcacatttacgccaaactggagatgtttaatccaggaggcagcatcaaagaccgcctgggccaatacatgattcaagatgcgattaatcgtggtcaggtaactgaaggtgtaacaacaattatcgaacctactgccggcaataccggaattggggttgcccttgccgctcaacaacaccatttgccaaccattctggtcgtaccggaaaagttcagttttgaaaaacaacaattgatgaaagccttaggggcaaaattaatcaacacccccagtgatcagggcatcaagggcgccattgaaaaagcagaagcgcttcacgatcaaactcctaacagtttcgttccaatgcaattcaaaaatccggccaaccctgatacttattatcacactctggcaccagagttgcttgacgacctcaatgacccaattgacgcctttgttgccggtgcgggcagtggtgggacatttgcaggcgtcgctcgttacttaaaggagcagaatccggcgactcaaaccatcgttgtggaacctgaaggctcaattctaaatggtgggcctgcccatccccatcggactgaaggcatcggtgttgaatttgtcccaccattttttaaagatgttcaaatcgacaaaacgttaacaattgccgatgccgacgcctttcatcaagttaaggagcttgccaagaagcagggattattcattggcagttcaagcggggctgctttggctgccagcttaaaggttgccaaggcacttcccgagaatagtaccattgtcacaatttttccagatagcagtgaacgttacatgagtgaaaatatttatgattaaaaataaagtgaggttattaaaatggaatttgatacaaaattaattcatggtggtattagcgaagataaagcaaccggagcagtttcggtgccgatttatatggcatcaacttttcatcagcaaaaaatcggtgaaaatcaatatgagtattctcgttctggaaacccaactcgagaagcagttgaaaaactaattgccgagttggaaggcggcacagccgggtttgcatttgcttccggttcagctgcaatcgacacagtcttctcaatgttctccgccggcgaccatttcgtcattggcaatgatgtctacggtggtaccttccgattgattgacgccgttttaaaacgctttggcatgacctttaccgtggttgacacccgcgacctggccgctgttgaagaagcgattacgccaaataccaaagcaatttacttggaaacgccaaccaacccgcttttacgagtaaccgatattgcagcggttgccaagattgccaaatcgcaccaaattttaagcattatcgacaacactttctcctcgccttacgttcagcgaccgctggaacagggagtggatattgttcttcacagtgcttccaagtatcttggtggtcacagcgacgtcattgccgggctggtcgtcactaaagatgatcaattggccgaaaaaattggttaccttcaaaatgccattggtggtattttggcccctcaggaaagttggctattgcaacgtgggattaaaacgttgtctcttcgaatgcgtgctcatttggccaatgccgaagccgtcttcaattatctatcaaaccagccacttgtcagcaaaatttactaccctggcgatccgaacaaccctgattacgaagtcgccaaaaaacaaatgcacggctttggcgcaatgatttcctttgaattacaggacggactggatccaaaacaatttgttgaacaactgcacgttatcacattggccgagagtttgggtgcactggaaagcttgatcgaaattccggccttgatgacccacggctcaattccacgtgacattcggttgaaaaacggaatcaaagacgagttaattcgcctttcagtcggcgttgaagatcaaaaggatttgttagccgatttgcaacgcggcttcaatgagcttaagaggagcaagaaaaatgtttcagacagcaaggtccattctcaagcgtgatccggcagcccacagtcttttagaagttctcttaacctacccggggattcgggccctgttttggtaccgaatcgctcactttatggcttttcatcgactttatacaattgccgggttcctaagtcaacatgccgccaaagtaaccgggatttcaatttcgccggaagccaaaatcggtaagcgcgtttttatcgatcacgggattggcgttgtgatcggtgccactgccgtgattgaagatgacgtcactatcctgcatggcgtgacgctgggtgccaggagggccgttgaaggtcggcgacatccctatgtaaaaaagggtgcattcattggtgccaacgcccaattgcttggcaccattacgatcggcgcctttagtaaagttggcgcaggggcaattgtcctgaataacgtggccgataaaaccacagtggtcggcaaccctgcccgaaccgttaacaagttacccgctaaagtcattaacgtgaccttcacgacaaacacgtcaaccactaaaaattaataacttacgaaaaacaccttgatgaaaagagttgccagttggcaaaaatatcatcaaggtgtttttcgtatttaactattgtgtcgaaaataattagaacctgtctagtatctgctgaatctggtagaattgtggaaaaccgactgaggagtttgtcatgccagattatccaagcaatatttctcgagcgcaatttgcgttaatacaacctgatttagaaaacttccgcaagcatacaagaccgcgtcgttatgatctttatgacgtatttaatgccatcctttactcgcttactacagggtgtcaatggcgtgaattaccgcaagatttcccggaatggcacactgtctaccgctattacgatatgtggcgagataaaccagacccgacagctgattcgctattagaaaggcttttaaaaaaactgttgcttcctatcgttttgcacagggccgatcggcccgaacgtcgtttgtgattgttgatgctcaaagtgttaaaaccactgatttaacgaaaaatagtggctacgatggcggcaaaaagatttcagggattaagcgtcatatggcggtcgatattaacggtttaccacaagccattctcgtgacacgagctaatgtatcagatcgttcaggtgcattggctatgcttagtttggctagccaaaatttagagctggttcagcatgtcatggttgatggtggctacactggcaatgactttgcggatcaggtgaagctcattttgaatgctaagacgacggtagctaaacgcaacgagttgcatatgttcacggtgttaccgcaacgatggatcgttgaacgttcatggagttggctagacaaatgtcggcgactttggaaaaactgtgaacgtgcccttaacagcagtcttcaaatggttgtattggccttcctgaagatagttcttaaaagatactagacaggttctaaaagttggcgaatctatgagacctatattcgagttaaaggccgttgggcctatttgcatcgcgctattgacagtaacggtttgaccatggattttgagctacgaaaacaccgcgattatactgcatcctatcactttttgaagcgtctcttgacgaccaatggtcggcctgatcgattagtcactgatcaatatcgggcaacactgaaagcagtgaagcacctgataaagcaagactatttgagcaaatcagcccaccaatgttccaaatatcgaaataatttgattgaacaggaccaccgattcattaaacgtcattgtgtccgctcagcaagctttcaaagcattcgaaccgctagtgcaacgttgagcggtgtggaaattgttcacgcaatacgcaaaagaacccgacgagagttaagtctcatcgggttctcagtcgtggacgaattagaagcattgttagctgcataaccttcaacataggatcaatagctggttagatggtcatctctcagactgtttgcaccagatcctgattatgctcttttattttctcgaacaggatacacaagtgcctgccgatgcaaaccatttcgcgctcgcagagcatagagaattgtcacggtatcgacaacttcttgcagcattgcgccaataattgttggaatgacaccgaagctggcgattaacatcaaacctgtacaaatcgcaatgccgatgaggaccgcttgcttggcaatgaccatggtttccttagcaattaaagtggccgcagcaactttcgccaaatcgtcgcgcagaaccacggcatcagccgattcgcttgccgcggttgccccatgtgcacccattgcaatgccgacatcagcaatcgccaatgaaggtgcatcattgacaccatcaccaaccatcacaactggccggccatccttagggacgttatccaaaacttcaatcttctgttgtggcaattgttccgcatagacttggtcaatgccgacctgtgccgccactttatcagcgattgactgctggtcgccagaaatcataatcagcttagcatcatttaattcgtgcagtttcgtcatcgtttcttttgcttctggacgaatctgatcggaaaatgtgatcgcacctgcgtactggccatcaacattcacatacacggcagtcgtatcaaccgtagccttcgtcccagcaaactcggctttaccgaccttgactttgcggccatccaccgtggcattaacgccaaagctagtggtttccgacacatctgtcgctggcagccgatcagctgtcggcacagcatctgccagtgaacgcgccaaaatatgagtcgattgaccttccgcacttgcggctagcttcaaaagctgatcctgtgagaaaccggcttgtggcaaaatcgtcgcaacttttaaaataccgcgtgtcacggtgcctgttttatcaaaggcaaaggttttagcttcacttaacttttctagcgtagtccctgacttgacaatgatcccgttgcggctattacgactcatgccggagaccatcgcaattggcgcggccagaatcagcggacaaggcgaggccacaaccaatacctgtgcaaagcgaactgggtcgccagagaagaaccagccaagacccgcaatcacataagcaatcaacgtaaatggtaccgcataacgatcagccatccgaacaaaatgtgctggccgcgcttcagattccttaaccagtttaataatcccttgatactgactatcttcagcccgttgcgtgaccttaacagttagggcagcgtcaccattgacggtcccagacataatgtcactacctgcgtttttggcaaccggtttagattcacccgtcaaactggcttcatccaccaaactctcacctgccaaaaccgtaccatcaactggcacgacttcctgcggcttaaccaaaatcgtttcgccaacttggacggcctcaacgtcaacatcttcaacgtgtccatcaaccatacgatgcgcggttgtcggtgcattttcgagtaattgctttaattcactgcttgcttttgttgctgcgtagctttcaagcgcatcgccaccagtcagcatcaataacacgatcatcgcagcccaatactggccaaccgccaaggtggcaacaaccgccgtaatggcaagcaagtcaacgccgaagttaccagaacgaattttcttcaccatgccccagaacataattaaagcaatgattgaccccatcaccgtgatcagcccttgcgcgatcagtggttgctttaaaacgaaagcaaagactagcgcaatggcacttacagcaagcaccatcattagttgccagttctttttcatcactgccaccccctttttctaagcattccaattctaattattacagacgagattacatatttaaagttaccaccctcaagacaaaaaagcctgtcctttcttgttaaaagggactttgcatatcataccatactatctagagggaagtcatcactttttcggacagtttgctaagcgactttttgtgaagcttggtcatacaaggaaagccatgctactggtgcaagatagtctaagcgtgcttgtacccttacgcggttgtaaaaggtctcgatgtaagcgaagacttgcgctctcagatcattgatatctttaaattgtatctgataaatgagctctttcttcatgatggcaaagaagctttcgctccaagcgttatcacccggtattcccaatgctgagaagctacgttgccaatgatattggttgaccaactttgtcactgctttggccgtgtattggctaccacggtcactatgaaaaatacacgtttctggcaaagcccacctttggtgggcttgtttaagtgtcgctaagactaaatccgtgtccatatgattggatatttgatgagctaacactaggttgctggtcaaatcccttatttggcaaatgtaagcttttccttctgatgttgtcgtctgtgtaatgtcacttgataaggcttcaaacggcttaaaagattggtgtttcactagattgggataatcaccttgacgagcaagtcggctatcggtcaaactcttcggatgacgacaacgtagcgttgaatacagaccgccatcagccatcagacgggcaactcggtgataggaagctttattaccatttttacgcaataaaccgcagatgcgtttgggcccgtaagtgccctgtccttgatcaaaaaagtgtttgattcgttgacgatattgcctttctttggcgtttcgctttggcaaagctctccgccaagcataataaccactcgttgatacgtctaacaaacgcgcccaccttaccacagaaacagaggtttccctcaacataaaagcatacttatcgctgggggttacttctggagactggcaaagtaggcggcggctttttttaacatatcacgctccaatgctaattcggcattttcacgttttaaggaacggttctcagcttctaaagaagcaaacggcgtttgctttccatcttcggtatatagcttccgccaacgatacagggcactttcaggaacaccaagttcggaggcaatgattttaactggtttggaagagttaaaactcaaacgtaccgcatttttcttaaaatcttggtcgtagcgattgcgtgaataggtcattttgaggactcctttcggataaatcaattctcttatgtttctgtccgaaattctagtacagacccagagtactctaacaactgaatcaacctgattactctaaaagttggcgtatggatgagacctatatcaagatcaaaggtcaatggaattacctctaccgtgccattgatgatcaaggtcttacgcttgattttcaactgcgcaagaagcgtgactttaactcggcctatcattttctcaaacgccttttaaagacctatggtcttccacatcgattagtgactgatcagtacggagcgaccctaaaggcaattaaaaagcttactagggaaggctgtctgcacaaaggtgtgcatcagtgctccaaatatcgcaataatctgattgagcaagatcaccgttttattaagcggcaacaagttcgttccgcaagttatcagagcactcggacagcagctaggacattatacggcattgaaaccatgcatgcgatacacaaagaaagccgaaagaagccaggcctcttcggcttttcagcgtatcaagaagtcgaccaattgttagcggcataggctacaaccactaaacacagtcactttgatctacgcttaatttcaactttgcaccagaaccttttgtcttaataacaaagtatataagggactaccattcataccgatcaaccaatcactaatttgacgggtttgggcttctttataagccaaatagtctttgtgccaatcaccaagatttttaaagccggtaataatggcgtctttttccaaactattcagccatagccgcttaatggtcttctttttaacgtcaatctgggcttggatcatgattgaccacgcaatattagagccttcccgaccgctatcggtggcaacaataatggtatcggccttctttaacaggtctttgacgaccttgaattgatcttttttactagctgacaccacaaacttgtatttatcggggaaaatcggtaaattagataaggcccattgctgatatttctgatcatatttatccggtgtggctagttcaactaaatgtccgagaccatacgtcacaagcgtattttcgggcaaaacagggtcgctaaccgtatagtaaccctgtttttttgtgctcttttgaaaggcttggacgtatgaacgggcttgactaggtttttcagctaagataacagtggtcatgttcgttcactccttgtgattaagtttctgttctaattctgttctaccttgttcagccgcttttaaccaggtttaacggtgcattttttattccgattacaagtgcatgccaccatcttcatgccggttccgggtttggtgttgccgctgctttttcgtcatttcccactcagtctcctttaaaccttgcgcctgtttttgccgttggtaatcttcatcacgggcatatagggcggtcatgattgcgttactaaaggccgtctttaagtaatagtctggactaactggcttgtagttcagtggttgataatgcccgatatttgcttttcggtattgatcgtccttatcttgttgctctcttaactgcttttggattttctcgatttgactgttcttaatcgttggatcgactttgcattcgccaaaaaagagttgtttagtgccatcatgctttaaaacccgttgtaagtgatgattttctaactgatctaagctaagctgtcccgacaaataagctaaccctaattgatgttcttgggtactgaaaacctgtggtggatttgattgccattgttccattgtttcgacttttaatggctttaaagttggatcatagtacatcacggctgtataagcctgttcctgtttagtcaatggcaatccatctaaatcgcctttgggaaaggcccttttcaatacttcatggtattgcgtttgaataacttgcttaacagccatgattgttcgcaaatctttgactgcgcgagtaatcttttgctgttcggttggtgaatatttctctagtaacccttgatcgacgtgttctagactttctaagttatcatcatgaatcatcagcgtatatttaagctcgattttgacttccttttcttgttgtattaataacttccagccaacgtatggccgtttggtaaaggccaataattgttgggccaacaaatcatcacgaatgttcattaaacgttcgtttaattcactacccttgaaaactgtttgttcgctatcggtttccttaattaattctcgtctttcagcttgcgtggtctgttcaaaattaagctctggataaagttttttagtcgtgcgatcaaccactttatttaagagttcatctgcttttttgagtgagctttcttgttggttaattgtcaataattgtttagaaactgtttgagatctctaaaagcggcgtaggaaaactgagacaaacgctaaagttaccatcgttgtactggtgtgcagctgtcgttcacagtttttccagagccgacgatatttttccaaccagctaaaggagcgttcaattatcca

SEQ ID NO: 185 - DNA, 862 bp, Lactobacillus buchneri
gtcaatttttcttagaaaaattaagctagtgagtggcgattattttggcggaagagaacagctaaaattaactgccacgagagcaagatttttcgctagaaaaatgagcggtggggtctgtcccgctggcaaggcgaccctcggtagagcccaaactttacaaggtaaagtatattgggctataccttgcatggaggtttgccgaattatgtgttatgctctaaccaaatttaactgtttggaatggggcggtgagatgagttatttagtcgctaatatgcagaaattaaaagctgataatttagttggtttgggtaatcatgatcaacgacggactcaacaccataaaaatccggatattgatgttgaccgctcggctttaaattatgatttggtcgctggtcggactaatcattttaaaacggatattgaggcttacattaacgagcgaaaaaccagccagcgggcggttagaaaagatgccgtcttggtcaatgaatggattatttcaagtgatagtcagttctttgctgatttaacggcagctgatacgcgtaaatattttgaaacagcgaaggactattttgctgaaaaatttggtgaagaaaatattcgttatgcaattgttcatcttgatgagagtactccccatatgcatatggggattgtcccgtttgatgatgaacataaattgtctgctaaacgagtttttaatcgcacagctttgcgagatattcaagatcaattaccgacttatttacaacagcatggtttcaatattcagcgtggggttcaagaatcagaacgtaaaagtttaacggtaccagaatataaagccatgcgggaatctattaagcagggg

SEQ ID NO: 186 - DNA, 9587 bp, Lactobacillus buchneri
ccatgtcaggctgaaacaattgaacagtggcaagcaaatccaccacaggtgttcagtccccaagaacatcaacaaggactagcttatttatcgggacagctgagcttagatcagttagaaaatcatcacttacaacgggttttaaagcatgatggtactaaacaactcttttttggcgaatgcaaagctgatccgacgattaagaacagtcagatcgagaaaatccaaatgcagttaaaagagcaacaagccaaggacgaccagtacagaaaagcaaatatcggacattatcaaccactgaactacaagccagttagtccagactattacttaaagacggcctttagtgacgcgatcatgactgttctatatgctcgtgatgaagattaccaacggcaaaaacaagaacgcggcttaaaagagaccgagtgggaaatgacgaaaaagcagcggcaacatcaaacccggaaccggcatgaagattggggcatgcacttgtaatcacaaaattagcgactggttaattggtatgaatggtagcccataatatattttatattgagaaaaatttggtacgtagagcgtgctcgattagttacgtatagctgccagtcttgtgtatggtctatcaaagagaccaggtaaacaaaacctttaagccgaaaccctattttgaactaaatgcggaaattcttgctaatcagcaaaaattcgtcgcaaaattagacccctatcagcgatttaaagacgaaacagggctaataacattcatgcaagctaaacacgttcagaaaggctcacaggctggtttaatcaagggcattcaaaaccaggctaaaaagcgtgctagtccccaactattctcgctatccagtctccagagtgccatgaataaacgttatcacgccagcgccagccagactttggcggccattcagaatttatacgaagccaagttccttagctatccccgcaccgattgtgcttatatcactgatgaagaatttgagtatttaatggctaatctgacgaagtatctggggttagtctctaagccagtcgctttaaccaataccactccgaacaaacgctatgttgatgggaaaaagttgaagaacactatgccattattatgattaaagtcgtctcgactaaagatcaattagctaccttacctaaaatacagcatcaagtctatgacttagttttaagaacaacgttagcgatgtttgctgatccgtacgagtacgaggaaactaccattattacccaagttggtgacgccaattttaaagcaacgggtaaggtcccaactaagcaaggttggcaagctttatttgatgatcacaaagccgatcagcaagaagcagcaactttaccgctcgttcaccaaggcgatcaagtccaagcaaatctgcaaacgccgcaaaaagaaacgacacctccggtaccctttaccgaaggtaccctgattacggccatgaagaccgctggcaaaacgcttgatgatgaagcagcccaagcgattctaaaagacgtgcaaggcattgggacaatttttctagtcacactgatagcatctattggactatctatcaattaatatggaaggacatggaaaataaaatgggaaatagtacaattaatttcaagtcttttgatctaagtacagctgaagatgtaaaataaaaaagattcggaagaatatcatcgacaaaggaaaaaaagcaatactttccagtgaattcacacttttttcaaaaatagaccacatttatttcacaatatcttcaaataattcacattttcaatcgaggcacatttttaagcttaatagttatcctaattttttctgatttcatttatcaaacaggtagctaccttttcgaaatttcaaaatgactgtgatggtgaagcggcattagttgaaagaattcataatgatccgacttataaacggcactttgaaattgtcgctgactaggcaggccaattagccggttatagtctactgagcaacatcatgatttaaaacgaaaaccaatcgaaaaccgatttgtacttggcaccagtggccactacctcatcccatcagcgctaagaaattgacaaacaaattgtgatcgagttggaatatcgtggagcccttggggtgtaaccgatttctgataaattctcattacttcattatttttagccactagtttgattaccaaaatcattttaagctagaagagcttcttttatgcgcgttcgtaacgaataaggaacttcgtttttaaagaaacacgaggggatctttttgacaaacacaattctattagtagaagatgaagaagctttaagttcttatctaattccggaactccaatttgaagactatcaagttcttttagctcgtgatggggttgaggctttaagcctttatgacaataaccggggaaatctagatttaattatcctagactggatgcttcctaaattagacggtttggaagtcttgcggcgaatccgcaagggtgacgatattcccattatcatgatgacggcccggggatacgtgggtgataaggttgctggtctggatagcggtgccgacgattacattactaaaccatttgaaattgaagaacttctcgccagaattcgggtaattctgcgccaccaacgtcatcgcccaagggtaacaaatctctacaccgttgaggacttgacgctcaacaccaaagcacggcaagtaacccgcggaaaccagctaattcagttaactcaacgcgagtatgaattgttactcgtcctcatcaaacacacgggcgaaaccttgacccgcaatgaacttctggatgccgtatggggcgtcgattttgaaggtcagcccaacgtcgtcgatgtctatattcgctatctccgcaacaaagtggatcgcaagtaccccaagcagttaatccataccgttcggggaattggctacgtgctctctggcaattatcaggagtaggaggcgcatttgtgcgacaatcaaaaaatcggactacctttcaggcaatccgtttaaattttacgattatcttcaccctttttgccatcttcacaggcgcttcggtggttacgatggttggggttaatttggtgcaccaagaacagacccagtcggttgaattgctcaacggtctcaaccggtcgtttattgaggataaaccagactggaaccagtggcgtaaaaacagcagcattaacacccaaaatacgtatgtccgggtcaccgatcagagccgttccaagacaaatccgaaggtcttctattcaaagggtgctaagcagtttttgtccaagaaaccagaaaaactctcccatacgttgcacttaccattctttccggcaattatttacacgcccggatacggaatttcgtactatcgcagtggcattcgcgcgggtgcccaaaaagacattcgatctgaaatttggatgagtctaaccccgatcgtgaacactctgctttcggtgatgctggtcgtactttgcgtgctcatcatcggactcgttctcggctggttcgttatttccgtagttgcaaaacggctaacccaatcactacagctactccaaacaaccgcccaaagccacagccaatcggtgaccaatattgaaacgttattaccggttcccgactcgccaattgaagttcgcgaactggcaaccagcttcaatcaactactcgctgcaatcattgaaaataacaagaaggaaaaagcctttatatccaatgcctctcacgaactccgaacgccaattgcggccatccggggacacgtttcactggttaaacggcgtggtcaggcccatcctgaaatcgtcaaccgctcactcgactttattgatgatgaatccgccaaaatgcaatcgctggttaacagcctactggcactgtcacgagcagacaaagaggttgtcagcaagacatccttcgatctgggcagtgtcgtcaacgaaaccgtcgaggaacaacgcgccgttttgagtcaacccatccaggtaaccggtgaccccaccgcaacggtagtcgcaaaccagaccgacgcctcgcaaatcatctcaattattctggacaatgccggaaagtacgcccctaaagacgctcaaattacagtgacgattaaccaaggacacccaacaacaagcctctcaattcagaacactggtcccagcatcccagacatcgataagaaacacatttttgaccgattttaccgcggtgatcacgcccacagcaatcaggtcattggtaacggcctggggctctcaattgcatcacaactagctgcgctaaacgatattcaaatgaccgtcacggatgtcaaaccacatggagccaacttcaatctcctgttctctcatccatcttctgcagatgaaaacgattcgaaatcccaaacttaatccacgctgaaccaaaagactgacccaatactggccagtcattttttatctcatcacactgcatcattaatggctttctgagaatttttcattttattcttttgtaacgcctgtattacatttcggtccctagtcatatccttaagctgttaggcatccgccttgaaaaaggtacaatgaatgcgtacgtctttgatttaaagtaagtctagtgattggagccgatgatcgtgcaaccgtcaattttaattaaacatccctatctatggcttggctggagcgtctttattttgcttgcactgagcgtctcgtttgaattaccccagctatttttcgcggatcaaaacacgctgaactatttgagtcgctttatttctctgccacgcacccacttctttgacgtgatcgcctttactggcaagccagcggtgaccctgttagcagcgacgattctcattgcggttctgtggcagcataaacaaatctgggagtcgttaacagcattgacaatggtcctaagtggtaacgcggttggtctactcatcaaattgatgattcagcgaccacgtccaacgagcctaatcacaccagcaactggatatagcttcccaagtggccacgtcatcagctccgttattttggcaatcgtgattttcaaattcggaatccagctcattcccgcaattcgtctccggctatcactaagtatgctgctgatcttttggttgggactcgttgcattatcgcggctttatctccaagtccattatccgtccgatgttttagggggcgcgctgtttgcattcctatggtgtgaaacggtgatggtcggttttcaacacgaattcgcaaaagttgatcaattggttaaggataagggaggcattgatcatgaatcatgacgatagattaaaatccgggatgattatgggaagcggatttcttctctcactgaccgtgatcggagttgtcatggcggttaatcaggtgaccccatttggcagccagaatctattgatcggcgatatgggcgcccagtacgcaccgtttttaacgggtctccgccatatcttaaccaccggaaacttcagctggttttcattttcggttggaatcggtgaaaacatcttcccactggtagcgtactacctgctaagccctttcaattttctcgtgaccctggtatctgcgagccaggtgccaactgcgattacttggatcctgatgcttaaaattgccaccattagtctcacaatgagtttttatttgcttcgccactttcaccgagcaagctggatgatcccctttttagggttagcctttagcctgtgcgggtttgtcagcgccgattttatcaatattatgtggctggatggtctgatttacttgccgttaatctgtcacggtatcgatcaagttaaagcggggcaccgtccccatcaattatttgcgtggctaacgattgcaatcatctccaactactacattggctatatgattggcatttttacggtcatttatacctttatgctgctgatttgggacaaatcccccaaggtatcgggaattcaaatgatcaccaccaaccgtcctttcctcaaacaggtcggaataacggaattcttcagtattctgaccgcaatggttgtgctccttcccgccgctcttggaatgctacagactgccaaggcggttcccacagttgccaaccgattcatcgacaacttcaagccccaattcggtctggaaattttcagtcaaattgggatggggagcacgggatacaccaatcggatctatcacgctccggcaatcttttcttcaattgtggttgcgattctatttgtgagttacttcatgcacccccggatctctcatcaaaaaaagattggtacctggtttgcgtttggtttgcttttaatcagcatgttggttggaccactcaacgttgcctggcatatgtttaacgagccatttgggtcaccttttcgctattcattcctagtaagtttcgtcatgattattgcggcctacgatacttggctggcaaatccgattcaccttccaagatttgcgaagtggctggctcccacgattgtgagtgcagcactcatcattgggtttatcgtgattcgaattggtaccgtaacaagccgtaacgcctacctctcactgcagccaaactccctcaaggtactggctgtcaatcttgggacggtgttggttctatcgctcctcatgtttcttggtcaccgacagtttgcaacaatgaccattggcggcctgatgatgctggaaatcggcggtaatctgagttatgccattcgaagcgatcccttaggtaaccagtccacgtatgcccgatcctataatgccgaagctgcccaactgtcctcagctacgaactcacaaacaagtctttatcgattaaacgtcacggatgataaactttccgcttcaattcttgaatacctcggttacaatgacccagtggcttttagctttaatggcatccaagaatatagctcaacgctccacgagcagacccgccaatcgctaaaggaactcgggttcttcagtaaaaacgaacgccggatcgacaacgccggtgtaactgcggcatccgaaatgctgctgggtgtcaaatacaacctcagtgctgcatcgggtgtgcagtcaaatcccacatatgtcggaatggggtttccggtaaccacaaactttattaattttaaattaaagccgggtaacctgtttccaaatttgaattcagttctccgacggctcaatccaaccccaaattcttatctgctgccagacaagatccagcaacgatccatcagccactcaaccattcctgggcttgttcacgcagactacacgattacaccagttcaaagcggccccatttatttaacaacccaatcatccacatttcgcgtctcattcatcacagttaatgggcggcagatttcgctgattccaaataaactgcacaagaagtacatcgtgaagcttggaacggtcgctgcttcaaagcccgttcatatcgtaatcggtggtgcgagtccaagaacgcttcaaggacttcaaattaggcgtttaaacgtcagttcactattgcaaacagcaaaccacttacgggcagaagcatttcaaccaacctatcacggtgatgtccttcaaggaactttacgccggtcaaccatatctcaacgctgggcctatatcgccgttccagatgatcccgggtggtcagcaaccgttgataatcgacccgttacaattcgcaaggttttgggcaatttcatggcggttcctttaagcagaacgactaatcacattgctctgacttaccacgttcctgggctatcaactggcattgagttatccatcgttggtttattgggatacggacttttcagcatggtcgccataaaaccaggtaaacacacaaaacgaaaggggcgcgattagctgatggcaactccatctcttaaccgttcaactcagctcaatccgcgaatcgagtggatcgacattgccaaagcctatgggatcattgccatcgtgttggggcacattttaaccggcaccccaatcgctcattttctttactggtggcacgttccccttttctttatcctgagcggaatttttattaaaccacttaataaccggcatgcttggcaccgcttctttcttcgccgagtgcgaaatgaactgattctctatagtctgatgggtgttttgctgatctgggggtacaccctgattcatcatgagagccacacctttttagtcaatcacctcgtcgacttaatctatggcgggcgcaccctcaatttttataccagcacattttggtttattaacgcctacatcctcaccacgattgtgatcacaatcttagtgtcggtcatccacagtcgaatcattgcgggggcgttagtcaccagcggcctatttcttggggccagctacaatcaagtaacgtggatgcacattaatggatttgccatgaccccatggagtgccgacacggttctgatcaccgcattttacagctatgtggggtacgtcctgtttcacacaaatcaaagctggattgaagatccaaaggccattagtgggattattgtaatggcgatgaccctcattctcattcaccttaatagcggattcacttttcgattgtcacttaaatcccacctgattcaaagctcacttccaaatgcgatggcacttatcatcataccaaccattcttgccctcggcgtgatggtgggcgccctgatcacgtctaagttgccgtttaagttcggtttgccactaatcggccggcatacgctggcaattatgtatgggcataagatgattctggatgtttgtgggttaatcggaatcaaaaatcccctatttcagttacttttagggatttgcattccggtcattatcgtcgtggcttgtgagaaaatcaggagtctggacggtcatttattaaatcgcaactccggccacggctatttaaaataaactaagaagtgcttagaatgatgacttgattgtgagtagtcaaatcatcatcctaagcactttacgatgtttaaatgcatcaattacattgttggccgaatcgcttttgccactttcttaatatcattcggcgtcgtccgacagcagccgccaataatctttgcaccggctgccaaccacttgggggtcagatcagcgaatgtggctgcttggggattgggtttccaagttttcgttttgggatcgtagatatcaccattatttggataaacgatgatcggcttatccgtattcggcgcaattgtttggattgtcgcttcgatattgttcattgacgtacagttcacgccaatggcactgatttgcggctgattgttaaagtatgcaactgcttccttcaatggtgtaccgtcacataaatgttccggatcactcacactaaacgataaccacgcgaactggatgtaagctgattcctgagacaacttttaagagagcgtataatgaataaatcgtctctcaaaaggaaggaatttttacatgccaactcgttacgacaaagaattcaaacaaaacatcatcaacctatataaacaaggcgaatcagccgc

SEQ ID NO: 187 - DNA, 249779 bp, Lactobacillus buchneri
  misc_feature (82515)..(82527): n is a, c, g, or t
ttaagaaaattatgcataccataataattccttatggaactatcacttttatcggtgaattaacaaataacgggcaaataacggtcaattaaaattataaatgcctttatatcaacgtttgtaaggggcacttgtgcctgcagtcggcataacatttcgtaaaaatagggaaaccaacgaatgacaatttgttgggttccctatttttgtattcctgcttgtaatatctccatgaaacaccatcataaagttcgcggacgatgtcagacgagaattggtatacaagaaatatcatagattggtatatgataataatattttgaaatagcccgacgtaacggtacccgattggataatcaggaaaaattgggcttgtggtatacgttgttttgcgttatgctgtactggtaaatacaaattgtttgggagtgaacaaaatgaaaaaagtattattaatttgcgagagtggaatttccagcaactttctcgctaaatcggctaggccctttattgaactgtatgatgcaaagattgaactgattccaactaacattgacaatgcggacacatatttgggtgatccaattgacttagtgctcgttgctcctcaagccagttatcacaaaaaagaacttgaattgtttgaccgcgcaacgcaaattaaaacaattcctgacgagatttatggttgggcaaacggtgagaaactcgttaagttcatcatggcccaattatctccgattggggccgcttaagatgactgatgagcagttaaacgggatcgccatgaaaatgctgacttattctggcaaagcaaagagcatcttatcggacttgatggatcatctcaactcatcaagtcatgatagtgatattgatgcccaattaaacgaagctcatcagtggttggtccaggcacatcagcaacaaaatttggtgattgccgaagctgagacagttggatactcattgctcttcacacatgcgcaagatacccttatgaatacagaaacaattgaatttgtgattagaaagtctatcgctgcatttacaaatcattcataagttcaatccggcatccggttattaatttgatactacttacgaaataggtcttgcctaattttgctgtgtatataacttgtcgtgacctccgattctgttgaattaaaattcaatctggcctataatggtctgtatgatttattcttgtaatgaacttcaggagtaatttaaaatcaaaaatctaatctgattaacttgttttgttaataagattagatttattttttggagggtatcacatgcaacaacaagatcaaacagaccaggaacgtcgcgcagatgcctctttctttggccagcctcggggactctcaaccctgttcttcacggaaatgtgggaacggttcagttactacggaatgcgtgccattcttctttactacatgtattatagtgtaactaaaggcggcctggggtttgataagccattagctgcgtctgttatgtcgatttatggctcgttagtctacttaacctcggttatcggtggctttgtgagtgaccgaatcctgggtagtcgccggaccgtgttctatggcggtgttctgattatgtttgggcacatcgcgctgtcgttgccaatgggtgcgccggcattattcacctcaattgtcctgatcacgattgggactggattattgaagccaaacatttctgaaatggtcggtgggttatataccgagtatgatacacggcgcgattccggattcacaattttcgtattcggaattaatttgggatcattcattgcgccgctgctggttagttggctcggattcaacgtcaacttccaccttggcttctcactggctgctattgggatgttctttggattactgcaatatattcgcggtggcaaaaaacatttgcctagtgccagcctgtatccaagcgatccattagaacccaacgatgccaagaaattgactatccgggttggtttgggagtggttgtcttcggcttgatcctgttgctcatgcaggtcatgggggcattatcactcagctcatttattaccttgctgagtatcattgccgtggccacgccaattatttactttgttgtcattatttcaagcaaaaaaatctcttccaccgaacgctcaagagttgttgcctatattccactgtttatcgcagctgcgatcttctgggcaattgaagagcagggatccgttgttttggcactatttgccggaacccaaacgaataataatgttggcggtattttcaatatttcgccaggttggtttcaatcgttgaacccactgttcattatgctgtacacgccattctttgcttggatgtggattaaacttggcaaaaagcagccgagctcaccatccaaattttcactgggattaggtattgccggattatcctatctgtttatggtgattccagttgccttatttggcgcacaagcaaaagtgagtccactatggctgctcggaagctgggccattgtggaaattgctgaactgttaatttcaccaattggactctctgttacgaccaaactggcaccaaaagcctttgaatctcagatgatgagtatgtggttcttagccgattcagctggtcaagcggtcaactcacaaattgttaaatactatacaccggacaatgaaattaattacttcttgatcgttggtctggttgcaattgtcgccggagttttgttggcattcctggttaaaccaattaagcggttaatggaaggtgtcaattagattcaagaacgaccgaatgtgttatcctaatttggatagcacatttttattttggggagaaaacgtgatggtaaagattgccgtaaccagtgataatcacttagatttgaataaggtgacactggccgatacaattaaacagcaggcaacttttttgcaagaccaaggggtagacgattacctgattgccggcgatctattcaatgattttcagaagtcggtggattacgttcagcagctgtcagcagccgttgatccaatccgagtttttttcatcgccggcaatcacgacatgatcaaaggtgtcagttatgatgaattggaaaatggccagtggccggggtatctgaacaatcaattctttgacgtccctcaaaccgactaccgaattattggcatgaacggctggtatgactacacttttgcagtgaatgaagataaaactgaagatgaatttcatcgttggaaaatggcttactggatagacgggctgatttcgcagcctatgagcgatcctgaacgggagcagatagtcctttcggaattgacccaacagctccagaacgcgcaatcagcgggcaagaaagtgattttgatgactcactttgttcccaaccaacacttcattcattatacgaatgattttcgcttctggaatatggccaatgccatgatgggcagtctgcattttcaaaaattgattgagaactatcaggttgaacgggtcgttttcgggcatattcatcaacgactggtgcctattaggcttaaggcgacgacatactataatgcagcggtgggataccacaaccatcgtcacaatgagtggcagacgaatgatttcatatctgaatgggcaaagcagttgaaaatgttccaaattttttgatgattgcgcttgacggaatcactaaaattttgtattattatattcgttggtttgatagcaacactcttttggaggggtagcgaagtctggctaaacgcggcggactgtaaatccgctccttcgggttcggtggttcgaatccactcccctccattttatttttgggctatagccaagtggtaaggcaacgggttttgatcccgtgatgcgctggttcgaacccagctagcccaattactaaacgtctgtgacgaaaggaactcgtcgcgggcgtttttttgtattttcaacgatcgaccattttgatattgcaaaattttgcattttccgctattgtcagtgttagaagaattggaatagtccgattgtaaattcaggaggtagcttatgaaaattggttttattggcgttggggcaatggctcaagcgatcattcaaggactgctgaaagcagaatttgttcctgctcaagacattttggtacacagtgctcaccaagatcattacgaaaaatatgcggctcaatatggcctgaccccgaaagaatcgaacacggcggttgttgacggcagtgatctggtggttttggcagtggtaccagccgttgtcaccgatgtggtggcggaaatccgtggtgcactgtcagccaagaagacgttgatctcaattgtttcaggggtttcgctggatcgattagaagagttgaccgattacaacctgccaattcttcgcagtctgccaaatatcaactctgaattcggtcaggggatgaccgctgttgcggctaacgagaacttaaccggggatcgaaaagcccaagccatctcgctatatcaagcaactggaagtgtgttggagcttaaagaaagccaattttcggtattcagcgccatttccggtagtgcggtagcgtacgttgacttctttatcgatagtctcagccgggccggggtcaagtatggcttcaccaaagaaatggccacccaaattgctgcccaaacaactctcggctctgcgcactcattgatggcatccaagaagtcgccagctgaaatgattgataaagtcagttcgccaggtggtgatactatcgccggcattctggcgatggaagaggctggattcctaccttctgtcatcaagggaattgacgcgacgattgccaagtcaaccggtaaccattagtcgacttgtggagcagatatgtcaacagtattaattcatgcaaagatctatacaggtaaacgaattattcaagacggctacatcagatttggtcaaacaattctcaacgttggcccaataactaattttgaacagcagccaagtgatcggatcatcgatgcttctcaacgcacaattgtccctggcttcattgatgtgcatacccatggtggttatggtgcagattccatgaatttggatcctcaagttattagccggatcgtcaacctgatggcccacgagggggttaccggcgtttttctgactaccatgactcaaagtgccgatgccattgctaagagcatgcagacgattaaaatggcggctgaaaccaacccgcgaattttaggtattcatcttgaaggaccgtttatttcacccaagtaccacggcgcccagccaacggaaaagattcaaaagcttgacgttgataaaattaccaggtggaatactctctcgggtgggctggtcaaaattttgacctacgctccggaaatgcgcgttgacccaacagccgtcagttattgtcgagaacacgggattcaaatggcagttggccactctgatgcaacctatcagttgcttaatcaagctctgcccccgcacgttacccatttatttaacgcccagcgaggtctccatcagcgagaaattggtgtggtggggtatgcgatgctttctcaagccaaagtggagttgatttgtgatgggttccatgtggtgcctgaagcggtacaaattgcttatcaaaccattggccccgatcggctggaactgattactgattccatggaagccaaagggcagccagatggcatgtatcagcttggcggccaaccggtcaatgtttttcggggaagggcaaccttggctaatggccatttagcaggatcggttctcaagtttgcggacgcttttaaaaatatgattcaatttaccgattgttcaattgcttcagccgtcaaaatgacctcgaccaatcaggcggaggaatttcacctgaaaggcaaaggattcattgagaatgggtatgatgccgatctaaatttgtttgacaatcacctagaccttatggcaacgtatagttatggcaaattagtgaataaaaactaagggagttggtatcagtgggtttaccaatttatattcaaattcataatgagattaaacgaaacattgaagcaaataggtggaaaattggtgatcgcattccctctgagcgtgagttatcgaccgactttggtgtgagtcggatgacgttgcgtcaagccattcaaaccttggtggacgaaggtattttagagcgtcgagtcggttcgggaacgtttgtggccaatcagaaagtgcaggagaaaatgtctggggttaccggcttcaccgatctgatgctggctcaggggaaaaagccttccagcaaaacaatttcgtatcacacgatggaaccgtctttgagcgagatggaaaaattacacatcagtcaggaacaagcggttttacggatggaacgaatccgttatggcgacgacattccgatttgctttgaagtcgccacggtgcctgaaaatattgtcgagggcttggaaaaatccgaagtaaccagttcgctttatcgaaccctggagcaaaagaagaacctgcaaatcggcaaggcccagcagacggtgtcggcgatgctggcatcggagcggattgctgaatatctgaacatcaaacgaggcgatgccattttgagactcagacagattacttcacttcaagacggtcgcccgttcgagtatgtccgcacccaatatgtgggcgatcggtttgaattttatttggaaaaagagtagtgggcgacgagacccgggagatgcgttttctaagggtactgggatttaaataccggttttgagggatttgaatcccagtacccttagaagtgagcatctgggtcgtcggagccgtcctcagaagtgactaaaccacaaggtgacataatatctccgagtaacgagataggcggccgccatataccaagtgccccttagaagtgagcatctgggtcgtcggagccgtcccccaagcggacaaatccagcaacacaaaaacttttcacacaaaaaccaggccatcacatttgttggcctggttttatcgtcctatgattgttttttctgatttttcttctttggccgatcgtaccgctgagcatagccggaccgaatccaatcggtgacccaggccatcacagcagacataaacgcgaagataatccaagacgtccaatcacgataaccgccaatttgacgaagaatcaccatcgacagcacaaagtaaatcacatagaagtttaatctgggcatccgcagataactggtgacataagccagcgcaaagattcccagcataccgtactgggtgtcttgaatggccgcctgatgatggagcaaattaacaatgatgccaacgccgacataaataattagaaaataggtccaaaacttcggtgaaactttcttcattgagccctcctggattttcttgaatatttttgtttaacgatctgccacaaatattttggcagcaccatcaacctgccaaagcgactgggttccttgacgacccggtacaaccactccaaatgcattttctgccaagctttgggtgctcgtttgacagttccggctaagacgtcaaatgaaccgccaattccaatccaaagggcgtcggcagcccgtcgatttttattgataaaggcttcttgcttgggataaccggttgcaacaaagaccatatccggctgggtccgtttgatatcgtggacaatgttgcgatcatcgccaaaatagccgtcgtgggtgccggcaatcgttagaaacggataattttcctggacgacttttttgagcttgcgaatcactgctggctgagcgccgacaaagtacgccgatttttggttggcgtttccccattccagtagatggacaaagagatcatatccggtcacccgttctttgagcggcgttttgagcatcttggcacccatgataatgccaataccgtcaggaacgatgtagtcagcggtcgtaatgagtttttcgtaatcgggattcgccttggcatacatgacgatctccggattggcggtgacgacaaacgtattttggtgttgattgatgacgttatgtaaaattgcttggaaatccttttcggtggtattttcaaaagggatgcccaagatatcaactggttgggtgggactttggttattcatagcagctcctttagactttgtttcatgcgaattgcaagattattttttgttaataatcggaaaaatgatagaatataaactaattatataacaaatctccggggaggatattgacacaatatgtcagaagacgataatttaacgctccataccgatttttatgagatcaacatgatggccacctactttgaaaagcatatggaaaatcgtaaggcggtttttgaagtgtttttccgcaagctgccgtttggcaacggctacgcggtatttgcaggcttggaacacattatttcatacatcgaaaatttacaattcactgatgatgatatcgattatttgcgcgaagtgacagattatccggacagttttttagaatacttaagaaactttgaatttaaaggcaccatcaaatcagcctatgaaggcgatattgtttttgccaatgaaccaattctccaagttgaggggagcttgtgtgaatgtcagctggttgagacggccattttgaatatggtcaattatcaaacgctgattgcgaccaaggcttccagaattcggacggtggtcggtgacgatccgttgatggaatttggcacccgccgagcccaggaagtttcagcagccctttggggaacccgggcaaccatcattggcggttttaacgcgacttccaacgtcttggctggtaagaagtttggtatcccaatcagcgggactcatgctcattcattggtggagtcgtttggtaatgattatgacgcttttaatgcctacgctcagacccatcacgactgcgtgttcctggtagatacctacgacaccttaaaaagtggggtgcccagtgctattcgggttgccaatgaaatgggtgacaagatcaattttgccggcgtcagactggattcaggcgacatggcctacctttccaaacgagtacgtgaagttctcgacaatgccggttatccgaataccaaaatctatgcttccaatgacttggacgaaacgacaattgccagcttaaagatgcagcatgccaagattgacgtttggggtgtcggcaccaaagtcatcactgcctttgatcaaccagccttgggcgctgtttacaagatggtttccgttgaagacgctgacggcaaaatgacggatacaattaagatttccggtaacgctgagaaggtttcgacacccggcaaaaaacaggtttggcgcattactgacagtaaagacggcaagtcggaaggcgattacgtcacactggccgatgaagatcccagaaaagaaaagtcgatcttcatgttccatcccaactatacttacatcaataagactgtcgataattttgatgcaatgccactactcaaaccaatttttcaagacggcaaattagtatatgaccagccaaacttaaagcagattgtccactacgccgaaaaggaattggcatcattgtggcctgaatacaaacgggagttaaatccccaaaagtatccagtcgatctgtcacaaaagtgttgggataacaagcgtgacatcattgaaaagattcgcaattatattcaagatatcaactactaaatttgtaatcgagggatgcatatgcgagctaaacaacaagaaattattgacgcgttaaaagtgaaaccaacgattgatcccaaagccgagattcgtcgttccgttgactttttgaaagactatctcaaaaaattttctttcctaaaaacattggtcttaggcatctctggcggccaagactcaacgctggccggcaaattggctcaattaaccatttccgagctccgggatgaaaccggcgatcctgactaccagttcattgcggtccgtctgccatatggtgttcaagccgatgagtctgatgccttggaagccatcaagtggatggacgccgatgtggttgccagagttgacatcaagccggctgttgacgccgcagtggcttcagttgaggcaaacgatatcgaagtcgccgattttaacaagggtaatatcaaagcccgtcaacgcatgatcgcccaatacgcaattgccggtgccaaatccggtgccgtggttggaaccgatcacgctgccgaagcagttaccggattttataccaaatttggtgacggagcagcagacattacgccgctttggcgtttggacaaagagcagggcaagcagctcttaaaattactcggtgcccccgaacatctttaccaaaaaacgccaactgccgatttggaagataatcgaccagcattgcccgacgaagttgccctgggtgtgacgtatcaggatatcgacgcttatcttgaaggtcgcgaagtttctgagaaggctgccgagaccattgagagctggtatgataagacgcaacacaaacgtcacaccccgattaatgtttatgacacattttggaaatagatatttagtgacttttcattagtggttaggtataattaccataaataaagggagtaaccagcaatttcgattgcgattatctcgtcaacgtgaaatactcgtatttccgggataaatcttaaatggtgagacttatgaattcttttagcgaggaatttgtgggtctcttttcttttagaggaggaagtttatgacacaggagaagaagatgttctaccaacgaacagtcgatgatgtgatgagtcaaatgaaggcccatcccactggtctgtctgatcaggaggtcaaagaccgtcgggaacaatttggtgccaacagattaacgtcaaagcggcggaccacgttaatcgagaagttcatttcccaatttaaagacttgatgatcatcatcttgattattgccgcgattattgccgggtttgccggtgaaacggtggatgctgcgattattttggccgtggttatcctaaacgcggtgtttggggttttccaggaatccaaggccgaaaatgcgattgattcattaaaagaaatgtcggcacccatggcgaccgttctgcgaaataatcaaccgatgtcaattaagagtgaggacattgtcccaggagacattgtcctcttagaggcaggagatgtcgttccagccgatgttcgactgattgaggctaattcccttaagatcgaagaagcggccctcacaggcgaatctgtgccggttaacaaacaggtggacccaatcgtggaagacgacctgccattgggagatcgaaaggatttgggcttcatgaacagcaacgtaacgtctggtcgggcaaccggcgtcgtgattggcacagggatgaatactgaagtcggcaaaattgcccatatgttaaacaccactgaagaaaccaccacgccgctgcaggagaacctgaaatcattaggtaagatgttaaccgttttgattctggtgattgccgtcatcgtgtttgctgtcgggatgtggcggggacaagagagcttgattaacatgctgctgacggcgatttccctggcagtcgcagccattccggaaggcctgccggccattgtgaccgtcacgttggcattaggaacccagcaaatggcccgccaccgcgccttgattcgaaagctgccggctgttgaaacgttgggaagcaccgatgtcattgcctcagataagactggaactttaacccaaaacaaaatgacagtggaaaaagtcttcttgaatgaaaaactgcaagattccgctgacacccatttaactttaaacgatcgattagcgcaaatcatggttttgaacaatgacaccaaatatcaagaaaatgagttggctggtgacccaaccgaaaccgctctggtgtcgttttacttacatcaagaccagccagtccaaaagtttgtcaattcccatcggcgactggccgaaattccgtttgactctgagcggaaattgatgtctacctacaaccaaatggacgatggccaaatcctaatgaccatgaaaggggcaccagatcagctgttggaacgggtcaccaagattcaagatggggacaatgttcgagacatcactgacgatgacaaacggttaattagtgtcaccaaccatgatttggcgactcaggcgctgcgggtgttggcgtttgcctaccgtcttgtagacacggtaccaactgagctcacatcagccgcccaggagcacgatatgatctttgttggtctcatcggaatgatcgatcctgaacggcccgaagttgctcaagcagttgcggaagccaaatctgcaggaatcaaatcgattatgattaccggcgatcatcaagatactgcccaagcgatcgcgaaacggttgggaatcttgggtcggggtgacaatcctggcggaaaggtcatcaatggggctcagcttgatgagatgtccgacgaccaatttaaccgggaagtcgctgacatttccgtttacgcccgggttgcaccggagcataaggttcgaatcgtcaaagcctggcagaaacagggcaaggtggttgccatgaccggcgacggtgtcaatgacgcaccagcgttaaagaccgcggatatcggtgttggcatgggaattaccggaaccgaggtttccaaagaagcctctgacatggtgttggccgatgataactttgccacgatcgtaactgcggttaaagccggccgcaaggtgtttgccaacattcaaaagtcactccagtatctgctttccgccaacttgggggaagtcttgaccttgtttgtgatgacgatgatgggttggcagatcttggcgccggttcagattttgtggatcaacctggtaaccgatacattcccggcaattgccttaggcgttgagccggcagaacccggtattatgaaacgcaaacccaggggacgaacgtccaacttcttgtccggtgggatcatgagcaacatcttgtatcagggattttttgagggctttattaccctttgtgtttatgcatttgccatcaccaacccggttcatgcttcagatgcgttggcccatgcggatgctttgacgatggcctatgcaactctgggactcattcaattgttccatgcctttaactcgaagaccatccatgagtcaatctttagaattggcatgtttaagaataaattctttaactgggcacttttgggatcggccgtgctgttgatcatgacgattgtcatcccaggattcaacgagatgttccacgtgactgagttgaccgcttcacagtggctggtcgtcgtcttcggtggctttatgatcgttgttgtttcagaagtagtaaaatacattcagagacacatttcccataaataaaattgaatggaggctgatattttgaaaccacaagatatgcagcgatatgcaaaaaccgtctcggacgtgattgatgagacgtcaaaaaacggtgaggatttaaacgccgattatgaaacactcagaaaggcaattgataaccaaacggttgctgatttgaccagtgatcagctggcgggcattcaagcccattttcaatccggaaccgataagtaccaagataacgtgaacaagcttgagcaggtggctgtgccggttaaattgttaggcaagcacaagttgctggttcgtcattatgaggactatgccaacgcctgccaggcaatgacggacagtattgacccgcaggcttcaacggtggacgttgataagttcaaccaagctgagaaggatcaggaaaatagtatcgctaaggtttccagtacgactacgcggattatgggagaaatttaaagagtgcgaagcgggctgggtgacgcggtttctaagccaactttggtttgaaccccgggtttgggtttaaatcaaagttggcttagaggttagcgtcaggcccgcgaagcacgtttcaaccagagtgcgacaagcaatgctttgacacggagagctaaggtcgctttgattaaaatcccgggtttgggtttaaatcaaagaggcttagatcgcagtgtcagttgcatcgaagcacgtttcctcaaaccaaccaaccagaaacccactccacaacaggagctcccaaaattaaaaaattaacattcaacattccgcccaaactgcagacaagtgttcctgccagcagtttgggcttttatgttcctgagaaaacctggttggagtccccggcatttgcttcattctgctataattaaacgtgacactattgatgaggtggaaatacatggacaacacattagcacataagattcagcaagacttacccaaaatccgggagaaacaaatcgtcgaaaccctcaagatgttggatgaaggcgacaccgttccttttattgcccggtatcgaaaagaacggacttccaatctggatgaagttcaaattcgagacattcaagacgctgctcatcgcatccaaactttggacaagcgcaagcaggaagtcatcaaaattattgatgaacaaaatgccttaacccctgaactgaaaaagcagattgaggcggcttcggttcttcagcaagttgaagatctttatttgccctacaaacaaaaacggcggacgaaagcgacaattgccaaagaacatggtttggagcccttagccaaatccgccatgtcgtttgcccccgatttgaagcaacaggctgcccagtatgttgacccggacaaagaactgcctgatgttgacgcagtcttcgccggagtccacgaaattatcgctgaagacgctggcgaccgggccgattttcgcgaatgggtccgccaaaacacccaacaatacggtcagttggtcgtcaaagttaaacgcggtggtaaagagttggacgaagaaggcacctaccagcagtattacgatttcaatcaacccatcaaatcaattccttcgtttagaaccttggccattaaccggggtgaaaaagagaaagtgctttcggtcaaaattgaagtcaatgaggcaccaatcatgtggcatttaaaggccaacaccgtcggcagtcatcaaggatttgctgccgatgtggttaccgatgcaatcgaagatgcctatcaccgcttcatcggaccggcaatcgagcgtgaaatccgcaagcagttgaccgaagtcgctgctgatcacgccatcgatatcttcggcaagaatttgtacaacttgctgatgcaggcgcccctcaaaggcaaaattgtcatgggatttgacccggcttatcgaaccggctgtaaattagcggtggtcgatcaaaatggcaagtatttggacaaaacggtgatctatccccataagcccgccagtgaagccaaacgtaaggctgccaaagggctgttcattgatttcatcaaccaaaatcacgttgaaatgatcgccatcggtaacggaaccgctagtcgggagtctgaacaatttgttgccgatgcaattaaagaaatcaaaacgcccatttattacgtaattgttaatgaggcaggggcgtcggtctattctgcaagtcaagtcgccagagacgaattcccggactttagtgttgaacagcgttcggctgtcagtattgcccgcagaatccaagatccccttgctgaactcgttaaaattgatccccaggcaattggtgtcggtcaatatcaacacgatgttccgcagaaacaactgggtgaacagttggacacggtggttgaaactgccgttaaccgggttggcgtcaatttgaatactgccagtcccgatctgttggtccacatttccgggttgaccaaaacgaccagtggcaatatcgtcaaattcagaaatgaaaatggcgaatttagtgcccgctctgatctcaaacaagttccccggctcggcccgaaagcttttgagcaatcggtggggttcttgagaatcatcggcggcaaaaatccactggataacaccgatattcatccggaaagttattctgccgccaaaagcctcctgaaaaagcacggattgaccattaatcaactcggcgagccggccgtttcaagtgctttgagccagcttaatttggctcaggaagttgaaagcattggagttggggttgccaccttgaaagatattatcaagggcctcgaaacgcctggccgtgacctgcgtgacgaaatgcctgcgccgttgcttcgaaaagatgttttgacgatggaagatttgaagccggggatgaaactgcagggaactgtcagaaacgtggttgactttggtgtctttgttgatattggcgttaagcaggacggtttggtccacatttccaaaatgagtcggacattcgtcaaagatcccagcaaggtggcttcggtcggcgacatcgtgaccgtttggattgactcagtggatctggatcgtcaccggattcaattaaccatggtggatcctgaaggttaggtgaacaaagaactcatgactgatcaagaactacagcaactcgttgaacatatttcgctgcaatactttgccaaaccgtttacccaccgggcctattttaatgcccgtttaaagacgactggcggccgttaccacctcaatgatcacaacatcgacattaatccaaaaatggacgacggggctgatcatgcggtattaattgggattatcaaacacgagctttgccattatcatctccatttggcaggatacagcgccaaacacaataccaagcagtttaaacagctgttaaaagcggtcggcggctccagatacgctcccagagtccagagtaccagggtccaaacgcgttatatttatcgctgtgaagactgcggtttggagtatcatagaagacgaagaatcaatctggtgaagtatgtctgcggcagatgtcgcggtaagcttcatttaatcagccaaacgcggcaaatcggagcgtagaaaggagccatcacatggcaaaaattattatcagagtacctgcaacgaccactaacctcgggtcgggtgttgattcggttgggttggcactgcagctgtattacacggtgattgttgaggaaaagacagatgaatggaaggtcaaccatgctttgggacacgacattccaactgatgagcacaacctcattgttcagacaatcttaaaggtcgattctgatattcatccgcatcaactgaccgttatctcggatgttccgattgcgcacggtttgggctccagcacaaccgcagtggttgccgggattaaaattgccaacaagttaggggatctggggctttcaattgaagatcaaattaatttgggaactaagattgaaggccacccggaaagcgttgctgctgcgatgcttggcaacttggttgtttcgacatatgacggtgaaaccgtcactgctgcgactcttcctgtcccagacgtctcggccttaatgtatattcgaccggatggtgtcagcgaggtagaaagtcgcaagaagctgccgaaacaaatcgattatgacgtggccgtccatgccagcagccaggagaatgttttcatcgccttggttgcccagggcaaatgggagcaggcggttaagctgattgagaatgatcatctccacgagccctacagaaaagagctggtcccagaaattgatcaaatccgttcaactgcccacaagttagacatctttggtacttacttgagtggtgccggtcctacggttgccacactgggtaagaaagctgctttaacccagttaagaattgatttggcacaacaaaatctaaatggtagtttgcggctgctgcaaattgatacagaaggcgcgaccgttcgcggtgaataattttcaaaaaccatttgtcaattgccaaaatttctgctataatttttaattgttgatgcggccatggcggaattggcagacgcgcaagattaaggatcttgtcgggaattatcccggtggaagttcgaatcttcttggccgcatggttaaagttcgaatcactatcatctcaatagtgattcggacttttttattgtgtagcatgtgatattttgctcaaataataagcgattggagtacaggaatgaaatattttatttttgatgtagacggaaccttgattgataccgaaaagatgtatatgttaccactacataagacactgctagaaaacggctatgacttctcttatgaagatgtcgttaagctctttgggattacctccatggacacggttcgaattcttggtgtcaagaacccggttgacattcgggaccaatggtttgccaaaattaaagattacacccaatatgcccacgtttatgatgggattgaggatgtggttaagaaactgcatgctgatccgactatcaaaaccgcgattgccacttccaaggttgaagctgaatttcaccgggatgtcacaaaatttggactggatcaatactttgatgcctttgttttttccaacgaaattaaaaaaggcaagcctgctcctgacatgattttaaagggcattgagaaattagacgctgatccggcagccaccatttatatcggcgataccaaatttgatctccaagctgctcacgctgccaacgtgcagtttgccctggccggttggcggaccaagaaaaccgcggactttgcggacacggattacgatttaaagacgcccgcagacttactaactattcagtaattccggcaaacgaaattgttattttgtgatatatttggtgtgaacagactttgtcaaatttaagaaatgggtgagtagatgatttcaattctggttgtgagccacggcaattttgccaaaagcttagtgacgaccgcagaaatgattgccggcaaacaggaacaggttggttgggtaagtctggccgcaaatgacggggtggattcgcttagtgataaggtcgcttctgcattggctgactttcctgaggacacgccaacgttgattttggcagacttgtggggtgggtcgccgtttaatgccgccgcccaatttgcagccaagaatccgcaatcgattgcattagttgccggagtcaacctgccgattctattggaggcctacatggcccgaaattcaaccctgagtgaattagttaataagatcaatgagattgctgacgattcgatccgtcagtttgaagtttctactgataatgatgacgatttgggagatgatttataatgacaatggatattcgccttgcgagagtcgacagccgcttgctgcacggccaagtggcaactttttggacacgggcggtgacgccgaaccggattatggtggtctctgattctgttgccaaagatcctttgcggaaaacattgattacccaagtggcaccgcctggtgtcaaagccaatgtcgtcaccgttaacaagatgatccgagcctatttcgactccaggtttgattccttcaacacgttgttgttgaccgaaacggtggctgacatgttgaaattagcagaaggcggcatcgatttttccaagattggcatcaatatcggcagcattgcctataacgacggaatgacgatgcttaccgacgccatttcgatgaatggagatatcgccaaacaaattcgaacattggcaaatgactttcatctagatgtctatgctcaaaaaattcctgctgaaaaaaaggaaaatttgttgaccctgttggataaaaagggcttttaaggaaccgaggggaattcaatgagcttagtttcaaccagcctggttttgttggtcgcatttgtggtcggaatggatggcattcttgacgaatggcaggtgtaccagccaatgattgcttgtacgctgatcggtttggcaattggcaacgtcggtgttggcattatgctgggcgcaattttacaaatgatcacgattggctggatcaatattggtgcttctgttgcaccggatatcgcgctgccggcagtcgtctcggctcttttagtgtgcggtccggccgccttaagtattaaacacgggattgccttagccgttccctttgcggttgttggccaacttttgaacgtcaccatccgtaaatcaattgtcaaatttatccatacggccgaccaagctgccgaaaatggtcaaatccagcagattgatcgcattcatctgctgagcttgggaattcaagggctgagagtcctgattccgacgggactcgtgatgctgatatctcctcaattgattcatcagttaatgcagcaaattccagcggggatcacaaatggcattgccatctcaattgggatggtgtcggcagttggattcgccaacctgattaacatgatggtcagccgctctttatggatttggtttatcgttggttttttaattgccatttttacgaagattaatctttttattttagcaggattaggcttggttgcggccatcagctttgtttggcttaagagtagacgacatggctcaaccggcggcgatggggaaggtaaagacgatttagatgactttgacaaagaacttgatgatttataggagttggtgggtataaatggcaaataatcaaaatatgattcacgattcccatcaaccgattcatcttcgtcagatcgattttttccggaccttttggcgctctggcactgagcagggatcgtggaactttgaacggatgcaaaacctcggatttgcttatataatggcgcctgcgattaaacgattgtatccggatatgaaccaacgtaaagctgcgttgaagcgccatttgggcttttttaacaccgcaccaattatgcagtccctgattactggagtggttttgtcaatggaagaacagcgggcaaatggtgccgatattagtgatgacacgattaatgccgttaagactgctatgatggggccaatgggtggttttggtgatccggtttggttaggcacgatccgtccggttctatcggcatttgctgccagtctggttttgagtggctatggcatgatgggaccaattctattctttattgcgtggaacgttttacggctggtctttcgttatatgactcaaatggccggttatcgtcggggagccgatattattaacctgtttaataccgggattattaagtacgttgggagcgccacttcaatgtttggcgtctttatgatgggcgtgattgttgctcggtgggtcaccgttgattttgcatcagttcggggactctttggcagttcaacgatttcccagttcgtggacacgatgattaatggcggccttaacgtgattgctccggttgccttgaccctggtttgtgtctggctgatccgtaggcgaatttcgccaatctggattattctggggctattcgttatcggagttcttggctactatgccggggtattggtttaaaaagcaaaagttacataaaattgattgtgaaaaaatagcggctcagataaaagttggtttgcttttatctgagccgctattttatggttcatgattatttaatagccattatatgtcgatgatgattgggttgccccttgaccgtcatcggtatctgtttgactggtttgaagcttggttgacttcgccaagccaagggatgttcgaatgtcgttggaaacccgcagcagttcgttttgaggaaccacttggtaggaaagaccatcgatcattgcgttttctccctgaagggtttgtgacttaatgtgatgagtggcgtcgccatattttgcccggatggcgatcatatcgtcgaaagtcatatccgtcttcatgttgccggacagtgacgagaggattgatttgtaacggggaagggaggtaatgttaagccccttcatgactaacttcttgataatctgtcgttgacgcgcctggcgaccataatcaccacgtggatcgtcatcacgcattctggagtagtccagagcttggcgaccatttagatggattttcttgcctttgacgacatttgcagccccatactggaacgtcagtggtggggtcacgtccacgccaccaaccgcattgaccattttttccaaaccgcccatgttgatgatcgcgtagaagtcgaccggaatatcgagcagattttgaacggtcttaacggctgttccggcgccaccaattgtataagcggcgttaatcttttcatatggctgggtgtcgccggggacgaccaccttggtgtcccgggcaatactggtcaaatgaatggtctttttctttgcgttgacagatgcgacaatcatcgtatccgtccgaccagtgtcgtgacgacccaaggcacctgtatcagttcccaatagcaggattgacagtggctttccttgctggatcactgacgaaacgtttcgagctttggtaacattggttgaatcgtaggtcttcttgaaggtcgacttggcactcttgtatgcgccgtatccccagaccaggccaccgcccaaggcgatcagcaggacgaaaaagatactccagccgataattcttcttcgacggtggttctttttcttatagtggggtttcttgtccgatcgacgagaatacactggttcaaaatcattattgttatctttatctgatggcatattgactcctcatttacaaaaaattctcccaaaagtatatggcagatttggacttgattgcagaaatcttcggttatttaaacattatttaataattgtaacatctgttgtgaccaacttgttcaattataccaaaaattataaccggctgtggattctaattgtgttataataattcattgttattgatttttagaattgaggaatgtttatggaagttttttataatgctgtttctggggttttaattatcctgattatgattgccttggggtttgtgttagccagaaacgattggtttgacggtaagatgaccagcatgattgcgcgcctggtaacccaggttgccctaccggcctacatgatttcaaccattatggaaaaatttactgccaagaagctgctgaccacacttcctgacttatttttcccaatcgtttcgatgctgtcactctacattgtttcaatctttgtggtcaaatttgccaagatccccaaaatgcattctgggttgttcatgtccatgttttccaactcgaacaccgtttttgttggactgccggttaacatggcgctgtttggaaaatccagtttgccgtttgtgttggtctactatatggccaacacgacattcttttggacactgggggtttatttgatccaaaaagatggcaaaggtgaggcttcatttaattggaagcaaaccctcaagaaggttttttcaccgcctttgcttggtttcatggtcggtgtcgtattggtattgatgcacgtcaccctgcctgattttttgatgcaggattttaattacatagggaatttaacgattccactgtccatgatttttattggaatttccatcaatattgttgacttaactaacgttcattttgaccgcagcaacttcttgattttgtttgggcggtttatgctggccccaatcattatgtcgctattggtcattccaacgccaatgccggtgatgatgaaacaagttttcatcatgcagtctgcaatgccgattatgaccaatgcgccggttgtttccaggttgtatcatgctgattctgaatatgcttcaatcatggtggctgaaaccacgttgttgagtctgatcatgattccggttctaatggttttggttgagaagctttaggagaaatgctacactgagtctgttcacacaacgacttgagaggttgagaagattagaaggtggcttcggtcatcttttttatggatttatttgtgaacaaattaatttgagcaaagaggatgtaaacgtgccgacactagtcatcatgcgccacggagaaagccaagccaaccgggacaacatttttaccggctggagcgatgtacctttgaccgataaaggggttcgacaggctcacagtgctgggaaagtgatcgccaaatctcagattcagttcgatgacgttcatacgtcgtttctgaaacgggcgattattaccaccaacattgtcttggatgaaattggtcaaaactttattcctgagcataaatcctggcgccttaacgaacgtcactacggtggccttcgtgggaaaaataaacttaaagtcaaagaacgagtgggcgcaaagcagctcaaaatttggcggcgaagttttaccgttgtgccgccgcttttgaccaagcgggacgaggatccccgttatgagcgttacggtgtccaaattccattgggagaaagtctggaaatggcacaacagcgattgattccatactgggttgatcagattgcgccgaacttgttagacaacaagaaccaattgattgttgctcacggaagtaccttacgcgctttgatcaaatttctggaaaatatttcagatgaagaaatccccaacgtggaggttcctaacggcaagccgattcgatacgattttgatgagcaattaaacattatcagtaaatcgttcatggagtagttcgttgcaatttaatagaccataaaaaatacgacaaatcagataacctgacttgtcgtatttatcatttaagaacaaattcttaggctaaggcacccattggatcccaaggcttcaaaacagttggttcttgtttttgggcttcaagctgttcgtcggtgaggtactttttgttgatcacgaactggtacacgaattcgttcatccagtcgtcactcatcacgaagtagcctttggtgccgactttttcgccccagctgttttcaaccttccacttggttggttggccgtcgaccagatcgactccggtaatcaccatggcgtgggtcatcaagctttcgccgtaatccaaacgttcagcttttgacatcgacaaatctgaatcgaataattcgtcgggtgcgtagaggctggtgtccatgattccttttttggtgttggaactttggccaacgtcacttccgaaccaaacggattcgccattttgcagctgtttaattgccaactttttgagttcagacatttccaggttcaaatgtttgaccggccggccattgacaacgttgcccaacatttcaattgtgtaggtcttattgaatggcttgtcatcagtgggtgagttgatcagggaaacgtagtcttccaagtttaagttaacgtattttttgaagaattcttgtggggtgatgccagcgtcaaagtgataattcttatccttgtcgcggtattcgaagtcaaatttggtggctggttcaccgagtgcgtaggtcaacatgcggtatacttcactcatcatattgtccttggtttcggcaatcttagcttcggatgccttgtcagcaaccaattcacgtaaggcaacggcgtcatgacgaagcttcaggttcaagaacttgttgagctgagatgagcgattactgttgaaggtttccggcattgccgacttgggaacgatcccatatttttcaattagggcacaaagcatatcccattgaccgccatcttgttgtggcgttgccatcaaccaggcaactttgcgtgaatctagcggctggtcggcagtttttaagacgttttccaagaaataattggccttttcaaatttatcccagaagttggtgtagttttgggatagttcgaaatcatccggaactttataagtgttcatgaggtgaatgcgcatcgtattgagggcggcaaacatccagcatcgaccactttgcttttgatcagcaacttttccagttgaaagatcgattgaaaataccgggctcattttgccttcagcggtaaagtcctcgctgctttccaaaatgccctgatgggtaactgcccgttcaatcactttcgaatcttttcgattatcaagattcttctggtacttgctgatttgatctaaattaatttctgctgtcaaaaatgatcactctccttaatagaatcttattttacgctcatttattaaaaagggctagtgagcagggtgcttttaaacggcaaacagccggctgcgaatcgttttgatcgcatttccggctgttgtcagtttttattcaattagcgggcttgaatggtctgcggtccatcttcacggccaacaatgactgtgttaaccaggtcgaggaacagtccatgttcgacgattccggtcatttggtctaattcaagcgccaaatggtggggccgttcaatttggcctaagtgcaaatcaatcacgtaattgttggagtcggttttgacgtactgatcgccattcatcctaaactttgggtgataacctttggcatcaaggcgtttaagcagttgatggctgccgtaagggatgacttctagagggagtgggaatgaacccaactcatcaaccattttgctgctgtcgacaatccacatgtttttatcggaattaattgccacgatcttttcccaaagatgagcggcaccgccacccttgattccctggaaggtccggttaatttcgtcagcgccatcgatggttagatcaatatggtcaatctcgtctaatcccttggttttaataccgagactgttggcctgttcacgggtccgttctgaggttgggacaccgacaattgagaggtgttcggacttcactcgttcgcccaaagcatcgaccatgaatttgacggtagatccagtgcccaaaccaacggtcatgccgtcttcgatgaacttaacagcggccttccccacagactgcttcaactcgtcttgatgtttcatatttgttccctcatttcaaagttgtttaaaggttttactacaccattatactgcgatactttaccatctttgtcaatctgtgcaaacagcttcacatagtttatactacaataatagaatatattgacagaaggagccagacatatgaaacgtggatttgaaattgtctcaaaatatgcagacgaaaacttaagcctgccttaccgaacgacggagaacgcagcaggatatgactttgaaagtgctgccgatatggtgattccatctatctggaaattgaattttttgaaagtcctttgggcacttaaacatgagaaaacggttcgggaagacagcattgccgaggccaaaaaagtgcttaagccattcttaattccaacggggattaagtcctatatgcagcctgatgaagtgctcgtgattgccaatcgatccagcaacccattaaaacgtggattggtgattccaaacggtatcggcgtgatcgattctgattattataataatcgcagtaatgagggcgaaatctttgttcagatcctcaactttgggatcactgacattaagatcaagaaaggcgaacggattgctcaaggcattttcctgccgtatctgttggcggaccaggacgaccaacgcaaaaaacagacccgaagcggtggttttggttcatcaggtcaataatttataagatgatgtaaagtccgccggcatttcgtcaaccttgattcataaagtgctaaaatattgatagtgtaagtataagaggagaatttagttggcaaaagttaaaacccaatttgtatgtcagaactgcggctacatttccccaagatatttgggacgttgcccgaactgtaatgaatggaacaccttggttgaagaaaccatcaccccaaaaaatagcacaatggcaacccaaagccttcgcagaaacggtatccatgacaataagcccgaatcaattaataaagttgagttccataaggacattcgtttcaaaaccgacatggaagaacttaaccgggtcctcggcggaggcgtggttccaggatcgctgatcttaattggcggagaccccggcattggtaaatcaactttgatgctgcaggtttccggtcagctcagtaaatccggtaagattctgtatgtttcaggtgaagagagtgcttcccaaatcaaaatgcgggctgatcggcttggtgtcaatggggaaaatctttatgtctaccccgaaaccgatatggatgtcatcaaagataccattaacgagatgaaaccagatgctgtcgtcatcgactcggttcaaaccatgcagattccagagctgcagtcagcgactggatcggtggcacagattcgagaagtgaccgccgatttaatgaacattgccaagggtcagggaatcactgtattcgtcgttggccacgtgacgaaaggtggtgcgattgccgggccgaagattttggagcatatggtcgacaccgtgctgtattttgaaggtgacctgcaccattcctaccggattttgcggactgtcaaaaaccgttttggctcgaccaatgaactgggcgtttttgaaatgcggactgacggcctgagggaggttaagaatccttcagaaatcttcttggaagaacggctgaaagacgctaccgggtcggccattgttgtttccatggagggaaccagaccaatcctggttgaaattcaggctctggtaacggcctcggttttcggtaatgcgcaacgaactgccactgggctggaccgcaatcgggtgtcgttgattatggctgttttggaaaagcgggcgggattgatgctgcagaatcaggatgcctacttaaaggcggccgggggcgttaaactggatgagccggccattgatttggcaattgcggtcagcatcgcttcatcctacaaaaaccgcggcaccagcccgacggagtgttatgtcggcgaacttgggctaaccggtgaagttcgccgcgttacccgaattgagcagcgggttgccgaggcccaaaaactcggtttcaaacgggtcttggttccagccaacaatcttcagggctggaatccaccaactggcatttcggtagttggggtttcaacccttgctcaagctttaaagcttgcacttggttaaaggaaaattgagagaaggcgatatttttgaaaagaaagagaattgttagaattgtatttacattagccggcgccgcaattggagccagttattttccgatgatctggctgatattccaagtccgctatgggacgctgtttaacaacactgcgacaaacgcagttgtgggtgcaattattttttattttatttcgttgttaaccggcaattatattctcaaagcggtcgatcgggtggaagtcagattgacaaagcaaagtccgttgtcgttattttttgggaccttgggcctgattatcgggctggtggttgccatcctgatttcgattgtattcttcagaacccgcacgttcttcttgaataccatgattccaacgatcttaatgttggtactgggctattttggtttccgaattggcaatacgcagagtgatcgctggcgaaaaatgtttcaatcccggcggaagtcagaaactgccaaggccggcgacgaaaagattatcgataaaccagtcgataagaactatcatcactacaaaattctggataccaacattttgattgatggtcgaatttatgacgttgtcaaaaccgggtttattgaaggcaccttgttagttcccaagtttgtgttgtatgaattgcagtacattgccgactccagtgacagtgtcaaacgcgttcgcggtcgccgcggcctggatattttaaacaagctgcagaacgaagatctgattccgatcgaaatttacgagaaggattacgaggacattccagaagttgacagtaagttgatccagcttgccaaagacgttgatggtgtaattatcaccaatgatttcaacttgaacaaagtgattcaattccaaaacgtccaggtatttaacattaatgcgcttgccaactcgctgcggcagaagattctgcccggccagaagttgaacgtgatggttgttaaaaacggaaccgaacgccaacagggggtcgcttatttggatgacgggacgatggtcgttgtcgaagacggtcgatacttcttgaatgatcacattgatgttgtcgtaaccagtgctattcaaacagatgcaggtaaaatggtcttcgcccgtccggaacattcgaccaagaacattaccgataagcctgatcagaataaagggaatggcaagaatgggtcaaataacaagaagtagccgccttccctttatttttggcgaagttcattgtacactttaaacactgacaaaattttgattatttttaagaaagaggcgttatacattggcaaacaatgcaattcgagttcgttatgctccaagtccaaccggccacttgcatatcggcaatgcacgtacagccatttttaactatttatttgcccgtcacaacaagggtaaattcatcattcggatcgaggatactgataccaaacgaaatgttgccgacggcgagaagagtcaactggataatctaaagtggctcggtcttgactgggatgaaggtcccgatgttggtggcgattatggtccttatcgtcaatcagaacgaaaagatatttacacaccattgattcaacagttgatcgatgagggtaaagcttatgaatcctaccggactgaggagcagctcactgccgaccgtgatgcccaaaaagcacgcggcgaaatgcctcattatgaatatgaatacgaaggaatgaccgaagaccagaaggcccaagcaattgctgacgccaaggccaagggtttaaagccggttattcgattccgagttcccaagaaccatgaatatgcttgggatgatatcgtaaagggcaaagtttcctttaattcggataccattggcggtgattttgtcatccggaaacgtgatggcatgccgacgtacaactttgccgttgtctgcgatgatcatttaatgaagattagccacgtttttcgtggagatgatcatgttgccaatacgccaaagcagttgatgatttacgaagcttttggctggcaggcaccaagatttgggcatatgagcttgatcatcagcgctgataccggtaagaaattaagtaaacgtgacgaatcagtcctccaatttattgagcaatatcgcaaattgggttatctgcctgatgcaatgtttaacttcattctgctcttgggctggtctccggtaggtgaagatgaaatctttaccaagaaagaattcatcaagatgtatgacgagactcgtttgagtaagtcacctgccaaatttgattccaagaagttggaatggattaacaaccagtacgttaaggaagctgataacagtacgatcatggatttggcgctgcgccagttgattgccggtgggaatattcctgaaaatcccgacagcaaaacaatcgagtgggctcgtcagttgattatgctctataagcgtgaaatgagttatatggctcagattaacgacatggcctcggtcttctttcaagagccggaacaaattgacggtgatgcattggcagagatttccaatgaaacggctccggtggtcttaaaagaatttcttgagcgaattcaaaaactcgacatttttgactccgttgaaatctttaaagtcatcaaagccatccagaaggacactaagatcaagggacgtcaattatggatgccaatccgaattgccgtgacccacgaaatgcacggtccggaactaccagagtccgttgaactggtcggaaagcaaaaagccatcgcgcatatcaaagaaacactggctcaaatcgataaagcgtaatttataaaaaatattattgattcgattggtctcgttgcatttacagcgagaccttttattatgggttatagttaaagtaataaaacaatgtgaattatgatattatttgaatataaaagataaagagaggaattcgaaatgttgcagatatttaataccctcacgcgaaaaaaagaaaaatttgaacccatcaccccaggtgttgttaaaatgtatgtctgtggcccaaccgtgtacaactacattcatattggaaatgccagaagcgcgattgcctttgatactgttcgcagatacttggagtatcgggggtatcaagtcaagtacgtttcgaattttactgatgtcgacgacaagatgattaatgctgctcgacagaaccatacgacagttggcgcgattgccgacaagtatatcaacgcatttatgcaggacacggctgcgctgaacatttcaagcaacgtgattcacccccgggccactaagaacattcctgaaattatcgacttcgttaaaaccttggtcgataaaggctatgcctacgatgttgacggtgacgtttatttccgggctcgaaagttcaaaagttatggtgccttgccacacatcaacgttgatcaattggaaatcggtgccagccagcacgttaatcctgaagaaatggctaaaaaggaagacccgattgattttgccttgtggaaaaagtccaaaggcgatgaaatttcgtgggattctccttggggaaagggaaggccgggatggcatattgaatgctcagtcatgtccaccaagtacttgggaaaaacgattgatattcacggtggtggagaagatttaattttcccgcatcacgagaatgaacgtgctcaaagcgaagccaacaccggccagacgtttgttaaatactggatgcacaacgggttcgtgacaattggtgacgataacgaaaaaatgagtaagtcactgggaaacttcatcacggttcatgatttgcttaagaatttggacggccaagtgattcggctattgatgtcgaccacccattatcgccgtccaatccagtacagtgatgccagtgttaaagaagccagcagcaacttgaaaaagctgcagacggctttcaataaccttgaatatcggcttcataatgctgacgagggtgatgatcccaaaaccgaccaggaagtccgccagattgtcgctgactttactgacgcgatggacgatgattttaacgtccaaaacgggattgccgccgtttatgaactggcaaaatttgccaacacttatagtgaacgcgagactgtcttcaaattgagcctgcagtttattatcaataccctgcgtcaattgtccggtgtctttggcattaagcttgagcaaagtgaactaaaagatgatgagatttggtcactgatccacgaacgggaacaggctcgccatgacaaagactttattcgcagtgatgaaatcagagaagaacttaaagcccggggaattgtgctggaagatacgccacagggaacccggtttagaaaggaataacaactttaatgattgataatttttcccagttaaacgggattgccttggcgtacatgggggatgccgcgtacgaagttttcattcgccggcatttgattgcccaggggttgaccaagcctaagcgcctgcagcatgttgctaccaactatgtatccgcaaaggcgcaggcagctttaattgatttaatgaaaacagatggtctgcttaatgaaaccgagtgggactatttcaaacgcggccgaaatgccaacagtcacacccacgccaagaataccgacgtgattacctaccgcatttcaaccgggtttgaagcggtctttggctacctatcattaagtgaccagacggatcgaatgaaagaaatcgcaaattggtgcattgaacaagtagaaagtgggaacctcaaacatgaagaatgataatcgtagtcaagatcatcgcagcgatgacagtcaggatcagcccgaagagtttgtgattggcagacaccccgtggttgcggcgttaaagagtgaaaacccggttaacaaactgtttatccagtcaggaatcaaagatgacgacaatattatctctgaaatcatgaaattggcgcataaaaagcggctggtgatttcaaaggttccaaagcaaaagctggacaagctttccaataaccaaaatcatcaaggggtggtattatcaattgcagcctttaagtatgcaacgattgacgatctatttgccaatgccaagaagcaagcggttgaaccgttctttgtgattctggacaatatcgaagatcctcataatttagggtcaattattcggactgccgatgctgccggggtgtctggcattatcattcccaagcaccgagccgtgggattaacggccacggtttccaaaacttcagccggagccattgaacgggttccggttgcccgcgtgaccaatttgtcggcaaccattaaagaattaaaacaacgcggaatgtgggtttttgggactgatgtttccggaactgattaccgtcgttgggatgccaaaggctcaatcgccgttattatcggcaacgagggtaagggaatttccccgctgttgaagaaacaggtcgacgaaatgttgaccattccaatggtgggagatattcaaagcctgaatgcgagcgttgcagccagcattttgatttatcagggctttaattcccgccacccattatcaaaataaagtcggtgagaaataatgaaagaagacctgttaattgttgatgcctataatatgatcggtaattggccgcacctcaacaagctcaagcaggccaaccgtttagaagatgcccgcgatcaactgctggctgaattgtcggaatataaaaagtaccgggacatcaatatgatcgtcgtttttgacgcgatgtatgttcccggtaattcaaaaagcttccgtaagtttgatatggagattgtctggaccagtaaggatcagactgccgatagttacattgaggccttggcccatcgtaagcaaaatcgatttacccaggtgatcgttgctaccagcgatcaagccgagcaatggacgatttttgctgccggcgcattgcggatccccgctagagaattgctcagagacgttcagcgtgccaaacaggaagttgatactgaagcgcgcaagatgactgatcaaggccaagtgtttcgccacacgccatttgacgccaaacagctccttgaattagagaagctgcgggacaaaatgatacatgatggtcaataaaaatattaggatgctgatattttaaaattggtataggtgggatattcactgaatgaacgctggttcgtcttgccggaagttgaatcctccgttaatgtttttcgtaatcgaatctgattaataaaaacatctgagggggataacaatatgttacctaacaatcgacttgaactgattcgtcaaacagctaaacgaaatgaagaggcctttgcgcagctatttcaccaatattatccaatcgtccgcaagtacaaacgccagtattatatcaacggctacgataaagacgacctggaccaggaagcccgaatggttctgtttcgctcggcgtgccggtttgaagctgcgagaaaagtcagttttggaacctttttcagtcacaatctgcgaaaccgcttgtttgacctgattcgcaccaacaatgcccaaaaacgggtgccggtagaaccattgacatcatttgaagccaacgagtatttttacgctgccaaaatcgccgataactcagctagtagtccaattgatgcggtgatcgtcgatgatgcactccgcaaactatacagcagctgttcaccattggaaaagcgggcgtttaacctgatgctcagtgaaaatggttatgcggatttggatcccaaagcccaaagaggaattatcaacgcttttgaacgctgccggcgcaaatttgacggcgagataaattgacggaattgtttttgaatgctattattactatgcttgtaaggaggtgccgctatggcacaaagaaaagttgctctggcttgttcagtttgcggttcacggaattatacgattcccgccaaccccaatcgaaccaaacgcttggagctcaataagttttgcaagtattgcggtaagtatactttgcataaagaaactcgttaatcatgatataaggggataaaattttgcgattaattaattttttcaaaaaagttgctcaggaaatgaaagtggtcacttggcccaacgcatctcagacgcggactgataccagtaccgttatcgggacttcaatcatcatggccatctttttaggcttggttgattggatcgttcaatgggcactccaatttctggcatagccttttgagtcaatctttgatatagttaagttgttgaaacctgcgaaaagtgtcaggtttttttatttgaactcatttaatggaattacgaaggagcagaaaaacatggtcgagtcagcagaaaagcaatggtatgttttgcatacttattctggatacgaaaacaaagttaagatgaatttggacagtcgaaaagaatctatggggatgcaggattacatcttcagaacggttgtccctgaacaagaagaacatgaagtaaagaacggtaaggacaaagttaagatggacaagactttccccggctacgtgctggtggaaatgatcatgaccgaccaagcttggtacattgtcagaaatactcccggagtgaccggattcgtcggctctcacggacaggggagtaagccaacgccattgctgccggatgaagttgacttggtactcaaacggattggcatgagttctcgccatgaagatttggatgtcaacattggcgatacggttaaaattgtcgatggtgccttcaccggccttgatggcaaggtaaccgaagttgataacgaaaagcaacgacttaaggttaatatcgaaatgtttggccgtgagaccagtaccgatcttgacttcaatcaaattgatacaaccctttaacttaaagtaggtggtcacgatggtatggatggctggtttgataattgttttgctgattgcgatggtggttgtcggccggctgattcggcttggaacgcccaaccaggttggtaatgactccgatccggcaaatgggattgaggcgattcccacactttttattccgggctactttggtaatcgattgtcatttggcagactcatcaatcgattaactcgacagtatggagctaacaaatcgatggtcatcaaagttgaccgccacggtaaaatccatgtttcaggccatctggcaaagtcaaaggtcctgatccaagttctttttgccgacaagtcttcccgcccaaggcagcaggcagtgtggctctctgaagttttggaggtgctcaatacccgctatggtgttgaagagatcaacctggttggccattccatgggctgtattaccattttttggtttctgacccatcagagcaaaatgacgcctgtcagcgtggagcatgttgtggcgattgccggaccattcaatgattcagagattgccagaagtactgataaagttgacgcttatcctttgaacgccaaggggccaaccaaacgaatgccgatttatcgggcgctgtcacaacgcgtttttgcaattccaagggacattaaggttctcaatattgccggccggatcagcaacacccagcaaaatgacggagaagtctcggtgaacagtgctttttcattgcgctatttactgcaggatccggccgcgcaataccatgaattggtgattcgaggcaaacgggcaacccatcggctgcttcatgaaaatgccattgtcgaccaagaaattgccaagtttctttggaaccaataatttaggttgttgaatgaaaatgtttatgttatattagtatggtatgtttatgcataccaacgtgggaggagaaattttgatctccatttaccacacacggacttaaggaggttatgtctcgtggctaaaaaagtagcgaatattgttaagttgcaaattccagcgggcaaagcaacacctgcccctccagttggtcctgcattaggtcaagcaggtatcaacatcatgggattcactaaggaatttaacgcacgtactgccgatcaggcagggatgattattcctgtagttatcactgtgtatgaagatcgttcattcgacttcatcaccaagactccacctgctgctgtgttactcaagaaagctgctggtgttcaaaagggttccggcgaaccaaatactaacaaggttgcaactgttaccaaagaccaagttaaagaaattgccgaaactaaaatgaaagacctaaacgcagctgatgttgaagcagcaatgcgcatggttgaaggtactgcacgcagcatgggctttactgtcgaaggatagtcaacccggttacgtcgttactttaacgatgacacactgtttcacatcgcgtgggaggttaatccgttataaccacaagcaaggaggaaaacacacatggctcgtaaaagaggtaaaaactacaaggcagcccttgaaaaggttgatgctgaaaaagcatacccaatcaaagatgctgttgaattgattaaagatattgattttgctaaattcgactcaactgtcgaaattgtgttcaaattaaacgttgacactaagcaggccgatcaacaattacgtggtgccgttgtcttacctaatggaactggtaaggaacagaccgttgttgtatttgccaagggtgacaatgccaaggcagctcaagatgccggtgcagattttgtcggtgacgctgacttagttcaaaagatccaagatggttggcttgacttcgatgttgccattgcaacacctgatatgatggctcaagttggtcgtttaggtcgagttcttggacctaaaggtttgatgccaaaccctaagactggaactgttaccatggatgttgccaaagcggttaaagaatcaaaagctggtaaggttacttaccggactgaccgtgacggtaacgttgctgttccagttggtaaagcttcatttgataccgacaagcttgttggtaacttgaagacaattgaggatgttattgtgaaggcacgtccagcttctgtacgtggtgtttacgttaacaacgtttcaatctcaacaacatttggccctggcgtcaaagttgaccttgactcattctcaagtgttgaagcttaattagtttcgatttaaataaaaaatccctaattgacggtttattactttgtgtgatagactgttagttgctgatatattcgcctaagactcaggtggcttctacgccttaatatcctgccgaggaaagtaagtttacttttttcctatgtctgggtgggcatagggattttttattaagtcccaacaaatttttgggaggtgaaattcgtgagtgaacaaactgttgcgattaaagcaaaaaaggttgcatctgttactgaagaattgaagaatgcttcatctatcgttatcattaactaccgtggtttaactgttgccgaggtaactgatttacgtcagcaattacgtgatgaaggcgttaagatggaagttatcaagaacaaggtaatggaccgtgctgctgctgaagccggttttgatgatttgaaaccaactttcaacggcccaactgctgttgtcttctcgtcagaagatcctgttgcaggacctaagattgtccacaactttgcaaagactaacgacaaacttaagcttaagggtggcgttatcgatggtgaagttgccagtcttgaagaaattactgcttatgctgcattgcctagccgtgaagaattgttatctactcttgctaacattcttcaagcacctgtacgtaactttgcatatggggttaaagcaattgctgacaagaaacaatctgacgatggcgacgctgcctaatcagaactaaataaattccaattaatggaggaaaataaaatggcttttgataaagataatattattgaccaattaaaagatgcttcaatctctgaccttaacgacttggttaagtcaattgaagacgaattcggcgtttctgctgctgcaccagttgctgctgcaggtgctgctggtggtgacagtgctaccaaagattcatacgatgttgaattaactgaatcaggtgaccaaaaggttaaagctatcaaggctatccgtgacatcaccggtcttggtttgaaagacgctaaaggacttgttgataaggttccatcaatcatcaaggaaggcgcttcagaagacgaagccaacaagatcaaggaacaacttgaagccgttggtggaactgttacccttaagtaattcattatctaatcataattgttctcagaactgtgtatcgacattgtcgatgcacagtttttttgtgcacctttgttgtgtgaaattcaattaattggcataatagacgaagagtacatattcaaaatgaaatgatggtggaacaataatgacacgtgtcaaagaattcatcgacaaacggatgaccatgatcaagctgatttttgtcttctccgttttgatttttgttattcgacagttggctaagattatccgtgaagtcaacggtgaacagttcaaaaccgttctggccagtcaaagtcgcggcgctcttttgataatgctggtggcgggctttatttcaattctgccgatgctggtgtacgactattcaattgttcagttcttacccactaaattttcccccggctacatcgttaaaagtggctgggtggtgaatacctttacgaatttactggggtttggcggattgttgggcgccagtttacgcgcgcatttctatggcaaaggggccactcgcaaacagatcctctatgcgatttccaaagttgccttgtttctgatatcagggctttctttactctgcttggtttcactgatcatgatctttggctttgggatcgggactgaatttgcccactattggatttggctattaggcggtgccgtgtattttcccggtgtgatgatttttacccaagtgactaattcacagtttttcagtgacctgtcaaccaagcaggaactggtcatgaccgccggctcgttccttgaatgggggagtgcactggggttctttattttgatcggttatctcatgaatctacctgttgacctccgattggttgtgcccatttttgtggttgccaacgttgccggagtcgtctcgatgatcccaggtggattaggatcctttgatatctttgtcatcattggactgggattcattggtgttgcccgaagtgatgcgctggtctggattctgctttaccgtctgttttattacttgttaccgttcattgtgggcaccggtctgttcattcacgatactgggtccaaactcaacacctttcttgatgatctaccacggcttctgtttcaacggattgcccaagtcttcttaactggctttatgtatttttccggaattatgatgttgttgtttgccacggttcccaatgtagtggttgttaataaactgtatgtcaaactattgccatattcgatttttttcgtcagtcatatgatgaatattatcgttgcattcctcttaatcggtttggccagtggtatctggactcgaaccaagaaggcatatgcccctacggtatttgtactgattatttcgatatttaacacatggtttaacgaggcgtttacctggcggatggtcttgctgttcgtgatcatcctaatcactctgcggctctccaaggcggtgttataccgggaccggatggctaattcctggggtgtgttcctgtttaatgggtcaatttttatcatcacatttgcaatttataccctcatcgggattgctgccaatcgaaatcttcatctccattttgataaagcctatctttttccatctgcgggtgcctggctggtcggttttgttggcttattgatcgccctggcggttctggttggcatgaatgcctacttgactgccggtcatccagaatggctgacacagcgatttgatgccgatcgggtgaaggctgtgattgataaatttggtggcaatgaggatagtcatctggcattcttgcgcgataagcagatttacttttacagcaaagacggcgaagatcaggttttcttcatgttcaagaaaattgctgacaaactgttaattatgggcgagccggttggcaatcgtgcccaatttgccgacgcgattgatgattttgtcaaggaagctgacaaatccgatctgaagctggtattctacgaaattgatgaagaattaaccatgagccttcacgaaaccggttttgactttatcaagaccggtgaggatggattagtcgacttggatcagttcaccctcagtggtaaacggcatcgcggcgaacgggcattgatgcacaaattcgatcgcgaaggctaccagtttgagattctgcagccaccgttttcagatgagttactggccactctgcggaagatttctgacgagtggttggataataaagcagaaaagggtttctcactcggcttttttgacgaatactaccttcaacaggcgccgattgctgtgatgaaagaccatgccggcaaaattgttgcgtttgccaatctgatgccggatggtaataaagtggtcacctcgattgatctgatgcgttcctccgccgatgccccatcaggcatcatggatggcattttgattaatctttatgaaatatcccacgataaaggatacaagtactttgacttggggatgtcaccgttctcgaatgtgggcacttcccgcttcagcttcactcaggagcggattgttcatctcatctatcaatacggttataagctttatagttttgagggactccggtcttataaggacaagtacgttgataagtgggagtcaaaatatattgcgtattatcgtcgaagcgggctggtttacgcggttctgcagattatcctggttgttaatcaaccgcgcaataaaaagccggcaggcctctccaaggctctctggtacattatggacgccaatcagcccaaataaggcggactgagtcgaaaattaattgattgtcggttaagtaacctggcaggcaatcgcattaaacagcagccggaaggtatttaacagatatctgccggcttttttgtgcggttaaatgtaaaaataccaacaatttttcatcaaaataatgtttactgaaatttaccttgatataagaggctttgtttggaaaccgatgaagcgttttcataaaaaataatccacattcacgaagtcttccccaacatccaagtggttcaatcatatcaaggattctcaattgtattttacaagtgagggaattgtgaagttaaggttgacaacgctgccaaaatgagttaaattttggttagtaaagtttactaaaatatatgtagagggatgaaatttatgatttctgatgacgtacaaaagctatttaatgacaagtttggttatgactcaagcaaagtatttttctcaccaggtcgaattaacctcatcggtgaacacactgattataacgggggccacgtatttccttgtgcaatcagcatgggcatctacgcagcttatggagaacgccaggataacaagatccgcatgttctccggaaacgtttctgatgctggaattgttgaagtatcgttggacaatttggcatataacaaagaagatggctggacaaactatccaaagggcatgcttgttcagattctcgaacacggctataagattggccatggttttgatctcgctgtttatggtaaccttccagatggtgccggactatcctcatcagcatctattgagctgttgactgcagagattgttaatgatgtcttttcactggggatcgacgaacttgacctggttaaatatggtcaactggttgaaaataaatatatcggtgttaattccggtatcatggaccaatttgccattgggatggggaagaaggatcaagcaattcttctggacacgaataccctcaaatatgattacgttcccgctaaattgggagatcgggtcattgtgatcatgaataccaagaaacaccgtgagcttcaagattccaaatataatgaacgccgtgctgaatgtgaagaggctttgaagcgtctccaagtgggattgccaattaaatctcttggtgatttgagtgaaagcgaattcgatgaaaatagttacctgatcaatgatgatgttttgattcgtcgtgcccgtcacgcggtattcgaaaatcaacgaacccttcaggcaaaggatgcgctggtcaataatgacttggaaacctttggtaaattagttaatgcatctcacgtttcactgcattatgattacgaagtaaccggtaaggaactggatacattagctgaaactgcttggaaacaaccaggcgttgtcggtgcgcgaatgaccggtgccggatttggtggttgtgcaattgcgattgttgaccgtgatcaagtcgatgcctttaccaagaatgttggcgaagtctatgagaaagagattggccatccggcagaattctacattgcagaaatttcagatggtcctaaagagattaagtaacgaattgattagaaggaggatatttaaatggcaattttagtactaggtggagcaggatatatcggttcgcacacggttgatcgattaattgaaaatggctatgacgttgcggtggttgataatttggttaccggccataaagcagccatcaatcccaaggcccgtttctatgaaggtgatgtccgtgacaaagactttatgaatcaagtctttgataaagaagagattgaaggggtcattcacttcgcagcattctcagttgttcctgaatccatggaaaagccattgaagtactttgacaataatactggtggcatgattagtttacttgaagtgatgaacgcccataacgttaagaagatcgtcttctcgtcaacggcggctacctatggtgaacccaagcagattccaattaaggaaactgatccgcaagttccaaccaacccatacggtgaaagcaagttggcaatggaaaagatcatgcactggagtgatgtggcttacggcattaagtttgtcgcccttcgctactttaacgttgcaggtgccaagcctgatggctcaattggtgaagaccaccaccctgaaacccatttggtccccatcattttacaagttgctgccggcgaacgtgatgagttgacgatttttggtgacgattatgatacgcctgatggcacgaacgtcagagactacgtccacgtgcttgatttggccgacgcgcatatcttggcactgaagtatctccaagctggtcatgatagcgatgcctttaacttgggctcatcaaccggcttctccaacaaacaaatgttggatgctgcccgtgatgtgactggcaagccgattccagccaaaatgggtccccgtcgtgcaggagatccaagcacgctgatcgcagcgagtgacaaagcccgcaagattcttggctggaagcctcaatttgacgacgttcacgaaattattaagaccgcctggaattggaaagaaacccacccaaagggctatgacgatcggaaaggaaatcagtaatcatgagccaatcagcagttgaaaagtttgtcgatttaattatcaaatctgattcaccatattcagatgttgaccggatttatgtcaccaacctgatttttagactgatcggtgatggttttggagagccaaccgaggattcatcggctgtcgacttagccaacgatctggtggatctcgccattgaacatggtaaggtcgaagattcgattaccaacagggagattcttgaagatcaactgatggacctgttaacaccaattccatcaactttgaatcagatcttttggaacaagtatcaacaatctcctgatgcggccaccgactacttctatcatatgagccaagacaatgattatattaagactcgggcgattgccaaaaatatttcatatgaaactaaaactgattatggcaatctggaaattaccattaacctgtcaaagcctgagaaggatcctaaggcgattgctgccgctggccgggcaaagtcaaccagttatccggtcggcccgttagccattgaaaatgaaggctatctcggccgcctaggctatccagcccgaagcaatcaccgggttattcggatgatgatcaacggcgaaccgtggggattccaatactcaccttatgcatactttggtgagcatgcgatttttcttaaccaaaagcacgtgccaatgtcaatcgatcaacggacatttgtcaatttggttgacattatcaagcagtttccacattactttgtcggcagcaacgccgatttaccaatcgttggtggttccttattggcccaagatcactatcaaggtggtcgccacacgttcccgatgatgaaggccaagattgatcgaccagttgatttggggattgacggcttgtcggcaggaattgtcaaatggccaatggcaaccattcgcctggtcagcaaagatgccaataaagtggtgaatgctgccaatcggattgcagaaacttggaagaactactcagatgagtcagttgacattcgggcctacacggacggaacgagacatcatacggtaaccccgattgcccgaatgaatgatgaccagtttgagatggatattgtcttgcgggacaatcaaacttctgacaagtatcctgatggtattttccatccccatcaagatgttcaacacatcaagaaggaaaatattggcttgattgaagtcatgggccgggcaattttgcctgctcgtctgaagaccgaaatgaaagaagtcgaaaagtatgtcttgggtgaagataatcagattgctgattatcataagccttgggcagatgaattgatgaaacgtgaccactttaccaaggacaatgttgaagaggtagtcgaccaagaagttggcaaagtctttggcagggttctggaagatgccggcgtttacaaatgggacgacaaaggtcaagcggcctttgatcgtttcattgagcaacttaaataatttggaatagggttggaaataagcgtccttgatttccagctctatttttattgtcaaaagggattcactcaactttggcctctgcaggtgggcttggattttgtttcaacaattatttttggtaaaatggaagcggaaccaaatttaagctgaaatcactaggaggcaactatgaaatttattgtatacaatgtccgagatgatgaaataccgtttattgagaagtggggtaaggatcacggaattgaagtgaaatacaccaccacaactttgaatcaggagacggttgaagaagcagccggctttgacggtatttcctgccttcaaacgattcaatattcagctgaattatttgagtcatttaaacgcttaggaatcaaatacttatcgctcagaaatgtcggggttgataacattgatttaccagccgctaaagccaatggcgttaaaattaccaatgtgccggcgtacagtccagaaagtattgctgaatttgcagtgatgatgtcactgtacctctctagaaaagtgggctatatgcgtcagcagttggatcaaaagcatgaatttcatttttcacccaacttcatgggccgtctgatcagtgaacagaccgtcggggtgattgggaccggacggattggccaggcagctatcaagctgttcaaaggcctgggggcaaaggtaattgcctatgacaagtatccgctgaaaaataccgacaattcgtttgtatatgccaaaagcttggaacaaatttatcaagaaagcgatattatctcaattcatatgccggcaactgatgataattatcatcaatttaaccatgaggtgtttgagcaaatgaaagatacggcaattctcatcaatactgctcgcggttcaattgtcgataccgatgatttgatttttgccctccagagcggtgaaatcgctggtgccgggattgatacaattgaaaatgaatctgctgatctccaagactccaggtccaccaaaaaagtcaatgatccggatgtattgaagatggcgttgatgccaaacgtcttgattacgccacattccgcattccataccagtgaagctgtgaaaaatatgattgatatctcactggggaatcttgagacgatggttaatggtaagacaccaaaggatttggttgattagtaattgttaaagacaaataaggctgatgcatccccgctgggatgcatcagccttattgagttactgtgaggtatttattaaatatcgtaatctgagtctttcatcgactccacgttccccaagaggtagccattaccaacttgtgagaagaaatcgtggttggcagtcgatgttgagattccgttcatgaccactggattgacatcttctgctgtgtctgggaagagcggattctgacccaaattcatcaacgctttattggcattataacgaatgaaggtgaggacatcttctgtccagccggtttggtcgtacagaatatgggtgtacttttcttcgttaccatacagtttgtacaggaagtcatagatccagttcttcatgtcttcttgtttttcctttggcaattgattgtagccaatttggaatttgtatccgatgtaggtgccgtggactgattcgtcacggagaatcaatttaatgatttccgccacatttggaatcttgttgtggccaaggtaccaaagtggggtatagaagccagagtagaacaggaaagtctctaagaagacactggcaacctttttcttgagtgggtctggttcattggcataaatgtcgcgaattttgagtgctttgttctgtaagaattcctcactgtcactccagtcaaaaatctcatcgatttgatcaggggtgttgagggttgaaaagatcgaggaataactcttggcatgaaccgattccataaattgaatattgttcaaaacggcggtttcgtgttgagtctgaacatctttccgcaacgatgccattccttcttgggactgcagtgtatccagtaaagttaagcccccgaagacgtgaccgacaacccactgatgatcttgatccagcgtccgccagtccgataggtcgtttgacaggggaattcgggtatccagccagaattgctcggtcaatttttcccaagtggccttgtcgatttggtcatcgatggcgttccaattaattgctttataattctcagtcatgaatttctcctttaaataacgcagctttcacattcgttggaaccaacttcttgttgatcgtccgtgaaagttcgaatatagtaaattgacttgacgccctttttgtatgcgtagtttctcaagatattgagatcccgggtcgtcatcttgtctgtccggccgtttttccattcatacagaccttctgggatggttgaacgcataaagagggttaatgccattccctggtcaatatgctgctgtgcggcagcatagatgtcaatcaccttacgcatatccatgtcataggctgaagtatagtaaggcattgtgtcatttgaaaggtatggggctggataataaatcttaccaatcttggattcctgacgctcttcaattcggttgataatcgggtgaaggctggcagtcgtatcgttaatgtaagaaatagaaccgtttggcgcaactgctaaccgattttggtggtataggccgtctttcatgactgattccttgaggttttcccaatcttccttagttggaatccaatcgtctttgaacaaagcttttacttcggcagattttggtgcaaatgatccgtccagatatttgtcaaaatagctgccgtcagcgtacttgctgttttcgaagttaacgaaagtttctttgcgttccttggcgatcttgttagatgcaactaagctccagtagtttaacagcatgaagtagacactggtaaattcaatggattcaggcgagccgtagtacatatggtgcttggctaagaaactgtgtagtcccatgccgccaaggccaattgaatgtgattctttattgcctttttgaattgaagggaccacgtcaatgttggagtggtcggtgacaaatgttaatgcccggaccatgctttcaactgaatggccaaagtcatcgccagccatcatattgttaatgttggttgatcccagattgcaggaaatatccttgcccattttgatgtaatgctgctggttatcaacagtggatggggtttgaacctggaggatttctgaacataagttactcatcacaattcgaccggcaatcggattggagcggttggcagtgtcaatattaatgatgtatgggtaacctgattcttgttgcagcttactgatttcagtttccaaatcacgagccttgatcttctttttggagatcttgtcattggcaaccaaattatcatattccttggtaatgtcgacgtaagagaatggcacgccgtattcgcgttccacatcataggggctgaataagtacatgtcagcatcggctttaatcaattggtagaacttatcgggaacggtcactcccaatgataaagtcttgaggcggattttttcgtcggcgttttcctttttggcacccaaaaattcgatgatgtctggatgaaagactgagaggtaaacgactccggcaccttgacgctgacccaactggttagagtatgaaaagctgtcctcaagcaatttcatcaccggaaccacaccggaagcggcaccttcgatatgtttgattggggcaccggcttcacgaagattggaaaggttaattccaacgccaccgccaattcttgacagctgcagggccgaattaatcgtccggccaatcgtattcatatcatcggtggtttgaatcagaaaacaagatacaaattcgccgcgattttcccggccggcgttcaagaagcttggtgtggccggttggtaacgctggtggacaatttcgtcggccaaatccattgccaactgttcatcaccgtcagcgaagaagagggcgttagcggcgacccgatccaggaagctttccagatataaatcattgtcgttggttttcaaagcatattgggcgtagaatttgtaggctgccataaatgatttgaagtggaaatcctgatcgtttaagtactggtacaatttttcgataaaggatagttgatatttatgaataaaatcggcttcgtaatagttgtttttgatcaggtaatcaaaccgatcgctgagactgtcaaacttcattaagtttggctgaacgttttcttttaaaaaggcttcgagggcttccttgtccttttgcagtggaatctgcccgttgacggggatgttaatttcgttgttcaaatcaaagtaggtaacatccttaaggttgtgaagtgacatatttagtaccacgctttcttataattgcgaataaaaggggcgagaccgtttgtggtttcgcccgctaatctgaaatcaatatgttagaatggatgaaggcaattagccggcaatcgattggagctgatcaggtcgaaagccgctgaatgcttgcttaccatcaacatcgacaacggggacagccatgaaccctcgttgtttcaggtaatcaatatattgtggttgctcgttgatgttgtgttcctcaaattgaacgttatgttctgaaaggtaacgttttgtcattttgcattgcatacagttgttctttgaatatagtgtgattttagccattgttaacacttcccctgtttcgttaaaatttaatttatgattcaagtttacactaaatagtgtgaaatgcaacgattaaaacacaatatattgtgacaaaactaattgtaagcaccaaatatagataacgattataaaagatcattttaggagaattttatgtcagaacaatcattttattattcaaagaatcccaacgtgaaatccgatccgattacatggaactttgcgttgcttggaaacaacttagtgttcacttcagataacggtgtgttctctaaacatacggtcgactacggcagtcgggtgctggttaatcatattaattatgatctcattcctgacggcaaactgttagatatgggaaccgggtacggtccgattggcatttcaattgccaaagcatttccggatcggcagattgatatggttgacgtcaatgaggtggccttggcgcttgccaaaaagaatgccgacgccaatcgggttgataacgttcatatttttgaaagtaacatatatgaagcgattactgatcagtatgctgccatcgtgaccaatccgccggtgagagctggcaagaaagttgtcgatgccatgatctccggggcagtcgatcacttagttgatggcggcaccttgacggtggttcttcaaaaaaagcagggcgcaccatctgccaaaaaattaatgaccaaactatttggtgactgtcagattttaaaacgggacaaaggttactacattcttcaaagcatcaagaaatcgtgagggttcgaaatgtttcaagctgatagtcgttttatgaaagctgcactggtcgaagcaaccaaggcctacctaattggtgaagtgccgattggcgccgtggtcgtccatgacgggacaattgtcgggcgtggtcacaatctaagagaacatttaaatgacggtacggcgcatgctgaaattttagcaatccaagaggcttgtcgaacactgcggagttggcggctgattgattgcgatctttatgtgacgattgaaccgtgcttgatgtgtgccggagcgattattaattcgcggattgaaaatgtttgttttggctctcgtgatcccaaagccggcgcaaccagaagtttgtacgcagtgttggaagattcccgattgaatcatcaagtcaacgttgttgaagggctttatgccgatgcggcatcgcggatcatgaaagatttcttcaaggctgcgcgcaagaaaagaaagaataaggctggcaattctgaatcatttaagttatgatagatattgccgcaaggccctgaggcaagggtcgggttacgaactgtgtcaggtccggaaggaagcagcactaagtatcatcaaccttgtgcctcttgtacatagaacttttgctctcagcaactttgctgagggcatttttttggagaaatttcttgaaagtcagacggtcgttgattgcactctggttagattcatcatataattatttagacgtttcattgaacgattttaagaattcggcattctattttggaggatttggtaatgagctatcaagcattatatcgggtttggcgaccacaaagatttgatgaaatcgtcggccagtcgattatcaccagaacattaaaaaatgcgctaattactaaacaaacgagtcatgcctatttgtttaccggtcctcggggaacaggtaaaacttcggcagccaaaatttttgccaaggcagtgaactgtcactacttaaaagatggtgagccctgcaaccagtgcgagacttgtaaagcaattaatgagggcagtttaaatgatgtcattgagattgatgccgcttccaacaacggtgttgaagaaatccgggatatccgggacaaggcgaaatacgcccccactcaggctgattacaaagtttacatcatcgatgaagttcacatgctttcaactggggctttcaatgccctgctaaaaacgctggaggagccgccggctaacgtaatttttattttagcaaccactgaaccgcacaagattccggcgacgatcatctcccggacacaaaaatttgactttaagcggattaaacctcaggatattttggaaagaatggaatatatccttgatcaaaaaaaggttgagtacgacgacaaagccctgaaattaattgccaaagctgctgagggcgggatgcgggatgccttgagtatcctcgatcaggcgatgtcttatggcgataataaaattacttatgagaacgccttacttgtgaccggcagcgtgaccaatgaattattaaccacctatatgcagcaggtggtcaagaaggacaccaaaagcgcgctgattaccattcaaaaaatattggatgagggtaaagacgctagccgattcattgaagatttgaccagttactgtcaggatattctgttatatcaacaggatcccggaatcgttgaagaaatggaactagggatcattgatgaccagttcaaggccttaagcggccagatcagcgatcaagcgatttatcagatgattaatgaattgaatgcgatttctaattcattgcggtttaccgctcatccagatgtttatctggaggtcttgacggtcaaaattacccatttggatgccacaaatcagcccaaggctgtttcagccccacaatcacagcagtcggctaaaacggccgtgcccccggaagttaatgcggaaattcaacaattgacgcagcaagttgccgaactcaaggctgaagttgccgatctcaaacgggagtcgacacctcagtcaccaacagtcagcacaccggagcctgccaaagtcagtgaggctcactcaatggacaatcacattgagctggctaaaatctatccaattttgggtaaagccacccggaaacaattaaatcaatttaaatcggtttggccggacttgatggatgccctgtcggtgactcaacgggctgtcatgcacgtgtcatcgccggtggctgccagtgccggcggagtaatcgttgccttcgaatacccatttttgtatcagaaggctcaaggtgacactgatttgaaggatgctcttgaaaacaatttggatcgcattgtgggaaaagcccctcaaattgtgtttgttccggaaaatcagtggcccgatattcgccgtgagtatttggccagtcacaaagacaagataaaaaagactggctcccagtccaaagaagcaaacgacccaaaagctgaaccggctgatgacgatccggaaccgtcaaaagaagagccggacagtcaaccagtcgtcaagaaggctgccgaacttttcggcaccgacattttagatatcaaagatgattaattggaggaaaagaaaatgatgaacggtatgaacatgaacaagatgatgaagcaaatgaaaaagatgcaaaagcaactgggtgaagagcaggagaatcttaaacagcaggaatttaagggcgttgcaccggataacatggttgaagtgacttttggcggtgacaaaaagatgaaggatatccagattaagccggaagccattgatcccgatgaccccgaaatgttgggtgatttggtattagccgctgttaatgatggcctttccaaggttgataaagcgactgaaagcaccatgggtaaatacaccaaagggattccgggaatgtagtctgcacgaaaaaaggggaaagtatgcaatatcctgaagcaattgcaaagttaattgatagttatatgaagttaccgggaatcgggagtaagacagctaccagacttgctttttacaccgtcgatatgaatgaagatgatgtcaaagcgttttcaaaggcgctggttgccaccaagaacgaccttcattactgttcgatttgtggtaatctaaccgatgaagatccctgtgaaatttgtcgtgataaaacccgtgatcaatcaaccatcctagtggtggaagaacccaaagacgtgatggtaatggaaaaggtccaggagtaccacggcctttatcatgttttgcatggggtactgtcaccaattgaaggcaaaggacctgaagatcttaatatcagctcactgatcaaacgactccagcaaaataaagccgttaaagaagtgattgtggccaccaatgccaccccagaaggcgaagcaactgcaatgtacttgagcaagttgattaaacccgctgggatcaaagtgactcgtttggctcacggattatcagttggatcagatatcgaatatgctgatgaagtcacgttgtttaaggcagtccaaggacggactgaaatttaatttgacaaggtggggttttcgaatgttttttaatcgattaagacggcaaaatgttaaacgtgaatacgacgatcgcttgttggagttaatcaacaatttgaaagaagagtgggatcatgctgctcaaacccaagaagcggttgctgacagtgatatggagatggagcaggaaactgcgttggcccgtcaaaaatatttcttcatatataaagaggcacgaattcgaaaaattaagaattaccaaattcagccctcggttatcagttatgatcatgacaattttgaataatccggaccacctaagcgttggctgaatcgacaggcaaacgaacagcaagtacaattaatttaaattaaaagtgagggaattgttttgaatggtaagtttataacctttgaagggccggacggcgcaggcaaaacttccgtgatgaatcgcgtgattgaagtttttaaccaggaaatcggcgatcaactcttggtcacccgagaacccggtggcaataaaatctcggaagaaatccgcaaagtcattctcgaccgtgagaatactgagatggattatcgaacggaagccttgctttatgcggccgctcgtcgccagcatctggttgaaaccattttacccgcactcaagcagaacaaattggttctgtgtgatcgttatgttgacagttcagtagcttatcagggggccggccgtcagatcggtatggcacaagttgccaagatgaatgagtttgcaacggaaaagttgttaccgttcaaaacgatctactttgatatcccggttgacgttggcctggatcggatcgccgaacaccgcgaccgcagtaaaattgaccggttggatgttgaaaccaatgaatttcataaacgggttcatgagggttatatgaaggtccgtgacgaaaatgccgaccgatttatcagtattgatgcaactcaaccgattaatcgcgtcgttaatgatacaattaagattatccaccaaattgccagtgagtattttaaggagagttgattatgaaattagtcattgcgatcgttcaagacaaagatgccaacaagttgcgatcagttttcgttgctcacgatatcatcgcaacccgattctcgaccaccggtagctttctgcgagcaggaaataccacttatttggtcgctgttgatgattcaaaagttgatttaactttgaaactaatcaaagaaacctgttcggctagacaacaatttatgacaccgccggtcagcttgaacggtgatacggcagaacatacctttccaattgaagttcaagttggtggtgctacggttatgattttgccaatcgaagattttaaacagttctagaagggaacgttatggaacacgatattgttaacgttgctcaaactaaacagccgaccatctttacccaattcatgaatttaatcaaaaacaatgaattgtcacacgcatacttgtttaccggcgaagatggtgccggccaattttcagtcgcaatgggagttgccatgcggcttttttgtacgaatgttcaaaatggcatgccctgtggaaaatgtgccgaatgtgtgcgaatcatgaatcatgatcatccggatgttgtcatcaccgaacctgatggtcaaagtattaaggttgaccagattcgccacgttaaaagtgaatttaccaaaagtgccatggagggatccaaaaaggttttcattatttcagaagccgaaaagatgactaccggggcagctaacagtctcttaaagtttatcgaagagcctaccggcaacgtggttagctttctgatcagtcagaatcgcaatctggttctgccgacaattatttccagaactcaggttgtggaatttcccagcctcagtaaaaagcagatggtccaagaattacagaatagtggcgtcaagccgagtgaagtcaacttgatgatttccattaccaatagtttggatcagattaaagagctgtccaaagatgattggtttgcctcgatgcagcggcttttggagaaatggtttacctatttggtcaaagaaaacaacatggcaatgcctttcatccaaatgtctttgatgcctctaattaccaacaaggaccgtcagcggattgttatttccatgatgctgagtttgtttgacgatgttttggaaatgaaatacgggactttggcggatgatcgggtgaagtacccggcgattcttgcacagaccaaattggcggccaatcagtggaataacgatcaactgttaaccatgcttgacgagctgcttgatatgaatagccggatggcagttaacgtcaattttcaaaacataattgaagctttgacactaaagatactcgcaattgggcaatcatagtttactaaagggtgataaaatcgtggacagtcaaaacttatatgatgaattaaaagaaatggatacacagctcagtgcgagtgctgaaaatttttctcacctgcatgaatcacttattgggttgatggaaaaaaacgctgagctggagattgaaaatcagcatttgcgcgatcggattaacgaaataaccgaaaaaatggacaataattcgccacgtttgtcaaagtctcgcaagaatctcgaaaaactgtacaatgaaggatttcatgtctgcagttcttattacggtaagcgacgggagaacggtgaagattgtattttctgtacggacattatctatggcaaacgcgattaagaggtaaacagtggacacacaaaagagttttgacacattaagtgaatatggcacgctgtacttggttccaacgccaattggcaatctggatgatatgacttttcgggcggttaaaattctccagtctgcagatttgattgcggctgaagatacccgcaacacacagaaactgttgaaccatttcgatgtccaaaccaagcagatcagttttcatgagcacaatactgccgagcggattcccgagttgattagcaaactcaagcagggaatcacgattgcccaggtaagcgatgccgggatgccgtcgattagcgacccgggccatgaattggtggttgcctgtattcgtgagcatattaacgttgtgccgctgcctggcgccaacgccgggatcactgctttaattgcttccgggcttttgccgcagccattttatttctatggcttcttatcaagaaagccgaaggaacagcgagcagaaattgatgagctccgtaaccgagaagaaacaatgattttttacgaggccccgcaccgattgaaaaaaactttgaagaatttattgactcagctcggaggggatcgtcaggcagctctctgccgtgagttgaccaaaaagcacgaagaatttattcgcggaacccttgatcaggtcaatgaatgggccaattcaactgaaattcgcggagaatttgttattatagtgtcaggaaatgcccatccacaaacgcagggagatgatccgcttgccgggatgagcgttgatcaacaagttgacttttacatcgaaaatggtttgagcgttaatgaagcaatcaaaaaggttgccaaagatcatcatttaaaaaaacaggtcatctataaccagtaccatgacatcaaatagaaagaagtaatgtccatgcctgctcacagttttagcgaattgcatacgattccgttttacgagtgtaacgtcaacaaccggatttcaattccaatgttgatcaatattttgattttggcgtccgaacaccagaacgaaaatttgggacttgatcaaacttatttaattgatcattatggagttggctgggtggttacttcttactcaattcatatcactcacttgccacgcaaagattcagtcgtcaaaatgacaacccgaggcacgtcatataatcgttattttgcctttcgggaattctggctgcacgatcaagctggcaacgagctggtcaaggtggagagtatctgggtgttaatgaacgaacagacccgcaaaattacaccgattgacgaaacgattattgcgccatatcagtcggagaaggtcaaacgggttcccagattggcacgtcctgaacgaattgaagcgactgatgatgttagcgcaaaggaataccaagttcgttggagcgatatcgattttaatggccacgtcaataattccaggtatccggagtggatgttggattcattgccaatggactttttgaaccaacacgaacccactaacattgacatccgctttgagaacgaggttaagtatggcaatcgggtcaccagctcagtgcttgttgattcttcagataatgctaaaattaaaacagttcacgaaattaaatcaaatgatgttctttccgcaagtgccacaattgtttggaaagatatcaaagcaaagggtaacgattaataatgaaaatcttagcaattaacacctcaaatcaaccgctttcagttgctgttttggataatgaccaacttttggcgcaaacaaccatcaccactcatcgcaaacatgccgaattcttgatgccggtcattgaagacttggtgcaaaaggccgatttgaagccaactgatttggatcgggtggttgtcgctgccggccctggatcttacaccggcattcggatggctgtcactgcagccaaaacgattgcaagcaccttgggaatcgaactggtaccagtttccagcttgttaaatcttgccttgaatgttcaagaagaagatgtgctgatcaacccgatttttgatggccggaatcaaaacatgtttactggattataccgctaccgaagtcgtcggattcaaaccgtgattgaggatcagcacaccaatctaacaaaatggttggaaaccgttagtcgttatgatcaacggattatcattttaggggataccgatccatttgaaagatcgatgcgcgacgttctgcataaccgtctggtggttgccaatccttatttgggaattcccagtgcgaccttactgggcttgtatggattgagtcagtcaccagtaccggtcgttgatgcggttgtcccacgatatttgcggttaaccaaggctgaggctgattggaaaaaattacatcctaatgaggatacgcatgactatgttgaaaaagtttaaagagtggtttaaccaacaattttataacaaagaggttcagcttcgcgagagatatctcgacatcaaaaaccacgatgttgaaattaatggaactgagtactttttggccaaggcgatgattccggatattcctgagattctagggattgagcgggcggtttacggtggtcagactccgtgggatgatcgggcctttcgaaccgaactgatgcgcaaaacggatcgcctctatttagtgttgcgtcgaaacgactggctggtagcgtttattggctgctcgctaaacgatcatactaaggactgtcatattaccaacgttgcggttgccccaaatttccagaatcatggcttggggtattttttggtgacaacaattatcaaaaaggcccgtcaattggaatatgccaaggtgacgcttgaagtgcgcgtcagtaacacccgtgcacaaaaattatatcgggatattggatttgttgataacgggattaaaaaagattattactttaacgatcgtgaagacgctttaaatatggttttggacatcaccaaaatcggttaaaagggatgggatgaattaagtggctagagatttagtacttgcttttgaaaccagctgtgatgaaacgtcggtcgcagtgattgagaatggcaatcgaatactttcaaatattgttgcaacgcaaatcaagagtcatcaacgctttggcggagttgttcctgaagttgccagcagacaccatatcgagcagataaccggctgtattggggatgcattacgtgaggcggacgtttcttatgatgaactgacttcagtggctgttacatacggtcctggcttagtcggtgcgcttttaattggtgttacggccgctaaggcggttgcctgggcgcacaatttgccgcttgttccagtgaatcatttagctgggcacatttacgctgcccggctggtcgaacccattgagtttccagcaatggccttggttgtttctggtgggcacacagaattggtttacatgcctgaggaaaaccaatttcaaattatcggcgaaactcgtgatgacgcagccggtgaggcttatgataaaattggccgggttttggggattaactatccggctggcaagccagttgatgaattagctcacaaaggtcaggatacttttcattttccacgggcaatggacgctgacgataattttgactttagtttcagtgggttgaagagtgcctttatcaatacggtgcaccatgctgatcaaattaacgagaaattgagtcgtgaagacttggccgctagttttcagcaagccgttgttgacgtcttggctgacaaaaccaatcgcgcgctcaaagaatttccggtcaaacaattaattcttgccggtggggttgctgccaatcaaggtcttcgggagcggttaaccaaagaggttgccgcgtttgccgataccaaacttgaattagtgccactgtctttgtgtggcgacaatgctgctatgattggtgctgccggtgagatgctgtatcggcatggtgttcgtggtgatgccactttaaatgcagatccgggtttggagtttgattggctggcagatgaggctaaataattgaccaattttttgaggtgattatgaaatcgtcagcgatcctgtgatgaaggataattcaataattagatcaaaagcagcctgagcagaaggataaaatccttttcctcaggctgctttttaatttagtgggttgtcgccaattggtaaagtagacgatgtgaatcggatatcttttgcctcttgtggattatgctactcactatcttcgagcttcaaactggccgtttcccaactggactcagtttctgtgatttgggcagtcacctgatcgagctgctgttgaagatcttgcaactttcccaggtcgttaaagacgtccggcttcgtcatttctgcttcaatttgatcctttgattgtgtcaattcatcaagtttggtttccagagccttgacttctctttcaagtttgcgatgttctttttggttttgcttattaatctcgtagttctttttatcggtggtcggcacggcaactggggtcggttggcccgccgccttcttttcagcctcatgagccttgatggcttcttgctcatcttttttatcgacataataatcataattcccaaggtaaagggtggtgccatgtcgggacaattcaacgaccgctgtggcaattttgttgataaaataacggtcatgggaaacaaagagaatcgtgccgtcgaattgattgagcgctttttccaacacttcgcggctgtcgatatccaagtgattggtgggctcatccaacattaaaaagttgttgtgctgcatcgccaacttggttaggagcaatcgtgccttttcaccgccggacagatcatggaccatcttgctcacgtcgtcaccggagaaaaggaagctccccagaatgcttctaatatcgccttccggggtcgttgggtgatcatcccatagttcctcaagaacggttttagaggcgtgtagtgaggcttgttcctggtcgtagtaaccggtatcgacgccagtaccaaactgcgccttgccctttaaaaacggaatgatgcccaagatgctttttaagagcgttgatttgccgacaccgtttggaccaacaattgcgatcgcttggtgacgtttaacgtccagattaaccggctcacaaaggaccgtactgtagccaaccgctgcgttggtaacgttcaggacgttattgccgcttttggattttggtgaaaatgagaagcgggcagtttttgaatcagccgtcggtttttgcagcttatccattttttcgagttgctttcggcgggcctgtgcctgtttggtggtcgatgctcgaacgatatttttttcaacgaaggtctgcagtttttgaatcttagcttgctgcttgtcatattctttccattcttggtcaatcaactggtcttttttcttggtgtagtccgtgtaattaccagtgaagtggtggagggtaccttgtgacatctcgtaaacctcagtgacaattctgtccaggaagtaacggtcatgtgaaatgatcagaagggcaccactatagttttgaatataaccttccagccaagtgatcgtttccacatccaaatggttggttggttcatctaaaattaataattcgggcttttccagtaacagtttggctaaggcaagttgagtcttctggccgcctgacaattcattaattggccgatcgtagtcagcttccccgaatccaaatccgtggagaacaccacgaatttcagcgtcgtacccataaccattgtgctgttcaaagtcggcacggatattgtcatattgtgaggaaatcgtttcatattcttcggtattggcgtcaacgcccaaagaacccatttgtttttccagagcgtgaagttttgcttcctgctcttttagactggcaaagactgatgccatttcagcataaatgcttttatctgaattgagtccggtatcctgggccaaatagccaatcgacagattctttttagtgctgatttggccgccgtcgacagattgttcgccgatgatcattttaaccagtgtcgacttgccggcaccgttacggccaaccagtgcgacacggcttttttcttgaatggccaaattaacttttgagaaaatagtttcgccattgaatcgtttggttagatcttgtgcttgtaagattatcaagtgtttggccacctttcattttgtaactaccaacaatcaattttatcataatttacacgatttcaggaattatttgtaagtaatatttgaaatatatttcacaagatgtcatcttatggtagaatgagatgtaaataggaattcacaaagttctcttaactaaaatgacaaataggaggaaattttcttgacagctgaaaatattccacgcgcaaccgctaaacgattgccgatatattaccgatacttaaatattttacatgatacaggaaagcaacgaatttcatcaacggaattggccgaggcggtgcaggtagattcagcaaccattcgtcgtgacttttcctattttggtgcgttgggcaagcgggggtatggatacgatgtggacaacctgctttcgttcttcaaaacgatcttgaatcaagagcatctgaccaacgtggctttgatcggagtcggcaatttgggccatgcgctcttgaactttaattttcacaaagacggcaacgttcgaatctccgctgcttttgatactgacgacaagattgtgaatacaattgaagacggtgttcctgtctacccgattgaggaactttcacatcaactgcatgatcaacagatcaaagtcatcattttgaccgtgccctcaaaagtcgctcagtccattgcggacgatgctgtcgccggcggggtaaagggtgtcttgaactttacgccaattcggcttcaggttcctgaagatgtcctggttcagaacgttgacttaactaatgaattgcaaactttgatttatttcatcgaaaactttggcaagtaaaatatcgaacaaattaatgaagaaaagaccggtgatcttgaaaacgccggtcttttcttatgcgttcatttaccgtcagcaaggcaatctgcagataaattcaccaagaaatgtgcagaaatccttgcaattggtctgaaaaaataatatattatacacagtgattagcacttttatcatgtgagtgctaatgttgctaaaaattgttgcaaacggagggactaacgtgttaaaaccattaggagatcgcgtaattatcgaaactgaaaaagaagaagaaaagtcggttggcggtatcgttcttgctgacaatgcaaaaaagaagccgcaagccggtacagttgttgccgtgggtgatggccgtgtacttgataatggtaccaaggttgcacctgttgtaaaaaagggcgacaaggttatgtttgataagtacgccggaaccgagattgaggataacgatcaaacttatctcgttcttcatgaaaaagacatcgtcgcaattgtcgaataattatattttaacgagataattgctaataagtgaatcatttgaatcattcaatgaatcaataatcaaaaatatttttttgaggtgaaatttgaaatggctaaacaagtaaagttttctgaagatgcccgtagcgcaatgctcaagggtgttgataaattagcagatacggttaaggcaacgattggacctaaaggccgcaacgttgttttggaacaaagtgccgggacaccgacaattaccaatgatggtgttaccatcgccaaatcaattgaattaccggatcattttgaaaacatgggcgccaaattggtttctgaagttgcttcaaagaccaatgatgttgctggtgacggaacaaccactgccacagttttaactcaagcaattgtcaatgaaggtatgaagaacgtcactgccggtgccaacccagttggaattcgtcgtggtattgaaaaggctactaaagccgctgttgatgcccttcacaaaatgtcgcatgatgttaagaccaaagacgatattgcacaaattgcttcaatttcatctgctaacaccgaagttggcaaattgattgccgatgcaatggaaaaagttggccatgatggtgttattaccattgaagagtcacgtggtgttgataccagcttggacgttgttgaaggaatgcaatttgatcgcggctacatgtcacaatacatggttaccgacaatgacaagatggaagccaacttggacaatccttacatcttggtaactgataagaagatcaccaacattcaagacattttgccattactgcaaaagattgttgaacaaggtcgttcactcttgatcattgctgatgacattggcggtgaagctctgccaactcttgtattgaacaagatgagaggaacattcaacgtcgttgctgttaaggcacctggatttggtgatcgtcgtaaggatcaactccaagatatcgccattttgaccggtgcaaccttgattaccgatgaccttggtttgaacttgaaggatgcaacccttgaacaacttggtcaagctaacaaagttaacgttaccaaggattcaaccacgattgtcgacggttccggttcaaacgatgaaattgccaaccgagttgctgaaattaagacccaaatcgaaaagacgacttcagactttgaccgtgacaagttaaaggaacgtcttgccaagttatcaggtggggttgccgttgttcgtgtcggtgccgctaccgaaactgaattgaaagaaaagaagtatcgcattgaagatgccttgaatgcgacccgtgctgccgttgaagaaggattcgttcctggtggtggaactgccttgattaacgtcatcccagaaatcgccaagttggatgccgaagctggcggtgatgaagagactggtattcgcattgttcttcgtgcccttgaagaacctgttcgtcaaatcgctgaaaatgccggtgttgaaggctcagtgattgttgaaaagctcaaggacgaaaagcctggaattggctacaatgctgccaatggtaaatttgaagatatgatcagtgatggaatcgttgatcctaccaaagttacccgttcagcacttcaaaatgctgcttctgtttcagccttgttgttgaccaccgaagctgttgttgctgatgagcctaagaaagacgcaccagctgctccaatgccacaacctggtatgggcatgtaatgaagcgttaaatcgttgatttgaatgaaagtattgtacaataagcatcgattccaaatcgggattggtgcttattttgtgcttgcgaattaatcaattcaatattaaagtagttagcatgtggcttagatcatattttgactctgagtgcacagctgacggatattttagcttgtctggatggtgatttgctgtgagcccattcagacgtacatatcaagacttgtttttaattgtcagaaggactatcattttatggttcacaagaatggtagattattaaataaaggagtaactatttatgtggcgctatctcaaacggctccttattggaaagccattaaagaccactgatgagggtggtcaatctttaaccaaatttaaagcactggctttactatcatccgatgcgctctcgtcagttgcatatggtactgagcagattacgaccattttaattacgctgtctgcagctgcgttgatgtatcaaatttgggttgcagccctcgttttggttctgttggctgccattactttgtcataccagcaaattatccatgcttatccctctgggggcggtgcctacgtggttgccagcaccaactggggtgagcaggctggcctgattgccggcggctcgttgctggtcgattatatgctgaccgtggccgtatcaacaacttcagcgactgaagccattacatcagctattccgtcattatattcacacggggtgctgatttcctgtttgatcgttgtgggcattatgctcctcaaccttcgaggaatccgcgaatctgcttcgtttttgacgttgccagtgtatttgttcatcatcatgattatcgcgatgatcatttatggcggttataatattgtgaccggcaacatcgaatatcatgcggctgctcatatcggggcacctgtcgaaggcatgactttggtcctgttcttccgggccttctcatctggatcatcttcattgaccggtgttgaagcgatcagtaatgccgttcccaattttaacaaacccaagagtaaaaatgctgcggcgaccttagccatcatggcgaccatcttggcctgcttctttggcgggattaccttcctgagttactacatgggcattatgccaaacagccacgaaacggtcctttcacaaattggtgaaactgttttcggccatggcattgtctactatatcctccaattatcaaccgccatgattttggcggttgctgccaacactggattctcagcatttccaattttggcttataacttggctaaagacaagttcttacctcatgcctatctcgacaaaggggatcggttggggtactctaacggcattatttccttagccgttggtgcaattgtcttaattcaaatttttggtggccggaccaattcactgattccattgtatgccgtaggtgtgttcattccatttacgctgtcacagtccggaatgattatccattggcggagaaatcggggtaagaattggcagctgaagtcagttatcaacttcgtcggcgcctttatttcactgacgttggttacctgcctgttcttactaagatttccaaatgtttggccttatttgattgttatgccgattcttttgaggattttctacaagatcaatcatcattacaagcgggttgccgaacagctgcgggtggttgaagagaatactgaaattgcgacaactcatcactttgacggctcgactgtcattgtcctggtaagcggggtcactcgggtgactgccaatgctatcagttatgcccaatcgattggtgattatgtcatcgcaatgcacgtttcttttgactccaaccctgagaaggaacacaagacgtctgagcagtttaaaaaagatttcccggatgtccgattcgttgatattcattcatcctatcggtcaattgcccaaccaaccttacgtttctgtgatgtcattgccaagcgggcagctgatcgaaactattcgaccacagtcctggtaccgcaatttgtaccaagacatcgttgggaaaatgtcctgcataaccagactagtttgagattaagagcaattttaaattcacgacaaaatattattatttccacttataactaccatctgcgtgagtagttaaatgaaacgatacaggccatccgttaagcaatagcggatggcctgttttagcgtgtttttaaccgcctcgtaccggttttaccaggattgtgggcaattatcttggaagagacgaagggtgcgtagggaagggataatttggtttgagtagtcgcttagctttgggaaaaatatgtaaacaaaaagaccgcccaaatggacgatcttttgatctcgcaaggaattagtgagcgattcccatgaagttggcaaatgttggaacaacgatgtcaacaacgattgaaatgataacaaccgcgatggcagccatcgcaccagatacagaacttaactgaatggcctttgctgaaccaacagtatgtccggcagtacctaatccaagaccttgaccaatcggttcagtcaagtggaatatcttgatgagccatgttgccaaagcgtaaatcaagacggcgttcaagatacatgccatagcagtaacggcaggagtacctccgatagcaccagaaataggcattgcaatagcggtagtagcagcttgtggaagcattgaagcgattccgttgttgttcaagccgatgagctttgatacatagtagatgatgaacagtgagatgaacaaaccaataattaatgatagcagaatctctaaccagaatcgtttaacaatatcgttacgtttgtacagaggaacggcaaacgcgatggttgctgggttcaagaaccagaagatgatatctccacctggtttgtaagcgttggtgtagaaccaagtaacgtcaacaccgaacatcttagccatcaaccagaggatgaagattccaagtaccattccaacaaacagaggttggaataagaagaatcctttaccaatcttgaatagccattgaccaaacaagaaaaccaacagtgacaagcagataccaaaaattggtgtccctaaatacgcaataatagttgtttgtgtagcagacatttatattcacccctttaattactttttctcgacgtcttcactaactgtaatatcgccatggaaaacggtctttctgatccagataaagaatgatgtggtgtaagcaacaacaacaagtaagacaaccgttgaaataataatagcaacaataagttgtacaccttgagccttcatgatatcaagagatgcggtcaattgaattcctgaaggtacaaatagaaatgcgatcattccgatcataaatgtagcaaatttatcaacccattcaactttgacgatgtggaaagttaataggagataaagaataattaaaccaagaactggggttggaacagggaactttggtgcgactgctaccaaccatgctgaaattaaactggaaacaaacaataccccggcgaagatacccatttgaataagaatgggcgcatctttcgtctcggcttgtgtagtatttgttttgtcagccatgataaaaactccttccgtttgtgaaatataaaataattgaacctgttgtcttacaatctctagtataaatgtttttgtgaaatatgacaattgaaaacgttagcaaaatttaaaaatgtgaaaattcacacaattggtccgtattaattatttgagtaagctcctttactttgtgagtcagacataccttgtttttatgaattgtcatttgtataattgaattaatattgatttggaaggaaataagtgaggttacaattttgaaattcgagatcattgtgtctttatttgctaccatgattatttctgcagtcttaaccccatttattcggaaacttgcttttgctgttggggcagaggaccggccaaacaaacggcgggttaataaaattccaatgccaacgattggtgggttggcaatttttattgcctacacctttacgaccatgattttattgcgggatcagttcccaaccaaaattttgtggggggtgtatggcggggaagtcatcattattctcactgggataatagatgatattttcgtcttaaagccccggcaaaaagttttggggatttcaattgccgcgctgtgggtttactttacagccggtgttaaaatgaccaccattaccttaccgtttatcacaatccaccttggttggctgagcttgccagtgacttggatttggattttggcaattaccaacgcggttaacttgattgatggattggacggcttggccactggggttgcaattattgccctaaccaccatgggaattaccgccatgttcttcttgaacgtcggtaatattttcgtcgccatcatgatttttaccctggtggccgcttgcattggctttttgccttataactttttcccggccagaatttatttgggcgataccggtgcgttgtttattgggtttatgatgtcggtcttttcgttgtttggattaaagaacgccactttcatcacgctgctaatcccagtgatgatcctgggtgtgccgattaccgataccgtatttgccattttccgccggttgttaaataaggaaccgattacgcatgccgataagcgacatttacatcaccgtttgatgcaaattggtttgacccatcggcaaacggtgttggtgatctatggaattgccctgattttttcgtttatctcactgctttatccgatttcaaccttgtggggatcgattctgctgacgattgccgttttgattggtcttgagttgtttgtggaaacgattggcctggttggagaagatcgacagccgctgttgaacggaattaagaaattggttaaagatacgaccagtaaaaataatcattagcgcattaaaaagccgtctgacgtttgtcaggcggtttttgatataatcatgaaaagttgtatgagcggagttgttgtaagtatttttttcgacttgagagggttgaattggaaatatttccaaaattaatccacttacaatgactaatgccaagttgccggagtgtttggtggataaaaattttttgaataccattgcccgaaaaaaatcttaaataaaacgttggggatgtggaagttgttaaaacgtagccatgtttgatattcccgagctcaccatgaacaccgaatttagtaacggtgtgggacaatcctgccccttctttcatgactttatcaacgaatcccttcaacattccgggaatgctgttccaccaaaccggcgtgatgaagatcactgtattagctcttcgaaggtcatcgagatactcaattgtctgttgatcatgagacttcccttgatggaatagacgcaattcttccacgtcataggtaggattgaattgtgcttgatgaagatcaattagtttccaacttcttccttttgaagcaagtgttgaaatgacagcttctagaactgcgtgattaaagcttcttttatagggatgacagtaaataattaaagttgtattcatgttagtcttctccaatcagttgagttgctgctaaagcgaggaactctcgacggtaagtaatggcaccgttcgcaatcaatgaaccataaccttgtataaacgcccagactttgataaaaatgtcattttccggttctcttaaggaatgctgtgtggcaagattatgaatgatttcatgtgttaaaaccaaaaagctaaatgagttatcatcaaaattttgtgaatatatcttgacaattccaggattaaacaataaaaaatccattaaatttggaactgtctcgatttgatgaataacgaattcacctaaatcaatcaacgtttgtaatgcatcctccttgtttcctttggcaaggtgattggatgcctgtacaaagaattttttggaaattgtgacagtgacatgcttaaacaggtcttccttactggagaaatgcttgtaaaaggctcctgtggttaagtcgagagtcccaagaagctttcgaagagaaatgttttgatacccatgttcattaatcattcgaattgtttgtgagataatcgtttctttcgtgtggtttgtttttcctgcgatctgtatcatcccctgcttaacccaagataacaccgttatcctattgctgtaaataaaaaaacatgatcagcgaagtgaccacgtttcatgaggtatgtttgacaaatttgaaggtgataaaattaaccagatgttattttcgttcatctttttgacggtcttcacgagaatagggtacctcgaaaattttgtattgccctttcttgtaggtaaattgatcactcaataagttggtgatttgtgtgatgagagggttaaattcactatcgctaactgcaatcactagttcaattttgtcggtataattggtttcttcaactggtatagcggcgttttccaagaagtattttaatcgatcaaattgattgtaatcaattaacaaatttaattcttgtttgctgaccaatttgacgatcccaagcgaatcaatcgttgtcgatgtcgcgttgctataagcccgaattaaaccgccggcgccaagcttaatgccgccgaaatatcgggtcaccactgctaaaacgttatgtaactcattcattttgaggacttccaagatggggaccccggcggttccggatggctcgccattgtcgctttcgcgttgaatatggtcatcgtcacccaacatgtaggcgtagcaattgtggttggcttttggattgtctttagtcacttgatcaatgattttttttgcctggttctcgttatcaattcgtgccatcgtgcagagaaaacgggattttttaatttcgatttcatgggtaccgtttgatttaattgtcagtgattcatttttcaaaaaggattcctccattatttacgtaattagtgattgaggtgatgatctatgattaatgatctatcagagttgtatggccgccaaatgccacagcgtgatctggccgcgacactgcaaaattcaccggacattcgcttacgtccggccatcagtgacgaccatggattgaaatgtggtcgctgcgggtcaaaattgcgccgttcccttgccagtttacctaatcaccacttttattgctacatttgtattcaaatggggcgggtggataccttgtcgccactggcttatttggaagagccaaatcattttactgagaatccggatccattatcctggtccgggcagctgacccaattacaaaatgagtgtgccgacaaagtgattgaagtgtttcaacaacgccagcgtcacttgttgtgggcagtaacgggggctggcaagacggaaatgctgtttaaagggattagctgggcaatttcaaatggattgcgagtcgggattgcttcgccgcgggtggacgtatgcatcgaactgttcccacgaattcaagccgcgttcaatcaagtttcaatcgtgttactccatggcaagagtgagcagcggtaccagtacagtcagattaccgtttgtacgacccaccaactgttacgattttaccatgcatttgacgtcctgattattgacgaggtggatgtcttcccatattctggtaacccaatgcttcattttggtgttcaaaatgcgattaaacccgctggggcaacgctgtatttaacggcgacccccgatcaggcactttttaaagcaatttctagaaaacagttgtcggtcagttatttaccaatcagatatcatggacattatttaccagaaatctcggcgattcgggtcaaaagtcttaacgagcagcttcaagctggcaaactgcctcaaaaaatcttgcggatggtggctgacctggtaacagaaaagcagcgattcttactgttcgttccccacattaaagacttgagtcaagcggcagctgccatcaaggctgccgggatagcagcgaaattcaaaacggtgtattctgctgatcccgagcgaattgagaaagtagcgttaatgcgcagtcaacaactggatttcctgatcacaacgacgattttggagcggggcgtgaccttcccaggcattgacgtcttggtattaaaggctgacagtgaaattttttcggcggctgcactcgtccaaatcgctggtcgggtgggtcgaaatagtgatcggccgacaggacaagtcctcttttattgtgaatttaaaacggccaacatcaaatcctgtgaccgccagattaagctgatgaatcgaaaggcggctcaattatgaaagcctgtttattgtgtggctccagactaagacaggaaatcccacttgcagacttgattcggttaaccccactgcagaaacgggcgatctgtgaggcgtgttcccccacattttcagcgcttaacctgctaccaacttgttccagctgcggtcgacggcgaacaactgatatgagcgatccctgctacgattgtctgcgctgggagaaggacggccaattcaaatttattaactcggcgatgtacgaatataatccggcaatgaaagattacatgaaacgatacaagtttgccggggattaccgattacggaaggttttttccgatcaaattcacgagcagttgaagaagcaatctgcgatcattgtgccaatcccggtggggaaggacaccatggccactcggggctttaatcaggtcaccgggctgttggaaaatgaccgctatttgaacctattaagcgtcagattcgacaagaaggccgtccgccagtcggcgaaaaaccgtcagggccgtttattgcttgatcaaccgtttgaaatgattgaatcacaaaaaaatcaagttaaaaatcaggccgttttattggttgacgatgtgtatacaaccgggacaaccattaggcatgcggccgctttgatccaacaagccggggcagcttccgtgaaaggatttacccttgctcgataaagaaatccagacccaatgattgttaaaattcgaactttcaattatactaaagttgtagccagtaatgaaagtgatttcattagtggaccattaagcctttaatggtgaagggagagaacgctatgctaatttttaacattcgtggtgaaaacattgaggtaacccaggcgatccgggattatgttgaaaaacggatcagtaaactggagaaatactttgaaaaggacatgaaaaatactgctcatgtcaatttaaaggtttatccagataagcaagcaaaagttgaggtaaccattcctttgccatacttaactttgagagccgaagaaatgtccaacgatttgtacgcaagtgttgatctggtgacagacaaactcgaacgtcaaattcgtaagtacaagaccaaggttaaccgcaagtctcgtgaaaaaggatttaagaatcttgaatttgcacccgctgcagatacttctgccagcgagtcagattctgatgacgaatccaaattccaggttgttcgtaccaagcaactggctttaaagccgatggataacgaggaagccattcttcaaatggacatgctggggcatgatttcttcatctatgaagatgcagaaacttcaggcatcaacatcgtctaccgtcgtaatgatggccgttatggcttgattgagaccggcgaagaataattaagttaatcaattaacgggcatgcgtattatgcaccgtcaaaagaatggggataaattgcagcttaatttatccccattctttttcgtttccggaaacatttgtgaaccaatctgatcgtttaacctttcatatctattcaaaatgtattatcatggttaaatgccgctgatgcattgttttttgtgttttcatgggcggcctaaaatgttacactaaataagtatgtagtccacaaatactaagaacaatttgatcagtattttattttagaagggaatttactaatggctaatattttaagaacatgggttgaaagtgatacacgcgaacaaaagcggctcagtaaaattgccgataaagttggttcgtatgctgaagagtatcgtcaactcagtgatgaagaattacaagccaagacaccggcatttaagaaacgctatcaaaatggcgaaacactcgatgatttgcttccggaagcatttgccgttgcccgtgaaggcgcaaagcgtgtcttaggtttgtacccattccacgtccaaattatgggtggaattgttcttcatgaaggaaatattgcagaaatgaaaactggtgaaggtaagactttaactgccaccatgccggtttatttaaatgcacttgcaggcgaaggggttcacgtggttactgttaacgaatacctttcccagcgtgatgccactgaaatgggcgagttatataattggctcggcctgacagttggtgttaataccactgaaaaggatgccgatgagaagcgggaagcctacgctgccgatatcacctactcaaccaacggggaaatcggtttcgattatctgcgtgataacatggttgcttataaggaacaaatggttcaacgtcctttgaacttcgcgattgtcgatgaggttgattcaattttaattgatgaagcccgaacaccattgattatttctggtcaatcaagcggcacttccgacctttaccaacggactgacagatttgccaagacgttgcacgaaggcgatgatttcaagcttgatctggaaaccaagactgtttcattgaccgatcagggaatcgaaaaggctgagaagtacttcaacttaaagaatctttatgacaccgacaatactgccttgacccaccatttggaccaggctttacgggccaactttatcatgcttcgtgataaggattacgtggttcaagatgatgaggtcaagattgttgattcctttaccggacggatcatggaaggccgtcgattctcagatggtcttcaccaagcccttgaagcaaaagaaggcgtcacgatcaacgaggaaagtaagacaatggctaccattacttaccaaaacctcttccggatgtataagaagctcgccggaatgactggtactgccaagactgaagctgaagaattccgtgagatctataacatggaagttatttcggttccaaccaacaaaccggttgtccgggttgatcatccagatgttttgtatccaactttggaagccaaatttgaggccgttgtcaacaagatcaaggagcttcacaaaaagggtcagccaatgttggttggtactgttgctgttgaaacttctgaatacttgtcacaacgacttgatgaagaaaagattccccacgtggtattgaatgccaaaaaccacgccaaggaagctgaaatcgttgccaatgccggccaacggggcgccgttacaattgccaccaacatggctggtcgtggaaccgatatcaaattaggacccggagttgttgaacttggcggcttagctgttatcgggactgaacgccatgagtcacgacggattgataatcagctgcgtggccgttcaggacgtcagggtgatcctggtttgtcacagttctatttgtcacttgaagatgacttgatgcgtcgtttcggttctgaaaagatcaaaaacttcctggagcatttgaatgttgaaggtgaagacgcggttattcgttcaagaatgatcaccaagcaagttgaatcagctcaaaagcgggttgaaggtaacaactacgattcacggaagaacgttttgcaatacgatgatgttatgagacaacagcgtgaagtgatttacggtgagcgtcgtgaagtcattgatgagcaaaaagatttgaagtgggtcatcatgccgatgatcgaacggaccatcaatcgaattgttgatttgcatactcaaggggaaaaagaagattgggatctgcaaaccatcttggacttcgccatcagtgcgatggtcagcccagaccaaatttctctagaagatttccaaggcaaatcagctgacgaaattaagagtatgctcatgggtctggcaaacaaagaatacaaagaaaagcaagaacaactcaacgatgaatcgcaaatgcttgaattcgaaaaggttgttatcttgcgagttgtcgattcccattggactgatcacattgacatcatggatcaattacgtcaatcaattggtcttcgtggttatggtcaacaaaatccactggttgaatatcagcgagaaggttacaagatgtttgaagaaatgattgccgatatcgaatatgacgcaacccgtctgttcatgaaggctgaaattcgtcaaaacatgcaacgttaatatgtattggaaagaatccggcaatgacgattgtttggattctttctttgaattggaacaaaattagaggagagtaatatgtcatttgaattgagtgaagcaaaaaaacaaatcgctgaaatgcaaaaagccatcgatggttttgggaggtcactttgaccttgatgccttaagtgaaagcatcgcgattaatgagtcgaagatggccgagccaggcttttgggatgaccaagaagccgctcagaaattgattgatcaaaccaatcagttaaaaaccaagcgcgacaatttcgtcggcctcaaaaataaactcgatgatctaaaagttactttggaattgatcgaagaggatgctcattccgggatggagggagaatttgagactgatgaaaagcagcttaaaactaaactggaccgctaccggttgaatctgttgcttaacggcaaatatgatcataataatgccattttggaaatccatcctggagccggcggaaccgaagcccaggactggggttcgatgctgctgcgaatgtatacccgttgggcagaagcccatgggttcaccgtgcagaccttggattatcaggtcggtgacgttgccggtctgaacagtgtttcactattaatcagcggtgaaaatgtctatggttatttacggtccgaaaaggggattcatcgattggtcaggctgtcgccatttgattcagctggtcgtcgacacacgtcatttgcatccgttgatgtgatgcctgaattaaatgatgacgtctcaatcgatattaacccggatgatttacggattgatgtttatcgatccagcggtgctggtgggcaacacattaacaagacttcctccgctgttcgaatcacccatttacccactggaatcgtggctgccagtcaggcgcaacgatcacaacttcaaaaccggcaaacggcaatgaacatgttgaagtcaaaattgtatgaacttgaagaagagaaaaaggccgaagaaaaggccaaaattgagggtgaacaaaaagacatcggctggggatctcaaattcgttcctacgtctttcacccatattcgatggtcaaagatcaccgaaccaattacgaaactgccaatgtcaacggcgtgatggatggtgatttggatccgttcatcaacgcctatctacaatggcaattaagtcaaaagaatccagactaatcggttattaaagccgcgtttgctttagcccggtgcgaatcatacgataaggttcttgacgccacattgcgttaagggcctttttttatcaacgacaggatgattggagaaccctaccaagcacccaaaggcagcaactgccggttaagccaccatcttgattagtctttcggatttcaaatcagcttaaatcagctgtcaataaatgatatactagccttataattattggtgaggaagacataatgaaatttttgattgcttgtggtttttatggattgcaacccgccttgtggatcggggttatccgcagttatttaattcatacgaggcggctgaagaaagagcgggggatttttaactccgcgatttatgaggatttttatgaaggtcgacattttgtcagaatggggctgatctttgggatactggcctccgtcgttttaggtggctttttaagcatttcactggaatggttgatcatttatgaaggcttactgctgatttcactcacgctgattcattggtggctgctgtcggtgactgttgccggtatcgccagtttgttggcgctgggattgccaaatatatcggaattgcgaccactgcttcattggtttgaaggactgggaatcaactcaacaactgtggccccgctcaatttgttgattttatttgtggtcattatcttggcaaacgccgttttcttgaacgttaacggtggtcgatttgattcaccgaccttggtgcgcaaccaacgaaacaataaaacggccgtttataaatttaacgaattgacgatttttccgttcctgctgtttgttcccggagattggatccataccagcttaccaatgatgccgctatttcaagtacacaatcatttctatgcgttgttattggtgccaatcctgattggacttaaatttaccgtcaaaagaagtgttcccagggccttatttaaaataatgagtcacggtatttacttattggcggggattggtgtttgcctggcgattgccggctacttcgtaccgcacctcattttacccnnnnnnnnnnnnnggtgtccgggtaattggcattcaaccggaaaccccagccgccaagatggatctcaaagttggcgatgtgatccttgaggtcaatggcatttcggtgactgatgaagattctttttatcgcgcgctcagcaccaactcaacttattgtcggttcaaagttcgcgatcgaaacgatcagttgaagatgaccgaatcggcgatcttcaagaattcacctcatgaaattggggtcaaaacatatacacagcttagtcattaggagggctatcgtgaaaaaagtgcttgtagttgacgacgaaccagcaattgttactttattggaatataacttgaagcaagccaattttgaagttcagagtgctactaacggagtcgatgcgctttcaatggctgaaaatggccaatttgacatcgtacttttggatttgatgttgccgcagatgagtggggaacaagtcctcaagcagctgcggatggaccgaaacgacacaccggtgattttattaactgccaaagataccgaatttgataaggtctttggcctcgagatgggtgctgacgactatattcccaagccatttagtccgcgagaggtgattgcgcggattaacgcggtgcttcgtcggtatgaaaagagtgctgcggcatccgaaacgccagctgccaaatcagccgaaaatgtcgaaaccactgggccgtttaccattgaccacaaaaaataccgcgtgagtgccgattcgaaaaacttaaagttaacaccaaaagaatttgaattgatgcagtacttggtcagtcacgaaaatcaagtgcttagtcgtgaccaattactccagggtgtttgggggtttgactactcaggtcaaagccggatggtcgatattcaaattgcccatcttcgtgaaaagattgaaccggatccaaaacggccgaaatatctgcgaacagttcgtggatttggttatgagttctccacgggggatgatgacgctgagtaaaatttataaacaaattttaaccgttgtaatcttaagcattgccacactggccgtgcttttttatggttttacgagcggcaatttgggctgggctgacctggcccttttattggccttggtcgatgcaattgccgggattattctcatcattcaataccgccagcatgataagctgctcaaacaactccaaataatgaccgaaaatattgttcatcatcagccggcggtgccgctttttgttgaacccgacaacccactcaaaggcgttgccgaccagctcaacgaacttcaaagcaggcagcaggacgaaggaaagagtattcgaaacagtaacgccgaactaattacgattctttccagccttccagtcggggtgatggtaattgattcaactcacgatgtgattttcgccaaccataaaatgtccgtcatgctgggacgagatattttgactcaggttcatccctatacccaagacatccgcaattatcaattgctgtctttaattgaaaatgtttatgacagtcacaagtctcagcaagaagagattcaaagcgtcggggcgacatctgttacctgggacaccagcgtggtgttcaatcaactcgaaaacgattttcacatcctggtgattatgtatgacatttcagatattattaacgtcaaacagatgcagattgactttttgcgaaatgccagtcacgaactcaagacgccgattactgccatctccggatttaccaaaactctgttgggtggggcgatggacgataagaagagtttggtagagtttctgaaaattattgatcaacaaagtgatcagctggcctcgctggttcaagacatactgacgatttcccatattcaaaacggtactaattatcattacaaaccattagctttacatgatttcattgatgcggagcttgcttcatatcaatcaatgatccaaggtaaccacgtttcaattcataatcaagtcccggaacacgttgaagtcattgccgacaccaccacgctcacgcggattttacgcaatctggtcagcaacgcggttaaatataatcgcccaaatggtgaggttaacattacctatagtgacaacgacagttattggcagctccacgtttccgataccggaattgggattgcccaaaaagacatttccagattatttgaacgcttctatcgcgcagacgattcccgaaccaagcagaaggtcagtgggaccggcttaggtctttcaatcgtcaaggaaatggtcgatgcggttggcggcacgattgatgttaaaagtcagcggggcgttggctccacttttactgtaaactttccgattgtcaaagatcgtaaccagcccaacacacaaacagactgatgtttgctgaatttcaaccaaatatttacattttcaaatcaatcaagccgggagcatctccggcttttttgcgtttcttcagccattaattaccaacacccggttatctatttacaaaacatttacatttgtccggtcaaatatttacattggtttaatacaatggtaattgaagattcaaggaggaattgagatgcgaaaacggacgatcgttaaactgttactgtgtgtggtggtaattgttgccggaattggtgcttacaatgcccgcagcaagacttcaaccaatcagcaatcaatcaccgctgttggttcaactgcgctccagccactggttgaggcggccagcgaacaatattctgctgatcatgctggcattttcattaatgtgcagggtggtggatctggaaccgggctgagtcaaatcgagtccggtgccgttcagatgggaaattcggatttgtttgctgaggaaaaggcgggcattaatcccgccggcttggtcgatcacaaaattgctgttgtgggagtcgctccgattaccaatgaccgcgttgggattgacaacttgagcaccgcccagttgattgcaatttttactgggaaatacaccaattggaaacagcttggcggacccgacctgccgattactttgatcaaccggtctcaggggagcggaacccgggtaacctttgaacaatatggtcttaaaggccatgaaagtgccaccgcccaggagcaggattcttcaggaactgtccgccagattgtctcatcaacgccgggggctatcagctacgtctcatttggctacttcaataagagcattcatccattaagcgttgatggtattaagcccacggaacaaaacgtgatggacaataagtggaaaatctggtcctatgaacacatttacacccgtgggaaacccaccggattgactaaaaaattcttaacttacttgaaaaacgatcatattcaaacgaccctctttaacaaactaggttacatctctgtgaaagatatgcattaccagagaacctggcagggcaaaattacaaaaggatcgggggaataatcgtgcaaaatgaaaaattagccaaacaactgatgaaaaaatccaaaacggcccgttacgaacgatttgggcacctgctcagtctttcggcgctgctgctgattatggcgatcgtgcttggcattattgtcttcgttgccagcaagggattggcgaccttcttcaaagacggcatttctgtcaaagacttctttaccggcacgttgtggaatcctggtaccaagactcccaacgggcaccaagccgtcggcgcgttgcccatgattgtcggctcttttcttgtgacgattctggctgctttactgtcgacgccgttcgccatcgggactgcggtgtatatgaccgagatttctcctaaacggggagctaaaattcttcagccggtaaccgaattactggtcggaattccctcggttgtctatggctttattgggctctcagtagtcgttcctttcgttcgaaatacgtttggcggcagtgggtttggtatcctatccgggacctttgtcctgttcgtgatgattttaccaaccattgtatcaatgactgtcgattccctcaggggcgttcccaagttttatcgtcaagcctcactggctttgggtgctaccaagtggcagaccatttggaaagtcgtcttgagagccgccacaccagggattttgactgccgtggtttttggaatggccagagcctttggtgaagccttagccgttcaaatggtgattggaaatgcagctttgatgccgcaaaatttaacgtcaccggcttccactttaacctctgttctaaccgccggcatggggaacaccgtcatgggatcgcttcaaaatgacgccctctggtcactagcactggttctgttagtcatgtcgctcttctttaatttattagttcacatgatcggtcggaaaggggcgtttaagaaatgaatcgaacacaaaagcaaagccgatttgccattgcctgtttaaaagccgttgctggctttgtggtggtcatcttagcctttctgattggctatatttttatcaccggactgcccaatatcagttggcatttcttaacgtccccggccaaagcgtttaatgccggcggcggaattggcattcagctatttaactcattttacctcttggtgttagcaatgttgatttctctgccaattgcacttggggcggcgatttacctcaacgaatacgccaaagataactggtttaccgctacgatcaagacttcaattgaaattttgagttccttgccttctgtggtggttggactgtttggtttcttattgtttgtcgttcagttcaactatggtttctcaatcatttcaggtgcgttgactttaacgatttttaacttaccactgttaaccagaaatattgaagattcactttccaacgtttccgatgaccagcgccaaggcggtttgggcttgggactttccaaatatgagacgattattcacattgtcgttcccgcttcactgcctggaatcatcagtgggatcattctttgttcgggacgggtttttggtgaggcggctgccttgatctataccgccggtcaaagcgccccagcgttgaattttgccgattggaaccccttcaacattgatagcccattgtcgccgctgcggccggctgaaacattggccgttcacatttggaaaatcaactcagaaggaatcatgcctgatttgacacaggtttcctccggttcagcggctgtcctggtcctggcgattttaatctttaatttgtcggccagatggattggccggaaggtatttgaacgaatgacttcagtaaagtaggtggctgaaaatgcaaaacacaactgaattaaacaacaaacccaagcggtttatttatgattttaatcccgaagaaaatgacattacgatgcagaccaaagatttggaaatttattacggcaaaactttagcaatgcacaacgcggatttgaagtttaaaaaaaataccattacggccttgattggaccttccggatcgggtaaatcaacctttttacgggcccttaatcggatgaatgatggcgtcgctactgtgaaaggtgagattctttatcaaggcgtcaacattaatcagcccaagatcgatgtttatgaggtccggcgccgaatcgggatggtttttcaacgaccgaatccattcgccaaatcaatctatgacaacgtgactttcgcgctccagcgacggggaattcatgataagaaaaccttggatcaagtggtggaaaccactttaaaacaagccgctgtctgggatcaggtcaaagacagtttgaataaaagtgccctttccttatccggtgggcaggcacaacgggtttgtattgccagagccttggcagttcaaccggatgtgttactgttggacgaaccggccagtgccttggacccggtttcaacccaacaactggaagcgactttacgtgaacttaaaaaggattatacaattatcattgtgacccacaacatgcagcaggcagcccgtctgagtgactacacggtcttcttcaacatgggtgaggccattgagtacaacaaaaccagaaaggtcttcacccggccgaaagtacagatgacagacgactatgtatcaggaaactttggttaggaggaacaatcatggcaacaccaattatttcagcagacaatttggatttattctatgatgattttcaggcactttacggaatccatttagatttcctgcctaaccaaatttctgcgctgatcggcccatcaggctgcgggaagtcaacatttctgcgctgcttaaatcgcatgaatgatatgatcgatggcgtgacaattaccggagcggttcaatttcacggagaaaatatttattctccgcaaacaaatctggtagaattgagaaagtcgattgggatggtctttcaacagcccaacccgtttccattttcagtctatgataatatcacctatggtttgcggatcgcgggacttcgtgacaaacaaaaattagatgaaattgttgaaaaaagtttgaagcaggcggctgtttgggatgaagtcaaagacaatctgtacgataacgccctgtcgttttccggcgggcagcaacagcgaatttgtatcgcccgggtgcttgccacttcgccatcggttattttgatggatgagccgaccagtgcattggacccgatttccagtgccaagattgaaaatactttgcttgagttgaaaaaagattatacaataataatcgttactcacaacctgcagcaggcttcccgaatttctgataagacagcgttctttatggaaggcagagtggttgaatatgatgacacaactaagatgttcgtgaatcctgaggaaaaacaaacggaggattacgttagcggacgattcggataggagagaagcttatggggaaagtttttgatgaagagattattacgttaaaggcggattttatgaaattgggggcactggttggtgaagccgtgaccaacgccgggcagtcgtttgtcgaccatgatattcaaaaggcggaaacggtgatcaccaacgaccacgagattaatcacctccagattcatattgaaaagcggtcatttgaaatgattgcgctgtatcagccggtcacgggggacctccgggaagtggtcggaattttaaaagccgtcactgatttggaacgcgccggtgaccatgcccgaaacgttgctcgatcggtgattgatattaaaggcaagcagcggatcgcttcagtggaagaaattattgctacaatgtctcaagaagtcagcgagcagtatgctgattcaattgagtcatatggtgatgccgatcaggacaaagccaagcggaccgcgcaacagtacgataaaaaaattgaccagctctataacgacattgcttctcccagttaccaagcgatggccaaggatccagagattgtcagttcagcgattatttatctaaacgttgccaaagatttaggccgggtgagtgattacagcacgaatatttgtgagtggacggtttatctggcaaccggaaaaattattgaattaaattaagaatggttgatattttgcactgcatacttgattgcagtgccttttttagataatcttaagctagaagttttattgtggaggcatgaggatgaatagtcataaaaaattacggcgttccagtaccaatcgggtgatttccggcgtgcttggcggaatttccgagtatctggactggaacgctgtcttggttcgaatcttgtatgtggtcttggcgtttacgcccgggatcaacgtggtcgcaattattgggtatatcattatgatgttcgcaattcccagtgatacacctggtagtggatcggcctttgaccaattcaaaaccactttatccggcggaacttctaacgacaaatccagaaaagtcattcataacgtcgaagaaaaagacgttcatgatgacaagaaaaggggtcaataattgagatttttaaccaatgtattggtcgatacgatcctgtttgttgcgatcagtggctttttccctgccaacttctacgttgccagcgtgggaattgcttttgtagcggcggtggttttagccgttttgaactggttggtccgaccgatcattacgatcttgtctttgccgattaaccttttaacactgggattattcacgtttgtcattaatgggttgatgcttgaactgacggcgacgattgttggggctaatttcagattctcatcattttgggtcgcaattggcgtggccattctgatgtctgcggttagctggatcattgctgaatatttccgcaagccataaggacttgtcaggctcaaagtgataaaattatattgattaattgaggagggatgttcttgactgaaagtgtaacggttgctgatttggttaaaaacgccaggctggatgtctattatgggaaggaataccttgaagaaaggaccatttccactgctgatatttccagaccgggcctagagctaaccgggttctttaattattaccctgtcaaacgaattcagctgttgggcattactgaaatttcatattccaaggggatgtctcatgaagagctcctcgatgtgatgcagcagatgtgtcaaccacagaccccggcgttcgtggtgtccacccaactggatccgccggaagaattgctggaggccgcaaaagaacagcaccttcccgtcctcggttccaaattgacgacgtctcgagttctcagtaacatgactaattacctcgacgataaattagcagaacgcaagtcgcttcacggagttttggtcgatgtttatggattgggaatcctgattaccggtgacagtggaatcggcaagagtgaaacggcgttggaactggttaaacgtggccaccggctgattgccgacgatcgggtagaggtttaccaacaagatgaacaaaccttgatggggactgcccctgcgattctccgtcacttactggaaattcggggaattgggattatcgatgtgatgactttatttggcgccggtgctgtccgcagtcagacgaaagtcgccttaattattcatctggccaactacaccaaggaagccaagtttgatcgtctgggcaacgggactcagaatgtccatatttttgatgtcgatgtgccgaaaatcacgattcccgttcgaaccggccggaatttggcgatcatcattgaagccgctgccatgaacttccgtgcccaaagcatgggctatgacgcgactgaaacctttgaccgtaacttgaataatttaatcaaggtcaacagcaaaaacgacgaaaagcataaagaagaacaggaacatcttgaggagaaaaataaagatctcatcgatggtcgtgacaaagattcagataaaaaataggagatcgttattttgacaaatttattgagcttagccctcaacccgatcgcctttaacctgggtccaattgaagtccactggtatggtattatcattgccagtggcgtgattctggcggtttggttggcggtccgcgaaggcgataaacgtgggattaaagccgacgatatttacgatatgattttgtgggccttgcccgctgcgctaatttgtgcgcgattgtattacgtcatcttccagtggtcttattacaaagataaccctggtgaaatcatcaaaatctgggacggtggtattgccatttatggttctttaattggtgcgatgattgtggtgatcctattttgccgccaccgcttcattccagtttggctgatgttggatgttgccgcaccaacagttattttggcacaatcaatcggccgttggggcaattttatgaatcaggaggccttcggtcaggtaacatctttgagctttctgactgggcttcgtctgccacatttcatcattacccagatgtacattagcggcgcgtatcggcagccgacctttctctacgagtcgctgtggagtttcttaggttttttggtgctgataaccttgcggcacaattcccatctgtttaaacgtggcgaagtctttttaacctatgtcatgtggtattcttttggcagattctttgtcgaaggcatgcggactgacagtttgatgcttggcggccttcgggtatcgcagattctttcaatcattttatttgttggtgcaattggaatcatcatttatcgtcgattacgccagccacataatccttggtatttagagggttccaaattaacagttaattgatcatttactaataaaggagatttatcatggctaaaaaagttgcagtgcttggtgcaggttcttgggggagtgttcttgccagtttattggacgagaatgggtcagacgtcaaattatggtcgtataacccgacacaagttaaggaacttaacgaacagcataccaacacaaaatacatcaagaatttcacgttttcagattcactggtggctaccaatgatttgaaggacgccatcgatggtgttgattacatcttattcgtggttcccacccaggtaacccgttcagttgccaaacaagttgcagaaattttggccgaccggaatcaaaaagtgaatatcatccatgcttcaaagggaattgaagaaaaaacttacttaagattatctcaagttctggctcaagaaattgatcctcagaaccgcaaatcaatttcagttctatccggccccagccaggctgaagatgtcgtgacccatgacattactttggtcaccgttgccagtgatagtgaccaagctgctactgaaattcaaggtttgttcatgaacaactatttccgtgtttataccagtgacgatgtcattggcgtcgaaattggcgctgctttgaagaatattattgctttgggcgccggcgccttgtatggattggggtataaagacaacgccaaggccgccttgatgacccgtgggttagccgagatttcccgccttggaacgtcgtttggggctaatccattgacctttatcggtttgtcgggcgtcggcgatattattgtaaccgccaccagtaccaactcccgtaactggcgggctggtaacgaattaggcaagggtcattccctggatgaagtcattaataatatgggaatggtcattgagggtattgcgacgactcgcgctgcctatgaactttccaagaagcgcggtgttgaaatgccaattacttcggcaatttaccacgttttatatgatcatgctgatattaaagaaacgattaaccaactgatgacccgtgaaggccgttcagaaattgaataactcagagaaggtgaagctcactatgaccagaaaagtaaccaaagcagtcattccggctgccggcttaggaaccagatttttaccggaaaccaaggcactcccaaaggaaatgctaccgattgttgatacaccgacaattcaatttattgttgaagaagccaaacaggcgggcatcaaagacattgtaattgtcatcggtaaaggcaagcgctcaatcgaagatcactttgactcgaatcccgagttggaaatgaatttggaagagcgccacaagaacgatattcttgaaaccattcgcaagaccaacgacatgaatatttacttcattcgtcagtctcatccccgtgggttgggtgatgcaatttacaccgcccgcagtttcattagcaatgaaccgtttgtggtcatgcttggtgatgacgtgatgcaggacaaagtgccactgaccaaacaattaatggaaagctatcagcagactggagcttccacattagcagtgaagaaagttgcccacaaagatatctccaaatatggggtcattgatccctctgaagaggtccgcccaggcttgttcaacgttaaaaagttcgttgaaaagccaacgccagagaaggcccccagcgatttagcgattattggccgctacttgttgacgcccgaaatcttcggcattttggaaaacgccaaaccggataaaactggtgaaattcaactgacatctgcaattgacaccttgaaccagacacagcgggtctttgctcatgaatttaagggtgaacgattcgatactgggaacaaattaagctggctcaaaaccaacatcatctttggtctgcgccatccagaaatttctgatggcttgcgaacttatctcaaagatttgggcgcccaattaactgaagaagacaaaaagaagtaagtgtatctactggacagacttactttttcatagtaaattaacgtgtaagtaaaatttggtaattaaagggaggatccatatggctaaacaatatgatgtcgtgattattggtgccggccccggcggcatgacagcggctctatatgcttcacgagccaacctgtcagttgcaatgatcgatcggggaatttatggcggccagatgaacaacacagctgccattgagaactatcctggttttaaatcaatcatgggtccagatctcgctcagaatatgtatgacagttcaattaactttggtgctgaatacgtttatggaaccgtcagtgctgtggaagatcacggtgactataagctcgtcaagactgacgaagacgaaatccaagccaaagtggtcatcatcgcaaccggttccgaatataagaaattagggatccccggagaacacgaatacggtggcaaaggggtttcgtactgcgctgtctgcgatggggccttcttcaagaacaaagaagtcgtcgttgtcggcggtggagattctgcgattgaagaagcctcttacctcgctggaatcgttgatcatgtgacagttattcatcgccgtgaccaactgcgtgcccaaaaggttatccaagaccgggcattcgccaacgacaagattgattttgtttggaattccaacgtcacggaagttttgggtgatgataacaaagttaccggcgttaaagtagtgaataaccagacaaatgaagaatcagttcttgagacgtctggggtctttatttacgttggtctgctgccaatgaccgatgcttttaaagatttgaacattactgatgaggatggttggattcaaaccaacgatcagatggaaacgtcaattcctggtatttatgccattggtgacgttcgccaaaaggatcttcgtcagattgcaacagctgttggcgaaggtgggattgccggtcaacaagcattcaagtatgttgaatcattggctgacacatcaaaggccagtgtttcggaacactaatttaatgattaatcaaagggaggccgcgtacaaacagttgttttgttcacggctctttttgcgaggaaaaggacggggaattatcaatgggaatgcatcagtatttggaaagtttagacgagttggaattgatcaatcgagcacctggctactttaaattcgaacagcattcggttgctgcccattcattcaaggtaactgaaattgcccaatttttaggtgacgtcgaggaaaatgccggcgaaaaagtcgactggcgcgggttgtatgaaaaagccctcaatcatgattataccgagcggtttattggtgacatcaagacgccggtcaagtatgcaacacccaagctgcgttcaatgctggctgatgtggatgacaaattgacggaaaactttgtccaaaatgaaattccggatgaatttcaagatgcctaccgaagacgtctgtcggaaggcaaggatgatagtttggaaggccgtattttagcggtggccgataaagttgacctgttgtatgaatcctttggcgaaattcaaaaaggtaatcccgaggaagtctaccctgagatgtataaagagagtctctcaacgatgctggagtaccgtgatatgcattgtgttcagtatgttttgacgaaagtcattccggatatgctggccgaaaactttacgactcaggataaattaagacgactcacccgcaaagttttaaaaaaggaagacaattccaaggaataatgattggcgaaagtatgttcgtatggtaaaatagcgttgaatagtgggctgaaacaaaatatgattttgcttgcagcccttttatgttgtgtcattttggtatagaggttagggggattcaaattgattgaacgtgaagcagatcgaaaatttgatctagtatccaaatataaaccaactggtgatcagcctgatgcaatcaagaagttggtggcaggtattaacgaaggcaaaaaagcccaaattttaaaaggggctactggaactgggaagacttttaccatttccaatgtgattgcccaggtcaacaagccaactttggtcttatcgcataataaaaccttagctggccagctgtatggcgaatttaaagagttcttcccccacaatgccgttgaatattttgtaagttattatgattattatcaaccggaggcctatgtcccatccagtgacacttacattgaaaaggattcgtcgattaatgatgagattgaccagttacgccactcggcaaccagtttcctactggagcgtaacgatgtcatcgtggttgcctcagtttcatcgatctttgggttgggtgatccatccgaatatcgaaatcacgtggtttcattgcgggttggccagacaattgaacgggatcattttctccgccaattagttgatattcaatatgaccgcaacgacattgattttcagcgtggtcgttttcgagttcatggggatgttgttgaagttttcccggcatcctgggatgaacatgcctttcgaattgagttttttggcgatgaaattgaccggattcgcgaagtggatactttaactggtgaagtcatcggcgatcgggatcatattgcgattttcccggcgactcactttttaaccagtgatgacgtgatgaacgttgcactgccagagattaaagacgagatggacaagcaggttgccaaatttgaaaaagagggcaaattactggaagcacaacggttgaagcaacggactacttacgatatcgaaatgatgcgtgaaatgggctacacgagcggcattgagaattattcacggtttatggaccgcagaaagccggggcagccgccgtttacgctgcttgacttcttccctgacgatttcttgttagtcgtcgacgaatctcaccagacgatgccgcagattcgggggatgtataatggtgaccaagcgcgaaaacaacagttggtcaactacggattccggctgccaagtgcactggacaaccggccactgacattgagcgaatttgagcagcacgtccaccaggtcgtctacatgtctgccactccggggccttatgaactggatcagaccaaagatgtggttaaccaggtcattcgaccaaccggtttactggatccaacaattgacgtccgaccgattatggggcaaatggatgatttggttggtgaaatcaataagcgggttgacaagcacgagcgggtgtttgtgaccactttgaccaagaaaatggctgaagatttaactgattatctcaaagatttggggatcaaagtgaagtatctgcattctgatattaagacccttgaacgaactcaaatcattcgtgacttgcggctgggtaagtttgacgtcttggtcggtattaacctgctgcgggaaggaattgatgttcccgaagtttccttggttgcaattttggatgctgataaggaaggcttcctccgtaatgagcgttcgttgatccaaactatcggccgtgcatcccggaatgaacatggcgctgtgattatgtacgcggacaccgtgaccgattcaatgaaggcggccattgacgaaaccgctcaccgacgggccattcaaattgcttataacaagaaacatggtattacgccaaccaccatcgtcaaaccaattcgtaacttaatttcgattaccaaaggctcggatgatgccggcgaaaaggacgactttgtcgaaagtgattttgaacaaatgagtaagaaggatcaaaaggatatgctggctcgtttgacggaagaaatgcgtgacgctgccaaaaagctcgattttgagcaggctgctactttgcgtgatacaattattgaattaaagggtcaaacgagtaagtaatctaaaggagattatgcatattggcaatggataaaatcgtcattcgtggggcacgtgcccacaacttaaaaaatgtgaatgtgacaattccaaaaaataaactggttgtcatgactggcttatcgggctcggggaaaagctcgctggccttcgatacactttatgcggaaggtcagcgccgatacgttgaaagtttgtcatcatatgcgcgtcaatttctggggcaaatggataagccggatgtcgattcaattgatggcttgagtccagcaatttcgattgatcaaaaaaccacttccaagaaccccagatcaacggttggaacggtcactgaaatcaatgattattttcgactgttgtgggcccgagtgggggtaccaatctgtcccaacgacggctcggtgatttccagtcaatcagttgaccagatgatcgaccagatcatgaaactgcctgagagaacaaaattgcagattctgtcaccaatcgtacgtgggaaaaaaggtcaacacaaaaagatttttgaaaagatcaagcgtgaaggttttgttcgggtacaggttgatggcgaaacctatgatattgatgaagcaccggaactcgataaaaataagagccatgacattaatattattattgaccgaattattgtcaaagatggcattaataaccgattgtcagattcattggaagctgctttgcgccttagtggcggttatgccgtcgctgactttttgggcgagcgcgatccactgatgttttcagaacactacgcctgcccaatttgcggcttcacagtcggtgaactcgaaccacggctgttttcctttaactcaccgctgggcgcttgtcctgactgtgatggtttggggatgaagctggaagtcgatgaagatttggtggttcctgatcgaaccaagactctggccgagggcgctctggcaccttggaattccgccagttccaaatggtatccgaatatgctcaagcaggtttgtgatgctcaaggcatcgacatggacgtgccatttaacaaactgccgaagaaacagcaaaactttgtgttatacggttcaaagaccaaatcattccactttgtcctccaaagtgactttggcggcatccgtgatgtggacggcccgtttgaaggggttgtcaacaacgtcgaccgacgctatcacaacaccagcagcgactttaccagggacaatttaagtcagtatatgaccgaattaacctgtcagacctgccacggctatcgattaaaccgccaggcactggctgttaaggttggcaagcataacgtggcccaaatttcagctcttgatgtcactgcagagttgaacttctttcagtcgctgacatttggtgaacaggatacaatgattgccaaaccaattatcaaagaaattactgatcgactgacttttctaagaaatgttgggttggattacctgaccctctcccgttccgcacggactttatcaggtggagaagctcagcgaattcgcttggcaactcagattggttcaaatttgactggcgttctttatattcttgacgagccctcaattgggctgcatcaacgggataatgaccgactgattgcctccctcaagaaaatgcgcgatttgggcaataccctgatcgtggtcgagcatgatgaggataccatgcgggctgccgattatatcgtcgacatcggcccgggtgccggtcagcaaggcggtcgggtaatggccgtcggaacacccgccgacattgaaaaagtaccggaatcgatcactggccaatacctctcgggcaagcggtttattccggttccagataagcggcgcaagggaaatggtaagaaaattcgtgttactggtgctgctgagaacaatctcaaggatttgacggttgattttccgctcggcaagatggttgtggtgacgggtgtctccggctccggtaagtcgactctggtcaatgatatcttgaaaaaggcccttgcccagaaactcaatcataattccgagaagccgggtaaatacaagtccatttccggttacaaaaatattgaaaaaattatcgatattgaccaaacgccaatcggtcgaacaccacgatccaacccagccacctataccggtgtgtttgacgacattcgcggcttgtttgccaataccaacgatgccaaacttcggggcttcaaaaagggccgctttagttttaacgttaagggcggtcgctgtgaaacctgtcatggtgacggcatcttgaagattgaaatgaactttctgccagacgtttacgttccttgtgaagtatgtcatggcaagcggtacaatgctgagaccctcgaggttgaatacaaaggcaagaatattgccgatgtattagacatgaccgttgacgaagccgtggattttttcagtgccatcccaaaaatttctcgcaagctgcaaacaattaaagacgttggtctgggatatgttcatttgggccagccggccacaactttgtctggtggggaagctcaacgaatgaagttggcttctgagctgcataagaaggccaatggccaaaacttctacattctcgatgaaccaaccactggccttcatagtgaggatatccggcgattattaggtgtccttcaaaagctggttgatcaaggcaataccgttttgatcattgagcacaacttggatgtcgttaagagtgccgattatctgattgatttgggaccggaaggcggcgatggtgggggaacggtcgttgcgaccgggactcccgaacagttggccaaagtccctgagagttacactggtcagtaccttaagcccgtccttgaaagggataagaaattgaccaagcaggctgaaaagcaggcagtcaaagcaagtaaataatttggttgagccatttcaatgaactgattggaagtggctcttttttgctgtctgaagttgccccattactgctagaatgctcattcggtcggggacaagtacctccgggtgtttctttcattcacatgacacacccggtatgttatactggttgaagttcgttatacgaaaggaaatcattatggctgttaacaaccaattcgtcatcatcaccggaatgagtggtgctggtaagactgttgccatgcaaagttttgaagatttggggtatttttgcgtcgataatatgccgccaaccttgctgccaaagtttaaagaattaatccgcatggagcgggatattaataaaattgctttagtaatggatttgcggtcacaggtcttttacgatgaaatcatcgatatgtttaacgatttaaagaaaaatgatgacaataatgttgacatcatttttcttgattcatctgaccaaaaactcgtttcccgatacaaagaaacgcgtcgggcccatccgcttgctcgcaatggacgcgtcattgacggtattaaaaaagagcgtgaattgttggccaacgtcaaacaggctgctgacctggttgtcgataccactaatatggcgccccggcggttacgtgaagaagtctttcacaattttgaatcaactgatgaaacacatactttccacgtggaagtgatgtcgtttggtttcaaatatgggctcccgttggacgctgacattgtcatggacgtccgatttctacccaacccatattatgatgccaaaatgcgttacaaaaccggccttgataaaccagttcgtgattatgtcatgaactcccaaggggccaaagaattttatcaaaaactattggatatgatggtcttcacactgcccggttaccaaaaggaaggcaaggccagcttaactattgcgatcggctgtaccggcgggcaacatcgttctgtggcaattgcccaacagctggcaaatgacttgaaagatcagtatccggtgaacatcacccatcgggatattgaccgccataaaacaaaggagggtaactgatgcttgacgcacttcatacgcaccaaccgcgaattgtcgtgattggtgggggaactgggctgccagttatcctcaaaaacttacgaaatcgacacgtcgacattactgcaatcgtcaccgtcgccgatgatggtggttcttctggtatcttgagaaactacattaacgtcgttccgcctggcgatatccggaacgttatggtggcactatcggagatgcctgagttgtatttggatttgtttcaataccgatttcgaagttcagaccaattctttgccggtcacgctttgggcaatttgattattgcggcactttcagagatgaaaggcggtatttttgattccgtccagatattgagtgacatgctcaaggtggatggccatatttatccggctgccaacgagcccctggaattaaacgctgaatttagtgacggcacgacaatgagcggtgaatctgaaataaccgctgccggcaaattgattaagcgcgtttgggtcgagaccaccgatgattctcataaaccagaggcggttcatcaagtgattgatgcgattatgaacgctgatcagattgtcttgggtcccggaagtctgttcaccagtattttgcccaacttaatgattgaaaacgtgggtgaagccttacgacaaaccagcgccgacatcgtctatatttgtaatatcatgactcaaaagggtgaaaccgagaacttcactgaagctgaccatgttcgcgtcctgaatcgtcatttagggatgaactttattaataccgtcttggtgaacatcaaagaagtgccggctgaatacattgattaccaaaaatggaatgaagtctcacaaccggttaaacatgattttgccggattgcgggccatgggctgtcgggttatctcagccgattttctggaattaaaggatcgcggtgcctttcacaatgggcaagaggtcgctgacgaattgatcaatttactgggtcgatcattggacgaccataagtaggccagtcactcaagaaatggaggggattaaatgtcatacgcaagtgaggtcaaaaaggaattaacctctttgaccgttcaccgggataatgccaaggctgaattaatggccttgattcgaattaatggctccctttcaatatccaatcaccactttgtgttaaacgtttcatccgaaaacccggcaattgccaggcggatgtacaagttgctttcaaagttctacgggatcactggcgagctcagtgttcgtcgtaaaatgaagctgaaaaagaataatttatatattttacgagttgaaaataaggcaacccaactgttggatgatctgggtatttttgatggtgcttcaatcgttgaacgggttcccagtcatatgttgacagaagattcgcagatccgctcatatctgcggggagcctttttagccagcggctctgttaataacccggaaacttccaggtatcatttggaaatctattccctgtatgaaaatcataacgaaatgattgcagaaatgatgaacaagtatcacctcaaagcccgcactacgcaacggcgaagcggctacatcacttacctgaaagaggctgaaaaaattgccgactttttgcaattgatcggtgcgaccagctcgatgctgaaatttgaagatattcggattgttcgcgacatgcgcaactccgtgaatcgactggttaattgtgaaaatgccaatctcaacaaggttgccaacgctgccagtaagcagattgaaaatatcaaactgattgacgagatggtcggattaaataaactgaaccctaagctggcccaagttgcccgggcgcgcttgaaacatcccgaagtcagtttgaaagagttgggcgacttggtggagggtggaccaatttccaaatccggagttaatcaccgattgcgaaagattaacgaatatgccggcaagctggctcagggactgacccctgaagtttagttttgaccaagctagtaaagtttcaacacatttttaaacctaaaaaaggattctaattatttcgctgtgaaatagttagaatcctttttaaatccaatcatttaactgttaatgacagaggttagccctcactaactcttaaaacacaggcaccacgaatatcacctttggcaatatatttcagcgcctcgtcagctttggccaacggatattcagtgacctccggatggatattgagtcgatcagctaaggtcaggaactcttcaccatcccgacgggtgttgctttcgacactggtgagatttttttcatggaaaatgtgacttggataactcatttgcggaatatctgttgagtggataccggccattgccaacgtgccacctggtttcagcgcttccatggcttttggaactacgtcaccaaccggtgtgtagttgattgccgaatccagcttaacgggtggcatatcataggttcctctggctgaggcagctcccagttgcagggcaaatttcctggcatcttcaccacgggttaaaacgtgaacctcgatgccttgcttcattgcaatttgggcggtcaaatgagccgagccgccgaagccatacaggcccaaggtgccgcctgcagggacgttagcccgttcatatgcccgatagccgatgattccggcgcaaagcagtggggcagccgtcagtgaatcaaaccgggccggaatccggtatgcgaaaccttccggaacagtgacgtattctgcatagccgccatcatgatcccagccggtataaagtgagttggggcagagattttctctcccggaccggcaatattcacaaaccccgcaagtccaacgtaaccaaggaatcccaatccgatcgcctaatttaaatcgacgggtttcagcacccatctgaacgacccgaccaacgatttcatgaccgggcgtcaaatgttccttatgaaccggcagatcgccttcagttacatggagatccgtgtggcagaccccgcaagcgatgaccttgaccaaaacttcgcctcgttttggttttggcaccggcttggtggtgtaacgtaaaggagaaaccgcaccgttaattgaaccgggcttaacaatttcccaggccttcatctcagtagggattgattcatcagcagtttgtttaacttgttcttttgtttgattgacatccatattaatggcctcgattcatcattcatcatgttaattttttaactaacttcacctatattctagtcggtcatcaaccaattatcaatcaggtggattatgtaaaaaaagcagccctcacaaaatgaggactgctttgaaaggcatcatacaattcaattaacgaattgaattactgcttttcggaactgctggtcataatgccatccaaaaggccataatcaacagcttcttgagcagtgagataattatcacgctcggtgtctttgttgatcttctcaattggttgaccggaattctcagctaagagattgttgatcatcttacgagctttgagaatttcttcagcagcaatttcaatttcagtttgttgaccttgagcaccaccagaaggttggtgaatcaagacttgggcatgtggcaaagcaaatcgcttaccctttgctccagaagaagcaaggacagaagccattgatgcggccattcccattacgatcgtttgaacgtctgacttaacaaagttcatggtatcgtaaatggccatgcctgaggtgatcacaccaccaggtgagttgatgtagaggtaaatatctttttctgagtcttgagcatccaagaaaagtaattgggcgataatcgcattagccatgtcgtcttcgatagggcctgataacatgataattcggtcttttagcaaacgtgaataaatatcatacgcacgttcaccgcctgcggattgttcaatgacggttggcactaaattcattcaagatgcctccttataggttttatgaaagatggcttacgccaagttcatgttaatatgatagtttattggtcaaaaaaggtcaaatgttttgctcacatcaaatcattaatttttccggtcaatcttcactgtgcttcgataaagaaatgcttataataagaaagcggattcattcgtgatacaataacggtaatcagcaaataccgagtcgggaggatatactatgagaactcatcatatttcactgttaaccagagatgctcaacaaaacattgatttttatacccgggttttggggatgcgcctggtaaaaaacaccgtcaatcaggaaaatatccgcattcgtcacttattctacggtgactatctgggaacaccaggatcagtggtgacattttttgtggtgccattattaggccatcggactgacggtaagcatttcttcaataatatcaaactttcgattccaaccgggagcactgatttttggaagaaacggttaaccgaccattcagtggctgttcaagatattgaccatggcctggtgttcgctgaccctgatgatgtcgaagttaaattattggagacttcggaagttttaaccgatatgcgggtggttcctgataatgggatccccgctgaaaaacaaattacgcatttaatgggaacagaactccacgtgccggatcctgaagctaccagtgcctttttccataattggttgggcattccggtagaaaataatgttgtccaattggaggacggccagtccattgaattatttgaaagtgaccagcaagatgtccggactcggtttggccggggcagtattgatcattttgcgattcaagccccaactaaggcggccttgttcaaattctgggatattgccaaagaacagcacttaaacattgaagagtatgccgatcgtggctggttcaagagtttgtacgtccgagatcctggtgataaccgggttgaaattgccacgacgactccggggtttagtctcgaagaacccattttgacgatggggcagggactgtcattgccaccgaaatttgagtcccaacgtcaagagatcatggacttctatgctaaagaaggcgttgattttaccgaaggtgttcgagagccaacgtccgtcccggattaaccaggggttgttgaattgcgaagaaaagattaaccatcaaaaaaagaggttcaaggattaagcttggacctctttgttgtttgtgaaatcaagccgaccattgagaggaccaaacttcagaaacatcccatgacttacctaagatattttgggacttgatttggcactccagaagcgataaattgaattgtttggcataggaacagacacacgctagtcagtttgcatgaaagtgagaaagagaatgaaaattgtcgaagaaaccaaggtcagtcccaaattggtgaaggacttgttgacggtttgggagagttccgtcaaggcgacccatttatttttgacagataacgagattcaaaagattaagaaggtcattccggaagctattggcggcgtccagcatttaatcgtgattgaaaacgacaatggggatccggttggcttcatgggaattaatgaccgaatgcttgaaatgttgtttatctcaaatcaataccgtggtaagggtttgggcaaacgactattggattatgggatgcagcagtattcgatcgaccagcttggtgtgaacgaacaaaacccacttgcgcgcggattttatgagcacatgggatttgaagtttacaagcgcacggaatttgatgaacagggcaatcactttccaattctgtatatgaaaaaagcggaatgacgatcaagctgattgcttacaaaaaacagcggggcatctgcctcgctgtttcgttgattaaaattgttttgtgtccactgaacctagtttcaccactaacacaattacctatgtgtcaaaaatgacctaatgaaacatgaatccttgcttgcgatgggtcagtgaaatctgatgcgcccggggggaatcgaaccctcatttcaagaaccggaatcttacgtgcgatccattacactacgggcgcaacttcctataccaatatactagaaagtgagaactttttcaagaacaaagaaaaattgattgtgaaaacgcttactaaatccatttgcattgcaattctcccgcggtctgctatactcgaatttgggtaatattttatggttactcgatgcatactttgaactttcgttcacaagggtgctgactttgttttcatttcatggtacgattaacgtgtactgtgtcttaatattttcttatttcctaaaggaggaaaacttagtatgactgtaaagattggtattaacggttttggccgaattggtcgtttggctttcaagcggatccacgaattacactccgacgagattgaagtggctgcaattaacgatttgaccactccatcaatgttggcttatttattgaagtatgattcaacccatggacgtttccctggtgatgtttcagcaactgacaagggtatcgtcgttgacggtaaagaaattcctgtttacgcagaaaaagatgcttctaaccttccttgggttaaaaatgacggtgttgactacgtacttgaatgtactggtttctacacttcagaagaaaaatcacaagctcatatcaaggctggtgcaaagcgtgttttgatttcagcacctgctggtcaaattaagactgttgttcctggtgttaacttggatgaattgaactcaaacgatgtcatcgtttcagctggttcatgtaccactaattgcttggcaccaatggcttacttcatgaacaaagactttggtatcaaagttggtactatgacgactgttcacgcattcactgcttcacaacaaattcttgatggtcctaagactaagaagaagcgtaacaaccgtactgccagtgctaacacgattcctcattcaactggtgctgccaaggctattggtttggttatcccagatcttgccggcaaactccaaggacacgcacaacgtgttgctgtcgttgatggttcattaactgaattagttgcagtccttgacaagaaggttactgctgacgaagttaacgatgctatgaagaagcacaccgctgacaaccctgcatttggttacaacgctgacgaaattgtttcatcagatatcattgatgattcacatggttcagtatttgacccaactcaaactgaagttactactgccggtgacagccaacttgttaagactgttgcttggtacgataacgaatggggcttcacttgcaacatggttcgtaccttgttgaagttcgcttcactttaataattaattgtaattggcggaggagggtggccttctccgtcttttactatctcgctatgttctctagatcacaaatcaaatcgattttgggaggtttccaaattggcaaaattaacagtttctgatttaaatctcgaaggaaagaaagttttgatgcgtgtcgactttaacgttccgatcaaagacggcgttattggtgacgataaccgtatccaagctgctttaccaaccattaagtacgttttggaccacaaaggcaaagcaattctttgctcacatcttggccgaatcaaaaaagaagacgacaagaagggcctttcattacgcccagttgcagaacgtctttccaacttattgaacaagccggttattttcgttcccgttactgaaggtaaacagcttgaagacgccatcaacaaaatggaagacggcagtgttctcttatttgaaaacactcgttatgaagatgtcgttaatggtgaatacgtcaagcgtgaatccggtaatgatcctaaattaggtgaatactgggcttcacttgccgacgaattcattaacgatgcttttggtactgctcacagatcccacgcctcaaacgctggaatcgccgaagcaatgcacaaagacggcaagccagttgctgctggtttcttgatggaaaaagaaattcagttcttaggcgaagctgttaacaatccaaagcgcccatttgttgctattctcggtggtgccaaagtttctgataagatcggtgtgattgataatctgcttgacaaggcagacaagatcatcatcggtggtggaatgacttacacattctatgcagccaaaggaatcaagattggtgactcattgatcgaaaaagacaagattgatgttgccaagaagatccttgaaaagggtggcgacaagatcgttctcccaactgacaacgtggttgctaaagaatttaagaacgacgcagaacacaaagttgttgccggtgacattgatgacggctggatggctttggacattggtcctaagtcaattgaagactttgaaaatgttcttaaagatgctaagaccgttgtttggaacggaccaatgggtgtctttgaaatgcctaactatgcccaaggaacccttcgcattggtaagttccttggaacgttaaacgatgcgactacaattgttggtggtggtgattcaactgccgctgtcaaacaattaggcgttgctgacaaattgacccacatttcaactggtggtggtgcttcacttcaatatcttgaaggtaaaacactccctggtattgcagcaattgacaacaaataattgacgaagagcttgctatttagcgagctctttttcttttactaaaaattggtataggagaaaaatgtggcttttaaattctcttttggttacaatggcattaagctaaaaaatgtaaaggatgattcttatgagaattccgttcgttgcgggtaactggaaaatgaatttatcagtcgctgaagcagtcaaatttcttcaagccatcgagggtgaattacccgatcctaagataaccgagacctgtattgcggcttcaccactctttttggagagcatggtcgaagaaaatggtgattcaccactgattatctccgctgaaaattgtttttatgaagacgagggcgcatacaccggggagactagccccaaagcgcttgccgaaatgggcgtgacccacgttattattggtcattcagagcgtcgtaagtactttaacgaaaccgacgacattattaataaaaaggttcacgctgcttttcgcaaccaattaacaccaatcatctgctgtgatgaaacgatgagccggcgtgaatccgctgatcgaatttcctgggtggtcagtcaagtgaccaacgcccttaaatcgattaccccgcaacaagctgagaagatcattgttgcttacgaacccagttgggcaatcggcagcggcaaaaccgccagcagcgatgaagccgaagagggttgttatttaattcgtcaaaccattgctgatttgtatggcgatgatattgccgatcaagtccgagtcttgtatggcggcagtgtaaacgacgaaaacgccgatgacattctgtcacagactgatatcgacggtgttttggccggtggtgccagcttaaaaccggattcattcttaaagcttgcaaactttttacaaaaatagttaaattcgctgatttatgttgaaacttcggcgagaaactaatagaattgaagttgaaccttgtacaaaaggtcacaactttcgctaaggagagaaaaaaacatgtcaattatttctgatatttatgctcgtgaggttctagactctcgtggtaacccaactgttgaagttgaattgtatactgaagcaggtgcaatgggccgtggaatcgttccttcaggtgcttcaactggtgaacacgaagctgttgaactccgtgatggtgacaaggatcgttacatgggcaagggcgttaccaaagccgttgacaacgttaataacatcatcgctaaagaaattgttggctacgatgttactgaccaattggctattgataaggctatgatcgaattggacggtacccccaacaagggtaagttaggtgccaatgcgatcttgggtgtttcattagctgctgctcgtgctgctgctgatgaattggaagttccattgtacaactaccttggtggtttcaatggtcacttgctcccaacaccaatgttgaacgttatcaatggtggtaagcatgccaacaacaaggttgatttccaagaattcatgatcatgcctgttggtgctccaaccatcaaagaagctattcgttggagttctgaaacattccacaacttgaagaacttgttgaacgaacgcggatactcaactgccgttggtgatgaaggtggatttgcgcctgacttgaagaacaacgaggaaccatttgaaatccttgttgaagctattcaacgtgcaggctacaagccaggtaaagacattgccattgcctttgactgtgcagcatcagaattctacaacaccgatactaagaaatatgatttaaagggtgacggtaagtcatacactgctgatgaatttgttactttgcttgaaagcatcgttgacaaatacccagttatttcaatcgaggatcctcttgatgaaaacgaatgggctgattggcaaatggctactaaacgccttggtaagaaagttcaaatcgttggtgatgatttgtttgttaccaacactgattacctcaagaaaggtatcaacatgggcgttgccaatgcgatcttaatcaagcttaaccaaattggtactttgactgaaactgtcgaagctgttgaaatggccaaagaagcaggctacactgcaatcatttcacaccgttctggtgaaactgaagataccacgattgctgacttggttgttggcctcaatgccggtcaaatcaagactggttcaatgagccgtggcgaacgaattgccaagtacaaccaattgatgagaattgaagaccaactcggtgacgttgccgattacaaaggaattcactcattctacaacttgtcagaacaagcacgccaagacatcttaaacaagtaatttgaaaaaagtcgtgaaagcgactttttttgtacataaaacgcctccatttttgcgtatctaactcttagatcataaataatggaggtattattttgaaaaaaacacttttattatcagtttcgttaggcgtgctgggattcgccagtccactggtgcatgagcagattgttggtgctgaaatcagtcaaacagctacccaggagtttcctgacaaaattaccatccaccaacagtttcaagttagaaacatccgtggtgacaagtcggtgcttgacaaacaagccacagtcaagatgtacattgataagagtaagtcgtcaacctttagtgccccggacaacgttccacattaccatccggtcgtttccgaagtgcattattctcccggaatggtggttaactatatggcagaagatgctgtggtgaccatcaagtaccttgatgaaaacaaccaaccaattcaggacaacaaggttttcaatcaagcaactatctttgggacctaccgccttaataaaaacgaatttgacgtttcaggttatgaactgctcaattcaaaggatatcaatggaaaaatcaaagagaccaactgggatgtgaccctcaaatataagagccttaatccattgattgctgcggattggttggctaatgtggttgtaccagaccagccagaacctggtaattccaagtctggtgaaactgggcagacaagcgaaccaattcagctcgttagtgaaaagcccatgagcgagtctgcttcaacgccggtggtttcaacgactgcgacaactgacatgcaaccatcaccaagtacaccgagcgaggctggcaatcatgtcgttccatcggttacccaaactgaaccaacgcaccaaccggctgtcaaaccagtcgaaacgcccgataaagaagtcaaggacactaccgcttccaagtccggccccaaacatgatgataaaaaggtgaaggtagtgggtgccacagggactgaaaacagccaagtaaccccaccagtggcggcgccgggaaccaaattgccggatcctgaaccaaaaatccagcccaccactaaaaccaatggggcgtcatcacggtccgataaagagactcgtgttactaaacctgaaagcaaaaaggaaggcgcagttgcagattcgtcgactaatgcaaagtcgacatcatccgttcagtccgaaaccggcaaaaaatccccatcatccaagccggtagaaaccacagccgaatcactcaaacccgatgaaaaagtgcagggaatttcaaaaacgtctgcgaagccgtctgaaaagccagccgaccttcctggtaaaaccacagatcaatccggctccacaaagaacacagttaagacttccgaatctgattcaaaagactcagaaaaaccggtcgttcaaacaaaacccaaaattccgaaaatcaaccagacaaaggtacccgaaaaatcaaccgatcatcaggaaatgcaaccaatgaccacaacctatcaactccatgggatcgacactcacggccacttactcttcaataaagccctgcatctcacttcagaagaggctcgggcattccggtcaaagaacgtcgaattttatggctatgaattacagtccaccgacctggatgcaagttcgaaaaccctgacattgcattatactgctaaaaaagtcacctttaatattatcaacgtggatcaggatggcaaaaccatctctaaagactcagtggaacttgaatatggccaaaccaagacttacacggccaagtttatttcaggttatcgggttcagcaaccaactcaggaactgaaggctgacaatctgatgcctgaagatgtgcacttcacttacatcaaattagctgacaaatcaaacaagccattagctgaaccgactgcactcagctcaaagactggccacaaaaaagggcgtcaatcagctatcagtggccggaatccgtctgaaaccaaatcaaagcgacacagcgaaaccaaagacacttcggaagtttcagaaaagcttccccaaaccggtgaatcgcagtccgttgtcggtgttttatcgggggtggcacttcttggcgcgttaatcggcaaaaaacttttcaaacgactcatttgattatgatataatggatatcagaaatcattaaaggatgagcaaaattgcaggtaagaggaagttacaagctgtctcaagtaaaaacaatcgttaacgggatcgtcattggtgtacttgccggttcggcagtctcaatgtttcggtggtcaattggccatatgacggatttgatgcgctatctttatatcaattcgatccatcatctgtcgtttctactgacgacaattgtcattaatattgccattggcttactggttggctggtttctaaagcagcagccggatattaaaggatccggcattccacaagttgaaggtcaattgttaggtgaggttgattacggctggtgggcgattctgtggcggaaatttgttggtggcattttggcgattggaagtggtttataccttggtcgcgaaggtccctcaattcagttggggtcaactttggggcagggagttgcccatttcaccaaacaagttgggtttgatcgccaagtgctcatttccagtggtgccgctgctggcttaagtgcggcttttaacgccccaattgccagtacgctgtttgttttggaagagatttatcataacttttccaccaatatttggattgtttcgctcacatctgcggtcacttctgacatggttgcgacgtatgtttttggcctcaagccggttttatacatgcgaagtacgccactgccactcaaatattttttgtgggttgtcattttaggaattgtccttggcgtgttgggccggttatatcagatggttattcttcggatgggaaagtggtatcggcatactcatattccctggtacttcaacggaattattccgctgttgttggtgatcccaatgggagcgtttttcccgcacttgttgggtggcgggagtgacattattctgaggttgagttcggcaaattatccaactctgattttatgtctttatttcataattcggtttgttttctcaatgctttcatacgggagtggccttcccggcggcattttcctgccaattctttgccttggtggtttaatcggcgcgattgtcggcagtatcgctgtcaatcttgggttgatgaatccactgtatttctcgagtttcattattatggggatggccggatactttgcggcaatcagtaaggcccctttcacggcaattcttttgattacagagatggttgggactctgacccatctccttggcctggcggtcgtgtctttaatcgcatacggcgtcttagacctgttaaacggcaaaccagtctattactcgatgcttcagcagctgctgaaagttcagaccaagatgaatttgggtcgaactgctgaaattatggaaactgtgtatgccggttcacagatggatggcaaaatggtgcgtcagatcaaatggccaatggggtcactgctgaccaagattcaacgaaatggtgtcgaaattgtgcctgctggcggcaccttgattcgatggggcgatacattgttcattaacgtctcgactaaaaatcagcacgcgatcactcaacaaattattgccttaacaacagaaacttaatcccaaaaggtagcgaattctgctataatgtgttagtttagtaagagtagtattaagccgatttaacggtaggaggctatcaacgtgtacaactttttgttaacattattgctgatcgactgtgttttaattacaatcgcagtgttaatgcaaccatcaaagactaatgacgccatgtccgccttaactggtggggccgacgacttgtttgcaaagcagaagccacgtggctttgaagcattcatgcaaaaaactacacttgttttagggattattttctttctcttagcacttgcattagtttggatatcatctcattagtattcaatcctcctgtttaaatgcaggaggatttttattataattgaatgggtggacatgaaaggatgggtgctatgcaaacaccagtcaaatctttttattttgaacacggaccgagagcaattattctgttgcatgcttttgccagtggcccggttgacgttcgaatgctcgcgaggtatttggagcgtcagaattataccgtgtatgcgccaatgtttacgggccatgggacggctgattttaccgatatcctgattcagggaacgcccgagcgttggtggaatgatgccaaacgggccgtccagtttctaaaggacaagggctatgaccaaatcagtatctttggcatctcgctgggcggtatttttgccgctaaaacgctggagaatgatccgactttactcggcggcggttcgtttggatcaccaattgttcgaaagcgtcagtttagtgttcataatacctttatgcaaatggccaaagccaattttgttcagtatgataccaatgaagcgattatgaattcaaaactcaagtggcttgacgaaaatattgatatactattaggtaagattgctgatttcacagttggtgtggcgcaggatctacctaaaatcacccaaccatacttcatcggtcaggggttaagcgatgagatcgtgaatcctgaaagtgccaagtctttgagggatggattggtgaacagtcgggtcagttaccacgaataccccaacgccagtcacatgattaccgttaatcctgctcacaagcagcttgaggctgatttaaccgaatttttaacacaactttatgaataataagaggaatatagattgcaagataatgatttgaaaaatcaaatagaaaacgttctccgaacctatccggataacgtgtttactgtcgagaaaattgctgacgtcctgagatcgcatggttcagcagcctttaagctgattgttcaagaattggcttctttggaacgcgataaagtcgccgttgtgactgaagacggcaagtttcaattgaatcctgataaacaacaattaagtggtattttccacgctaatgacaaagggtttggtttcgtcgcttatgatgaaaatgctccagatgcttacattgcgcccgataacaccatgaatgcactgaatggtgatactgtggaaatggaaattgtccggccggcgcaaccgggatctgatcggggcccggaaggtaaagtcactaaaattgccgaacacaaatatacccgcgtggttggaccgtttgaaaagactgatgatgacaaaggatacattggtcaattaaccctcaacgataagaaaattgccaagtacaaattttatatcaacgacgttggcctgaaaccaacacctggtgaagtgatcactgctcaaattaccgaatatccatctaccaagcaccctgattacatggtggggattgccgatgaagtcatcggatcagttgatgaccctggaattgacattttacagattgtttatgcccatgatattcccgctgagttccctgaagatgtcattcaggcagcggatgccatcccagatcacgtgactgaagccgagaagattggccgagaagatattactgatcaggacttggtgaccattgacggggaatcttctaaagatttggacgatgcggttaccgcttggaaactccccaatggcaattatcatttaggggttcatatcgctgacgtgagccattatgttcaacccggcagcgccattgacaaggaagcattccgtcgtgggacttccgtttatctgactgaccgtgtgattccaatgctgccaagacgtttatccaacgggatctgttccctcaacgaaggcgaattacgattatgtatgagttgtgagatggagattgatccatccggcaatatcatcaagcatcggattcaccccagtttaatgcgttcaaccgcccgaatgacctacacagcggttaacaacattttggaatctcacgatcaaaaaaccatggaccgttacgataaattggttcccatgtttgaaaccatgggtgagctgcacaaaattttatacaagcatcgaaaagcgcgtggggcaattgacttcgacgataacgaagcagaaattatcgtggatgacaaaggccacccaatcgatattaagctgcgggttcgtggtactgccgagcggatgattgaatcattcatgctggccgccaacgaaacggttgccaagcactactatgaaaaacacgttccctttatttaccgggtccatgaaacgccggatgccgatcgaatcagaaccttctttgagacgttgaccgcattcgggattaatgtgaagggtgatccagagcacgttaccccaaagactttacaaaatgtcttgaaaaaagttgccggcaagcctgaagaaatgatggtttcagtgatgctgctgcggagtttgaagcaggctcgttacgccgatcagtctttgggacactttgggttggcagcaccgttctatacccatttcacatcgccaattcggcgttatccagatacaatggttcatcgattgattcattattatcaagataacgggattaacgatgagaccaagaaacgttatgccaacgtgttggatgaaattgcgacgacgacttctcaatacgaacgtcgggccgttgatgccgaacgtgataccgattcaatgaagaaagctgaatatatgaacgatcacatcggcgaagaattcgatggggttgtcagttcagttatgaaatttggtctgttcattgaactgccaaatacggttgaaggcttggttcacatcagtcgaatgaacgacgactactaccaatacgtggaacaatttatggccttggtcggtcgaaacactcgtcgaacctacaagatgggtcaggcaatcagagttaaagtggtcaatgttgacgtcaagcagagtgccgttgactttgatattgttgatcctgaaaagacgccacaaagtaacatgctgccaaagcggacttatcataataataactatcatggcaataacgagcgccacggcaattcgaataacaattcccgttccaatcacgccaacaacaaccgtgggagaaacaacaaccatggcaacaacggacatcggaaccataataaacattaagctgtaagcgaggtgatttgatggccaaaggcaaaaagcagcataataacgataatttgatggcgcaaaataaaaaagcccgtcatgattattcgatttcagaaacctacgaagctggaattgtgctgacaggtaccgaaattaaatcgattcgtgctcggcggattaacctaaaggacggcttcgttcaaattcgaaacgatgaggcctacatgatgaacgtccacatcagtgagtacgctgaggggaaccaatttaatcatgacccgctgcgcaatcgaaagttgttgctgcacaaaaagcaaattcgcaaattggctcaaattactcaagacaaaggggttacaatcgttcctttaaaggtctacctcaaaaatggttttgccaaagttttaattggggtagcaactggtaagcatgagtacgataagcgtgaaaccatcaagcgacgtgatcaaaagcgtcaaattgaacgagttatgaaacattattaatcaagctcaaacaaaaagcgatgaaatcaattggcaagctgccgactgattcatcgcttattttcattgtgcagggtcgaaatattttcactttcaagatttggtttgacgggtgctttattcaaaacacccaacttcaatcgggaagcatgtgccaacgagggatgattgagaatggcggcaatggcaagcaccagtggctcatgattggtattgtctacatccatgatccgaatgacttgatcggactgactgtatgacttgattgtcgcaatccgctggcgtccgtgcatgattcggtaagtttgtttgtcctgattaccggcaaccaaccaattaattccgttgataaaaatcgttgtgtagtgcatcgtaaaatggatcacggaaccgcccacaaattggtccaggtaatacaaatcaaatttaggcgtcatgcccagagattgttgacggacggttgccacgacttcacctgaaattgagtaaattgaaaaagtgtcgtcaatcaagccccacttgccgacaattaaatattttgtgtctcgatattgatcggtgaccttagtcgaacgggtgtgatccagttcggttaaattcaactgtaattttcgactcatagacgcatttcctttacttgtattattttcattttaacacgttctgaaattatttacgctggtgttattttaaaaatggtatggtagaataaaacgtgaggtgttgggaatgaaaccgtttataaaaaatgactggtgggatgttttaaagcccgaatttgagaaaacttattatcagcagttacgccaatttttgatatcagaatacaagacgcaatatattcatcctgatatgaatcacatttttgaggcgtttcagctgacccctttcagcaaggtaaaggtcgtgattttgggacaggatccctatcatgagcctcatcaagcccagggattgagtttttctgtcatgccgggcgttaaaattccaccgtcacttcagaatatttataaggagcttcagtctgacctcggaatcaaaccggttgaacacggtgatttggaaagctgggccaaacagggcgtattactgctgaattcagttttgaccgttcgcaatggccaggccttttcccacaaagggaagggttgggagcaactgactgatgcggccatccaaaaactgtccgctcgtgagaagcccgttgtctttattctgtgggggagagctgcccgagataagattgcgttgattgatacgaagaccaacgtggtgattcaatcggcccatcccagtccattgtctgctcatcgaggattctttggttcgaaaccattttcaaagaccaatgaagcactggaagcaatgggcgaggagccgattaactggcagctgccggaaaaggtatcgcaaacatcttagactgattttgtagaattggaggatttatcatggaattatttgaaagtcttaagcaaaagatcaagggcaaaaacattagtatcgttttcccagagggtgacgatgtccgaatccttggtgccgccagccgtctggcaaaggacggactggttaatccagtgattctgggggctaaagacaccgttgaaaaagttgctaaagacgctgacattgatttggggaacgttgaaattatcgactacctgaaccaaccagcggatcaaatcgatgaaatggttgcagctatcgtggaacgtcgtaagggcaagaccgatgaggctaaggcgcgcgattggctgaaggatccaaattactttggaaccacattggtctacatgaacaaaatcaacgggatggtttcaggtgccaatcatccaacgggcgacacggttcgtccagctctacaaatcattaagaccaagcccggcgttaaattaatcagtggtgctttcattatgcaaaagggtgacgaacgatacttatttgccgattgtgctatcaacttggacccagatgccaatgccctggcagaaattgcggttgaaagcggcaaggttgccaagaccttcgatattgaccctaaagtggcgctgttgagcttctcgaccaaaggctctgccaagggtgatatggtcaccaaagttcaagaggcaaccaaattagctcaagaacaggcacctgatatggcaatcgatggtgaaatgcagtttgatgccgcatttgtcccaacggttgccgagaagaaggcaccaggttcaaatgttgccggtaaagccactgtctttgttttccctgaattacaatcaggcaacattggctacaagattgctcaacgattcggtggttttgaagcgattggtccaattcttcaaggattgaacaaacccgtttctgacctgtcacgaggcagcaatgaagaagacgtttataaagttgctatcatcacagcagctcaggccttataatagaaataattaaacagggtaggattgcggtggttattgcgtcgcaatccttcctttttgaatgaggtgattaattgactaaaacgataacagtccattccgcggatcaaaccatgacgatcggtgagaaattagccgcatacttggcgccacaagatttgattttgctcgatggtgatttgggagctgggaagaccacctttaccaaaggacttgccaaaggattggggattacgcgaccaatcaagagtcccacatttaccattattcgcgaatatcaagacggccgaattccgctgtatcacatggatgtgtaccgacttgaagaaggcggtggcgatgatctgggcttggaagaatattttaatggcgacggggtcaacgtggtcgaatggtcaaagtttgttgccgacgaactaccggatgactatctccggattatttttcggcgggatgattctgagggcgacaacgtgagaacattgacttttgaggccaccgggcaccgttttgaacaactaattgatgatatattttcagaataacaatggaaagcgagcaatgatgtggcagaagaagtagactttcggttagcagaaccgagtgacggtcaggcaattttggatttgttgaaggttcttcaaggcgagtccgatacgtttttggtcgattctgatttggatgacattaccgcagccgacgaagcccaacaaattaatttgatcaatcattcccggaccaatttgatggcggttgccacctatggctccgaattgattgggattgtgaccgttgacagtgttgataatggagtcggggaagtcggcgtggccgttcttgcgggttaccaaggatactcgattggcaccaacttgatggaactggccattgactgggcaacagattttagctcgcttgatcaactggtgctgactgttttctcgaagaatgagccggccattcatgtttattacaaagttgggtttcacgataccgacgtgtactttcaagacggtcgtgaagttgtgagaatggcctttgatgtcccaaaaaaggattgaagccttgagtgacgtggttgcttattgcaactaagaccgccacttttttattaaacggacgtgatgactggttgatctcaggcacttaatgaaataacgcaaccatccctaatcttggaatggttgcgttattttgttgaatgctgggatgaaactaagttcgttccaatctctttagattgctttgacaaatggccggagcatatcgctgccaaattgggcctgttcggttaatagaatattggcacaggcaacactatcgtccagcgcgttatggtgatgttccaaaacgatgttgagcttatcgcaaagggtgttaagtttgtgattttccaacgtcgggtagaattgcttggaggtccttaacgtgtccagtgtcagatagtgcggcggttgaacttcataacgttccagtgttcgtttcaagacgctgttatcaaatgatgcgttgtgggcaatcaccaatttattggctgaaaacagcggttgaatgtggcgccaaacttccggaaaggtcggggcatcgacaacatcacgttcatgaatgccatggacgttgatatttcgccaactaaagtccatttccggattgattaatgaataaaattcgttagtgatttgattatctcgaacgatggccagtgcaattgaacatgcgctggctctttttgcgtttgcggtttcgaaatccatcgcaacaaaattcatatttttcacctcaagttaatcacattgtacaaagaacctcgtgaaaacgcaaccggagtgcttcccggctattccgccccatagataacttgtttcgtggtaaaattaatgtatatgttttgaaaccgaggaattgaaaaatgatgcaatcaaaaactgttgtagatttatatccaaaaattgagattctgttaaatgaacctttatccaaatacacccacacgttgactggcggtccggcagatattcttgcctttcctaaatcgattaaagaatgtcaagaaatgttggattatgccaacgagcaatcgctcccggtcactgtggttggcaatgccagcaacttaatcgtcaaggacggcggcattcgtggcctgacaatgattctaaccaaaatgaaccggatttcgtcacatgataatgaggtcgtcgcggatgccggagcggctttgattgacgtgaccaaggctgcccaagcccattcgttaactcacttggagttcgcagcggggatccccgggagcgttggtggagcggtgttcatgaacgccggtgcttatggcggtgagatcgccaatgttgtcagtggggcggaagtcttgacacccgacaaccacattattcacttgaatcatcaagagctggatttcggttatcggcattgcagcgttcaagaaaaccatcaaatcgtcatttcggcgaccttctctttagaagtcggcattgctgacaaaattcaaaagcggatggatcatctcaatgctctgcgggcctctaaacagccgttggaactgccgtcctgtggaagtgtcttcaaacggccaaccggctattttgccggtaaactgattcatgatgccggacttcaaggcttccagatcggcggcgcccaggtttcaatgaaacatgccggttttatcgttaatgtcgatggtgccactgccactgattatttaaacgtcatcgcccatgttcaaaagaccgtttacgacaaattcggcgtgcatctggagacggaagtcagaattattggagaagaccccaagtcaaactaggagttggtaatgcgtgcacattcttgaagcggtcattctgttaatgacgttggttgttttttccaacgttgttgaccattttgttccagcggttccggttagtttaattcaagttgttttgggactgggagccgctttgattatgcgggtgaccattccgcttgaaactgattggttcctgctattatttatcgcgccgttgctgtttaacgacgggcgcaggttccccaagcaggagttgtggaagttgcggggacccatattggccaatgcaattgtattggtttttttgacgacaattttaggcggcttgctgtttcacttaattattccaactatgccgttttcggtcagttttgcgctggcagcgatcctgtcgccgaccgacccggttgccgtgcagtcgatttccaaacgggcaaagcttccggaaggaattttacacattgtcagtggcgaaagcctgatcaacgatgccagcggcctgattgcctttaaatatgcaattgcagccacggtcaccggcgttttctccattaaaacggccgccattgactttgtttatatcagtattatgggcttcgtcagcggtctggtcattatggggctgattttgatgattgaaaactggctgtatcgacagggaatcaacgatgtcatttttagcacggtcctgcaggtcacaacgcctttcgtggtgtacctggtgactgaagaatttttgcatgcctccggtgtgattgcggtggttgccgcagggatcatcttccacttttacggaacggcaccggatcgcagtcaacccgagctcaaattggtcagtgaaaaaacctgggacattattatctataccttaaacgggattgtcttcttaattctgggaatcgaactgccgttagcaaccaccaatgtgattcaaaataacaagattaatacctttgctgcactgggaatttcttttctagcctggctgattttgttggccattcgagttgtctggatctacgcctaccaagcggtcagcagtattcgctcccgaaaaatcaaatcaattcaaaccaagcaaatgcccacctttaaggcggcgctgttggcaggattgtctggcgttcggggggccgttaccatggccggagttttatcgattcccatgacgattgataatggcagtccgtttccgtccagatcactggcgttattcgttgctgccggtgtgatcatcatttcactggtcgtggccaccgtcaccttgccgttgatttctgaggataaggcaccactgttgactcgagccaactcaacggatgatccggatgaaattgataccggttcagccgacagcgatgcggaatacatttctgaagatgaggcccgcgtctatattatgaaattggcagttcaacgaattgaagaagaacggcggcccaataatcaaaaagaggcttttgacttaattctcgattatcagtttctgattcgaaggctggaattaaaactccaagataaaaaagaaatggactccatcattgctgatgaattggcacttcgaagggttgctcttcgtggtgaacgggctgccgttcagaaattatttgacgaccaaaaaatttccaaacaggctttcttgattgccaatgccaagctgcagcgtttagaaaatcggatgatccgctcggttggtcggaaagtcaaacttgggcatggaaccgcgcggaatttcattaaactgcggaatcgcgtctctttgtggttgattcggcgcaaaacgaatgaagatatttctgatgagctggccctgattcagcgagaacaggcgaaggcggctatctcggcattatccgactactttgcccgtgacgatattgacaatcaacggtttgacagtcagtcggtttatcatttaattgtgcattatcgaaatcagattgagctggccaaggatcattccaaaaagcagatcaatgatcaggcgatgaactaccagagcctgagaattaaggccttggctgccgaacgtgaaggcgtgcaggtgctcctcgaacaaggcaatattgactggtcgatggctgcccacttaagacaatatattaactattctgaaacagttttgattatggattatcaaaacgagtagggggacttcaaatgaatgacaaagggttagtgaactttagagacatcggcggaatcagagttccttccggaaaattgcagtcaggatacttttttagaagcggtcaaattgccgggatcagccaggaacaaacggccttcctgcaagaccagtgccggatccgggatgtttacgactttaggagtacggatgaagtcaaacaggcaccggatagtgcgatttctggtgccaaatattaccatattgatattttgtctgataaaacgtctaatggggctagtctgggggctatgattaccgacggcaacaaggttcatgagaatatgcttaaaacttatgaatcaattgttttaagtcagtctgcccaacaggggtatcatgatttcatgacggatttgctggcagatgatgcaccgatcctatttcattgcttcgctggaaaagaccgaaccggctttgcagcggccgtgattttaaaggtggctggcgctgacgatcaacaaattatggatgattatctgctgaccaatcaacttcgggtcaaggccaatgaagatttgctcaaccgattcaaaaatgaaatgaatcagcagcaattggacaacctgcacacagccttgctggttgatgccgattatttacgccacgccaacgatgttttgctggaacactttggctcatttgatgggtatttgaaaaatgggttggatctgcccagcgattacattgcgcggtttagagaaaagttcgtgacggattgatattgaagcaaataaaaagggatgaaccgtcgaattacggtagcatcccatttattttgattgtggtttttgaatgagtttgagtgtgtagtagaataccagttgaactgccgttaataaaacaataaacacaattgtcggccggctccacatgttcaataacggtctgataaataattccggggttaagaacaagtaaatcgtgtgaatccgcaagaaacggccaatgaagatcccgattgatgccagaatggtgagcgccacaatgacggcgtgtttgaccaacagattgtgggcatggaacctggctgtaatcgcatcgccaaccttatccaagccccaaagcccgaccaaagttgagaaaatggttgaaatcaatagcagcgcaaacttgaaccacatcagatcgtccagtcttagcaatccgttgacaccataaggattcagtagtgacaagtggaataaatccgtcagcaggtaaggggtatttggataaaacaacagccagacgatgatcagcacccaaaacagcaggccgttttggggtttgccaacgtcaatgtggaagctgagttcaattgggataaatgccagaaacgtatttaacactaaaaaattaaacgggggttgttttaaatatgaatatagtaaggcgatccagaccagaaaaagtccccggaccagccattttgtttttgtgttcacgttaaaaccccctatcaatatataattaaactatttttcgcggagaaataccatcaatacttgatcgatccggtcatttttaatgttttatttaaacatcgtcacaaattttaatcgattatcagtttgacaggcgacaatgatataatatttctgaaaactaattaggggagagcgtaatgaactggtcagatatttttacgatacataacttgacgagcctgattgatattttggccgtttggtttctaatttataatttacttttgattgtcagagataccaaggcagtccagcttttgcgcgggattgtcctgatcttggtggttaaaattattagtgcctataccgggctctccactttatcttggatcatggatcaggtgattaattggggtgttattgggctgatcgtcattttccaaccggaaattcgtcggggcttggaacaccttggccgtggatccatttttgtcaaagggcgcaaggaaaacgaagctgcgcaaaagatgatcaccgctttggatcgggcaattcaatatatgtccaaacggcgaatcggtgccttgattaccttacagatgaatacgggtctggaagaatatattgagactggaattgcgctggacgctgatgtgagcggtgaattgttaatcaacattttcatcccgaacacaccactccacgatggagctgtcatcattaagaataaccgggttgcggctgccgcagcctacttaccgctttctcaaagtaacctgattcccaaggaattagggactcgtcaccgggcggccgttgggatctcggagttgaccgatgcgatgacagtggttatttcagaagagaccggtgaagtgtcaattactcaaaataacgaattactccgtgggatgacccgggatgactacctgaaatacttcaaagatcaattgtttaccgatgaagatgatcagacccaccggacatttcttagtacggtatccggctttattgacaagcatttcaaagggggacggtaatatgcgacaatggctcttaaaaaactgggcatatcgtttgctgtcgctgttctttgccatcctgttattcatgtatgttggcagtacccaatccagcacaaccagcaatcagtccggcaacaccaattcaacctcactaacttcaaaccggacccagacattttcagttccactttctttaaccgtaaatagtaacaaatattttgtgaccggttatccacagaaggtcaaagttcatctcaccggcccatccgcgttggtgaccaccactgcgaatacgcaaaatttcaaagcctacgcggatctctccaaattgggagtggggacacataccgtcaggattcagcaggacggtttaaataatgatttgagatatcgcttcgaaccagctacaattaaggttgatattcagccgcgggaaaccgtttcgtatccattgaccgttaaatactctcaaagaaatattgcttcgggatatcaggcaggcgaggccaacgctgacgtcaagaacgtcaagattaccggtgcgtccgatcagattaaccggattaagtcggttgtcgcccagcttaacgttccgcaaaatgccaagtcatcaatttccagtcaggcaattattgaagccctcgacgccaaacaaaacacggttaacgtggtgattaccccggctaccgcggacgtcaccttaccaatcacgccgggcaatagtaaagaactgccgatcaaactggaaccaaagggtgtcactgatgacaacgagagcttcacgctcacttcggcaaccaagcgggttcgggtatttggaaccaaggcggaattggccaagctggcctctgtcaaagtcgaagtcgacaccagcgatgtcaccaagactaagaccaagcaggtgacgttggatcctaaattaaacggcgttaaaggatttgatccagagcggatttcggtcaaaatcaccagaaataactaacaaatatttaaaatatttaaactgaaatgaggaatttttaacatgaagtattttggtactgacggcgttcgcggtatcgcgaacaaagaattaacccctgagttggcctttaagtgcggccgagccggcggttatgtgctgacccaccattcagaacgtaaacagcctcaggttctggttgcacgagacacccgaatttccgggcagatgcttgaagaagccttggttgccggcctgctttcggtaggaattgaagtgttgaacctgggaatcgtcacgacacccggagttgcttacctggttagaaatcaggaagctgatgccggtgtcatgattacggcttcacataacccggttgaatataacggtatcaagttcttcggtgccgatggttacaaattgtccgacgaactggaagaagagattgaaggcatcctggaaaggccggaagacattctaccccgcccagccgccgatggcttgggagtcgttggggattatcttgaaggtagtcaaaagtacattcatttccttgagcagacaatttctgaggacctttccggcatgaaggttgcagtggacgctgccaatggttccaccagcaagctggttaccacgttgtacgcggatttgggcattgaatttgaaacgttagccactaatccagatggccttaatatcaacgatcatgttggctcaactcatccggagcaactgcagaagtttgtcttggataaaggggtttccgctggaattgcctttgatggcgacggtgaccgttgtatcgcagttgatgagaacggtaagttggttgatggtgatgccatcatgtacatttgcggtaaatacatggctgaacgtggccgcttgaagaagaataccattgtgacgactgtcatgagtaatatgggaatgtataaggcaacggaacgtgaagggatgaccagcgtgaagacccaggttggggaccgttacgtcgtcgaaaaaatgaatcaggacggctacaatttgggtggcgagcagtccggtcacatcatcttcttggatttcaacaccaccggagacggcatgctgaccagtttgcaactattatcagtcatgaaagccaccggtaagaaactatcagagttggctggcgagatcaaaaaatatccgcaacgcttgattaacgttaaagtagctgataagaaacacgctttggacaatgacaaggttaaagacgtgatcgcccaagttgaagaagaaatgcatggtgatggccgcgtcttggttcgtcccagtggaaccgaacccctacttcgagtcatgaccgaagcaccaacgcaagatttggttgatgattacaccaaacggattgcggatgttgttcgtgacgaaatgggaattgaatagtttagacatttttcagagaatcatttatttaaatatgattttgagcagatgttgtaagtaaaacgaaagtttactgcaacatctttttattttggtctccgcgcaactgccaaagttgatatatcaatttttaagatttggtataccatttgacatcttttgttgacttttatctcgaagttaggtagattatacgtgttatataaatatatagagttcatattctgtatataccaatttatgaaatttgaggagaatactaaaatgtgtggaatagttggagtaactggaaatgataatgctgtttcaattttattggaagggcttgaaaaacttgaatatcgtggttatgattccgctggtatttatgtcaacgatttgaatggcaacgactatctggtgaagcgtaagggccgcatctccgaactcgaagctgccgttggaccggaagttcacggttctgtcggaatcggccacacccgctgggctacccatggggttgtgagcgttgacaatgcccatccacaatattctgaagaccaccgtttttacttggttcacaatggggtcatcgaaaactacaaggaattaaaagccaagtacttgagcaacaccacctttaccagtcaaaccgatactgaagtggttgttcaattggttgatcgatttgttcaaacagaggggatgacgactaaggaagccttcttgaagactttgagtttacttgagggatcttcatatgccttcttattgattgacagcacagatcctgagactttgtacgttgccaagaacaagagcccacttttgatcggggttggtgacggctgcaacgtggtctgctcggacgctttggccatgctgaatgtgacccatgacttccttgaattacatgacggtgaagtggtgacaattaagcctgattcagttgacattgaagaccgtgacggccacaaagttcagcgggacactttccatgttgatatggatgcccaagagaccgataagggtccttatccatactatatgttaaaagaaatcgacgagcagccaaacgtgatgcggaaattggcctccctttacactgaagaatccggcaagccaaacgttgattcacaattgatcaatgcaatgaaggaagccgatcgtttgtacattgtgggtgccggaaccagttaccatgccgggttagtcggtaagaaattattcgaaaaattggctcacgtcccaactgaagttcatattgcttctgaatttgcctatgacaatccgctgttgtccaagaagccgttcttcatcttcctgtcgcaaagtggtgaaactgccgacagtcgtgaagttttagtgaacgtcaatgccaataactatgagagcttgacgattaccaacgttgaaaattcaacgctattccgcgaagcaacttacacgatgctattgcacgccggccctgagatctctgtggcctcaacgaaggcttacaccgcccaaattggggttgaagcgattcttgccaaggcgttgggtgaagctaaagagcaaacgatcgccgaagagtttgatattcgccagcaattaggattggtcgcaaccgggatgcaggcgattattgatgagaaagatgtcattgatgatctcgctaaaaagtattttgttccagccaaccgggccttctatattgggcggggaattgaccaaaccgtttcattggagtctgccttgaagctgaaagaaatttcatatgttcaagcagaaggctttgcatccggtgaattgaagcacggcacgattgccttgattgaagaagggacaccggtcgtcgggattatcacacaaaagcggacggctaacttaacccgcagcaatttgcaggaaactgaatcacgtggtgctgcaacctttaccatcgttcgtaagggattggctgaggaagatgatactttgatcattccagacgtcaatgagttgatcacaccgctgctcagcgtggttcctgcacaactgattgcttattacacaagtttgaacaagggactggatgttgatcgtccacgtaacttggctaagagtgtcactgttgagtaaatttgaatagcgtttctatagaggacaggcagagaatgcttgtcctttttgtttatcaatcattttttgatgaggcatgccataaaacagacacactggataaattgagatattgtccaaaaattttcttgatatctcaaaatggtagtttctttttttgttttcaaacagaaaatgatatattataagagttgttaaagttattaagaaagtctaaagcttctttggctaattaattctatttagggcttcattttttctctgttatctaatatgatagggatgtggcctaaacggaggtgtggatcattgaataaaataattaagcatggactaactgccttacttgttacggggatgggggttttattcacagcattttctgcccaaagtacataccaacaagcttatgcttccacagcaagcagttttatctcaaaatataaaaatgacgttaccaaagcttcatcgaagtacaacttatacgggtcggtcatgatggctcaggccggattggaaagcggctgggggcaaagtcagctgacgatcgaagccaataatttctttggaattaaaggggcctataatggtgcctcggtttcgatgccgacgaccgaatataatagcaatggtcagatgattaataccactgccaattttaaaaagtatccaaccgcgtacgcttcttttgccgacaatgggtccactttaagaaacggcaccagctggaaccccaagtattattccggttcttggaaagagaacgcggcaacgtatcaagacgctgcaaatgctttgactggtaaatatgcgacagcacctggatatggtcagtcgttgattacagttatccaaacctataatttggatcagctgtttggcgagaccggggatgggtcgtcagcatcatcgtcgacctctgcttcatcatcatctgcagcatcgagttcaacagcaagcagctcaagtgccagctcagcaactgcttcgtctaccgagacttcgatgcctacagcaccaaaacttgccaaagttaaatactacaaagcttcaggcaaagatttggtaccactttccagtaaatacaagaaatattacgtatataatcatgtgaaggggtcaaccacctctgagaaacgttatacttggtcacagctgggtgttaacagtcgggttcaagtctacctggatatgcgcggagtcaagactaacagctcaactaactggtaccgtctacgcttctatagcaatgccaaagccaaaaagttctgggttagtgctccggcattgtcatttgccacgacctattctggaacggcgactggtgcgttaacgccaagtaaaacttcttcggggtacatctataaccacattgtgggttccagctatctgtcaaaaccggttaaaaaggtaaagacgattgcggccgccaacaaaggttacaatgttaataaaaccgcccttcaaaagaccaccaaggggcttattctctggtatcggattgcggacggcaagacaaagggttggattaaagcttcagatgtagtatcatatcctggatcggttgcggttgtgaaccacaaggagaccaagtcgatttctaagaatgccaattcgacttatttgtacgatcatgcaaactcgacggggaatttgcagaagcattacaagctcaatcaggttgatttacaagttggcactaaggtgacagtcgataaaattggctataaggtcagcgaccattcactttggtatcgaatctcaacgcctaattcttcaaccaagtattgggtttccagtgcctttttatcataattgaatatggaaacagccgatgttgttgaccattcgtcgtaacatcggtattgggaggtttttagcatcattaagcaattcaaacatgtcatgatgaaagccctaatcgccacggttgcggttaccggcttttgttttgtccaagcaaaccactcgcatgccagcgtggaaaccgatttcattaatcagctgaaaacgccggtggtgaagattagtaaggctaaccatctctatccatccgtgatgatggcccaggcaatcgttgagagcgactttggccgttccgagctatcattggacgccaacaattacttcggggttaaaggcgcttataatggccaatctgtgactatgagtaccggggaatatacctccaaggggaagcattatatgactgcggccgcttttaaaaaatatccaagcgttgaagcctcaatcaaagataatgcttatctgttacgccacgggacattgtccgatccgaattattatgagggaacctggacgacgaacgccatttcttccagtgatgccgccatggcactgtcactaacttatgccactgatatgaattatggtaataaattaaatgcaattattaccaagtatgatttaaacaaacttgatgggtctgtcagcaccggggacattggttctaaaattgatgcctctctcaataagcaattagctggtgactccaaaaaatcagctttaattcgagcagaaaattcacgttccaaaattaacagtattccaaagcggattattcccaactttgtttttaacgacaagggagccgtcgccatcaatcaaggcgacgccgtgatccaatttaatagtttgcctttgcagcgcgttgttcgccgatagatgtttaagggttcgcaaagtttatttgggaatccttttttcagttgcaaagtttgttataatgttactcgtgaatttagtctctcttaaattaggagcggagcaatggaaaacgattataaagtaaaagttgaaaatgttaccaaagagtatgaattattcaagacccagtctgaaaaattacgctcattcttttcgattaccaaaaaacaggttcctcatttttggtcattaatgggggtttctctgacggttaaaccaggggaaacccttggcctcatcggagttaacgggtccggaaaatcgacgatttccaatatcatttccggaattatcccccaaaccaccggttatgttgacgttcgcggggaaacttcgattgtggcaattcatgccggcttgaggagcagtttgacaggccgtgaaaatatccgtctgaaatccttgatgcaagggttaaccaatgaagaaattgacgaattaatgcctgatatcattgcgtttgccgatatcggcgattttgttgaccaaccagttaagagttattcaagtggtatgcgctcccggcttgggtttgcgattgccgtccacatcaacccggacattttgatcattgatgaagccttatccgttggtgatgatacattctaccaaaagtgtgtcgacaaaattaccgaatttaagcaggaaggtaagacgattatttttgtcagccattctctcaaacagattgaaatgttgtgtgacaaggttgcttggatcaactatggtgaactcaaaatggttggtgacactaaagaagtgacccagaagtatcgcgagttcacgcagtggtttaagaagttaagcaaaaaagaaaaacataagtttgaaactgaacgcaagagtgttcagaaaaatttcagtattaaaaattatcaaaagcaaatcactgaacaggaacaaaatgctcacccggatgagaaggatgttcccgctaagatccataaacgtttttacggctcggtcattagcgaaaaaatgtcagtttggaatcaattattgacctgggctgtgttgattgtggtggtcttcttctgcttggttaacgtttccggccattcagtcgagcacgtgattaataatccttctgcgattgttcatccatcgcacacgcttcatctgccgggtaaagaatgactttcaggttgccagatgattgtttggcaaccttttttcgaaatttagttgacagcgctttcaatattgagtatattatgttcgggtactaaataaataccttctaatcaattctctttctctcttaaaaaactgacgtctttataacgtcagtttttttatgtataatgttcttcgtgagtaaataaggggaggtcacacgttgaagagtcatgaagtattgacattaattgaagaaattaccagaaacgatggcagcaagtatattgagatcagcaatatggtgcagaatggtcgggcagaattggcagctgagcgaggttttattaagcaggtcaggatcttacagcttaatatcccacattctcctcatgtggccaaatatgagcaatatattaacgaaaattatacgatgccgactgaagatatggaccactttgaagaatggcacaaaaccccggaaatgcagaaagaagtcgacatcattcttaaagaaaatcacattagttagtgggttgatgaaatttagatgataaaatagtttgcatattttcgctggatatgatataaatatatatgtcgtttttaaagaaaatatttttgctccgtagttcagtggtagaataattgactgttaatcaagaggtcgctggttcgaacccagccggagcagtaaagatcttccgggggcggttgatcccccaaaatctttttttatgcaattttgtagttgtcagtcactcttagatatgatatattatctaagtggtcgttaagtaaatatttttgctccgtagttcagtggtagaataattgactgttaatcaagaggtcgctggttcgaacccagccggagcagttacacaaagagtaggcaatttgcctgctcttttctttttatcattttttcatttagaagtctggttatttaatcttcaatctaaccgatggcccttaagtggaatgattctctcagggcattcaaaaagacctaaccgaaaaaacttccggtcaggtcttacaacatgcaaagtaactttataaattgatttcagatggggtcgcaatgatttgccggtcaccactgtcatagacgaccagggattttggataaccattgtcgtaaggatatggtgaatcaaaagttgccaccaattcatttccttgaatgaaatcataggacaaattgccatcgttattaactaaattaaatgtgatcagatttgataattggaaaacgccttgcaggtcgttatcgatgatgtaccaaacgttatcaattgcctcatcgggtaatgatgaaacgatcgtgtagctggcgaatctggattcattgggattaaacattcataacaccttcatttctgcattgcttgtcatatgtaacctaccaaattaatcaggccaacgcaagtaattagttagagttcaaactcttgattatcagtgattaaacggacaatgtgcttttcagttcgggcattttccggcggcagcgtcatataatcgccatagattttggtcaagatgccatcgtaatcagcggggacccgaatataagtgtcctcaaatggcaacacaatcgtatcatttagttggtccaggctcagaatttctttttcataggcatattgtgaggcgagattcttgacgttcattaacgccgctttgtcgttatacatggtcatgacgctttcgcgttgttttttgaaatcttctgccgtctctgcctgctcggcagaaagggaggcatgaaacttgcgaattggattatcgatcacgttataacgcagtttcaaataaattcggctgtcgagtcttcgcatgtccaaaatttgccgccgttgacgggcaggagagtctggaattcgatccaaggggaagatatccaggaaaacgcctttccgggcgttgttaacgttgttcttctcctcaatgaaggtattcctatccaatagtttggaatagctcagagcgtaattctcgtccgtccatggggtttgaagaaaatagtgagtccctttaaggtcttgctcagccactttcaaaaattgctcgtaatccacccgcagcattccgacgtccatatcatcgtcccagggaatgaacccctgatggcgaacagcccccagcattgtcccacccaaagcaatgtaatggatgtggtgttggtgggtgattttggcaaattgtttgaaaagatccagttctacttggtgaattagtgaaattgcatcatcagccataaatatcaatccttttttgttatgtcataattataaagcataatgccataaaacgataaagttaatccatttagttgcgacactggttactaaaatatataattaaggtgatataaggtttaataattaaaggggaatggtgacagatatgagtaaaacaaatcaggatctattaaaagaagcaatcgacgtttatttgtcgtcacttaaatacttagataactttgtttctgaacccgcaactaagtacggattgtcgtttgaacaatacttaattttgcatacaatcgctgaaaaacaaaacgtctcattgatggatattgccagtgaacggcgagtaacccgaagcgcaatttcacgccaaatcaaagttctattacagcatgattatatttttcaaaaaccagctgaaagtgatcgtcgtcgactttatttacatttaactccaaccggtgagcaaactgaaaagcacgtcaacgatctgatcaccaaacgttttgacagctggatcagccgttatggggacgacaaggtcagagccattttgaaatttattaaggaattcgctgcagaagaaatgaatagcaaagattacaccaacaaatagcattctgggatccatctggaccggggcaaaactgaggctttgctgccggccttttatttgtcgaatctgttgaattcaaaagggggaacgagtatgtggatggtggctttgacaggcgtcgtttttgccgttttgacggtggctttaggtacatatttgatcaagaaccgaaacacgtcggttcttggttggctggccaatttggatttactggcattattggccctcctggttcaattatttgaggtgtttggcgaaaaatataatgcgttggtgattgccgtggccgtcgcaatcgttggtctggccgttattttgggattaattttgagttttattttctggtttatcaacgcaatcgtcgtttggcgaaaagaaggttatagtctcagcgggtcgttgacgttaatcgtcgggatcggcgttgtcctcattgatgttttgattttctttaacccaattgacctgccaacaccgattcaagcgtttgtcatgacttttttgacgatgctgattgcttatattttgctgactgtgtggaatacgttgtcttcgatgctgttgtatcaattatattttccccggagcaataaagattacatcatcgttttgggagctggattggttgatggacacaaagtcggtcgcctgcttggcggtcgcattaataaaggaatcgcattttataatcatcaaatccatcgaaccaacaagcgcgccaaattggtcttttcgggcggccagggtggtgacgagttactccctgaaagtatcgccatgcgtgactacgccttggaacatggtgccagaggggcagacactttgattgaagaccagtcagtgaatacttttcaaaatatgaagttttccaaagccttgattgataaggacgccggttcgactaatcatagaattgttttcgttaccagcaattatcatactttgagagccggtatcctttctcgggaagttggtatgcatgcttttgggattgggtcgaaaacgccattttattacctgccgaacgcagtcattcgtgaatacctggccctggttgtcatgcataagaaatttcatttggtgatgctcggcttgatgttggtcgcctcagtgattgtgggggtgctggcagggcttggaattgcttaatgtttggattgaggagttgaccgtttggttgacgccttttttttggttaaggcaaacgtgttcccccaaaccggcttgcctcacactccgatgtaaatgtgttcccccaagcagcaacctgcacataagccaacttccggcgaaatcaaactcgatttccccgcaagtcagcttatgctccggttgctaaccgctcggactcacactctaaacatgttccgccgcaactgacgcttgtttctaagggatctttaactcaaacccaaacccaaacccggggtttcagtcaaagctcccttagaagtcgcgccacccgttggtcctcacactctaaatgtgttcgacaagccagctttctccgcttagtccgataacagcagtcaacgcaaaactagcgttaactactgttatcaccctaatgctcaaaagctaatcagcttgcctcacactcttttcatcttttcttcacaccttattcacacaataagatattaattattataaaatataactatagcaagggagctataatttccacaatactatttgtagaaaggatgattatcatgtttagtttactctggacacttatcattggtggcatcattggcgcacttgcaggagcgattgccagtcgtgacatgcccatgggctggatcggcaacattgttggtggcctgattggcgcctggctcggagaagcaatttttggttcctgggggcctcaattagctgggatggcaattttaccggccattgtcggagctgtcattttagtcctggtcgtttcaatggtgactcggggaatggcacgttaaggttacctcttttaagaaaggaggttgcaaattgaataagttttcaagattaatgatctggattgtcagcctgattgggattgcccaatcggtttggctggttgggttagtcattccaatcgactatttgtcaccagtcgtgactcagacaattcaaacggatactccttggatgatgattggtgctgcgattgtatccgcggtcgtcgccctagtcagtctgatgatgttgataacggcaatctttgcgccgaggaaggctgaccagttgcggtttgagtctccacacggcaggctgagtatttccaagtcagcggttgaaaaaattttgcagaatcgaattatgacgcaaaacaacgtcaatcatgtgactgtcaaattgcgattgaggactcggaatcgggtggttcgcgttagcgtcaacgccgttgataaactcaaccaagatctggtcaaactgggtgaggcaattcagaacaatgtcgtggatgagatccagcagttgatggatgttgaagtcaagaaagtgcgggtcaaagtgaccccgtttgaagcttcaagcagacgcgaaaaagccagtcgcccacgagtagtttaggaggaggatgtcgatgaatgcaattatgtacggagccgtcttcggaatggtcgcaggcgtcgtgtgggtctttggcggcctcagcggcatgctgacggtgttggcactgaccttgattggtgccttgatcgggaccgttatctggaagtttggcgggctcaagcgcttaatcagccaattagtgagtgatgattaaataacagaaggaaagtgagatgactgtgatggatgcaacgattcaaaaatcagatttaaacaagaagttaacctttgaaaactcggtaattgaaaaaattgccggactggtttccagaaatgtggacggcgtcctgtcgcttgatggcgggatgatgagtgaattagcggatcggttctcaaaaaccactgatccgacaaaggggattgacgccgaggttggtgaaaaacaggttgccttggacatggaagcaacgattgaatatggcgccgacgcccggcagatctttgatgaaatttgcagccggacccaaaaagccatcaagaattataccggtttggacgttgttgaaattaatttaaatattaacgatgttctgaccaaaaaagaatgggaacagcaaagtacccgaaagaaagacgatatcgcaaacactgtcaatgatgacagggtggaatagccaatggagggaaaaaccatgacacaagaaaacagcagtgtagcaaccgtattaacttatgatgacagtgtgttaaccaagattgccggtaataccgttcgtgatgtggatggggtgctgtctttagaggggaacctgattgattcggtcactgatcgtttcagtgacgagacggatccctcaactggggtgaaagtagatttagacaacgatgataaagaagttaaattggcaatggatgcagtcttggaatatggcaaatgcatcccaacggtctttaacaaaattaccactaaattaactcagacaatcaccgaaatgaccgatttgaagccaaccgaaattaaaattcacgtgaaggatttacagacacgggatgaatttctaaaaaagaaccagaagaaagataagggtgagaagaaaaaataattaaagaccattttgatcaaccagccccttgtggttgtcgtcttaactatgcgattgttttcgattcaggatctttttgattgtcagcatgatggttaagccaattgctaacaccgccaaagtgattgcgaacggacggttgttggttacggtcatcaaaataaaaccaatcgcgattgtgatcaacatggaaatatcaaaatgagacattttgccacctcacttactaagccatggcctcgtcttcctcaagctccaaccaaagggccagcgccgtcgggttgaagtccggccaactggaaatatgttcatatccgcgcgccaaaagcgagctttgctttcgttttttaaggtcatcaaaaatcgttaatgcaaacaggttatcttcaaggtcggtgataacggttcccaatttgtgctgccactcggcaactaggtcctggtagatcaataatttccgggcattcttgattgtatagtcgaccccttgatcccgcagggtttgtttataatcttcatactcttgcaaaacagattctttagcggtttcccactggtcattattgtatctggacactttattagccattgtcgttcctccctagtccaaaataaattcacaaacactaagaagatggtcacaaaacaatcgtttcatcccatcttcgatcgaaaatatattttgtctactgaagaacattaaacactaaatcgggaaattttgcaaagcaactcgccattaatcttctacagtggctcccagaacatgttcgaagtgatccaatgcccagtcattgccggcttgggtcaatccggcaacgccgctcttgtgaacaacaatgttgtagcagagattataagcgtcgacggcagtgtgtaaaacgcagatatcgctgcagacaccgactagatgaacggtgtcaacgtggcgttcacgcagccggatatccaggtcggtgccggcaaaggcactgtagcgggttttgtcatacatatacaccttatcatctgcttgatgctctttaaaccaaggtgataagccaccataaaattcacggccccaagtacctcggacgttgtgaggtgggaataacttggtttcaggatggtatgggtcatttggtgtatgcacatcggtcggtaaaatcacccagtcgccattggccacaaattcgtcagctaattttaaaatatgcggttccagtacctgtccagggccgccacagctcagtgcccctttatcggccacaaaatcgttggtataatcaataatcagtaaagctgtatgagattccataaatgtatccctccataatgactcgattaaaagtccaattaacttttattggctcaaagatactcgatattggccgaaaaatcaactaatttgctgattaaatttcgtctttgttcttcatccgtgaacatgtgttgacgatttggggttgacatttcaaatatgaaccgtatactggtaaatattcacagagagctggcatttgctgaaagccggcaactaaaatggcaatacttaatggcggcagccttatctgcaattagaggcaatacatattgtattgtggaacttgggtggaaccgcgttgaagaacgcccctggtactgtaataggtactgggggcgtttttaatggacatttttaaggagaacactatggaaacgaaggatcaaacaaattcactatcgcgttcactaaaaagccgacacattcagatgattgcgattggcggggcaattggaaccgggctgttcttggggtccggatcggccattcacacttcagggccatcaattattttatcctacttgattgttgggatcttttgtttcctgctgatgcgggggattggtgaattgctgctgtcagataccagcaaacattcatttcttgattttgtaaaaatgtatttgggtgaccgctgggagtttgtgaccggctggacttactggttctgctggattagtttggcaatggccgatttgactgccaccggaatttatatcaagtattggtttcccggagttccccaatggattccaccgctgattattctcttatgtctgttcgccgccaatctggtcaatgtcggattgtttggtgagatggaatcctggttttcgatgattaaagtcgtggcaattattctcctagtcgttgtcggagtgggactcgccgtgttccacgtgaatgttgacggctcgacggcttcgttcagccagctggtcagccatggcggctttttcccaactggcgcccacgggttcttgatgtcatttcaaatggtggtgtttgcctttgtcggcattgaaatggttgggttgacggccggcgaaactgacgatcccaaagccaatctgccaaaggcgattaacagtttaccgatccgaattggtttattttacattggttcgatgattgcagtcatgagtgtttatccttggaataaaatcaccacgaccgccagcccatttgttcaggtgttctcgggagtgggaattgtgggtgctgccgggattttgaattttgttgttttgactgccgcggtctccgccactaacagttgtttattcagtaccagccggacaatgtacgcgttgagtatgggtgggaatgcttcatcatttttaaccaaattggggcgtaacggggttccaaacattgccctgaacttttcaaccgcctttctgttaatcatcgttgttttgaactactttattccagcgggtgtcttcaacctggtttcaagtgtttcaaccattaactttgtcgtggtgtgggtggttttaatcatcgtccacattaaataccgccgagctcatccgaagggcagtgaggtctttagaatgcctgggtatccgttgagtgattatttgacactggcattctttgtcttcattcttggattcctattggtgaacagctcaacacgggtggcgatggtcatttcattgatttcaattggctcgatgctggtgatttaccaggtgatccaacggcgtcatggcggcaggtagttggggattgaaattgctttcggaaaaaattagactttagttattcataaaatgacgattgaagaggcaataccatgattaaaattcataagtttgacacttacacctgggtcgaggcaatttcaccaactgaagacgaattaaacgacattacgattgactatcgggcaccagccaagttcaaaggctatatgctggatcgtcatgagcagccacgggccacttttgatgatctgtcagggtttagtgcactggtggtcagggcaattgcggatcctaagcaaagccgaatgctcacatcgccgatttttctgggattcagtaattccctgctgattacggtgtgtcacgcccaagagcaggctaagctggtttcagaccattccaagttggcatatgacagtgttgccgagcacattttggcaatcctgtttgcattgatttcgccgttcttcgataaattagacgagatcagtcagaaagccgagaagttggaagggatgcacaaccgggcaatcagcaaccacagtttggatgaattggcagcactaaagaccagtctggtctatctgcgctcggccacggcaggcaacttgatcgccctgcaggagttacaagccaccatcaaggataacttgaagatgtctccggaacttgccagcaaaaccaatgaatccattggtgacctgttaattgaatacaaacagtgtcaaaccatgtttgatgtggtcggcgacgtggttcgggaaaccgagtcggcatttgggaatattttgaataataaattgaaccaaacgatgcagtttctgacgatttggtcactgattctagccattccgccgattgtttccgggttttatgggatgaacgttaaactaccatttgcaggtcgtggggaagcttggttctatacagtcgttttaacgatggtaatggtcttattgatgattgtgtatattaagaaggatcgccgcttcaagaaatagaacataactgaaagccgcttcgtggatttttcggtatacaaaaagctcgtcattcaagatgacgggctttttgtatggggcaatttgcaaataccgacgggtaagtttcacgactacatcgcaaaaacgtgcttgccggaatcatatcgtttgagtgcgttcacagcctcagtaatgttacctcgtaaaatatcattatggtcaatgtcgattattttaaagttcatcagcagttcgtcggggagatcatcgatgatgcgcctgtccatcaaaatgatgtcggcacatggcttggtagcatcgaagaaatggtcgggaataatatcaacggatggttgcagtgaatttaatttttctttgagtcgatcacaaaaatgttgaatgaggacatcgtcaacaatgggattcccagttaatgaaggttgtattttgcctactcggatatcaccaactactttaatgttcacgcttgtcaccgtccttgtcgaatttatcaatcaacgccatactacacgattgaatgacggtgggtgacaaagttggtgattcttttcttaaaattaaccatattaacaaaattataataaatgaaccttaaaaacagaccagcattgaaaacaacaggaaggaaaccgtcgaaacattggcccgtttttcaaaattacggaaattaacccgggattcaaaataagcgtagaatgccagaatgccggcgataagaatgattttaaaaaatgagatgttgagcgtgagacacaacattaaaatcagcaccgacacgatcatcatggacagctgattgttttgtttcataaaggcgtagtaggaaaagaaaatatttgcaaaaatcatcagggtgatatacatcagtgagaccagggaaaaatagtgatggtaggtcgttgtgaacaacaagacaattccggttccggaaatgaacccataaataatccaacgacagtgaggttcatcgattaaattagagactaacagcaggttggcgagcaaaaagccgatcagaatcagccagacgttaatgctcggcgtatcgaggtacagcgatgccaataagatacccagtaaaatatcggttaagacgaccatgacggcatttttgtgcggtcggctgacggcggtcaataaaacggcaaacacgaacccgatcaccaggagatgcagaaggcgcggattgacgaaaaatccctttaacgagatattggcaaatagcatccagataaagaccatgctgacggcgcgcagtcctgattgaattaaaatggagcggtcaaattttaacaaatcctcaacttcctcacatttttaatagctaattataaaaataatcctactggttttctgtcagatggtcaatggacagctgaaaataaggcttgaaaagcaaatcaaatatgataagattgtagagttatgagttcccgataggattcacgtgatgcgtgaagaagccttgtaaccttaaaaaataatagggggaaaatagaatgcgcgaaaaacatttatttacttcggaatcagtttcagaaggccatccggataaaattgcggatcagattagtgatgcaattctggatgccttgttagcaaaagacccggatgctcgggtagcatgcgaaacctcagttaccaccggactggtgtttgttttcggtgaaatttccacgactgcctacgtggatattcaaaaagttgttcgcaacacgattaagcgaatcggctatgccgatggccgttacggctttgatggtgattcatgtggtgttatcgttgcccttgatggtcagtcacctgatattgccttaggtgttgatgacgctttggagcaacgtgaaggcaataccgacccgttggatcaaatcggtgccggtgaccaaggactcatgtttggctatgccattgatgagacacccgagttaatgccgttgccgatttcattagcccacaagctgatgagaaagcaggcagacttgcgtaagagtggcgagattggttatctgggcccggatgccaaggctgaagtcactgttgagtatgatgacaacgccaagccggtccgagttgacacggtcgtcttaagcactcagcatgacgatggtgtccgattggatcaagttcggaccgatgtgatcaaccaaatcatcaaacaggtgattcctgccaagtatcttgacgacaagacccgttatctggttaatccaaccggccggtttgtcattggtggtcctcaaggggatgccgggttaaccggacgtaagattatcgttgatacctatggtggttacgcccaccatggtggcggtgccttttcaggaaaggatgctaccaaagttgaccgttcggcaagttatgcggcgcgatacattgctaagaacattgttgccgccggtttggcaagcgaagctgaaatccagttggcatatgccatcggggttgccaagcccgtttcaatcgacattaatacatttggtaccggtaaagtgcctgaagatcaattgattgatgccacacgagcattatttgatcttcgcccggcaggaattatcaaaatgctggacttaaaacgaccaatttatgaacagaccgcagcgtatggtcactttggaagaaccgatattgatcttccatgggagcataccgataaggttgatgcgttaaaagactatttcaagttataaacagctgacaagcaaaacgcccttgaaaattcaagggcatttttttgtttaattttaaagaaaagaggtcatttcatgacgaaaacagcaaccaaaagtaatgtaaccttagtaacgattgccctctttgtggccacctttatggccgcaattgaagggacaattgtttcgactgccatgccgacgattgtcggtgacctgcggggagtttccctaatgaattgggtcttttccatttttctgttaaccaatgcaattgcgacgccaatctatggtaaattggccgacagtattggccgaaagccaatgtttattggtggaattttgatctttgtctttgggtcggtgatgtccgggttatcgcactcaatggtggttttgatcttttggcgggccgtgcaaggggttggagccggctccatcatgccgatttccaatacgattatcgccgatatttatcccctggaaaagcgcgctcaggtgttgggcctgaactcgtctgcttggggaattgcttctgtgatcgcgccactattgggtggtttcattgttgatcacttgagctggcactggattttctttatcaatttacccattgggttgattgtcatggtcatggtccagattttcctgcatgaagacaaacaccacagtaccactaaaatggacattgccgggaccacttggctgacgatgatgctgttggcagtgatgtatgcgttccagttggtcggccaggatccgatcaactggcagatcgttgcggtctgcttcttggttacagtgatcgccacggtcatgtttattcggacagaaagactggcggccgatccgttaattccgatggaactgtttgataatcggaccttcgtcgttcaaaatatcgtggtttttttggtcagtggctttctgatcggctacgaagtttatctgccggactggacccagggaattttgggcctgcgggcatcgatggccgggtttgcggtgacgccgagttccctgatgtggattgtcggctcatttttggccggtaaattgctggccaggacgtcaccttaccgcattattaacctcagtctcttctttatcttggttggggccattattatggtgctgattccggcatatacgccgtttgtggccttcttggggatttcaatgatctgtgggaccggctttggcttaacggtgacaacgtcgattattagcgttcaaaatgaggttaaaccaactcagattggtgtggcaacttcctttaatactttgtgccgaacgctgggtcagacactgatgatttcaatctttggtatcgtcatgaacaccaccatgctgcgtggggtccggcaaacggaacatacatccttgaaaatgatggacaaactgattaacccattgactgccaatcagttaagtgacaaaattttgccgcagttgcgaaatattttgtacaattccctgcataatgtctttgtggtcggcttgattctgattatcattgcctatatctgcaatttgtttgaccgcaaaaataaaaaacagcgaatcaattaatcgatccgctgaatcgccatcaatattggtggaaaatgctgctgatttaagaagctgtatttcaaaacactgtatcgtttttggtcgagttgactgccaaattcgaggacggtgtttttttcgcgttcgccgcctggatgaccatagtaggcaaccacgacgatcacgccattatggcataagtggttgaggcagcctttaatcgccgcaatcgtcgtttcagggtaggtgacaatcgtcttatcgccgcccggcagatagccgagattgaagatggcgccggaaatcatggtctcgtatggtaaaatttcatcaactttggcatggctgatattgtacaggtagacgtttttggtgcgaacgtgattggtttttagaagtgctttggtattttcaactgcctgggcttgaatatcaaatccatacacggtgccttgtttgccaactaaattggctaaaaacagggtgtcgtggccgttacccatggtacagtcaacgacggtatctccggaatcgacagtttctgataacagttcatggctatattccaatgctgatttgattttcatgagatacctcccgcgaatcgattaaatacccattgtgacaccattaaggtcactaggccaagactccagccgcccagaacgtcactggcataatgaacgccaacatatatccggctgatgccgataccgacaatcatgatgatcaaaatcagatcaacgatcagccgttggctacttcctttaagcatgcggttggccagcaaaatcaggctgccggcaaccaccatgatactcattgagtgaccactggggaaactactgctgtgaacagccaccagatgggtcagagatggtcgcggccggttaaccatgtgtttgaccagggtatcaatcggggctgccaagacgacgccgttaatcaacaagaataaggcggatttgattttgcgaaccaaaaataaaatcaatccggcaccgattgtgaaacccaatagtgactgataatttcccaactcggtaaaatgaatcatgaagctggtcagtgagggcgtttgaaagcttctgaccatgtggccgaagtaggtgtcaaaggtattgatccattctttatgtaaaaccacgccgtaagtcagaatcaaaaagatgaccagtgaaaccaaactaacggtgcttgaaattttttgtgattgttttttcatgttttcaactccaataataaaattatagcacgctgagcagttgttttttaagacctgttttggtatgataataagcaataatttcaatttgtgaaaatgcagagacgaattagtaaccaactgcctgttttccagaaactgagtggctgctgtgaactcagaacaggtcgtggcgaactcatcgtcgaatgcttggtcgaacgaagtaaatcaagccggtttgtcgccgttattgattcgagagctcaagtaattgagaatataggtggtaccgcgataaatcgtcctataagaagcccagtctggtttcttatgggacttttttcattgattgagaaatatgaaaggtggaagttgcaaaatggcatacaatcatgaggtaattgagcgcaaatggcagcattactggaaagaacacaagacatttaagaccgaagaagttgctgacaaagacaaatactatgtcttggatatgttcccttatccatcgggtcagggcctgcacgttgggcatcctgaaggctacacagctacggatattatggctagaatgaagcggatgcaggggaaaaatgttcttcacccaatgggatgggatgcttttggattacctgcagaacagtatgcactgaagacggggcataacccgcgagactttacggctaagaacatcaaaactttcaaacgccaaattcgttcgcttggattctcatatgattgggatcgtgaaattaacaccaccgacccaagctattacaaatggacccaatggatttttgaagaattatacaaacgcggattggcttatgaagacaatattgaagttaactgggcccctgattttatgggtgggaccgttgttgccaatgaggaagtcgttgacggtaagactgaacgtggcggctatccggtttatcgggtgccgatgcgccaatgggtcctcaagatcacggcttacgctgatcgattgattgatgacttggacgatctggattggcctgaaagtattaaggaacaacaacgcaactggatcggccgttcgcgtggtgccagcgtgttctttgaggtcaaaggtcatcctgatgacaaggttgaagtgttcaccacccgtcctgacaccctatttggggcaacatacatggtgctcgcgccggaacaccagctggtttcaaagattaccacccctgaacaagccgctgaagtcaaagcttatcaagaagaagtttcccgcaaatccgatcttgaacgaaccgatttgaacaaagataagagtggggtcttcactggtgcctacgggattaatccaatgactggaaaagaagtgccaatctggattggtgattacgttcttgaatcgtacggaaccggtgccatcatggccgttccagcgcatgatgatcgtgattatgattttgccaagaaatttggactgccaattgttcccgtcattgaaggtggtaataccgacgaagctgcctatacgggtgacggtcctcacttcaactccggcttcatggatggcatgggcaaagatgacgccattaaggcagccattgattggttaactgaccataaagccggtcatgaaaaggtcaactaccggctgcgtgactggatcttcagccgtcaacgatactggggtgaaccaattccagtgattcattgggaagatggcgaaacgacgctggttcctgaagatgagctgccgcttcgattgccaaaggccaaagatattcagacctctggtggcaaggaaagcccactcgctaacttggatgactgggtcaacgtggttgataaaaacggccgcaaaggcaaacgtgaaaccaacacgatgccacagtgggccggaagttcatggtactggctgcgttacatggatccgcataacgaccaagccatcgcttctcctgaaaagttgaagtattggtcaccagttgatttatatgtcggcggggctgaacatgccgttctacatttgctatatgcaagattctggcacaagttcctttacgatttgggggttgtgccaactaaggaaccgttccagaaactggttaaccaggggatgattcttggaaccaaccacgaaaagatgtcgaagtcaaagggtaacgtgatcaacccggatgatattgttgatgaatacggtgcagatacactccgggtatatgaaatgttcatgggcccaatcgatgctgccaagccttggagcacggaaggtattcacggggcctaccattggcttgaccgggtatggcgcttactgatcgatgataacaatcatttgcgtgaccgcgttaccacgatcaatgacggcaagctggacaagatttataaccagacggtcaaaatcgtttcagatgactttgaacatatgcggtttaacgtcggcatttctcaaatgatggtctttgttaacgacgcctacaaggcagattcactgccaattgattacatggaaggcttcgtcaaactcctgtcaccggttgccccacatatcgccgaagaattgtggagtttattgggtcatgacggcacgattacctatgaaaagtggccaacctatgatgcttccaagttagttgagaacaccgttcagatggtcgttcaagtcaacgggaaagttcgttcacacattaaggttgcccgtgatcttgataaagaaaaagttgaacagactgccaaaagtgatgagaatgttgaacgatatctggaaggcaagactgttcgtaaagtgattgtcattccaaacaagatcgttaatattgttgtcggttaacgtgatcaagcaaacagctggggaattgtcctcagctgtttttatttgaacagttgaattattttcaaaaaaataaaaaaattccgccattttctccgtatatatattacgaacgggacgagttgagtcgtcttgaaaaatgttgaaggagaaagatgatggataaatttgataaagtgactttggggaaagctaatggttttaaattttggagcagtttagcgctcatggctgccagtgggttaatcatgctgcaggcaccgttggctcacgcggatttcccagcagacaacgtgcgcacgactgagttggggcagcgggtgacattttatgttcagccggtgtccaaatcggattccgctggtgactggcaggtgattcccggagtcaagccaattaagatggtcggcaatataggggagtcatttcaagtaccggtttatcagaactttgttccaaccgcaacgatttctcatacagttccagattctcgtgcagacttgcagcacccgctgttgctcaaatatcgccaggaaagtactggcctctataccgcaacggtgaatattaactatatgaatcgtcaagatagtcacacgctggacaccgccaccaaaacgctgcattacgctgaccaagtaaccattaagccaaagaagattcagggctatcagccggttgaggcaaccttcgaaagcccgtatttcactaaaaataacgatcaatcggtgaacttctggtttagagaattaagggatctgacttgcttggtaaaattctggtatcggccagtgaatgcttctcagccagatcagcctgagcaggtcaaagaagcccaggcaaagccgaaccacgctggtgtgtctacgagttctcactcaggcaccgattcaaaacttgtggaagctgccaaaccggtgacacaagacagtggcgacacaaagccagccagttcgaatgtagcgccggtattaccagtcaactcaactgatcaggcgcaaaaaagtgctccccaagttgaagttaagcaacaacggcccacggttactcaaccaactttagtaactaaagaaccggtgttccaggcggttaagcctgttgagacgaaagctgcaagtcttccgtcagatttgtctcaggttgcacaacaatcgccagtggtcccgtcaaaaccaacgaattcgacgagggttaatgtggcgggaaaaagtcaaatctctgttagtcggccaacagagagtgtccgcacgtcatcccggccagcgactgattcccacctgggagcaattggggtcgcgatcttaaacaacccaatgaacgcaggccaaactacaataacccaaccgactccaaacaaaaaagtcgccgtaaaaggggtggccgtctacgccatcaaaacggtcgggctatacaattcccccaattttaagtccggcaatcgacttttccgatatccagctcaaaagcgctatgcccgacccatgtttgtggtgaccggctatgctcgttcagccactggccagttgcggtaccgggtacgggatgtcaatcatcaaagtccttcccatggcaaggcaggctatctaacagcaaactggacctatgtgagaccagtttattatgccagtcgtcacccaaaaatcaaagtgatcaacccgactggcattcatggctatcaaggtaagaatttgactggtagagttgccacatacaaaaagggccagactgtcaatgtcaaacgcatggttcattatcatttaacaacgcgttttgtcttagccgacggttcatatatcacggctaatcgtaaattagtgagtgcttttaaataatcagccacaggaatgaaaaacagccaaaatccacaatggattttggctgtttttgagttgctattgcattaattcactcgcagaactatcttggtaatttttattccacaggaattccgttagaattttattgacggcaatgttgttattgtgcagggcactgtgttgcgccttgggaccaaaagcttgaaatgtttgataaaagctgacgtgatctcgcaaaatatagcctaatgatagggcagaagcgttggtgacaacgccatctgaatttgaaccatcgcccaagttaccataaatattcaaaaccctggcttgacgagggaaattttttctcagccgatagagtaacttgtattcaggatggatgatcttgggtttaccagtcggcaaaatgcgatttttattgggcgcatcatcccataactgcatcagtgggccggatgtcggctgattggacttgtgattatccatgatcccatcataaggcccggcgatcacacataacttattggttcgtggcaaatcagatcggttgccgttcaaaaggttatagtagacgacggcgtaagcccccatggaatggccgacaaagtttaattgattgacatggtatttctgcttgagtaacttgcagaccttggtcagccagcgggcatactgaacctcgccggcgcggttattgtccattcggaccataatgattggattaaccatccatgacttaaccgttccagtgactgacaattttccgttggctctcacgcggacaatcattcgccttgaagcggccccactaacctcggctgctgagatcatatctttttcggaacgaagggtggcaccccagccgtggacaaagatagtcggcgtactggagtcaatatagttggccttgagctgatccgaagcacgctgatcctgccaaatgttaaaaccgaagcccaagatgatgagcccgccgattacaaagtaaagtattcgcaagtttcttgagcgccgataatttatcaactaattgaccgccttatacgtgaattctttattttttgtttgacatagccgtagcccagtgacaggataaacgaaattaaaaccgccagaattgtttccataatggcaccattgtagccagcttcatcaataatgtcgatgacagccttgtgcagatacataattcccaatgtctgttggcccaataattgaaccggcttaatgagaaactggggcatgaatttgcagaaatagtaactggcgctgaaaacgactagacaaacaataatcgggataaaagtaatgtaggaaacccgagaaatcggaatgtggtgataggaagcgtgaatgattttggacttcaggaagaacgcgaagttgaaccggtccatgtgctgcatccaaaacaaccagacagtcagcatggctgctggaataatcacccacaggtccttaacgaattgctgaattttatggaaataaagatagccaaataacatgaagaacatggcgataaaagcaacatcgaagtcccaaggcacgtatttataacttaggaagtaaatgtgcttgtaactggtggaaatgattaatgaagcaaaggccacaataatctgtgcttcccggcttttgacgtatgtaatgacaatcgatgtgaaaaccagggccaacaggtaaacattaatgtaccaaaaaacactgaggtagtggttcagtgtccgtccaccgtacagtaatcgggcaaagtagaaaatcgtatacgaccaactttcgcctctgatgaagtgtgacagtaaaatcaaaaagccaccacagattaaatatgaaattagcagtggtaaaatccgtttcttgaaaaaaccgatccaattgttattgacgattggctttaagaaaaagccccccatgatgaagaagatcggcatgtgccaccaataaagaaaatggaacatggtgccgtgtcgtgtcatggcgtgaccgaaaacaacggcgacaattccgaccgctttggcaacgtcaatccactcgattctttttttactcacaagtgtttcacctcgaaaattattaagaccacatataaaaatattctagtgcatttagggtgttcatgacaatactttttcattacatctctataaaacaattgatgcttaagtaatttttaatatatcaccccgttattgctattcattagcaacttgattaaaatgaagcgagtgtcaaagtatacgaaagtaggaacaatcatgattgataatcatcaaaacctgacggaaaagtcgcgtgaccagatgttatccgggtcagcgtggatgacggccggtagtattttgagtcgatttctcggtgcagtctatattattccctgggggatttggtttggcaattatttcttccaagccaatgcgctgtacggactcgggtataacatttacagtttcttcttgatcgcggccatcgcagggattccctcagcgatcgccaaacaagtggctcattacaatgccttaaatgagtatggtgtcggcgttcggctttataaacggggcttggtgttggccattgcgacaggagttatctgtgcggtgatcctgtattttggtgcgcccttaattgacggcggcaatcccaacgtcattccggttttgcattcactggcatgggcaattttgattattccgacgatgagcctcacccgtggttatttccaaggttaccaacaaatggcgccatcagcgatttcccaatttgtcgaacagctggctcgagttgcctacatgcttttaacagccttcattatgatgcgggtgctgcatggcagttgggtcaatgctgtttctcaatcaactttcgctgccttcattggggcggttgccggcctggcgacccttggcgtttattacttccgccgccgcgaagattttcgacagctggttttgtccagcaataatgagatccacgttgaagcaaaacaattatatcaggaaattattgcgcaggcagtgccctttattatattgggtgccggaatcacgatttttatgctgattgaccagttcactttcttcaagattatgcggatggcgactgattacaactacgcgaccctgtccgatctatatgcaatgtttgctgtgaactcaaataaattgattatgattactgtgtcgctttcctctgctttggcgattaccgccgtgccgatgctctcagaagcgctgaccagcggggacaacgtcgaaattcgcaaacaaaactccaatgtcatggcattattcatgtttgtcatgattcctgccgccttggtaatgccgcaattgccggaccgcttaaccgggtcttctatggcaccactcatcaggcactcggcgctaatattctaacgttttcatccattatctccattccgatgggattgtttgttgttatttctgccgtgatgcagggattgtctcaaaacagacgggcagttaagttctttgctgttggaacagtggttaagtttgtgcttcagtggccttgtacctattttttgggttcatttgggccactgctttccaccgggattggcttgaccgttgccaactggctgattcttagatatttgaaccgccatttcggttttgaaaaacggatgttggacattgcttttcggaagatttcgaaatattcattgtttatgtatgctgctgcactgttgacggtttatgggttgaattttgttgttcagttgattggtaatccatttggacgggttgtcagtctgatcgtgaccttggtggccgttttggttggtggggtaatttatctctacttagccttgaagagtcgaattgctgatatgattctgggcccgcgaagtgacaagttgcgacggttgcttaaaatcgaataaccagccgttttcattcatatttagccaggataaaataaacaagtctccatcactgacaattcagctgatggagacttttgtgattcaatttagttatttagcttgatgcttatacataaatttcggcagggcctcactgatttggtggggcagaacaacatattgcttttcagctaatttatctgcaatggcactatgagaataaaccgccgctaacacagctttttgcggatttttgaactgggcggcaaagcccccgaccattccggccaaggtgtcacccattccgcccgttgcctgggcaggagtgccgccagtgttttcgtagacgtggttgtccgcataaacttgcgttcgatgtgatttaaccaccacgattgcgtggagctgtttggcggctgcctggtttttctctggcgtctggtcggcaatcttaatgccggatactcgctgccattccatttgatgcggcgtcaaaatgttggtcgaatctttgggcagcggcaagttgttagcagcaagcaatgtcagtgccgaaccatcaatgactaacttttgttcgctgccggcaatccgaaagacttttgtcaacagggtcaacgcactgggatcggttcccagaccaggcccaatgaccaccacgtcggcacttttaatgattggttctgcctgatcaaaattgttccaatccacaaacattgcttcgggcagccagtcatgcagactggtttgattactggggtccgtaatcgtggtgaccaagccggctccggaataaactgctgccagtgaggccatgataatcgcaccgccaaagttttggctgccgccaatcaaagcgattttgccgtaagtgcctttaaaactatctgccggtcgcttgcgaatgacatctgttaaaatttgacttgtgatttttttgacatttatcatcatcagatctcccatccgaatctgtttttcaccctaattatagcatttctggagtggacagattgccaacgccaattgaatagtgtgataaaattgaactataagaaatggacaggagcgagaaaaatgacagttgattggaaaaagcgcgcacaaagttatcaagacgagtatttgaacgatttaaaggaattgatcagtattaacagtgttcgtgacgatgagcacaagaccgatgaatttccactgggcgaggggccaacccaagcgatgctcaaatttttatcatttggggagcgcgacggctttaagacgcaaaatatcgacaacattgttggctatattgagtatggttccggcgatcagacaatggcgatgcaggcccatgcggacgttatgcctgctggagacggctgggaaaccaatccatttgaaatggtggaaaaaaatggcaacgtctatggccgtggaacctcagatgataagggacctgcgttagccgcttattatgggttgagaatgctgaaggacaatgggattatgcccaaaatgaagattcgtttgattattggaactgacgaggaaagtgactggaccgggatgaagcattatttccaagttgaaccgcaaccgacctttggtttttccccagatgctgaatttcctctgattaatggtgagaagggcaatgccacttatgtcacgacctttggccatacaaatggttccgaattcactttgaagcgatttgattccggattgcgcttgaacatggttcccggatctgcggatgcgctggtcgaagtcggtgataacgaaaaatttgtcgacggctttactgaatttttggatcaaaacccgattgccggtgatgtcaaatcaaccggtcagggcgttgctttgcacattaccggtaaagctgcccacgcgatggaacccaagaacggcgtcaatgccggcacgtatcttgccaagtttttgaatgcctatccatttgacggggccgctaaggaatttatttcctacctggctgaagacctgcatgacgattcccgggcaaccaagatcggcgctgcgcacgtcgacgacatcatgggagagttaaccatgaacgttgggattatgaaatttgacacgcagcacggcggcagcgtcaacaccaacttccgttacccgaaaggaactgacgatcaagagattttagctcacttgcaacaggctgccgagaaacgccatggaaccgtgaaggaaatcaacaatatggacacccactacgttgatccaagtgatccgattgtcagtaccttgatgcacgtttaccaggaacagacgggcgatatggattccaaaccggaagtcgtcggcggcggtacttatgcccgtttgatgaaacgcggggtggcgtttggcgcattgttcccgaacgcccaagataccatgcatcaggcaaatgagtttcagccggttgccgatttaatcaaggcaatggcaatttatgggcaatcaatttatgagttgacagccaagtaaaaacattgaggtggttagtatgttggactttaattattcgaatattctggttgggattgatggttcaaagactgccgccaaggccgttagacaggcaatcacgattgccgagcacaaccatgccaaactgacaattgtggcaattatcaacgaccgtgaaattctgggggtgtcaaaagccgccttgatcggttttggcaacgtcaatcaatcaacgatcgatgaggtcaaatccagatttcaacggctcgttcataaatacgaattgatggcaaaagaccgaggacttgctgtcagtgcctttgtgacatcaggcgatcccaaaaataaattggcccacgagttggtggatgacgaacatgtggatgcaatcgttgtcggggccaccggggcaaattttgttgaccggatgacaatggggtctacagctgcttttgttattgcccaagctccctgtgatgtgtttgtggtccatcgcgactagccggtttcaagtcggttagaacaactgaaataaaaaaagaggtgagccggtatttcgagaatacctggttcgcctcttttgtggtccattattcaattttggttggctgatttttctgcggattgttaacaattaatccccagattccggaaatcacgtacaagaaactgcccaagacgcccagcacgattaaaacaatcggccacacataactttcattgtagtgaagtcgtttaataccaaagaacgcaatgatttgctggattccatacaccagcaaaagaaaaatggcgatcatgtgataattccatgagttatgaacgcctgcagcatccgtcgttctggtcagcataaagattgccagcgccaaaacgacaatggtgatcacccaccagacgatccagccgcaaatttgagcggcagataatttatgttgttttgtattttgcaaatctacatctcccccaatattgtttatatcaagcctaccaagagtggcctgattcagtcaaataaaagttgcatccaggccaccaaaaaagttatacttttcgaagcacgtcattgagaaatgacaatttcgaagggtgaggtttggtcatgattgacatcgtattcagtgatagttttgcatcaacattgaagtattactatcagaaaagacatcttgacgggcaggttttggcattgccaatgtacctgagcttgggggacatcagtcaacgctcgtttatggaaagtcgacaaactatttataaaatcgaatacgctcattatcaagcctctgaacaattaactgtcgaagcggtaaatgctttacggcaggggcttgatcaactgagtcaaatggctcaggccggcgaatcgtttcgcatttggtggagtgagaccgctgacgactactgcggctttttgtggatttgcgattatttaaaggatttttcagttcaaacgacgagtgtcaaggttccaatgaccttggtccgagaagacagtttgatgattatttccaaattaggtgaaatcagtgaagacgccattgatgaacttcaattggcatcactacaaagggacctgtctgctaattcccggagagccttcagttactattggcatgacttaaggagtgaaaataatccgatcagaacggtgattaacggcaccgttgtcagtcaatcgattgacttttacgatcgttttgtccttgccaatctcagtcaaagacggtttagaaatattctgcgggtaattggtgagactttgggcgattatccgttcacggctgactggtggtaccgccaccggattgattacttggtgtcaaagggaagcgtcgattataaggcggatccggacgcaatcgttgggaaaattaaattggcaaaataaaaaagggctgtttagctgtgaaatgatcagctgaacatctccttttaactccgtggccttttcatcgtatctggtagacctgaaacttatgactgtctgttagagtgtctcactttgtggttggcgaattttagccaaagcatcatcaatctgtccgagaacgattgtgacattcttgggatcggacaagtcatacttttgcaagtcgattttgatcttgggactgacatcgtattcttggaaccatttcttatatgcagcccacatcttgaagtagtattcctgaaggcccgggttgtcgtcaaactgttcatagtcgcgaccgcgttttttgatccggtgcttgatggtgtcaaagtcactatcagcatacaccagcaaatcaggagccttttttggcaactcgtcgagttctgccatcatgttattcaataacttgaggtaaaccgccaattcagtgtcggtgatgtttccctgagcattattttcccgggtgaacagtgcatcttcatagattgagcgatccaagacgttattatcatcactcaatgcttgtttgatcattgagaaacgcttgtttaaaaagtaaatttgaagtagaaatccgtattgttttggattggagtagtaaagcggtaaaacgggattgtcgccaacgggttcaaaaaacgcttttgtcccgagatgttccgcaatttttccggttaaagtggtctttccgaccccaatcattcctgcagttattatcaccatggtagcccctctttataataaaatgacaatatatagtgtaccacaaaatgtggtaacacaatatatataatttcccgattcggaagttaaaattgggaatgccgcacatattaagtagtacaatatagttaataagttaaatggagggaatttaatgtataaagcggttgtgttctttgacttagacgggacactttttgataatgaaaaaaacgtgtccgacgaaaatgtagcggcaatcaatgaattacgtgccaataatattttaccagtgatctccactggtcgaaatatttttgaaattcagtatgtgattgatgccactgggattaactcgttagtcagcgctaatgggagttatgttcagtatgaaggcaaaaaactcaaagcagaacaaattagtgatgatgtgattgaggaaatccttgcctttgcaaaacagcagggggatgtcatttccttttacaacaataaggaatttgcgttgacttttgaaaatgacatgacgaaagtgaactatcgtctgttgcgattaacaccacatgttgacccagaattttacaagcatcacgaagttaatttcttaaacgtctttaattacgacaaggataagctttaccaagacaagttcaaagggaagttgtctttggtccgtaacaacccgcgttgtttggataccatgaagtggggcgtttccaaacaaacgggaattcaggctttgatgaaaaaactgaacctcggtgacgttccatcatatgcatttggggatcaaatgaatgatttgcaaatgttttccgaagttaaatttccaattgccatgggtaatggtgtcccagaagttaaggaaaaggcgtcttttgtcactaaatcaaatattaacggtgggattgtgaacggccttaaacattatgggctgattgattaatatctcgccaaaggttgttctcgaccatttaacgacgaaaggcaactaccccgaaacagaggtagttgcctttcgtcgttaatcatcagaattagggatgaaacgaacccttaattcatttgcttttcaatattagccaacgtcatttctgaagtatcggcaaaattaatgtcggcatcctttaagatatttttgtcgccgatgccaatcgaggtttcgccagctgcgttaattgattcaacaccagctgccgcgtcttcaacgccgatgcactgttccggcttgagatcaatcaattcagcaccctttacataaatttctgggtcgggcttgcctttactcaatgtttttggatcaacaatctttgggaaataatcggttaaattcagcttttgcaagactttgggcgcgtttttagatgctgaagccaatgacaataaataaccgccatttttgatttcgtccaagaatgctttaatccccggtaagatattgtcaggggtcatttgatcaaccaacttcaagtagttggtatttttttcagttgctaaatcaaccttttgctcatcagtgtatttatcttgaagatttccagctttcaaaatcatttccaatgagtccattcgactgatgcctttcagaccgtcttcaagttctttggaccatggagcgccgactttatcggcaacttgatgccatgcctggctgtgaaaaaccgaggtatctgtaatcacaccatctaaatcgaacacgaagcctttaatatcggaaaattttgccattatcattcactccttattatttgtaggtaattgttgccatcttgttcttagtcagtgaataagcctttttcgcaacactgacgtgagtatcggcatctgcggtcacatcgatccgatgatgaccgatgacgaagtggtaattgattccttggtaagtttctttaaatgaaattttagaccaagtgcttggcaggtgaggattaatcgtgacctcgtcggtatcaaaccggacaccgccatagcatttcgtttcaatttgaagggtcgcacccattacacctagatggattccttcggcagtcgtcccgccttgaatgtcgtagtaatctgagaacagggcagttgaaaacagctgccatgactggtccatgttgccgtcaatttcgtccagaaccgaataaacaattctggaaagcgttgatccatgagtcgtccggtcaagatagaaccgtaagttgctggtaaagaagttggcgggcagcttgtaccccagacggttgatgacttcttgcacttcgtcaaacggcagttcatagtaggccatcaatgtatcagcctgcttggcaacttggtaggcgtccggtgacttgccttcgcccttgagcagtcgatcaattctggaaatatcaccatacttcttccggtatgaatcgaaattcagtttggataggttgaagtaccctgagaactggccgataataccttcttcgttgatgtccaatcgcagtttatgggcaatatcgttcatcttggcgagaagtgcgtcgtcaaagccggctttttcactggcttgctttaaaacggcgctgtcttcctgcgataccagggtattgaccttgtcaaacagccaggaaaccatgatattcgtataggcattattggttaagccatgatcgttggagttagggtactcttcgtgaaattcgtcaggccccatgacatgatggatgtcataacggtcggctgattgatcgtagtcggtcatgctgacccagaacttggaaatcgacagcagcatttccaatccgtattgatccatgaattctttatcgcccgtgatgtggacataattgataatgtcataggcaactgaaatggaaacgtgccgttgtaggcggctgttatcgggatcccatttgccgctaaccggattcaagtgaacaaattgtgattgctcatcgccatacatccctgactgccaaggatacattgcaccttgtttgtcctctgaggcagcatactttcgcgcctcagctaaccggttgtaacggtaaagtaggcactgtttggcaatcgcagggtaatgaattgcatagaatggcaagtcaaacgtgacatcccaaaaaatgtgtccacggtaagcttcaccatgcagcccacgagcaccaacggatgcatccaatttaccggaggacaaagcagcactggtaactaacatgtggaaaatattgaccctggtcaacttttggctggtaagatcattatcgataataatgtcggagtgttgccaaacattgctccagaatttttcactatcgcttagcgtatcttcaaatgaggagtcatcaagttctttttgtgcatcggcttccaaatgatcattttcgtcttgggaagtaaagacggtgacattctttttgaattcgtattccttgccgggctcaacgttaatgctcaaagcctgttggactttaccttcctcagtcgtggtatcgattaattttttggtatcgaaatctggactgctgagtttggagttaatcacaaattgaacgtgtgaggtcttggtttgaccggtcatcgagacttgattgtcatgagctgacatgccgatgacatcaatgtggtgctgatcaaagtcttgataacgttccacgttgccgttaataacgttgccatcaatgccggcatagatttgtaaactgccggagaaattgatgggctttaattcatatttgattgcgtaacggtgccactgatccatgttggcgactttcgtagcccggacttggatgatatggccggttgaaagctgaacgtgcagcgtggttgtcaaagtaccggtcttcagatccaagcttcggtaaatatcttgaatatcggctttcttaatggtaaatggcagttgatggtcaacaccgaaactaatgtattgggcattcggtaagtttaccaaatcctcgttcacaacgtcgcggtcattaatcttagtcgtcaattggttgtaaacaccggcaacgtacatacccgggtaattatccttatcagcgtgggactcaacgtaggccccccggagaccaaagtaaccgttcccgattgtcagcatggcttcttggccgtagttccgtttaccggcatattcaccatagtaatccagatgccacttaaggtattcttccttatcggcaacggcttttttcagcccaacttctttgatcttttgcagattaacaaccggaatattcatcatgttggcaattgccaatccgatatcaatcttttggtgattaatgccaataatcgtatctgaaaactcatagtttaacgaattttcgataatggcggcgtcgatcggcaggccggtcagcgctgctttgatattttcaagattatcgccaattgaaaatttggggttatatgtgatcataaactttcgaaacggcggtttgttggaatcttctgaataatttaattccatgaccccatcgcgggccctaatagcaaacgttctcataacaaaacctcttctcaatttttgggaaataaattaaaccttcacacttttaattctagcccagacatcatgcaatcgcaatcaattaccgttttggaatggtctgcggtgcgtcattgacggctcattgtttattttttaacagatcccggatctcggaaagtagtacttctttgttatcgattgcaggctttgtcggctgacgcttgaggaccttgttaatgagtttgattaagataaaaacgacaaaggcaacaattagaaaattgatcagtgaattgataaaggccccgtaacgaaaagttgcatcaccgactttgaaaatcaggtttgacaagtcaatttttcctaagaagatcccaattaacgggttgatcaaattatttgtgagggaggtgacaattccagtaaaggcgccaccaataatcaccccgacagccaggtcgatgacgtttcccctggcaataaaagccttaaattctttgagcatgatttttctcctttcaactagcttattttcatgatgtatttattatatcgactttaaataccccaagacaaactctaactttcccaattcaaacgtgaactccattggcaaagtatgatagtatgaaataagaaattttacaggagaattcatttgaaaaagtctaaattattcttaatcgtcggcgccgtcgtattagtgttagcagtggcgtttttcatcacaaagtcttggcatttatcagtcctgtcgttcgcactgatttggctgattgcaattattgccattcgcctgattttgacgccgctggtggtgatgattgttcgccaacgcgatgaaagaaaagcccaacgagaagcagacgacaatagtcgtgacaaataagattgtttgaaggggattgtatgaacaaggattggctccacaggattttcataaccgcaggattgatcttgcttgccattggtggctctgcggcaaccagcgggcaggcagctgccaagacgaccaacgttgctgactccaaacagcagttggttgatattgtgctgcggccaaaaagtcagtcggcacttcaccaatttgtctacaacacagtgacgccgagttcaccgacttatcgcaaatttgtgtccccaagtacttttgccaaacgattcagtcagagcccaaagcagattaaagctttgcagacctatctcagacaccatcatttaaaggcgcagacttacaaaggtaatttgattatggtggtcaagggatcaaccaaaaacgttgagaaggcgtttaaggttaacctggtgaacgtcaataacggtgaggtcaaatatcaaaaggccagccgaaatcctcaactacccaagaaactttccaaggttgtctataccgtctttgggttatcaaattactcaccgttttcttcatataaaaccaaatttcagccctcttcactgcataccagagctgccagcgggacgacaaccaccaagaagtattcaccgacgcggtttgtccgtcgctacaatctacagtccctatacgataatgggtcgactggccgcagtaaaaccattggtatcatttcatttgccaacttccatcctaatgatgtgtaccgctactgggatgatgagggcatcaatgtgaaatccaatcggctaagcgtttatcggactaacggcttcaagggtacctgggatggctatgatgaaacgaccatcgacgttgaacaggccggcgcaatcgcaccggacagcaacattcggacctacattgcccgcccaaatattttggggatggtgaattcaattgctgccgcagttggtcaaaacgtggccgacagtttgtcacttagttggggccaaagtgaagcccaagtggcttatgaaatgaaacaggggattaccccgaaaaaatataatcaaatcatgaacttattatttgagcaggcagctgcccaaggaatgagtgtcttcaccgcgactggtgataatggcgcctatgatgggattaccaccggtttaacgtcaggattgtccgttgacacgccgtctaattctccatatgtgaccgcagtcggcggcacgacactgccgaaaacctatactgtcaataagaaaaaagtcaccattcaccaggaacgcgcctggggggctgactttttataccccaactataaacaccaacgatttttcggaactttggacatgcttcaaagcttctttgccggaggtggcggcggttttagtaaatataatgccagacccgcctatcaaaaagggatcagtggtgtcgggacgtatgatgcgactaatctttggaaatttaaatatggccggccggaattgttgaaaaagccgattaatcttagcggtaaatccagcggcagaaaccttcccgacatttcagcgaatgccgaccccaatacgggttacagcatgttcattaccccgaagaataatcgaaattccaaggggcaatggctgattaccggtgggaccagtgtcgtcgcccctcaaatggccgcagccagtgttttgatgtctgatttcactaccaatggccgcttgggcttttggaatccacagatctatcgatttgccaaacgatcaacttcgccgttcaaaccgttggacagtcggacaaataacaccaatttgtactataccggacagccggggaagatttataaccaggcgaccggacttggaaccattgattttacagctttgaacaaagcttttaatagttaaggagacgctgcatggaagagcaaagaaagttaacttttggtgactactttgaacgattaatgatcttttttgggctgattattttggtcggctcagttcagctgccactgatgttcattgcccaaggcaagctgtcagcagttgccaattacgctgttggagctttgtatttgttgggctttctaatcgccatttggctggcacagtatgcctaccggaagtatggccgctacgaagtcaaaaaaatgacctggccaaatgtcaaaacaattgtcattgcttggattgcttttttggtgattgagttcttattgggaaaccttaataaactggtctatcacgtcactcaaacggacaacaatcaggaaattcaatcattgttgtccagcaatcatcttaccctgattttgatgggatttacggcaatcttctgttcgccgattcttgaggaaaccatttttcggggatatttgatgactgcgttctttcggtcgactgaaaaatgggcaccaattattgtcagtgggatggcttttgccctgccgcatatggatcctgatctttcccattttaatatcatcagttttttgacgtatgcgatcctaggttgtattttggcctatttgtatgtaacaactaaaaatttgaaggtatcaattggcctccattttttgaataatttaatcgcagtcggcggaatgattgcgatgatttttgctgtgtaattaattgtgagaggtgttaatcatgggattatcggttaaattgatgaatgatctttcggatggcctcaagggtcggcgaaatctgattacagatgttggcggcgtcaaggtcgggcaggtgactattgatgatggtgatgttcatagcggtgtgaccgcaattctgccccataccggcaaccttttccggcacaaggtaccagctgcctcttgtgtgcttaacggcttcggtaaaagcgtcggcctcgtccaaattgatgaattgggaaccattgaaaccccgattgtgatgacgaatacctttggcgtgggcacggccctaaatgccctcaccaaacaaatgctggctgacaatcctgaaattggggataccaccagtacagttaatctgattgttgctgagtgtaacgatggcgacgtgtccaatatccgcaaaatggcgattactgaacagaatgtgtccgatgctttggctgctgttaacgatgactttgaagaaggtgcagtcggtagtggccgcgggatgatgtgctatgatctcaagggcggcattggctcttcctcgcggattgtgaccgttgataagaagcaccaatacactgttggcgcactcgtcatgaccaactatggttatttaaccgactttattgtcaatgggatgcctattggagcccccttggccaaaatgttggccaaggataagcaaaaagaagaaaaggggtccattatcacgatcctggcaaccgatgcgccattgaatgcccgccaactcaagcgaatggctaagcgggcaacggttgggattaatcgttccggtggctacattggcaacggcagcggagaaatcgttttagcattttcaactgccaatctggtggaccattttgaaaccagcgagtttgatactgttacccggtttaacgataaccaaattgatttattcttcagagctacggcagcggtcgtcgatgaggcgattttaagttcaatggtgcacgctgaatcagtcgttgatcgaaagggacggctccggttaaatttagttgatgcatgcaagaagttgatttctcagcagccggattataccgatatggttgagcaggtcttttcacagcttggggtggtcaaatgagtgcgaagattttattaggtgctgaaaacattcgccaacttgcctggggtgccgtcaacggctgtgaagcagccagcttgctggaggggctccattatcagggccgagctttagacctgaattatggccaatttctccttcagatgccaatttcaccagatagcaatccttaccacggctttggtggttcacctttcaccaatcggcccggcaagtttgaggcaatctttacccgacccttgatgtggtggggaaatcgttatggtaatctgcaagaactgagtggggcagatccccagtggttgtatgactttgtggcaaaaggggagccggtgttaacctttgtgaccgtccgttttgaacaacctgagtgggattcgtatccatttggtcaggttccggctaataatcacgcggttttgttggacgggatcgatggcgaccaggtccacgtgagtgatccgattgacggtcaatactggctgccaaaaaccaaatttgagccgatttatctgtctcgtaagatggcaatcgcaattactaagtaaaattcacagcaaaatcgcatattctaacaggctttctgaactcaatattagaaaaggcctgtttttttgacacttttatgctaaattagaaccaagatgagtttgttacgcgtcttacatattagaggaggattatatcatgcatttatctcgaggagtggctgcactcgcaggtgtagcaagcattgcattaattctggcaggttgtggtcaaaagtctggtcaagccaacaagacgattaagacttcaaccgattctgaactgacgactgttgatccatcgaagaccacggctgttggaactttcaacgttttaaacaacgtcgatgaagggttggttcgtctaggcaagaatagtaaagttgaaccgggaatcgccaaatcatggacggtttcaaaggatggtaagacttacacttacaacttgcgtaaaggtgccaaatggagtaatggcgatccggtgactgccaaagacttcgtttattcatggcagcgaaccttaaatcctaagacggcttcacagtatggttacctgttctcaggaattaagaacgctgacaagattcaaaacaaaaaagccaaagtttcttcattgggaattaaagcagatggtaattataaactgactgtgaccttggaacagcgaatcccatactttaatttgctgatgggctttcctgtcttcttcccacaagatgccaaggcggttaataaatatggcaacgattacggcacttctgccaagacccaagtttataacggaccgtttacgctgactggatggactggaaccaataacaagtggactttgaagaagaacaccgattattgggacaagaaagctgttaagcttgatgacatcaagttcagtgtccaaccggatccttcaacgtcattgaacctttacaatcaaggcaaacttgatatgtcgcaactttcagctacccaggccaaacaaatgggtaacaagaaagatatgatttcacgaaagcagtcttccaactactacattgctgttaaccaaaagaacaaggtcttcaaaaacctgaaaattcgccaggcaatgtcaatgatcattaatcgaaagacattagccaacaaagtcatgggtggcggcgcaatcgataacaatagctttgtttcagagggattggccgtttcaccgaagaacggaactgactttacgaaagacacaaccgctcccgcatcaatgacttataacccaaccaaggctaaacagctctttaaggaaggccttcaagaagttggtcgttcgtcattacactttactttgttgaactctgatggcagtgaccaaaagcaattgagtgagtatctgcaaagtgccttgcaaaagttacctggcttaacggtcactttgaacaacattcctggtcgttcaattttatctcgacaagctgatggtcagtttactgtgaccgttgccaactggtttgccgacttctccgatccaatcacattcttgaacattttgacttccaataacccaagcaacatttccggttggaagaattcagagtatgattcgttaatcaaagccagcaacgctgacgatggcagcaatgccaacgctcgttgggatgacatggttaaggctcagaatttggccttgaaagatcaagcaatcattccactttaccaatcaggtgaaaaatggatggttaattcaaaagttaagggaattgtttacaacactgctggtgccaactacaatttcaaagaggcttacgttaaataattaatgaggagtgacacttattggaacccgtgattaaaaagattgatgtccaggaagctgctgtgccactcaaacggccgttcaaaactgcattaagaactgtcaccactgcccagacgctgatcgttaaaatgactaccagtgatggtaaagtcggttatggcgaggcagcaccaacgccggtgattaccggagatacccttccaagcattgaaagtgccattaacgatgtgattggcccgaaattgattggcaaaccattgtttgactcagcggatattaaggcgactatcgatcagtcaatggtccataattcgagtccgaaggctgctttgaatattgccgttaacgatttgctggctcaatcgtatggggtgccactatatcaactgttgggtgggcactcggatcacatcacgaccgattatactgtcagtgttgggacgattgaggatatgatcacccaagcacaagacttgattaccaaagggtttaccactttgaaaatcaaggtgggggatgattctgaagaagccgacctcgataaaattgtggccatcagaaaagcagttgggccagccattcaaattcgtttggatgccaaccagggctggcatccaaaacaggctgtcgccgttattaatcggatgcaggatttgaatctgaacattcaactggttgaacagccggttaaagccactgactttgatggtctggcttacgtgaccgccaacaccacgacgatgattatggctgatgagagcatcttttcaattgaagatgccgctcgcatcattagtatgcgtggttgtgatattatcaaccttaagttgatgaaggcgggcgggattgataatgcggttaaaatcaatacccttgccgaggctgccggaattccctgcatggtgggtagtatgattgaatcgtcggtttccgttactgctgcggctcacttggccgccgccaaacgaaatattcagtatgtagatttggacgcatcgatgatgttctccagcaacccaattgtcggtgggatcatcaatcaaaaaaacgaaatctcttttccagatttaccgggattaggatttaagtaacctaagaggctcggacataaggattcctcatgttccggcctttttgagtagggtgaacaagccggcaatgctttttatgctatctagcaggtagttggtggctaatgaggtataatatatgtatactaaaatttaacgaatggaggtgcccagatggaaacaagacgagtcaaagttccagtggcaactatttggaagtctaaagaatcaccaagaaaagttgatcaaccagccttagacggcgatggtaaaaaatgggttgaacaaatgagtgatgagcaatcagttgcgctttccgatgatgacttattagaaacgcaggctttgtttaacgatgaagtcattattgatcatttcgacggtgactgggccaaagtctatattcccagtcaacgagatgattctgattcaaggggctatcctggttgggtgccaagtaaattattaagcgatcagcagattagttatccaccggttacctcaattgtgagaattgctgttcggacagccaatttgtatgatgaaaacaaaaagccggtcctcgaaatcagcttgggaactgtgctgccacaaacaggcaccagtggtgactacattgccgttgtgaccccgcttggaaagggcttcattgacaaatcagcagcagtactgccattcgttgggagcaatgctggtgaaacgatggttgagatgggacgccaatttttaggcgagcgttatctttggggtggaaccagttcctatggttttgactgctctggatttgcgtacacgcttcatcgggtacttggatttgatattccccgggacgctgacgatcaacaagaaaacggcttacctttagcaccggaagaaatcctaccgggtgacttggtatttttcgcgtatgatcacggcaagggctacgtgcatcacgttggcatgtacattggtaatggaaagatgattgaatcaagaacgccaggcgccaaagtcgatattgccgaactgactgaaccaaaatttgcggccgagtttgccggctttaggagatattggcgatgagtgagctttctgaaacaattgaacgggtgatggctgacagttcgtttaagtatggcttgttaattcaaagcaacggtcagaccttggtggaccatgatagccacgaggctttcccatcggcttctttgatcaaattggccatcttaaacgatgttttggacagcaacgttgatctggatcaatccgttgatgtttcgacggatgagttggtaggcggtgccggaatcttacaattgatgtctgttcggtcatggaagcttcgggacttgttggcgttgatgattagtgtgtccgataattcggctactaatgtggtgatctccttgatgggaatgaaccatattcagcattatcttcaaacccatgatttccacgagaccaggctggaacgttatctgatggacggtcgggcacttgccagtggcaaaaataactataccagtgccactgaaagtttgcggctgcttcagcaagcacttcataatggttccgaagtccagagctggttcgtcaatcagcagttccgatacaaactaccgggtaattttgatgaatcaggcgagaatgttgctgtatacaataagactggtgagggcaatttgattgaccatgatgtcgctcaaattgtatataacaaccattctgttgacattgccatgttgactgctggatccttgaaccgaatggaaacgatccaaaaatttaatcaagttggccagtcagtggttgattggctggcatgaataaaaaagcaagcgtcggccaataagcaattaggctccacagtataaagggattacctgaattccagttggatatttggataatcccccttatacggtcggaagctgcttattggcccacaattataccagataacattcaaacacaaatcgaggctggaacaaaatctttcattttgtcccagcctcgattttaaattggatttatgattagattatactctgcaccaaaatcttaacattttggtcagagcgtttagatctgtgtttgattgtacaaatcaagcttttgttcaatggtcgccatcgtctgagaacaagcttctttttcagctggggttaatcccaaaacatcaaagcagctgttcacacgactgaagacattgtcctgttgctctttggctttgtcggttaactggatgacaacggttcgctcgtctgcttcgcaacgggagcgggtgatccagccatgattttccagccgcttgagtaatggggttaacgtgccgctgtccaggtggagatattcgcccaattgcttaactgagagtggtgcatattgccacagagtcagcatcgcaatatactgtgggtaagttaaatcaaaaggcttcagtgcctgctgataaaaatgattaaattttttgttcgctgagtagacttggaaacacaattggccgtccaagcgaattggttgggtttgaggcataatttcaactcctattatttttgcacatactgccgtgaaacacggacagcactagtcgaatcaatttaaatactttatgttattattgtaatgtatttatatttaaaagcaagacttaacacagggagtcaaattaattgcggacaattaatttgacataaaaggggattgttacatatgaaaattggtaaacttagatttagtacctggttattttggattacggtggtctcaatggctgcttatcttggttactatggttattggttaatgaaaggacaaccaaaatttcacgggcagacgttgctcttggtggaggtctttattgggatcctcattgccagcttgccatttttaatcgagaagttgggccggttttattttccacagattgaattggttttcttttatattttcttatacatgtccattttcctaggatccggattgcaattttacagtgtaccgttttgggataagtatgaacacgttttttccgcaatgatgttggctggactgggattttcaatttttcaaggattgatgagtgccagagataatgcaaccaacaagccattcttgatgagtctgtttgcctttacgtttggaacgacttgtggtgttttctgggaaatgtatgagtttaccgctgatggactgggtggtttgaacctgcaacggtatgaagaagctggcaagttgttgctcggccgagcagccttgatggacacgatgactgacctgatcgccgatttggcaggggctttcctcatggctttgattggttacctgatgatgaaacatgatccaagttccagccgatatctggttttcaaaacaaaacgacaaaacttcttttcaagttactacttttagtgtaaaataaaacatgttgttgccctcgtggcggaactggcagacgcgcagcgttcaggtcgctgtttgagcaatcaagtacaggttcgaatcctgccgagggcatcatataaagttaagaggttgagatcactattgcacgatagcgatctcaacctcttttttgatccgtttttttaaaaaattagtcggccgattatccataagcaggattggccgactaattttaagttatcaacatgttaaaacttgagtgtttcgttggcgaatctcgagttaaaacaacgattgtcttaatgggcccctctgacgagaacttggtatacaatttggcgaagttgacggttcctagtccagtggcttgattgtaaagtttaccaggttggccggtgtaatacaggttattattgttatcagcatcgtcaagcacagtaaagggtgaatcaggttgcaccgcaaattgatagatttgtgggttccaaaagccgattggcgaagttgtcccgctgttcatcaccgcgttggcaccagccatttgtggcgatacaaagctggtgccgccgttcactgtccattgtttgactggaacgctgatgaccgttttgccatccttggcataggcgaggtcttgtccggagacgtaggtcgcgtaaccggtgtaactgtcggcattggctgaaacatcgggaacgtttcgaccagatcccttgccaatgataatttgtggatctttattcactaagaacccaccgctcttatatttcagcagatcgattgcctggaaggtgttaacgccggaaaatccttgctggtagcggggcgtcggattcaaaattgaaaatccgccgccgctgccgccataattagccggtttggtttgtggattgctgtatgtgtcgccccaagcccgttccttatcaatggtgattaagcggccatcggtaattttagtatagggtaatgtggtgccgccggtaatgacttgatatggcgaagttgagaaaacgtggttgaattgtttaagtgccaattcacgcggaccatagtcgccacttgcccgaaagacggagatgccctgaacagctgcttgttccaacagcagattaaaggcgtcgttgtactcacccaaagaggcactggcaccttgttcccattgactggcaagctccgtgttgggtgaaaagctggttgaaatttgtttatcacgatcatccgaaacggcctgcataaaggcggtgtaataagatgatgtcgttgaagtgacgttttttaatgataggccgatataagcatcaattttggcatcgggtgcgacggctccagactggttaacatccagcgttgattcaatttgagccgggtttaatcccatcgacaggatcaagtggccggtcttggcaccgtcaattgaataaattttattgatccggctggggtcggcgttgacaccggtttgctgccaatatttgagcacgtcttttgcattaaagtcgtccatggcaataatgccaattcgctgtccttgaccggttaaaccttgtttatataaatcactaacctgataatgatcagcgaattttaaggcaccatattttttggcaaaactggttttactcaaatcagtatttggcggggtcgggttttgtgggagtgagggtgttactgcaagacttgtcttcttactttttggtttcgttgcgtacacaccgatgacactgactgtttgggccgaaagctttgccggtaatttaactttggttcgataatcgtttttgctgaccttcacttgtttggcgttaaatgcccgaatcaaattcttccgagtgccaacgactttgatggccaagtttcccggatagacggatgccttgagatgatatttccctaagtagcttttaaaatcgttgatgtctgtcgtcgggcggccgaattgactggcaaattggcccggcgttaagtattgatgataatttggtgaacttggatcgacggtggcatagacataatctgtcagttgggatgaactttgcggttttaaagcaatatttgccacaactgttttcgatggtgaaacttttggcatcgtgtacgtgttggattttgcactggtcgacacgctgccagcaatcacaaaaatcccgctcaatatgccaataactaatcttttgcccctcatgaaaaccacttcctccataatttgataacatttaaattataacattaattagtccattgactgaattggaaagccgtcataccggaaaattgtacctgcttgtgattaaaaatatatcttcagacttattaattgcttttcggatataaacgtagcattatagtggtgtagacagtaatgtgtccgcttacaagaaagaagggtgatatttatgtatgacaacattttggtaccacttgatggaagtaaaaattctcaacaggcactggaggaagcttgcaagttggccaaacaatttgactcaaagctccagttggtaacggttattaacaacaccaacttctactatggtgcaggggcagccggcatgccgccaagcatgtatgacgatcagcacaagatcgctgagaacattattgacgaagccaagaagtatgctgattcacaaggtgttaaatatgaaacagccattgatattggcaacccaaagaacattatcgcgcacgtttacccggatgagcacgacgtagatttgattgtgattggtaagtcaggtgtcgatgcgattaaccgactgttaattggatccaccaccgcctttgttgttcgaaacgcgacaacaaaagttttggttgttaatactaaaggctaaagataaatttatctataaactaaaagggattcaaaattgctcccaacaattttgaatcccttttcctgatgaaatttatatatcactaaatccgatcagaaatcttataaggtttttgaatcgcatttctttcattgtcatgactaatgatgtcgtcggccataaaaatatcgaagttcttgttgtcgacaccatgaacaaccaaaacctttttgttgtgttctttttccttgtaaatttgagcggttttgacagcttcattgtgatcatggaagttgccgatagaatctcccgggttgaaaaatacgatctcgtccatttgtatctctcccttcaaaaacaatttgatactctatctaaagtataacttaaaagaatggtaaaatgaaattcgaaagtgttttaatttcctttagtcaagccgttctttaagaaaggtttatactactggtagcaatctatgtaatctgataaaatataaaacgttattaatttcagactaaccaagaagatttgataaaggggtataaaatatgtgcggatttgttggttacgttaaccaaaaagatgttccagaaggtaccattaatagcatggctgatcggatcaagcatcgtggccccgacgacgaagcttatttctccgacgacaatgtttcaatgggatttcgtcgactttcaatcattgatttagcacatggccgtcagccgatgttcaacgctgaccaaactaaagtactgacttttaatggtgaaatttacaattataaagaaattcgtgaagaacttcgcgatttgggatatgttttcaagactgatgttgattcagaagtcttggtatacggctacgaagaatggggcccagccttgttagacaagcttcgcggcatgtttgcatttgtgatttatgataaaaagaacaatgaggtcttcggtgcccgggatcacttcggaattaagccactgtactattacgatgacggtgatacgttcctttggggatctgaaatcaaagcatttctggagcatcccaatttcaataaggaactgaatttgcgcctgctgccaattcacttgagctttgagtttattccgtccagagaaaccatgttcaagcacgtctacaaacttttgccaggtcaatatttccttcataagaacggcaaaaccgaaacccatcgttactacaaattcaactacgatcatattgacaatagccaaaccattgaaggagacgccgacaaaattggtaagttgattgatgattctgttaaggcccacatgattgccgatgtcgaagttggtagtttcctgtctagtggaattgattcaagctacgtattaaacgaagctgccaaattaaagccgatccagtccttctcgattggttttcatcactccaaatatagtgagttggcttggtcgactgagtttgccaagaccattaaccaaaagaatacgccaatctacatgaatggcgatgattacttcaatttcctgccaactatgatgtactacatggatgagccgctttccaatccagcggccattcagctgtattatttatcaaaggacacttccaagcacgtcaaggttgctttgtccggtgaaggggccgacgaattctttggtggctacaacacctatctggaagctatcccattcgatcgttatcagaagtatgtaccaaagccggttcgtaaggggctggctgcagttgccaaacggctgcctcgtttccacggtaaacgtttcttggttcgtggtgcccagccgttgagtgaacggtactatcgtgtgaactacgtctttaattacgacgaccgcaatcgcgtgttaaaagatccttcaattaacacagattcaggcgcctacaccaagcacatctttgatgatgtgaagggcaaagacgaaatgacccaaatggagtactttgatattaacacttggctgccgttcgacattcttcataaggctgatcgaatgagtatgtgtaactcacttgaagttcgggtaccattcgttgataaggaagttgccaaatttgccgaaaccatgccggtcaagacacgaattacaccggatgagaccaaaattgcgttgagaacctcagcagaacgggaaatgcctaagaagactgcccttaaagagaagctcggattcccatctccaattgccagctggattaacgatcccaagtatcacgaacgaattgtgaatgctttccattctgatacagggaaaaagttcttcaataccaacgaattggatcgtctgttgaaggagcatgctgaaggtaagtccaacatgcagaaaattttcaccatctatacctttatcctctggtatcaagtttacttcccagaagatacaactgagaacacggtcagcttggttcatcgtacccagatttagaaatatgcaaagaatggaaggtgcacatattggcacaaattactgttgctgaggttttagttttactcaaagaacataatttattgcttgaaagtcaattgagcagctcaagtcatccctttgaccagattgcatataactctaaattggtcactgacaactgtttgttcttctgtaaggggaacttcaaatctgcgtatctggatgatgccagacagaatggcgccaccgcgtacatgtccgaaaagacataccaaaatgccggcattccaggcattattgttaagaatatccaaaaagcaatgtcgctcgtaagtgcggcattttttgggtttccacaagatcaattgccaacgattgcctacactgggacaaaggggaaaacgacatctgcttactttaccaaagcaattctggatcaaacttatcagcgaaaggttgctttatcctcaaccatcaatacggttgtcggattaaagcccgaagatgttgttaaatcaaatttaacgactcctgaatcgttggatttgtttaccatgatgcgaaaagccgctgataatggaatgagtcatttagtgatggaagtttcatcgcaagcctacaagaagaatcgggtttatggtctgcattacgatgttggggtttttctcaacatttcacctgaccatattggtcgcaacgagcacccaacttttgccgactatttgcactgcaaagaacagttgttggttaattccgacgtttgtgtgcttaacgctgacgggacacatttaaccgacatcttttacacggctaaagcaaccacccaacctgaaaatatctttatttatggacgggctgggcagaatcaggaaactgaatttccagtagatgtcgagtatcggtcgttaaaggattcgctgacggaaaatcaaatccaagtgactgcccgaaccgccaaggcgaagcaattgaacattgacggtgtataccggattggaattcctggagattataacgaaggcaatgcagttgccgctgcgattaccagcgccttgatgggggccaaaccgactgagatcgcttatggtctggccaatacaacggttcccgggcgaatggaaatatatcagacccatgatcatggaacaatttacgttgactatgcccacaactatggcagtttacattccgttctcgatttcttgaaaaaacaggctcctaacggtaaagtgacggttattacaggcagcacgggtgataagggaattgatcgtcgcgagggccttggcaaagcaatcaacgaggctgccgatcaggcttatttaacgactgatgacccggcaaccgaggatccgcaacaaatcgccaaagaaattgccgctcatatcgatacctcaaaagtggctacaacctacatccccgaccgcaagcaggccatcaccaaggccgtttccgaaagccagaagggtgacttggtagtggttgccggtaaaggtcatgatcagtatcaaaagattaatggcaaaaacgttccgtatgaaggtgatgcggcaattgttaaaaatctcgtgaaaggactctagtaatgaaaaataagcagcttgattttacacccgttctgttaggcagtgactttaacgcctatggaatggccagaagtttatacgaaatttatggcaagccggtcaaagcatttgcccaaacccaattggcaccgacgcgcttcaccaaaattgttgatttggagctgatcccaggctttagtgaggatccagtctggattgatacgatgaagcagcttaagaaacgttatgccaatcatcaagaaccggtgattttgattggttgtggggatggctatgcggaactcattgccaaacacaaggccgaactagaagatgttttcatttgcccatacattgactatgatttacttaagaagctcaacgacaaggaaaacttctacaagatgtgtgatcaatacgacttaccatacccgaaaacgaggatcatttccaaagccatgtatgcttcgggcgagccgattgaacagccatttggctatccggttgcgctgaagccggccaacagtgttgagtggcttgatattcactttgaaggacgcaaaaaggcgtttatcattaagagtgaagcagaatttcgggagattgttgccaagagttatgataacggctatacatccgactttattctccaagacttcatccccggtgacgacagtaatatgcgcactttaaacgtctatgtcgataagaatcatcaagttaaattgatgtgtctgggtcatccactactggaagatccagcgccggcagcgattggcaattatgtcgcaatcattcctgaatttaatcaggaaatctacaacaaagttcaggcgttccttgaaaaaattaatttccacggctatgccaattttgatttgaaatttgaccaccgagacaattcttacaaactgtttgaaatcaatttgcggaccggccggagcagtttctttgtaaccttgaacggccatcatttagctgattgggtgattcaagattacgtcttcgattcactgaaggaccagtcgaccttgtatgccaacaaggacccacgccaatatttcttgtggcttggtgtcacgccaaagatctttgaaaagtatgccaaagacaatgctgccaaaaagcaagccatggaaatgatcaacgaaggccgatatggcgacactttctggtacgccaaggataaaaatatcaaacgttttgcattatataagtggatgatgcacaattatgccaagagctttaagacatactttgtcgaaaaataagggactgatttagttgaaaaatttctttacaattattggtggtatgggcaccgaagcaactgaaaccttcattcatattttaaatgatcggactcaggcgacgaaggatcaggactatctgaactatattttggtcaatcattcgaccgttcccgatcggacagactacattttggatcactcaaagcccaacccattgatcccgctggcagaagacgtcaagcagcagagtgccctacatcccgatttttttgcgattccttgcaatactgctcattacttctatgatgagctccagaaactcacggatgtgccgatcttgcatatgccaaaggaaaccgttgcagccattaaggattatgcgccaaatgccaaacgggtcggtttaatcgcgacagaaggtaccttacatgatcaaatttatgatcatgaaattattaatgccggctatgaattagttaagccaaccgacaagattgccgatcagacgatgaccttaatctatgatgatatcaaggccaaaaacgaggtcgatgagggattgtatcacctgattctttctcaaatggttgaatcgttaaaatgtgacatcgttattttaggctgtactgaactgtcagttgcccagcagcgggcgggtaatcacgattatccagtgatcgacgcccagacggttttggctgataagtgtattgaattggccgaagcaaatcgggcaaaataaatagccaactaacttaatagttgaccaaagtttgtaagcatacggcgattggcgtggcgagcatcaataaccacagcagtttggggctgtagttgacgtcttgctttcggccataagcggtttcggttaatgcaatcactgccagcgtcaccactgtgccaatgataaccagcagtggatgacggtgaaatgaacgaagtgaaatgacgacttggctaatcatgatgagccagtagaagacgcgggcgatcatcatcgaatcgatgacgtgctttttcatggatcgggttaacccccagataaaattgacgaatagaattgcccaacagctgtagttcaatatgatccacattcaaatcacctcttaagttaagtatctgtattttgggacaaaaaagcaatcttttccaaaattctttagagatttcaaatctttatgacaaagataatttaaaatgatataattgtttttgttatgcgggtatagtttagtggtaaaacacaagcttcccaagcttgcgtcgcgggtccgattcccgttacccgcttagtgttggttgtctcagcactggggtgtggtgataaatgttgacatataccgggtcaacaagttattatacacattgaacgttataaatattcaacaataaaagaacagtagctggtcactgaattgtcagcgatttcgggatggtgggagccgaaaaattgagtcagcgaagcgcgctttttagaatatgaatttaatactttgagcggatatttttatcaaatagagtggtaccgcgggtttactcgtctcttacaattattcttgtaagagtttttttgtatatttatagatggagggaacattaatggactacaaagcacaggttacgaactcaattttaagtgttttaaatgacgaattgtcatcagccgaggtttatgagaagctcgaaaagcctaagaccttagcaatgggtgatttggcatttccagccttctcattggctaaagttttccataaagcaccaaatgccattgcgcaagacttagttgagaaaatcgatcaatcctcttatgagaaggttgaagcaaagggcgcctatctgaacttcttcttggataaaggaaacttcagtaatgaaattttgaatgaggttttggaagaaggctcagcctatggtcaaaacgacagtggtaagggtggcaatgtcccaatcgacatgtcatcacctaacattgccaagccaatttcaatgggacacctgcgttcaactgtgatcgggaactcaattgccaagttattggttaaaaacggctatcatccaatcaaagataaccatttaggtgactggggaacccaatttggtaagctgatcgttgcctacaagaagtggggtaacgaagaagacgtcaagaaagatcccatcaacaacctggtgaagtattacgttaagttccataaggaagataaagaacatcctgaattggatgatgaagcccgtgaaactttcaagaagctggaagacggcaatgaagaagaagtctttctctggaagtggttccgtaaagtttccctggaatcatttaacaagatctacgaaaaattaggcgtgacttttgatacctacaacggtgaagccttctataacgataagatggacgaaggaattcaaattctcaaagacaagggcctgctcgtagaatcccaaggtgctcaagtcgttaagctcgataaatataatttgaatccagcccttatcttgaagagtgatggcgccacattgtatattacccgtgatatcgccactgccatttaccgtgatcgaacttacaaaccagccatgaacttatacgttgtgggtgccgaacagacttattacttccagcagttgaaggccgttttacttgaaatgggcttaccatctgccgaaaacctgcatcatattccatttggtctgattacggttaatggtaagaaactgtcaactcgttccggccggatcatcttgttggatgaagtgctggatgatgcaattgacttagccaagaagcaaatcgaagcgaagaaccctgatttgcctaacaaggatgaagttgccaaagaagtcggtgttggcgcaattatcttcggtgatttgaagaatgagcgaactaacaacattgactttgtgcttgaagaccaacttcgatttgaaggcgaaaccggtccttacgttcaatattcacacgcccgtgccgaaagtattttgagaaaagccggggacattgatcttcatggtgccaacaagcagcttgatgatccagcagcttgggaaacggtcactgcattgaaggacttcccagacgttgttaagagtgcctgcaaggactttgagccatcagaaattgccaagtatgccttgagacttgctaaatcctttaacaagtattatgcgcactcaaagattttggtggaagatgatcaattggcagctcgtttgtcactggtcaaggcggtttcaattgttctcaaagaatcattgaacttattgggcgtcaaagcaccggacgcaatgtaatctaattgtatttgaaaccaaggctctctaccaaccaggtagagggtctttttgtttcgaaaaatttcagattgatcaatagcttgtggcgggcgctcttttttaaatcctcgttaaatttttccaccctgaatttcgccacttttcagatatgatacaatattgaggtattcacaaaaggagtatcgcatgaataagaattctaccaactcatttagaaaatcggtcgggacctttttgaaacgtttcaaccgattttgtcgaagattccacttggttaagtggcttgtggtcatttttctgagtatttcacttgtgaccagcacctacttggtgttccttgccaaaaccgcccacgtccagaacttggaatcctcgctctcaaagacaactgaaatttttgacgttaataataaaaaagccggcgaattatacgctcaaaaggggacttatgttcatttaaatcaagtctcggcaaacattccaaaggccgtgctatccaccgaagaccgtaacttttatcatgaatacggtttctcgttcaagggaatcgcccgggccatgtttttactggttaagaacaagctgcttcatcgcaactatattagtggtggtggaagtactttaacccaacaactggtcaagaatgcttacctgtctcaagagcagacgatgactcgaaaactgaaagaattattcctctcaattcaagtcgaaaatgtatactcgaagaacgaaatcctgaccatgtacctgaacaatgcctactttggtaacggcgtttggggggttcaggatgctgccagaaaatattttggtgaaaatgctgtcaatttatctgtacctgactctgccgttttggcggggatgctgacatcgccaagtgcctttaacccgattgatcatccaaaggccgccaagtggcgacgaaacgttgttttacagctgatggttgaaaataataagctgacccaggcgcaagcaaattactacaagaaaacgccaatcacactgcgggatacctatgttcgaaaagacggttacaagtatccatattactttgatgccgtcattgatgaagccatcagcaagtatgggatgacggaatctgagatcatgaaccggggttatcggatttacaccaatttgaatcaggctcagcagcaggcgatgcagaacaactttaataacaatgccatgtttccggccaatgcggctgatggcaccgaagttcaagcggcatcaattggggtttcaccgaccacaggtggcgtgactgccgttgtcggtgggcgtggtaagcacgtctttcggggttacaaccgggccactcagattacccgtcaacctggatcgacaatgaaaccgttggctgtctacacgccggcccttgaagccggctataagttcgactcggaactggttgataagaagaaatcttatggcaccaatcattacacaccaaaaaactataacaatgtttatcaaggaaaagtgccgatgtacgaagccttagcgcaaagtatgaacgcgccggcggtttggctgctgaatcagatcggcgtcaatcgcggttatcaatcagtcaaagactttaacattccggtcactaagaaggacaagaatctggcgctcgctttgggcggaatgtccggcggcgtttcgcctcaacaaatggccggagcttatacggcctttgccaacggcggtaagattgttaaaccattttatattcgtaagattgttgattctacgggtaaagtggtggtcgataacacggccaagcaggaaggccgtcaaattatgtccagttcggttgccaaacagatgaccagcatgatgcttggggtatttaacaatggaaccggtgctgacgccaagccgtatgggtatcaggttgcgggtaagaccggaagtaccgaagccgataataccggctctgctgacgccacaaaagataaatggatcatcggctatacgccagatttggtggtggcgacttgggaaggatttgataataccagtcaggcccaccatttggaaaacttgagtgggactggtgtcgggccactgttcaaaaacgaaatgcagacaatgttaccatataccaagaattccagctttaacaccaaggatgcccaatccatcgttcaaggtgaaagcagcaatgacaatctttgggataccattcaaaagaaaacgaatcaatatggtaatcaaatcgaacaaaaagccaaagatttgattgatgatgccaaaagctggttcaaacactaactttggcaggaagccatttcagtaatgtgttagaattaagtaaataaaattgttaggggaccctatttaatgaatgaaaaaatgaccgcaacaaccaaccagcttcaagccgaattgattgcatccgatgaatttacagagatcaaagctgcctatgacgcactcaagaagagtttggatgactacaaattattcaatgactttcaagatgctcaacagaatcttcagcaaaagcaaatgcagggcgttcaaccaacccaagatgagattcaaaatatccaggcgattgctgggaaaatgcgcgagagtcaattaatttccgcattaatgaccaaagaaaaggcactgagccagttattatcagatattaatgagaccgtgacaaaaccaatcagcgacttgtacaaatcataagcagatcaagcacgtgacaaaaggggccgagacaaaaagtgtgtgcacttttgcctcggcctttcctttatacataagttgaagaagggacctatcatgaaatttattcacacagcagatttacatctggacagcccgttcttgggactcaaaagtcatgttttacccaatgagctctgggagaaagttcatcaatcaacttttgattcctttcaaagaattatcgatgacgcaattgagcagcaagtggactttgttttgctggccggtgacttatttgaccgagaagaacgaagtgtggccgccgacgcgttcctagttgctcagcttaatcgattgaacgaacatggaattgaagcctttatcagctttggcaaccatgattactctacggcagatccggcttcatttggctacccggcgaatacactggtttttggcaaccaggttgaaaccaagcagtataccttaaatgatggggaagttgtggccgtcagcggctttagctttgataagcagtggattacccaacccatgattcaagactacccaacggccgttagtgatgttaattggaacattggcatgttacacggaagcttaagttcactcaattctccggaggccaattacgcaccattcacactgtctgaacttgaggaaaaaggttatgactattgggcattaggacacattcataagcgccagtcgttaaatgagcagcaaaccatcaattattccgggaacacccaaggccgccatattaatgaatcgggtgagaaaggatatttgctggttcaaagtgacgatcagcaccttcaaaccaaatttgtgccaaccgcaccgatcgtttgggaccgggtcgccatttctcttgataaaatgtctgcagaccagatcgttgaatcaattttagaaaaaattgctaatctgcactacgacaaattacatttcattcggatccagttggccagccaaacggcgattgatgccgacttactggccaaaattaataatggtgatctcttggatgacctgcaggacattaatgccgacaagtggcagcagctcaactgctggattacttcaattgaagccccacaagtaaaaagtctggtctatagcagtattgatcaggattattttaatcaagccaaggcggcaaccttgaatgacgaagtttttgatcaaattctcaaggactttaataagcagccaactttcatcaaggacgaagtcggatctgaagaatccaaacaggagatctttgatcaagccggggcgattcttcaggaaaatgtcgttcatgaagatactgaggaggataaatccaagtgataatcaaacaactcaacatttatggttttggccgctggattgatcaaaaaattgatatcaaaaatccacttcagatgatttatggtcctaacgaagccggcaagagtaccatcatcgcgtttatcaaagggatcctgtttggattcactgataaaaagcattccatccacggtcagtaccagcccaagggcagtgccccatatggtggtgaaattattttttcagctgatcaacataactataaggttgtccgaactggtttaaaatacggcgggacggtaaaattctacgatttggataacgatactgagcttaccgctgatgactaccagcagctcattgcgccaattgaccgaaccgcttatgaccaactgttttactttggcagcgttgatcagacggccttctacaaaataggtcgagacgaattacgactgcgaatccaatcacttggtgtcgccggggcaggcgattggatggacctccagaccaatttggataagcagtcggcaaaaatgtatgcgccccgcggtcgtacaaaaaagattaatattcagattgcggaatataaaaaactcgaagatcaggttagcgctgccaaggcccacttcccacactaccaggatctgcaggttcaattaaagcaggaccaggcgaaatcaaaggacctccaagctgatttaaaaactgctaatcaccagttggataacaaacgccgactgcagacggtcatgccgctggttaacaggctaaacgatctcaacacggtcgattcatctcagttgaagccacaattcggtgatgctgatctcaacgagtttaataaattaaacatggcactgacagctgaaagcgcggatgttcaaaaggctgaaacggccgtcgctgaagtggcccgccagtcatccagaaaaccggttcaaaccttctatgaggctcatagcgacacgatcgaacggttataccaagagctgccagccgccagaaaggttgctttggcaatcgaattgggcgattctcagctgcaggacgttcaacgacaaatccagacccagtctgcctcaattgcgaaaaatgaacagggaaatctaccacaagcatttgacgatcagaccttttctcgggtgaacgaactgctgcgggagcaacagaatctccaagagaaacgggcggaggtaactcgaaagaaaacccagtctgccgaacagcctcatggtaatggtgggctaatctggtatggtgtggcagccgctctggtggtattagggttcttattaggctctagttcgtttggatggattggatatattctggcggtggtcgcggccctttggggatggtacagtgccaaagggagttcaaagtcccagccaacctcaagcccaagtcatgaagacccagttgagatcgatcagaaacttgagcaaatccgaacagagttgacggctgttcaaaagcaatttgggctccagggaattgatgaagccaaatggctgccgatgcaaagttcgcttcgagaaattcagcgcctgcaacagagttatcaacagcaaaaaacagcactcaatgaacagcaggctaagtaccaggattaccttgaccaatggcaatttgccagtgattggctgaagtttgatcaaacaaagtattcgaccgccattgaaaccatcggcaagaccgttgctcattggcagcagttgtctaccgattatcagcaccaacaagcagtactcactcaggagaagaagacactggctgccgcaaaagccaagctggtcgaactgacccagcaaaaacaaaccttcttgaaggatcgacatgttgaaaacgacgaagcatttcaaaaaggtgttgcctttcaggccgaactggccaagcaactggatcaaaaggccacgcttgaaagtcaaattaaggccgccaaaatttcaattcctgaaaatattgaccaagatgccttgaacaccgacgttcgtgaagctaccgaaaaagtgcagtccttacaagatcaactgaatgatttgagccgggaaatgacccgggttcagactgaaattgccggtttaatcaagaatggccaatactacgatttgcggcaggagctggccaatcaacaaactgaaattgttgagaatgttcagaagtacctggctttgaagctcagttcccagtggatccaggcggtgttggacattgccagcaagggtcgactgcccaagacactggcattagcaaagcaatatttcgccactttgacgaatgatgcctacaaggagattatttttaaaaaagaaatttctgtcgttcgaaaagatgatgtctcctttccaatcaacgaattgtcaaccgggacgttggaacagctttatttagcactgatcttttcgatggcggttggcttcagcagtcaatatccaatgccaattatcattgacgatggctttgtgaactttgaccagcgtcgaaaagcggcagctctggcaatgctgcaacaggtgagtgagaagactcaagtgctttacttcaccgccaatctcgatgcaaatactgattccaagctcgtcttagatcttaaaacgctttaggaggcgattttatggcaaaacaattgatggatatcaagttggatgaagaatttgagatgtatgtcttactaaaagacgcctccaagcgggtggctaaaaatggtaagccatttctgtcgttggtctttcaagatcagtccggccaaatctcaggcaaatactgggatgcctcgccaacagatgtggagcagtttgtttcaggcaaagtcgttctgctgaaaggtaagcgggagaactatatgaattctccccaaatcaagattctggcaatgcggctggccaaccaaagtgagccccacgatccggttaattttgtcaaacgggcggggatgtctcgcgatcagatggaagaatacattgaccaaaccatctttgagattaccaacgcaacctataatcgaatcgtccgcagtttgatttccaagcacgccaacgcgttttatacctttccagccgcaaaatccaatcaccatgattttgccggggggctagcttttcacaccatttcaattctcaaactggcccattcgatcgtgaatcagtatgagggcattaatgccccattattgtacgcaggggccattttacatgatctgggtaaaaccattgagctgtccggtccaattgccacagagtacaccttagcagggaatctgttaggacatctcagcattatggatgccgagatcgttgaagcggctgacaagttgggaattgatcccaaatcccaggatctgattttactgcggcatatgattctgtcgcaccacggattactggagtatggttcaccggaacggccgaagatattggaggcagaaattctgcatcatttggatgagttagatgcgacgattatgatgattcaaagcgccactaagaatgtcgaacccggccaattcagtgatcgggtctttggattggataatcgacgattctacaaacctgagaaatcagttgaccccaaacaaaaaccgacccaaggggaattgttataattgacgggatacaaaaaggattggacaattaattgtccaatccttttttgtatgaatgatttaaaaattacttcttagctgatgagctggttgaaaggtagtctgataagacgttttgcaggtctttatcttggatggtaactttacccttcttaagaaccttagaaacaactgaatgtaaggtattgctatcagacatcttgctggtaacgatttgatcctttaattcagattcgtgttgcttccaagttccctttgatggatggttgaccatttggattacttggtaaccatactgagtcttaacaggggtcttggtatattcaccgttcttcagcttgaaggcagctttcttgaagttggcatcaagtgacgtgttggtgttgtcgaatgctgcgattcggccgcccttgttcttagttgctgtatcagttgaatactttttagctaagcttgagaagctcttaccgtctttaagttcactgataactttttcagcagttgatttctttgaaaccaagatttggttaacagttacttttggttggtaagacttgaattgagtttcaagttgtgcgtcggtaatcttgacgttgtccttaacggcttgcttcaataagagattggaacgaattgaatctttcaattgtgaagcagtcataccgttttgttggagaactgagttgaatgatgaaccgtattgcttcttgtatttagcgaattcactattaacttgagagtccttaacatctttaccgtattgcttttccaagaccttgttcaagatcatttgctgcaatacttgtttaccgcttgaagtactcttcaaactgctgtaataagcactttcagtaatcttaccaccgttggttgttgcaacagttttgctgccacaagctgcaagggtaaaactcatcataatgccggctaaaacgattagccattttttcatacaaaaacacatccattcctaaaagtattcgtctgcaaagcaaacgttcccgataataataacataatctgcgtcgtttatataatgacctcaagaatttaaacaaatattcatattttacttactttaatttgtcggtatacttgttgatttcgtcaagccgtggctgaattttgaacatcgcttcatccacatcccgtgagatgtcgttaatggtcttctcaaggaccggcatctgcgctgtgaaagcattcatcgacttcttaaagtcatcataagcgcttttccagtcagcggccttttgctttcgatcatcaaaggtcgacttggcccgctcaacgaactcttggggagtttcttttcggctgtataaataaactccggcgacaacggcagttgcaccaacaattttaaaaacggttttcatgattaatcacccatatgttgttcaatggattcttgaatcgcctttaactgttccggtgaatatttgttggagttatccttgaagatcatcttaaagtcgtcgttactggtatatcgggggaccaggtggaagtgtgaatgaaagacggactgataagcgacttggccgttattatttaaaatgttcatgcctttgatgtcgggatttgaagctttgactgcccgagcaatctttgggattctggcaaaaacttcactggctaattcttcatcatattcaaagatattggcgatgtgcttctttggaatcaccagcgtatgtccaggagtcccttgagaaatatccaggaatgctttgacaatgtcgtcctcatacacggtgtagctggggatctcatttcttacgattttacaaaaaatacaatctttcaaaatttctaccttctttctgtgaatactaatgatattataccattattgcgtttttggcccagctcaaaggctaattttgtatggtataatcttgtttgtacatttatcatgatacggaggtaaacaatgaccttacaagtttcgaatctggttgggggctattcccaagtaccagtgttaaaggacgtcaattttgacgttaaggatggcgagttggttgggttgatcggcttaaacggtgccggcaagtcaacgaccatcaatcatattatcggtttattaacgccatttaaaggctcaatcaaaatcaacggcgtcggcttaaacgatgacgtgaaacaatataaagagcagattgcttatattcccgagcagccaattgtctacaaggaattgacgctaaaggagcatttggaaatgaccatgctggcctatggacttgatcaagacgaatcctggaaacgggcacatgacctgctcaaacttttccggctggataataaattagactggttcccggacaacttttcaaaagggatgcgccaaaaggtgatgattgtctgtgcctttttgactaacgccaaactctttattattgacgagccgtttcttggcttggatccactggccgtaaacgacttattgaacctgatctctgaaagaaagcaacagggagccagcattttgatgtcgactcacgtgctggataccgcgcaacgttattgtgatcggttcgttttacttcatgacggtcaagttcgcaccgaaggaacgattgaagagctgcggaaattattcccagatgccggcgattctctcaatgatatttacctgactctggcaagggaaggcgatgcctcatgaagcagttattcaggcagcgtttaacgacgcatctaaaggaaatgatgcgctatctcagattggtttttaacgactactttgtcttggctttgttgtttgtcattggtggcttgggatactattattccaatgcgcttaagcagctgcacaccggtctgtggtgggcaccaattgtgattatcggtattttgttggttagcgttcagctgggcaggtttgcgaccttgattgaagccccagactatgtttttttgttgcccaaagaatctgaactttataactatcttcgaagcggctttcggtatagtctttcgattgctgtcgcaatacaagtcctgttttggatcttgttgatgccgtttgttcaagttaccatgcgcgccacatcgacggagttgtatctgcttttggcaaccattttaatcttgaaaataacgtggctaaataccgactttgcccgtaaataccatttgcagcaatcctggttggccagtcggctcatctttcgattgctgctcccagtgattgcattggggtcgtctatctacatcaactattggcttgggttgggcattgctgtggctgcgcttttcgtcagttatttttcccgccggaattgggtcagccgatcacttgactggacgacgatgattaccgatgaaaacagtcggatgcacaccgtctatcaattctttaatttatttacggatgtgccaactctgcaaggttctgtcaaacggcgccgttacgtggacgggatcttgagccgaatcaagctgattccaaaaaacacctacttatatctctacgctcacggaattgtccgtgacaatgagatgagtgggctatacgttcgtctgctggtgatcggaaccttatttctggtattcgtcaagggcgagctgttacccatctttttgagcctgctgtttgtctacctaattgggttccaaatgattccgttttattttcatttctcggataacgccttcgtgcacatttatccaattaccaatcagtaccaattgaagagttttcaaagggttctgctgtacttgttgagtacggttggcgttgtttttgccgtggcagttctcgctgttaatttggccacgccggtcacgatcatcggcgtgattgtcggcgaagcactcgaaatctgggcatttgtctatctgtatttacccagacgtttggctcgaagcgagcgaaccagataaattgttgaataataggagaatgatatgcgcgtaagaaaaaagccgtgggctgataaatatatcaaaaaccacggcgactatattgtgaccgatccaaagaattggttgggtaaatggcaggaccggtttgccaaagtccaacccttaaacgttgaggtcgggattggtaagggccggtttattatcgagaccgctcgagccaaccccgacatcaactatattggcattgaactgcagacttcggtcattgccacagcactgcggtcgtttatggcggatccattgccaaacgtgcagtttgttctgactgatggcgccaatcttgatgaattgttttatgaaaatgaaattaaaaagattttcttgaacttctccgatccttggccaaaaaagcggcatgccaaacgtcgtttgacatcaccactatttttgaagacttataatcacgtgctggaccaggatggggatatcgaattcaaaactgataatcgcggcttattcgaatacaccttggtcaccatgaataatttcccgatgaagttcgattatgtttcgttggatttacaccattctcctgaaaatgaatcgaatattgaaacggaatatgagcaaaagttcagtcccaagggacccatttataagctgattgcgcattttacagcgtcatgacttgatgcttaaccacttgctgtgaggtttggtcgacccagaattcttctgttttgcgatcaccttcagggttcaaataattgaagccaaagtgaaaaagcggcgtggagtcagtggtcggtagaatgctccaactgccaatatatttgaagccttttaatgcggctgattgtttggtatccttgacgatagctgctaaaaacttttcgtgtttgcgatcggacttggccacgatataggcactgccggcaagcgctgcgagtgccaggccatagaagacggtttgttttttcatcatttcaccttttttgtatatgatatgtatactttagactattagcagcggatgagcaaactgatttggctgggcggaaatttgtgctatgatgtactttacattagtaagtgaaaggatgataattttgcaaaatttacctaaaaccaatttaaaagatttaaccaaacaacttgagaacggcaagtatatgctgttcttcaccgctgactggtgcccggactgccgcttcatcaagccggcaatgcctgcaattgaagccgaatatccagagtacacattcttacaggttgatcgtgatgaaaatatcgatcttgccggtgaaatgggcattatgggcattccaagttttgttgcctattcagacggtcaagaaatcggccgcttcaataatggcgaccgcaagactaaagccgaagttgaaaactttattaactcgttagcaagtaccgtagcaaaataattaattgttggaaggaattttgaaatgttaataaccagttataacccaaacagcacaggtgacacaatggtcctcattatgaacccggatgtgggtgaacaaagtgtgacaattcatgataaggttgcccggatttttgccgctgatagcaatcagacgttggggtacaactttttagaagcaagtaaagtccttccagaaattgtccatgaaaatggccaagttcatttaaccgaagaccaggttactcgcttgaaccaatatttgggcgatcacggttttccggcagatatccgttatgataatcagcccaagtttgttgtcggctatgtcaaatcagtggaagaccaccccaaggcaaatcatttacagattaccaaaactgatattggcaccggtaaggacgtccaaattgtcagcggctcgccgaacatgcgcgaagacattaaagtggttgttgcgttaagtggggctatgatgcctgacggccagattatttggcccggtaaattgcgtggtgttgaaagcgatggcatgatttgttccggccgcgagttggggttgcccaacgcaccgcaagtccccggggcactgattttacctgatgattatcaggtaggggatgcctttgattttgacaagacacagcatttatttgattaaaggactttgggtggatgagtaatgaagcattatgatggacccgcattttttcggcggaagggcattacccgaaagcctcatcaagagcgggaaataaaacagaataatcagccggtggcaccgaaaatccaagatacacgatcaagcaaggtccctgattccaagtttgatcgtcgggatgagaccccggcttttttgaaagaaattaaaaatttcaaaccgcaaaagcggtcaaaatccgataaacggaaacagcaaattcaaacgaattattttctcagccaggcgcatcgtcgtcaccgtctgtacgatgaattgacacgccggctgaggattacatatgatgatctcattgtgattgccgataagcaaccaacaattgatcagcctcgtgagcagcatccaaagcaacccgttcaatcaccaaaacccgccaagccgactgaaggccaacctcagacatcacctcaaaaatcatctttgacagatcaaccaaagatcagctcaggagaaggggtacggcatttaaatcgtcaaccacggaaggctttgaatcaccatgggttgggacagtcattcaattcaattatgcataaccaaagggccagcgaatctgacctttctttgtttaacgctcaacaactgagtcacaatgcccaggttaaaaaagtgaatcacgttaatcaacccacgaagggtgttcaacattcattggctgaaccaaacgtctcagagaagccgactgaagacaggggttaccaatttccgccgctgtctttattagccaagcctcagcaagccgaatcagaatcgattgatgactggattattcaccaatctgaaatcctgaatcaaactttctcagccttcaaggtcaatgcccaagtggttgactggacaaatggcccaacggtcacgcaatttcaagtcaaattggcactgggcgtcaaagtcagccggattaccaacttaaccgatgacttaaagctggccttggcagccaaggatattcgaattgaagcgccaattcctggtaaaacgacagtcggaattgaaattcctaatcccaatccgagaccggtggtcctttcagaagtgatttcaaccaagcattttcaagatagtcaatcgccactcaccactgccttgggtgttgatttgtcaggagttcccagaacgacagacattaaaaagatgcctcatgggttgattgctggggcaactggatccggcaaaagtgttttcatcaacagtttgttggtttctttgctgtacaaagcgaccccggcggatttacgattactgttaatcgatccaaaggcagttgaactggcaccttatgacgggattcctcacttgttatcacctgttatttccgatcctaagacggccgcagcttcccttaaatgggtcactgaggaaatggatcagcgttatgaaaagctcgcagctgctggtgctaaaaatattgaacagttcaatcgacaggcaagtgaggctcacgagtatgggctgaaaatgccttatattctggtgatcattgatgaattggctgacctgatgatggtcgcttccagtgaagtcgaagattacattgtccgcatcactcaaaaagcccgcgcagccggcatccatttgattgttgccacgcagcgtccaagtgttgatattgtgaccgggaccatcaagaataacattccgactcggattgctttcatggtatccagccaagtcgattccagaacgattttggattcggccggagcagaacgtttacttggccgcggagatatgctatatctagggagtggtgcaaatcagccggtccgactccaaggtgcttttgtcaccaatcaggagcttgacggcattgttgattatgtccgccaacagggagaacctaaatacttatttactcctgatagcttgaaacgagctagtactgaaaccagctccgaggatcgtttgatgccccaggttttaaaatatattggcaatgaagagacaatttccacttcaaagcttcaacgggtattttcaatcgggtataatagagctgcaaacattattgatcatttgcaggaaaagaacttggtttcagagcagcaggggtccaagccgcggacagtgtattacaagccggcagcagatgaatccgctcgggaatcaccgcaaaatcatcaaaaataacataatggataggtaggatgtctaatgaattcagatacggtatatcattttgtaggaattaaaggaaccgggatggccgccatggccttaatcttgcatgaccgtggtgagaaagtgcaggggtcagacattgaccagtacacgtttacacaacgtgggcttgaaaaggctggtattaaaattttacctttcgatgaaaacaacattcacgaaggattgacggtaattgccggtaactcctttactgatgatcatccagaaataaaaaaagccagagacatgggattgacggtttaccgttatcacgagtttcttggcaaaatcatcaagggtaagaccagcatcggggtttccggtgcccatgggaagaccagtacgactggcctgttagcccacgtgctttcaggaattgcaccaaccgattatttaatcggtgatggttctgggaaaggtgttcccaatgcccggttctttgtctacgaagctgacgaataccgtcgtcactttttggcaactgaacctgattatgccattatgaccaacattgactttgatcatccggattactacaagagtatcgatgatgttgccgatgcatttcaaacgtttgcgaaccagacgaagaagggcatctttgcttggggtgatgataaacgtctccgtcaactaaaagccaaggtaccaatttattattatggcctcaaggatactgatgatttccaggcggttgatgttaaacggacgaccagtggttcgagctttgatgtcacttataaaggtaaaaatctgggaaacttttcagtaccgttgtttggtgagcataacattttcaactcattggctgtgattgctgtggcttactttgaagatgttgatttggatgaaattcgcaaagaattgaagactttccaaggcgttaagcgtcggttcgccgaacgtaagattgccgggatgacgatcattgacgattatgcccatcatccaactgaaattaaggcaaccatcgatgctgcccgtcaggaatatccaagcaaaaagattgccgtggtatttcagccgcatactttcagccgaacgatcgctttgatggatgattttgccaagagcttgaacttggccgatgaagttttcctgacctcgatttacagttcgccgcgagaaagtcacggaaaagtttccagtgaggacctgtcaaagaagatcaccaagggtgggcgcatcttgtccgttgacaatatgtcgccactattggactacgataacgacgtggtcatctttatgggtgccggcgacattcaaaagtatgaaaaatcttacgaagatctgctaagccatttaagcaaaaaaattaattaagatatcttataaaagccgttagttgagtcctaaatacttgattaatggcttttatttggtagaattacttaacagtataagtataaatactgcaaattgtttgaggcaatatttgaacttacaaacaaaagggagcggatttaatgaacaattatccaaacgaacaacaggaagctcgacgagtcgttaacaacgcagccgggttgaatgcttttttaactaaaatgtatggctggatgagtttggccgttttagtttctgctgcaacagcatttttagttagtgggtctgttgctggtggaatggcggcttacattgcaggtcaccaaggtgtgatgtggggatcaatgattttatggtttgttttgccatttgtcatctcacttcaagcattgaaacggccgaccctcgcgtttacagtactgatgttgtattcaattctaagtggttttgttttcgccacgattgcgtgggcgtatacaggtgcctcaattgcggcagcttttgtttccgcttcggcaatttttatcacaatgacaaccgttggattggttacccacaagaaccttgatcgttggggtgcccaagcaactgctgctttaattgcgttaatcattgccatgattattaacatcttcttgcgtagttcagtgatttcatttgttttctcgatcatcgcagtgttaatcttcacggtcttaaccgcctatgacacccaaaagatgaagcagatgtataaccaatattctggtaatggtgaagtttccatgaccggtttggcagtctttggtgccttacaattgtacttggactttgtgaacctgtttctccaattactctcgatttttggtaacaacgaccgttaattcagatttcgtcacaacgattggccattgatttggttgatcgttttttgttatctgtcgtggtaaaattaaagtaacagttttcaccagaggagaagttaatgactaaaaaattattattaattgatggtaatagtattgccatcaaagcgttttatgctttatacacggccatggacaaatttaccaatccatctggcctacataccagcgccatctatggctttaaccggatgctggacaaagtattagcagacgagaagcccaccgatgtgctggtcgcatttgacgccggcaaaaccacttttcgaacgaaaatgtacgctgattataagggtggtcgggcaaagacaccaactgaactttccgagcaatttcccttcttaaaagaattaattaatgcccgtggcatctccacctatgaattaccggattatgaggccgatgatattattggaacgctcgccaaaaaggctgaagaagctggtgactaccaagttgtgattgtcactggcgatcgagatttgacccagttaacttcagataagaccacggttcaggtttctaaaaagggcgtcaccgaactggaaacatatacccccaaacacgtcgaagaaaagttgggtgttaaaccgagccagattattgaaattaagggtctgaaaggtgacaactccgacaactatcccggcgttgaaaaagtcggtgacaagacagctgtcaggctggttcaacaatttggcacgattgacaatctctatcaaaatatcgaccaggtttccggtaaaaaattaaaggaacatttgattcatgaccaagcccaggccgagcgcgcccacacgttggcaacaatcaaccgcgacgcgccggtaacagtctctttggatcagttgaagtatcagggagacaatatcgataaactgaccgatttttacgagcgaatgggcttcaaatcgtttctggccaagttatcagttgatgatcaggatcatgccgatgatcaggcagatattcaatacactgtcttgtccgccaagaatgcggctgagctggatcagttcacagatgaagtgacttttcacctggaaatgtcagaagaaaactaccacacatcgccgttggttggctttgcgattggacagggtgacaaatggtatgtgaccaacgatcctgaattgcttcacaatcagcatgtcattgaccttttgaccagcaagactatcaaaaagaatgtctttgatgccaaacgaacctatgtcggtctttatcgacaagggattgagcttgccaacgtggacttcgatatgctgctggtatcatatttgcttaatacaactaataatagcaacgacgtcggcaccgttgcccatttacacggattctataatgttaaaaccgatgaagaagtctatggaaagggtgccaagcgacacattgacccgcaatcacctgcctttttggcccatttggttcataaggtcaaagcgattgatgctcttcacgacgggatgtttaaggatctggatgcccataatcaatccaaactgtactgggatatcgaaatcaagattgcctttgtccttgcccacatggaaatcaatggcatcaaagttgatgcagccactttggagggcatgggcagtaaatttaaagagcggctggctgaaattgaacagaccattttccaagaagctggtgaagaatttaacattggttctcccaaacaactgggaaagattctgtttgaaaagctccgcctgccgattctaaagaagaccaaaaccggttattcgacctcagttgacgtgttggagaaattggctccggatgcgccaattgttcaaaacgtgttggactaccgccagatttccaaactacagtcgacatatgttgatgggctattaaaggtcattcatccagatgattccaaagttcacaccagatatctgcagacgttaactcagactggtcgattgtcttcagtcgatcccaatctgcagaatatcccggttcgctccgaggaaggccgacttattcgccaggcgttcattccatcacatcccggttggcagattttctcctctgattattctcaaattgaactgcgggtgttggcgtcaattaccgacgaccaaaatatgcaggacgcctttaaaaacggcgaggatattcatgccaccacggcacggagaatttttgggctgccgtcaaatgaagaagtcaccccggaacttcggcgtcaggccaaggcagttaactttgggattgtttatgggattagcgattttggtttagcgtccaataccggcattaccagaaaacaggcgcatcagtttattgaacgttattttgaagaatatcccggagttaaaaaatataccgaagacatcgttgaatttgcccgtaaccaccgctacgttgagacgattgcccatcgacgccgttatttgccggatattaattccaagagctttaatctgcgttcattcgctgaacggactgccatgaacacaccaatccaaggcagtgcggccgatatcatcaaaattgcgatgattaatatggccgatgcaatcaaggatatgaaaacccgcatgctgctgcaggttcacgatgaattaatttttgaagttcctgacgaggaattggacaccgtcaaacaactgattccaagcgtcatggattcagcgatccacttgaatgtgccattaaaagttgaaagccactggggtaagacctggtatgatgcaaaataagttgaagcaaatgggggatctcaatgcctgaattacctgaagttgagaccgttagacgcggcctgacccaattggttaaaggaagcaccatccaatcggttgatgtgttgtatgccaaaatgattaatttaccaccaaacgatttcaaaaaagccctccgtggcaaaacgattgaaaaaattgatcgacgtggtaaatacctgctgattcgattgagtgacaacctaacgattgtttctcatttaagaatggaaggcaagtacgatgtggagcccgaagatgcaccggtcggtaagcatacccatatcatttttcatctgaccgatgggcgtcagttgcgttacaatgatacgcgaaaatttggccgaatgaatttggttgataccggcactgaaatgcaggttgccggtttgaaaacgattggaccggagcccaccgaagataatttgaccgtcgattacatgcagaaaatttttagcaagagccgtaaagtgatcaaaccatttttactagaccagagtaatattgccgggttgggtaatatttacgccgatgaggtcttatggctaagcaaaattaatcctcaacagcctgccaacacgttgacgttgagacaaattaaagagttgcgaaaaaatattattgccgaattagccaaggcgatcgccggtcatggaacgaccgtccactcatattcaactgcatatggggaagctggcagttttcaaaatcaattgaatgtttatggtcgtgaaggcgaaccctgcccgagatgcggcacaaagattgttaaaatcaagttggctcagcggggcacccacttttgcccaaaatgccaacctttgcgtggtgtaaaaaatgactaaattaattggcttaaccggcgggattgccaccggaaaatcagtggtcagcgattaccttcatcagcaggagattcctgtgattgacgctgacatcgtgacccatcaagttgaacaaaccgggactcctgggctccaagcactggtggacgcatttggacagcggattttgctggctgacggcgcacttgaccgccaggcaatcggccggattgtgtttaacaatccagctgatctcaaacaactggttcgaatcattgacccattcattcgcgaagagattttttctcagttgaaacgttatcgggatgctgaattgaccgtcttggacgcaccaactttatttgaaaatggctatgtccatctggtcgacgaggtggtggtggtttactgtgatccggtcactcagttgcagagattgatgaaacgcaataaactgagtattgtaagtgcgactaaaagaatcagaaatcaatggccattgcagacaaaatgcgatttggctgatacaattatttataactcaggaacaatgacaacgacgctgacacaagtcgacagatggttggcgaaggaaacgaaatagacgaggtgaacaccatgcaatgtcctcattgcggatacaatggttccaaggttgtcgacagtcggccaactgatgacggtcgggtgatcagacgaagaagagaatgtgaacactgcggttttcgatttaccacatttgagcgggtcgaagtaacccctttattagtggtgaagaaaaatggtaaccgcgaagaatttaatcgtgaaaaactgttaaaggggatcgtcaggtccgctgaaaaacggccagtttccatggatgccattaccaatttggtggaccgggttgaaaataaattgcggtcactgggcgagaatgaagtttccagccaacaaattggtgaatacgtcatggaagatttggccaatttggatgaaattgcctatatccggtttgccagtgtttaccgtcagttcaaggatatgtcggtcttttataaagagcttaaggaaattatggaaaaggataagaaaaagggtcaggatcactcgggggacaaataatggcagagtcgttcgataaattaacacccgatacaaaatatctcacgaccaatgcccacattaatcggagcctcgatcacagtgttttaaccaacttgtatctaccaatcattggtgaaaaagcattgggattatacaatttgttgtggtcgatgagcttaaatgatcacaatcagttggttttgcataagcattacgaaattcagagcatgttaaattgcaaaattgatcagctggtggcgattcgaaagcaattggaaggcgttaaactgatcaatactttggtttcccaaaacaaaccggatgtcttgatctactcgttgaatctgccgctaactgctgaacagtttttacgaaccgatattttgtcgattattttattgggcaaagtgggcgaaacaacctacaagcagattgtcgaccgactggtgctgccacttccggatctcggggagacgaccaatatttcggcttcactgctggatttatttgctgtaccccagaacctgattaaaaacattccaggcgcagtcaatgacgccaagcagaccattgttcgatccgctgcaaatgtcagtgagaacagtttcgaaccggatagtcgccaatttaacttcaagctcttattaagcatgttggaaaattcatacgtcgatcttaattctgttaaggccgctcgtgatttgattttgtcagagaatttgctctatggaattgatgagatccaaatggctaaactcattcaaaaggcgactaatctcagcaccaatgaattgaatcaatcacagttgaaggcaattattactgataatttcagccggcatcaagcagagaacgtggagaaagcagcatctactgctgagatcacgccttcttccgcaaaattcgacacggcaaccaatcaactgatttcaattagtaaaaagacggctccagtcgtgtttttggaacaaatcaagaaacaaaagcacggtattgtgaccagcggtgagcagcgaaccttgcgcgagcttgtcaacctgcgcgtgttgccgaatgaagtcatcaatattttgatttactatttattagttgatgaaaatcgttcgactctcaataaaaacttgatgtcaacgattgccgatgattggtcacaacacgggatttttgatgccgagcatgcaatcgatgccattaagaatcgaacaatcgacaaacagaaaaaggctgatcagtgggctgccaagtacaaacagcggcgggttaatgtcaaagagaccctgccggattgggcgaaggatgatcagccttcctctgccagccagccgacctcacagttgactgaggcccaaaagaagcagctcaaagcacagcttgataagttaaaaaagccggggagtaggtgagattgaatggaaaaagtaagtgatttcgtcaagaaactaatggaagaccgtcaatttaagggtggcaatgtcgcatcaggtttccaaaaaattattgaacagatcaaaaatgaccctgagatcgccaaatttcttcaggatcatcaaggtgaactggctcctgatgcggttgaccgttctgctgccaaattgtatgagtatgtgaatgtcaaaaatcagattaaggccaagaaacaatcatttgcacctgggtatttgccccaattggtcattaacgatcatttgattgatattgcgtattcagcctctccagaggtgatcgaaaaacagcgcagtcagtccttggcacgtcgaattaagacggtttcaatgcctaaagatatcaaggatgccaggatcgccgaattcgacggggctgatcccgataatccagaccccaatcgttatacagccctttcaatggcattggattttattgcccaaatgaaggccgacaaaaagactttccatccgggtctgtacatatatgggccgtttggtgtcggtaaaacatatctgacaggtgcaattgccaacgaacttgccgataacgggattcaaaccactatggtgcattttccaagttttgctgtcgaaatgaaatcggcgatcaccgataactcggtcaccgaaaaaattgatgtgatcaaaaagtcgccggtgctgatgattgatgatattggggctgactcaatgtcctcgtgggttcgtgatgaagtattgggagtcattttggaataccggatgcaacagcagctaccgacgttttttacgtctaatttttcaatggcccaactcgaacaggaacatttgcgtatcaatcaaaaaggcgacgatgaaccattgaaagccaaacgactcatgcagcgaattcgattcttgtctcgtgaggtcgagatgaccggtaaaaatcggcgaccagtttaatttacaaattgaattgacatttttgaacggcaactctatactaaatgtcaatgaatcaaagagacatgacagtgatgactcatcacagggagaatggttccagcctggaagaccgtttgttgagaaattgtttgttaccactctttgagaatggattgcggataatgctttcccggttggtaccgttagcagccacttgagagctttttggataattgtatccaaaaatccaatttgggtggaaccgcgctaattgcgtccctgatgtacttgtataagtatgtcaggggctttttttgtggctccaataaaatataaagggagtaagaaatatgtcacaactttcatttgaatttccagatggtagtgttaaacaatttgatgacggcgttacctcagaagccattgccaaatcaattgccgtaagtttaggtaaaaaagccgttgccgccaaggttgacggaaaatgggtcaacaatgacgagcccctacataaaggcggcaagattgaaattgttacgtcagatagtgacgaaggcctcagtgtattacgcgcaactgccgcccagattttgaaaatggcaattgccaatgattttgataatatccactttggtgaaagcgatgccgataaagacggcttcttcgttgatactgacaaaccagacactcaaatcagtgttgatcaattgagttcacttgaagactcaatgcataagattatcaaacaggatctgccaatcaaggtggtcttcttaagcgctgctgatgctgcaaaggttgccggcgatgatccttatcaaaaagaattggtcaaagcaaacgaagttaacggccaagttaaattcttccaaatcggtgacttccaatcaatcgccgaaggagctgttttaccatcaaccggcaaagttaagatcttcaagctgctctcagttgccggagcttactggcagggcaagtcatccaacccaatgcttcaacggatttatgcaactgcttttaacaagcaaaaagatttggatgccgaccttgagaagcgcaaggaagcccatgaacgtgatcaccgagtcatcggaaacgaactggatctgttctttgttgatccaaaagtcggtgccggcttgccttactggatgccaaacggtgcaacgatcagaagaaccattgaacgctacattgttgacaaggaagttgccaacggataccaacacgtttacacaccggttttagccaaccttgatctgtataaacaatcaggacattgggatcactaccgtgaggacatgttcccgccaatggacatgggagacggtgaagagcttgaactgcggccaatgaactgcccaagccatattcaaatttataaccaccatatccgttcatatcgtgaactgccacttcggatcgctgaactcggaatgatgcaccgttacgaaaaatcaggtgctttgtccggacttcaacgagttcgtgaaatgactttgaacgatggtcatacatttgtcgccttggaccagattcaagaagaattcaagaatatcttgaacttgatggttgaggtttatcacgattttgatattaacgattataccttccgtttgagctaccgtgaccccaagaacaccgaaaagtacttcgatgacgatgaaatgtggacccgtgctcagaccatgttgaaaggtgccatggatgaaatgggcttggattatgttgaagctgaaggagaagctgccttctatggtccaaagctggatgttcagaccaagaccgctctgggaaatgaagaaactttgtcaacgattcaattagactttatgcttcctgaacgcttcgatcttcactacatcggcgaagatggcaaacaacatcgtccagtcatgattcaccgtggcttggtttctaccatggaacgattcgtcgcttacctgactgaaatctataagggtgccttcccaacctggttagcaccacatcaagttaagattattcctgtcagccaagacaagcacctggattacgctaagaagattaatgaccagcttcgagcattgaagattcgttcgtcagttgatacccgtgccgaaaagatgggttacttgatccgcgatgcacagactcacaagattccatataccttagttgtcggtgatgaagaagtgagtggcaacagtgtttcagttcgtaagtatggtgagcaggatacccaatcagagtcagttccggacttcattgatgaagtatctaaagacattgcttcatattcacgtgaagaagattaacggattaccaagtcacttattaatgcgcttaacggttcatagttgacacataagtgattagatgatattctgtaatagttgttcaaatgaaagcaggagctacccgcttctcgcctgagtaaatttctgaatttgctgggcatgatatcgagtaagagcttggtcagccaagttctttaattgagagcgggcgcaaatgtgtgcccgctctctttctgctttttcaaattattcggaggtgaagtaccatagcaaaagatatgatggttaatgatggaatccgtgctcgtgaggttcgtttgattggtgctaatggtgatcaacttggtgttaagactaagtcagaagctcttcagttagctgaagatgccgacttggatcttgtcctggttgcaccgaaagccaagccaccggttgcaaagattcttgattatgggaagtatcgtttcgagttgcagaagaaggaacgtgaatcccgtaagaaacaaaaagtcatcagtgtcaaggaagttcgattaagcccaacaattgatgtgaacgattttaacaccaaattgaagaatgctaagaagtttttggcaaagggcgaaaaggttcgggtctcaattcgatttaagggccgtgccattacgcataaggatatcggccggaaagttcttgaccaaatggctgctgaaacggcggacgttgccaccgttacccaacgacctaagatggacggaagaagcatgttcttaatgctttcaccaaaagaccaagatcaaaaataatagttgttaaatacttgaggaggatttttaccaatgcctaaacaaaaaacaaaccgtgctgcagcaaaacgttttaagagaactgccaacggtggatttaagagtgcaaatgcttataccagtcaccgtttccacggtaagacaaagaagcaacgccgccaacttcgtggtactagtatgatggacaagactaatatcaagacttacaagaagttattgccacatctataaaatcaactatacattcaattattacttttcaaaatataggaggaattcaaaatgccacgagtaaaaggtggaacagtcacacatgcacgtcgtaagcgtgttttaaaattagctaagggttatcgcggtggaaagtctcgtttattcaagactgccaaagaccaagttatgaagtcacaggtatatgcattccgtgaccgtcgtaacaacaaaggtaacttccgtaaactttggattgcacgaattaacgctgctgctcgtcttaatgacctcagctacagccaatttatgcacggtttgaagcttgccaacatcgacatgaaccgtaaaatgcttgctgatttagcagttagtgatactgaagctttcaaagctttaactgacgaagctaaaaaagcacttaagtaattttgatgtgctaaaatgactttcaccgatagtttggtggaagtttttttaaataaatttactataatttaaggagcgacatatgttgtctcgatttaaaccaacatggatgattggggatatttacacgatttctccccaattcctgcgggatcataatatcaactgtgttctaaccgatttagacaataccttggtaccttggaactccaagaagggttctcaagcgttacgcaactggttgtcagaaaataaaaaatttggcattaaggtgattgttgtgtccaataacagtcacaagcgaattcaacgcgcggttcaagattacgagctgccgtttgttcccagggcaatgaagccgctcactatcggtatccggcacgctctcaaggaatttaatttacaaaagcgcaacactgttatgattggcgaccaattgatgactgatgtggtggctgccaacagttgcggtgttcgcagcattttggtgaagccactggtgcgtgacgatgcttggaataccacgatcaatcgttactttgaaaagattgtctggaataaattatcgaaaaaatatcctgatttacattggaaataggaggaattatggcaaatagtgaagttgttgttgacggtgaagtcgttcattgtgtgggttgtggggcagctgtccagacgactgacaagaacgcactcggatacacccctgaatctgctttaaagaaggggcttgaaaatggggaggtctattgtcagcgttgttttagacttcgccactataatgaaattgctcccgtcagtttatcggatgatgacttcttaaagctgttaaccagtatttctgatactgactctttgatcgtgtacgtggttgatatttttgatgtgaacggaagcctcattcccggtctccatcggtttgtcggcagcaatccggtcctgttggttgggaataaactcgatattttgcccaaagccttgaagcataacaaggtgaaggattggttgcgacaacaggctaacgcggccggtattcggccaattgatgttgagctgatttctgctaagacaaattttgatattgatcgtttgttggatcaaattgaaaagtaccgtcagggaaaagatgtttatgtcgttggggttaccaatgttggtaaatcaactctgatcaactcaattgtccgtcagtcaactggcatcaaggagttaatcacgacttcccgttttccgggaacgaccttggatcggattgatattccgctcaatgacggtcataacttagtggataccccagggatcatccagcctgagcaaatggcccaccatctgtcgggtaaagaattgaatttggtgacgccacaaaaaacaatcaagccgaaaggttaccagttaaacccgggtcaaacgctcttctttgccggcgttgcccggtttgattacaactctggtgacaagcgtcatggattcacagtgtatgctgagaataatttattcattcatcgaacgaaattagaaaatgccgatgagttttacgctacccatgtgggttcatttctaacaccgccaaccgaagatcaaaaggctgattttccagctttggaacctcatgaatttaagtccactgaaaaaagtgatttagtgatcgagggcttgggttgggtaactgttccagagggcgtttccgtcactggatgggctcctaaaggcgtatccgttttgatgcgcccagcaatgatttaactaaagagggacttatgaaattaacaggaaaacaaaaacgatttttaagagccaatgccaaccgcatgcggccaatctttgaagttggtaaaaacggtctttcaccagtttggcttgaagagattcaaaaagcacttgatacgcgtgaactgattaaaatcaatgtcttacaaaattccgcagcgaccgttgatgacatcaaggactatattgaaaccaaaagtgatgtgacggtggttcagacgatcgggaagactttggtcctcttcaagccgtcaaaagatccaaataagcaaaaattatccaacgaagttttggcgatttagaggtaatgaaggatgagcaacgtcatgaatcatgtcgaaacattaacccagacgaaaacaattacaaaacaaaacggtaaacgcatcgggatcttaggggggaccttcaatccaattcataacgggcatttaattattgccgaacaggtcttggatcaactggggctcgacaaagtttactttatgcctgatgccaatccaccgcacgttgaccggaaatttgcgattgatgccaaagatcgggtggccatgattaactgcgctattcgggacaatcccaagtttgccattgaaatgactgagattatgcgtggtggcgtcagttattcctacgacacaatgaaacagttgacccaacagcaccccgagaatcaatattactttattatcggtggtgatatggtcgattacctgccaaaatggtatcgaatcgatgatctggtcaaattggtttcgtttgtcggtgtcaaacgtgacggctacacaccagcttccaaatacccggtaatttgggttgacgtgccgttcatcgatatttcatcatcgctgattcgctcgaaaatgcgacagcaccagtcaattaagtacttggttccggccgctgttgaacattatataaaggagaaccatttatatgaaaaatgatcaactaatctatcaaggccattttgttccatacactcgtgacgagctggttggcaaactacgcgccgctctcagtgatcaccgttttcagcattgtctgcgtgttgagcagactgccatggacctcgcagaacaaaacggggttgatattgaaaaggcggcgattggtgggttggtccacgactatgccaagcaacgtccggatgacgattttattcaagcaatcaaggactatcaattagagcctgaactgctgaattatggcaacgcaatttggcacggtgttgttggttggttgtttgtcaaaaatgagttacaaatcaccgatattgatattttaaacgccgtcaggtaccatacagttgggcaccagtatatgacgccattggaacaaattgtctatatggccgattatattgaaccaggtcgggattttccaggtgtcgatgaggcacgcaagattaccaagaataatctgcaagatggcgttgcctaccaaaccaaacaaacgttgggatacttggttgcccacaataagccagtttttccacagacaatcgtgacttataatagttgggtaccaagttcaggaatagattaaggagtaaatatgaacagtaaagaaatttcagaagtcgttgttcgtgcggcagacagtaaacgtgccaacgatattgtggttctcgatatgcaaaaggttagtctgatggctgactattttgtcatcgctgacgcagcttccagtcgacaggtcaaggcgattgccgatgaaattgtcgatcaggttgaagccgatgacgttaatgtctacagtgtttctggtaaagattctgcccgctggattttaattgacctcggtgacgtggtcgttcacattttccagaaagatgtccgtgatttttacaatttggaaaaattatggtcggatgccccaatcgttaataccgattcgtgggtggaggcataatgatctatacagaattcgccaaattttatgatgatttatttgacgcaactctctatgatcgttgggcccattttgttgtgaacaagacaaaagggatccaaaaaccgccttcagaaattaaaattttggatctggcctgcggaactggtcgcttggcgattaaattagcccaaaaagggtttcaggtgactggggcggatctatcagaggacatgctgacaattgccgagcaaagagcacgcgaagcaagtgttgacgtgccctttattcaaactgatatgcgcaatctggacggccttgatcagtatgatttgatctgctgttttgatgattccttgaattatttgattgatcaaaatgatttggagacaactttcaaagcagtgtatgatcatctcaattcggacggtcagtttctctttgatgtgatttcaccttatcaggcaaccgaggtttatcctggttatatgtacaactatcggagtgaagatgccgcttttatgtggaccagctacgaaggtgacttcgcgccaatggctgttgaacacgagttgaacttcttccaatacaatgaggagaaggatgcttatgatgcgtataatgaaatccatcgtgagcgcgcttacgatgacacggtgattaaagatctgctgtcacagactggtttcttggtaactctggcaagcaccgattttggggacaaccccttcgtacgggaaaccaagcgctggttctttagtacgggaaaagactaaggaagtcggagaatatgcttcaagctgttgggattgtttcagaatacaatccctttcataatggacatttatatatgctcgaacaggcaaagcaggcaaccggcgcagatgttactgtcgccattatgagcggcaattggctgcagcggggtgaaccggcggcgtatgacaaatggcaacgggctcacgctgccctgctgggtggagttgacctggtcattgaactgccattattttcggcggttcagccttcccacctattctcaaaaggggcggttgatttggctgccaaaataaagtgtcggtggttggcctttggtgcagaacatccagaaatggattatcaaaagctgattgaccatcagccaaaaaatcctgccgattttaaacgatttgatcgtccatacgcctccgtcttccaggattatctatttgagaaaaccggcattcggttgaatcaacccaatgatgtcttaggatttggatacgcaaaagccaatgttgaagcaggcaggccgctttcgctggtaccaattaagcgaaagggcagccaacatgatgcgactcaaattgacgatgtcagtcctattgccagtgcgacagcgattcgccaagcggtcgttaaacatgacttgaaggctgctgatcgagtggttcccaaggggacaatggggatgcttgagcatgaccgaatgctcacctggcaagatttttggccgtttctcaggtttgaattggttgagagtccgattgaaaagcttcatcagatttatcagatgaccgagggaattgagtaccgtttaaaacgggccgcaatcaaggcagaaagcttcaccgagttcctacatttggtcaaaaccaagcgttatacgtatacaagaatccagcggctgtgtacctatgtcttgttacatgcagttccaagtgatatgcttcaggcggccggatatgtccggctgttgggctttaacgcggtaggtcaaagatacttgaatcaaatcaaaggagaccttgacgttccattgattaccaaaattactgacgacgttgttgccgacacaatccaaatggattttcggggcgggatgttaacccagatgattaatggcttgtctcaagattattatcgacatccaatcatcatggaataatccgtaaactcctatcaaggaaattgccttgacaagcctatttgttgccggtataataagttttgttgcattggaggaattatattgaaatggtactttagagacttgcaaaagtactcggatactgatcctttcacattcaacgagaaccttcaaatcaaagccgatttgcttgatcgatatgctgatgaagtgatcgatgcatccgactttcacgttgaagggactgcttttgccgatcgcggtgatgtgattattgactcccatattgttgggaagttggtcgtcccgtcatcccgttcattgacacccgttgacctaccgcttgattttacagttgaggagttctatgttccttccaaggctgctgaatcacggtatggaaaagatgacgttgtctttgttttagatgaagatgatatggttgatatgcaaagagcagttgttgataatgtgattttgcatattcctatgcacgtcctgtctcctgaagaacttgcaggcaaagagatgccaagtggtgacgattgggatgttatgtccgtcgatgactacagcaagcagaaggcagaattgaaaactgttgatccacgtctggccgaattgaaggacttttttaagaatcgagattcgaaatagctggacttaaaatttcactagtggatattttattttgacgaggagggaaaaagaatggctacaccagcacgtagaacttctaaagctagaaagcgcatgcgtcgcggtcacatcaagttgacgactcctaatttgagcctcgacccaaagaccggtgaatacaccatgccacatcacgtatcaccatcaggcttttacaaaggccgtaaagttatcaaagataacaagtaattaataaccaatttagaacgccatggattctaaattggtttttatatacataaaaatagggccgccagcgagatgcgtttcgctggtggcccttaattcatttggatcaatattatatttatttagtaaaatcaacaaccattcggccaacaatcttattggctttcatttcatcgataatgtcattgacctcatcaagtcgacgagtttgtacgattggctttactttgccttcagcgccgaattggaatgtttcagcgaggtcctgtctggtaccaaccagtgaaccggcaacttgaatgccatcgagaaccgtcttatcgatgttaagtgccatatcacccttaggaagggcaacagcaaccaacttgccatctggacgcaaagcgttaacagatgtagtgaaggcctcagttgtaacggcagtaatttgagcattatgcacgccgccaaccttcttttgaatttgatcggcaacatctggatcatgacggttgatggtgatatctgcaccgttgtccttagctgcttgaagtttttgctcattaccatcaacggctaccacatgggcaccaaagacgttatgggcatattgaacagcgaggttacccaagccaccacaaccaacgacttcaacccattggccgggacgagtgtcgccaactttgagtgccttatacatcgtaacgccggcacaggttaatgaagtcgcttcaattggatcaagtccttctggtactttaacggcgtagtctgcagggacaatgacttgttcagccatagcaccatcaactgtgtagccagaattttgaacgttacggcagagtgtctcacggccagtgatacagtactcacagtgaccacagcctctgtagaaccaagcgattgaaacacggtcgccaatctttaagttagtgacatcgtcggcaacttgaatgacttttccgacgccttcgtgaccaatgattcggccgggaaccttaccaaagtcgccttcagcgacgtgtaaatctgtgtgacataatccacaatattcaacttgaactaaggcttcaccttggtgaatggggcgtaaagtaacatctttaatatcaacatatccatcaacgggatctcttacaacagcagctttcatagggttaatcatcctttttgtaatatattttcaaacaagttcattataaacgtccccttgggcattatcaagtgaatttctacacaaaattagtttaaatgaaaaatatttccaagcaattttagccgtttttctaagttttattaaagtaaaagactaaaactctcataattatggtaaaatgagagttatgttaaaaggtttctacgttactaataaacaaattaagatattttatgggagagctgatcatttatgagtcgaattttgattattgaagacgaaaagaatttagcacgtttcgtcgaactggagttaaagcacgaaggctacgatacccaagttgagctaaacggccgaactggtttgcaggctgcattggatgagaactttgatgtcattttgcttgatttgatgttgcctgaattgaacggaatggaagttgcccgccgattacgtgaaaagaagaacacaccgattatcatgatgaccgcgcgggactctgttattgaccgagtttcaggctttgatcatggtgctgatgattacattgtcaaaccctttgcgattgaggaactcttagctcgaatccgggccttgcttcgccgaattcaaatcgaaaatgatcaacaaaagaacaacaagaaatcagtcacattcaaggacttgaccattgaaaaggaaagtcgaattgttcgtcgtggcgatgaagtgattaacctcacaaagcgtgaatatgaattgttgctgactttgatggaaaacgttgacgttgtcctggcccgggatgttctgcttaccaaagtatgggggtacgattccgaagttgagaccaacgtggtcgatgtttacatcagatatctccgaaacaagattgatcgtccaggtgagaacagttacattcaaacggttagaggtacggggtacgtgatgcggtcatgaaccaacccaacacaaaaccaaagagaagaaagacatcgctaaaatggaagtgggcgttttttacgtccattggtgttttagcgattgttgttattttctcatgcttaatttttaatcgatttaccaacgtcttatttcaacaggaacgttcgcacattgacaataccttgagtaccgtttcttcaaggttgaccaattatgcctcaccattgaccaaaagcgatgtgggacactatttgaagccaaagatcaccgacagtaacgatcaggtaacacaagctgatggcaacgatttgtattccaattcgttgatcgttaatttttcccgcgataacattttagtcaatgtctacagtgtcaatggcaaggaattatttgaatcgcggaagagtacggccaagttttattctgccagcaagcggaaaatttttaccaccaggcataatggccaccaaattctggttggctcagaaccgctgctttcaaagaagaatggctcattgattgggtacgcacaagtcactgatcaattggacaattaccgagcgacggctaacaagctgctggttatcttaattattctggtgctgatttctgttcttttgacgatgatttttgcctatattctagctcaggaattattgcggccaattaatgatattcaaaaaacgattaatgaagttaagagcgatcccgactcagatgcacgggtaccggcctttcgatccaacgatgaattaaccgacttggctcagttgttgaacggcatgttggatcaaactcagcgctatattgaccagcaacagcaattcgtggaggatgtttcccatgaattacggacaccggttgccgtcattcagggtcatattgatatgctgctgcggtgggggaaagatgatcccgaagtcttggaagaatctttgaaagcttcactgcaggaaaccaatcgaatgaagagcctggtttctgaaatgttggatctttcgcgtgccgaacagattgaaattaattacggcgaagaaattaccgacgtcaatcaagtgtttgaacaagtttataatgatttcaaaatgattcatccagatttcacctttacgtttgatgatgacaccgatcatgacgtttacgttaagatttatcggaatcatcttgaacaagtattggtcattcttctggataatgccattaaatattcaaccaagcgaaaagaagtccacctgtcactgtctacatcgatggcgatggttaacattgctgtccaggactttggtgaggggatttctgaagaggataagcaaaaggtcttcaaccgcttctatcgggtcgataaagcccgcagtcgtgacaaaggcggtaacggactgggactttcaattgcccacaggctgatcgaagcttaccatggtaacatttcgattgaaagttcacttggttccgggtcgattttccaaatcaatctgccaatcttgcagcatctgccaagcgaagaagaaatggagaaaaagacttcatcaacctccaaagaacaatcggaagattcaggactcccagaaggaatcttggatacttccaaacatgatgatcgtccattaaatgacgatgaacatcatgaaaaataagtttaaaaaggcgtcacatccgttgcaaactgcaatgaatgtgacgtctttttaatgggtaagagtcattgtgactaattaagttttccaagttccctacgaacttctggtgcctcggctttgctgctggtaaaaataatccgatcatttagttttaacgatgtgccgccggttggccggataaaccgtttgtcacggtaaatttgggtaatggtaactttgtcgataaatggaatgttgcggacctgaatgtcagcatacagccggtttctcagggcaacttcgtagacactggaatctgtggacgtcattaagcgcattgttgacggcgcttcgatcaacgctcttaacatgctgatattaacatccggggtattataaagctccactcccagtcgatccaactcgtctctgcgatcgtctaaaatattgcggtcttcgaatcggacgatcacccggcggacaccatattgcttggcaattttcgccaattcataattcttttcggaattaatctgaccaaacaccacgacatcagcatcaaaaacaccgtttttaatcatgacttccggttccaaactgtccagcagatggatggtcgtttcactgttgaaggcccgataattgtgctggttgttggtatacatggtcacatcataccagcccttggctaattgttgcgccacagggacagtcgtcaaattggtgccgataaagtgcacgctcgtctttttgagatcctcggcttctgatgaatacagcttattaaaaatcagtggaccaaagacacaggtgatgacggctgacagcaagaatgcacctgactgttggctggtaattctgtgtaagtggttggcaacctgcagcactgccaaaacaacggtaatggtggtggcagtcatcgcagttcctgcaactgcgtttaggttcttgaaacgcaattttaaggcactgaataccaagctctttgccaaaacgtagccgacaaaaatcacgggaatcaacaccagcgtttgtggattcgtaattaattcttttaagttcaaattaacgccactcatgatgaagaaaattgggatgaagaagccatacccaattgagtccaaacgaactttggtttcttcatgcggttcaagtaatttgatgacgattccggcaagaaatgcaccaaggattccctcagcgccaaccgattcagcgacggttaccagggccacgatgataaaaaatgaaagccgaatatccagctgggtggtcgacttgttgatccgatcaaagaagcggaaaaaggctttgaaccgccagaacaagagcgcagctgcaaccagaatcaacaagatcagccataaggatttggaatggggactgtaggctgaagcgtaaaaagtcaacccaaccatcgggacaacttctcccagggcggcgattaagaggattgcctggccgaacggcttgctaagcagctccttttcttttaacccggcaatgacaatgccgagtgaaatcgtcatgaacagaatcgcggccagccaaatatcggtgaacaagccgctgagttgaagcagataagcgatcacaaacgacatgccgacaattgaggcgtaagcgattgtagccacttgtaatactgagtacttcggctgatcatgctggcttttcttctcgagcggtgaaagagtggtgggcttctttttaaagaggctgaaatcaatctccatcccgcttaagaacaacaggaagatgaccccgacattttggagaatctccaaggtttccgagttggtgatccagttgaacagtgacggtcccagcaggataccaacaataatttcaacaaccgctgttggtagaaaagtgattttaaaacgggccattgccaatgggatgacaagggccgccaggagaatgatcaatagcgaaatttgattcataaacgaaaacaactcttttcctgaaaaatatacatgaatatcctaccattcttatcctgagtttgggtgtcatatcactcaaaatcttgcagaaataaaaaaatcacaccaaaagatgtgattgagtgtgattatttatgatgtcgttgttgtttaccagcgtttcgaggacgcttagccgctggtttttcagcttgcttatccaccgtcgttttggttggctgagcagctggacgagcctgaggctgatgcccggattgctgcttgccggtatttcgttgacgatttctttggtgaatatcggaaccggtcgattttgtcccactggcagtcggcgttggatctggcatcagatcctcaaccgtcacagcttttttgccttcattttctttggcgatccgctttcgaattcttggtcgatacatattgatgatcaaagtctgcaaacatgcgaataggccgccaatgaagaagtaaattcccagaccggctggggcactcagcgtgaacaccaagatcatgattggactgagcagcatcatggcgcccatttgcttcttttgcgctgcaggggtgcccagcatggcaatgtagccctgtaatagataggaagcaaatgacaaaacggctaacagccaactcgattggccgagtcgaatgcccatgaaaactgtatgagacagctctggcgagtaacggattgcggcgtacaaagcagtaaagatcggcatctgaatcaataatggtaagcaaccgatcccaccggtcatcgaaatgccgttttgtttgtacaatgccatcattgcttggctggcagctgtctgttcttcaggggtactggctgctttttgacgcttctgtaattcagccatttgtggtctaatcaactgcattttttcctgttgaatagttgaagccttcatctggcgaaccatgattggcaagaggaataggcgaacaaccacggtcaggacgatgatggcccagccgtaactaccgacaaattgggcaatccattccataattgcctgagcagggcgggccagataatcatagacggctccgtaaggcttaccggacttggttgttcggacacagccactcaaaagaagggccatgccggaaagcaatcccagcgtggtgaggtgtttaaattttttcatgagtaagacctttcttaagttagtacgtaaacaaaacaatcttactagattattgcctgcttttcaatttaatatttcacattaaaccctttatttacccttttcgcgatataattgacttggagacttttgactttggcaaatggggtgggtgaattcttgattttttggataaattgcgccagattttcactttcgccgcttgcaagaattgaaacgctgccgtcgatttcatttttgacccagccggaaatgttgaggctttctgccagctggatggttgaccatctaaagccaacgccttggactcggccggaagcgttcattttgactgtttgaattttgtcgttcaaatgatcaccacctacaattaataatgaaagagagatattttatggatattgaaagaattacatcgaatcagaataaccgggtaaaagaatggaccaagatgcagtccaagaagggacgggttaagtccggcgaatacgttattgaaggctggcacattgttgatgaagcaattcgccatcgccagaccatcaaacaactgatggttgtcgacgagagctatttgggcgatctgccggttgacgatgataccgaaattttcttaatcacgccagaaattgccaaacatatctcgtccacagagacgccccagggtgtgtttgccgtgctcaataccgaggactaccatgaacagattcccgatgacttaaagggtgcctggctgttattggataacattcaagacccgggcaatattggcaccatggtccgaacagcggatgcggcgggattaaacggcattgtctttggcaagggatcggctgatctttataacccgaaagttgtccggtcaatgcagggcagccaatttcacatgaagctgtttaccggagatatcttggaatggatggcagcctttaaagaagctggcgttaagacttatggcaccgaattaaatgatcaggccatttcctactatgatataacacctaccaagcaatttgcactgattatgggaaatgaaggcaatggggttgacccaaagattttggagaagaccgatcaaaacctttacattccgatgaatggtgaggcggaatcgctaaatgttgccgtagcgaccggcatattacttttcaagtttgttaaataacggtcgttttcattgatatttggggcgataccatgtatcatgtttgtaaataaagacaaaggggtattacatgcaaaaggatgaatggaaaaacgattccgagtatcgtgaaatagtttctgacctgatggcgactgacatggttaagaaattggctaactatactcagcaccatcactcaactcgacttgaacattcaattgctgtttcttttgacagttataagattgccaaaagaaggggcttagattatcgtgccgttgcgcgtgctggtctgcttcatgatctgtttttctacgactggagaaccaccaagtttgatttgggttctcacgcatttattcacccacgggttgccctgcggaatgccgaacggatcaccaagttatccccaatggaaaaagatattattcttaagcacatgtggggattaactttggcacggcccaagtacgaagaaagtgtcatcgtctccttggtcgatgactacgaagctgttcacgaattcgtgagtccacttaaatcaaagttcgaaacgttaaagaagcaagttaagcgaacaactgctgttaaataacggttgtccgatgagaggggggaatttatatgcgacaagtagttggtctgcaagatgccattaattattatttgtgtcctaagttcgagaagacattttcattccttggtaaaaaatggaatggcttaatcattgacgtcctccttcaggaaggtgttttgagattcagggagattgcccgacaaatccccaagtgcagcgatcgtgtgctggtagagcgcctgcgcgaactggaagacgatggtgtcgttgtcagaaccgaacacgatgattcatctttaatcgagtattcattgactgaacaaggcaaagaattagctccaatcatgcatgaaattcatacatggtcagaaaaatggtatccaagcgttgaaaagtagcttgaccatttttttgttttagcttattattcactaatgtaaagcgtttgagaaaaaagtagtaggttgataacctatctgagagacttcgtggttggtgaaaacgaagtaggaaatcttcacgaattcatttttcgagctgaaattgggcgttatttaacaaaaaatttccggttaatcaccgttagcgatgtcttaagtgtgttgtcttttgacagcaaattagggtggtaccgcgttgcttcgtcccttatcgggcggagtttttttgtgtttaaaatttgaactggagggatactatgtcactgcgagatcaattgacagagatcaaagaaaaagggcttgctgatattcagcagaccaatgatttaaaagcattaaatgaaattcgagtgcatttgctcgggaaaaaaggcccgattaccgctgcattgcggggaatcaaagaattaacccctgaagaacggccggaagtcggcagttatgccaataagattcgggatgccatcaccgaagccgtttctgatcatcgtgaaaaattggaagatgctgccctcaatgcgcaactggcagctgaaaagattgatgtgacgatgccgggaaagccggttgctcaaggccaaccgcacgtgattcaacagatcattgaccaaattgtcgatttgtttttggggatgggctatgaagtcctttccggtccagaagttgaagaagataagtacaactttgaaatgatgaatctaccgaagaatcatccagcccgggatatgcaggatacattctacataagtaaggaaatcctaatgcgaacccaaacttcaccaatgcaagcacgggcactggagaaacatgatttttcaaagggaccgctgaagatgatctcacctggaatcgtttaccgtcgggatactgatgatccaacgcattctcatcaattccaccaagttgaagggctgtttatcgatgaacacgtcactatggccgatttgaaaggtactttgatcacgatggcccaaaatatttttggtgataaattcgatattcgtcttcgtccaagttatttcccatttacggaaccgtctgtggaggttgacgtcacttgctttaactgcatgggtaagggttgtgatgtctgcaaacacactggttggattgaggttttaggtgccggaatggttcatccaaatgttttggacatggctggtgtcgactccaagaagtacggtggttttgccttcggagtcggtccggatcgtttcgcaatgcttaaatatggtgttgacgatatccgtgatttctatttggatgacgttcgcttcttaaatcaattcagtaagaggggtaattagagaatgaaagtttcatataaatggctcaaacaatatttagatctgaatatgcccgctaaagatctggctgaaaagatcgaacgaacagcggttgaggtggattctgtcaccgttgccgaagacggcctgaaaaagctcgttgtcggccacattttatcaatgaccaaacatccggaatcggaccacctccacgtttgccaagtggatgtcggagaagacgaacccttacaaattgtgtgtggggccccaaatgttgacgttgaccaaaaagttatcgtggcgctgcccaactcacgaattggcggcaacgttaaaatcaagcgttccaagatgcgcggaattgaatcatccggcatgatctgtgctttggatgaaattggcttcagcaaagacgtcatccctaaggaatgggcagacggtatttacgtttttgatgacgatgtgcctgttggtgaaccaatttacaagtacttgggaatggatgatcccattattgaccttgatgtcactcccaatcgtggtgatatgttaagcattttgggcactgttcacgacctggctgcaatctataaccagcaaccagaaattaaaaaaccagtggttgatgaagacagttcattggatgccaatcaagaaattcaggcaaaagctgacgatcaacttgccaaaacctacaagctgcgggttgttgaaggagtcaaaattgcgccgagtccttcttggctgcagattgttctttggaacgccggcatccgaccgatcaacaatgtcgtcgacgttaccaactatattttgctcaagtacggtcagccactgcattcatttgataaagataaaattaacggtaacgtcaatgttcgcctggcgcaaaagggtgaaaaattaaccacgcttgatgaggatgaacacgagctttccgcagacgatattgtgattgccgatgacgacaaaccgattgccttagctggtgtcatggggggcttcaacacccaaatcgatgacaataccagcaacgtggtgattgaatccgcgatttttgattccttcaagattcgtaagactgcccaacggcataatttgcactctgaggcctcccaacgcttcgaacggggaattaatccagacggtgtccaagatgctgttgacgaagctgtcagcatgattaagcagcttgctggaggcaagatcgccaaaggcacggtgactgccagtgaatatcatcctaaactgccaacgatttatattaccgctgaacgaaccaatcatgttcttggaacttcattaaccaccgcagaaattaaaagtatttttgatcggcttggcttttcaagcgaagcccacgatgacggtttaaatgtgaccatcccggcccgtcgctgggatattttccgcgatgctgacttgtatgaagaagttgccagaatttacggttatgataatctcccggcaacgctgccgaccggacgacaaagtattggtgttttgacgccgattcaaaaactgcagcgcgcttccagaactgccttggaaggcttgggcctgactcaggcgatctcttattctttgactactgctgaaaaagcaaaaatgtttttgatgcgtgatagtcaagaaacgaagctgctgtggccaatgacccaggatcatgcggtgctgagaatgaacatgttgtcaggattacttgatgatgttgcctataaccatgcccacaaagttgacgatgtggccctttacgagtctggacgggtcttttacaaacatagtgcggaccaaattcggcctgaagaagttgaacacattgccggagttgtcacgggcaatttcactgatccgctgtggaataaccatgtcaagccggtcgactttttccagttaaaaggcattgttaaccagttcttggttaatttgggcgtcaaaggtgacattgagtacactgccactgatcaatatcctgaaatgcatccgggaaggacagccaacatttcgatccacggccattacgtcggtttcctgggccaaatccatccacgaattgccaagcagttcaaaatcaaggaaacttatggatttgaactcaatatgcaggagttgattgatttgccaaaagatgacaaccagtaccaagctatctccaaatatccatcaatcaaacgggatatttcattagttgtggatcaggatgttaccaacagtcaaattttggcggttatgaataaacgtggtggtgccttcttgaacgatgtgcgtttattcgatgtctatgaaggtgacaatgttcccgacggcaagaaatcgatggcttactccctgacttatgtggatccccgcgaaaccctgaaggacgaagtggtcaacaccgcctttgaaaagattaaaaaacggttaacagctgatttaaatgcagaaatcaggtaatttggaaactataattaaattgaacagataggaggagcttctcatgaccgatgactcaagtcgacgaaaccccaaacccaataaaagcctcgggcgaagaattattatttctgtcattaccttactggttattttagctgcaacaatcgggctgatgggctaccggtattttcaagatgccttaaagccactgaacccacagaacactaacgtcactcaggttcacattccgcttggcgcttcgaacaagcaaattggttcgatcctgcaaaataaaaaaattgttaaaagtggcatggtctttgattattatgtcaaatccaataacatggccaactttagggctggatattatcaattgaaaccctcgatgagcctcaaaacaattgccaaacggcttcaacgcggcgggactgatcaaccgatccaaagcaccaaggggaaagttttgattcgagaaggcgccaacattgaccaaattgcgacccagatttcagtgacaactgacttcgatcgtggagatttcttgaaattaatgaagaatcagacataccttgaacaactggccagtcgttatccgaagctgcttaatccggcgatgaaagccaaaaacgttcgataccgacttgaaggctatttgtatcctgcaacttatgaagtggaaaagaatacatcgttgaagtcactggttaaccaaatggttgccaagaccaatcagatggtttcgccgcactttgctgccattaaaaaatccgggatgaacatgcagcagttcatgaccttgtcgtcattgattgaacgggagggtgtcaaccagaccgatcgacggaagatggctggagtattgttgaatcggatcgatatcaacatgccattacaatcagacgtcgcggttttgtatgccattcaccggaataacaaagtgttgacgaacaaggatctgcagagtgattcgccatacaatctttataagtataccggatttggtccgggaccatttgacagcccaagcattagttcaatgagcgctgtcctgcatcctttggatcgttcaaagaactatctgtacttcgttgccaataccaaaacgaaaaaagtatattactcaaagacgtatgctgaacatcagcagcaaattgcagcgcatacttccgataacaactaattgagagggcatctatttacatggtaaatcacaaaacacggccagtcgttattggcattaccggaggatccggtagtggcaagaccacggttgcacgcaagatttttgaccaattatccaattattcgatcacgatcattcaacaggattcatattataatgaccaagctgacatgaagatggccgatcgcaaaaaggtgaattatgatcacccgatggcatttgattttgatctgttgattaagcagcttaagcaactgctgcaatatgaaccgattgaaaaaccggtctatgactatggtcaatttacccgcagtcagcagaccattcatcaagaaccgcgcgaagttatcatcttggaaggaattttaatccttgacgataagcgattacgtgatttaatggatattaaagtatttgttgacacagatgatgacattcggttaattcggcgaattgaacgggatacaaaagaacgtggtcgttcactggataacattattcatcagtatttgatgactgttaagccaatgtatcaccagtttgtcgagccaaccaaacgttacgcagatttgatcgtccccgaaggtggggagaaccaagtcgcgattgatttgctgacgaccaaaatgcgttccattttgatgcggcgtggcaacaaagaaattaagaataaccttgattcaacaatataaagataaaaaggggaaattaccaaatggctgaagacacatatccaatgactgccgatggtcgcgataaactcaaggcagaattagaagacttgaaagtaaaccaacgaccaaaagtggttgaacgtatcaaaattgcaagaagttatggggacttatctgagaactcagagtatgagtctgctaaagatgaacaaagtatgcttgaaagtcgaattacaacgattgagcacatgcttcaatatgcccaaatcattgattcaaatgatagtgacaaggatgaggtaacggttggcaagaaagtgaccttccaagaattgcctgatgaagatcccgaaacgtatcaaattgtcggggcggccgaagctgatccaatgtcaggtaaaatttccaatgattcaccaattgccaaggggctcattggtcaccgtctcaatgaagaagttaatattcccattccggccggaaccatgaaagttaaaatcactaaggttgaatagagctacttgcatattacaaataacctagtatgtgaaaagagctaactgtgagcatctttgctcaacggttagttcttttttgataagttaaattaagcccgcaatcgtcacgttttgaaaggtgaacagccccttgatgaacaatgttagcgtctaatcggcttgcatatcgtttgtgaaataccttaatgatgttataatcgattgtaagcgaatacaaacacagattttaggagtgtggcataataatgaaaattgatgtaactgattccgcaagcaaatggttccaatctgaaatggggttaagccaaggcaatggtgtgcgcttctatggaaaggtttatgggaaaactcccgtccatgaaggcttctcgttagcgttaacccgcgatgatcatccaggtgagacttataccaaaactgaaaaggacggaattacttatttcgttgacgaagatgaccgctggttctttgtcggctttgatttgaaagtcgattttaatccagaaaaagatcctgaaaatgttgtgtacacatacacacctaatggggatcttgataaataaacgtaaccaatcaaaaagggatggaagccaaaatggttttcatccctttaatcatgcaatttatttggtatttgttggtgtctcagtgtgcttggctttttgtttcttacgatgtttcaacgttgcctcggtgccgataaatgctaagccaaaagcagtgattagtaggccgactctcagcccttcaggccagtaagtaaagacaaccttatggtgacccttgttgattgggatatacaggaacatctttgcccagcgttttggtttaactgatttaccatcaaccttagcagtccagccattctcaaatggaatggtcgtggttaatgcttgattgttggacttgacgtccactgttccggttaactgatggtggttccacttcgtaactttatacggcttggcgtttaagtccttagagaactgagcaatctttgaattatgaactttgtacaatttcacgtcttgtaagagggcgttattcttgttgacaaagatttgaacatttgcagtggtattgatgctggtacctgtggcaatgttagcaatgatggttttttcagatggtgtaaattgagtctgcgcttgaccatcaaccgaaattgaaatgttgcctttattgatttcggttcccaacgtcatgtagtaagacgtgttcttctcaattgggacagagaaaatgatgtaggacatttccaagaggttctttttcttcaagacagcattatctaattgagaaatcggttgaatgttgttataccgcatgtcagtgtaagttgctggttcaaacaagttcttgatgtttggatccagacgatgggcaatttggttttggtaagtaatcggactcttggcaattgaattatgttccattccggatttaggcgccaggaaaccaatcgggaccgcatacggattccggtaggtaccaatcaaggcgtcctgtgacaacaaggtgtaattgttataatcaggctttcttgtcaaagtagtcaacagctgcttctttggttttttgttcggattagcttccggaatttggtgactcatgtaatacttcatgttcaacaatgaatcagtaaacatggttccgtttgagtaaaggacaaatgaatccccatttggctgaccgatatttttgaagaactgagacgtatcggattctagggttgacgagaagattgagccgccattgtaattaccagtgaaggcatcgttcttggtccgcgagaaagtggttcccaatcgatagaatcccttatctttttgcttaattttattgacatgtttgcgcatcacccgctcaaactgggtgtaattgctggccttcaaataatcaagatgattcagtgaggtgaccatgttaagggccatttcaccactcatcagcacggccaaggtcatcgccagaacaatgtttctgcgataaatgcctaagaagacaacgatcccaagggaaacgaccaaataaacacagccccagagaaagtcgaagtggcgcatgtattcgagatgcttccagcggagttcgacgtaaagaacgcccaaagccatgataccggcagtgaccagataacctttccagttgatgccttcatccaagatatgcagaaaggcttgaaaggcggtcagaatcatccaaaacgagaagaggtaggagaaacggaaagtgtaccaaaccggcagctgcataccgtgccagaacagatccagtggttggaaacacattgatagaatcataaatgctgtcaacgaaatattggcaattttgacgtttcgtttgatggttggaataaagaagtagtaaacaaataggatcaaaacgacactggcgacaaagacgttggctgttccggcaggcagttcattgaaattaactgatccattaaagaacttgcccaacatgtccagtgggttatattcaaacttgattttgtattggccctttgaatattgggttttgcttcccagaagcgagaaaaaggtcggcagcagcagccaggcagctaaaataccgctcagaattgacgccttaagccatttgagaacggctttggtcgatgtttggttttccaccggcaatgccttggcagcccagtaaatgaacatgaagagggttaaaaagatggcgatcatgtaactcatgtagtaattcataatcaacatggccgttaaactgatgatgtagatggcactcgactgatttttcaagatcttgaagagcccatagaaaatcattggcaaaacgaacaacacgtctgtccaaagcatgttgaattggttggcaaccatccagcccatcatcgcatacgaagcagagaaaccaatgattgaccagccaacgtgtttggtaactttcatcaagaaatagccaaaacttaaaccagccagaccatacttgataatcgtgatgatgcccaagacactgggtaatttagaaagtgggaaaagcaacataatcaagttcagtgggctcattaagtagtaagcccaagttcccatcatgtcgcctccaagagcctttgaaaatgaaaagaaaaagccgcttggactatgtaggagggtgtcatggaaattggtataaaagtcaatatactgttgacccaagtcaacggtcataactgacgagccgccaaacggagcaaagtggcggaaaataaagtaactggtggaaattagcaccggtaccaaaaagcacagcactaatatggaaattttcgttgtcttctttgaattcataatctacatcctttttaaaagtgattaacaacatatagaatatcataataagttaaagattgactaccggttgtagtttttagttggaaaatttgatagaataagtttcatggcaaggagttaatat

SEQ ID NO: 188 - DNA, 741 bp, Lactobacillus buchneri
taccaaggcgatgatacgtagccgacctgagagggtaatcggccacattgggactgagacacggcccaaactcctacgggaggcagcagtagggaatcttccacaatggacgaaagtctgatggagcaacgccgcgtgagtgatgaagggtttcggctcgtaaaactctgttgttggagaagaacaggtgtcagagtaactgttgacatcttgacggtatccaaccagaaagccacggctaactacgtgccagcagccgcggtaatacgtaggtggcaagcgttgtccggatttattgggcgtaaagcgagcgcaggcggttttttaggtctgatgtgaaagccttcggcttaaccggagaagtgcatcggaaaccgggagacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgatgctacgcgaagaaccttaccaggtcttgacatcttctgccaac

SEQ ID NO: 189 - DNA, 522 bp, Lactobacillus buchneri
aacccttcatcactcacgcggcgttgctccatcagactttcgtccattgtggaagattccctactgctgcctcccgtaggagtttgggccgtgtctcagtcccaatgtggccgattaccctctcaggtcggctacgtatcatcgccttggtaagccgttaccttaccaacaagctaatacgccgcgggtccatcctaaagtgacagccgaagccgtcttttaaaccaaaaccaggtggttttggttgttatacggtattagcacctgtttccaagtgttatcccctacttcaagggcaggttacccacgtgttactcaccagttcgccactcgtctcaatgttaaatctttcaagtgcaagcacctaaaatcattaacggagacgcgttcgacttgcatgtattaggcacgccgccagcgttcgtcctgagccaggatcaaactctcatcttaaattgtttaaaatgataagcctgtgatagctcatgatttaaatttattatttgttttacgaattgactt

SEQ ID NO: 190 - DNA, 42645 bp, Lactobacillus buchneri
cctgcagtcggcataattatgcaaattagaagaaatattaaaattaggaatgctgttaaataggcattcctaatttttttaatttataaaaacgtactagaaagtattaaaatataaataataacgggcaaataacggccaaacgggcagaagaagtttaacctgatacagagtaaaataacaaaataaaaacggaaccttattaaaggttccgtttgattggtatagtttcatcatgagaggaaaggttatctaactcttcacgaatctgttgatcgttttttgctttatattcatccattaaataggaataaatctttgttgttgtggatacgtcagcatggcctaaacgcttagaaatgatgtaaatgtcaattcctcgagatagtaggtaagctacatgtgagtgtcgtaaagaatgaaagtgaaagccttgctttttaattcctaagtcttttagtatagaacgcaactttttattaacggcagaggatgatggaatggatttatattgattaacaaaaattagttctccattattgtgatccttcaatatctttaatgatttcagcaattcgtcattaactgcaatgattcgatttgaaccagccgtcttagtatctttgaatccaccgccttcggatgaattccaagatttagtaatgctaatcgttttaaaattaaaattaacgtcattccaagttaatgcttgaatttctcccaagcgagcaccagttaaaacggccgtcaggatcataaaggtggaggtaaagtgatagtttaagtgattctccagataagcgatgagacgcttaatctcagccacgttgaggtattccacatgcttatcacgtgacttgtcataaataagactgactcgctgggtgaaatctttatgaatcagatcgtcaagaatggcattttgaacagttgctctaatcagtgaattaactttataaacagtatcttttgcatgagaatgaccatagaaattaataaatgcttgatattgtggtcggtcaatactttttaaagtaacatcaccgaaataattatgtaatactcgactagttattttatagcgattcttagtctgattctcaattttgggttctttgtacgtgtgataaaaatagtcaaaatagtcagcaaacttgggatctttaggaacgagatccaaaccattgtggatatcgatttccaattgactcgcaaatagctttgcagctgatttagttctaaagccgctcttagttttctcatgttcctgaccattggcatcataatagtagtatcttacctggtatccatgaccatgcttacgtattgatggcattattattctcctttgggtaatatactaacacatagtggggaatctacttaatagagcgatcatttattaattatcatggcatatagattacaaaaaaatgttaaagcctttacaactccttttttcttttgcattcaaccttgattatgttatactatttacagcaagttagttgaggcatgtgtttgcatgcctaggtagcttgaaaaaacaatttttttgggaggaaattacacatgaaaaagtcattgaaaaagactctttttgctggcgtagctgcattatcatttgtagctgttgccggtgtatctagcacaaatgctagtgcaaaatcatatgccaaagttacatcaaacaaagctttgacaactgatgctactactcgtaacgttgctgttaacggtactaacgctctttatacaaaggctggtactttgaagggtgctaagaccgttgcaactaagactacattagctagtcttaagaactctaagcaaggtcaaaagaacttccgtgcttatcgtgtagctactactaaccgtggctcagtttactacaaggttgtttcatttgataagacttaccgtggctggatctatggtggtaagagcactgcttcattcgctggtggtattgcttcattcagcactactacagcacctgcagcagctgcaaacacttcatcttcagcatcttcagcttcaatcaatactcagggccaaaccactgcattgactgacgctcaaaagaatgctacctacaagatcaccaaagccggtactgcaaatgatggcactgccaccacttacacttacccagcttggactgagtaccgtaagggccgtaccgttactgatgctactccttacgctaacgataccttcaaagttacggatcaaacgacccgtacccgtgaaggcgacctttgggtaaagattgctgacactaacgctaccaacggtcaaaagatcaatggctggattaagtacagcgccttgactgctcaagctactacacctactactactccagttgccgataatgctgtacgaattacctttactgatccttcaggtcaaactatcaagtcgtttgattacactaagaccaacgctaaaaaaggtgacactttaggcactcttacatcaacagataatggtacttatacttggactttagacagttcggtacaaaccagtctacaaagtcaagctaatgaagcacttcagggaactggttatggattcaagcttgataacaacatctcattattggctcaagctaaaactggttcagaagtcaagcttcctttggctaagggtgatactgtatatcaaaaacttagtccagtagcttatgtaaatggtagcaatgcaactaataactcaaaattaaccaattatgtaggtgttaaaaacttaccttcatcatattttgccgaaaaggttcctcttgacaaagcaaatctctttgatctttctcaagtcacaaagaatggcgttccattggatgtgttgaagaaacaagttgctgactatgtatcatgggttaactccaccaagcataaaggtggtaccaccactaaatctacagataatcgattaaataatattaacaatgcaattgctactgctgcaaaaaacacttatatcgcacctgccaatttagcaattagtgatttgtttagtggtaacacgaacgcttcctatactggaacagatgtgctgaactatctcaacaagcataatgaattgaaaactttgaagtcagctgttttccctgtatttgacaaaaatggtaatatcagccattttgctcaatatacattcacagctcaacaagcattgggtggaacctttggtcaaggtgctacgactgtttactacagttactcaacaacaccaagtcagacaagctttcctaccgctagttcttctaatacttattcaccattcgaataaataagattcatcttgtttatcaatttccattggtcttttattaaaaaggggcttcgtcaactgttgttggtgaacaaaatattggagttctaatcacttggtgattagagctctttttgtatgaactcgaaaagcgagcagcactcttagacggaatctgaagaagtttactgtgtataattattgtttgctgcaaagcttgtgtattagcctttctattcaaaatctagctcaacaatagattcttccaattgatcaagcatttcgttaactgaaataaagtgtcgccatttattaggatcatgtttagcaagtcctttaaagttactgctgatcttatcgtggatatttaccaaaaatttgtaatacatattagctgcttcacgatcgattctttcctgtggccaacgtttatccagagaacgttggttatttttttcggtcaaatattgcaggcatttgctagtaaacaaattctcgatattgctattctcttttaagtaatctcttaattcttcagtatccatgttaaaatcctccttaaaattagttaattgactatttaggactcgaacctaagcaaaccacctggttagtcgaaacatatgttcttttaaaactttaaatgaagctcccacatttgggagctcataagatcactttaccgattacattaacttcatcacaatcaaacaccatgtcatcgtatgccttgttaattgattttaaggtaacggtattatcctcatttacataaaactttttacaagtaacaccaacatcacgaatgtggacgatcgcaatttcaccattctcaacctctggttggtagtggataaaaacttgactacccttttttaagagcggttccatagaatcaccatccacagtaactaattcatctgcaccagcggggaccttctcaccagcaataagcttgtggattaattgggtatcttgatcctcaccgttaataggagacccggcagcagttgaacgcccagcaggaatttcaatcatcggcttgtggtcaaacattgaagttattttttcgttattctgttcgtttaattgatcactagcgtaattgtaaactttctcttggcgagaagggtggagctgatcataaataggaagaatatcatttcctttatccactttttctctattgcgtggaacatcaaaccccattagccatccttcatttacatttagagctttggccaatatatataatttatcttgacgtggttcacttttattattaatgtattggctcaaatccgttttacttatctttattcctgtcctttctgataaaggctttgtttttgctatgatgtctacttgcttaatatttctctcattcatcaattgcttcaaacgatcgccagtagaaattttattagtcaaattttcatctcctaattacttgatgtcttaattatacttttgattgaacaaaagttcaatataaaaattcaattattttgaacttgagcttgacaataaactgaacattagttattataataaacgtaagttcaattcttttgaactttaattcttgtgaaaggaggtttcagtatgatttttgattactcgatgttattaggaaaaattgtttccaaatatggaactcaatataattttgcaattgcgttaggcgtttccgaaaggaccctatcacttaagttaaataataaaattccgtggactcaaaaagaaattgaacattgtattaagttgttagatatttctaggggagatattcctgagtatttttttgatttaaaagttcaattttcttgaacaaaatttttggaaggaggtgagttaaatggaaaaaggcaaactgcatcagtactttgatagtaatattcagcctattttaaatatggcgataggagttctatttatgacaattggttacttacttggtcatatgtcctagaaagaagccaagtgatcgtcaatgaatagttgaaaggaggtgaataaagtgaaccaagacgcagaaaaaacactccgagccatttgtggtagcaaggagtgcaataaggaaaaaatcgtgccaatgacaaaagaatcgcgtaaaagagcatttaatcttttatcaaaaattctttcagacctatacgaaccaaattgttagttcgttcattctcatactgctgaataaatttaaacattttgttcgtccagtcgtcgttggaattgccatttttgacatcttcacgtatccgctcaatgttctcttcatcatgaaacgtgtcgtcaaacttgtttaaaaattcagcgtatttttcatcaaattcatcgtttgtcacaattttaacctcgattacttgaattaattaaattatacgtcagtaaataatagaaggaagtaataaaaaatggcaaaaccacgtttagttttagaaaagaaagcaccagaaccacgagtatcacgattgattagcattaacactgatttgtataaccagttaatggacattaagcacgaaactggattaactgtcacagcggtagttaataagtttatcgcttatggagtgaagaatgtggaaattgaagacaacaaaaacgacgattaattaatccacgtcagatcttatcaaaaggaagtgagaaagatgatcgataagaacaccagttttgaattaaaacaaattgatttattagatcaggcaaaaagcacaaatatttctctcatcttggagaatggaagtattcttctttcagaaataaaaaaagctcagcagctaagtgctgagctaggagatgtgctgaatcatatcaagcactttaatcccgagtttcggatgaagtgattgatacaatcttaaaatctgcgattaattagaataattcaagcatacgccaataaataccataggagaattaatcttgaagcacgattatatttatttttgccatgacaatcaaggaaataatgttccacttgcaacaggatcaacgagtgacttacaactagtcctttggttgaatcgacaagaaaaagaaaccatcattccaaaaaaatgggcttctaaagaattatttgttcgtgtcaatgaggagaactttatcgttaaaaaccgttcttaatcatctgacttttaatgatgtttgaaatcacttgtgctgagatgctttcaatcatggacatggaaaccgaagctagctttccaagtgtgtatttaattgttttagaatcgtatttctttaaatctgatgattcgataaaatcattcaaatgcaaaaacatgccaaatgtaacattcttctcaataaacagcataatatctcgaacacagtcctggttaagtttcatcgttatcgcctcgattaattgggataaatcaagtatacaactaaaggaagtgacaaaatgtctcaagtcattagtgctaaagtatcaattcaaattcctgataattttgaattgataaataaggaagattaccaaaagttaaagcgggaatcaacatttggacggacttggaatttaaacgatcttcgtaaatggtgtgggaacaaatcaccacaatggttaaaagaaaatttcttggaaaatccaaaatattcacgggaaatgcaagccttaatggatgatagatatttagtccatcgtggcagtaaaggtagtccctggttgtttaaagctaccaaaatgcagcagttcctggaggatcattggagtgaatttaactggtaaggaggtataaaaatggttctaattttaccacagtggttagactatgtaatttttagtgcgattggtttttgggttgggactgagtatatgaagtataaagcgaatccaaaaaccttttggaaggggtggtttgattaatggaatctttggaagtactaattttattatttttggtagccttggtcattgaatactttataccaactgggcgtcactaaaaaatagaaaggaatcatatcgatgaataaattgcaaaagtattcgacatctgaattaataggtgaattaagaaaaagaaaggaagcccaactgttccatggtggcctttatgccaatactgaaatacgaggcaaatatggccaagaaaatatgaagcttccaaatgattactggattttattaattagcgacttttctccgctaaataatagttgaagacgtttttaacaatttctaatttggaatctgaaaaaccaattgacttaagatattcttttaaatgtttccaatctaaatttcccttaggaaacgatctatcagatcttatttctcttgctacatcaccaactggtaagctaacgtctttaaagcgcattaaccaattgtaaagatccataaaaattcaccaccttaattatatgcactaaatagcccactaccgcaaatgggtggactataactactaatattataacacctggagggtcatcagaatgaaaacattaacaatacagaaccgtatcaaacgtttgaatatgattattggacgcacacccgtggaaaacgatcatagcttgttggcatatttctttgtcctagataaagaaaagcaacgactatctgaatatattttacatcacgaggtggaataatgactaaattttggagagcagttggtgtaatggattcccaaatattagaaactggtgtctctcgtgccgacgttatgcgaaagctcagcataaagtatccgacttacgtcgtaactgggaccgacaaggattttatgaagaagcggaaagaacgagtcccaatttatcccgaaccaattagattaatctgtggcagaatcacaaaatctaaaagcaaagagattgcagaaatgaagaattcaattgatcaacgacactatttacattaaaagatggaggtaaatataaatgtcaaatgaattatccctaccagaatacacgattgactatcagctacctgtgattacaattaataattttgatcaattaaaaacagctgtagaagcatatgccaataaatatcaaggaatggcagtaacagcttccacagaaaaagaatcaaagtatagccgggcagagcttcggaaattgaagcaagctcttgatgataaacgtaaggaaattagaaaaaaatatgctgaaccatatcaacggtttgcagctcaaattaaagatttggaaatgaccctggatagttcgattaacccaattgacgctgggctaaaagaattggaagagcagcaacgccagcttcgcttaaaacatgttcaatctttgattgctgaaatggcacctaattaccatgtggaaccaggtgaggttgaaattgatcctacttggttaaataaaaccaccaccaagaagaaagtaaccgaaggaattgctgatgtgatgggttatgtcaaaaagaaacacgatgatttggaagcaggtattaaaaccattaccaaatatgctcaagcttatcagattgatccagctggttggatcgaccagttgaagcaaggccaagatgttaattatttgcttcaagcaattgataatcaggtcaaactaaataaacaaaaacagcagactctggaagcacaagcagcagaagcacaaacacatcaaattcagcagaaagataaaacgattgatactaacactggtgaaattgtttcccattcagtgtctttaaaaataacggcaacaattccacaaatgaaactgttgagggctttcatggatagtaaccaaattcgttatcaaagagtgggtgcttaatcatgaagacgattgaagctaaagatttgcagcgaaccttgaattggcgagtcattctatatgctaaacccggaactgggaaaacaacttgtgttaaatatttacctggtaaaactagaatttttgatttggataactccgctaaagtattagctggcattagcaacgttacagtcgatgaaatggatcgaactcaccctgaagaagacatgaagcagtatcttgaacaggcatcagaattgattgttggttacgacaatttagttattgataatgtatcaagttttgaaaaagattggtttgtggaaaaggggaagggtagtcataacggcatctcaaatgaattgcaggattattcacaatggactaattatttttcgagagtaatgactgctatctacgcgttgccagttaatgtattaactacagcttgggagacgcaacgccagattaccactgaaaatggtcaacaatttaatcaatatgcacctgaaattcggcaaagtgtgatggatggaatgctgggattatgtgatgtggttggtcggttgattattaatccgaagactaacggtcgtggcgttatgctgcaaggaaatgactcgatttatgccaaaaatcgtttggacaatcgaaccatgtgtgctgctaaggatctgtttaagtttgggagtggcaacgatgacaaaactaattgatattacgggtaagaaattcggaaggctgacagcagtttgcattgataattctcaacgtcctaaaggatctacccgtgcttattggagatttaaatgtgactgcggaaatgtcacttatgcttcaggaatcgatgttcgaaaggggaaaatacaatcttgtggttgtctacacgatgaactcgctagtaaaaggtttagaaaacacggtcattcaaatacgaaactttattttgtttgggagtctatgaagcaaagatgtttcaacccgaataataaaagcttttccgattatggtggtcgaggtgtatctatctgtaatcaatggaaaaatagtttttgtgcttttgaaagatggtctattcaaaatggatatgaaagtggaaaatccattgatcgaattgatgtagatggtaattattgcccatctaattgccgttggactgattggaaaacccaggccaacaataggcgtaaacgaaactctccagtgactaatagattgcgggcagacaatatcagcggtgtacgtggtgtttcttttgataaaagcaaaaataaatgggtcgctaaaatgatgtatcgaaaccgaatcatattggataggtcatttacaagctatgaggaagcagtaaaagaacgtcaccttgcagaaatccggtgtcaaaaaaatgccatttaaattatttgattatcaacaacgaattgtggatgaaactcgccaaaaaattggccaaggcaataatggggtactaattgtttccccaccaggtagtgggaaatcagttattatagctgaaattgcgagattaacagtttcaaagggtggtagaattttgttcttcgttcaccgtcaggaattagttaaccagatcgtaaaatcatttcaaaagcaagatgttgatttgatgaattgcacaatcatgacagtgggcaaagttgctaatcgattagatcacttgcctaaaccaaacttaattatttgcgatgaatcgcaacatagtcgcgcaaaaacatatttaaaaatttttaaatactattcggatgttcctaggcttggattctcaggcagtccgtggcgaatgaacggagcagggtttgacgatatttattctgctatggtcaaaggccccacggttaagtggttaattgaacacaaaaaactaagcccatataaatactacagtgtgacattgtttaatgacgaaaagctaaagaaatcaagcactggtgattacaccaatcaatctgttagtgattcagcaaagcccactctgtatggcgatattgttaaaacttggatggataaagcatttggacagcgaaccattgtttatgctcatgatactcaacatagcaaacaaattgcggctgaatttagaaaagcgggtatcagtgcaaaacattgtgattctaaaactcctagtgacgaaagaaaacgtattatgagtgattttagaaagggaaagatcactgttctatgtaactttggattggttgatgaaggatatgacgtcaaagagtgtacgtgttgtgtaatcgcacggccaactgaaagcttggtatttgatattcaagcaacaatgcgttgtatgcgatatttgccaaataaaatggccactatcattgatcatgcagctaactatacccgttttggtctgcctgatactccacgacaatggagccttgaaggacgacctaagaaaaaacggcagaataacacaaaatcaattccggtcaaaacttgtccaaattgttttgccgtggtaccgacacaatgccgtgtttgcccacagtgtggtaatgagattaaatatgacgctgacggaatggaaattgatgaaacggccagtattgaaaaagttggggaatttaaactgactactgattattcaaaaatccagacggcaagaaaaaagccggaagatgcacaaagttacaaagagttactagaaatcgctaaagcccgtggatataaagctggttgggcctatgtacaagctaaacgactaaaaatggttaactaatggaggaattttaaaaatggcatttatacaagcaaattacaagaacaacgaacacaaagatttttcagctttaccaagtggaaattacgagatgattattaagtcagcgcaggagaaggcaactaagaacggggcagaatcactgcaattagatttagtggttcgaaatgacttagatggggttactggattaaaaaataccaatgccaagtaccataaccgtcatgtctttatggacaattggaaacgcaaaactactaatcagtatgatttggatagtttccaatacattcttgaagctgttcaaattccagaaggaacaccattgaatacaattaatgattttactaaagcagttgctaacaagccagccaaagtgtatgtcaaaaaaacggttgatgattatggcggtgaaaagaaagacatcaatcagattgccccttggaattttagcaagagcgattatccacaagtgcagcatgtatggaaagaccaaaaggacggtaaaaatccatttgctggtaatcaaccagcatcagccccaacagataatccatttgacaattctggagattcaattgatatttcagacgatgatttaccgttctaggagggtaaacagtggcatatgaaaacattccaaatgaattacgggccttaaaacaatggggcctgtttcaaaaaatctggcaacctgagcgaaataagtacaccaaaataccccacaatgcgctcgatggtggagctggacgcacgaatgacccaagtacctggactgattatcaaacagccttaaaagcactccaaacgtatcaaatggacggtctcgcgttttactttgctaatggttatgttgggttggatattgatcacattggggatgagttggagaaatacgctgcacaggattatcaacaaaatgaagttcaagatgtgttgacgatgactaaatcctatgtggagattagtttatccggtaccgggattcatgctatttttaaaggcaaaattcctggtgatcgacgtcgcaaaggcaacgttgaaatgtatgagtccggacgattcttcgcgttaactggaaaaaccattggtccatacagtgatcgaataaacacaccacaaccgcaagtgatgaaacttatttataaacactactttggtgaaagcaatgtgataaagcttcccaatcaagcaccgattcgacctaatgatttaagtgttgatgaaattattaaacgcgcggaactttcgagaactggtaaacgtttcaagatgtttatgcacggtggttgggagggcttctatacttcccattcagaagctgatctagccttttcgaatgatttagctttttggacgggccgtgattttaataaaatggatgaaatatttcgaaagtctagccttatgcgaccgaaatatgatgaaaaacatgggaaaaccacttatggggtttcactccttaacaaatccattaatgaaactcgggaaacctttaatccacaacaacatcccttgcacaaatatgatcttaaattcttaaaatccaagcctaaaaagaaattaccacctagaagttgggatgacactgggaatgctgatcgatttattgatgtttttggaaatctagtcaaatattcctatattgataagtcctggtatttctataatggcagttattgggaaatggacgatcagggaaaagcagctcaattcgttgatatgactgtggataatatgaagaatgagaagttgcatgttgctgccggcgtggatcctgaaaaggctaaagtagcttgggaaaagtttttgaagaagtcgcgtagtcatgctgccaagcaagccatgataagtgaagtgcaacatcgggttccagtattgcatgggcagtttgatcaagacaaaactttattgaacacggttaatggttatattgatttaacttcgggtatcttaaaagaccacgacattaagaaaatgttcagtcatcagacaagcgtggaatacaccgacaaaattgattgtccagaatgggatgaatttttaaatcaaatttttgctggtgatcaggaattaatccattatattcaaaaagcagttggttattctgccacgggaagtatcaaggaacaagtgatgtttattctgtatggaaatggccgaaatggtaaatcaatttttatcgatacaatttctgatattctgggaacttatgccaagtcgatgcaggccgattcaattatggtacggcaaaataaatcgggagccaattcggatattgctcggttggaaagcgcccgattagttacctcaagcgagcctaatgagggtgtgagattggacgagggattggttaaacaattaaccggtggcgataaagtaaccgcacggtacttatatggtaaggaatttgagtttaaaccacagtttaagctgtggttagccactaaccataagccaatcattcgtggtactgatgacggaatttggcgacggctgatgttaattccttttaaggtaaaaattcccgatggccaagttgataaaaacctaaaggataaattaaaacgcgaatccgtgggaatccttaattggatcgttgagggttgcttattatggcaacgagaaggcttgaatccaccaataagtgttactcgtgctagtcggcaatatcgtgaagaaatggatgttattagtttatttgtagatgattgctgtgaagtgggtgatagttatcgagcacctgcaggagaactttttaagaaatatcaatcctgggcaaaagacaattccgaatattctatgagtaaacagaagtttagccgtgagataaagcagaaatttgaatataagcaaagcaatggtcgattttatttaggattaaaaattagagatgatcctagattgaattggacaaaataatctttttggacggatggacggataagtggacagataacggacggatgatttataaaccgaaatccttgtggctctaagtattattactccttttattactatggacggataaattaataaaagtatataagataaaagagtaaaaagatatataaataaaggtttgttgaaaagatccgtccacatggtaaaaaatagtctttattcttacagccacaatggatacaacaactaaattatccgtccatttatccgtccatttatccgtcataattatttggaggcgtataaagattaaatcagaacatgaaattcaaacagaaattcttttagcattatctcgacatgattgcaccgtttgtcgcagtaatgctggcaagattaaaactgatgatggcagacgaattatgttatttccgagaggttggccggatattaccggttttgaacatcatagtggaaaaatgattttgattgaagttaaaaatgaacgaggcaagttacgtgaagatcagaagcggtttgccaaatttattaagcaatatccagtgttatatggtgtttgtcgttctgtagatgacgcgttaaaaataattggaggtaaataaaaatgacagtaaagattgttgataaggaattgttcaaaatgtaccaatgcgcaatggcagaaaatatttctgattggaagcgaatagctaaattcgccaaattcattgataaatatgccgatgatgaaactatttctaaccgtgatgatttagctagtgttatagatgcaattttaaatcatgaaacagtgaaattgtctgcacaaatgtatcgcttgaagatgaatggcatggttggtagtaatggtcaacagtatgtatctcggcgagtagatgatcgtggtgggtatttcatctgtggaattcgtaacccacacgtttgtcgaggcgaaattacacaacaattcacacgggatgaagctgagtttttgaaggatttgttaaataattcaagcattcaaagtgtggagggatgaaattaaaaccataagacttatgaaagcttgccaattagctgttaaatgtgcacaataagtatatgtaatattatttgattagaggaattttatatgacgtatgtgataaaaaagcaagggaaagttcataaactgaaagaatttcgcagcattcaagcagttttgaaagcagaaaccggtttgccaatcaaaacctggatggttgaagaatctgttcagcatcatcaaaacatctgtggatggacaatttctgaaataaacgcaaagaaatccgttaataattagtttctccttatcgtcaatgtctagctgtaagtaaaccaagtttaaaggcggtgaaaaaatgggaaatgaaaacttagtaaaagcaattactgagagccggaattttgaaaacggcattaaccggattcattattcaattcattgttcaagagacgatgcttttagtctattaattgagcaagtattaagacgaattcatttttggaattataacaatgctaataccttgattaaggcattcagcgatcatggcaatccagattttaagaataagcaatgggcaattacctatgctgctaaagatgtggttgaagattattatgggcacaagacgttattggtagagaattttgataaatctgatgaacttggacaattggcgcctataaattgtaaaagttcagtgtcggttgagaattcattggtgaataaggttatttcattattcccgacggataaaaccaaactgtttgtaaaaagcctgcttaaatatggaaaaatagctacaatggatattttttcaatgactgataaaaagtttgaacatgcattgtatgatcgtatagcttacgttaaatcaaatgcacaaatgtttactgaacagttaagtgtcttcgatcatcaggatacgttagataaactaaaggtattaggtgattttgaatattacattaataaatacgctgatccaatgacattaaacagcgaagttcacgctttatttatcagcaatagcgacttgttcaatgatatatttgattacgcaactaaagtatatggaatgaaataccaaggcgttgtttggaaatcgtttggcttaattaatgatcatgaattgaaactggatgaatacaaattaattgattcaatcattgatttacagcaggaattaagtaaacagttcgtaccgaaagaaggacaggtgagcttatatgaagctacatatctgtcatgaggttggctgtcaagcattgataccaatggggcaaaggtattgcagtgagcacgttacacagcaccagaagcccaaccatgcagtcagttctgcacgaaaccgagagtacaatatgtactatcgtgatcaaacagcgaataagttttatcactcaaaggaatggaaaaagattcggcaatttgttgctgcacgagattattatttagatgcagtcactggcttgccagtctcaaacgataagattattgttgaccacattgtgcctagacgtgtcttaccagttgataaatggttagacatagataacttatggtgcttgtcaccgactacgcataatacgaaaaccaagattgaacaatcactcaatcaaaaccaactcaaacactgcagcaaacgttggtggattaaagtgttatctgaacgcacgaaataaacatccctgatgtaggaaactcctgtcagtttggatgggaataatttcaggggtaggtaccgtttcttggatggtggggatcttcatcaacagaattaaaaaaatgtctttgcgaaacgacaaagtgtttttcaggtggtatcatgtaggtaatcggaataaatatttctgatgaggtttacttattaaaaacaattttttcaacctcctctgggtgatatagatataaagaaaaaattgtttaaagcttactgtttgaatcttacaaaaaaatatacaatttaggtgaatgtttaaacacccccggggtggtgaaagcctaggggagcgcacgcccagcagtagcgcacgttaaaagttgtaaattcaaaacttttttatgggcttactataactgggtgcacgcaatttcacaaattgcttatatgaataaccctactataatgactatgtatatttccctcctaaaagttaatataattagacgttttttcacgattgtagggtgtatacgttcgaacagtgtgtttaatgatttttttgtgattcattagtctaaatgaatcagattgaaagagtccctattgggggctcttttttattgcttggaggtgaactaaaaaatgccaaaacaaatgaaactaactacagacaagcatgctcgcaaggatcagcgagttagaactcaaaaactaataacggaaacttctggaatggatttgattcaaaagagttgtccaaaatatctgtcaagttatgcgcgagcaatgtggacgaaacttgtaccaattttgcaagcatcaggatatgtcaaacaggccgacaagggaacaattgaagcgttttgtattaactatcaattattgcggaaaggctatgactcaattaaaacagatggtgttgtcaccaaagtttctaaaactgtggtcaatcaacgaactggagaaacatatgaagacaacgcaggctggaaacgtaatccggcatcacaaattattgattctgctacggcaaaattaaacagcttagcacacgaattaggcttaacaccatctgcacgagcctcattactgcaactctcagatgacaacgatgaggaacccaatattaaagagatgttaaatgggggaagtgagttttagtggtacaggaatttgattttactcaaagaaatactaacttggataaaatatttcagcagcttgatgggaaaggctactttgatgaaatcaaaagcaaataccgtgatccggccactgtttattgttaccgggtattaactggtcaacagttagcctgcaaaacaattaaactagcagcgtttagacatttgaatgatttaaagcgatccacggaaggtaattttccgtattactatgatttggataaatgccgaaatatctgtaacttcgcacgcatgtgccctgatgtttctcaaaacaagccaataccactgatgatttggcaacaagcaatcttgtgcctttctcagggatggcgaacaaaggaagacaagcaaaagcgatttgagcgatgtatggtttcagtggctcggactaatggcaagtcatatttattgaatatcttgatcctttacgcttacttggtcgaggctagtgaccagtttaacgccgatttatgttacttggcgccggttgataagcagtctaagaagtcttggcgttacattaaacagacttttaacagcttacaagaaatgcctggatttcgtaaattaatcaaggatcagaacattgcgattaatgatgatgttttgaaatccacgaagactcaaaaccagatattacgaatgacagctggtagtgcacaattagatgcctttcatttcctttttgccactgtggatgaatacggggatgaaaattttaattcggatgtgatttctaaagtcacgtctggacaagttcaaactagtaaccggcaaacattttttatcagtacggcatacagtaaccctaaagtcccgatgtatagtgatgttagacgactcactaaggtgatggaaaaagattctaaccgaacggaagattcaacgttggcattaatttggcagcaggatgatcaagatgaagttgagaaccccgaaacatgggtgaaaagtaatccattactagatttaccggctaagcatgataccctactgaaagggttaattagtgaacgtgattctaaactggaagatggtacgttaaacgatttcattaaccgtaacctcaatatgtggttgcagactgctaaagataaatatttgaaattagaggatatacaaaagtcagttgtttctgatttcgaaattgataatcaagattgctatgtgggttttgatttatcacatgcttcagatgatacggcttatagttttgtttttccatatttgaatggcgaacaaaagaaatatttcatcttgcagcattcatttgttccgttagcccgagcagataattccattattgtgaaagaaaaacaagatggaattaattactcaaacgcagaaaagttaggcttttgtgatatttcgcaaaattcttatggcttaattgatgaagattttgttgggcgctggttcctggattttgttaacgatcatcatttgagagtcaaagcgtttatttatgatccttatcaagctagcgcaattactgattggttggataataatatgccagaagtgccttttattactttaaagcaagggacggttagtttgagctcgcccacagtatttttgagaaatcagtttattgcgggaaatattgagatgttggctgatccgattttgcagacctgtttggtcaacgctgtaacagtggctaatccatatggtattaaaattgatcgaacggcgttgacttcgaaaattgattgtgccgatgctactatcgatgccatgtctcaagcccttttttattttgaaaatcctaatcatggccttaaagaagataaaaagaatccatttaatggaatgagtaatgaggaggtcaacgaattctttaccagtgattattttagcttttaatattttcaacacttgctgggtgatatatgtagtgaataaattattagggaggcagatagttgaatctgaaacaactatgggcaggtttaatcactaacctatcttttatattatttttatttgggttaattgcatttgtggttgccgcaagccttattaattttattgtaggttgggtagtggccgggattgctttaatcgttttagcctatgtcatttcgtgaaaggaggcgttgaatgctgaacccctttaaaaattttatgtcaaaacaaacacaaacaattagtaccaccgggtattcaccatttatgttaaatggtacgttgctatccactaacactgtggatgcagacggagcactgcaaaacagtgatatttatgcggtgattaatcgaattgcaggtgatgtggccagctgtgaatttaaaacagaccaatatagcaacatgctaaatcagcccagcacattattgagtgcttataatttttggcaagcagttagtgctcaaatgatgttaactggcaacgcctttgttctaattcagcgaaatggcaatggaagtccagcagggttgaccttaatcccgttttaccaggtcagcattactttagataatcaacaaaatgttctttattacacagttaattacggtgatgaccgagggcaggtgacatatttagctgccgatattttacattttcgcttgtttgtttctgggcaagttgccactgaattggttggtagcagcccgctaaatagtttagctaaagaaattaacatccagaattatagtaatcaattgtcactgagcagtttaaagaatgcaattgcgccaagttatacgattacggttccggcggccaaattggaaccggaagctaaagagaatattagaaaatcgtttgagaatcagaattctggttcgaatgctggtcgaccaattgttttggatcaatctgctcagcttgattccttacagattaatccggatatagctaaattattaaataatgccacgtttagtcagacccagattgccaaggctttttgtgttccagatagttatttaaatggtcaaggtgacgaacaatcatcaattgagatgattcgttctttgtatcaaaatagtttgagcttatacattcgaccaattgaatcggagttgtcgttgaaattgggaattgatataaaaatggatattaattcggctattgatgttgatcatcagcaattaattagtaatattactaaattaagtactggtcagtcaccagcattaacgccacaacaagcacaaacaattctgaaacaagcgggagtttttcctgatttgaaagtttcagcagtggaaggaggtgatgataatgacaacagtgccaattaagggtgttgtatctagtgatgatgatgccgaagtttatcagttttttggatattcaacagttactccttccgcagttaaagatgcgttaagcactgcaaatggtcaaaatattgttgccgaaattaattcacctggtggcgatgtgtttgcgggttctgaaatatataccgcgctcaagaattatactggcaatgtggaggttgatattgtcggactagctgccagcgcagcaagcgtcattgcaatggcgggtgatacgattaagatttcaccaacggctcaattaatgattcatcgggcttccactgtatctcaagggaatgcagatgatttatccagcgatttgcaggggttgaactcgactgatcaatcaattgcaaatgtttatgtacaacgaacaggattagagccacaggcggttatgcaaatgatgaacaaagaaacctatatcaacgccaaagatgctgttgaacaaggatttgcagatgaaattatgtttgacgatcaaccagccaaagttactaatatgctctcgccggttatgttgagtaatcaggcaattagtaaaattaaatcattgttaaccaaagtaaaagaaaagcctaaagaaactaatagccaaactagtgaccaattacgatcacataagttggctattttatttaagaaagaaggaaattaaattatggatttaaataagctgcacgatgcttggcttgaagctggtcaaaaagtaacggaccttcaagaaaagcgtaatcaaatggcagttgaactgaacgattctcctgaaaaatattcagatgaggatctaactaaaattgctgattcaattgataaagcaaagaagacccgagattttgctaaaggtgcatatgatgatgccctggcaactgctaaattagtaaagcctgataaaccagctgcaggtggtcaaaaagatgttacgccaaaagacaagcctaagtttattaatattgtcaagggagccttaaagggtgatccaaagtttttgaatttgatgtctagtggacttgatgccaatggaaacggtgttggcttgacaattccagaagatgtccaaacggccatcaatactttgaagcaaacctttacgtcgctggagccattagtaactgtggaaggagttagcgcaccgtctggttcacgagttattgaaccacgtcagtcggtaactccatttgctaatttggatgatgaaacagcgcaaattggtaataacgatgagccagcatctttcaaaccattaacttataaaattcatcgctatgctggtatttctagcattacaaatactttgatgaatgatagtgatgccaacctcttagcatatttggaaaactggattgccaagaaagatgttattactcgaaacagtgaaattttaaaagcgttggctaagttaccaagcgcacaaaagaccacagttgatagctttgacgccattaaggatatttacaacaaggaattggacccattaatttggaatgaatctgcctttattactaaccaatcaggctttgctgtcttggataaggtcaaggataacaacggacaatacgtcattcaacctaacccgcttaatccatcacaaaaaatgttggctggtaagacaattacagttattgccgatgcatttttgcccaatgatggaaacagtttcccactttacattggtgctttgacggaagctgttcgtctattcgaccttcagcagatgtctttgttggccaccaacattggcgccggttctttcgaaaatgacttgactaagattcgggcaattgaccgcttcgatgtcgaattgtgggataccgaatcggtcatttatgcaccatttactgggttggcagatttaactcctgctgcgaagactagtgggactactagttcaactggtaagtaactaaaataggtcgccaaagaaatacacaatacagtgatgggcggctgttaggaggggtgtcatgtgacggttaatccgacagaattaatggatgagttgcatattgaccaaagtccgactgaattaacgactgttaccaatttgattaatgaggcaactgagattgtcaatcattcagtcagttcatccgaaacccaatatcaggcctcatcaatttacgacttagcaataaaaacactggcaactcaattatattatgatcgtgaattatctagggggatgtcggctggtttgttgatgatgctagatcaactccaaggaatggtttcaggaagtgatccggatggcacttaataaatttagtccggagcagtttaatcggcaagcccagtttggaatggctttaccaacaattaatcctaatactggtgcatcaggaacgcaatttaaaccacagttcgtgttatggtgcatgccttatacgcgaactaacacacagaacgtttcgcttttgggaacagattttgaagatactattcaaattgttattcgacacaatccgttaattgacaaaggtctgctagttcaatatcaagaccaactgtatcaaatcgttaatttgagtttagatgatagcaataaaattgtgacttatgacattttgactctacagattaatgagagggttggtaaaaaacatggttagtatggccgaacaattagacgattatttagcgaaaataaaacgattggtacccaaccgggcggaaagaactataatcactaaagccggtgccgatgttttacaaaagaaattagctgatgaaactaaacggctacattatagtaatcgaattgctaccggaaatgatcctcacttggctgatagtgtattagttagttcgaaaaatattgatggtgatgtggatgggacagcgacagttggctgggtcaagaaaaaagcagtgattgctcgctggctaaatgatggcactgtttacattgtcggtgatcactttgtggaaaagacccgtgaggaaactcgttctgatatattaaaatctgaatatattaagtggaaggagctgggtcactaatggaattaccagttatgactgtttatcagttaattcaatctttgcactatggttggattgaccagctttattccatgaacattcctcccggagctgatacttctggaaagcagaccattgtcttgattacttccattactgaacctttaggcggatatcggaacgatcaatttagtaatatgcaagctaatattcaagttcaaatattttggaaaaaagatacacaagaaaatacttttaatgaagaagttgccctaatgaataatttggaaaatcaggattggctggttagctcacatgagcctaacactgtggatccagataccgatcaaattacggcaactttttcagtttctaagacaattacaatgaagaaagaaggattttaaatgtcaacacatggtattaaagatgtcacctttgggttagttgatgcgactggcaaattgctcactggtgatgcaggagtaggaactaatggtatctatttagttgatggcgatgctaaaggcgctacgacggccacagtttctggcttggaagccgcgggtactgtcgcctatgctaatgatgaagcaaaacgagtttcaaatggtcaggcacaaccagaggtcgcattggaattcttggatattgattttgacgagttgcaaaaactcaaaggatatattcaggatgcggctaatggtggttggacacgtcaattgccaaagccccatgtagcaatgttgttacattttcgttcatacacgaacattgatatgtacgaaggctttgctaatggtcaactaattgaaactggtagttctcatgcaacggataataatgctgaaactgatgccaatacggcgttaacttaccaagcattaacaccggctgacaataccatcttcaacggagaaccgtacaagatttggatgtctcaagatgctgggttcgataaagccaaaatgttagcagaagtttttggcggttattcagcaactaccggtagtagcacaactggttcaaccactggatcgactacgggtagcgccactggttcaacgactggcggtacaacaccaggaaaataaattaaggcggggattgttccccgtatacataactaaataaaataaaggagttttgatcatgaaaattaatattacaaaattaggtttacgtaaaaagtcagctgaggttaagactactgtaggagtcgttgagaaagcacagaatttacaaattcaattgctaaaatcggattcaattgactttactaatgatgacccactagcagttttggaaacgcaaaagaaaatggttcaaggattattgcaatttatgattgatatttttaagctatccgacaaagaagttgaaaagattaaatcaactttggacttcaccgactttcaaaatttcatggcctatgtactatttagatttcaaggaatgagcgatgaagattgggaaactgttactaaacaacaaaccgaggaatcagcagacccaaaagaaaacaattaagattagccaaattaattaatgacctaagcatatcccaacaagatatgcttttttttaaacaacaaatgatgaaacagggaatcttaccagatgaattaaatcgacaagattactttgagtttatggcagtcttaaatgctaaagataagaaaaaacaagttactgatccggttgtcgagttattaaataaacgaaaggggactgactaatggccacaattaatgatgtaatgagcacttcaattcgcttggatgcagtacaacctacacagtcattaaaaactttaactaattacattaaagctaatactaatgcatggcgttctcaggaggtggccttaaaatcttctggagataaactagatgctttaaaaactaggtatcaaggaatatcagaagaaatcaaaggttataatttgaaaattgacgaattgaaacgtcgacagtcaggccttgatcaaacaaccaatcaaggttcagaaaagtatgccaaatatgctaatcagattgccaaagcacaagagaagattgctggtttaaatgatcaacagtctaaagcggaaaagcaatttgaataccttaattcaggactatctggattgcagcgtaactatcataaccttaatcaggtaactaattcttatgtggatgcgctaaaggctcaaggaaagattaaccaggctggtcaagtaaagcttaaaggccttaaggaaggattgaatagcttatctgatcagtacagattacaaaataatgaactcagtaaaaattcacaggtttataaacaagcccagttggcctatgaaaaacaacaaaatgttgttaaccgcctcgccaatgatacccacaagaatgcggatgaatatgcccaagaaaaggagaaacttaatcaattaaaaggtagcttggacattgctaacgaagcttttaacacccaacaagtacgagtcaacaaaacagctgcttcactagctaacgttcgttcagatgtggttaaatacgacttacaagtcggccacatgagtgatgccatggctcggatgggtgacaaagccaacgttgctaagaataagattaagaattcatttggatcaattaaaggtagtttactaggtgctagtgtagcgatggggacattgggagcagctgcattttctggtgctaaaaaagcgactgaacttcaaaatgtttataaagtaaaccagaacttgttagttacgggtggtgataagactaaaactgccattaagaccgtgaccgaaatgcaaaaagacgggactaagtacgctcttaaatatggagttagtcaaaaagaaattgctgatcaataccaggatttaatcaagcgtggtcatacaggagctgagtcgttagcggttatgaaaactgagctacaggccagtgtggcttcaggtgacgactttaaagatgtggttaaagtatcaagccaggcgattgaagcatttggcatgaaaaccaataatacggcaaaaatgatgcacaacactaaacgtgtagttaatgcattagcttattctgctgacatgactgctactgacttccacagtttgggcaaaggcatggaatatgtaggcgattcagctcataatgcgggctttagtattgagcaaacttccgctgctttaggtgaattaagtaaccacggtttggaagctgataaagccggaacgggtctacgaaaaattattactagtttagcagcaccaactaattcagctatgggtgctttgaatgacattgggattaaatcaactaaaatattccaaactgccaatggtaatttcaaaacgttgcctgcaatttttaaaattattgaggaacatactaaaaaacttggtggagctgatacagcacgcatatttaaaacgatttttggccaaactggtatgcaagcagctcaaatcttagctagatataatggtcagttagctgatttaaccaacaatgtttctaaagcaagcaaagctgggacttacgttcaaaaattagctaacaagaatgcacaaactgcccaaatgtcccagaagcgattcaagcaagcctgggatcaattatcaattatgtttgggtctaagttgttgccatatatgacaaaagcagctaatcaaatgaccaagctctttggtgaaaaaggctttcagaaagatattggtaaaacggctactttaactgcacatgtggcaggaggaattgccaatattggtatttttgctgttaagcattatgaaggtgtcaagcgctttggtgaagcattaactgcaatttgggcagttggcaaagtttataaatactttaaaatatttagcgaccttacttctgtttttagtggtcaaaaattaaaggtgaaccgattgacatcagcctatgatgatcagactctagccattgaacgtaacactaaggctaaagaagccaatgtggatgctgggaatgaaactagcaaagttgatgatattgctgataacgctggtggtgaaggtaaggttgccgaaggtgccgaaaaagatggtaaaatggccatccacgatatagatgatacaagtaaagttgccgaagataccggaaagataggccgattcgctaaattagctgaaaagtttagaggtgttagcaaattcggaaaggttgctgcaggctctgtaggtgtcttagacgttttaaattcagcaactgatttaattggcatgaaaaagaagactgccggttcacacattggcgctgctaccggttcattaggtggtactgcagcaggtgcagcaatcgggacagctatttttcctggaattggcacagctgttggcgctggtttgggtggattggttggggaaggcgttggtcgtaaattcggcaaagctatccaaaaaggactatcggctcaaaaaattcatgtaccaaaactatctgccaaatcttctttcaagaaactttctgatgaagcgacaagctattataaaaaccgtgaggctcaggacaaaaagaatttacagttactttataaaaacggggatattactaaaaaagagtacgaaaaacgcctacaaattattaaagatgaaggatctaaagccaaccgattaactctgatgagtcaaaaggatcagcaggcaattgccaaatattatgcgcaatcacggcaacgactaacgaaatcatggaatgaaaagattttaaaagctgagaataaatacggtaaaggatccgttcaagttgaaaagctacaggaagaaaagaaagaatctcttgaaaaacaacatcttaaatttgctacgaaagtaactgctaaggaagccgaactgcatactaccttagctggccagattaaactgtctactaataagattgctaaagattataaaacgctcactgaaaagagtaaaaaatattccaaagaaaaaatgattaaattggtggctaatgctgatgaagaacaaaagtctgttagtaaaaaagccaacgatgaatatcatagtgtctataattcagcttggaagaaatataaaaatacagttaaagcagcggacgaagagtataagggaaatagttcagctgccaaagctcaacgccaaaagattattgaagaagctcgtaaacagagaattggtgtaattaatcacgccgctaagcaaaaaaatgattcaatcaccaaagccaaacagcagtctgacaaagtgtacgattatgcgcataatcaaaatcaaaaggtaacagctcaggctgtttctcaatatgagaacattaagaaaaataattccaaaactaaagacaattacagtctctcctggcatggcatctggaagtcagttggtaattggattggaaaattagttaatgggatgaataagaatgccatttcagcccagaataaggtctttaaacaatacggtggttcacaaaccttagaccagattccaacggtagcttgggcaacaggtaccggattattgaaaaatggtttattaacgaaaccggttttggctaagcttaatgatggccacgattcaccagaaacacataataaggaaatcattgtccacgcagatgggcaattagagccagttgagggtaaagatactcaccggtttctagaagctggctccggcgttttaaatgcgacagagtccaaaatgctaatggctttaaatggtatgcaacactttgcttcaggtaccggtttatttggtggtatcggcaaattttttaaaggcatctggggttctttaaagcagaagttgtcagcgttatctcatattgctaagcattctgatgcaaccttcaaacaagtttttcaacctaattttggcgatataaagggaacagttgggaagaactttgccaatatgtttggcaaacgtgacaagcaacagggttcggtttggtgggatactgcctggaatatgctacacggcatggtttccgaaggcggcggtcagactgattcagcatttttgaatgaagctaagaaattggcaaatcgtgcccatcaccgatattctgaaggctctaatgtccgcttaggaccgaattattatgattgttctggcttagtttatgagactttgaaacacatgggaattacagttccaggtggatctaccacagtcccggagtataaatactcaaaacccgtatcgtggaagaatgctaagactggtgatttggctttcttcggtgctggaggaagtcaacacgttggtattgtggttgataatagtggctctgggcatatgttcagtgccgaaaatccaaaggacgggattaaatattctaccatcaagggattcggtgattttgttgggattcgaagagtgcctggattgattgacaaagttaaaaagtcaactaaatctcataaacaaagttccggattacaagcactagtaaagtcgcaattaaagcattccggggtttggagttgggtatcaaaaaacttaaaaccattatggcaaaaattgttcggtagtttaagcagttttggattaagtggcgatgtggcagctagagctaaaaccttagctaaagcattgaaaaagctggatccacgcgcaactaaagcaggaattgctgcaattcttggtaattgggaatttgagtcaggattaaatcctaacgcaagagattcatctggtggagcttctgggcttgggcagtggttaggtggtagactgaatcatttgaaatcatatgctcaacgtcatggtgaaaactggcgcaatgcagctacccaattaaagtttgcgttaagcgatgacagttctgattcttctgtatttaaacgaatccttgagggtcatggttcgattgcttcgttagccagtcaattttctgaagattgggaacgtggtggctatacggggcaacacgttaacggtgcgaagaaagttgctaattatttaggatatgcgaatggtggcttagttgatcaagaacagttaattaaagtagccgaacgtaacaaaccggaaaccatcattccgtgggatattaataaacgaggacgagcctatgaattgctagctgatactatggctcattttaagcaaacagatcagcacaccaaccaatcaagcaattcggatggtcaggctgtcaaaagacttgaagctaagtttgatacaatgattaaacttatgagtcaattggtcgatggccaaaacaatccgattccggcagtagtgactgacaagcaaattgttcaggcagtcaataagcataacaaacgaacaacggctaagaataattggggaagaggtgtaacctttggctaataacgataattatgatgtaaacacatttgattttgcgtttgatgaagatggaaatggtggttttaattcggaagacgatttaggcatatttctaaatcatgtatcgaaaccgttagcccccaatattactgagtcatttcaagacgtccctaaacgttatggtggtgtgtacttgggaacagattacggtgaaaaagaatttgacattccaattacctgtttctgtaccacccgcgatgaatataacgaacgaattaaaacattaactaacgttttagttaataccagcagtgatgctgatactgaatatccgttgaggtttaatgacgatccagatgtaacttattatggacactttacgagtattccaacaccgacatttattaatgaaggtgttcaggattttcaaaccacgttagtcttcatgctggcggatcctcgtggtttcctgccgcaaaaagaaataaaaattacggacaatgatcagcaaattattcctgaaggaaatacggaagttgatccaattattcatattattccgaaaactgatctttattatgtgggttatgaaacaaatgatgactatgtagcggttggatataatgttgatgacggtgatacgactacggatagtgatggcaacgtcacagtcatgggacaatcccaaactcaacaggtagacgacccgtgcaactcattagccacgtggattcaatgtagcgaaaatacgcaagcctttccaatttataagggcgagatagatggaagctcagcggccaccggtacttcaattatggtggctaaagataaagatgaccattatgaatggggcactcgtggtaaacacaagaacttttacggcccagcagttatgcataatggcttacctaagataactccttattggaaagtttcggtgcgtttgcatcatgttaaacgaatgaaaaatgagcgggcaatggggaaaattgaagcttatttattggataataatggtaatgtttgtggccggatggggattgaagattactcaatgggccgttacccacgggcgtttattcaattaggtaataattttgatagtagtaactctgatagttatttgacattgctgtttgatgaaggtaatggtcagcagaaacaaaatgaggctaccaagcatgttaaagttgcctacaccaaaacagtcaccgttaagaagacgactaaaaagaagaagtgatataaatgaatctacaattctttgctcgaaggaaacgaaaaactcgtaggaagactaagactaaaaagaaacgagttgtgaaatctaaaaagggtggcaagaagagtagtagtaaagggggtaaaaaaacatcagctcccaaagctacaacaaagaagaaaaaggaaaaagaatatgtaactgaaacctcgtatatgaataaggatgcctactcgaatttttatggtgaatttattcttgaacgacagaaaaaatcggatagttcggggaatgtttacgacaactgggtagcagaaattaaccagtgggatcctaaaaccggtgagccatatagtgttaacaatacaagtaaaactcatatgcataaggaaaagttggataaatccggtaagtttggttttgctttagccaacttaggcgttttctttggtaagcatgatattaaagaggacttagttaatccagtggtggcgtataagtcagattatgaagctttaaccaattatgaagaatggcgcagtgatggctctactgatccagatgatacaccacatattattgccaaggctggtcaagaaattattattgatacggccaacaataaagttaccattgatggaaagccggccgataaatacgtttcatggttatcgacttttcctaaattaactggtggagttccacaaactctacactttttcccggatcccaaaaatgctgatgtaacaattgaatatcgaccagcaattaagtagtcacgaaagcgactgctttttttatacataaggaggttagagatttgtatattatcctggataaaaatttaaagcgagttgctacgttatcgactaattcagacgccaacccgttttggggcgaagtagttgaacgccaaattgccgatgataacagtaactcggatgatggcattactggcgttagcacttttaatagtacggatccgaatgctaactccaaaagttggaatgatacattaacaggactaaccatgttgcaaagtgcccctgcggctcaatacttaacggttggtaatagtgtcgcagtgtatgatgatgtgcataatcattggcgtatttatcgaatctatcaggttgacgaaaacattgatgcaactagtggagctcatctggtaacggttgatgctattaacctagcaatctataaattaaataagaccattccaccccaaaaagaaattaaagattgtaaattagatcaagctatgcaatggatcatggcagataccggttgggatttacaaaataattgttcttcgggattatttgccgatattaattttgatggaacgtcttctagtcaagctgccttacagacggttctatcaacttacgatgcggaagctgatgcttattgccatattgatgcaaacggtattgtgactgatcttattttagaattggctgatcaattgggtgaagacgaaggtaagtcaattacctatgggcaaaacatgctatctgtccaacgagaaacagttgatactaatttagtaaccaagctttacattgtgggcgcaaataatgcttcaattgcctcggttaataacggcaagaattatattactgacgtttcagcaaattctctttataacactgatcagaacacctggctggaaggaacgattactagtgacactattactgaacctaaagcattacttgattggggattacgcgaattaagattgtacaatcatccacgaattaactatgctgtggaggttactcaagattttcaagctaacttgggcgatactattaaggtgattgatttatctatgaacccaattttgacaacggaagcgcgagtcattcaacaaaccacttcggagagtgatccaagtcaaaataaagtcgtcttgggagagtttagcacagttaaagtaattacgccggcgtttatccgtaatatggaacagcgttggaatgaccatgttaagaaactgtttgaagaagcccgagagaatgccaatgcagccacagtcagtttgattacaccattaggttcaacttggtataacacggatacttccaaacgggtgattgcgagactatttattgaaggcgagaatgtaacttcttatttgtcaccgcaagcttttaattggcaaaaaattaatatggatggcacccgtgatattggctgggaagctgaccatgcaaaagatggttatcaggttactatcgaaccaccatttgtcgggacactattagtcaccattgatgatacttatgtgaaagatgaggcagagatgtggattgataccagcaattcagctgatggttcctggaataagctttgggaaactaaagatgccgccaacaaagattttaatggcgatcaacatattggggccttacaattttcatatttattgagcgatggtttagtgttgtctagttatcactacactaaagacaaaagccattcagattgtgaatttattaaatggaatgccgatggaacattacaaagcatgatgtttgtaactggaggtggtcattgcggatcgtttggctatgatgaaagttccaatacgatttatacagaaataaaagatccgattgatgggaaatattatttggtaacaatgacataccaagccaatacaagtgctagtaatataaccaagtggtgccaagtaaaacaatattttcgagttaacgttgatttgaagaacaatctgtggctgggaagtacgacgagtgggaaagtgtatgtttgtcagataagcgatttgcaagctggaaactttaatcctatcattgaatttaatctgcaagactttggctggaaaccattaccagctggaaccattaataatggcacttataatactctccaagcgaatgggattagttatccatttgctttttttacggcgggtgatactaacaatgctgatgacaaacatgttatgtgtattaacttaattacacagtcaatggtatttgattatgtggtggaaccaatgcaggatattaagttaacagtgccgttggaaaatggcggtcatttggagccggagggcatatatgaagatgttaataattctaggttaattgttggctttaacgtttctgaatatagggatgctgcacatactgtctctattgctcatagtgccctatatacagctccacttggaatccgtgatgattctaaagacttagttgttgaatatcctgaacaagatgaaggtgaaaatgatgaagttgaacaaccagtaattgctggaaatgataatgcggatgattcggatgatagttctgatagtgatgaagatggggatgaatcaactggtgaaggaaccaaaattgaggatggtgatagtaattgattattgcaacgggaacattgaatattgatgaaaatgctaagcttgctcaacaagcctctgacgatgcaaaaaatgctgctaactctgcagctgatgaagcaggtaaaattaaaacttctttggatgggaaaatcactgtttcatcgcaagagccttttgatgatggtaaaagtcatgatgaaggtgatatttggtacgtccaagacagtaaccatataactagtgaaatgtacacctatgatggatctgattgggttaagactaagatgtcccaaacagccttgtcagttggccagctttcagcgttatctgctgatttaggaaccattgaagccggatatttaaattcggtagaaattgattcatcaatcattaaagctgcgaaaattgatgcaacttcaacaattacaggggcatcaattgaggaagatggtaataatggaaggatcacattagacacaaacggtttttgtgccattagtaatggtaaatatcttcaatttgtatctggaaatagtaatgggtacactcaaattcgtggtggcttggatgttgattcaattaacgttggatcctcaatcattgaaggacaaacttttcaagcatatggcggcaacaatactcatattggtagtgaaaatgcatggacctatttggcagaaggaattaaatgtggtcctggaggttacatttcatcagtttcaggaaccgatatttatttccacaatgaagctggtacgacgattgatcttcatgctggtgatgtcatttcacatggaactaatttacttagtgaaattaataaaattgaaaataaattgaagatgtaaggtgatttgatgagtaacattaacgcacaagatttaattgaccaattggttaatgagtacagtcaagatatggcagcaaaaaatcaacaaattgcgttattaaaaattgaaaataatcagcttagaaagaaggtgaaaactaatgagtaaggagctcgcattcacggatgataatgatgtggttaaatatttagatacaaccactgcttttaatctggcactcacggccgacggggtggcctttgatttaactaatgctaagtcaattctggtaaaaatagctaatgacgatggatatatcatgcaagaagctattgatttaaccactgtaactagtccgcttggtggaacactaagctttccaattaatcagaatatcatgaacacattggttccagacgattatgatattgaagtttgggttactatgaatgatggtacacaggctatctttccaagtgatggtacattaggcttttcaattgaagagaacctaatgagtgatactggtgaagtaattccgacaatcactttgaatgactttcagcaacaatttgatgatctaagtagtcaaatggagaatgcagtccacaatgtacagaagggtgaccaaggtaaccctggtaacggtattaaggctgccaataaccagtatcagttaagcgattcaccagttacagttcccacagggggctggtcagatactattttggcaacaactgatcaacttccttatctgtggactaaaattatttttacctacgatgacggaacaactaaagaaactaattttgtttccagccgaggtgataccggtagtcagggaccaattggaccagtgggaccacaaggaaaacaaggaaatggtttggttgttagggggaaagctgataaagaggaaaatttacccacaacgggtaacaaccagggtgatggttacttagtcggaacggacttatatatttggatagatgattcatggcaaaatatggggagtattacgcctgatttagctgattatgtaaaagtggctgatatgaacaatgctttaaacactaaagttaatgttgctgatatgcgtaaaccagctagcgatgtagctggaattgaagaggttagcgccaaacaagataaaattggttacacacctgctgatgatagcaaagtagtccataattccggagcagaagaaattggtggtccaaaaacttttgacattgcgccaattgataaggcaacgggtaatccttatatcacaaaagatggtgttccaaccaactatgcaaaagacaataatgacggaacgataacagctaatggaactatttttaatcttttaaagtctttaagtgcttcatcgattcctcaagacccaaccaaagactacaatactcttccacaaggacttgctttgatgtcagaagttaatggagaaccggctaacatgcctccggttaaatcaacatatttgacgctgacaatcgcttctagttttgcaaccggccgtaagcgtcaactggcatggttagacgcgggtgctaattcgtctaacaataattacacttatatcagatactgtgttgggagcacttggtcatcatgggattcaattccaacaagtactcaaataagtagccttattccatctactattgccgatactacgaagccagcaaacttcactgatggacttcaaaaaggtggtaaagatgttgccacaaccacagatgtcacgagtgctgttaattcagctacttcaaatgtagttacaactgataaattagcaaactttacagcaggtttgcagtctggaggtgtttcagtcgctactagcgacgatttgaaaagcgttgaaaattcggcttggcgtcagctaagtatgccagattgtaatggcatgggaggaattacacttctttatagaaactttatatcagatcattacatgaatttatacgcctatggtactgcaattaactcaaataccaaaggaccaaccatgcttgacttatcttcacttattgacaacatagaatccgtatcaggagtggcaagggatcttgagtctgatggatatcacattttctctagttcgtcaagtggacggtcgggctcagtagacttagtatcatcaggaaataaattgacactggatgccaatattatgattaccatgagctcttttatgctaattatcggagatgattcaccatttgcaaaagtaaaatacgacaattggattggctcatagttattgaacaatgataaaaaaggagataataaacaatgtttatttatgttacgtttgattcaaatggttttgtcactgactataaaaaagtcgaaactgatggttatacaaaggtgttcgttttagattcatggattaatcagttcgctcaatacccagataagttcagatatgattcaactactcaaaaattgcttaatccaggtaacttaccaagcgtttcattggatcaagtaagtacagatgtaacaactttacaaactcaattaaaatctttgcaatcgacaggtactcaaactgattcacaattgggaactttggtaagtaacatttcagtggttcaaggacaaattctcggagaactacaaaatattcaaactcaattaaatgcttctgaaaaagcaactgctgtaccggcagcaaatacaactaattcaccagcttaataaaaggaggtaatacaatgtttaatattgattggcacggaatgcttaaaattgaatatgataacggttggttatcttatgataaattgaaactgttcgttggttggaatgaattaacaaaagatcagtttactgatattactggtaagaattatgacacaggcagcgttgcccaagtaacaagctcatcataacgattactcagtttagtaaacccatatgtgatctcttggcggaatgcaagtttaattaaattaaagtccgtcactcttttggaacagtggtataatcattttcgtaggcattaacccctctaatgcctatgcattcgaacattcatctgagtatttatgaatggcctcatacttattgttcatgcattccccctcaatatgtatgataccgacagatactcacacgcccgtcataagatgggcgtgtttgtttttaataattagttgttacgactatataatcgtgatacaatgcgtttgtggaattccattcctccaagaaggaatttcatgttcttcaatatgataagaattgaggacgccctttaaagcggggcgttttcttttacacaaattttatggaggttgtcttatgtatacacaaatattaaatattttaaattcctttaaagcaaccggattggttgcttttttaattgctgtaattccagcaacttacaaattggttaaaccgttgattgaagctaaaattaaaactgaaaagaatactcatatcaagcaagggatggaattaggcttgaaattagcgaatgctttcgttcctgtggtggcaagtatgcctgctttaagtaactcagatcgcaaagaggcggttaaccaatctattgattccaatttaaaaaattccggctttaattttaaagcagaaacaattgaaggattagcagaacaagcttaccagtattataaacacactctaaagggagataatcacaaagcacctgttactccggcgcctacaaatgacgttacgtccgacgttccagtcgatgacgatccggaagtatttaatgaaccccaatctgctcaacaaaaataggaagtgacgaaaatgactaaaaaggttgctgatttgtctgcgtatcaaggcagttctgagacctacatgaaatctctaaaaagtcacggaattgataccacggtggttaaattgacggaaggcactggatacattaaccctaaagctagagaacaagtggctaacggattcaaagtatttggtactgtgagtgtttatcatttctttcatggtcatggttcatcagaagctaagtatttcttagcttgggttaaagaatttggcttggataaatccacagtcctagccttagatgtggaagcacaagacttgccttggaagaccactgctgaagtaaatgtctttttaaagcagttaaaggccaatggattttctcatgttattacttatggatctggttcctggtttattgaaaagcggattgatcgaactgaacttattgataaacacatttgggtagcagcatatggtgttaatcaaccaggaattgataatgcgaatgcttggcaatataccgataactatgaagggctaagtgtggatgccagtttagattttgatggttcactatccggaagtgggatagttattaagactgctaaaccggaatattatcaaacaccgggtttatatgaagcaacgcaaagcgtaattcaccaatttaacgatgccgaatttaagtctaaacggcatacccgtctgattaaaggaagccgattttacgctacgccaattaaatatggtaaaatttatcgactttctacaccaactggttactatacagcaaacaaagataaagttagatttatttttgcagtgaaggctggtggcaaataatgacggagattcctgatgaaattaacatgactgaaatgctgataggcattaaagaggatatttcttccattaaacagcagttaagtgaccaagcagacttaaatgaaaaagccgataaagctttggctaagtctattgaaaatgaacatcgaattgataatttaactcacataaattatgcattgatttctttggtggcagcggggattcttgtgccactgattatctatttgatcgagaaatttatgtgagatgaataacctctgggcgattccagagatacatagttagacattggtatacgttaattaatattatttttggcttttaagaaaattatgcataccataataattccttatggaactatcacttttatcggtgaattaacaaataacgggcaaataacggtcaattaaaattataaatgcctttatatcaacgtttgtaaggggcacttgtgcctgcagtcggcataa

SEQ ID NO: 191 - DNA, 13211 bp, Lactobacillus buchneri
ctcataggctttcttaacggttcgataatcaacattatattgccgggcaatctcggcgaagttaggcttaatattttcagtcacgtaaatcgtcactccttctcttaaatcacgtctcacatcaaattcctcctacactctgatgtgattcatgatacaaaaaatgtaggaaaaccaacagttctaacctgccgttttcctacattttacgggtgccttttacaaaatgcccaaataaaattgatgaggtggcaaatatccttcaaagataaagatgatactgtttctctaataccttttgataaaagagatgctctctatactcaaacagcaatagaagatgtactaaatccaaaagccttcataaaggccttaacagacacggctgctaagttcaacattagttttaaaaaaatttctttgagctctgacggacttgtgtcacatctgtatgatgccgaatcaaaagaactttcagcaatatcctacaatggaactgatttgcaagatgtaatcaaaaaaatgcacgaattcattaataaacacaaaggagctatagcttggaagtataatgaaatatacaagtcaatgacattaaacaataaaaaggatcttgtaaaaacagctttaaagaaagccttcaatggtgatgacactctttttaacattgctaatacttcaaatacaaaaaaagatccttcttccaataacaatgactataaaaaagtaactataaaggatatatactcttcaatgtcgtttacaatattggattataaagacaaatacgtgattccaaagggtatgatgattgctaaagttaggagcaacagtgttccgaataggttatcattattactagatgaataccagaaagaaaacaaaattattaattacaagctcaaagaaagtattatctgggataataaagatttacgggatatcgctatgttcttagttggacggcttattcacaaacaaagtatcgacaaatatattcaaaattaataggggatcataattgattaccggcccgtggagttgtataagttagattgacagaacgttccctctctgacatgtttgaagaaggttaatgttaggatttcaaggcttaccgctattttccgtacgaatgttccgagccaattatgaattagatctagcacaaaaattccaaaacgccattaaatcaacgttttggaatttttatttgcgggcctaccgctaaaattcgtatggctgttccattgacccctatttcagtgcgaacacacaagagtgtactagtgcacacattagtacaatgattaattacttagttttttatgtttttgaaatacgtcacgttgttctagggtttcgattgaagtctcaattccgcgacgttcgtctttagaaaacgaatccagaaaataattcaacgctttttcaatggaatccttttgtgattttgaatatccatttattgcaattgcttcagcaatattttttatgtggttattaattctaatattcgcgtaaaaagttacacttgaaacattatttttagaagataatgttttttcttgagtctctttctttttagtttctgttagatcatcaagcgtgaattctttttcgggcgtaatttcatgacctcgatcaagtggatcttttttatttggattgttaataaggctcataatgactcctccgatattctgcttaataattcatctaccacatttttatatacttcctgaacagctcgatcaaattgatctttaaaggtaacaccagtaacatcataccgtttaagccgttccatattcttaatagttgtcttaaacatattttcttttccaaacattgtttcagctttggataatgtgcttaggtcaaccggagcaccattctttaaaagaaccggtaaaataccagcaacatctaaagttggtgcatgaaactgattaattaatgtatcttgcaagtaacgaataaacgcctcggcaccttgtaaagagcgttcttgggtttgtaaaacaataactgcgtagtcagtagcatataatgcgctgtcggtaattaaacttattgtaggtggaacgtcaatcaaaatataatcatattcacccttccactcactaatcatttgtgataaatacttaacgcgctcactataatctttttttaccgtttccatgtatcgagggtacaaagcaaaatcagcagatgacggtagaacatcaagattgtcgactatattaattattgtagctttgatgttttgactttttattcctgccattaatgtttctttaaaagttaccaaatcacctgttttattttctttagttttaagataaagatttgttgcatttgcttgtggatcaaggtcaatcaaaagagttttataaccccttcgagcgagttcaattccagtcattgtcgaatttgtggtttttccagtgccacctttgaaatttgaaaaagttaaaactgtcgtcataaacgctctcccctttttattacatgtatacattaacacttagtaagggtgaaagcaatttaattagtacaaatacacatgtaataatgtatacattattacatgtgtatttttttacatttttacaattatacattgttacaccacctaaataaacgctgctataccggtatttatcgccgtatatttgtatacaaatactaataattacaaatatacatttacacattagtatttgtaattatgtggtaatgtatacatgtactaacattaaaatttaccgttgctattttcagttcattaacttatattgaaagagtaatcaaaacgggttacaaattgagtataaaaagaaaaagaccgctgaatgggagttcagcggacgacgtatttcaaaacattccaatgtaaattacgttgtcattatagctcaaaaaatgtctttagtcgagtgctattaagtgtacccttttttagtcctcaagcatttactattttgcctttttctttgcattggttgaacagtaatctgctcgaggacttttttaattgcgattaattaagtccagcccccatcactcgggcaaccgggagtggggagagccacaacttaattattgacggtagaagccaaactaccgtgttgctaattgaagcgatgaagggtcttggacttattaagggaatgacggcgagctgcaccttaattgacatccgctcaaggaagcccggcataaaaatagacaggtcacgtgagagccgccgcagtaaaatcccactaggccattcagtattactatgttgctgggtggccgaacgtgtgggctacgtaatgaacggtggttagacgggcgctgaaatgtgccggggctaatcgcatgactgattaccgaactaataaaaatacgtgtgatcagggctgatgagggcgtctattcattggcttctccgaaaagtaggagaacggcggttagtggagtaaaatcccaaaatacatagtcaactgacgggcgacggacgaccgacggccaaaaggtaagttgattttgattctcttgaatttatattttcataaaatcaaggggcaaaatctgccctcaaagcttaaaactctctctagccaaaggggtcagtcgcgttgctcctttgcaaaatcaaaaccgccaaagaaaagttcaaaagataaagtcaagttcaaaggactaggttcagttttgctcataataagcgataactagaaaaagtaaactgatccgtgcggttagtggagttaagaagctgtccaaaggttcgctagtgcttggatttataggtgattattctgttttggatggagatttattaacttggtacccgtcagttactcactgagttggtggacccgtttgtgagtttggtggcgatagatttgatagatcagttttagttggtgatcctgatcgtggtagtagttgtaagggttgaccgtaaagtgttggagtttccggtaggcggtccggttgagtttaggtttagctaaacctttattctcgtagtcgtggggggcagaggtggccttggcgactaatccgggtgtattggtaatggttgaggttaatggtgccttgaccattgggcagcacaaaactaagtcccagtaaggccaggattagcaggctgaggatgatttggtaaccgaggtcatcggcgaagaatttgaggaggccccaggtcaggagggctagtgtcaggaggcaaaggacgagcccccagatggtcagaagaaaatggcccaggaagtatagaatggcaatcacaatagcggcggcgatgagaaattccatgagcagctcctaacggacaaagagtaacaggacgagtaaggcaccgattaacaccccggccaaactggcaaataacatgtgccgccagagaccgtttctgatctcctgggttgcggtcatggtttactgggtttctttaagaagctgtccaagatctatgattttttacattgaagtatatcaaaaatcatagatcttggacagcttctaaataaaagtgatatgtaatcgttgtacttttacgattgtatcgaatcgtaaactgctttattaatcaaaatatgttaaactttttctaatgtttctctaatgtttttttaaatgttgataaatgaggtgataacaattggacgaatataaattatatccagctggagactgtgcgattaatgttacgtttagcaatcgtgttgacccacagattaatcgttcgattcagcaacttcaagaaaatttgcggtctatgcaacagactggaattactggatttgttccagcttttcgaacgttgacggtattttatgatccgatactggtgacgtttgaacagttgaagcgtgtgattcatcaggcatcattgaaagcatctacgcttcaaacgcaggcaattcgtatcgtgcatattccagtttgttatgggaaagattttggtcctgatttgaagaatgttgctaatcatgccaaattgacaccgagagaagttgttaaacgtcattgccaacccaactatttgatttacatgctgggttttttacccggatttgtctatctgggaggactagatccacaacttgcgacgcccagattagcaacgcccagattgaaaattgaacccggtgctgtcggaattgcaggggagcagacgggaatttacccgattgaatctccaggcggctggcaaattattgggcaaactccattaagattatttcagcctgatcaagatgagccattttactatcatgctggggattatatccactttgatccagtttctgattttgagtatcagcagataaagaaaatggtggacgaagggcactatcaagtatatatcgagacgaggaaggtgactgaagatggggattcgagtgacacagccgggattactgacgacggttcaggatctgggaagaactaaaggccttgcgcaaggcttttcaccatctggtgtcatggatcagtggtccgcaatccaggggaacttgctcgttaataacgttgaaaatgaagccgtccttgaatatagcattctaggaccaactgtgacattttcaacaccggccgtcattgctgtgacgggtggtgtggttaatgccaaactaaatggtactcagattcatgaaaatcaggcgattgaggttaattcggaggatgttttagaaattggtcctttgacgcagggacgctatgggtatttggcggtttcgggtggacttcaagtagattcaattttagccagtaaggcaactagcttgcgctacggactgggtggatttaagggccgcgcacttaaaacgggggattttctagcaacggtagagccgaagcctgtgattgcggaaccggaaaagcgaaaaattgctgttagctcacacgatacagatcaaacggttttaattcgtgtgacagaaggaccgcagtttgctcagtttgaggctgaaacaatcacagcatttacaaaccaacagtttaaaatttcaaagaatgcggatcgaatggggttacggttagagggccaaccattatcagtggctaatgtgccagagatgctgtccgaagcaacggtggctggcggcattcaggttcctaagaacggtcaaccaatcgttttgatggcggatcggcaaacgactggtgggtatcccgtcattggcgttgtcgcatctgtcgacttaccaacgatagctcagctggtaccaggtcaggtagttcgattcaaaatgattagtttgacgcagagtcaacaagcactagccgaccagaaagcgcaactcaagcagatcaaacaaacgtttgacgccttaaaccccaaagtaagtcgaaaaacagccactaagattagtagactgtttagataaaataggaggagatacgatgaaccttgatgaaataaaggctgtaatggcgttaatgaagcaaaatgatgtgacagagtttgaatacgaaaatgacgaacaacgctataaactgaagcgtggtagcacgcaaggggtcccaactacgcaacttgttgctccagttgaagaggcggtggcaccggtggctgatgaaccaacgaccattaacgcaccgatggttggtatcttttatgaggcacctagtccggacgagaaagcttttgtgaaggttggagatcaagttgaaaaggggcagacgattggtgtcattgaagcaatgaaaatgatgcatgatgtcgtcgctgatcacgccggaaagattaccaaggtattggtagccaacgaagaaaacgtagaatttgaccaaccgttatttgaaatcgaaatcgattagataaggaacgtgatcacatgcataaaattttgattgctaaccgtggtgaaattgcggttcgaattattcgtgcttgtcatgaaattggcttgcgcacggttgcggtgtattcaaccgttgatcgagatgcactacatgttaagatggctgatcaggcggtttgtattggaccagctaatccacaggcaagttatcttaatcaaaccaatattatcgaggctgctcgacggacaggagctgacgcaattcatcccggatacggttttttatccgaaaacgcggaatttgcaaaattgtgtgagactcagggaattacatttattgggccacattcagagacaattgcattattaggtgataaagctcgtgcacgtgaggtgatgcaaaatgctgatgtaccagtgattccgggaagtgcagaagggttcactgagcttggtactgccctgtatcaagccaatgaaattggctatccggtgatgctaaaagctgctgcgggaggcggtggtaaaggaatgcggttgattcatagtgaagcgcaacttaagcatgaatttacgatggcccaaggggaagcgcaaaaggcatttggcaatcccgaaatgtacttagagaagtttattgttcgtcctagacatattgaagtgcagattttggcggacagctttggtaatgccgtgtcacttggggaacgggactgttctttacagcgatatcaccaaaaagtgatggaagaagcaccgagcgcaattgatcacaaaacgcgctatgaaatgttatcgaccgctcgtcgagctgctaagacgctaaactttttgggcgctggaacgatcgagtttttatatgctggccccagtcaattttattttatggaaatgaacacacgaattcaggtggaacatccgattaccgagtttattactggagtagatctcgttcggggccaactgagaattgctgcgggaatggcgctgggaattagtcaggagaaagttaccttaaacgggtatgcccttgagtgtcggattaccgcaaccgttccgggaaccattaaggggcttcacttaccgggtggcaatggtgttcgggttgatacggcactatatcaaggctatcaagtaccggcaaactatgatgcactgctcgcaaaaattattacctatgcaccgaccagagagattgcggtaaaaaagatgcaagttgcgatcgatgaaaccgtaattgaaggggttggtaccaacttagatttcttataccggttacttaacaaccaggatgttttagataataagtttgatattgaatttattgatcgattaataaaggaggatgcccatgactgaattcatcacgccaaaacagattcgacaacaatcacgaactggtgccttcacgggacaaacaagtggcatgtgcccggggtacacacaagctaacttagttattttaccgaaaaaagaagcatacgactttttgttatttgcacaacgaaatcccaaaccctgtccgattttggaagttgcggatgcgggatctaaacgactccaaacgttcgcacaggatgttgatctggcaacggattttccaaagtatcgcgtttaccaaaatggtgaattagtgtctgagcctactgatgtcaccgatatttggcgtggtgatcttgttagtttcctgattggatgcagtttttcgttcgaagcagcactcattgcagctggaattgaaatgcggcatattactatgaagcgaaatgtaccaatgtataaaactaacattaaggctaaatctgctggtcaatttcatggtaattatgttgtcagtatgcgaccaattcccgaagaacaggttgttaaagcgatcacgattacagagcggctgccgcaagtccatgggaccccaattcaaattggtgattccgaacgaatcgggattcaaaatcttgatcaaccagattttggggatgctgttgaaatttaccccggggaagtgccagtattttgggcctgcggggtgacacctcaagcggtggtgatggagagtaagcctgaatttgtgattacacatgcaccaggacatatgttagtaacggatattcgtgataatcaattggcagatattttgtagggaggtaatcagatggcaaaaatcgacttgaattgtgatcttggtgaaagttttggacgttacaagctgggattggatgaggacgtattaccgtacattacttcagctaatatcgcttgcggattccatgctggcgatcctgaagtgatggcacaaacagtcacattggcaaccaaggatcacgttgcgttgggggcgcatcctggattacatgatttggagggcttcggtcgccgaagaatgcaaattagcgcgctggctgcaaaagctgatgttcaatatcaagtgggtgcattacaggctttcaccccagatggaaaactccatcatgtgaagccacatggtgcattgtacaacatggcagcggctaaccacgagctggcacgagccatttgtgaaggcatttatgccgttgatccgactttgattttggttggactagcaaatagtgagttaattagtgccgctcaagaaattgggttgccatacgcgcaagaagtgtttgccgatcgccaatatgaaccagatggtagcttagtttcacgaacgaaacctaatgcggtgattactgacgaggatgtggctgttaaacgcgttattcaaatggtagaagaacaccaaattaaagcagttgatggttctattttgacaattcacccggatacggtatgtgttcacggggatggcattaaagcggtggcctttgtcaaaaaaatccattcggcattagatcaagaaggaatagaagtgaaatcgatgtaggcttgaggaggcatttgatagatggaaaagaaaacaaaaaaacgatcaccgtttaacgtagcgatgggtgccgcatttatgatggcgatggccgcggttggtcccggatttttgacccaaacagcaaccttcaccagtaagatgggggcagattttggatttgcaattttaatttgtatcttagttgatatcgtggttcagttaaatatttggagaattattatcgtttcagggcgccacgcacaggttttggcaaatgaagttgtgccggggttgggttatgttttatccgctttgatcgtgatcggtggttttttcttcaatattggtaatattgggggtgctggattaggattgaatgtgctctttggtatctcaccagagaacggtgcgttaattgcagcagccgttgcaatcgtgttatttttagtacgcaatgctatgttggttgttgatcgaacggttcaacttttagccgttgttaaagtgctgattttgatttatattttggcagtcacgaccgttcctcttcagagtgcggttcaccatacctttatgcccacatccatcgatttctactcgattgtcacgattgttggcggtacggtcggcggctacatttcattttctggtggtcaccgactacttgaaggcggcgtccgtggcattaataacattaagtatgtaaatgaaggtgctttaactggaattggtgtggcgtcagtaattcgagtaatgttgttcttagctggtttagccgttgttttggctggacaccagttggatccaactaacccggctgctacgatctttaaagtggctgctggcaattttgggtataaattcttcgggctattgctgtttgctgcaggtatgacctcaacgcttggatctacgtttacgtcgatttcatttttggattacaatgtgaacaaggaaggccacgaaagctggcgtccgtggattattgtcggattcatcgcactttcaacaatgattttctactttatcggtagtcccgctaaggtcttagtcattgttggtgcgttgaacggtctgattttgccaatcgcccttgccatcttgctaattgcagctacacgtcataaaatcatgggggcgcaataccggcaccctcggtggctgttagtgacaggctggattgttgttttatttatggcctacgctggtattcgaacattattaacaattcaattttaaataaaatggctctttgtcaaacatcctaaagtaagaggtatcaagattgtgacgacaatcttgatacctcttttactatacttaaattgaggttgaggtcgtcaacatcagtggaatatacattccgagtgtcaaactggcccaacaacacgtagtgaacagttagatttaggatgtgggtccttgagatcgaatatagaaaatgaacgaatctgcgaagttgttacctcaaaaatatatggaaggcgataaagtgcacgttttaggtattgatgtgagtcgtggaaagagtaattgtgctcttttacacgatcatacggttattaaggagtttcagattatccataataagtctggattggcaaagctcaagtcaataattacgagtgacctgccagtcatggcagtatttgaaacgactggtatttattctagagttctgactcgtttttttagcgaggaaggaatgaattaccttgaaataaatcctttggagtcctcaattcgcatggcggggttgagaaggcaaaaaacagaccgttcagatgcagttaaattagcgctcctgggaattgatcagaagtcactgattcatggtcgtagaccatattcaaggccatatgagcaacttcatttaatggcacaccgctatctagaaataactaaggagagatcccggattatcaatcatttacatgccgcacttgatcaaacatttcccgagttaaacgatatatttaacccaattcgatcagtgctcggcttaacttttgttagtctctttccccaccctgattttttaacaggatatattccaggaacgatggcaaaacaaatcattggcttggtaagtcctaaaatcggatttaatcgtacgtagatgtaatgaggtctggcaggcaggccaattgtcgtacccagcacaacctgcgaattcatttctgactaatcaaatccatagttattgtgaagagattcagcgatataatcaggcccatgacttattaaaacgccaattgatcacttacgcgaaaacttttccggagtttaaactcattgcgagtattcctggggcgggagagatatcaactgcccctgttactaggatttacaggaaaaatagcgagattcccaagctataagcagctgaatgcttacgtaggaatagatctacgacgaacccaatccggagggctcaaagaagctgaccggattaatcggagaggccaaagtagtgcccgttatattatgtttgaaatgattagatccatgcttagaaataaagcacgcattgataatcacattgtggattactactataagttaaaaaaaggaccacatcctaaaccggatatggttgccatgattgcttgtgtgaacaggcttgataggacgattatgaatttggtccgcacaaaccaaatttataattacgcaagaacttcccattaagcagactatttaaataccagtatagttgatatttatgatagcttttttctgtcaaaaagctatcactgtttagtgtactctttttttaataagttgatacttgacatcatattagaaatcctgttgatagatagcttttacagagttgaaagtcatgcgactttcaactctgtttttttatctggtttagtcttcatttggcgcagtttaatgcgtgaaatcatatgatgatagttacggaatccgaacgcagttcgttgaattggcttaatcattctgttcatgccttccaccggaccatttgaatagcctgtttcactcgcattcaaaattacttccagattttttttgaaggtacgaaaaatttctttcatctgtcgacttaagttttgagtgttgtacaaataatcaacgatgccatctttatcgtgatctttgagacttttcatgatgttttgcattgattcgtatgatgcctttaactcagggctaaccgccagcccttcttccactcgttctaattgtgtgagttgttttcgaagatggcgatcataaaataattgtttttcgtctaaattttcagcggatttcaaataaagccgccatgagaattttaacgttcgatattcggcagattgtttattgtatttttggtagattgcaaatttaattcgaatttttggacaaatttgtcagcataacctgatacggtgtttgccagtcgagtattttaagcggtcgctggttaatttggagtaacgtcgtcgttaaatcttgagcactaatgtgctcaaaacgagtccctttaggataaaaataacgta

SEQ ID NO: 192 - DNA, 1138 bp, Lactobacillus buchneri
gagtttgagcgggtgctcccgctcattttttgcgatcaagctggttcagcttggtctgggttcggggcgacagcgcccgagggtttgaaaccgtcgttttttgacggtttcttcttatcttgatacatagtagacacaattattttttctaaaactgcctctaagccttgacacacatgacttaaagcgtattatggtggtggaaagaaaacaataaaaaaacccacgtgagaattcctagtttggcaacgggggaacacgtgagttaatcttgaatattcggatttactagacctagtttaaggcttgagttagtaagcgtcaagtccttagttttagtaaatacataaaggattaactcttctcacgtggctagtgagaggagcttttgatttggcggataaaaagatattgcaagataaaaatagttatgggaagccacggccatggcggcagaagaaattagaaaacttacgttatgcggaatatctatcaattttgttatataaaaaagcacataaagtacaaggctgcgctgatgttttgcgttttcgaaagttgcctgatggttcgactaagctttatcaaacgtggttctgtaagagtcggttatgtcctttgtgtaactggcgtagaagcttaaaaaactctagtcagttaactaagattttgacagaagctcatcgacaacattcaaccgctagatttatttttttgacacttacagaagaaaactcagttgatggtggtgatttaaaacggcgtttgaaggcgttaactcgtgctttctttaagctggttcattacaaaaaagtatctaagaacttgctgggttttgttcgttcaactgaaattacaactaacgataacggaacataccatcagcatttgcatgttttactatttgttaagaaaacgtattttaagaattcaaataattatttgtcgcaggctgattggactgatttgtggcagaaggcactcagaagctcatataagccgattgtgaacgttgaagcggttcgagtgaataaatctaagggaaagtcttctttgcttgctagcgcgcaggaaacggccaaatatcaagttaagtctgcggattacatgacggacgatgataatcgcaatcaacagg

SEQ ID NO: 193 - DNA, 305 bp, Lactobacillus buchneri
ttgtcggcattgaccttagacactttgagtctggcgaatatatcgccgtcgatcatattagtaagcgtggtaatccatatgcccgcaaaattctgtatcgaacaattctcaatatgatggtaagtgctcgcacaaagccatcccacatcaatgattattgccgggaaaggaaaaagcaatcttctggaaaggctgatttcaagaagattgccatgggtgcaattagtcgtcttaaccggactatttaccacttgatcctaaataaccagaaatacgattatctcaaaactcgaccaaaagctgag

SEQ ID NO: 194 - DNA, 628 bp, Lactobacillus buchneri
acgtcacactgccgagaaaagcttctagtgagtcatcaactacccgtaccgcaaaccgacacaggtagtcgaggagagaatcctcaggtgagcgagtgaactctcgttaaggaactcggcaaaatgaccccgtaacttcgggagaaggggtgctgtgcgcaagcacagccgcagtgaaaaggcccaggcgactgtttatcaaaaacacaggtttctgcaaaatcgtaagatgacgtataggggctgacgcctgcccggtgctggaaggttaagtggatgagttagcttcggcgaagcccagaaatgaagccccagtaaacggcggccgtaactataacggtcctaaggtagcgaaattccttgtcgggtaagttccgacccgcacgaaaggcgtaacgatctgggcactgtctcaacgagagactcggtgaaattaagatacctgtgaagaagcaggttacccgcgacaggacggaaagaccccatggagctttactgtagcttgatattgggtgttgacacagcttgtacaggataggtaggagccattgaagccggaacgctagtttcggcagaggcgttggtgggatactaccctcgctgtgtgaacactctaacccgcgccact

SEQ ID NO: 195 - DNA, 757 bp, Lactobacillus buchneri
ttccgcaataatttgttttaattgacttgaatttttcatactctttctccaattacacaacggacataagcgtttctgacaaaaccaagtctggtagagttttaactgattattgatcttacgaaaacgcaaagtttccccacaacccctaatgtcatgtgcacgtttaaattctaaaatcgacaaatattctgcataacggacattttcaattttacgttcacgccaaggtcttactttcccgttttttgttttatctcgaaaaatttctgacatatataaaaactccttttctaacctacgtgaaaaggagtttgatttctgtttttgcttatataattttgacaaccataaaaattatatacctaattattcaaaagtcctataacatctgttatactaggctttgaagcaataaaactctgaaatcaaactcacgtgttccggacggccaaatcaggaacttgcacgtgggttttttttgcgcttctttattattaaattttatatgtccaataatacaccaaaaccccataaaatcaatgataagggacaaattactcgcaaaaataaaaaactagttgatcatactagtatcaagataagaagaaaccgtcgaaaaacgacggtttcaaaccccaaaaaagcagatcagcaaaaatcgctgaactgcttttttaagaccatggctttcagccatactgaccagctgaaccagctggaccccacaaatgagcgggagcccccgctcaaactc

SEQ ID NO: 196 - DNA, 870 bp, Lactobacillus buchneri
ctgatcttttgtctagtataacctattccgaacgaattaaaatcgaaaccttttgtgaactagggctgtccaatatccaaatgggcgttcggctgaaccgatcaccgtcaacaatttcttatgaattatctcgatgtcaaccttatcaggctgaattagcacaaacagatgccgaatacaagcgatgacgatgtggtcggaaaactaagctgagcgatgagttaaagcaaaaaattctcaactatttacgtctaagctggtcaccaggaatgattgctcacgaagttaaactagctactaaatctatttataattggctaaatcaggggagaattggtttctccttgaatgatctacctgaacatggcgtacgccaacggcgtaacgttgaccaacgatccaaatataatcaatctttggagcgatcaattgaacagcgtcccatgatgattaatcaacgtaatcgcatcggcgattttgaactagatacagtcgttggtcctcgtgggcatagtaaggcagttttattaactttaatcgatcgaaaatcacggttcctttgggcataccggttaaaagatcggacgacagcgactgttaatgaagcactaactaagttcctaaccacttttaatggtccggtgcacagctttactgtggaccgtggcactgagtttagtgggctagtatcacttgaatcacaatatgatattaagatctattactgccatgcttatacgccagctgaacgtggtagtaatgaacgctttaatcggaatttacgttatttttatcctaaagggactcgttttgagcacattagtgctcaagatttaacgacgacgttactccaaattaaccagcgaccgc

SEQ ID NO: 197 - DNA, 308 bp, Lactobacillus buchneri
cctaatttgcgctgtaagaagcggtcaacgctccgaacaattccttgtagcgtcccgactagcttttgaagacgacgattctcaatgtctagttccatagccttactttcagctttaatcagttggtctttttgaatatccatatcagacctttgggacaatgtttcagtaaaatacgtatcagttaagctggcgccctgtttaagtttatcaaaatcaaaacggtcaaccagcacataccgcttatggaaacgggattctttcgttttaacactatttacatcaaatttagtggcttgatacgtttt

SEQ ID NO: 198 - DNA, 6211 bp, Lactobacillus buchneri
gcttttcaatttgctgccacttttcatcagagatggcgtgtcgattagtggttaatggaggcttagtcatgcggtgattcctcatttcttgttttttaaccagattataccggaactttggctaaaaagcttgttttaagacagaccctaatttatttaatctgataagccattagtcctcatctggatcattgagccaatcagcgacttctttagcgtctttgaactctgttactggtgtctctttggtagcctttaaaaagcgtaaattagctctttcttcttcgcttaaagacacattaaaaggtaaggcaccattagcaacaatccgcttataaaacatattgatcgcggtagttgggtttagacctaactggcttaaaacggcttcggtattatctgccaattctttgtcaatctggacttgtacgcgtttcttttccttaactgccatgattttctcgcccccctttattactactcacattatactaatctttgagtaccatctcaattagcctgcttctttaaaagttgtgaatttaagtttgctgtcctttccgcaatggcacttatacaacggtcctaaagtgcccgtaagcgcattttaaaactcgtttaatataattatgctctatctgtttaaaacagcttaaatggccttatatagctttttagttttaagcacgctcatcgttagggtgtttggccacgtattctctagccgcttgtttattccaccaagcgccaattcagccactcaaggtgtctatttttgcttctaagcgattttaaagcgattttaatataattatgcatgtaacacctaaaacggcttaaatgagcttatacggcgtttaataccaagaaggctcatcgtcagggttctgttcttcggggtgtttggccgcatattttctagccgcttgtttattccaccaaacgccaaataggttttgcatggtgccgtacaagtagttttccacgttcttgatgtgcttctcattgcttctcagggcgttaaagtagcgtctcaaggctttagtcatcaaaggtttcagttcttcatcgtccagtgggattagaaccccaatatctttgtgatctttctcaactcggtacttagcattcaggatgataccaataaaccggcgcatttgttgtggggtacggcaccaaaaactaagtagttgcacagcttctggttctaagaaaatcgggaagccactgacttcatcagttaagaagtcattagcatgggtcaccaaatcccggttttgggtttctagttctgctggtgaaaaatgggctgtggaaaagtccaacttttgagtatctatattgtatctattagtatctaagcttctaggttctttatctagattgactgtagaatttacagttctgcgcccagcaagggtttgagcgtccttttcaacggtgtcatgctgaactgtagaatttacagttctgcgcccagcaagggtttcaacggtgtcatgctgaactgtagaatttacagttctgcgcccagcaagggtttcgggcgtttctgactgttcaccacgcaaatatacgtcagttgcttgtacatcgagggaagcaaggtagagacgatttggtagctgtttacctgccttaggttgaaaacccatacgtttttgccgcagtagattaagcccctctagttcttttttgatcttaattacggtcttttcggaagagttgaatagttccatgagttcagcattcgtatagacaaagtagatgttgccgtcttcgtccacccagttgttacgcaaagagtactctagccgatctttcagtaccatataagccaatttagcgtcactgctgaggtgcttatatttttctccatacattaaaaccttgggaaactgaaagaataaggctccataaacgttatcagcttgataaaacttaaaatttgtttgatccattataaaaactccctttcttgactgacacacgctgtctcaaaagagagttgctaaaacatttgatttgctttaaaatacaaatctgatatgctctaactgaattacaaagcattcatttgctgtgaggctttgtgattcatcagcatgtgtctttgtgtgagttgcccagtcggcaacttttttaatttctaacaacaaaaaatggactaaatagctccagttagctacttagtccattggttttaatttattttttaactatccttaacttgtcctggcggactagtatgcggtataattaatctataaattagatttcaatgttcagtcgattttaactggcaggtctaaatcgactgaatctaagtagctgtctggtagctacttgctaaacctaaaatccctgattcctcgtgaatcggggatttttctgtttagcttgatctctttattcggaggtcgcggggcttcttttgtatattcagttattttaggtctggcagaaatgctaggccttttttaatacaagcttattgtatctacttattaggcgggtgtcaacttttttctttacagcactacagcactagtttgtgctagaactactgcactataaggctactgcactataaggctactgcactatgtagtgttgtagggccttgatatgtcggggataacatcacatttttaatatgctgtatagcactacagcactaaagaactacagcacaactgcactattgacatacagaactatgtagtgctatcattataaatagaaatggaggctagaacaacatgactcaagttattacttttggcaattttaaaggtggggtaggaaaaactagtaattctacaatggttgctttagaacttagcaatcgtgattttaagactttactagtagatttggaccctcaaggcaacgctacaaatttgtacttaaaaacaaaactaaatatcagcaatgaagttgggcatttcgacaagactttaatgtctagtgtagaagatggcaatctagatagctcaatcatcaacatcaaagataatttggacttgctagcatcagcacctgacttctcgttatatccgagatacatggaaaagctccataattataatgatagggtgaaagaatttgataggcttttaacgcctctaaaagctaaatatgactatgtaatcattgacataccgccgacaattagtttaataaccgacagcgcactatatgcttcggactattgtcttattgttatgcagacacatgaacatagttttgaaggtgctgaggcctttatcaaatacattcaagaagaagtcattgatgagtatcaagcaccaagacttgagttagttggaatcctagctgtcttactgcaagcgggagcaccagttgatgaagcaacggtagctaatgcaatctcggaatttggtgaagagaacttatttaaaactagaattcactcaatgcagcgtttaaagcggtacggaattacaggaattacatttaaatcaaagtttgataaacgtgtatttgcagtttataaagatgtaactgatgaactactacaacgaattgaggtaattgaacatggctaactctcttattcggtctaacagaaacaaagcaaatgctattcctaagccagctaagcaggctaaagcatcagattttgacaaaacggctagtgatagtaaagcagtcagttcagtcacgtttgatactaatttgaagattagcaaccatactagaaacaagcttcaagcaatggcaatgataggatatgccgagaatcagcgactatccgttgatactgctattcaatcattctatgaacagctgtctacgaatgaacaacgtgaatttgacttacaggttagcacactagaaacaagagacgtaaaactgaaaagtaggaataactagcaataatcataatttagggggaatcgttatactattattgtagagataaacaaggaggaattaaaatgagctattcagaagcaatggctaaacactactacttaaacatattctacccggtatgggtttatttttttactttgtgttgcatttcaattgtaaattcgccgctgaaagaatagcaaaaccccctgaggttagatttacttcaactcagggagtttactttacaccaagaaaggctatcttttttagtagtgactaacccgtaactttcaattaactctcatcgtccgttatggtcgacctagaagcattaataatgatatagccctcagaagctgtttagatgtcaacccctcagataattgagcaaaatccagaacactatcttacaccaaaagattaatgttccgaatgtttttttaaattatcagcaatactttttgtggaggattccattgcttcttcacggtttttcttggtaacaaagtaaatccaatttggaactaaaacagttgcagatctaatattaataaatataaagtcttgaatagatcttaggtcttcaacagaaattgaatatctattttcatctacagagtgaatgacatcatctatcttattaattagttgggtttctccacctaacaaagctttaaaactgatccaataatttacaagtttgataacaattggaattatagtaactatggcagtatccatagcatgtacccacatgtaatctttaaaaaagataccagcagtaataaatcctagaaatagcaaaagtaaaaatgctattacatttttacaggctttatggagatgtatattccatactacattattcctttggcaaatgattatatttaattcatctgaatctagatttggattagggtaccaattttttaaaatactctgatcctttttttttgaaaacttattaataatctctggacttggttcccttccgactaatatttcattccagtatagcccgaatataagagtatcaaatttttcttgaattcttgcggcgctttttatttcgtcctttgaccactgagttagtaagagagatatcacggtggcgatggttgtgacgaattgaatgcaaattccatttccaataaaaagtataaggataatcggaactaatgttgacaaaaagctaaaaagctctataaattttgcttgagaatataaattcctttgtgcagacaataatcgaattgctttaggtgtgttttgcttagctatgtcaaattttattttcatctatcagttcccaaaaaacgtaatccaagattttattgcttgttcactcatagatacagtttcgtaattattagcctcttttatcaagtcatggtaatatattgcttttttctgaatttctaaacgagctgcaaaatctaaagaattcagatctccttgaaatccctttcggtcttgaacagaaccaaaaactgcttttgaaagataaagaaggaaattttctataaactctcgggagttggagtatattggattagtgtctataaagtcaagaaccgtggtctctagtgcataagaattaagcttgcatactgcattatgagcctttcgccaatacttcagaatacgcactacttcccttagatcaattgtggcttttttttgatattccgttaaattttgacgatctattcgtggatctgttttttcccaagcaccttccccatttggaatgatgtagtagtaatatccctgaccatcatcaacagttctaaatccagggactatatcaaatccccagtcgtaacttgataattccagtctgagagcctgcttactccttttaatatctgccgactgatattgcgatattccattcaatagctgtttaagataattcaagacttttatagaactaagcccatattctccatccattttctttaattcaggagcgctatctggaacatttataaacacctgattccattgagacgtatctaaattagcggtgctaccctttgccgaaaaaataatcatttgatcaacatcgtcaagaggtctaatctgtgtctttcgagcaaatgatcccatttttaatgaaaattctgagctcgagtatagttcaaggttttcctcgcttttttgactaagatctgaaacttgaaagctaataatcacgccaaaggcgtgtggttattggcttttttggcaaaaaaataaacgcaagctctcctgcgttgtatactttagtcgaccaaaaccaagatacaaaggagacttacgtcatgaatattataagacaaaa

SEQ ID NO: 199 - DNA, 58065 bp, Lactobacillus buchneri
  misc_feature (41985)..(42054): n is a, c, g, or t
ttagccagttttagagacggcgtccagcgccaaatatgctcacggcattactaacttcacaatcactttataccaaaaagtgatgaactaaagccccgtcgggttttaattcatcacaagcttagtctgttttaaaggccggagggagctcagaaaaacataataaccgtgcatttaaacgacgagacccgagtgacgctaccaaataggctaggctgttttcatccggtcgtctaagtgtattttacaagaggaagagagacccaaaaatcccgacaaccgttcccccgagaaacaaaagaaaccacaaacgaaaaggaccgaagcagactcgcttcgatcctatttttgatgcttctcattcttctcggcccgataccggctcatcccttctttataaggattgccaaacaaccgactcaatcccgtccaccaggaattggtacttgacggttgagcatcatcgactggcaacttcttgccacagttcagacagacaacgtcatccggcttcaacttcgccccacaatacggacaaaatgaaaatttttgctttgccatcttgcttacctcgattgctgttggcctttgttgcgattggcattgcgctgacgccgtttttcggcttcagcttgttccttggcagccccagcttggcgaatttgttcttcacgttgctttttagctttatcttcggcaataatttggttgtgcattacattcatccggtgcgacagaaagttccagccgccgattaaaaacagagcgccgaccactgagtacggaaatgtccaccatggaaaataactgccttttttgaaaaccattgggccaagaaaattatagagtgccatcaatattgcgaccatcaaagtcacctgcagggtattgaccagccacttgggcatcttaaatccttttttctttgccaccatgcatccccccctaatcaatttcattttcagtcagaaaggccttgaaataatcaaaggccatctcgcgaatattctcgatgccaatttgtcgggttggcaaatcaccatcgtcatcaacgtctagcaattccacattcaaaactcccgtttgcagatcgattgaggttggatacccagcaaaattgtcctcatcggcagtttcaaagcgaatcactttttggtactgaatcgattgggtgatgatatgaatcaagatgttgtccgcgttatcaaatgcccgatccgaattcagaaccggcaacgcaaaatgcttgttgtgtttattctcaatcacaaatttatcgatcacccgtaaataatccgagtccgtaataattctaccaatatcatcgtaacgaatccagacgtaaccgccaaatcggccgttcatatcgacaaccatcatgacaaattctttttcgttgctggaaataatcttgccaacgtaaaaatacttccggttatcattggtgtcaatcacgacccaatccccgctgttacgcagttgttcaatctgatcacgaaagacacttggatcatcaatgatctcattttccacatgattttcaggcttgaccatatctaagacgttttgcagcagttgtagttcagtcccaccaaactcaataccacgaatatcatcaaatcgaatgttgaacaccgactgctttgagaaatcaaacttattaatgttagtaaagaccattccgtcgtcttgaaggtccgaaatgagcccttcgttgtatttcagcttgccggcctgtgcggtaatcaccagaccaactttttgatcatcctgcaatgtctgaatgacccggtcgaacaacgagtcgctcatcttgattggtaaatcaaaagagggctgggaattgaggtggtgcttctcgtcaaactcaattcgatcctgcatgtttgccaagtcgtaactgtcggtatcaatggatttaactgaagaaatcttcaaataaacttcaccatcctgaatgccgtaatcgttgtaggtcaacatgatgaaatctttatcgcttaaaaactgaatgacaccggtgtaaacgatatcggagtcattttgaaaagcgttaatcagctgctcgtcgatttgggcggtacgcagcttgtcgtatagggttttcatggtgtcacttctttcttgggtgggttagttgtttgtggtcttgtttgtggcgcttgcttgtggtcgatttgggtttttaaggtttaattttctctagtggaaatgtgctccctggggcagtaacctgcatctaaggaacttcgaacgaaaatcaaactcgagttccgttcgaagcaccttagactccggttactaaccgccccagtccgcactctagtgaaaatacgctccgacgaccctggtctctactgcgtaagtcaaaaatttcaacgatgaacaaagaccgttcatcattaaaatttttgacttacactccgggaccacccaggtctcgttgcgctctctacgaaattgcattccccataaattccctaagttcatcacccgacatattatcactcaatccaactaaaagcttgattcttgctttctggccgttcaatccttgacagagaatcgttcccatcttcattaattggatgcccccaccctcatagtcgtagatatcctgggcgacgccgttataacatcttgagaccaagacgattgggatatgattatccaataatcgttggatcgccggtaaggtctgcggtggaacatttcccgctcccaatccttccagcaccaatcccttggtattgtcgttgttgatggcatcaaacaacgtgccgtccattcccgcatacgccttaatcaaatagacgccttcgaccacctggttgatgtcacacacttcggtttgaattaattcctggaagtattttgccttgttttgcgttacaatgccaattggtccgaaagttggcgttctaaacgtcgccacattggtagtatgcgtcttggtcacgtatctggccgtgtggatctcatcattcatcaccaccacgacccctttgccgtaggactcatcagttgcggcgaccaggatggcatttctaaaattgtacaggccatccgagccaatttcattagatgatcgcatggcacccgtcacgacaaccggaattgtgttgggcagcgtcagatccaagaagtaggcggtttcttccaacgtatcggtaccgtgggtaatcaccacgccgtcgacaccgtcatcaatcgccttcataatacgctgcttaatttttaacatcacctcaggagtcacgtgaggagacggcaggttaaacatttcatcagtaattaagttaatctgaccctttaagatcacttgttcttcggcaatcgggttctcatcattggggacaacttcgcccttttcgttttgggacatcgaaattgtgccgccagtatgaatcgcaagaattgttttcatcaatttcatcctccatcaacctgttaatctataccattgtaccgtaaaatggaacatgaataactatcaatcaagaaagaagtctcagatatgccaaattccgaccgctactatacgccgcaaaattcaaaagatgcgatgcgccagatcgaaaaactatttaataagtataaggacgccccactcacccaagaactcgtcgactaccatcagaatttggtgaaccgcttaaagactgacattctggcagctgccaagcaggaaaacgttcccgccagaattgagtcaatcaacacgatgatcgccgccatggagcgttggttaaaggtccgcttggccggcaatccctataacggcaagatgaagaactttaaatttgtcagtgatgaatcactgcctaagttcaagcgccacgtccacaagatgaatggcggatcgacccaccgttcttcaagacattaagactttctctttgtaatctagactattacattgcagaaacgtaggaaataaagcagtttccggccatataagcaagaaagctaaatatcccggcccgggatatccgactttcttgcttatattctgggaactaaccgcttcatttcccactctcaatcgttataattaatttatcaatcatattagggggaagaccgttgagcaaaaccattgttgaattaaagaacgtctacaaaaagtacgacgacggctttacagctctcaaaaatattagtttcaaattacaggaaggcgaattctacacccttcttggcccctccggctgtgggaagacaaccatcctccaatcaatcgccggctttacagaagtcacatccgggcaagtgctgtttgacggcaaagagattaacgatattcctgccaacaaacgccagctcaataccgtttttcaagactacgccctttttccaaacatgaatgtgtttgacaatgttgctttcggcttagtcgttcataacgccaaaaaagacgaaattcagacccgggtgcacgatgcactcaaaatggttcagctcgaacagtacgccactcgggaaatcagcgaattatcaggcggccagcaacagcgaattgcgattgccagagcgattgttaatcggccaaaggtattgttactcgatgagccgttatcggccttagacgccaaattacgcaaggatatgcagtatgaattgcgtgagcttcagcaaaatcttggcattacctttttatttgtcacccacgaccaggaagaagccttggcaatgagtgatgaaatctttgtcatgaacaagggcgaaatcctccagaaaggttcaccggtcgatatttacgatgaaccgatcaaccactttgtcgctgactttatcggcgaaagcaatatcattcccggtaaaatggtggccgattaccaagtcgcctttttaggacatcaatttgaatgtgccgacgccggcatgcggcccaacgaaccggttgaagtcgtgatccgaccggaagacctggtcatcactacgccggaaaaaggcaaactgcaggtcaaggtcgacactcagttattccgtggtgactactacgaaattcttgcctatgatgaggccggcaacgaatggctgatccattccaccaatgccagcacggatgatgcgattatcggcttgacgtttgggccggacgatatgcatatcatgcgttataacgaaactgaagccaagttcaatcaccggcttgaaagttatgaagagtagggggggcggaacatgaagcgaaattatcgggggctttttttcacgccttatattttgtggctgacaatgtttgtcatcgcgccagttgccctaatcatctattattccttttttaatattcacaaccattttacttttgccaactaccaggaattcttctcgtccggaacgtatttgacgatgacggccaattcggtcctctatgcctttttgatcaccctgttcgcaattttgatcagttatcccatggcgctggtgatcagcaaattaaagcaccgcgacttgtggatcttgttggtgattttgccgacgtggattaatttattactgaaggcctatgcatttatcggcctgctcagccacgatggcttagtgaatgatttgttccaattctttggcatccctgcccagcacatgctgttcactgacgccagcttcattctggtcgccgcttatattcaaattccgtttatgatcctgccaatctataactcattgactgacatcagcgattcctacatccgcgccagccgcgatttgggcgccaccaaatggcagacactgaccaaagttatcattcctatgaccatgccgggaattaagtccggtatccaaattgttttcattccatcgctatcactcttcatgctgtcgcggctgattggtggtaacaaggtcatcaccttaggaacggcggttgaggaacactttttgacgacgatgaactggggaatgggttccacgatcggcgtggtcctcattatctcaatggtcatcgtgatgctgttgaccaacaccaagcgtaaaaggaggcggacatcgtgaacgataaggcttccagaaccggtaaaatttatatcaccattatctttttgctattgtatattccaatcgtctatttaattctgtactcattcagtaagggcactaccatgaccaatttccaaggcttttcgctgaaacactacggtgaattgtttaacgacaaacggatgctggcaatcttcttgaacactatcctgattgctctgctgtcttcggtctgctcgacgattatcggcaccatgggggcactggccgtccataatgccaaacgccgccacgaacgagaagccctcctgtcgctgaacagtatcctgttggtctcacctgacgttatcattggtgccagcttcttgatcttctttaccgccctcaagctgccgctgggattttggtcagtgctgttaagccacattgcctttgaaattccaattgtcctgctgctggtattgccaagattggacgaaatgagcccgtcgatgaccaatgccgcgatggatcttggcgccagcccggcccagattttaagtaaaatcgtcctgccttacattcaaccggggattattgccggcttcttcatggcaatcacctattcgttggatgacttcgcggtcaccttcttcgtaacgggaaatggcttcaccaccctgtctgtggaaatctattcaagagcccgccaaggtatcagtttggaaatcaacgcattggctggtatcatgttcatcttctcgctcatcctagttggcgtgtactattggattgagaccagaaacactgcctcgactggtaagaaaccaattgtggaggtgactgaccgatgaaaaaatttctcgcagcattgattgctattctggcgttgtgtgccggcttggcttatggcagtaatcagctcaccaaatccaccggcgataccggcaataaggtccttaacctctataattggggcgattacatcgatcccagtcttttgaccaaatttcaaaaggaaaccggctaccacgtcaacgtcgaaaccttcgacagcaacgaagcgatgtacaccaaaatcaagcaaggtgggaccagctatgatctcaccgttccaagtgagtatatggttgaaaaaatgaaggccgatcacatgctgattccactggacaaatcacgtctggttggcatgaatcattatggccgctcatttctcaacaaatcctttgacccgcgtaacaaatactccatcccctacttttggggaacgctggggatcatttataacgatcaatatgtcaaaccgggatccttggagcattggaaccagctttggagcaagaaataccgcaatgatattatgctgatcgattcggcacgggatattctgggcttttccctcatctcaatgggccagtcggtcaatacaaccaattcagctgaactgatcaaagctaaggataaactcaatcgtttgtcacccaacgtcaaagcggtggtggccgatgaaattaaaatgtatatggcagagggtgaggcaccgatcgccgttgactggtccggtgaagcatcggaaatgatgtcccagaattcgcatctgcactatgtcgtccccaccgaagggagtaacatgtggttcgacaatttggtgattccaaagactgctaagcattttaaggcaatttacgccttcctgaattttatgaacaagccggaaaatgccgcccaaaacgccgagtatattggttattcaacaccaaacatgtcggcttttaaactgctgccaaaggccacccgcgacgataaacagttctacccaacccaaaatgtaattgaccggctgcaggtttacagtaacttgagtccgcagaaagtccaagaatataacgatttgtatttggaattcaagatgcaccattaacccggattaaattcttaattggtctttgaccgccaaatgcattaaactgataacgaggtgaaaataataatggcaaagaaaaacatgcgacaagaaatcatcattgatatggacgaatttatcgtcacatacgcagcaaccctcttggatccgaaccagaacctttccgagttggtgtataacacagcaaaagaagatattacaaagtgggacgacttgttccacgaccaaggatttggtcgcaaaaataaatttatcaacatcggccgaggctacttaagagatgcccaaaacttggacgctgaagaggcggaaaagcaaggcgaccagttagcccaagaagccatcgattacttgggaaagcacacagacttttttgagaagtggagaacagactagagcgcgagaagacccggttagggcccagaacataagcgagaaattccaatgatgaacggtccttgttcatcgttggaatttcttgtttatgtggccgggccctgggtcgtcggagcgtatttcagaagccgaagggagcgcaaaatgacctaacaaacgcgccccacgtttcctaacataaagagtaagaaatccattgcaccccaaaagaacgcccacaagctttttccaccaaaattccccaactttgcgtcataatagacctaatcaaaatatgagaattctggggggaagggctcaaaatgaatcacacacctgcacaatcaacgacacaaaaaaatggttggtggattttggtttccatcggcatgtttgcattcatgtcgaacctggattccagcatcgtcaacattgccatgcccatcatggccaaacagctgcatgtcccgatgaatcaaattgaatgggtggtttcgtcatacctgatcgtcttaactgcactcttgctgtttttcggtaaactcggcgatatctatggcaaaatcaaagtctttcgaatcggaacagttgtcttcttgcttgggtcatttttgtctggcctgcaaattaattttccgttcctgctggtcggtcgatttattcagggaaccggagcagcgatgaccttatccaacacttacggcatcaccacctccacctttggtattaaggaacgtggccgggcaatgggctttgttgggaccttcgtggctttgggggcaatcgccgggcccggacttggtggcctgattctttcaaggctatcttggggctacattttctgggttaacctccccattggcattatcgccgtcattctgggcgccattgtaatgcccaaggcttatcaaacggtgccgggaaccatcgattggctaggtttcatcaatttctcactgatgattatcggcttgttcctcggtgtcttcatcggccaagaacttggctatgggtcgccaattgcgctggcattatttgcgttagggctcatcaccatgtggggctttttccacgccgaaaaacgggccaagaatccattgatgccgctgtctttgtttaaaatcaagccattcacttatggcctcggggccgctgttttgatctttctttccaacttcttcaccgtgatcattgtgccgttttacctggaagatgctcggcacttgtcagctggtgaagccggcgcattgctgatcattttcccggtcgtcatggtgtttgccggcccgtttggcggttggttggctgatcacttctcgccagccgcaactgccactggtggtctgttgatcgtcgctgtcgcccaagccatgtatttcttcttaaccctaaccagcccaatgtgggtctacgtggtcatcacgatcattatggcttttggcaccggcttgtttcagtcgcctaacagcgatatcgtcatgtcagtggttcccaaggattcattgggaagtgccgggagtttgaacgccctggcacggaatgttggcatgatctctggtactgccttatcgaccagtgccctatttatcgcaatgagtgtcaaagccggattccatgtcaccaactatttaccaaaccagccggaagtctttattttcggcatgcacgttgcctttgcggtttcactggtaattatccttggcgcctgggtactgtcaatcatgcagggtcgaaccgtcaaacctggtgatttgaaataaccaattgatcagttaaaagatccctaaattttaccgataacgaagcgctttgattatcatcaatctttgtaaatagtccttaaataaaaagtgagacccggcgataagccggatctcacttttttgcttacttaattttagttgcttgtcccttacgcttccgatactcaattcttcccagcttgataatttcggtcacaaccagcacgataaaccctgcgatggttggtacaacccagccatagaagaagtcgatgctgccagtgtggaagacgtcttgcataaacggaatgtagaacatagctgcttgaagcgccagcagaattccgatgatgataaacgccatcttgttctcgaagaaatgcttggaaataattggataggagttacgaatattgaacagatagaaaatcttaccgaagataatgatgttgaccgccatggtactacccagaacagccgtcaagacaccagaatcaacaaatcgatcgaaggtgaagatgcccagggcggaaattaaaatcgatacgtaggtgatttcgaaaacgtccatttttcctaaaatccctttggcaacatttcttgggccacggatcatgattgactcctcagccggttcaaagataaacgcgaattgaatggtcaatgctgaaaccgtgttaatccacagcagttgcgttgggaacaacggcaactcttgtcccataatcatactgatcaggacaaccagaccttcagcaaaactggttggcagcaggaatcggattgtcttttgaatgttatcaaagacgtgccggccttcagcaaccgcatcaacgatggttgtgaaactatcgttaaccagcaccatatcggcagcttccttggcaacagcagttcctttaatccccatggcaattccaatgttggcctgcttcagagcggcagcatcgttgaccccgtcaccggtcatggcaacgattttgctgttggcctgttgggccttgacaattcgcagtttgttggctggcgtggttcgggcaaaaacattgtaacggccgatgttcttaattaaatcttcgtcggacatttcatcaatctccggcccggtgatggcatgaatactttcatccaagtccaatttgcgggcaatcgctgatgcggtatccgggtggtctccggtaatcatattaaccttgacgccggcacggcgaaggctttgaatcgaaggaatcacttcttcacgaggtggatcaataatcccgacgaccccgcttaattgaatgccgtccgcaatcttgtcctggtcaatctcgtccacatctgtgggaacgtttttgtatcccagggcaaccactcgcaaaccttgctcagttaatttggcaacccgttcataccaagtctggtcatcaaagttggggtcactttgtttgaccatgtcgaaaatggttccgggtgcgcctttaaccattaactcgtgatgatcattttccttgatcaaacgggcactgtatcggtacgccgaatcaaatggcagtgtatccacttcatcgacttccggctcacggccgattaatttgtgaaatagggtcgttaacgcaccatcagtcggctcaccgtttaattgccattcgccatcggtttgcaccaactcggcatcggtagttgtcccggcaatgtcgaccaagtcgcggaattgctggtcttgtttccaatcatatttttgaccatccaataaaacatccccatcaacacctttatcaccggcaataaatccaaccccggtaacttgatagtgatgttcgtcggtaatcacatcggtaactgtcatttcgttcttggtcaacgttccagtcttatcagtgtcaacaatatccacggcacctaaagtttcaacggcgggcagcgttttaacaatcgccccttttttggtcatcacctgaacgccccgcgccaaaacaacggacgtcgaagctggcaatccttcaggaatcgaaccaaccaccattgtgataatcgctatggtcaaggttggcagactgtaaatcttggtgtaaagaccgaggacaaacagcaaaatggcaatcgccacaataaagagtgacaggttaatccctaatttgttcaaattccgcatcaacggtgtcacctgagtcttcacttcggcaacactttgttgaatctgaccaatttgggtatccttaccagttgcaatcacaattccgaccccggatccctgagtcaccgctgttgaagcaaacgccatgttggagcgttctgccaacggaaccgaatccttgttaatcggatcttcggtcttttcaacggaattactttcaccggtcaaagtcgattcttgggcccgcatattgtctgcagaaatcaggcgtaaatcagccggaaccgcgtccccagcctcaaggttaaccagatctcccacaaccagttcccgggccggcacttcaatcttgtggccgtcacgaatcacatagttctggctcactaagagttccttgattttgcttaacgcattgtcagcctgcatttcttggaagaatccaataaacgcgttggcaataataacgatcccaataaccgctgagtctgaatagtgatgcatgaacagcgtaatcacagccgcagcgatcaaaatgtagatgatgctgttgttaaattgcagtaagaactgcagcagcttgcttttcttcttagcggttaattcattgtaaccatctcgagccaggcgtttggcggcctcttgctcgctaataccgtcctcttcgttggtctgatactgttttaccaactcatcggtacttctctgccacaacttttcatcgggaggaacctcgttcatattgtctgccattaaatgtatcacctttccttttacaaaaataagattgttgttaagagtattataatatattactcactacttttggtatataaaaatcttaaaaatcgaccacaaatcatgtgatcgatttcaaatccctattcgacaactttggtccactcatcaatcgtcttgccgttttcatccttcaaaaccagccaactgttggtgccggcaaaatagaggaagaggcccacttcattgaccgattttaaaacgatatctttggtggtcacaaaattgtggaaactatcggcattctcagatctcagtttctgagcaaacttggctgaaaatcccagcgacccatcctgattcaaatcgggttcggctttcatcaccgcacctgccttaaccaacatttcgttacgcttctgccagtagacgattgctttagcgccatcatgatcaacgtaaaacggaatttcactcacctgtttggtgaatttgtggcgtggcttgcccttgaatttcttcttgggaacaaataccgatcggaacccaagaccattcaggacggttaaaaccaaatttcgaaaggcttcaacagtttttcgctgattgctgggaatcttgaccatttccaacagatctttcttaagaattccccgttcaacggcatactcggaaaaacttttggccaaagaaccagcctccaagtcccaggctggttcgatctgaatcacaccgtcggccttgtcagttggttcagtttggacgctgatcagctttccgtctttaaggtacaggttaacgtcggcattggcctgatcgactgtccttgtgaccacaattgtcccttggccgtccggtaaggtcatcctggtcgaatcatcattgatttcaactgccaatttcatgctgcattccccatttcatttgttcttctcatttatcataccattgaataacaaaaaagaagcccacaaccctttagtggtaaaggatcatgagcttacttttaatcgaagaagaagtttgtgatgcacagattattctgtggtcagtttgttggttaaattaccggaccatttccagttttgaacctctggaatatccgtgccgtattgacgaatgtaatcgtggtgcttttggagcatttggtccatcttagcttcaaaatcgtctgccgaagcggcgaacttggtccgagaaatggcatccttagccaagtggtaacgatccaattcattcaggacccgcatatcaaatggcgttgtgatatccccattctcacggtaaccatggaaactgatattgtgattatgacggttgtataccaggccacggaaggtattctcaaagccatggaaggcaaagataaccggtgtgtcagtggtaaagtacttgtcaaattcagcttgggttaggccacggctatcctgatcttcgttgcttggacgcagtctcaaaatgtcaatgacgttgatgaagcgaaccttcaattgagggaaagcctcgtgcagcatatcaatggccgccaaactctccatggtggcttcggtaccggcagtcgcgaagatcacatccggatcgccttcatcatttgaagcccatggaataatccccaaaccatcgttaaccagcttcgtggcttcatccattgagaaccattgtggccgcgggtgtttggaagccacaatcaaattgatcttctcgcgagtctgcaaggcagtattcataacggccagcagtgagttggcgtctgctggaacatattcgttaaccaactcatgacccttttcagccagatgtcccaacatgccgggatcttgatgagtataaccattgtgatcctgctggaaagcgtgggaaacgttcatgatgttcagtgacggataatcatgacgccacgattgttcagaggcctttctgagccacttgtagtgctgagtgagcattgaatcaatgacgcgggtaaatgcttcatatgaggcaaagaatccgtgacggccgcttaagacgtatccttcaagccaaccttctgcttggtgttctgaaagctgtgaatcaataacgcggccttcaggagccatgttttcatcattcggggtcttgattggttcctcccattgacgcttaccataatccagcattgagaagaacttattggatttggtttcatctgggccaaatgctctaaatgacttgccgtttcgcttcatgatctcggtgtagaagttggataatacttcagtatcctgagcttctttgtcacctggtttgtcaatcttcaaagcgtaatcggctgggttaggcatgtccaacttcttggggttgataccaccgttgacgattggattcatcgccatccgctggtcaccgtccggtgtggttgccttaatttcagctttcacagaaccgttgttgttaaataacttttctggttcatatgattttagccaattgatcaacaaatctttatgatccatctgaccggcactgacaggaattggcacttggtgggcacggaatgatccggcgattggattgccgtccaagtcgaatttaggacctgtccagccctttggtgaacgcagaaccagcattggccagtgtggcaaagtatcatcattattgtcacgggcgtgcttttgaatggccttgatttcagtaatgattgcatccatcgttttggccatcgtctggtgaacccgggtatagtcttcggggtcacctttcgtttcaacgaagtatggcttccagcccatgccttcaaagtacttggttaagtcagcgtcactcatccgggaaagaatggttggattagaaatcttgaatccgttcaggttcagcattggcaagatggcaccgtcatggattgggttgatgaatttgttggagaaccatgatgcggctaatgggccggtttctgcttccccatcaccaatttcaactgcggcaatgacgtcggggttgtccaaaattgccccggtaccgtgagcaatggaataacccaactcgccgccttcatgcattgaacctggtgtttcaggggcagcatgggaagcgactccgcctgggaaggagaattgtttgaataatcgttgcaggccagtttcattttgggcaatctttggataaatttcgctatagctgccgtcaaggtaggaattggaaaccatcacctgaccaccatgaccggaaccttcaatatagaacatattcaaattatatttcttgattacccggttcaagtgggcatacataaagttctgtgaggcaattgtgccccaatgaccaattggcttaatcttaacgtcgtcagcgactagatctcgtttgagtaacggattgtctcttagaaacagttggccgactgataaataattagcagccttccagtacagattgactttttgcaggtattcatcggaatcgaaattcgtcatattagtaacctcctgaatttaacagtaacgttattaccaattcgattattggaccggtccaaatcaaattacaagtttattgtatgcctcaggggttgatatttcaatggtttaagcattggaataatttattttgatatagacgaaatttatactaaattcatttagtataaggattagcgcagatttcatgaaatatattcagacaaccaggattagaaacactttccccaaataaggctgggacactttttacaaatgtcccagccgatttaattgctctttgatccagatagatcctgtcagacctactcatcagcctgcttgcgactaatagtgacgctgtcgatgaatgtgcaagtacttggctaagaaatacgccaaatcacaataccaggtttcaatttgtttcatgattcgtcctccaatacaaacatgacccgttttaattcacccagcgcatcccctggattctgccattgaaaatcatatcccagggaaagatttcgataccgaatcccattttctatgacggaattgggcatgtgggaatgaccgctcaatgacaagctgacatgattgtgttcaaacaactgtcgataccggtcgctgcccaactgatacatgaagcgatcataaaagggaatcggcagctggcgagccaactttttcgtcggcagcatgtggctggccaccaagatttttttgccgctgacagccaatcgattgatttgatgctgccaagcaagaatctgctcgactacccatttacgatctcgccgataactgatttgattgccgttaatgtacaattgatcgggccagacatgtttggcaacaaagttattggcgtatcggggaccggctgcttcggaaaaatgattggcaaaggtgtagtcgtaccagccattaattccggtgatcagccagtgcctggtctcaaatggatgccgggttaaagacgttggcagccggtccaggtcacgataagccgttcgggaagccgtctgaatctgctgaactgatttttgccggggatggtccacgtagagatcgtggttgccaatcaaggtgtgaaacggaactggcaaggcttctgccaattgttgatagaaccgcaagttgcgttgaagtccattcgccgagtcccccatgatcaccagctggtcaagattttcatcactgatcaattggcccaatacggacacaaaatcatactggcggttaaaatcaatgtgtaaatctgacacaaaaccaatccgcatggttatctctccaatctggttgttttctatattgtagcgcacgaaaaacagagcaaattaaaaaatgagaatctttacaagttcgtaagtaaaagaaagctgctgacaagcaattagtgacttgattggcatcaaacgacactttgataccagaaaataataaaagatccgcatcatcccaagcatcgggacggtgcggatcttttttaaggtaaaggattatcaaagccttccagcttcgttctagccgagataaggattctcgggaacccgtaccaaatcatcggcaaccaagcgttcagcaatctgaaccgcattccaggcagcccctttcaagaggttgtcggaaacgacccacatgttaaatgctccttcattttcaaagtcaggacgaacccggccgacaaatgtttcgcgcttgccttcagcttcgattgactgcggataaatttgatgggcagtgtcatcttgtaagacaacgccatcggcaccatccaatgcagctttgatttgatcagcagtcgcattcttatcagcaacttcaaagtaaactgactcaccatgggcaattcggatcggaactcgaacacaggttgcagtcaccttgatgtctttagcgtccatgtcgtccaacataatcttcttggtttcgtgaatcatcttccactcttcatgagtgtagtagccgtctgattcgaaaacatcaatctgtggcaataaattaaatgccatctgataatgcttcttgtcccccttggtaggcaaaatctttggctcagttggttcgccgttcaatacctgttgggattcttccattaactcattcagtgcagattggccggcaccggaaaccgcttgataagttgagacgataacttgcttcaaaccatactttttgtaaatcggttcaaggcaaaccaccatttgaatcgttgaacagttggggttggcaataatgccgcggtgattataaagagccttttcgttaacttcagggatgaccaacggaacttctttttccattcggaaggcactggtgttgtccacacagactgcgccacgcttaaccgcttccggcaggaattttttggatgttgagccgccggcagatgacaataccagatcaattccgttaaatgagtctggggtggtttcttcaaccgtgatatcttgaccacggaattgaagaaccttcccggcagaacgtgacgaggccaatagtttgacactcttaaccggaatggttgactgctctaattgttggatcatgcgggtaccgacagcgcccgtagcacctaaaattgcaacgttaaactctttcatcctaatgaatccccttttctctattttgttaactcaagtaaataactgttcatgcgatccattgccaatgtgatgtcttcatcagacgccgcatatgacatgcgaatccagccttcgccgccggggccaaatgcagaacccggggtcacgccaactttggcgtcctttgccaaatgagtggcaaattcaaccgaggtttcgtctattgtatcaggaatcttggcaaaaatgtaaaatgcgccttggggcatgacaatctgcatccccattttttcgagccgatcagcgatatagtcacgccgtttgtgataggcagcccgcattggaatcggatcatcaaggccgttggtcaatgcttcggcggctgcgtattgcgcaggattggaaggagcggtgaccacgaaggcatgcattttggacgcgttggtcacaaagtcctttggtgcagcaatgtagccgattcgatatcccgtcatggcatgggatttggacaaaccgttaatcaaaatggtttgacctggaatcatggccgcgattgagtgatgcttgacgccataggtcagctcactatagatctcgtcagccagcacatacatcttgtgttgggaaataatatcagccaacgcctttaattgagcctctgtgtattcaactccagttgggttggatggataatttaaaataattgctttaacactatccccattttcatcaaggactttttgcagcttttcaggagttaagacaaacccatcatcagaagtgtcaatggtaatcagttcagctccggcaacttgaataattgggaaatacaaggcaaatgccggtgtgggcacgataaccttgtcacccgggttcaagatggtggtcaacgctgaatagatcgcttcggtagcgccaacggttaccacgatttcagtggccggatcatagtaaacacccgtccggtccttgagataattgctgataccgtcgcgcagttcaggaattcccttttgtgctgagtagtgggatttattttcctcaatactcttaatagcggcctgtttggcatgttccggaacatcgaagtccggttcgccaatcgtcaatttgacgatgccgggaattgaagaaatctcttggtcaaattcacgaattcctgaaggtccaactgcgtttacattttgattaacgacttctgaaagtttgctgtctaactgtggcatgttttcctcctgatttaattacataatattttctaagccgacgattagcttggtcgctttggcggctgccggcactgccagttcaaccccgctcatgaaagaggcgcggtcaaacgagtcttggcggatcgtcaaggcttcacctttgctgccgaaaagaacttgttcatgagcaacgtaaccgggcaggcgaacggaatggatcttaatcccatcgtaatcgccgccacgaacaccctttaaggtttcctcagttgccggtgaatcgtgttttccgcgaacttcagcaatcatcttggcggtcgccaaggcagtgcctgatggagcgtccagtttgtcgtcatggtgcatctcaatgatttcaacgcccggcatgtatttggcggcttctttggcaaacttcattaaaagaaccgcggagatgccaaagttgggtgccaggattccgccgacgttggtttgttgagccaactttttgagctgatcaacttgctcatcgctcatcccggaagtcccaataactggatggatgccgtgttcaatggcaaatttggcattatcaaatgcagccgcaggaacggtgaagtcgatccaaacatcggcgtcggtgtcgatttcatccaaactggcaaacagcttaaccttatcgtccattcccatgcctttgagatgaacggtgtcgattccaggattgtaggcccccaccaattcaaagtcatcatttttattgaccatttgaaccgtcttttgacccattgagcccatgaaaccagcgactaaaactttaatcattgaaaaaactcccttgtttatctgtgtttgataatttccaaatcaaccgcttaactgcgcgccatttcagtgccgtcaaccggaatatcttccaagcggctgacacctaatttacttgccagggttgctttttcttcatcgttcaatgaaagaatcggcaagcggcaatcaccggccccaaagccttgaacattcaaaatggctttgacacatgacggtgatgggtacatgaataaggcttgcacttttggcgtcaagaaacgcatcatgtcgccggcagtctcaacatcccctgattcaagggcgtcgtacatcttccgcatctcccggtcgtaaatatggctggtaactgaaatgacaccgttggcaccaactgctttagcagacaaggcctgggcatcttcaccggtgtagacattgaaatcatccggggtattttgaaccagatattccaagtcttccaatgaggtacactgcttaacgccggcgatgttggcgttatgtgataattcgaccaccgtatcgttagccatcgtgacgccggttcgaccaggaatgttgtaaatgatcaatggcactggtgactgttcagcaactgccgtaaagtgggcgatcatgccacgttgatttggtttgttatagtatggcacaaccacaagggcgtaatcaatcccggggatgttacccacttcagctgttaaacgcacggtctcggcggtattgttactaccggtcccggcaataatcgtcccacgcccgttcacaatttgagcaaagcgggtatacaattcaatcttttcgtcatggctcaaagttggtgtctcgccagtggtgccaccgattacaaatccgcggctcccagtatccagtaagtgattggttaatttttccaaaccgtcaaagttgatgctgccgtcttcgccaaacggggtcacaattgctgtcataatatctgcactaatcatcataaatccctactttcttttattgggttaattattcattctgtattcaagaaatctggtaattgatttaattccctttggaatcgatgattctttggggttcagggtagctgaatgaagctgtgaatcatcatcgacgcccaaccaaaacatggtaccgggaatcttagataataggtaaccaaaatcttcgccggtcatcgccggttgagtttcaacaaagtcggtttccggatcctgcttggcaaattcaatcaatcgtcgagtcagttcgtcgttattttccaccggcaaatagccaccctgattaaagtgaatcttgacttctgcgccatagctggttgccactccattggcgaccatttttagccggtcaacaatgtgttcaatcatcttctgggttaagccacgaatggtaccttcaattctggcttgccccgcgataacatttcgaatggtgccggcgtccagtttaccaaaagtaattacaccgccctcgatgggattgacacttcttgatacaatcgtctgaacctggccgatgaattcggctgcggcaaccaccatgtcgttggcgttctgcggataggcggcatgaccacttttaccaatcagatcgacgttgacctcagtcgttccggcaaacaaggttcccattcgacagccaatcgcgccagccggtaaatccgggttgtcgtgcagtccataaaattcatcgggccgccactttccttcaaagacgcctaattcataagcaaccttgccgccgttttcgctttcttcagccggttggaagaagaaaaccatgttgtcagccggctgatgctcggaaaaccagttgaggactcccagtgcgacggtcatatgaatgtcatgaccgcaagcgtgcatcacaccaggattcttggatgaaaatggtaagccggtcttctcgctaaccggcagggcatcgatatcggtgcggtaaccaatcgtccgtttagggtttgatccgttcacgtacaccagcagagccgtcggtaatttggggatttctcttatttcaatgtattgttgattgaaagattgaatggttttcaacaggtaatcatgagtggctctttcgtgcatcgccagctcaggatattcatgcaaatgtctgcgaattccaattaaatcttccttcgttagttgactcattggatcacaactttcttaaatcatcttccagaccagtttccgaggttgtcttttcatcaacgtctttgacctttcgcgctgggacgccggcaaccacagtgtgtggggcaacgtctttggtgacaatggatccggccgcaaccacggcgccttcaccgacatgaacgccttcgataaccacggcattcgcgccaactaagacgttatcgtcaatttggaccggtttggcagatgccggttcaacgacgcctgccaaaacggctcccgcaccaatgtgggaatgcttgccgacaattgctcggccccccatgacaacgcccatgtcaatcattgtgtcatcaccgatttcggcaccaatgttgatgatggcgcccatcatgataactgcgttgtttcctattgtaacgtgatcacgaatgatggctcccggttcaatccgggcattgatctccttgatatctaataatggaactgcagaatttctggagtctgcttcaacctggtaatcatcgatggccgatttgtttttcttaaggaaccgtttgacgtcagtccaatcgccaaacaaagttgcggtgtgcttttcggcaaatgccttgattgattttggaaacttgatgtccttaatcgatcccttgagatagatcttgaccggggtcttcttcttggcattgccaataaaatcgatgatttctcgtgcgcttagttgttccattgtgattctccttaatgtcgttattttgtatgaacttttaatgtaatttttatcgggaactggaaacgtctcaaccagcctgcggctaaaaacacgtttgttagattcttttgaggtagcttaagctttgaaaatacgctccgggagccagatgctaacttctaagacaatcatgattcaagcccaaaatcagggcttcaatcatgattgtcttagaaaccgcatctcctggctccctccgcgctctactctagttgaactcctcatccaacgccaccaaatcctcaaacgtttctcgtctgatggcaacctgcgacttgccgttttccacgaataccactgccgggcggggattacggttatagttggaggccattgcatatccataagctccggtatccagcatcgccaggacatctcccggttgggtggccggtaaatcctgcttttgaatcaagatatcaccagattcacaatacttgccggcaatccggaccgtttctttaatcggtgcacttggattcttggcaagaaccgcctcgtatttggcttgatacagcgcgggacggatattgtcacccattccaccgtcaaccgtgacgtacgagcggattcccggtacatctttgcggctgccgactgtgtataaattgtagccggcaggaccggcaattgaccggcccggttcaatccaaacagcgggcattggcaggttaacttcttccgtgcgtttcttgatggccttaacgattgcatcgacaaacatttccggagcaatcgggtcatcatcttccgtgtacttgatgccaaaaccaccaccgacgttgaccactttggcaacataaccaatttctttattccagtctgccaaagtatcaatcaacttaacggctgccatttcaaagcctttcacttcaaagatttgcgaaccaatgtggcagtgaatcccaagcatgttcatccgctgatcttcaaggacaaggcccagtgctttacgggcctgaccgctttgaatatcgaagccaaacttgctgtcgacttgaccggtctgatcatattcgtgggtgtgggcggaaacccccggtgttacccgcagcatcacgttgatgtgtgattgtttatcttccaaaacttcttttaacaggtcaatttcatggaagttgtccaaaatgatgaccccaatttggtgttcaactgccatttccagttcttcgcgagatttgtcgttgccgtggaaactgacccgttccattggaaagcccgctttaatggccgtgtataattcgccgccggaaaccacgtcgatatgggccttttcctggttaatcagctgaaacattgcaatgcaggcaaaggctttgctggcataactgaccgcaaaatcgacgccgttatcttggaacaccttttgaaaatggtggatctggtcacggatggatttcacatcgtagactaccaagggggttttatattgcttaaccagatccaatgaatctactcccccgatttccaagtgtcccgcttgattggttgataactggtcgatttgattgctcatgttttctcctccaaaatatctttttgtgaatgatggtgtggtgaggtgttggtggctcggtagaagctgtgtctgttgggggggttaaaagcacgcttgttaggggcttttgaaatcccttcggccttgaaaatacgctccgacagccgggtgaaaccctgcctagcctaccagccctcatcgcgcaggaagcacgtttgttatgattctttgagctccctgcagcttccaaaatacgctccgacgggccagatgctaacgtgtaaggccgggatgatttaaatccaagttcgggattttaatcatcccggccttacacaccgcatctaccagccctcgtcgcgctcttaataaaaaaatctcctcattcggcgttcgccaaacaaagagattcagaattttagttcaatatcattccgtatcatttgtcgttagcgccccgcagccgacttatccgccgcgacagtccatagcctcttaagctaagtcccagcgcgccaagtgctacctcacatggtgcttcggcaaccgcccctttcattaacttcaaagttcaggtaggaactccactaattactgatgttggttgcaacctctaatgatttaattgacataattctataatgattctcataaagtgtcaaccacttttatgagtccggatgcaaattcatgcaaaccaatcacgataaactgatgactcttgcaaattaattcaaaactgctaaaattcgttttaacaatctctaaccgaattgttaattaatgggaatatccagggagtgaatgaaagttatgaaagtcgttaagtttgggggcagttcgttagccgacgccgcccacgttcaaaaggtgattcgaatcgtccaaagcgatccggaacgaaaggtggtcgtgacttcggcgccgggcaaaagattcgccgatgacatcaaagtcactgatctcttgatcaaatatgccaacgcaatcatcaatggaacggatgccaaatccattgttgcaaccatttttgaccgttaccaggaaattggcaatggcttccatgtttcaaaaagcgtccttgatgatcttaaggccaaattaactgcccttcccgatcaatcatatccaaacgacgactacctaatggccgcctttaaagctcatggtgagcgattgaacgctgaattatttgccgcctgcctgacagaggccgggacccaagcacggttcgttgatcccagtgaagccggcatcttattgagtgacaatcccaatggcgccaccgttcttgaacaaacctacgacaatctcgccaatttgacatatggtgaggaaaccttggtcttccctgggttctttggatttaccaaagaaggcaacattgccactttcgcccggggcggatccgatattaccggctccattttagctcgcggcctaaaggcggatctctacgaaaacttcaccgatgtcgacgcaatcttcgctgccaacccgaaaattgtgccggatgcccgacccattcacaaaatgactttcagagaaatgcgtgaactttcatacgccggcttttcagttttcaacgatgaagcaatcattccagctattcaaggtcaagttccaattaacgttaagaacaccaacaatcccgatctcccagggactttgattgtccccgaaaaagattttacttcaaaaaaaccggtgaccggcattgccgcatccaaccgattctcagctctttatctccacagatacctgctgaacaaggaggttggctttaccctcaaaattctccaaatcctgtataaatatgacgtttcctatgaacacatgccatcaggaattgacgacttgacgatcatatttgaccgcagtcagctggacagtgatacaattaaaaaaatgtgtcatgacatccaggttgaactgaatccagacacgttggattggatcgatgattacgccatcatcatggtggtcggcgaaggcatgcgggcaagagtcggcacgattgaaaatatcatccggccattggctgagcacgacatccctgtccatatgattaatcaaggggcgtctcgaatttcaattatgctgggcactcgtcaatcagacgccgacgcagcagttaaatatatttaccaacatttttttaaagaagatccttccgttaaccaacttgaataccaggcggaagtatagaggaggcgcgttatggttcaattactcaaagttcatggatcacaaaataagttctttatcttagatcaaacagctttacaaactaaattaagtcagcccgaattggtggccttggctaaacacattaccgaacctgaaacggggctcctcgatggtgcagacggcctgttggtcattgacgattccgaccatccagacactttgggcagcatgcaggtcatcaacaccgatggcagcattgcgtcaatgtgtggtaacgggctgcgcaccgtttcccgttatctgtcagacaaatttggcgaagatcaattcaaggtcgaaacgatggatagtgatctgcatgttcatcgtgaagcagacttggccgacaacgtcccaaccttcagcgttgaaatttctccggtcacttttgctaaggaaaccctgccttttgataatttaggcaccgatacacttatcaacaaggccgttcccgagtttgcgcccgaccttaaattcaccgcaattagtgttcccaatccccacttaatcagttttgtcgacgaggaaaccatgcactcaaagactttggggcaactgggcaagatgctcaacgaccccaatccttatttcccagatggggttaacgtcagcttcgcccagattctcgatcacaacacactgttcgttcgaacttatgaacgtggtgtcggcttcaccaatgcatgtggaaccggtatgtcggcaaccagcttggcattttgtctcaaccatccggaaatggccgactttgacgaactgatctcggtttataatcctggtggcatggttaagaccagagttcacagccgcgatgataccttctcaattgacttgatcggtaacgcgactttcactcacaagattgaaattccggaagccgatctccatgccaatgatttagagcatgcacagatcacagaaaccgatgaacaaccggcatatctgagatttgtggaaagtcttaagaaccaactgattaaatagacaagagtcgaacacaaggcatcttgatttcagaatttaagtaaaaaaacgagttattcctgttttggaatgactcgttttttttgcttgaatggccgggatcagccgctggttccacgtttaagctagctatagcggcccagacatgatcaacaaatagtctgccttagcctcattttttagtgtgctcattaacccacacctcatggattaattgattggccaacaccttgcaaatcatctcaatcagctgatcctgcatgaaagtcgtcgcgtcaaagtctgccggctgcccattaacggcggtaatccgcatcccatcagtttgaatttcaacgttatatttggcaaaggtatcaacaatcgcctgtaatttttgcgcatttaacatttactgacctcccagccgcagctttagtcgccattcgtcttggcggacttggttcggcttgatgcgtaaatccagatagggcgccaccaacagcaagaaatctttgacgtcttcataatgtgatttgcttgagaagtaatgattggctttgcgttgggacaacttgtcaattttaatctgcagcttgtttaaatagtcttccaccagctgaatggtattttcccgaatactggcaatctgggcaatcttttcgtcgtcaggatcctcaatctccaactcttcaaccaactggtaatggtttaattcctggtcaccaggattaatcagttccaagtcaccatcgccaactgcggcagcaaaggattcgccatccgttcgtgccaaataactgggcaattcttccccggtcattttaaccagcagaacggcttttcgagcaatcccctggccaaatttgatgtgaatgacaaaattctttttgccgatataattgacgttgtctaaaattaattgtgggttatgggtaaccacttcaccaatcgcgaaataagtcgcccgttttgttcgataaatctcaccaaattgtggtgtcaattctacacgtcctttcgttgttgctcataagcatcatcatacgttacttgaagattttttcaaagtcaggattttccaaacatatgttcaataattttgtataatgggtattggataattcaaaacgaaatggaggggtcgtcatggccgtacaccaagtcggtattcgagaactagtggaatttttactgcggaccggtgacttaagccccgttatcagcagtgagaatacggcacaagaaggcagtcggattcaccgcaaaattcaacgaagccgaccagcttcttatcaatcggaggtggcacttaaaacctcgatccagtatttggatgacgaatacgtcatcagcggacgagcagacgggatcgatgaccgcgacggcaaaccgttgatcgaagaaattaagacctccgacttggaattcagctcggtgccggactccacccttcaactttattggggccaagtcaaagtctatgcttacatcgtcatgcatcaagcagatattcgatcagttgatctgcagttgacctacgttcagacacctgatgaaaaaatcaccaccaagacccagacgattaccaaaaccgactcggaactcttcttcaccgccttggtcaccgaatttgagcaatggatcaaactccgtcatgaactggacgaaaaccgaatcagttcagcgaaaaaactccaatttccattttccgactaccgacccggccagcacaagttagcaactaatgtctacaagaccattcttttggaaaagcacttgtttgttgaagcgccaactggaaccggcaagacgatttctaccctttttccggcaattaaatcaatgggtgaacagctgatcaaccgcattttttattttacggccaagcagagtacccgtcacgtggcggaaaataccatttcgattatggctgaacaagggctgaaattaaaaagcatcaccctcaccgccaaggacaagattacgttcccaactgaaaaagaactgccacctgagaacaacccctacatggtcggctactatgaccgcgtccggccggcaattaaagatattattcaacacgagaatcaaatcaccaaagccaccattcaagaatacgcagagaagcacaaagttgaccccttcgaattttcactcgacgtcagcctgttttgtgatatcatcatttgcgactataactatttgtttgatccccaggttcacctgcaacgtttcttctcatttcccgatcccaccaactgctttttggtcgacgaagtccataacctagtccagcgatcacgggagatgtactcggcaacgttggaatcatcaccgattgatcctcttttagagcggttggtgaagaaaaaggcaggcaaccaaaaagtcattaaacggcttaaatccttgaagcgctcatttaaacgttatagcaagccagcctcagaagtggttgataagcagatcgctcaactggcgccactggataatttcaataacactttggagaatctaatcgaaacgattcaccagtggctggcaacccaaaccccgagtgataccgttgacgcggtagtcgactattatctgcaatgccgccgttattacctgatcagcaccttttatgacgaaacctaccgcacacggatcatcattggcgatcacaccatcatttttcgccagttctgcatggatcccagcaagcagctcaaagcctgcttgaaccttggccgggctgcaatcctattttcggctactttaagcccgatgtcatattaccgacaagtcttgggcaacgaagaagacagtttaggaatgatttcacattcatcatttccaccccaaaattgccaggtgattatcgccaacaacatcaatacactatacgccaaccgggaaaatagtctgcagccgatctgtgagaacatttacaccatgatcactcaaaaggttggccattacatgatgttcttcccttcaatggcctacctgaacgccacattgagtaaatttgtcgagctgcatccagatattgacgttatcaaccagcagccggaaatggacaatgcggcccggaccgcctttttggatgcctttcgcacggaagatcatcaaaccaaggttggctttgctttactgggtggcattttttcggaaggcatcgatctgaaaaatgatcagctgattggcgtcggcattatcagtgtcggccttcccggcatgaacaaagaatccgacctcatcagagactactttgactcattgaacggccaaggattctcatttgcctatcagctgccaggctttaataacgtcagccaggccgccggacgggtaattcgcactgacgaagacaaaggtgtgatcgttttgatggatcaacgcttcaaccaaacccgttaccggcaaattttcccccagaattggaccaacattaaggtcaccaataatcccaatcagctaagaaatgccctgcaaaacttttggcagcacggcaatcagtaagtgttctcgtgccaaaaaaagcgaatgggtgtatactaataacgctgttcgttaatcgaattaaagccaggaggggtaatcttgaaattagcaatgtatgatcatcagccaacatttgtggcgctccaaaacggtcagttctggggcgttccaattattggttacgactcaatcgacgatattttaaacgattggcagaactttttggctaacgtactcattaatattaacgacgataaaatcatcgacaatgacaatgccactcaacttgatccacaacattttgagcagcctgttcaacatccccgtcagctgcctgctgttggcttcaactatctcgatcacatgaaagaaatggacattgtcaaaccaaagcggcccaacatcttcaataagtttgtcagctctttagccggccctcacaactcgattcatttgagtagcgacaccgtcgactgggaatccgagctcgtcgttgtgattggccgtggtggccgcaacattagccgtgaagacgctgaagacgccattgccggctacatggtcggccaggatatttccgatcgaaccgttcaatcaatcgatggtcccagtacgcagtttgaccttggaaaatcctacaagaattattcgccggttggcccttacataaccaccatcgctgacgttgacgatattgtctccaagaccgttaccaccaaggttaacggcgaaatcatgcagcaggcgacaattgataagatgatttttgatattcaaacgctggtctcttacatttcgaacgtcattgaactgtaccccggcgacctaatctttaccggaactcctagtggaaccggcgttggccgtgatccgcaagtcttcttaaagtccggggacctgtttaccagtgaaattgatggtctgggaaccatcgagacaaaggtcaactaatcaagtcagttatttttaaagaatttccaattaaaaaagctggagctaaatcgttgtgatttggctccagctttgttagtttaagttttaattgcaaattgattctgactcatactcgtcaatcttacttcttgcgtaaaattgaaacgccttcgggtaccgtgaaatccttttgaatcatggttaatttgccagactcggggtcacgcgtgtacaatgtagcgttgtcagaattttggttcaaagcgatcacaaaggattgatcatcgcttaaattaaagtcgcgaggaaaatcgccttccgttgaaatccgctgaatcaatgacaaattaccggattcatctgaactgaagaccgcaatcgaattgttcccacggttggagacatacacgaagcgcccatctttggaaactctgatggcagcggccccattatgttcggtccagtcatcgggaatagtcgagtgaatgtcccttaacgacaggacccctttgtcggcatcatagtccaatacggcaacattgctgcttaattcgccgaccaaataagcgaccttcttcttggcatcaaagtaaatatgccgtggaccataaccgtcttgcatctgcagttcgctaaccggcactaatttaccgttggcttccaaatcatagataaagactttgtcgacgcccaaatcaacggccacaactctaccttccggtgtcaaattgatatagtggggatgaggaccgtcctgttgctcttttcgaaagccgagggttcccttatccataatccggtcggcctttgaaattgaaccgtcatcggcaatccggtaggtgttaaccgttccggcatgataattggcggtgaagactaaccgcttatcttcgtcaaccgcaatgtaagccggtgaagtttcctgatcatgaaccgaggcaattggtttcagtggaaaatcatcgctggtaccatcccattcaacgaagccaccggtcacgtctcccttgtcatctttgactttggtgatcgcgtaaatccgcttttgattggattccgcaacgtaggttgggtcaatggcgctgccaacaaacgttaaattttgtaatttttgattttcagtatctaattctaactgataaacacctttactaattcttctggtataggttcctagcaagtatttttctatcaaaattttccctccaataaaagtttatgtcttcattatgccacagataaaacctaaccaaaacacatttgaaagctttttcacgaaaggaacacattttatgacatcttttgaaaaatttcatcccgtcctcaccgcccacttaacccttgattggctgacccaaacaccggtaaaatccattgacgatctgttttccaagccggcagttacaaccgccaaggccgagaaaatgcccagccaaatcctcgatactgttaaagagatcaatcacataatgcgccgggtaatgaacgacaaggaattgacctggggaattaccgactccaactcagacgcgtttgtgggcatcatcagcctgcgcggctttgaagcagctgccccatcgggatcaattgaattcatcattgaccaggatcaccgtgagtatctggcagaagttgttgaaagagctgtccgattttcccaggatcattttgaattcaatcagctttcaatcacgtttaatgatgtatcttcacaaaccgcaaaagaactgagtggaattggttttgtaggcgacggcgaacagcggtttaccatccaactttaaactaatttcaaagtaacaaaattattaacgacaatccaattcagaatcgttgcatatccagaccaagcatattagaattgttctaaagtaacgattggattataataacagtaaagaataacagaacgctcctcatggaggtgccaataatgacaaacacaactttaaaacgttccctgggtcaacttaaaaaacagggcgtccggattactcctcaacgagaagtgatcttggattatttgattacccaccataatcacccggatgtcgaaaccattcgcgacggtatcgaagacaagttgcccaacctcagcgtggcaacaatttataacaccctcaagatgctggtcgacaatggcttggtcattgaactgccaaataacgatggcggcatccgctatgactattttggcgttccccattaccatgcaatctgtgaaaattgcggcaaaatcatcgacatttttgatgatgactatcccgaattagtcaaacacgttcaacaaaccaccagagaaaaaaccgactttttggtgaccggtacccaattagaggtcaccgggatttgcccggattgccagcgtaaactccacctggccaagcttgccaataaatgattattacagcgttaaactgttgatatatcagtcattagctcgataatttaagaattttgtcaagaactcttaatatgattgacaattagtaccgcaaagcccacgggtacgcgttaaatcgctatccgtgggctttttgtccggttgaattgtatcatgcaaatcgtatatattaatgaccgtagctaattaccactatgtaaaaataaaataaacatttaaaacgaaacttaaaaaaatctgcaataaacacttctgaagggaataattaatttgaaaaaaagagcgattgtaacagccctttgctcgctgacactggcggcaatcggcatgtttggactaagcagcactgcgggggctagcagtgtcaacgattatattgccaataacaatatcggccatgccagtgttacatcatcggtgtggagcggttttccaaagaacgcctaccgaaacggaaccggtaagcctgaaggggtcgtcgttcatgaaactgccaaccccaactcaacgatttataacgaaattgcgtacatgaagaagaattataataacgcatttgtccattctttcgttgatgccagtcgaatcatcaacatcgccaacaccaactacttggcttggggtgccggctatccggccaatgcccgctttgtccagtttgaacaggtcgaagtccacagcaagtcagcgtttgcccacgaaattgccaacgcagcttactacaccgcctacattttggataagtatggcttaaagcctaatgatgcagcgtatgacggcaagggaactgtttggtctcacgggggtgtctccaaatatctgggcggtactaatcacaccgatccagccggctactatgcatcagcaggtaagaaatatttcggtgccagctatacgtttgcccaattttatcaattggttaagacaacctacaataatttggcagacgatggcgcagcccatgggtcattaaccgcttcatcagcaaaaacagcgtatgacaaggtcacatacgccaaagcagatacaaaggcgtcattaggagacaactacaagtcatacagattatataatcacgttaagaattcacgatccggggtcaaatcatattcgtggtcctcagttgacgcttccgttggtaagaaggtctatattgatgacatcgggactaaatcaaacggtcacgactggtatcggattaccttctccaccgacagtggtgcgcaaaaatattgggtctacgaaaaagcccttgacctaatcaattgacatcatttatgaattaatatatgattatgacaatttagaagaccaagtagtgtgcgtacagagaaagtgccgtcggctgaaaggcatttaagaacacgaatcctatcttcaagacgattgccctaatcaggcacggatttttccgttataaaacaaaaagtgtgaagcctggctttgaatgagaatggtaccgcccgttgtgggtgtctcaatttcaaagcaggctttttttatacaaaaatatggggtgagcagatggacaaacggattattaacgcaaatcgaatcgtggtcaaggttggtaccagcagcctgatccacccaaacggtgcggtcaacttgaagacttttgatgagttggcgtacactttgagcgcgctgaataaccagggcaagcaacttgtcctggtttcctccggggcaattggggttggcttgaacaaaatgcacctcaagaaacggccaaccgaaattggtgcccagcaggccttggctgccattggtcagtcagagttgatgacgctgtttacgcaacgattcgaccactatctgacagatattgcccaagtgcttttgacccatgatatctttgattatcccaagagcaaccagttcgttatgaacaccttcaattgtctactgcgggacaatgtgatcccgattgtcaacgagaatgacaccgttgccactgacgagttggaccacaagaccacctttggcgataacgaccaactttcagcaatcgtcgccagccacgtggatgcggatttactgatcgtcttgtcagatgtcgacgggttctatgatcaaaatcctaataaagtcgctgatgccaaccttatcagaaccgtgagtcacgtggatgaaaatgaatttggtgttgccggcggaaccggcagccgttttggaaccggcggcatgcaaaccaagctgctggccgccaaacgaatgcttgatgaagaccggatcatggttttggccaacggtgccgatccacgcattatttttaaaattttagccggcaaagatgtgggaacgatctttcaaaaggagagtgtagctcatgaatgacaaattaatcgaaattggcaaaaatgccaaagctgctgcttataaattgaacctgctggataccgtgaccaagaaccgaatcttaaacgaatttgcgatcgccttggggcaaaacactgagctgattcttagcgctaatcaaaaagacttggctaacgccaccgacatgcccagcaaatttaccgaccgattaaagctgacttcccaacggattactgacatggccgagggcctccgccaagtggccggactggccgatcccatcggtgatatcgacaagggctgggagaatgacgccggcttaaacattgaaaaaaaacgggttccattaggcgtcatcgccatgatttttgaagcccggcccaacgttactgtcgacgcctccgctttgacatttaagagtggcaacgccgtcatcttgcgtggtggcaaggaagccatcaacaccaatttggcgctggctgaggttctccggcaagttctaaaagcgaaccagttagacgaaaatgccattcagattctgcatgataccagccatgatacggccaatgacctgatgcatttgaatcaatacgttgacgttttgattccacgaggcggggccggcttaatcaatgccgtcgtgaaaaactcgacggtccctgtcattgagacgggtgccggcaactgtcacgtttacgttgacaaggatgccgagttacaaatggccattgacatcgtcgttaatgccaaagtccaacgcccatctgtctgcaacgccgctgagaagctgttgatccaccgggatgtagctgaaagcatgctgccggcaatcgctcaggcgctggaggaccacggcgttgagcttcgtggtgatgaagccagccggcaaattgtctcctcaattaccccggcgactcaagacgactggtcaaccgaatacaacgatttgattatggctgttaaagtcgttgacgacgagcaggccgcaatcgaacacatcaatcaatactccaccggccactctgaagtgatcatttccgataactatcaaagcggtcaggaattcttgaataaaatcgactccgcctgcgtttacgtaaatgcctccacccgatttaccgatggcttcgagtttggcttcggtgcagaaattggcattagcacccaaaagctccacgccagaggacccatgggcttgaacgaattgactaccaccaaatatgtcattcggggcaatgggcaggttagaaaataacgagtttaataagcatattgatgagaccgggagactgggacaaaatgaaagattctgttccagcctctatttgcgtccgaatgttatctggcagaactgtgcgccaataagcagcttccggccgtataaggggattacccaaacatccaagccctggatatttgggtaatccccttatcctctggaagcaaaccgcttattggcccacgctgccgttttttattgaaaatacgttgtctttcacttcccttttgtgaccagatgacgtatactgtatttagttagccggctaactaaataaagaaaggggaccaatcgtgagttattacaactttgtcgatcgacccagcaagcagcggattcaagagatggccgatcaattacacttggcagtatcacctgatgcggtgcatttattcttggattttcaactagcctatcgggaggtcgaaaagaactatgaaagtctggtggcgagttttgacctaagcgaatccaggttcatcatcctgatgttcttgtattatgcagatgacaaacagcttctgccctctgagattgcacacaaattgggagttaccaagccaacgatcagtaagttgttgcgggggatggaacaacaaggtcttgtcagcagtcaccagtcttcaactgacaagcgggttcgggatattcagttaacacctgcaggtgaaaaactgctacgaacttttttgccctataactatcggtccagttccctactatttgaagattttactgacgaagaaaaacaacaattcgcgcatttactacgaaaactactcaaatccaaagacaagatccaacaactggaggaagactatcatgaacacagaaaaaattaatttactagaaacctatttaagcctgtacattaaccccatggacgttttaaaagccggtcaaaccggtcagtcgccctatgtgattttagacgttcgaaatgcccctgcccagattaaaaaagaccagatcaaaggcgcagttgccatgccagccaaagacttggcagctcatctgagtgaactggacaaagctaaaacctacgtggtttacgactggaatggcggcacaatcttgggtaaacaagctgttttgatcctactcaaagccggatttgacgcattcgaacttgccggttccctggaaggctggaaaggcatgaacctgccactggaaaccattcaataattttggacgcatttcatttgaacaacagacaccaagaaggccgaaacattagagaaatcctgatgtttcggcctttagtctgtctatttgaatttacttcagtaaatggtgctgttgcagatattgcttagccacagccgcggccgaacgatgtttaacggtcacttggtaattcatctcctgcatgtcacgggttgtgattttgcctgctaatcgactgagggcgcgaaccacttgtggatgcgtcttggcaaactggtcggtcatcaatggcgcgccttgatatggtgggaagaattgtttggaatccttgagcaccaccaaatgatactccctgatttgcggatcggtggtgtaagcgtcggtgacgtcgacccggccatctgccaaggcgacataccgtagagagggctccattgtccgaactgattttaattggaaatgataggcttttcgcaatcctgggtaaccgtcggactgctggtaaaagtcgggatcaaaggcgccggttaattggctgccaacccgttgcaaatccgcaattgtgcgtaaatgatactttttagcggtcgactgacggacggtaatcgcatagccgttttggtaggccattggtttcagataccgcatatggaatttttgactcaaggcatttttagcatccctgtaggccaattgaggctcgctattcacctttttgggggaatgaaccagtgattggagaaccgtgccggtaaattcaggataaacgtcaatttggtcactctgcagtgctttgaagagaaaactggttccgccgaagttgggtttaagttggacttttgtctgtaggctctcttgtttgaccaagtctttatacatattgatcaaaatttccggctcaccgcccattttcccagcaatcgtaatcgtttgggacggcttgttgaacaaggaccaccctaatcccgcgccaccgaggatcagtactactaagacgccgattcccagctttttgaaagaaaattgagataagactttgattaaccaactggcaaccagggccaagatggctgataaaactgcgccaacgattaaggcggcattgttgttagtctgaatgcctaacaggatatatgttccaaggccgccaccgccaattaaagcggccagggtggccgtcccaatcaccaggacagtcgcaattcggattcccgaaagaatcatcggcatcgctaatggcaattcaatccggaacaatttgaaccgtttggtcacgcccaaagcgtcggcagcttccaacaacactggatcaatgtgggtcaggccggcataggtattttggaagattggcataattgcgtacagcaccaaggcaataattgccggtaccgtgccaatcccaacaaacgggatcagaattcccaaaactgccaggctggggatcgtctgaatcacgccggcaatttgtgaaatgatttcgccgatttttggccggttcaccaaaccaatcgctaaaggaatcgcaatcacgatggtaatcaagatcgcaatcaatgagatttcgatatgctgccaaagggcttgcatgatggcagcggcatttttatcaacatatgccacgacttcgtcaatcatttgtcggctcctttcccaaatcggcgacataagaaatcaagtcactttgcgtcagaatggcaccgtccaccaaaatcagctggctgggatttttttccaacaggccggcccattcatagactgtctggctgttctgcagcgtaatcgcctggtcatctttaccaactggacgccccaggccggcattaagcacttgttttaaaagtctggtgccggaattgtcgacgtcaaagaaccgtttgacaaactcatcggcggggttgggcctcaaataatcnnnnnnnnnnnnnnnnnnnnnnnnnnnnnnnnnnnnnnnnnnnnnnnnnnnnnnnnnnnnnnnnnnnnnngcctacgggataccgggtcaagggcgctgaagggttcatccatcaacaccaacttggggcgggcagccagggcccggacaatgccgactcgctgagcttccccacccgataattcgtcaggcatccggttcaaaaattgatcagggtccaaattaactttgctcatcaattcaaccacccggtcatgctttttttgagccggccatcccaagttatcaagttgaatggtggcattttgttcaacggtcatattgggaaacagcgccccggtttgtagaacgtagccaatgtgtcgccgcaatttttgtaagtgactgtcggcgacgtcctcgccgtcaattttgaccgtaccgctggttggtaccactaaacggttaattgtctttagaagggtcgttttcccacttccggaagggccgaccaacacaaaaagctcaccatcatcaatggtgaggttcaaatctttcaatgcaaattggccgtcaaacttttttgtgacattcgtaaactcaatcaatgtcgatcacctcgtaaaatccatggtgttttaaatatactcattttgacgatcgaacacaactcaatgctttaactgggctttgtggagccgcttcaacttgaaactcatcagccaagtcgtaacgggaatcgtcgtaacgaccccgattaaggaaaccacaatcgcgatcaattccgcagcaaacaccttgtcgttaagaatatcgccgaaggaataattcaagccatagaaccaaatgaataacgccaacgaactgccaaagaagccaaagaacagagtattaacggccgttcctatgatttgtttgccaatcacggtgccatccaagaagagctgttcacttttaatggcttgatgttgagttataatttcatccaagccagaggcaatcgcaattgcggcttccgcgaccgctcccaatgaactcagaatggcggttgcaatcgcaattttcgtgaaatcaatgccgacatacgttgagaggccttcaagttcctcgctgtcttccaaaccaaaaccgccaacctgggcccaatattcaatcggaataataatgactacaatcaatatcaaaacaatcaccgaagcctgaaaggccgtggtcgaggcgttgtcactggcactgctccaaaaaatggtgatggacagtaaaatcacgctggcgacaatcgtgacgataattggcggcagatgaaaggcaatcagcacaatcgtgaaaaagagaatgccaaaattaaccaccaggctgagaaatgaggtgatgccctgtttgccgccaacaatgatcatcaagaccagtagaacaatccccaaggctgtaatagctcccattagcgttcatcccctttaatccagagtccggcaaaggcactcgataaaatcaccgtcaggacgatcccaatgccgctaatcaggctggaagtcatccccaatgacatgttcatcgaaaacgaatagtgccaggtgttgccattttttaagtaaagtaaggtcatcgccagggtttcggccatgaagatgaagaacaaaacgttaatcaggggccccataatcgatttgccaatttgtctgcctgatttaaaaatcgccattcgagacagttccgggcgctcctgcttcaacgtcgccaaagaagcgacaatatcggtggcctcatccatgacggctcccagcaccccaatcaggacttcggcgataaacaatggcttgggcagctgagtaacgtactgcatcgactcataatagataccccgctcgttggtgaggccgaagacgatcaacgtaatcaagatcgttgccgccgtcgcgcacagaaccgccgacaacgtcaccagcattttcttgctccagcccataaccagcagtaaggtcacaaagcagaaaataacggccaaaacgctaaaaatccagataaccgcagccccgttattattgtggtcaagcttaacagctatccagaacagaatcgtgttgatcaggatgctggaaatcaccgtcacaccgcgcaatttaagaatgacaaataacaggctgatggcaatcgcaaatagaaaggcaatcggcgcatcccgcttaatatctttaactgtggcgtgtagtttgggctgagtatgtaacgtaataaagagcttttgtcccttggtatattgatggtccattgcatgcgaatctgagtaggcattcttaatgcttaatttttgaccagcatacttcccgttggtaatcgtgccgaaaagctgctgattgtggtaatgatcgacattttgaaactcatcggtcatcttgattgctttgccgttttgcacccggtccacccgataaatggtctgctggtacaggccatcattgtgctggcaaaaaaaggccgctaaaaaacaaaaggcgacgaccaggacaatctgaagccacgtcattttactcgttaatttagagttcatattgcacatcttttcagattaattttagaattattgtaacatctgtagaaaaagaagcgtggatttatttggaatcgttaggaaagtgaaagattcaccggattaaaaaagccggtgacaaggataactccttgatcaccagctattcatcaggttttacaaacccggttactcattattttttataatcgacaaccatcacattaactgttgaatgccggacaacgtaagctgttgtggaacccagaatcgctctggatatcccgttgaccccggactttccaatgacgatcaacgaagcgtcatacttttcgggtaattctttggcaatttgaatctttgggactccaacaacgaagtgggtttcgactttagcgcccttcttctcggcaatttctcgggcatcgtccaaaatttcttctgcccgctcacggaacgactccatcacgtcctggcccagcgtcacgccgtactgaacataacgttgatcactggcgaccgaaacaatctgcagggtggcatcaaatgacttggccaaatcagcagcttcttccaccgccctcattgcattgtcactaccatcaactggaaccaaaattgtgtcatacatctccaacacctccgaatctgactatctaagttaatcataccattgtgtgatggaataaacataaatcaagtccggataaatctactcaaagctcagatgcgaaataattgttttgttatctgccaactcggcatgccgttcttttaaccggtcgtcataggtagcaagcagatatttttcttcggcagactcaccgaccaactcagggaaatggatctcactgatttcattggtgacgatcagcgtgcaaaaagccataaaggcaacctgaacgtctttggtcttggtatcggtggtcaaaaatttggtaaagacctccaccgcacgcttactgctgccagtgacataggagatgcacgttaaaatctcattgggccgggcaggtgataggaactggacatggtcatagcccgcggtcacaaaggacaaatttcctgggagaaatttcaccccggccaaaccggcattggcatccaaaattcgtaaggtttcgccgccaaattgaattcgattgttattcaactgggctggaaacacatagctttcatgaatcgccctggtgtctgagcacttgatcgtttcgatgataatcgcctccaaattcaacggattttcaatcacttgctaataaaatctacacatacaatgataaccttttcatgcctataatagcaagctttttaagtgttatatgaaaggattgtgaacgaaatattaaattattcagctgcttattgtaagcgatttcacataggtgtaaacttaggttgttgatggtaagaagtttttcattctaggaggtcataattatgaaagcagtacgtatttatggtgaaaaggatatcagagttgaagacgttgagattccagaaccaaaggatgatcaagttcaaattaaagttaaatattgtggaatttgtggaagtgatttgcacgcctatctcgaaggctggggcctgccaaccgttccttatccgttaaccggtaaaaccgtgccaattacgctggggcacgaattctcaggtgaaattgttaaagtcggtaaagacgttgacgacttacaagttggtgaccacgttgccgttgaaccacttttagcttgcggcaaatgtgaaaactgtcgggcaggaaactataacttctgtaaccgtgccgtttcaactgatggcgccggcaacttcctgggcttctcagaagatggtgggatggctgaatttgccaacgttcaaggggtctttgcccacaagatgccaaaagacatggactttgaattaggtgctttggcagaaccaaccgccgttgtttacgaagctatcaagaagagtcatttgcgtgaaggccaaaacgttgctgtcatgggagccggcccaattggcttgctggaagctgttttagctaagatcgcaggtgccaaccacgtatacatcgttgatgtttccaaagttcgtttggacaaagccaaggaattaggcattgaacatgtccttgacccaagccaagacgacgttgaaaagatcatcaaacaagacttaccaaatggtgtggacattaccttcgaatgtgccggcgttcaagcaaccttcgattcagcattgaaagttacgaagcgaaccggaattattcaagtagttgccctctatgcaaaaccagttaccatgaacatgactgatgacctgattatgcaaggtaaagacgttatcacaaccctctgctacaacaactcattcccgaatgtgttaggcattattgataatcacaaggatctgttcaagaaagtggtcactaagaaaattagcttggataatgcattggaagacggcattaaagctctctcaaccgataaatcacaagttaagattatgatcgatccatcactgtaatcatctagtaagttaacgagaaagtaggaagaccggcaacgatgaacaaaaaatgttcatcgttgccggtcttttctttgttagagaagttgctcattgggcttaaagaataaccaacagatattcaatccatcggcaaaaacatatgttataatcttcatatgaaaggaatgacatatatgactgatgaccccgtttcaatcaactcaatcgttctcattgataaccgacatttgtcagaatcggaacggatttttaaattacttagtaatcccaaccggctgcagatgctaaaagtccttgcgcagcaggaactgaacgtcagtgagctgggaaatctgcttggtttggagcagtcctacgtttcccaccaattagcattattaaggaaacatcagctggtgtcatcccaccgcgacggcaaagccaactattatcaactggatgatccccacatcctctacgtcatcaatgagatgctcaagcatgctgatcacgttatcaggggtaaaaagcatggagagtaacactgattcacaaacactagttgtccgcagcctccacactgaatacttttcaacggcctggatggctttcgaattcatggttgggttttattcaggtctcaaagccggctcaattctgttaatcgcatttgggctggatagttttttagagattatttctggaagcacgctcatttggcgactacgaaaggaaaatactggtgccggccctgaagcaatcgaacgggcagaaaagcgctcctcattaattgttgggatcgttttactgttgctggctgtttatgtcaccgccgtgtcactgtttaacctattcactcacgcaacggcagacaccagttattctggtatcgccattgggattgcctcggttttattaatgcccattttgatggtccggaaacagtcattgggcaaagcgctccactcagatgccctcgttgaagatggcatgtgcaacatcacctgtgcctacatggctgcgacagtcttaatcggcgcactgttaaccgcgctgctcaactggtggtgggctgactcagtcgcagctttgattttagtgtattttattgccagtgaaggatgggagtcgtttcaggaagggcatgccaaatagagtggggcacgaggcgttttgatcccggccatttaacgcaagtatggccaaagcatctccaattctattctcatttttatcattttgaatattacattgtggaaacgtgggaattaaagcagtttccggccatataagccagcaatccaaatatccaaacgcgggatattcggattgctggcttatattctggaaactaaccgctttaattcccactctggcttacattcccataaccagccgaattacaccaagcgaaataacccccactaccacaatcacgagcagatttttggaaatgactgctgccagcactgtcggcagtgaagcgaggaaattttcccagtcaatcgatggtaagtgaccgacgtgttgaacaaataaattctcaaaccatagcgctgacataatcgcaattggaacaaaactcaagaattccacgacgcctttagacagctgaaattttttcagcacgacaaacggggtaattcgagacagccaagtgacgatgcccgtgccaatgattgtcagcagcacaaaattaaaagaaggcatgtttcatcaccaccccaaagctgcaggccacaagggtcaccagcaaaattaataaactgcttgggatgaagatcaagcccaagtaaattgcaaccaacacaaacccgaccacgatcagttgcaagttgaatttgattgatttgtcgctaatcaattgcagatacagtaaaccaatgaacatcgctaccagagcaaaatccaagccaaatttttcaggattgctgatgaaattccctagaaccgcaccaaccaacgaagaaagaatccaagtcatgtaagaaatgacgttggcggtattgaaccaagcgaagttcagatggttatcagaataattcagcttgttcatccctaaagcaaaactttcatccgtcagcaatgtcccaaccaaaatatttttaaacatgctgtcatacttaaaataagaggccaaagtcgtgctcatcagaatcatccgcgagttgaccaaaaaaacggaaaaaataattgaaaaaatggggctgtgggtcaccagcatactgacaataacgaactgtgccgacccagcatatgtaataatggacatcaacgttaccaacagtgggcttaatccagcggctttgccgacaatgccgaaagccacaccaattcctatgtatccaaataccgttggcaatgtatcctttgaagcggcagaaacagttaaatcaccattcatttaacacactccttctttgtgacatgagaatgtaacttattagtattagtaaaattttaatggtgttctaatttaaagtcaatgatatttagataagaaaatcctgaagttcagtcattatactgaatttcaggattttgttagttagccagtgctctttggtaggcatcatacgtcccgggatcaaaacacaccatcgtcacatcaagcggtgcgtcaaacgttcgaatggcgtcaatggcaatcttagcagccttatcaagtggaaaatcatagacccctgtactaatcgagggaaaagcgaccgtctggcaatgattttccactgcccgtttgaggctattcacatacgaatttcgcagtaattgcggttcattgttatgtccgccacgccaaatcggcccgggagtgtgaatcacaaatttcgccggcaatctaaacccgggtgtaactttggcttctccggtcggacaaccattgagcttccggcaggcctcgtcgagctctggaccagctgcgcgatgaattgccccatcaacaccgccaccaccgctcaaggcggtattagcggcattcacgatcgcgtcaacctgcattgtggtgatatctcctttgatcaacttaaattgtgccatggtttcacatcactttctatgggctttctcccatgctttgatttgttccaaacgttttttgaagcggacttcattgccttgctcggtcggttcataatacgtgtggccaaccagagaatccggcattgtctgcatattagtcaacttatctttggcttcgtgagcatattgatagcccttgccataacccagcttggacatcaacgaggttggcgcattgcgcaactgcagcggcaccggctcgttaattgagtgcttgacgtcggtttcagcacccagggttgccttatacacggcattggacttgggggccaaggacaagtaaatcgcgcactccgtcaaatggacgttacattccggcatccccaaaaattggcaggcctgaaatacattaattgccacgttcaaggcgttagtatcagccaaaccaatgtcctcactggcaaaccggaccattcggcgggcgatatacaagggatcttcgccgccgctcagcatccgggtcagccagtacacggcagcgtccgggtcactatttcgcattgatttatggagcgcagaaataatgttgtaatgttcctcgccatgcttatcgtacagaaatgacttggtattcatcaactggtggagattgtcggtcgacactgtcaccttgccatcctgcttgggactgttgttaaccgccatttccaaggtgtttaaggcaaccctggcatcgccattggcaaattcggcaacttctttaaccgcttgatcgtcaatcgaaatggtttcttttggaaaagctgctggatttttcagcgtctgatgaatcagctgaacgatgtcatcggtctccaaaggttgaagcacgaatactttgcaccgtgataacaaggctgaattgatctcaaacgatggattttccgtcgttgccccgatcagagtaatgctgccccgctccacgaatggcaaaaaggcatcctgctgggctttattgaatcggtgaatttcatcgacgaaaacaattgtcttgccgcccatctcccggttcgcctcggcgtctttcataatctctctgatttctttgatgccgctggtgacggcactgaaagtgacaaacttggcctgcgtttttttggcaatgatctccgccaaagttgtcttcccaacaccaggcggtccccagaaaataattgagggcaactggtcactttcaataatttctctcagcactttgcctttgccaaccagctgatgctgaccgacaaattggtccagtgtctttggccggacccggctggctaagggctgattgccgtcctggttgccggcaaataatgattcctgtttcatgaagacacctcctgacaaatgaaactgctatgtatatgcccattatacgaacgcatgttctaaacgtcaactctacctttattttagcgcactcagctttcattgaccgaatttcgcaacttatggcctggctgattgtcttcctctcaggcaatgtcaaagtgacccgaattaataagactctcaagcaacgcaatcaatcccagaataaatcgtgatttgatgggtgataatttcccctcaacaataacaaacaggttataattaagctgaatttatgggctgtctgtttgttttttgagggagatggcaaaatgtcatataacaataacttctatcgggagccggcattttggctgagcatctgtgcggctgccgtgggcttgatgtccctatttcttggtaatgcggtccagtacagcatcatctggtggctgcaattgctgatcgtcgtcattgcactgattgggattttttatttcttttcgaaatattcaaaggatcaggaaaataagaataaacatttatagcactagaatcatcaaaggcgccccgtttctaaccagaaacgaagcgcctttaatgctttaactatgacaaattaatccgttttcgatacttccgaaccagtccgaggcctaacaaccccagccagccaacaatcgacaaagcggtgaacaagccattgaatttaactccacggctttgaatgctgattttggcttgcttgacggtctgtggaatggtgagcttaaaggtcccccgattcgaagttgccggcttttggatggttttgccattgaatttgaccgtgtaattcatcccggcatagtggacaaatggcaaatccaatgtggttccctttttcatcggcacggccagctggtaagaaagcgaattgttgcctggatgcaaactggccgtggcaatttcaaatcgctgtccgtttaaaatggtcaccttgttggccagatcatcaatgtgcttgccggcagtcattggtaagtaatcggtccgcccggaaccgttatcggttgggaactgattctgataatcctggttgttcaccttgtaattttgcaggttcaggttggaacgtggaatttgatgcgttggggttgctttgtaggttaactcaggctgactggtgcggttgaactgattatcatacgggttctgatcggtagctacgttcattgaatacatcgctgaataatcaaatgaattaatcagacaaagacttgcaacaatcaccagtgcactgacgccgatcgttctgcgactgaactgggttgccaacagataactgccaaaagcggcaatgaacattactaaaaccggaataatgcggtgcccactttgaatggcctcgattccattaagcaatggaatgtgatgaattaaattccatgggaacaagttggataacacaaacaacgttacaaaactactaaagtaggcatatcgaccaattggcggcacccgtttgatgaagaagcccccaaagatcaacagcagcaataaaatcaggccgattcctttgttggccagactctggttcagccaggtgaacaaactttgcggatctgcatacagtgtttgcggattcggtcgcatcaatttttggctcatcgccaacaccgcgatcggtccccaaacgatcagactcaaaattaaactataaacggcggcgatgccaatcttcatcaatcgagccgcccgttctttaaccggctgcttggtgaaaaaggccaggtaaaacaccaataaggcgatgaccacaatcaacgtcgtcggtgcgtgcgcgtacatgatcccggtaaccccaatggtgagcaggtaccagcgattagtatcttcgaacatcacctcgtaaagaccggcaaaggccagtgggatgaatgggtaggccagaaattcaccaaactgagtggtgatgatttccatcaccaaataagtagtcagtccatataagatggcaaaataaaatgaaattcggctggacttggaaaccaatttcatactgtaataagcaatcaccagtgtggcgaacacaaccaggacgtaggcaaaataaatcgcgctaatcggtgaaagcacgaaccgcagcccggcaaatatgtacagccaaatccatgggtagcaggccaccaccgcatccccaatttgattaaatgtccgggtggcaatgtggctgaatggcgctccgttttggagattggccagcatttcctcaatccggctcaaatgaaactgtaagtccgggccggaatagacgtgcatcgtcagccaaaacggcaaaactgcaagcaaagatagacaaaaaaagccgaggttgatgaccagcccctgatgctggcgaaacttggaaagtaattgttgagacataaaaaatggacctcctaataaaaattagcggtcccccctgtcgctgttgtattttatgatacgagatatccggtcaaaattcaaatcttattctgacattagtggatggtgcaaaaaacaactcttccaattatgaaagagttgtcttaatggggaaaataacacgtgtaaaaagattaaacttaacggtcaatcgtatccgcagtcatgtggaatacgtcagaaagtgaagtcgtcttgtcagcaaacttcttgttcaaaatcaactgacgaaaatcttcgactgagatattttcagtatctttaattgggaatgcctgaccggtgtatgaaccggttattaacgtgatcaccaaaccattcttgctgtccaaatgaacttggtaattctcaaagtagatcccatcatcataactaccggacaaaaacttgtgagttgcaaaatagtccgaaataaaatcattgaacttctcttttgaactcagtgcttctttaaattgtgtttgagttgcgactgtcatcgtaagactccctttctctcaaaattgtgtctaatcaaataacaacgcacatctatttttgtaaatggtctttatgagtcatctactaattttcattttagtccgtcagtcgcattgtgcaagtgaaaagctaatgaaaacgttgtcagaacgcaatttgtaacatttgcattctggcaacgtttccaattttatttattctttttcgacttctctggaactttttccaattcagccagcgctttttccaattcggccttctctgattctggcaggtcggggtacttaagcggtaattctttcattcggcgatcaatgatgtcagaaacacaaagtctggagtaccatttatcgtctgaagggatgatgtaccaaggattggtcttgttggctgtgtgctcaatcgcatcctcataggctttctggtaatcgttgaagtaacggcgttccttaatgtcagctgaggcaaatttccagttgtgatccggcagttcaattcgccgcttgaaccgatcccgctgctcatcggcagacatgtggaggaagaacttcaagaccatgaagccgtttcgggtcaaatagtcctcaaagaaattgatatccttgaatcggccatcgaagaatttgttatccacttgatcaagtttggtgatcgaaccaatcttagcgttgacaatcatttccgggtgaacccgactgatcagcacatcttcgtagtacgaacggttaaaaataccgataatcccatgttccgggatgtgtcgatgaatccgccacaggtaatcatggcttaattcaattgaggttggtgacttaaagcttgtgacctcaattccctgaggattaaccccgctcaaaatgtgtctgatcatactgtccttgccagacccatccatgccttgaaagattaccaagacaccaaaatggttttgggcatataatttcccctgcaaatcttgaagcgtcgcaatgttgttttcaattcgtgctttgatgtcatccttgttcaaatcttcaacggtggcggaagtcggaatcttggcaatctttagatcccgatccccgttgtatcgaaaagatttctcacggtcaaaaattttcttttcgtccatagtgttgccccctaaggaatcatttgtaacaactttataatagcttatcccttggaaaaataactaagagaatgtttattctccacatttatttctcatattgagtatactagattacatagaattagtttcatataacgctgttttagtgtcgcttgaaacatctatcaactctctttgaaggaggacttaatttgaatatcttaaaagcaaactcaacaactggtggccaacccgaccaaccagccgaagattcaatcgacaagtcgttattaaaggacgacctttacaaagccgttaacggccgttgggaaaagaccgccaagattccggctgaccattcgtcaacgggtggcttcatggatctcaatgacaacatcgacaaacaattaatgagtgacctcgatgacatcatcaaggaaaatcagccacacgaggagccgttctccgaattcttgaagttgtacgaactggcccgcaactataagaagcgggatgcagatggtggcgaaccactgaaaccgtatttggaaaaaatcgaaaacatcactaattttgatgatttgaacgaacttttgccggagctggttaaggaaggttacccactgccatttggcttttgggttgaacctgacatgaagaatacacaggtcaacgctttattcgctgcggttcccggcctgtttctccccgaccgaacctattatgaaaataataatcccgcttacaagcaattgatgccggtcttcaccaagatggccagccaattactggtattagcagactacagcagtaatgaagcggatgaaattgtcgaatcggccaaacgatttgatgccaaaattgcaccaaacgtcaagtccgctgaggaatcggccgattacagcaagatgtacaatcctcaggagtttgcctacttctcagaatcaagttctcatcttgattttgtcaatctggccgacgcgttgtttggcaaggcaccggagcagatcatcgtgaccgaaccgaagttttacgagcgctttgacggtctggttaacagtgacaccttcaaagacatgaagaactggatgctggtcaatatggtccgtttagcatccggctatctatcagaagaattccgtcagaccggttctgtcttcagccgtgcgctatccggtaagaaggaagcaacgccacagaagaaatcagccttctatctggcagaaggaacattcggccaaacaattggtgactattacgccaagaaatactttggcccgaaagccaaagctgacgttgaacacatggttaaaaacatgatcaacgtctacaagaaccgcttaagcaataacacttggctgggcaaagacacccgcgagaaggccattttgaaactggacaaactcgaactccaagtcggttatcctgaccacatagatgaattggaatacaaattcaaagtgacccctgaaaatgaaggtggcaccctatttgacaacatgtccaagtttggtgcgattaccgttcaagacacctttgaaaaattgggtaagccggtcgaccgaacaaaatgggaaatgagcgccgcaaccgtcaacgcttactacgaaccatttaagaacatcatcgtctttccagccgcaatcctccaagcaccgttctacagcttgaagcagacttccagccagaactatggtggaattggtgcggttatcgcgcatgaaatttcccacgcgtttgataacaatggttctctgttcgatgaattaggtaatttgaataattggtggactaaagaagatcatgaatacttctccaagctggccgacaagatgatcaaggaattcgatggcattccatttgcgggtggtaaggtaaatgggaagctgacggtttccgaaaacattgccgatgccggtggtctgagctgtgccaatgaagcggcaaagaatgaagccgactataacttgtatgacttcttcatcaactgggctaaggtatggcggatgaaggccacggaacagtataagcagctgctgttaaatatcgacgtacatgccccagctgaattgcgggccaatgttcaggtgaagaatttggatgatttttattcgacgtttgatgttaaagacggcgatggaatgtatcttgaacctgataagagagtgaaaatttggtaggaagcagacctattggaacgctttttatccaaataataatcgaataaagacaaaatggcacctaacctcaaaaaggtttagtgccattttttattcttaccatttgttattagaagccatttgttattagaagtgatcaataaccagccaaaagtagcctttgccggcccttgggcaaaaaacacgcttcttaggttcttaagcgctcccttcggcctctcaaatgtgttccgacggccgggtgaaaccctgcctagcttacttggcgacggcgcggaggctaacttctaagcgcacctgaactaacggggcttcgtatctctctgctcctcaaggagaaaagcacgtttgttaggccgttaagtgctctcttcggcctttaaaacagactaagcttgtgatgaattaaaacccgacggggctttagttcatcactttttggtataaagtgattgtgaagttagtaatgccgtgagcatatttggcgctggacgccgtctctaaaactggctaacttcactg

SEQ ID NO: 200 - DNA, 305 bp, Lactobacillus buchneri
gggctctaccgagggtcgccttgccagcgggacagaccccaccgctcatttttctagcgaaaaatcttgctctcgtggcagttaattttagctgttctcttccgccaaaataatcgccactcactagcttaatttttctaagaaaaattgacgcccgaattaaaaaaaatctcggctatcttttccgccgagattcctttaattcgcaaaaccgaaatttttgatccacaaaaaccatggaacaaaatttcaaaaatcactaaacatgcaatgtttatatccgactttcgtatatgccgtcatag

SEQ ID NO: 201 - DNA, 305 bp, Lactobacillus buchneri
aagctcatataagccgattgtgaacgttgaagcggttcgagtgaataaatctaagggaaagtcttctttgcttgctagcgcgcaggaaacggccaaatatcaagttaagtctgcggattacatgacggacgatgataatcgcaatcaacaggtgattgatgacttggagcaagccttggctggtactcgtcaaattggttatggaggtttgttgaaacagattaaacagcaattgaaattggacgatgccgataatggtgatttagtaaatgttgacggggacaaattgtctgaaccgactgaag

SEQ ID NO: 202 - DNA, 305 bp, Lactobacillus buchneri
gatgagcagcgcatccacatttattataacggagaagaaattcgtacgcactccataactaccaattcgctgaattatgacccccaagatcagttcaatatcctcaaatctgatttgcttaaagggcggacagatgaagacatttcagcttacattcgtgaacatatgactgattacgacaacttataggaggctaccatgaccactaataatcaaattcttttaaataatcttgagcgcttagggttaaacaaaatccgtgaatacttgccgaattaccttgatcaaattcacactgataatct

SEQ ID NO: 203 - DNA, 843 bp, Lactobacillus buchneri
atgtcaagggcagtttaaaaatgtaggttttcggcagaaagaaatgtaggttttcggcagttacttgaggccacgtaatcggtaagatttaccagtgatcttcactacgtgaacatgatgaaccaagcgatcgagaatggctgctgtcacagttgggttctggaaaatatcaacccaagcggatagatcactattgctggtaatgatcgttgaatgcttttcatagcgggcattgactagctgaaataagaggttagcttcttggtgaccaattggcaaatacccaatttcatcaataattaataggtcatagcgcgaatagcggcttagagatcgatcaagcagtcctttttcgtaagctgctctcaatctaatcaacagctcatgacaattaataaagagaacccgacagccctgtttacaggcctcaatcccaatactaattgccaagtgggttttaccgactcccggattgccaataaagattaagttttcagacttttccataaaagccagattctggaattccagaacctcttggcgattaatactgggttgaaagctaaaatcaaatgtatctagggattttgtattggggaaccgagcacggccaatggcccgtgcaatctgaccttcgtgtcgattctggagttccgaattagttaaatcaattagcgcctcagttaatgacagattatcagtgtgaatttgatcaaggtaattcggcaagtattcacggattttgtttaaccctaagcgctcaagattatttaaaagaatttgattattagtggtcatggtagcctcctataagttgtcgtaatcagtcatatgttcacgaat

SEQ ID NO: 204 - DNA, 5559 bp, Lactobacillus buchneri
  misc_feature (2886)..(3026): n is a, c, g, or t
ggctttaaaacaggatcatagtacatcacggctgtataggcttgttcctgtttaatcattggtaattcattaaaattgccgttaggaaaggctcttcttaaaacttcctggtattgggtttgaataacttgcttaacagccatgattgttcgtaaatctttgactgcgcgagtaatcttttgctgctcggttggtgaatacttttctagtagaccttgatcaacgtgttctagactttctaagctatcatcatgaatcatcagcgtatatttaagctcgattttgacttccttttcttgttgcattaataacttccagctaacgtatggccgcttagtaaaggtcaataattgttgcgtcaacaaatcatcacgaatattcattaaacgttcgtttaattcactacccttgaaaactgtttgttcactatcggtttccttaattaattctcgtctttcagcttgcgtggtctgttcaaagttaagctctggataaagttttttcgtagtgcgatcaactactttatttaagagttcatctgcttttttgagtgagctttcttgttggttaattgtcaataattgtttagtcacatcttcaccaaccgcatgtttaattaaggtgctgtttttccaattaaatagcatgcgccgcttatcatctaagttctccaaactgatataagttttcagttcatggcttaactctttgactacccgtttttcattaaacgagaagtgtttacttaggctatctaaatgacctctattgattactttttcttggttatttttataactggctttggccttgcgatagtccttaacttgttggttaaatgcttttctttcatgccgcttactattgattccctcatgttgagttggagcttcatttattccttgatcttcaaaggatttttcactaattcgatcaggaatgtttttttgctccaaagcctgatttacacttgccgcccaattgtgccgccattcagttattttttcttttttatcccaatcaaccaaccaaatttttcggtttctcacattccctgcaggggtcttagttttattaccatgactatctaaaatgtattcggtttttgttttctgtccccaagtaccatcggggttaaatgggcgattggttaacatcacgtgtgcgtgtggattatctgggtgatctctatgaattgccacatcagctaccataccttgatcgacaaaattttcttgcacatattttgtcagtaattctttctgttcggattcacttaattctaccggtaaagccacgttaaattcttttgcataccgtgagtttgatttacgatctttcttttcaacttcattccacaactgctctcgatcactcgcccattctggcgcattttcgggagttaaaataaagctttctggcataaccgagcgggcataaaaatagtggcggccttcttgattatcaaataatttttcaccacttcgataagcggcactggcaatcgcacttcgtcctttaccagcactaatattactaaaactcatgtgaaagattgccatgtcagtcaccgtcttcctttgattctatgggcttgactttgttgtcgccatcggcgacttctaatacagcttttaatgggtttagcacaacgtcatcaaagatgacgtgtaagtgcgcattgacctcgtttaactcggtctgctgattcccctaaatttacttatagtgtatgccttccgcttcgctatttcaactttcatcctttgacttaacattctctgtatgatatagtgtcggtgatcatttctaatatgattggagggatcgttatgtctcaaagtaacttagaaaaacaagaagctaaattaaaagcccttaatcaaaaaattaaggacgaaaaaaataagattgaacaacggctaggtaaacaaatcatcagtcaagccaatttagattatgctaatttgtctaacgatcagattaagcttttagcccagcaattttctgaatttttaaaggtaaagtccgtagatcattagccatacgagatggggaaattccatgtctaatcaatatgaaaaactagtcgagcagcaagcacgtttaaaacaaaaaattgagcgagaagattttaaattacggcaatctaaatactacgaaaatcggcaagcccgcaaagcccgttctcgccgattaattcaaaaaggggctttgctcgaaaaatactttcaagctgataacctctcggtcgaacaaaccgaagaacttttaaaaatatttgctgactatgttaacgcccataaaccggataaattaaaaaacgatcaacctaataactagccgatcgtttttattttcaggattgttttttggctttacttctgggttttgatctgcaaaattttgtaactgcttttgcaccttttctggataagtaatattggggtttatctatcaacggacaaagtcctttcgcttaataacctcatcttgccttttatctaaaaagtaggtatataaagcgtcatatactttgcgcttttctggatctggctcatgtaatgacttatcaagtaaatcttttaaatcagtttctttggcaatttcaaaaaagtcattaattgtgattgtatctttcatgttcatcacacttccaagttattaatttatttaatctgataagccattagtcctcatctggatcattgagccaatcagcgacttctttatcgtctttgaactctgttactggtgtctctttggtagcctttaaaaagcgtaaattagctctttcttcttcgcttaaagacacattaaaaggtaaggcaccattagcaacaatccgcttataaaacatattgatcgcggtagttgggtttagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttattactactcacattatactaatatttgagtaccatctcaattagcctgcttctttaaaagttgtgaatttaagtttgctgtcctttccgcaatggcacttatacaacggtcctaaagtgcccgtaagcgcattttaaaactcgtttaatataattatgctctatctgtttaaaacagcttaaatggccttatatagctttttagttttaagcacgctcatcgttagggtgtttggccgcatactctctagccgcttgtttattccaccaagcgccaattcagccactcaaggtgtctatttttgcttctaagcgattttaaagcgattttaatataatttatgcatgtaacacttaaaacggcttaaatgagcttatacggcgtttaattccaagaacgctcattgtcagtgttctgttcttcggggtgattggccgcatactctctagccgcttgtttattccaccaaacgccaaataggttttgcatggtgccgtacaagtagttttccacgttcttgatgtgcttctcattgcttcttagggcgttaaagtagcgtctcaaggctttagtcatcaaaggttttagttcctcatcatcaagtgggattatgacaccaatatctttgtgatctttctcaactcggtacttagcatttaagataatgccaatgaagcgccgcatttgttgtggggtacggcaccaaaaactaagtagttgcacagcttctggttctaagaaaaccggtaagccactgtcttcatcagttaagaagtcattagcatggttcaccaaatcctggttttgtttttgaatttctgctggtgaaaaatggactgtggaaaagtccaacttttgagtatctatattgtatctttttttatctctttctttaggttctttatatagattaagtccattttttgaacttccgctcgtagcaagggtttgagagctgttgtcaacgaacttatgcggaagtccattttttgaacttccgctcgtagcaagggtttcaacggtctcccgcggaagttcattttttgaacttccgctcgtagcaagggtttgagggctgttttgaccatattcaccgcgtaaatagacatcggttgctttcacatcgagcttggacagatataagcgattcggttcattctttttagttttcgggttaaagcccatttgtttctgaacgagtaatccgattgattccagctctgcttttattttgatgacttttccctttgaacaattgaacaagtccattaattcttgattggtaaagataaagtagacgtgtcctttactatcaacccagttgttgcgcaaagaatactctaatcggtctttcagtaccatataggctaatttagcgtcattgcttaaatgtttgtattgctcgccatacattaataccttaggaaactggaaaaacaaggctccatatacattatcggcttcatagtaattgaaatttgttgattttgtcataattaaaactccctttcttgactgacacacgctgtctcaaaagagagttgctaaaacatttgatttgcattacaatacaaatctgatatgctctaactgaattacaaagcattcatttagcggtgaggctttgcaaattcatcagcatgtgtctggttgtgagttgcccagtcggcaactttttttaatttctaacaacaaaaatggactaaatagcttcagttagctacttagtccattgacttcaatttgtttttaactatccttaacttgtcctcggggactggtttgcggtataattaacctacaaattaagaacaatgttcagtcgattttaacttggcggtgaaaatcgactgaatctaagtagctgtcctatagctacttgctaaatccaaaatccctgattcctcgtgaatcggggatttttctacttagcttgatctttttattcggttgttaaattaatcttagtctagcatagcgcttacctagcggcaactttatttggtcttgtatattttgccagcttttggttgaaaccagtaggcgatagaagataccagtaaatattcaaataatataaaaacactaaaatgcttggctgtattaatatcaaaagcactaaacacgaggagcataagtaacccgcaaaaatacgtgataaacagagacattatctgtaaaattcttacgacaatacgacggttaccaatacgacggttaccgctgattctttcaaataatagctgtaaccaatactgcattggaaataaccactgtcgaataaagaagcggtcatctaccaggtgattttttgcaattccaatggctgggactatccaaaagacaataaggctggcaaacaaaaatataacacttctgaaacttgaaagtatgaagacagactgatcccttggtatcacagggcatattttaattaatttaaccatttagcttgctgttaacagcgaaactaaccgtttcggcaaaaatgtgaagaactgattcattatctgaataatttgggctc

SEQ ID NO: 205 - DNA, 21833 bp, Lactobacillus buchneri
gcttttcaatttgctgccacttttcatcagagatggcgtgtcgattagtggttaatggaggcttagtcatgcggtgattcctcatttcttgttttttaaccagattataccggaactttggctaaaaagcttgttttaagacagaccctaatctcgatgaaaaacatgttgttgaagattactccattggaaataagccatcacttcccttcattactgtgcatcctcgtgggagtatcgtgatgcctgtacagcacatgtatcccatgcatgaaccagtagacactcatctgtctattgtcattcatacggctaatgaatcacgtggattagacctcatggataacctacaagctaatttgagagacccagaagttcactatcaggtgaagcaaaagggaatcatcattgttgatgtagaagatccacaagacaacagttttattgggattaacaattccattcagcaatatggattcgatttggtaattagagttgaacgcaactttgaatcagatcaaccaactattgaatcaattgataataacaaccaaagtataaatagaaattaggaggaaacacaatgcctattactaatgaaccgcttggcccagtgcatacaaccgttaagcttgtaacgccagttaaggacttgggcgatcaaattccaaagtatttaattgaagatccagacgcaaccgaagctactcaaactcgctataacagtcttcaagaagttggggacgactttgatccagacagcttggtatatctccatgctcaagcagtattcggcggcccaaatccaccggaagcaattctagttgtcaaggcagtcgccgagaattcatttgtatcacctacaagtattaacgtcgatcaatccagtgtaacgggaacagttggtggaactactaaagtaactactactgtattaccggcaactgcaacggataagtcagtaagtgccgtatctggcgatactaaggttgcaagtgtatcgccaaacggtgatggctcatttactattgcattcaagtcagcaggtaattcaactattactttccagactggcgttaatgatgaaattaccactacaactcatgttagtgttgcagcagccgtaactaaagttactggtgtaaagcttgataaaacgacattatcaggaaaagttggcggaaatgatcaattaacagcaagtgttcaaccttctggggcaactaaccagggggttttatttagctcatcagacgatactgtagctaaggtagacagtactggaaaggtaacatatgtcaaagaaggaactgctgttattaccgcaactactgaagatggtggtttcaccgcaacttctaatgtaacagtttctgcagcgtcttaaggaggactaacgaatgctacaaattaaatcagaaaacaatgtaaatacaattgcctttgatggccaagttgatggtgtcacccttaagtttgaagttgatttggacgatgccacgcttattaacactgttaaggcagttgcgcctaatacttcatttgcagagtcattatttaaaacggctttgaataagatctcgactgctaactttaacaaaaagagtaatgaaggttcgaatggaactgatcctgctcagactactaagtaagggaggaaaatataatggcaaactcagataatttaattgccgctgttaaaaagttttataactctggcgatgaatatttaattccagttggaattgataaaagcaagattccagcattatcgaattacattgaagcccagaacaccggactgttgcttgttgatgtcgatgatattgctgataccgcaccatacgcatccaatgttaatacagccgcatttaaggctaacaccgatgctaatcatgcgaatgtattatcatccggtactgtgggggcggtaagtgcattaccagtcggtagtttcgatattgctaacacatcaggtcttgatgacagcgtgctaccacaagaccaattatcattccagcaagaccaattagttccatattcagaaggcaacattaatacgtattattttgctcaagggatgccgatcgtacgtgatggtaaaaccttaagcggagactatattgacatgttattgggacgtgattttattatcaagcatagcaacaagaagcttactgaaatcatggttaaaaatcctaaaatttcttatgataacaccggcattaacttgctcaagtctggaattgaaagcgtgtttgatcagctttaccgtaatggtggaattggtgagaaagataatgggaagccagattataccgtgactgcgttgccacgagaagatatgaaggacactgatgtctcacaacgtatttatcgtggtttatcttggcagtatcatccagcagatgccattgatgatgtttatatttctggtgaaatcgacctataaggaggaaattgataatgcaacttacacaacacacatttgacccatgggaagtgtcagttcaaattgatggcctcccatttaccgactttggcactggcgataaagtagctgttgcttggaacaacgataacgttactgattcggttgataataatggtaatggtaaatcagccattaaccatgatcattctggtacgtttacgtttagtattgatcctaatgctgccaattatgctcatctcattgacttggccaacaatttgactggcgttcctgtatcagtaacatcaagctttgctcacttccatacagatagtgcacgaattacccgtcctgttgatacgactttgaacgcggagtatccaagcgtttctgtagtctttaaggcttctgtattgcaagttgacccgattactgcataaagcaaatttatattcaattgataaataaaggagaatgtttgaaatgacagaggaagttaaaactaagtcaacaactaaaaaggctgccgagacacctgttaaggaaccaaaattggttagaactgaacgaaatggcatgattgttggttctgtaaccctttgggacaaaaagaccaagcaaaacattaaatatcccttcaattttccaggcgtagagaatgccgttaagtttactgatttggcagatgttagtcgtcatgcctactgggatgcctttattaacggtaatgatgatcttggacttaatccgcttattggtacgcccactgttggcggcaaaccggaaaaaatgagttgggaattctgggaaaaccattccggtgttatgaaggtttgctcagaagccgatcggtttcttgtgcaagaacttaactaatcactttattcgtaaaacagaccttgaggcattaattaataaatcaacgtctcaatcaattggctggactgcttatatctataatgggttagaaagcggactgcctcggccaattaagtatatgaacgctgatgaactgtctgtcttcaattgggcgatttctaagcgcatggaagtacagtcacaaatgcgaggaggactctaacatgggatacgcaagaagtgccaaagttggattccgagttgtatcagaaaatatggatgcgattgatcgtgcgaatgacaagatggatcggcttatcagatcaagccgtgaggctaataaccaactttctcactttggtgatcgcatgtcggttcagggattgaccaagtttgaagataaatatgacagtttgatctctaaatcaaccaaattatcggatactgttacaaataatgtcgataaaataaataatcgtttaaagggccttgctgataactcgcgtgaatatgcggggcaaatcggcaaggctttttctgatacttccaaggaagccaggaactcatttaaacgtttgcctaaagaggcaaacttcaaagtaaagacaaatctcaagcaaacaagtagtgatattgatcatgcaaatacacgagttcaaaggttcggcacaaagggtaagacatcgtttgataatttaagcagaagtggtcgcaagacaacgaagtcgttcagaaatctttacgacgccggaaatgattttgtaaatattagttctcaaatcgctatgggtgctgggatgattggtgcagctttcttaaagtcagctaacgaagttaccaacctgcaaaataagtacattaccatcaagaacttattaaagactggtggagaatcatcatctcagtcacggcgtgaaacttcattaatgcagaaagaaaacaatcgatttgccttgcaatatggtgtttcaccaaccgcaatggctaaaggtggagaagagcttatccggcgtgggtattctggtacccaagaactcgcctcacataagtactttttgcaagcagctagagcgtctggagatccgtacaatgaagttgtaaattatggtgcgccgacgcttgaacaatttggctataagactagagcgggtagttcaagatcaaaaatggccgggtacaccaaaaaagttcttaacgaaatggcctatggtgctgatttaactgccaccaactttaatggcatgggcgatgcattgagatatgttggtgccacagcccacagctccaaccaaggactcgccagaaccgttgccggtattggtgtcctttcaaacaatggtcaggacggttcaattgctggtactggtctgcgtaaggtaatgaactcgtttgcggccccgaatatggcagctaagtctcaacaaggacaagttatgtcagccctggggcttaagccatcagattttcaaaaggccaacgggcaagtcaaaagtcttgctgataatatggatgtcttgaagaaagccacggcaggcatgagctctgctcaaaaatttaacgtttttcacatgttctttgggacaaccggccaagaatcagggctgattcttgccaataacactaaacagttaagatcactaactggacaagttagtcgtgctcaacaatatggcaaaaatggttatattcaatcacttgccaaaaagaacatgcagtcttggaaaaatcaaatagacgtctttaagcaatacatcaacattatggggatgggattcacaaagacagttttgccatcgttcactaaagctttaggcgttgctaacaagttccttaaagttcttatcggactaccaacaccaattaaaaaggctgctggatatgcaacggcttttgctggtatttggggaggcatcaaggtcggcaaagggctgcttggattatcaagcagtcttttatttggcaaaggacgccgggcttctgctgcgtcaggtgcactttcagttgctgaagatgttgccggagcttcaccattggcaggatcccgacttcatcgtgaaggcaaagtactaaccagccggagcgaatcaacccactttgcaccatctcgtttaggcaatgcggcgactgcattaagcagtgaccggcttctaagaggaatgtcgtatgccacgattggtcttcaaattggtggtcatgccgtaagcgccttcaaaaaaggtgtcgacagtaaacaaggtggtagccaaatgtggcaagccggtggtaacgcggtcggagctggactgggagctgctttaagcggcggcaatccattagttatgatgattggatcatctgtcggcggatcggttgctaaatatattgcgggaagcaaatatataaagaatttagccaaaggtggcaacgttgacgggaccaaaaggagagaatcagttcccggagagtccggagcggggcttcaaggacccgaggcacaagcggctaatgggcttggttatcgacaagctatgaacgctcgtaaaaattctaataataaagttcatcatagaagagttgccttaggactagataaatatggtgataaagagcttaaatcatttacgtcttcatttaataaagctaatcagaattgggctaccgtttccaagggaactggttcaaagattaatcaaaatgtatatggttctttgcgtaaagggcttaagtcatataccaactcagaaaaatcctcatctagtaagcgtattcagatgcttcttaaagaaggggtaattagcaagaaacaagctgcctcaatggaaaaaaccgataccaagtattggaatagccattatagcaaggcatctaaaagtattagtaaagttacacagagtgagcgaaatggtggcaaaggccgtgaagcggctatctcgttcgcaaacagagctgtttccaaattgcttaccaataatgcgaacaaggaaacaattatttatggtcgactaaaagaccgtactagtaagctttctcaatcacaagctcgctcaattattaggtcttcatacaagacgatgcagtcaactgttagctccgcaaataagacttacaagtctgccaagagtgctgcaaacaagaaatacgagtctgttaggaatgcggctgacaaagaatattatgtaacaggttctattactaaaaagcaacatgacaagatcgtcaaaagtgctagaagccaacgagacaagacgattagcgctgcaagaactaccaagaacaaaactattgataatgctgaaaccatgcacgagaaagttgttcagaagacttcagcaatggttaaaggcaaccttacgcaaatgaatacctggacagggaaaatgaagggtatttggagcaagtttggcgattggtggggtaatctttggggcggattgactaagatcggtcatctcggcgccaaagctatggcaagcaatttaactcctgagcttgaaaagacaaactcattcttaggcaaactaaaaagtggtaaaaagagcccacgaaagagcaagcgaaccgcaagtactgatgcgtccagactgcccggaaatgtatttgcttctcatgcattgggaacaagtggcgctgcgatgcatgctcataatgctctagtagccgagggcggcatcgaaatggcttacaaggtaaacgggcgtaaagcacgtatccttggatccaatggccctgcaattgccaaagttaaaccgggagaacgtattttaaaccataaagataccatgaaggttttgagtggttcctatgggaaaaatcttccgggatattctactgggaatacaaagctcggtggcaagcaagccaagtctgatattgatggattgagtaaaaagaatagccaagtctggtctaaggtaagcaagacaacttctaagcacaccaaaggtattaagaagcaaactgttggcgactacgatgcgttgcaaaagggttcttacaagcaacttgtacaatttgataaaggaaatacttctaagtggcggaacattaatagccatacgaagcattacaccaatcaatcaaagaaccaagctatttcgacctatgatagcatgcaaaaaggcgtgcagaagcaagttaaccaaatgcagtctggagttatttcaagcggaaaggccacagcaactggatttggccatgcactcgggaagatggacaactacgctcattctgcaatgtctaacacggttcatcagttaaatggtggtatcaaaggtattgataaagtccttgggcaatttggtggcaatagttccgttattaatgccatccattatgctagaggttcaaatggacaattggaacacgatcaactggccattttgaacgatgctaaatcaggaccacgacaagaagctattgttcatcaaaatggttcgctatcattgccatccggtaaggataccgttcgttatttgaaacgtggtgaaagtgttcttaatggacaccaggttaagaaattagccgatcagggaatcattccacactttgcaaaaggttctggtgtctctcatagcgaactcaataagattatcagcaagaataatgctcatccaaacaaagctttttcaaatgaattttcatcacaaatttcaagatcaaatacagttcttggtaatgccgttaaaggattaagcaaacgggcaacaactaaatacggaaatccttggtctacagaagtatggcatcaaatggataacgcaagaagttcagagggttccggggcttatggcagtggcacatggcttcacaaccctggcaatggctttggcgtttcgtcaggattcggttaccgcgggcctgtcgccggaggtctttcaacccatgatggtgttgatttctcaggcggtcacgtggttcatgcagtccatcctggtaaagttattcgatctggtggagcactaaatggctggggtggccctaatggaattggccaaaacatggttaccaagtctaaagacggatactatgttatctatcaagagttcaacggtaagaacaattctggagcccatacctatgtgagtgttggtgatgacgttaacgctggacaaaagattgcagcacttggacctgctggaactcatgttcatattggggtttcaaagcacaatccgtttagcaacaatcctgattccactagtggttggtttgacgtcactaaaatgagatccaccaaagctaaaaaagcggctaagaagagcaaacaagcttcttctgcgttgtcaaaacttgtatcaaaagagattgccccacaactcaagtgggtcaagaagcacttgagagcaagcaatgtcggctcgctaggactaagcggcagtatcgcatctagggccaaaacactttatgacgctattaaggcagcttatccatcagcaactaaaaacggtattgaagcggttcttggtaactgggaatttgaatctggtggcttaaatcccggcattagcaattcagcgggtgctcttggtttaggacaatggcttgatcgtgggccggctctgagacgatatgcagcaagccatcatatgagttggaagaatgcaggtttgcaaatcaactttgcgcttcatggtgatggtgcaaatagttccattttaaagaggattttaagaagccatggatctgtagcctcccttgctgcacaattttcaacggactgggaacgtggcggatatacatctcaacacgttaatggagcgagaaagattcaggcagcacttcataacaatggtggctggtcatccaagaacaaattaaacatctatggcgaaaaagatcccgaagttgctattaatcctaagaaacgtaatgccgatagtcttattggttcagcaattgatgcacgcagtaaggtttctaattcggtatttagcaatgaatcacaaaagaagatgcataaagcacttctagaaaaccttagaaagtataatccgctcaaaggtttagcaagtcattcaaaaccggctgccaatgcaaacagcaacgttactgtcaatctcaacatgaatattacggttaacgctgatgataaaaatgctggcgaaaaagtggcgaacgatatttcaagacaagttgaagaaaaagttcaggctatttttggccaaatgatggcaactcaagaaagggggacagcataatggcagcaacatcggatgtagcaaagaatgcttataattcagcactctcagtcttagacagtactcaagctgcctacaatcaagcaaatagtgattatttggaaagtttaaataatcaaacagatggagctggccttgatattgatgaatcttctcataagctattagcacaatatacgtcgggaacatcaccttatattggttcacaatattgcgttccttatagtggtggatatttaatttcatataattctggcgaaaataccatttatcaacagatggatagctcgatgaaatacgtatcgaaaatgatagttgtcaatggtagtcacggatcgtctttcggaattgatggttcaggaaatatatgggcatcagttagaaacaatggctatcaaattagcaagttcccatatcaagccggaagctatattaacgccagctcacttgaacccctttttagttcacaatctttactaagggtcaattacgatattgccaataatcttgttggttacacggtcgatgatagttattgtatatgcgatccaagtgatctaaccaatcctaaaaaaacgattaacatctcaacaatgggtttcagtgttggacagcaaacatggcaatctcaatcactgagttggccatatgttttctggcaaagtggcgcatataattccaatagtgatccagcgactgtgggatgttttaatgctgatacaaatactaaggaatttgtcaaaagctatctaacgagtagctatggtatgaagtattcctataatgagccagaaggaatctattcaactggatctgctgttttagtgacgtttaataataatgataatggatcgaactcaattaactatctattttcaattcctacactgacggctgattcaacggttagtgagcgtttaaaagcattgaataatttaaagaaagccttagctgatgctaaaacggcattcaattctgctaagtctgattttcaaaaatatcaatcaactagtaaaacaattgtcaaagatacgcgaatttataaaaatgcgactaaagatgttaaaaaccaaaagaagttggttgcaagcactaagaaaaagatagccattgttactaagcaatatgccaaggcaacaggggctaaaaagcaatctttgaaaaagcaacttgacagcctgaataaagtttataaagagcaaaattctgcattaactacacttaagaaaaaacagtcgacagctaaatcaaagctttcaaaagcccaaagtaaatcatcaacagcagaaaaggcattgaaaagatcaattcttaaaaaagaaatatcagctgctgtgatgactgaaacgggtggtaaggatgttacttggataacgcctgtaaatcctggcagtaaagaaagctatgccgttttatggccagatagtgaagacttttcggaaactgttaacgttaacgaaacttcagttattaagcatacccccattaacacagttacccaggctggaactgagagtatatcagttggtggcgccctaattggtgaagatggggatgttccaaccctagtaaagaaatttgagcgtgttcgtaaatgggctgaaaatactgcggaagttcaactaattggtcaaacgtcgtttacacatgcgattatatcggcaattgataagcctcacgacacttatttaactaaccagattccattgactataactttgcaaaaagttgattgggcttcatccaatattaagaagaagaaaaattcaaccaaaagcaaaggcaaggcgaaaaaagttgctggtagtggtcatactcaaaaaaacagtaaaagtaccgttaaaactgttaccactaaatcgggggatacttactataaattctcgcaaaagtacaacgtaagcgttgctcgactaaggaagtggaataaatatgctgatcgttccataccagtaggcgttaagctacgagtgaagtaggaggtgaaaactattgagtttaagggataaattaatagttgatatgagtgatctaccaaactacgttattttgccaattgggaccgagaatttcacgatagaattctattaccgtgaacgatacgatactctttactttaatttatacgatagtgatgacacaccactaattatgggcgagaaattagtttatgggatgccactgtggaacatcaatgatgctaacttacctagtgaaaggattattccacttgatgaagctggcgtcgaggatactgttagcatcgataattttcaatcatcagtattcttgtattttgatgatcttgatccggaagttgagaatccagataatgctgatcaggatgatctggattctgataattcagatctattggacgatgattcaggaagctcacttattgaagatgaaccggctatggataataatgagttcgcacttccaagtgattggagtgatactaaatgaactatgtaaggctttaccgcagggtagagattgatggtaaaaaaggtaaactaactctaaaaagttatgctaaggttccttataatatttcaatggatattgaatcatcatacgcctctgggagtcgggaaacgacgactgtaactgttttgggaatgccaaaggaagatattaattaccttgctaaaggagcaaatgcacgagtatatgcgggatggtatggagaaaatggaatatctaataacgttggtatcattatggaaggtaagctcgcttcgcccactccttcaaccgttgattcgtcaggaaaatcaactaccatcaccattgttgatggtagtgattatgataaaattgccgaaattaagaaaaaagtgacgacagctagatcagtatcagcacagaaaacacttgatcagacaattacggcttataacagcaaaatgaatgctcaacggcgtaaatggattgataaccatccaaatgcaaccagtaagcagttacgagcttatagtcatacgattatcactaagaaaaatgcgtttgctaagaagaaacgtcaagaatatgttaaacaaaaagctaatcatacggctaaggccaaggtttcaaaaaagaccaaatacaaaccattatcatttgctaaaaacactaaaggatcatcaattattaaaaagattgctaaagaggccggtatcaaaatatacaaacttaaactcgtgtatgacaagaaatttaccaagggatatacagcaaagtccaagccaatggcggctattaaaagcgttgcttcacaatgtaaaacgccaatttcatatccaaatgggagacttgaaattgctgattattctaaaaacaagaaatcagggcttcaccttaactatgatactggtctattgagtgaaccagaaccacaagacgattcagatgatgggttgcagcactaccaagtcacagctttgtttagaccatactttacaacaggatatattttctatcttgaaagtactgtcattacagggtgggttttaattaatagcggaaccacatcaataactgacgattctggtcaatcaacacttgatgtagttgattattctaagtataaaaagaagaattcccaaagtgtaaaaaaagctaaaactaaagatcaaaaagcgaaagaaaagctggacgctgccaaccgaaagaaacttaaggaaaagcaaagaaggaggcgtaagaaatgaccaaaagtcgtaactatatccgcgaattcatggatcaattcaaaaatgatgttatgagtgatattcatagtgccattagatgcaaaattgttaaagtgaatgcggataaaacatatgatgtacagcctttggcgttattttctgatggcgctaagcgcccacagcttttaagtcttcaagcatctttcattccgattaagatcaaatatcatgatgatattggtgactcacatgatttttcacccttttatgcagaaatgacaattaattatcaggtaggcgatgtggtgattgtcgtatttgaagaccgagacacgtctaactctaagggaaatgacgtttttaaaattgatagtgaacggatgcatgacgctaatgatggagtaatcattggtaaagtcgatataaagtaggtgaaaattcatgactcaagatatttatatcaatgatagtggcgattttgagcaggatgataggggaaatgtttccgttgttagtggtatggatgagattgcccagtcttgtaagatagctttaaataccagaaaaggcggctggactttagatggagacgaagggcttgactggtcatctgttattggaagtaatgtacatgatcaatttgtaaccgctgcaatcagagactgcctgcttgaagatccgcgaattgatgaaataagtttgattagctttgatagatcagagaaacgtgtcctaaaggtttcaattaaaattgaggttaataatcaactcaaagaaataacttgggaaacaggtgatattgatgattgatgaaaatggctattcaccactaaattatgatgatgctttagatacagttcaaggatttattagaaaagagaatggtgaagatactaatgtatcatccaggtcattttggggaacaattgcacgggttttagcccaaatcgcagttaatttagatgagaattgtgaaaatgttcatgattctggatatatacagcaagctactggagttaacttagatagaattggtggaaattatggattaatgcgtaaacaggcagaacctgcaagtgtaacattatcatttactgggacacctggatatgtaattccaacgggaactgtatttatggatgacaatggtaacgaattttattccgttgatgactgtcaacttgatgtaaacggagtcggaacaacaattgttgtttcaagcgaattaggttcacaatacaatgttgatgcaggtacaattgttaaccaacagtcgcctgttgaagaacttgataatgtaaccaattcacaggcagccgagggtggtcaagatatggaaacagatcttgattttagaaaccgattgctattggcatcaaactccaatgaatctgggacaattaatggcgtatacactgcattaatgaacactcaaggagtcactgcggtaaaaagtgtctataatgcatcaattagcgataatgattcgtacgggaacccaccaaaaacagttcattattatgtacaggggggaactgatcaggatgtggccaatacaattttccgagttggaggcggtgggattactctttatggatcgttaagcaagacagttttagatgattctgggtcaattcaaacgatcttctttgatagaccacaggaaacaccgatttacgtcaaggcatctattagggttagtgatagcttcgatcaatctgagggaacggatgatgtcaaagccgcaattgagggttatattgaaagccttaagatgggagatacagttgttactaatcaattctttagcaatatatatgcaattgatgggattaactatgcagatgtggcaattggaaccgacaagggcaaattaagtagtgacaatattgttctcaccgcttttgaaattccaacgattgatgatgacaatgtggaggttgactatgtatcaaactagttatgatgaactatatccacaaatatttaaaatgtttgatcgaggactggctgttggaactggtagcaatattaatacagtcattcgtgtattatctgactttcagctttggcttgataatggggcagaaatgattcaaagttcatggataattgacgaggctgttggagaacaacttgatgaaatcggtgatgatatccatcaacccagatatggtgctaatgatgatacttatcgctttatccttaagacaaaaattttggcatcacattctggtggaacaatcaacgacattataaatatcgtctgcaacgcccttcaaatcgatcctaaaacttccagtctgaaagttcacactgattatcattgggacggtacaaagatggttggcaatcctcaagtggttgatattgaccaattaccgacgagccttatttcatctaatcaaacgttgcttgtattgatggatcgactgtcgtctgccaccctcaacggagttacgattaatacaattgcgtttatgaacaattctaaactaattgaatatgtaggtgttgggactcagtccatcatggttaaagaagttaatgtaaaaggaggcaattaacatggcatatgacttggcaaaagtaactgctaacggaaacaaccttattgctcaaatattggccaacaagtcatcactaagcattgataagatagaaataagtgatactcagctgtcatcgacaacagacatctcaacaatgacatctgttccaaaggtagtacaaactgttagtgcaaacggattctctaaaaatagtaataccttgattatttcaacagtcgttgataactcatccataagcgctgattacaaggcatgggtatttggaatttggggatctgattctcaaaatgggcaatcacaattaattgcagttatcacatcaacaaatagtccagatacaataccagctttttctggtagtactccggtatcatatacgtataaattcaacattggtttttcaaatgcaagtcaaattcaatttaatatgattgatgatgcctttgctaccaacgatacggttgtccatacgactggtgatgaaacaattgacggccaaaagaaatttaaagttgatccagttgacggtgcagggaatgcttacgccaagacaatcgacgttaatcagcaactggatagaaaagttaacgtatctgatatgcgtaaacctgccagtgatgtagccggaattgaggaagttaacgccaagcaagataagattggttacacacctgctgatgacagtaaagttgttcatgataatcatgacgggactataacagctagcggaactatttttaatcttttaaagtctttaagcgctacatcaataccacaagacccaaccaaggactacaatactctcccacaggggcttgctttgatgtcagaaactaatggagaaccagctaatatgcctccggttaaatcaacctatctgacgctgacaattgcttccagctttgcaactggccgtaagcgtcaactggcgtggttagacgcaggtgctaactcgtctaacaacaattacacttatatcagatactgtgttgggagcacttggtcatcatgggactcaattccaacaagcactcagataagtagccttattccatctaccattgcagatacaacgaagctcgcaaacttcacagccggtttgcagtcaggaggtgtttcagtcgctacgagcgacgatttgaaaagcgttgaaaaatcggcttggcatcagctaagtatgccagattgtaatggcatgggaggaattacacttctttatagaaactttatatcagatcattacatgaatttatatgcctatggtattggaattcaatcaaatatccaagggccaaccatgcttgacttatcttcacttatcgacaacatagaatccgtatcaggagtggcaaccggccctacatttacttacgtgtcccctaattctggatacgcgcagttagtagcatcaataaataaattaaaactgggttcagatgttagtatggaggtaaaccggaggccggtactaattagcggaaatggctcacccttcgcaaaagtaacatacgataattggattggctcataatgattaatttagagagaaggaaaattttatgacttattatgtaacacttgataccgatgatcgggtattcaatttttgcaaagtatgttacaatatttcacgtggataacagcgcattcactgttgttattcatactcctcaagtgtatattcccccagaatatatacctctagatatattcatagtttttcatatatcccctaaaagtatatgaaaatgcatctatctacggataggtgcttttgttttacccttagacacttaatatttggaaaatgatataataagtgcaaagtcatttagttgaaatatcctaagataaagggctcagtgatatgggtaaagaaaaagaacacaagaaagcatcatttagtgaatcagaattaagaaagatgaagaatgacttatccaatgttaatgatctcttctatatatttgtggcgttattaactgtctttcaaacgctatacaatagtaacagtgttttgctggtatttacgaccagtgtttacgtcacgcctgttttaattttttacattgaagattattcgttgcttgcaaaatattgggaaaaagagaaacacttccatttttctaagggtaaaatttttaagcttactatttggtttctgtttcttcttactttttctgtaattgttacattgttactttgtatatatacgtttaaaagctataagttgttttacgttttgatcaggtttgagacgttgtatacgttatttatgattattgtgaggaccctcgtcatgagaactcttatttggaggtgactaatatggttactatgactttaattgcattacttgttatctttgccggtgtaatttttggaacatggttaaatgccaatagttttaaagatacattaaaaatcatttttttgatcccaattatctattatttttttgttaagcaagaaattgacgcagaccagaaggaaatgttgcagatctttaacttaatgctggaaaaactattaaagcctcgaacattgtctcgcattgcggccaaaagccacgaaaatgttaaaagtgtgcgttataaaattaagcagatagaaagggaccttaatagcggaaaactgtacactcgaaggaagtcaagaaaatttttgagaagccatggtatgttatcatttacacttttatacgccggattaattaatatgtctcaagctggtgatctaatggaaaagaacgccggtgatatactactatctcaaactcatagactatcaaaagaagattacaaaaaagcgactccgatttttaaaaggaagattctaaaaaaatacggtttgccggcagcgtaatttgaaagctaaactaaggccttttgctttacctgaaaactttcaaagaatgttataatgactatgttaagagattggcttatttggtaaagatgattgacaattcaacttacacggtctctcaataggctttgattcaatacccaggatcaaggcttttttagtttcatatttctattaataaaattatgtatatgcaattagccgtctatgaaaatagatggcttttcttttaccccaaaatagaagggaagtgaggccatgccattaagcgatcaggatcatcaaatgttattgaaacatggcaaagaactatcggatcacgaacgtcggattactgatcttaacaataaaatgactgacacgctaaaaagtgtcgatgaaagcaacaaatatttgcgggaacaaaacaaccgtatcttggaagccatcatccgtggagacgagaaaagtgaaaatcataaaaacgagatggaagtcatcaatcgtcagaacctttggaaagtagtcacgattgcgattggctcaagctccgtgatttatttgattctacaacagttaatgcactttattcattaggaggaatttaaaaatgttaactaaaaagtatggtacagtttcaattttgtttgctgcaaatgttgccgatggtggccggacgattgatgaagtaccgacaccatttaaagcggatgttcaagcattactcaaaacagatgaattatcaagtgaaccaaccttaccagcagcttcaacagattctggtaatggttttgcaaaaaatgatacccaggaggtggccaaataatgttcgcaattttaactaagacttttaactatttacaatcaactggcgttttggctgcaggaattgcttttattctagctgtttggaaagccgttttgcctattgctcaatcgcacgctaaaacggctcaagagaaattgttcctaacagccgttcaaggatttgttgcccgttatgcgcaagttcaagcactgagtaaatcagatcgtttcgctgctgttcttaatgacgcattagactttgcaagcgatcacggctacacttgggctaaatctgatttggtaaagggaattattgaaaacatttatcaagactataaaaatgcaggcaaagatgtcgcccctgtcattacaacccctagttctgatgttgttaaagatgaacccgaaaccgttgctccatcaacaactgataattccacaaccgatacttcaaaatcagatagcaccgatactgtagaaagtgacggtgcaagtgatattgcaaaattggaaggtgaggttgagaaataatggcatatccaattgttgttgatacctcggcttggcaatccgattcattatcatttttcactggtttaaagacttatggtgtttctggtgcgatggttaaattaagtgaaggtgttaaatatacttcacccaaggctgccaatcaaattgccaatgcttataaggcctatggtgttgttggtgtatatcatttttggcattatggcactaatgaagctcaatatttcctcgataaagttaagaaaatggggttagacaaaacaacttggctggcgcttgatgtggaagctccagatttaccgcaaaaatgtactgccggcatcaataagtttctaggctatctttatgccaatggctaccacaacttaatggtttacggttccacttcatggtttaaagaaggccggattaatcaagcaaagctgcacaagtatgctaagttatgggtagcggcttacggcacttcacagccaggaattaatcatgtggatatttggcaatacactgatcggtttaaaggaatgtcgcttgatgccagctatgatttcaaaaatttattgaagtcaaacggcaaatcagccaccccgattaaaccagaatattacactgccaagggtctgtatgaagttaaaacggatttgattcatgcttataataagctcccactaaaaggcgataaaaacaaacggtatgtgcgtttggccaaaggcagccgtttctatggagtcgcagttaaagacggtgacatctactcactcaaaacgcaggttggttacttaacggccaacaaagattatgtagaattgattaaagaagttaaataaagtatgcaaaggggcccactcagattaagttctgggtgggcctttttgtggttacttaatcaagttccgtaattatgatacaattaattcaaattattgattgtaggtgggatccatggagtgtgtttcattatatatagatgaatcaggaaattttgggtcgagtggcagatattttacactcacttcattaagatgcattgatcactctaattttaaacttaatcgtgctgtaaaaaaagctagtcttaaaataaagaaaagatatgacggttctgtaacacgtacaggcgaagtaaaagcttctttatgtaatccgattgccaaggactatatgctccgtaaaattaaaaagagcgttgatcggatcgactatattacagcagatttgtcctatattgaaccccgccttttaaataatcagaacatactgtataactatttgttgacttttttaataagtcctattataaaaaataactctgatttgagcgaaattcatatttatttagataatcgttctttaaaagttggagatgaaatgagtttttctgactacattaaaagtaaaatatggatagagtatgatcggccagacatttctgtttcagttcactatgttgattcccaatctgattatcatatacagggagccgattttgttgctaatgccattaacggcttttacgaatataatgagtcatactttacacaaattttacgttcctgtatggaggttagagttaaatttccatacaaatattttggcaaatgagtttacatcctgcaaactatagtttagtattataggtaattaagggtgagtaagacatacaaagttgtgttattttattaaaaacataagctgcatgtgttgtagccggcttgtatgctttgcccctacatatttagctgtcgtccacttctcaaattatgaagtggattttttatattcttgaattgtcaaattaagtgcaacactacattaaagaatatttcataaggcgttttccatccgagacatttacggggacgattattcatttgttctgcatatgcttgtatccggcggtcagtaattgaatcaaggtcagttccttttg

SEQ ID NO: 206 - DNA, 20745 bp, Lactobacillus buchneri
agagattaaccaagcctaaaaaccatgtaattatcaaattcaaaaaataactatttttgaagcttatttcttatacgctcaaaaatggggtaataaacttcaataaagtcattatttttccttgacgtaatatagtttgtctaacgtgtaagtccaaaaagctttaaatccaagcccgggatttcaatctttccggccttacacaccgcatcacccgttgctcgtcacactctacttgttaaacgtatcactctccacctcgcggataaaggttgccagatgatcatagtagacatccggattatcgatcatgtgatggtggccgccttctggtgttgagacgaatttggcgtttggaatcatttgtgccatgcgcttaccagtttcgattggcatggtttcatgttcaccaaatgtgaccagtgttggcaccttgatgttctttaattgatcggtgaagttccactcagccaatttaccagtgacaacgaattcgttatcgccttggaaagcgccatagatatcggtgttagtaacatcgatcagatgcgacagcttggaaggctgcttccggtcaatgtatcccttattcaaaatatcaacgtatgattgatatttgtcgttgtcgtagtcacccttggcttcacaatccttcatgtaagccacttgttccggagttaatgccttctcgcggacttcttcgagatgcttggtgtaatcgtcaattcgatcaaccatggaagaaataatggcaccctttaaatgttgaccaaacttggcagcgtactcttgaactaacaggccgccccatgattggccgatgagataaaagttgtccaacccgagcttttcacgaacttcgtcaacttcgtttaagaaataatcgtagtttaaaatatctttgcggttcttgggatcgctgaaatcaggactgtcagaataccatgaacccaattggtcgtacatggtgacttgcacgtccaagccttgcttcttgagttgtttggctgcgtcctcccaatattcatgttcgccgccggggccgccatgcaatgctaacaaatgaatgttgcctgtgccttgggtattggtccataagtgatagccgttatccaaagtaatgatttttgttcctgtcttcataaaatcacctatccttattgttatttataaaaatcatatcacatttatccctggttatcatcggcagtcaacaatggtaattcaatctttgaagcgctcagatcaactgtgtaggaaatatcctgattactgcggatggtgtagtccatatcagtggcgtaaatgatcaatccaagttgatgccctttcaacaagcgccaaaatgttggctgaaatgccatggtgaagttgtagtattggccgggcttcaggtcgtccgattgataattgttggtgcgattttgcatattcatatgggcatcggtgaacttcttgtaagccgatgcttttttctcaggcaaaaattctttcaaatcgtctttccgccattggtaaccggtaataatctgctgggcagacaaaatttgggggacagcggtcaaccgtttttcgaccccataatcaaccagcgccgcactcaataaacctaaatccgcactgctggcagcccgcaaggtaatcgtcgctcttccatccacggtgatatcttggtccagtggctcggacacgagtttaatactgtgtttatcaagcttggaatgattcttggtaaatagggccttctgccacttcttggtgttttcgatgtagtccttaaataaatcgtctggcaattgatcgctaaatgaatggttctcgttcagatctgtccagcgcttatcgtcaaggggaatttctttaacgttgccgccccagtctttgtaggtgttccacgtttccggttcagcgttatcctgtaccaaaacatccggcacaatctggttagcttgattatcgaccgccaacaatttgttagttagccagagattgacgatatccgtgaaatcgactgagcggaagttgttgaggtattcatgttgtccttgatgaaggactaatttttgggtaatcttttcattctttaacgtttttctgaggttgtaaacgtgagacaatttaacattccaatcgttcaaaccgtgcactagcagcatgtcagccttgatattgacattcttcagaagatttcggttatcccaaaaactgttgtaactgccagttacccggtcttggccagcagtcagttttttcaactgggccaaccaagtgtcctttattttgaggtaatcggcagccgactgctcacgactaaaggtgagttcacccaagacgtcagtatcttcaccttggaagccgccgggagcgacgaccaagccgttctctcgataataatcgtaatagttagagatgccggcttcaaccacagcggtcttgagtccgtcaacgccagtcattgcggccgccgttgagagggtgccaagatacgagcgcccggtcatcccgacgttaccattggaccaccaagccggaatggcaatttgatcggaccgattggtaaatgcggtccgatcgccatgcagccactcgatgaccgaagtggcactgatggtttcgtcaggcgttccggttgttcggacgccgtcagaatctttagtgccgacaccggatgaatagaccaccgcaaagccgcgcgccaggaagtaatcattcagtgaataagtccaggttttaacaaatgattcttcagcgactttgttggtatccttgatggttcgtggctccggcaaatcatgattgtcgtaatcgaacttaacgtcctcataactcagatggttgggttgcttgcgggttaatttttcctgattaacgtcgtgggtcatttgatcggcttggtggtcgttagtcccttggtcgtaagggctggcagtgaaaataaccggtaccttcaagccgttttcagtttctcccggacgaatgatttcagttttcaagaggtctcgttttccatcatggtcattgtccaagggcgcttcaacgtaaaccacgtcgcggatgagcttagtggtatcaaagacggcctgggatttaccgttaaagatgagcggctgtttcagttcatcggttccgaagaattggtgatagtagccttgacccgccaaataatcaatcaaggtctggccaaatttggttcgcgtattaagcagtttgtaccaggcgtcaatgacctgattgcggtcgagcgtatcgtcgacaaccgccattggcagtcgatattttttcatggcggaaaacgggtcgttcaactcgaagtccagaccaacttcaaatcccaacagctgcaagccaacgttataaaaggctaacttgctgacggcagcttgagttgtcgtgaactcataggcatttagagtgggggttgccatcaaattagcaaccttttgaatccgagtggccaagctctgcttttcaatgaagaatttcagcaggaattggcgataaagcatgaccggatctgccatctttttggtttgggcggttaagaaatggacatccgccaactctttgacaatagtgtgatgatcagtgggaacatatgcaaactgattaattttcatgaaatacctcctggaaatgattgttaacgccattataccttacttttgaatccctgaaccggtcggcttttgccgaaattgcagtggtgtctggcctgtcagcttcttaaaaactctgatgaaataatttaaatcgttgaatccggtcatcaaggcgatgtcggtaatcgagggcgttggtctgctcaaatattgttttgccaaaacgatccggcggtggttgacgtaatcggtgatggtcatgccgacctcctgcttgaattttcttgaaaggtaggacggattggtgccgatagattgggcaatttgattgagcgtgatcgggtgccccaagttcagcaggatatagtcagccgctcgttgaatcattggggaatagccggaagttgagagggtaagaaccagttggcaatattcccgcgtcattgagtggactaagatgtgtaaaccttgaagcgtgttttggcgctcgattaacaaggcgtacttttcagaaatgtcgttgagataaactgggtggacgccgcctttgtgcgcggcaattcgacaaatagtattgaaaacaaagcagatattttttgaggagcgtaatggcttgcctggaattcgattcgagaaggaatcaaatatcttggtcatggttgtattgagacggtggacggcaacttgatcgcctgaagcaatcgcattggtgattttggcttcgtttgcgtagttggcttcgatttgcgcccgatgatcgctgttaaccgtcatcaacgatctttcaattggctgagggccatgggttactttggctttttcgtgggcggtggctagctgtcgggaaaataagttggtcatcaaagtggccaagtcgttgattttatcttctgccagcaccggcaaactttggtacaactgggtgagttgccgatgttcgctgatggtataggaattcatcgctacgatgtcattgattccgtcaatggtcagagtggtggtcaggaacggtcctaagacgacaacttggtcgtcaggttggtcaaggcgggccgccacgtagctcagctgggcggaatccgtgtaagtcaggtactcattagcgtggaattgctcaatttgttgaaagatcggatcaaactcgttgagccggtggaaggcgggtaacacgttctcttgaatttgcaccacgggggtgccgtctttttgaatgatggcaatatcaatttgggtcagggaatgaatcagttcagcagttgattggttgtcatacacggtcatcgtcaagctcctttctggtagcggttacataaaagtcaataaaatgcgatttaagtaaaaattggataagtattcgatcccagtttagcctatattaaagacattgaaaagcagtgatccaaatactgactaacgaacggaggattttaactatgttatacccactcacaacacccagcagaacggttctggacttatcaggactctggaaatttatgatcgatgaggagatcacgccaatcgatcccaaacggccgttgccaactgaagatgtcatttcggttccggcttccttcaatgatcaaaccgcgtcaaagaagattcgtgagcacaacggctttgtgtggtacgaaactaattttgatattgccaaaccattgcgcagccagcggttagttttgcgatttggctccgccactcatgaagcttgggtttacctcaacggccaggaaattgcccatcataagggtggctttacaccatttgaagtagaaattaacgattatctaaaagacagcgacaaccgcttaaccgttaaactcagcaatattcttgattacacgactctgccggttggcaactattcggaaagcactgaccaagatggccacaagctccgccacgttgacgaaaactttgatttctttaactatgccggtcttcaacgaccagttaaaatctactcgacgccagctgactatatcagcgatatcacagtcgttccagacgtccatttggctgaatccagtgctgatgttcaggtcaaagttgctacccatggggagattgatggagttaaagtgaccattttggaccaagacggccagccggtagtcagcggcacttctgccgataccacgttgcatattgaccacgttcatctctggcagccgttgaacgcctatctctataccgcaaaagtgacggtcagccgaaatggtgaagtgatcgatacctattcagaagactttggtgttcgcaagattgaagttaaaaacgcccagttcttaattaacggcgaaccattttattttaaaggctttggcaagcatgaagattcatacgttcatggtcggggaatcaaccaaccggtcaatgtcttggatattaatttgatgaaggatatgggcgctaattcgtttagaacttcccactatccatactccgaggaaatgatgcggttatgtgatcgcgaaggaattgtggtgatcgatgaaacgccggctgtcggattgatggtaacctttgggtttgatgtgtcaatgcttgagagcgacgactaccaagacgatacttggaccaaattaaagaccgccgacgcccacaagcaggtaatcaaagaaatcatcgatcgtgacaagaaccatgcctgtgtcgcaatgtggtcgattgctaacgaagcggcaaccttttcaaaagggtcatatgaatacttcaagccgctatttgatgaagcccgtcaactggacccccaaaagcggccctgcacctacaccagcatcatgatggccaccccgaagacggataactgtatcggattggttgatgtgattgccttgaatcgctattatggctggtatgttggtaatggtgatttgaagatggctgaacaagcaacccgcgatgagctgcaggaatattctgacaaattcccggataaacccattatgtatactgaatacggtgctgacaccattccggggctgcacagcaattatgacgagccattctccgaagaattccaggaagactactatcgaatggccagcaaggtcttcgatgagtttccacactttgtcggtgaacaattgtggaacttcgctgacttccagaccaaatttggcattcaacgggttcagggtaataagaaaggaattttcaccagatcacgggaaccgaagatggttgtccgttacttgaaagcccgttggactaagattcctaactttggttataaaaaataatatcgttaattttcgaaccggaacacgtgattccgcgtgcgccggttttttattgcttcaaatgaaagcgcttaacaaactaagaaccagcacatgattaaggaggggtttaccttgaaaacagaaaaactcaaaatgcgtgaaaaagtagcctatggattgggggatttgggcaacggcttgatgtttcaatttgctcagctgttcttactaaaattctataccgatgttttacagatcccagcctattggggagggttgattttcctgatcgccaaattcttcgatgcctttgtagataccagtgttggtgccttcgtggattctcgtcagcatatttccaaacgcggaaagtttcgcccatacattctctatggctcattattcctgggaattgcaacagttgcctgttttgtcacgcctaattttggtgagaccgggcggatcatctatgccttcgtttcatataacatcatgggattttgttactccgttgtaaatattccttatggttcgctggcagcagctatgactatggattccggtgatcggacttctttggctgccgcgcgcaacttaactgggcaaatggccgccttgcttaccggagcagtggtaattccactggtagcgatctttgcgacgcctaaaattggttacattgccacggtcgcgatttttgctgccgccggcgttgtttcacagattctctgttactccggaaccaaagaacgcatcattgaccataagccccgccaaaagggggatggtctcaagtcaatcaagggactgttaaccaaccgtccgttcattattctatccattttcacgattcttagtgttggctcgatgttccttaaaatgggtattcagctatactacttccagtacgttttgggacaggtcggaatcgttagtattgtgagtctattgagtgctttatcgattattccagcggtgatctttgccacgccgttggttaagaaaattggtaagaagaacgttgcaatatacgcaacactgggattcattgcagccgaactggtgaacttttttatcaccggctcacacgttgttccttatctgatcgtcaacacgatttcatacatgttcctgggctttagtgggaccgtcgcctttgcgtttgtgaatgacgtgattgaatacggtcagttgcaaaccgggattcgctcagaaggaattatttattccggctacagttttgtgcggaaaattgcccaaggggtcgccggctttattcctggtcttgctttgacaatgaccggatatgttgccaatcaacctcaatctgccagcacaatctccggcattagtgccgtatatttcttagtgccagcgattgccagtgcgatttcctgcattgtcttttactttggctacgacttgactgacgagaaacatgccgaaattgtcaaagagttggaacgacgtgaaactaatcgcaagcagaatgaacatctggatgtcattgatgacaattcggttgtcgattctttgaattctgaagttcctaataccggcatggttaatcactaactaacggtcacaagtgatactttgaaacaaggacgaaccgaaaataactttttggttcgtttttctatgcttgtaaagttaatcacaaaccattgcaattctcgatgaagaggactagccttgaaccgtataaagcgtttgcaaaatgattgtgaagggggtcgctttaatgtctacgattattgctgctttaaaggaatctggcgatgaaaaccgtgtggcaatcacaccggatgtggctgcgaaattagttcacagcaagtttgaagttatgatcgaacagggcgctggtcagaatgcttatttttccgaccaagcctatcaagatgccggcgcaaaagtcgttagccgagatgatgcagttagtcaggccaatgtgatcgcgacggttgatttacctgattcagagactttgggcaagttgcatgagggacagattttaattggcttgttgaaggccttgaccgatttggactcggtgcaaaaacttgctaaacagaaggtcacggcgctgtcgtttgaactgctgccgcggaccatttcccgtgcccaaagcatggatgtcttaagttcacaagcctcaattgccggttacaaagctgctttggtggctgctgacaaattcgcccgttatttcccaatgatgatcactgctgcggggactgccaagcctgccaaggtgttggtcttagggaccggagttgccggcctgcaagccattggaactgccaaacggctgggagcaattgtttccggttatgatgttcgtccagcgtctcgaggcgaagttgaatcactcggtgccgaatttctcaccagttcagtcagtgccgtcggtgaaggcggttatgcccgtcaattgtctgctgatgagcaaaagcagcagcaagacgaattaattgggtttatcaaacaaaatgatattgtcatcaccaccgcgcaagttcctggaagaaaaccgccgctgctggttcctcaagccgccgttgataatgctaaaccaggtagcgtcttcgttgatttggctgccagtgatttgggtggtaatgtcgctggatcaaagcccgatcaaacagtgatcaccgattccggtgttcaactgattggggccgggaatttagccagtgaaatggcaacgtcggcttctgaaatgttctccaagaacgttcaggcagtgattaatgatgttgctgataaggatgctcaaattaccatcgatttaaaagatgatgtaatgagccagttggttgcgaccgatcatggcgaaattatttctgaacgagtcagaaaagcgctgaacctgccaatttcaaaaccggctgaagacgatgctgcccctgccgattctgacgacaagtcagctgagaagggggattagccattatgagtcaagaattatatacgaatttagccatttttgttttgagcctgctcgttgggtttgaagttatgagtaaaattccctcgaccctgcagacgccaatgatgtctggggccaatgcgattcatggcgtcgtcgttgtcggtgcctttgtgattgctgcagaagccagcagctggtatttctacctgttggcatttctggccgcattctttgcagctgtcaacgtcgccggtggttacaccgtgactgaccggatgctgggaatgtttaaccggccgaaaaaacagccgaattcagctgacaagggaggcgacaaataatgtcactccttaaaacgattgcttccctaatttacttgctgtcagcggtctgctacgtaattggtgttcacatgatgcgctccccaaagacagcccggaatggtaatttactttccggacttgggatggccatggcagttgtcatgattttagttgaaattatcgccaagggtcagattacgttgatcggctggacggtattgtttgccggtctgttaatcggaattttgtatggggttatccgcgcacgcaaagtgccaatgaccgatgtccctcaattagtttcactgtttaacgccgttggtggcggtgccgctgccacaattgggattttcgattatacccacgaagctgtcggtacctctttgagcctggccttttccattccagtgctgcttgacattattattggtgggattaccttctcaggctcgctgattgcgactggtaaattgtccggacacgtccccggcaaaccgatttcgtttcccggcgataaattgattaacggcttggcagtgttagcgattatcgttgccggtgtttggatgattggttttccttccgcttactggcctatggtactggcattgttagccagtttgatttttggcctattgatgaccttgccaattggtggggctgacatgccggtggtcgtttcacttttgaacgcctttaccggtttggcggttgcctttgccggatttgtcattgacaatcaggtcttgattatcgccggtgcgctggttggtgctgccggaacaattttgaccctgcaaatggccgaagcaatgaaccgatcagttgccaacattattgctggcggcttcggtagtggtgattccaacggcagtaccggtgcgggcgccgaagtgccaaccaacattaagaagaccacacccgatgatgtcggcatgcagctggcctatgcgcacaatgtcatgatcgttcccggttatggtttggctgccgctcaggctcagcatgaagtcgctgaattggcgaaattgctgacggacgccggaattaacgtcaactatgcgattcacccagttgccggccggatgcctggccatatgaacgttttgctcgccgatgtcaacgttccttacgatcaaatgaaacagttggatgaagccaactcgatgtttgaaaatactgacgtttcgctggttattggcgctaacgatgttaccaatccattggcccgtgaaaagggtaacgccatttcggggatgccaattttggatgttgataaatcaaagtccgtcgttgtcattaagcgttccatgagtaccggttatgcgggtgtccaaaacccactgtttagtgaagatcaaactagtatgatgttctcggatgccaagaaagggctgcaggagattattgcagctaccaaggggtatttagattaaatgaagagtggggcgcgaggcgctttgatcccagaatttaagtaaataatccagttattcctggttttggaataactggattatttgcttaaatggccgggatcagccgattgtcccacgtttaatctatatgacagtggaactcaaaagagacgatgacataactgacaaagaatgatgtctcgcctcttttgggtgattatttataatagactttcacaaacttcgaattggcggtaatatagccacccttgacagcgaatcgcttggcaccggacttggtgttcgacgcatcatggctataggtgtagaagttgactttaatcttggcgcctttcttgtagtgaccgtttttcttggtgaaattggcagtggtatagcggttgattgtttttttggcgaccactctggttggctgcttttgtttaccgttcataaccagcttacggttggcagtgatgaaattaccattgcccagcatgtaacgggtggtcaagttgtgggtggtgattgactcgacctttaggattcttccctgcttgaacgtctggactggcttggtgaggtccttttcgttgtattcgatgactccatttgggctgatgacggtgatgaactttgggactgcctggtagtaaaccggagaaacgaagctggacttggtggtgatgtagccggtcattcccgcagttggactatcatggttgacatcgacgactttgaaacgtaagcggcctgcgttggaatagctgtagccggtgaccacaaacattggtcggaagacccgtggcttttgagtataaccaaccagtcgctcagcttttttgaaggttggattcttgtataggtaaatcttcttcagtgagtagacgacttcaccagtggttttggcatagttgggtaactgcgtgccgcttggtggggttgggtggactgggaaagttggggtttccggattggttggtggatttggtgttggggtggtcggtggcgtcgggttgaccggtgttgaattcttagtgtaaatgagcttaaaggtttgcttttctccagtaattttaccggtttgtgccgggtagtatttggagaaggtgtaacctgggatatttaatttgtaatcggctgtcgaaagatcgaaggcttgatcgatttcccctttgatcgtggctgaggcatgaattgagtttccgttagtgtcgacgtactcaactgtgaccggctgggcttcttctggttgaatgacgtatggcataaagtagctcagtgctgcgtagagcggttctcctgggtagacgttatattgcgcaatcatgtagtaagtgtaggtattgttaacgacggttgcgtttggatagtagctggcccatgggttagtgggatctgttgggatgatttgcggtgccaaatttgtgtaggtgaaatcatcaccattaatggttgtggttccctgggccacaccagtcccacgggtgccgttgcggaagacgtcaatttgagagtacttggtatcggttgggttgccataagcaagggttcccggacggagaaatttttgctggtaaggctggaatggtttgttatcctcggttttaacgttttttggtaaggcgtccacaaacggtgctttccaagtgtaggtgttggagtggagcacttgtagtggtttaatgacgatttgctccaggtagttaaatccctcggtatattgttcagcgtccaatgtgtttagattattgatgcagttgttattgagatataaagtcttgacattcttcagacccgcaattggtgaaatgtcttgaattcgattacctgacaagttgatatattcgagtttttccagaccttcaagtggtgagacatcaataatgtcatcatgatgaaatttacttcctctatttaagtctgcgttcaattcaagcttggtgaggttcgtacaatattccaagccttccagtgaataattacccttatttgctgggccgaccgaaccgttgccgccattgaccggttcttggcggtccacttgttcgttggtcccaatttcccagcccagctgagttagttttgccaaatcttccttaaatgtggtcggcgtgaagtcattcaaggtaaagttgggatcttgaatgatcttttgatctttcatattgattaaaaccaattcccgcagtttctcattcggcattattttgtcgatggtctgttcgtcttgagtagtggctgcattggcggccgtgaccatcggcgtttggttatttaagaccatccccacaaacatcaggatggcggtcgtcgtgatcattaacaaaaagttgagtagtctcttggaacgctccatgattattcacccccaagtgtaaatattccttccttgtaatcgatttcattatatcggaatattaccagaaattgaaagtatcttgattgtgaaattaagttcttaaaattaccggtctcagcccatgaacgcgggcagttggtatggtaaactaatatcaatagtacgtaactaatggttaagaaaagaaagggttattagatggcgtttgtgggtcaaattgcactcattttaattgcaacattattggcggcagcgattagtcaacgattagggatgccggccgtgatcggccagttgattgccggagttattttaggcccgggtattttaggtgtcctgcacaatacggaactgatgcacgccggggcagaaatcggcgtgattattttgatgttcattgccgggatcgaaagcgatctggatttgctcaagaagtatttcaaaccggcaattagtgttgctgcaatcggcgtactgtttcccatgattgtcttttacggctacggccaaatcatggggcagggctttgagcgttcaattttttggggcgttatcttcgcggcaacttcggtctcaattagtgttgaagttctccgagagttcaagaaactgaacaccaaggaaggcgcgacaattctgggagcagcagtggttgatgacatcattgccgtgattttgctgagtatcttcgtcagctcctttggagttagcggcagtggatcgtcgaatttactggttgccacactgtatcaattgatgtactttttaggtgtgatcgtcctggttaaatgggtggtcccggtggtactgcgagtggcagaacgattgccggtccacggctcggtagcgattacctcgctggtgatctgtttgacaatggcctggtccgccgacgctttgggcttgagttcggtggttggcgccttcttcgctggagtggccgtttcacagacgaagtttcaagatgaaatctccagcagtgtcagctcggtcggatacacctttttcattccgatcttctttgtcagcattggcctggacatggagttcaacaatgtcatcaagaacctgggcttcattgtcatcatgacgattttagcgatcgctaccaagctgtttggcggtgccctgggtgcttggatcaccaaaatgaattggagcagcgcgtttattgttggttccgggatggtatcacggggtgaaatggcgctgattatcgcccaaatcgggttgtccgccaatttgatggccaagaacctgtactctgaaattattattgtcattgtattgtcgacgattgtggcaccaatgttattgaagaaaacgatgaaagtttaaaaggagattaatgatggttactgaatatgcgagtggtgcagtggtttatgaaattagagacggcaagatctggtacctgttattgcagagtgccacctctgatttttggggattacccaaaggacacgtcgagaagaatgaaaatctcatccaaacagcaatccgtgaaatccgcgaggaaaccagcttaaagacgcagatcgacgccaactttaaagaaaaggttgagtacgatatgaacaacggccaccacaaggacgtgactttctttgtcagccgggtcgctcctgaagtcaaggttcgaaagcaggatgaagagatcaactcatttggctggtttgactatgaagatgcctacgaaaaattaacctatgataatctccgacagctgcttaagcacgccgacacctatatccgcaataaagaaaacatcgaggaagcctgatgaagaatcgagtatttgtgatcaccggagccgctggcagtggcaagacaaccgttcgtgattatttacatgaccaatatcaaatggcccgggtgatcacccacaccacccggccgccgcgggagaatgaacgtgacggggtggactattattttgaggacgaccaatcgttctttgacaatcactttttggagtccgtccactatgccggccactattatggttcatcttacgaaggcttagagaatgcctgggagaaatcaccgtttgcgacgattgtcctggatactgccggagccattacatataagcagaaactgggcgaaaaagcgatcatcatttttctgcaggtcggcgataccgaagaactcaaacgccgaatgcagggacgtggtgacaatgctgagatggttgctaaacgggtcagcagtaaggaataccaccgggatctcgaaatgcctcatgaactgcagggcaaggcttatcaagtggttaaccaggattggcagcagacgcgtcaacaaattgacaaaatcgttgagaattatcgttaagaaacagcgggatagttgttgctgaaagtagattatggtaggatgcaataaacagtaataattacttattagaggtgaacagtatgcctgcagcaattgaacaagcgaccaaagttttaaaagagaataatttcaagataaccaagcaacgccgggcgatgattgaatttttagtcggcacggcgacgcataagtttgttgaagtcaccagcattgatgatttcatgcgcaaaacttttcccaacatgagtcataacacgatttaccgcaacatttccgagtttgccaatctcgggattgttgagcggcaggtgcagggggatcgggcatcggttaaattccaatgtgattttcaacatgagcatcaccaccactttatctgtagtaactgcggtaaagtgatcgaactcaaggattgcccattgagtcctgaaatcacctcccagctgactggctgtgaagtgactggtcatttgtttcagatttatggcttgtgccctcagtgcgtcaacttaatgaataattaacgaattgtttaggtttcgttcatattcttatgcgataatggaggttacaaaaatttagtaaggaagttttttgaatggataatagaattccaccattaattacgccatttgccattctctcaatttctttggcactcggcgccactaacgttgtggtcaataatgtgacgtccaccaatgaaggaacccctaggaccactcaaacgaccaatcaaaaaaagatttcggattccatctatgggaataagaaaaagaccaacgattcggatgcgaaagaaaaagctgagaaggctaaggaagcctccgaaaagaagaaggccgcggaagaatcgtctgcggccaaggcttcgtctgaaaaagccgagagcgaaaaaaacgccagctcttcagatgaccaaaccaacgatgatacaaccaataacaacaagaatacgacaaccgggacgacgaccaataaaggaacgaccaccaataagggtacaaccactaataaagggacgacgaccggtgggaatacgactaacaacaataactcggatcaaaatacccagaccagtagtgacagcagtaatcagacgactggaacaacgggcggaaccaacactcaaaataacaataatacgaatgccaacgctgatgtgacgactggcaatacaggggagggaactaactaatgtttagctttttggacatggttaaccactacctggggtacttcaatattaatgtgacccttaagagccggatttacacagtgttaggcttctttggtgacgtctacctgttttacatcagttttcgtttcttgcagaatcagatgtttagcaagggtgtcccgattttattagtcgcaatcattttgctgtactttacaatttgcaacttcttttattactttactaagaagcagccgtggttcgatatttcaccgaaaattgccaagctgctgcacattcaagagcacccacgagaaactcaggtgcaatccaaaatgggcaccaccgtcatcgctgatgaaagaaacgtgccggccaacggcttgttcgacgaccagcacctgttaccggctaaaattgaggtcagcccaatgcagcaggctaatattgatcgactagttgctcaaatggaacgccaacagctgtttagggccgactataacggcatgagtgaccggaagatctatgaactgctgaaggttaatagtaagccgatttatgccattggcaaaggcgtattgcttccttattttgaaatgcaaaaacaaggttcgtcattgatggtctattgcggtttgaaccaagcagagatctatccggtcggtgaaattaagcgaattggcctgcagtcgattcgatcgcttgatttgagtcaggtcaagttatacttggcatcagtgaccttagttggtggaccgtacaagcagatcggccgggctggggtgattgaagcgccacaggactataagctgcgggcaatggttgcttacaagaagttataaacgaaagggcttcattatgagaattaacgttttacaacacgtcgccgatgagggacccggatccattcaggactgggcgcatgccaaggggcatcagatgtacatttaccacccggaccaatttggtttactgccaactgcagctcagactgatatgttgatcatcctcggtggaccaatgagtcctaatgacgatttgccgtggattcaacaagaacgggaattgattcaacaactgttggatgctcaaacaccaatctttggtgcctgttttggggctccgcagattgccaaagtcttgggctacgccgtttccaaaggcccggcaaaagaagttggttgggccccggtgtatcgaaagtccgacgtgattcctggactacctgagcaattgacggcgctgcattggcacgaggatatgtttgagcttcccgatgatgcagatttattgttctcaagcgaccacttggctaaccagggatttgtgttgaatcaccaggttgtcgggttgcagtttcactttgagcccaaagaagataatgttcgcgagatggtcgtcaatgacgctgcatacattcaaggctcggtgttgaatcagtcagctgatgaaattttggctcgtcaggttccagcagaaaataaaaacgtcatgtttcaaattctcgattacatttctgaaaattaatattttctcatcttaataacgtgcaattcaacccagcccgggtttggattgcacgttatttttaagctctcattttttagccacaaaatgagcttccaattaaattttattcaaatggggtttccattttcactgatggtgaattataattagataattacccaaatttatacatccaaaataatggtcgagtttgaatggctttatcatcggattaaccccgttgatagaaaatgtgacatgaaaataaaatttttgtaacatttttttgacctatcaaaatttttaacatattatggatgtagtatcattcttaggcaattttaataaatagcctgaaagcattggaggaaaatgacatggcaatgatcgaatttcaagacgtacaaaagtattacggcgatttccatgctttaaaggacatcaatttgaaaattgaagcaggcgaaaccgttgttttaattggtccttcaggttctggtaagtcgacactgatccgaacggttaatggccttgaaccgattcaagaaggtaagttgatcgtcaatgggcaggacttggccaacaagaagaccgatgttaaccggatccgaaagaacgttgggatggtgttccagcattttaatttgtatgccaacaagacggttcttgaaaatatcatgttagcaccacgaattgtgttgaagcgtcctgaaaaagaaaacaaagagttggcaatgcagttgctcgaccaagttggtcttcaaagccaagccaacaaattgccagcccaattatcaggtggtcaacagcaacgtatcgcaatcgcccgttccctggcaatgaggccaaagtgtctgttgtttgatgaaccaaccagtgcgttggatccagaaatgattgatgatgttttgaacgttatgaaagatattgcgcaagattcagatatgaccatgttggttgtgactcacgaaatgggatttgcccgtgaagttgccaaccgggttatctttatggatgacggtcagattttggaagatgacacaagcgacaaattctttgatggtgaaccctccaatgaacgtgcacgacaatttcttgggaaaattattacgcattaaaaatttcattattgggaggtcgcatcatgaagaagatcatatcaagaattgggttattgttaaccctgctcttaatggtcgtttctttgagtgcctgttcgagcgcagcatcacagaaaaatgtgctgaaggatgacaagcagacaaagacgatcacatggggcgttaaagccgacaccaagctgtttggtttaatggatgttcgggacaatcagattaaaggatttgaaattgatttggccaaagcgatgaccaagcagattcttggcaaagacggcaaggcacgattcattcaagtaaccagtcaaacccggatgccattactgagaaacggcaacattgatgccattatggcaaccatgaccattaccccggagcgagctaagcaagttgacttttcacgctcatactttgatgccgggcaagccatcctcgttaagaatggtagtccgatcaagaatgtgaaagatctgaatcataagggcgccattgtccttggggtggttggttccaactccgttcaaaatattaagaagtttgcgccgaaagccagagtgcttcaactgtctgattattctcagaagctgtccaagatctatgatttttgatatacttctatgtaaaaagcgagtttaagctatgaaaaattatcccagcaatattactcggcaacaatttgaattaattcgaccagctttagaaaattttcgtaagcgaactaagcctcgaaa

SEQ ID NO: 207 - DNA, 19230 bp, Lactobacillus buchneri
cagtgaagttagccagttttagagacggcgtccagcgccaaatatgctcacggcattactaacttcacaatcactttataccaaaaagtgatgaactaaagccccgtcgggttttaattcatcacaagcttagtctgttttaaaggccgaagggagctcaagatagcatgacaaacgcgccagagcgcgacgagacccgtttagggcccaccaggtaggctagaccgttttcggccgtcggaacataagcgaaaacttccaatgatgaacggttcttgttcatcgttggaagtttttgtttatgtggccgggccctggggcgtcggagcgtgttttaaaggccgaagggtgctcaaaatagcataactgctcaactatacacactccaaaaaaatcctccacccagcaataaaccactcacccatcacatcttccgccggaccttcagcataatcagcattgccacaatcaaagcgacagaaatccccagcgtcagcatccaagcatactgcatcccggctaacgggagtttcacgttcatcccatagaatccggtaatgatcgttggcacagccatggtcagtgaccaaattgtcaaaaatttcattgtatcattcagattattgttggcaatgctgttgaaggtgtgatcgattcggtcaacgacttgagtttcaatctcaaacattcgttggacctgttctccttcaatttgcacgtcttcgaataaatcaattttatcttggtcagcaccgacaccaaaatgggtctttggcaaacgattgagttcactgagattggtttgaactgcgctggacaaaaaggtcaatgtctgttgaagatgtgaaagtgaaaccaagtcactgttcttcgtcttccggttcagcattttatccaaatagttgcgtttcttggtaatgccacgagaaattgggataaagctgtcaacaactgcaaacaatgtttccagaataaatgcatcgacgctcttaacctcgggattatccaatgccgagtaaagcgccgtattgacttcaggaatgtggctttgattaaacgtgaataaaacacccttatgaagcaacatgccaaatggctgggtaatatatctcagcgcatctttgtcgagggcatacggcgccagaaagatgaataattggtcgtcctcattgatatcataaacatagttagtactttcatctttatcagtgacgtactcaataatatcttcatcgatgccatactgatcttcgagggttgcccgttcttcggcattgatttgaatcgtttcaatccatttggttccattgattgtcttttcgggtttgatcatttagtaatccccctgttagttattaacctctattttagactaaaagaaaagaagccgcagacaaatttttaaattgtcaacgactcccaactgctaaacacttttataaagaatataacggaaacctacttattttttataaaggtctttaaacggttatttcagcaagccaaccgtctggagaatcaagtaaacgttcaaggttaccagcacaatggtggcaaaccaagcagcgtacttgacccaagtatgattgacgaactcacccatcaacttcttgttactggtgaacatgaccagtgggatgatggcaaacggtaaagcaatactcaggaacacttgtgatgccgtcagtaatccttcaatcttagcctcattgccatgatagtaaatggcaaagatcaaaactggtgtgactgaaagcagacgagtaatcaatcgttgtgcccaaagtggcatctttagatgaatgaaaccttccatgatgatttgtcctgaaagtgtcccagtaatcgttgaactttgtccggatgacagtaaggctacggcgaacagcatactcagaattggactggcaatggcgccaacaatgtgtgaatcctgcaaagcgttgaataaatcaacgaaccgaccaactgaactgttcgtaccgaagaacaaggcagctcccaataccagcaataagctgttaacgataaatgccagtgacaactggatgttggagtcaatcgttgagaacttgattgctttggcaacatccttgcgattcttccggtcaacccgacgtgtctgggaaattgatgatcccaggaacaaatcatggggcataaccgtcgcaccaacaatcccaagtgccaggtagagcattgacttgttcgtgacgatcgatgttgaaggaatatagccggcgaacagttcaggcatattcggtcctgccaagaatacttcgtatgagaagaccagtaaaatcactgcaaccaaggtggccacaatggcttcaatctttctgaagcctaatctcatcaagagcaacaggatcaacacatcggcactggtaatcaaaatgccaactactaatggaatcttgaacagtaattccaacgcaatccctgaaccaataatttcagcaacatccgttgccataatggctaattcagtgatgatccaaaggataaatccaactcgcttactggtacgttcacgggtcaactgagctaaatcttttccggtcacgattccaagtttagctgccatggattgtaacaacatcgcaatcaaacttgagatcaagaccactgataacaggctgtacttgaattgagccccaccagcaattgatgtgatccagttaccgggatccatatacccaacggcaatcagaattccaggcccggtataagttatcaacgtccgccaaaatcctgcatcttgcggcacgatgatactaccgttaacctcatctaagctcttgctgtcgccagcatcttctgtactactgaaaaacttcttcttaggttctttcatttccacactctctcgcatgtattagccctctttcattggtttgaattcgggcaattgtttgagtagttactcagtcaattaccaacacttattatacacacggagatataaaggtcaaccattactctcaaaagttttcaagaagccgttttcatggcatttatcaaaaatttacatgaaaatcagctaagcgacttttaaaatactagattgagtgtatacttaatctgaaatttaaattcaatgcacagtaaggagccacactgaatgctgaatggtaccgaattaaaattatttgctgatgccaacgtgctaaatgcaatgaccgacaagcaggtcaaaatcctattggcagcaatcgaagtattcgcagaaaaagggtatgccaacgcaagcaccaaagaaattgccaccaaggcaggcgtttccgagggaaatatttttagtaagttcaagaataaacgcgggttactgaatgccatcatcgaaccggtgatcaactcgatttttcccgccgtcctcaccgaatttaagactgatcagctccccctacaatttgtcactttacatgcctttgttgattcattggtccgcgacagaattcaatttctcaaagacaacgcagccgtcctcaaaatttttgtctccgaggtcttatataatgagactgtcagaaaagaactgctgactaaattccctcccctttattggcacaacatcaataaaaatttgaatcaactcaaagacaaccatttaatcgtcaactgggagaacttggaaattctcaaaatcatttggtcggttgtcggtggcgtcatcattggttacctattgtttaatcaacctctggagcagcgagaaatcacccacatcatcgacgcgttggtcaagtcccttgccagataatgcttcacaatattaaaagctgaaattcaatgatgaatttcagcttttttaatgtggaaaatgataatttggtcaatgattatttgatcggataacggtttcatccccactatgacaatcatcatcttgcgtgttcaattttggactccaaacacgaacattaaagtcaaaaattaatttcgaattattgttgataattacaaagctagtgtttatactaaacattaactagcgatgcgaattatttatttttattttaaattaatgttcgtgtttagccgaaatttaacaaattgaggagaattcttaatgaaacgcaatgataacggtttgctttatggtccagatgataaggtttcatatttccaatcaggattactgggactccagcatgtgttggccatggatgtttacgtgccaccgatcatcatcgccgggctgctgtcaatgagtctggcacagaagaccggcttcttgcaggcggctttcttggcctgcgggattggaacaattcttcaaacccggtacttcatgaagctgcccgtttcgcaaggcccatcatttgtgccaattggtgcggttgccggggtctacttggcaaacggtgccgctaacggcgggatggcgactgtcctgggatctttgattgtcggagcattgttattaattctgcttggcgtttcaggcgtctaccaaaagattatcaacacattggttccagcaattgtcggcggcaccatcatcacctgtgttggcctgtcgttattaccatccgctttgaatgacaatatcttcaaggcagccggaaacgtcaaccaaaacattgaaattgctgccatcaccgctttggcaatgttggtcgctattacaatcggcatccgcatcccccaacttcaacgattgttcaaagtcagttcaatcattatcgctttgatcgtcggcacgatcgttgcttcgatgatgggccgtttcgattggtcagtcgtgaacaacgcggcttggatcagtctgccccactttacttcattacattacgggattcatttctcactgccggcaattttaaccttcgtagtgatttatatggtattgacaactgaaaccaccggtacctggttcgcaatgagtgccgttgtcggtgaaaagatcaccaagaaacaatggaatcgcggaatcattggtgaaggactcagctgtctgtttgccgccctgctcgggacaaccccaatgaccggatactcaaccaacgccggggtggtttcgatcaccggtgttgccagcaaacgtgtcttcgtctcagctgggatctggttcgtcgttcttgggttctttggtaaattatcagccttcctgtcagctgttcctgccgctgtgattggcggaatcttctccatcatttgtgtcatcatcatgctgaatgggttgaacgttatccgtaatctggccactgatgaaagttccatttatgttttagggattccaatcgtcttgacaatggctgtaattctcctgccagccaaggtggttagcgaaacgccacaaatggttcagtacctgctcggttcaccaatcacgattgccgctttgagtgccatcattattaatctggtaatgggcaatcgaaaagtctctgaagcgactgaagattcagaagaaattaaatccactgatgcaccaaaagaacaattagcagaatcaaaataatcattaaattgaaaagaggtcggacgtaggcattgattgcctatgatccgacctcttttgtgttgacccgttgaattaaacttatttggttaacttgtgataaacctcatcggcaattaagtcgttggtccacatccagacaacgtggcccaaagcctctgacacatgttcctcaaccggttgatctttggcagacggaaccgtgcccattgccggcatgatgcccaaatgaaaggcaccccagacaccgagaccaaacaatgtgccgtcgcccattttaattaccggaacataatggccggccagactgtaaaacattgcaaacgaagttgaaaaaccaaagtggatcatgtagctgacccatggtaattgctgatcggaataggtgtaagttgcgtgagtcacctgttcaggaattccggcctgctcaagtaaacgctgtggcgggttggttttattccgttcaggtgtccgcggcggcaaaacattttcccagcccaatttgacgagaccggaaataacgccggcaacacccccggcaattaaggcggctttccaattaactgatttgctcataagacgatcccctttcgacattaacgttaatttcattatagcccactcaagccaagttctctgtaaaaagagtcgatgagcgtttatatttgcaatttctacgatgacctgttaaagtgtagataatgtatttagcttcgaaacaaggtccatcgttctaataagaatgactccttacttttcaagtttcaaatgcaaaatttatcgcgctatgcgcaacggaggtttcattcttatggaacaaggtactgttaaatggtttaatggagacaaaggttacggttttatcactttagaagacggcaaggacgtttttgttcacttctcagctatcaatgctgacggttacaagacccttgaagaaggtcaaaaagttacccttgacgttgaagatagcgatcgtggcccacaagctgctaacgttactgttgttgaataattaaatcaaaataaataaagacccctgtgagggtcttttattttgcccaaaatgtgttggaattccggttccagcgcatttttttgtggtcaaaaaactgtcgttataaccgcaccggagacaatcagcaacaaaccaaagattgtaaacgccagttcacgaggcgtctttgtttcgtgcatccaaatcatccccagcaacgtcgagatgaccacagccaactgcgaaaccacaaaagctgaattgacgccattcgcctgaacggaaccaatgtaagaaattgcgcccagggagaagaccagtccaccggcaatattcaaccagctgactggctctttaataatccgctgctgaccagtgacgaaaacatagaccagaaccgcgagcaggataccgattgcttctgggaagaagatcgccagtcccgaatgattcagtccccgaggaatggccatatacacaacgtatcccaaggtcgtcatcaaaagcatcagaatagttggcagcttcttttgcggtgtcctttgggcaaccagtggcttatcggtgaccgatgtcagcataatgccaacaatcaaaattaggatcccccctgcacccagcagtttttccatcatcgtcgaccattcaccaaagataacgacaccgaccagtgaagtgccaattaattggaatccggtggaagttggcatggtggtggataccccaatatttttaaaactaatgaactgaccgacttgaccaataacccagaaacttccagccaggactgccgctaaaaatgtcggcactgaaaggtgtggatgataaaaaagcgtcatcaccgctgccaccaagagcgtcccaacggcagttccaaagatttgatttgctggcttgccaccgatgcgggcaacaactggtcccaaaagcccccagccaactgccggcagcaacatcaacagtacattcatctaaccaactcctatatctaattcgcaagattatctgtcatggccgatcaagctggtgcttatcaaaaccacccaaaaagctggcatcaaaatcacgccgactcttaagataccgcttgccgaactcgtcaattaagccatggaattcctgggcatcctgatatgtaaatgattcaggcagccaaattctcttttgaagtttcgaataattgccaagattgcgaaatcccagatccgtaaaaagcgttctggcatatttgtcggcaataaacgccggctgatcaaatacatagaccagcagcgaatcagcggtttcctcccccactcctggcagctttaacattgtccgacgtaaatcggatttatacttatctgccattaaggcaaagttgcaatcgtcctgatcaaaccatttgaggacggcttggaggctgcgggtcttgttgacgtaaaagccactagggcggattaatgactgcagtgtttcagttggcaggttcaaaatctgtttcacgtccaaatgcgtctcatcttttaaatttgtcagagccatatcgacattgttccaattggtattttgcacaaggatggcaccgatcacaatttccattttcgaatcggccggccaccagtgctgtggccccatctgttggaacatctccttgtaaagtggtaccggattaatcatggagacacctcctaaaatcagctacaatcagtataacagtttcggtcgtggtagcgctaccacagttaaatacgctatactgggtataacactaatttggaggacactatgactgaacaagaaaaaatgttagccggaaaaatatatgatcccaccgatccactcttagctgctcaacagcaccaagcgcaccgactttccaaacgatataacgatacctttgacgaggacaccgaagaacgggccaaaattgtggctgagctgctccccaatgccgataaaggtatttaccttcaagggccaattttcttcgattacggcatttatacaacgattggcgaccacttctatggtaatgccaaccttacaatcctcgacgactgtccggtcacgattggcagcaacgttatgtttggtccaaacgttaccttggccaccccgatgcatccactccgctaccaagatcgcaatctcaaacagcgctcagacggatctgaatacgatgacgagtacgccaaaccgatcacaattgaaagcaattgttggcttgccagcaacgttgttgtcattggtggcgtcacaattggcgctggcagcgtgattggtgccggttctgttgtcaccagaaacatccccgctaattccctggcggtcggcaatccgtgtcgggtcattcgaacaattactgcggacgatgacattcatctcaaatcaaatttattttagacaacaaaatggatccggccaaataacggccgaatccattttgttgtctaaaatattaatgcgcttttttacgaagtttgtgtgattgataagtcaagaatgcccaagcgaccagaccgaagaagattggtccgatgatcgtccagaaggcgttgacgtaatcgtgttccaaaattgggtaaactgccgtaaacccaatcccgccgatcaagacaatcaaaacaatgattgagatggtatcggtcatccaccgtttggtataaatctcaaacggtcgttccaggttctgcttgcgtttgaagaatgggaaggcagccaccaggaagatatacgggaatgaagtggaaatgtttcccatattcgtcaaaatcacgtagaactgcttggcacttgaaccaccaaaggtcacgaagaagatcaggaccgcaacaatgaccgcttgggtccacattgcaaatccaggcatccccttcttgttcaacttagtcatcttggcaggccagaaattcggatttgatcccatgatgaatgacttcagtggcgagtagaccagcacgaagaacgaacccatataagccatgaacatactcaacccggcaaagcgggcaaaagtcgtccccaagatggtgctggcagctgcagaaagatgcagactctggcccagcacaacacccaggttggccatcaagacataggtaatgttccccaggttaacgtgaccatttccaaggactgaatgccaattggcagtgatcccccagaggaagatggaaagtgaatacatcacggtgattaccaaagtggaaatgattaacccgcgtggaaatgttttttcaggttcatgcatattatcggtcacaccaccaagagtttcagttccggcataggcaaagaccgcataaaccataaatgaaatcaaagcgattggtgactgaaaatcagggttcggcgattgaataaagctgtgcatcccggtaaccggttgggccaaatgaccgccgtttaaaatcaaaacggtgacactggcaattgcaaaaatcaccgtcagcagcgaaacaaagattccacccaccgaagaaattttggaaatcgagtccattccgcgaaccgcaaaccatgttacggtgatgatccaaagaatggccagcagaccaatcgtcttggtagaactcaagccaaagaagctccagctctgagtcgtatcgtgcccgaataaggttgtcgcaaacggaatccagactttagaagcagtggacatcatccaaataatccaggatgataaccaaatgaaggtaccaataaaggcccattcttcgccaattgacccggctaaccaggaataaatcccgccatgggcgtctttgaaggttgacccatactcggcgaacatcatagcagttggcagcaggaacaaaattgcggccaatacgtaccaaataatacttgcataccccatttgctcataagcaacggtggtattggcaaaaccataaatcgtggtaaaaatcattaagattaaaccaactaacgtgatctttttcttcgacatagctagattccccaattataatattttgaaatatgtaattctggtgattgttaaaaatcaaactaaagaatagcatgccattattaaaattaaccaacaagagtcaggaacaaggttaaatctccattaaaattgaaaccggttcatccgttgataagcgttagtttccccatttaccattagagttgggtgaatcttaagcaacaaaaaagcactattatcaggattacccaacaacagtgcttcaaatattatctaattagtccaacttagtcttgctgacaacgtttaatttgtcatcaaaatcgtaaaccactggttcaccagtagccatttcaaggttcatgatgtcttcgtcagaaatgttttcgatgtactttgaaagtgctcgtaatgagttaccatgaccagcaataatcacgttcttgccgtcaagtaatttaggagcgatttcatcttcccagaatggcataacccgttcgagggtaacctttaagttttcaccaccagggataatgtgtggatcaaggttggcgtaacgacggtcatgaacggctgaaccttcgtcgtcggccttcagaagtggaggcaatacatcgtatgaacgacgccagatatgaacctgttcgtcgccatacttttcagcagccttcttcttgttgtggccttgcaaagcgccgtaatgacgttcgttcaaacgccatgatttaacttccggaatccaaagttggtctgagtattccaaagcataatgtaaagtcttgattgctcgagtcaatacggaagtaaatgcaaagtcaaactggatgccggcttttttgattaatttaccagcattgatggcttgcttaaccccttcttcactcaaatcaacatcgacccaaccagtaaactggttagataagttccattcactttgaccatgacgaattaacacaagttttgccaatataattacctctttctttatctctatcagattgattttacaccaaatggaaaattttttcagcttaattgtgaaacttttataaagtgaatccggtttctatggttcccccggcttggttgggactttgtcgagtttgccttcatgcttcttaactcccaaaatgtcgaggaagaaggtgaaaatgggtaccccacaaattaatccccaaatgccaaagaagtgctcgccgatcaataagacgacaaaagtatagaagatcggtaagttggtcttggaggccatgaagttggggttcaaaatgtaagcttcaaacgcgtgtacgacaatgatcgtgatcaacagataaaagacatcattccacccgccgactgaatacccgaccaatgacaacggcacaaaggaaataatcacgccggccactggaatcaggctcaagatgaagaccatcaatgccaaggctgccagctgcggcagatgcatgaaggccatcacgatggtggtaaggactgtgttgcagatggcgatgaagaattgtgcttcaatcacaacaccaaacgttgcgacaaatttcttgccaaagaagtacaaatcttggaagaaccagccaaagtcactttcaagaaacagcttggaaaatctggtcatggttcgctgttcaatggcaaaaaagaaactcaaaatcatcgacaagaacagcgttattcccatggttccaacgccggtcacgtatttccaaaccagcgacacgccatttttcatctgagccataatattgctttgcttaaccagttcattcaaccaactcatcgtggtatcatccggtagattcttggggttggtgtaaaagagaataatatcctgtgtcgttcgaatggtttgatcagcaatttttggaatatatttggtcactgcaaagtacaaccccaaaattaccaacaggtaaacgaacgtgacgataatgcccgccggaatcttgatgtgcctgcggattgcattggttaatttaaccaccaacaaacagaagataaaggttaacagcactgtgctgatcatactccgggtcacataaagcacaaagatgaccagcatcaacacggtaaatcttctcagtggtacgttgttgacgaaccttgcccaaattgacaaatacccaaccccctcgtgatttctaattaaaattaattttactcttagaaaacggtttctcacaagtattattacttataaacagaaagggagtgtgccaaaaggcggtcttgcttccgttgcataacctagaatgactttttgagctgaaagctcggaaagttattctaggttatgcctaggaagcggccttttggcacacgttccagctatataaaatgaaacaagcaaaggggctgttgtcaaaacgttagttttgtcacaacccctttaccgaatcttaatatcgggctttcacgtactggccgattgtttcgccattcttgtgagcacctttgatgacgtttctgacatcctggtcgctcattgcgttggaatcgacaccagcagcactgatttgctttctggcactggtgatctgagcagccgtaatcggtttgccgtcaagatcgcggtcgcccttggtcacagtgtattcatttgagcccttgtaggcagcggcagctttcttctcagacgacgtcaaactagcacccttagcgccggaaacgttgggattattgctggtgttactgtctgatgtgctggagtcaaaactgttggaactagcggaagcattgccgctgatggcatcattgttcttatctcgtaatgtttgggccttcttcaggatatcggcatagtacttttgatgaattgatttatcagagaaaatcttatccagcgtactgttggactcggtgtactgcccattaccggcctgatccaaggcttgattataaatcttgttgtagttttgacggttattttggatgcctttaatcttggtaatttgtgctttggcacgatcagacaacagttcattgcccttcttggtgtcaacgactgactgatactcactctttgcctgaccgaatttaaggtcgtcaaataaatcgttggcggaaataaacgattgcgtttggttcagtatcttatccgctttatcatcattcggtttgcgttttaaggcattggtaaacgatgtttcagcagcggtgtatttttcattcgaaatttgaaggcggcctcgctgcatagcttcagcgtaaattttttcgttttggctatgacgggcatatgcgtaaccaccaactgatgcaccgataacgatggcgattacaatccagatccattttttcaaattgaagccctcctaataaaatttgttcaaatttattataacatttttccctaattggcattttcactggcatgccaagattcacgatatttggaaaaacaatcattagagactattataacaaatgacagatcgagactttgttcaaaatatttgttatattaattttaaagatttgaaaggagcacgcaaatggctgacagttcagaagaatatattaagcagcacatgtttggcaatcctcagatcaagccggacgagaaacgggcatttcttggcaacttcagagaacgagtcgccttagcgctgacgatcggccagctccagcaagccggcacggcggaaatggtcactaagatcttaaaaaactatccggaataccgtctctacatcaacggccggatggaccaggacttgatcgacccattcatggacattgcgattaaagaaaattacaagtacaccattctcgtgcaaaacgggatgcgggtcgaccaacgcttgagtcccgacgactttggcctggtagtcgccaatccgactgagaaaattaaaagaagaattttactgtaagaatttaatccaaatagattcccacatagtgcaactagattaatgaccacaaataaaaaggtcgagagataggcaaaatcacctttccctcgacctttttgtatgtaacttgtcgctcatcacactaccatcgccaagagaaaaacagcaaccagccccaaaacaaccgaaattgccattgaacgagtccaataagcaatcccaatcacaatgacggccgcaatcatctccggtgcccggttgacgatggtgacggtatattcaggtgaaatgaaaatgtccttgacaaccaacgccgtgaagagcgagattgggacatatctcatccattcgttaaaccaatctggaatttttcgggtacggaaaaacatcaggggaatcagtcgcggcgcaaaagccacacaaaaacaccccaagattaaccatacatgctgtgttgtgttccattccataaagatagctcctagtcatcagcgtcttcgtcggcgtcttcaggcgatccggcagggtttttcatcggccgcagccaaccactcttgggtttgtactttctgatcgtcgcttcgaccaaaaaaccaatgaaggatgctgtcaaagtggataagaccagccccaacgtggatttggtaaggaccataaagaaagccgccaagaatcctgacaaaatacaaattacaataatcaacccattcttcagctgaaccacaatcatgtacaggaaaagcgcggtcagtgcaaaatggacaattgttaaatcaatgttaatagccgatccgattagactgccgataatgttactaattgtccaaaagatcagcgtcatgtgttcaacatgtagtgcttcatgaggggtaaacttcttatcagttgaaaattttaaatagttcaacgcgtagttttcatcgttcattgacgccgcaaacagcgcggtaaaccccaaggattctccatgcagatacttggaaagactggaccccagcaatgcgtaccgtagttcaagaaagaacatcattaaaatgaccgaaagcatcggcgcattagtggccagaagagacgcaatcaagaattgagccccaccggaaaagaccatgattgaaaccattaaagtggtccaaacgttaaagccggaagcgttcaataaaataccgcatgccagcccaattggaatataactcaaatctacaggcaaagaagcgtcaagaattcttcgccaatatggcagcttctccctagattttgcgacagcttttcccaaaaggattcctccatctaaacccatctcacacattcgtgacatgtgtgtaaaaataatgtaaacacaatccaaatacaattatatgggatatgactcaattaataaacaccttttgtgtaattgaattttaaaacagccgtaatatcgcgcgccataggcgaacaaagaaattggcttttttcacagattgattggtcaccatcaccagcttgccagccgagtggccaatgtattgcaatcgtttgccgtcaatgcttagccgagcgtgacctacctcagtgccctttttagtcggcgatgtcagtttggcaggctgattaacatactgaccagaaatctgcttggcagaagtgcctttgtcggcccaaacccagtgggtcgtcttggtaaccggcaagatggtcgtctgtttgccatcgggaattttagctttaccgaccccggcaattgtcgctccggctgccaacttaatcggttgatgagtggcataaacccatttcatcaacttggcggtctgaataaaccgcgcaggatcgctggcggacttgtttctggcacctaacaccaccgtgataatccgatgctttccattcgtcgtggctgaaccaacaaaacacgcccctgccttgtcggaggttccagtttttagtccatcaacgcgaacaccttgacccaaattgtgatcatcaatcaattgattatgtcccgtcatggtggtcccataaaatgttgacgtcgtctgcttggtaatattggtcaccttggggaacttttgcagcagcttttgagccagcaaggcaacatcttttgccgacaatcgattttccgcattggcactgacatgtggtaaagccaatttaccggtcaacttgttggtcaaaccggaagcattgtagaagtggccgtcggaaatgcctatcttccgggcggttttgttcatcaacgcggcaaatttggttgctgtcccagccactttctggccaagtgccaaggcggctgcattggcggattcgaccaaagtcgcattgattaattggcggacggaataggctttgccggcggtcagcggtacgttggtgagaccggaggccgtgcttaatttggcaagttccgatgaaattttaactttgtcatcccaggccagtttattggccttgatttgctgatgaacgatatagacggtcattaacttggaaatcgacgcaattgcccgcggctgattggcattcttctggtataaaatctgaccgctgtcagcatcgacagcaatcgctgatttggcataaatagctggttccggggtaactgtcgacttggcatcaaccgtcatcgacagtgttaaaacgcaaaaaaagcccattaaggccgttaaaattttgattcgatgcttcataaagttctccttttattcagcaattttttggcggggctttttgcttaatttatcaccatgttgaaccggtaaatgaatcgcaaaggtcgtcaacttttcatcagagctgacattaatgtagccgccatgcaaatcaatgatactctgggcaattgccagtcccaggccggagccgccggtatccttattgcgagagctctccacccgatagaaccgttcaaaaatctgatcaagcgacttttgcggaatctccggcccatcgttggcaacgtgaatgacaacttcgccgggttggccgactgcggcactcaaataaatgtggtggccgcccttgccatatttgatggcgttggaaatcaagttattgaaaacccggcccagcttttcggcgtcggcctcaatgtataagggcttgtccgtttctttagcagcaattgccagcccgcttttatcagcttccagctcaaaactggccaccagctgttccatcatttgattgaggtcaatcttactgatggaaagtggcgttccggtctgtttgaccttggtatattcgaataaattgtcaaccagggacttcatttgtttggccttcaaataagcaatctcggtgtacttcagcaaatcttcctgactgtgatattgcttatcccgaatcagacccaggtagcccaaaatagaggttaacggggtccgtaagtcatggctgacattggtaatcagttcatccttggaactttcaattgcccgttcctcatccattgacttgatgacactgtcaaccaaggcgttaatgctttcaaccaccgattgggtattaccactcagtttaaagggaattcggtgattcaaatgaccattggcaatgtaatgcagctcactgatgatgtggcgcaactgaatttggtggtaacgtctgatcagccgccaataaaccacggcaccatcaaacagcagcaggaggacaataaaaatgttctcccagctccaaagatgcatgtggtcggggccaatcaaaatcgatcgtttgataatgaaaattccgtcccgcagccctgggttggtggagattgattggttaattaaaatgatcactgaaaggttgagcaacaaaagcaaaatgactgttacgacaccttccagaaacagctcagttttctcacgacctgtcagtttcatgcggcatcccccatttcaaaattgacttggcctaatgggactcgatcttatagccgacgccccaaacagtttggatgactttctcgccgttagtggcttcttcaattttgtcacgcagatggctgacgtggaccatgacggttttggccgagacaatgctttcctgtcgccaaacccgctcaaaaatttcgtcagctgaaaagacccggttaggatggctggcgagcaggtataaaataccgaactccaaggcagtcagctgaatcggcgtgccagtgatcgttttgacttcgtgagaatctttattgatggttaaggggccaatgtccaaaacatcgggcgtatcgttagtgacgtgctcttcagtccgccgcagcagcgactttacccgtgccatgacttccagaggattgaacggcttggtaacataatcgtcggcaccgctgatcaggccctgaattttgtccatgtcttcggtcttggccgacaaaatgatgatgggaatctgagaatctttacgtacttctttgacaacttcaatcccattcatcccaggcatcatgatgtctaagatcatcaaaccaatgtcggattcagtccgtaagcgggtcagggcttcctggccactgtaagcggaaacaggctcgtagccttcatttcgaatataaatttccaggagctgagcaatttctttatcgtcatcgacaactaaaattttcatagtgtaatcaacctcattatcgtctgtatttactattattttatcattattatgtgtctggctttatcaattagcatccagttttgattttacactttttaataaattcaacaagcatgtctgaaatgttactgtaaggcgtttgcacaacgtttacaagattagcatgggaagcttaaggggaacttaaaaaagagagtgcgacaagcaacgggtgatgcggtgtgtaagagggacagtggttaaaatcctgaacccggattttaacctctgtccctcttacacgttagacaaactatattacgtcaaggaaaaataatgactttattgaagtttattaccccatttttgagcgtataagaaataagcttcaaaaatagttattttttgaatttgataattacatggtttttaggcttggttaatctct

SEQ ID NO: 208 - DNA, 350 bp, Lactobacillus buchneri
tccaagcaggatcgttcggcgttaacttccttcattatcgttgacgctcagagtgttaaaaataccgaaacggccgagaataaaggctatgatgccggtaagaaaatttccggaattaagcggcatctagcagtggatatgaatggctttccccaagccattcatttaacgcgggccaatgtctctgaccgtgacggtgccagtgccatgttagccttaaacgccgaaaacttacgccgggttcgaagcgtattggttgatggtggttacagtggccgcaatttcgccatggatgtccagcttaatttaaaagcgaccacccaagtcgccaaacgaaatgagttacataa

SEQ ID NO: 209 - DNA, 835 bp, Lactobacillus buchneri
tttcgaggcttagttcgcttacgaaaattttctaaagctggtcgaattaattcaaattgttgccgagtaatattgctgggataatttttcatagcttaaactcgctttttacatagaagtatatcaaaaatcatagatcttggacagcttctaagttttataccaaggccacaatcgttaataatacaaccgcaaaacttgttcgtaaaaattataagtgcgttgttactttcaatagcaatatggactattctgaatccaaaaaatatgtaactgtccaaaccaatccacttaggagtgaagtgggtgatggaactgatggtatctttatgaatgttacttactttggaaaaaatgcaagtaaataccataatgcactaatttcattttcttactggtggaacaacctaggcgatataccggaatcaaatccagagggatccgtagttgtattcaaaaatggcaaggtttcattttctgatagcttatataataaattaccggattaaaaagataagtttttttctaaatcacgtggtttcaattggctgtgaaagtatttgagactttaccaacgatcttaacttgaatgatttgaacctcaattgagatgtaaaaggcacccgtaaaatgtaggaaaacggcaggttagaactgttggttttcctacattttttgtatcgtgaatcacatcagagtgtaggaggaatttgatgtgagacgtgatttaagagaaggagtgacgatttacgtgactgaaaatattaagcctaacttcgccgagattgcccggcaatataatgttgattatcgaaccgttaagaaagcctatgag

SEQ ID NO: 210 - DNA, 12721 bp, Lactobacillus buchneri
ggtgattagagattaaccaagcctaaaaaccatgtaattatcaaattcaaaaaataactatttttgaagcttatttcttatacgctcaaaaatggggtaataaacttcaataaagtcattatttttccttgacgtaatatagtttgtctaacttctaagtgcactttaattaaagttccaaacccaggaacttcaatcaaagtgcacttagaaaccgcctctcccggcccttgtcacgctctgactttttgccccgcatacaccgccgcaccgaccattcctgcttcatcgcccagctgcgccgtctccagcttgcaggcttcacgggcaaccggcagggaatgatgcgccaaggtttcgcgggtatatttgaacaacggctctccggcagccgagacgccgccacccaggattaacgtttccggattaaacaaattaatcacgttgcccaacccaaatcccagcaactcgccagtttctttaaagacttcaacagcggttggatctccttttgctaccgctttcgagatcaatttggtggtcagttcctgcccttgtgacatccattcacccactaagctggtttggccgtcagccagtttttcctgcatggttttgacaatcccgcgagcggaaacataccgtcccaaacagccggtactcccacaagcgcacggccgaccgtggcggtacatgttcatgtggccgatctcaccgacactattggaagcaccatataacacttggccgttaatcagaacagctgcgccaagtccggtaccaatggtgaccaagacaacgtttcgatgacctcttccggccccaaacgccatttcaccgtacaaattaacccggacatcgttgtcgatgaagaccggttggcccagcttatcctgcagccacttggcgaccgggacatccttccaatcggtaaaattcggtgaaaaaattgaaatccccttttccacatccatttgcccgggaatgccaaaaccggcagccaaaatatcatctgaggtaatcttttcctgagccattaattgctggcagcacgcccagatccgattcagtacttcagtaggaccggcctcttcatgagtcggcttatgtaatttttggaccgtttgaaaatcctcatcgaacagtccggccttaatgttggtcccgccaagatcaacacccaaataatattttgtcatatcgtccacctcacaacagcgatcaattcaatcaaaaacgcttacttactatgataataaccgattagactgcataaagcttccaaaaacattccaatcaccatcagatacatgacgaccatattcatgcccagataaagcagaatgcccatcaccaaatacaacagtacaaagaaccaacgtaaccaaatattattaaccatttcgatcccctccaaatccattttaactcttacattagaatctttacaatctgtgaacaaataatttgtaaaaacgcggttttaatgtaaactaatgattattaggatataatatatgtaaagagtaattggagaggtgataccatgaacttaacagaatatcttcattcgcagctcaagtttttaaatgaccagatgagttccgctaagaaagataaagacgaaacgatgcaatatctggtagattcaaagattacagaagtcaaattaatcttggaagccctccaaaagggaatcatcgatggaataagttaaaatgtggccgattggccattttttatgttttaatagactagtgcgtaataaagtttgattaaaaaaggaagtagaatattgattacattaaaatcaccacgagagattgagaagatggctgaatcaggtgctgttctggctggcgttcataaggaacttcgcaagatgattaagcccggtttggacacatgggacatcgagttgtttgcccgccgctatatcaaagatcacgacgcctacccttcagaaatgggctttgacggctacaaatttgcgacatgtatttcaattaacgatgaagtcgctcatggaattccccgtaaaggcttgaagttaaagaacggcgacatcctcaaagttgatatgtgtgtcaacaaggatggcttcgaaagtgattcttgctggacttatgctgtcggtgacgtcagcgatgaaatcaaaaaattaatggaagttacccgcaaaggcttgtaccttggcattgaccaagctgttattggtaaccgtcttggtgacattggaaatgccattcaaacttacgttgaagatcaaaaccacatgggcgatgtccgtgaactgattgggcacggcattcagccttccattcatgaagaacccaacgttcccgcatatggtgtcccaggccaaggccttcgtttgaaggaaggtatgacgatcaccatcgaaccgatggttaacaccggtacttgggaaattgccgaccgttacgacaagaaggatgactggacatactacgtttcagccgatggtactccttcagctcaatacgagcataccttggccattaccaaagatggtccaaagattttaacctcccaggatccagacattgacgcaaaatatctgctttaatttaaatcatcaacaaacggccgggacatttgttccggtcgtttgtttagattaaaatagatgtgtagaaccaattagtaagaaaatcaccacattatttgtatggggaggaatgattgcatgaacaataagaactttaaatttcctgacactgctgcctacgaatttgttattcaagcgctcaaagaccgcggggtgacctatgaagacatcgccgagatggcctataatcttcaaaagaaatttgtccccaacattcaaatggatgaagtcaaaaaagacaccatcgacgtgctccacaaacgagaggttctcaataacgccatggtcggcctggagctggatcgattggcaactgaaggcaaaatcaaagaaccccttgaaagcatcatcatgaatgattccggcgtttttggcgttgacgaaggtattgccttaaacattgccaacatctacggcacgattggaattaccaattatggctttgttgaccgggaaaaaactggcgtcacaaaaaaattggatgaagccaaagacggcacatccaatacgtttattgatgatattgtcggtgcgattgccagtgcggtctcagcgaagatcgcccaccggaacaactaacgccaaccgtgtgatttttgatcataatcccgctttttaataccggaaacatagggattgcccttaacaaaataccgcagcggcttggtcgcccaagtcccttgattcgcaaccccgattcgattagattcttcaatctgaatggggatttttttgtcgtcttgatgaatatttaacttgctgtcaccaaagatttccatattcatgtctttatcggcaatcccaaaggcttccatcaattttcccggaccattggtgagctcaacgccatggcgggtgcggttctgttccataacggctaacccaattgttggctcaattgcccggattagaatcccctgggggacgtcttttgcttgagccgcaacatccaagaggtatcgcccatgaatggaatagatgtacactgttcctggaggcccgtaaagcggttcgttggaagctgtccgccggcccttaaaagcatgggcagccgaatctttttgccccatataggcttcagtttcaacaattcggccacccaccagacctttgggggaatcataggttaaaagcatccccaacaatttcttggagatttcgtcggtggtgccgttagaataaaatgggtcttggtccaaatcaaccatccctttcaacaaatggaggttatcacatgcaattaaaattagaacgaatttacgataagccgcaggatctttccggctaccgagtcctcgtcgaccgcctatggcctcgagggatttccaaagtcaatgccaagctggatgaatgggaaaaagaaatcgccccatccaaagagctgcgaacctggttctcacatgacccagaaaaatttcccgattttaaggaaaaatacgtcgctgaacttgatgccaacccacagaccaaagatttcgtcaaactaattggtgatcagctcaagaatggcaatgtgatcctgctttatggtgccaaagatcgtgagcataatcaagcagtcgtcttgaaacagtacttaaccgatcacttaggccagctttgacgaatattggccagggtcaattctttagttgattcaaagttaatatcggccattgttagaacttccggatcaccaacaccaattgagaccacgttagcagcgttaatcgactcgacgccgacaatcccgtcatcgatgccaatacattgatcaacgttcaggtggagcatctcagcggcctttaaatacacatcgggtgccggcttgttatgcttgatgtcggccaaattcacaatcaatggaaagtaatcttccaattcaagtttgtggatctctttaggcgcattagccgaggccgaagcaataatcatctggtagtggttcaaccggagctcggctagaaagtcgcgaatccccggtaaaatatcatctggattcatgatctcaagcatttgctgataaatggcgtttttcttgtcagcaagtgcttctttttgctggtcagaatatttgccaaccaacccgccgactcgtaaaatctcgtttaacgaatcgatccggtcacggcccttgatcgcctcttccaggtcttgattccactgcacaccaatcccttcggcaatctgacgccaagattggctatggtaccgccaggaatcggtaatgatgccgttaagatcaaacaacacccctttgatattagcaaaatcagtcatttcaaacaccctttcttacaaaaaaagactgaaaacaagattgtgttttcagccccagcggcagcttgaattatttaacagcgttaaagatccaagtgatgccatacttgtcaacaatctggccgtatttgttgccagaagttttcttttcaaaagttacgattactttgacttcttctgattccaccactcgctcgtacaaatcctgcaacgaggaaagggcatcggaatcatgcagatcaacttcaaacatcagcgaaatcatcgaggaaatcaccggcttacctaaaaaactgtccgcacaaaaaatctgcttgcctaaaatgttgaaactggcttgcatcgtaaggtcgtcgagattgacatcgtcattaagcgacatgtcttgcgcctgcttttcagttggggattcacgttgaacatccgtggcaccaaaaacagtttgataataatccaaagcttctttggtgttttcgaacgtcaaatatggaattaaattaatattactcattaggtcagcaacccttacattttaatattattcaaagtttagaatacctttaaatacaatagttgtcaacgtcaaccgtctgccaatgcctattctgataggaaatggcgtcctttttggtaataatttttggaaaagtgatagacttaaattaaacggatcgggaggaactatttaatgaaacttgcaatcacaatttttgtattaaacgcgttatacatttcgattaataccttcagaacaatgctggttgtgaaaggccaccaatttttagcccccatcgtggccgtcggcgaagagtttgtctacgtgatggccttggcgatcgctttgcagcatattgacagtccgttaaacatcgccgcatatgcggttggattcggtgttggtatctacattggaattgtcatcgaagataagatcgccttggggtacgtcaactttgaggtaaccgtccagattgacccgacgaatccgattcatgcccacaatgaagagttggccgaaaagttgcggaatctcggttacggtgttacggtcagccgtgctgaaggccgctcaggagcccgtctggttctcagcattctggctcccagaaaagccgaccgccgtttgatggaacaaatcaaggaaatttcacctgacgctttcgtcatggttcaagaaccggttcaattatccggtggcttctggagtaaagaagttgaccgtcgttatcattcaaccaatcatatgcactaatcgtcatcttcatcgaataagccgagctgtttgagactattttcaatatcttgaactgaagttggcgtcgttggtgccgtttttcgatgaatgggctttggctgccttggagttggctgttgtttgatcggttgaggtttaggaattggctgtggaccctgcttatccggagtaacggcagggctggcctgcggatccggctgacccatttgatccatggtttggtttaacaggtggtcgacaaaaacatttccctcatcgcctgcgtgtcccttggtccaataataccgaatgatcgggaaatctctcagattggcatcaactgcttgccaaagctgcttgttatgcagcttcgagccgtcactcttgttccagccgcggcgtcgccaaccagccagccagcctttttgaatcgcatccagaacatactgggaatccatgaccacaccaatccgctcattttgcagaccttggcgtttcaaatacttcagggcttccaagaaggccattatttccattcgattattcgtagcaccaaattcgccaccggattcgaaatatttttgactaccagtttgaactaaaaatgcccaggctgctttatcgctggcttttacgtggccgccacgatggttcccgtggttgcgcgacccgccgtcggtgtagacgatgatatcaccatccggttggactgagcggcggcccgttgaagcctttttgtgagatttgtggtgtgtcttagtgggcgacgttgtttttttcgccccgttgagataggcattggcttcggcttcggtcttaaaacttttatattgggcaccggaaaatcctttaactttcttttcggcctcgtcccaactagtaaagataccggtctttcgaccttttttaactgcgtaatatttcatgaaaatcatggctcctcagtgtaaaaatttcagaaaaaatgttaattattaattataatgtttctatctactttgcaattagataaatctatgcgaaaatgttaataaaagggggcaaatttaatatgacccaaactaaagccacattgatctcggtcattgaagccaaagcacttctaaaagaccagtcagatcaaataaacgagcgttttccccgattaaaaaaacaaggtaagtatattctacctgattatcggttaacaagaaaacgtgaagctttcaagattcgaaagcatacatttttacagcatcacgcacgttcctacgttgcatttgattccgagaacggacagacgctttggatgcacaactttccaagcctgaccgaagccttgttttggttggataccggtcttaaacctaccgataccgacactaacacatcgtataagtcatggaaagatctgcacgaagatgacattaacgccctcaaagacattttgaaggaacgttctcgtaaacgcaaggaagcggcggctgccaaaaaagctgcctcggttcccaaaaagaaaccggcggctgtcaaaaaatcgacagttgttaagaaaaagaaagctaactaattcgttattcgaacctaaaaaaggtatgactgtgaatgaaagatcattttgttcacggtcatgcctttttattgtccatttagttattgataatgaccagcaatgtcgtctggactaaaatctgtggtgaattgacgatcataagccttttcataggcagcaactttttgttggtaatcaatttggcgcatcttttcagcagcttcgcgctgtgatgtggtcgacttttcgaccgcatccggataaatcggcggtaacacatggaccgtataattgatgccatgcggatccgatttggtcggggcgtcaaccatcgaaacaaagcaggacacgattggcacattcaatctaacggcgtagtagtacgctccccgttcaagcggccgcggtttgcgatagttgaaccacatttcccgttccggataaattagaattgattgtttgcgtgccaagctactttgcaaaagggcaataaaccccttgcccatgtaattgacgctgtcgctgacaggaatcgtatcagcgtatgtcatcaaaaatcccagcatcccgggcattttaagattggtgagctcaacgacaatcgacaaatcaggttgattcagggctgatcgaaccagcaggctgtcaatcgggctaaagtggttacaggtaatgattgccggccattctaaagcctttaaattgtcagttccctcaacttttaaattgggattcatcatcctcgcagccatattcatgaccgaccgggcttcagctgcccgccaatggtaacgtttagtttggtgaagcttcaagaagtggtccaacacctcatgctgctcggtgagtgtcagtactggatcatgtagttcgactttttgattaaattttccctgacggacgttttcagcaatgttttgaatcactttgtcacgctcgccaagctttaccggtgtaaaagtcatagggcaatttttactccttgcttggcccttgcgtaaaatgtcgttggggtcttaataatatcaacggctaattgaatcaaatcggactgattcttctgatcacgggcaacttctttaggattcatatctgcgagctgctgtttaagcatagtctcgtaatcagtttgtttggcataggtccaaaaatagctttgtcgaggggcatcatcataacgccacggcttggcaaataagttatagtgaatcaaccagggttcaacatcctgtggcgtagtgatttggatattccatgacgggttcaaataataaattcgatttctcgcgatggcattcatgtagtcctgatccggcgccaaactcttgaaatggtacttgttcaaaagctgcaaaaagtgttcagcgaattttgaacggcgcatttcggcgaggttcatcaacaacacgccggaattaacgtatttctgtgaatcaatcccaacggcttgttcagcatagtcaatcgtttccggagtgtggccgatgaagtgatccggcactgcgccaaccaggttatcacccagctgagtatcaaataactcacccacatcctttaaaaccaccgtgtctgcatccagatagagtgccttatccaatttggggaacaattcagcaataaacagccggaaataaattgtaaaggtaaagtaatcgctgcgaagtttgttattcttatcagtaatttcttgcttcaagcggtcattaattgaaacaaactgaattttgagattgtctgtttcaaaggctttgagccgcccttgattgtcggtattgagatcatcacacaacacaatcacctggtaatgcctgtccggtgatgtatgcgcgaccagtgaagacagtgaaactgccaaataaggtgcataattgtcatcgacagcgtaaaaaattggcacggtttgattttccataatgaatcccccttaaatcaatgtgattgatgctggtaggtcataaatgacacgttgctttggtgactgcgggtcaccatttgggcatgaatctgatcatggagcttttgttggcgttgcttgcgcggaagtgacttgtccggcataaacggaccgtcaaagtataccacctgcttgggtcggctcaacagtcggcctttttgatatgtaatcgtcatgctgtaactgggcagatcggcagcgaccggataatggaaagcgccgactggaaacggacgaatcttggtgtaatacggccaaacatgggcttcagggtagatgaacactcgttgatgctggtccaatcgagcattcattgcccgctgaaattgaatcatttgtgataatttggcaggtaagatcaacgccccacccatcgttaaaagacggccgacgatgggaataccaaggttggcgggttccgcgatcggatacgcccgcctgggtactgccaccagcatcggcaaaagcgcatccccaagcggctgggtgtgattggcataaatgaaggcgccccgtttgccttgggtgcgcagacatcgcttattccgaaaagacgtccgcaaatacaggcgacaataaacgaagctgacaacaaccgccacccagtagacgaccgtcgccgttacgcggtaaaaccaattttgatgcagccaaatgtagccctcaggaatggtggcattttgattcttggtaaagaccacgtcatcatcaaaatcatgatacgtaaacacttttgatgcccgtttagtcattaccaatgtcaccctttcttccgacaagttaaaatcatgaacagaaccattctaccccaaatatgacattattttatcatacaggacgtttaaaaatggcaattcgctaaaaatcgtcctttaaatgattaaattggtgtaaaattaaggcttgctatgctaggatatttgggataacaatggatgtatacacatcattagaaggatttaggggataattttgatgcaagctcagtccaagaacaatacaaagtttaactttaaaacatttatgggcctaatcaaccgaattcacccccgttactggcaactgctgcttggtttttttctaggagttgtcgcaacggcgatgcaattgatggttcccggcatcgccaaggggatcatcaactcaatcggtcattcaatggatgtcggcctaattgttgccgtcattttactattcgttttcagtaccattatcggagccttttccggcagtattttaggcttcttcggcgaagacgtcgtctataagctgcgaacaacactttgggataagatcttaaccctgccggtgggttattttgaccaaaccaaatctggcgaaataacctccaggttggttaatgattccacacaggtcaaggaactgctggccaattcggttcccaaaaccgcaacttcgattctgcaattggttggcgcattggttttaatgctcatcatggactggcggatgacactcattatgtttatcgccgttccactcgtcttgatctgcctgctgccaattgtccgccaatcccacaaagttgccagagcgagacaggacgcactggcagatctcaatggtaaagctggtgaaatgctgggcgaagtccgtctggttaaatcgtctacggcggaaaacttagaacgaacagccggcgacaaacggatgtatcgcctttatcgtatcgggttaaaagaagcgatctatgattcgattgccggacctgtcatgggcatggtcatgatggccatggtcctgggaattctgggctatggtgcgatccgggttcgggaaggtgccattgatattgggaccttattttcatttctgatgtacctggttcaaatgattagtccatttgcggttcttggccaattcatgtctgatgttgccaaggcaagtggctcaaccactcgaatccaggcattattgcaaactcatgaagaagatcatctgactggaacggatttggatattggcgatcaaacacttcaaatgaaccacgtcagtttttcttatgatcagcatcaccccgttttgtctgacgtgtcgtttacggcagaacccaattcggtcattgcctttgccggtccatccggcggtggcaaatcaaccattttcagcttaattgaacgcttttatgaacctaacgagggcagcatcacgatcggcaataccaatattactgatattcaacttgccgattggcgccagcaaatcggcctggtcggccaagacgctgcgatcatgtctggaacgattcgttacaatttaacctatggtttgccgggacatttttccgatgagcagctttggcatgtcttggaaatggcttacgcaacgcaatttgtccaaaagatgccccagggcttggacacggaagtcggtgagcgtggagtcaaggtatcgggtggccaacgtcaacgattggcgatcgcccgggccttcctgcgtaatccaaaaatcttaatgttggatgaagcaacggcgagcctggattccgagtctgaaatgatggtccaaaaagcgctggaccaattgatggctaatcgaacaacattggtgatcgcccacaggctaagcacaattaccaacgccgacgaaatttatttcatagaaaacggcagggtaacgggccagggaacccaccagcagttggtgaaaacgactcctttgtatagggagtatgtgaaaaatcagagcgcgacaagacccggttagggaccggagtacaaagagaatcaggccatgatgaacgtttcttgttcatcgtggtctgattctttttgtacagtaggtccctgggtcgtcggagcgtattttaaaagccgaaggatcctcaaaataacataaccacatcactgcgcgacaagcaacgggtgaggcggtttctaagtgcactttgattgaagttcctgggtttggaactttaattaaagtgcacttagaagttagcctcagttgcgtcggagcgtattttctacctatagtcaagttataccggcaatttaagaccattctttttctgtcgggcatggctgtgccgtaaattaattgtttttctggttaggtaaagtggctttgagggtaaactaaataagcctt

SEQ ID NO: 211 - DNA, 2581 bp, Lactobacillus buchneri
aaacattgaactttggcaaactctttacccctatccggggtaatcgttaacgatctaccaggccatagcttcattaagtcgctcaaagtatccgtgactgcttctgaagttcttttagcagctttaccaataagcaggtaacgagattttcgatcaaccaatgtaacgacacaagcctttccgcttttgcctaacacggtatcaccttcccagtgaccaatttctacacggttgtcagcttctcgcggacgatcatgaatcttgttggggattggaatcttgcctcgcttttcttgataagctttattgtggcgagacttgccgtgatgccttagatggcgcacggcactagagctgccagatttaaacaaattatcaaataagccattgaaaatcccacggtaaatagtcgtggtactgatctgcaccggatacttttcgactgccaagcgattcgatatttcctccggagaccaaaggtcttcgcagaagtgttctctcaccacttcaaacacctgaggattactcaaaagagagactctgccacagttgcctttgcgctgtttgtacttctcctgagccttcgaaggtgaataggatttaccagtagaattacggcttaattctcgagaaatggttgagtaacttttcttgatatggctggcaatctcacgaagtgagtttccatgattcctcattaaaaagatagtttcccgttcatctatggtaatatgcttgtagtgatccatggctaaattcctttcatgattgttttcgcaaacatcattttacagaaatttggccatgggccattctttatttaattagtgttgcacttaaagtgtaaattcaagttttaaaatactcttagcaactccggttgaaataatcacgcccaaccccaacggaattaaagcagaataatttaaatgactaacttcaataatcataaataaagccattaatggtgcttgttgcgaggcagctaacaaactacagcctcctagtaccgaaaattgccagacggggatagtggttattggagcgacaatcatcccggcaattgttccaatgactgcgccgatcgcaattgaaggcgttaaagtaccgccggcagctcctgagcggattgttaagaccgttaccagtcctttgatcaaaccacttaaaagtaataatagaatgaagtggttactcgttgtgctgattgccatttgagcgagtggtcgaccatttcccatgatttgtgggagttgtgtgagtgtcataccagttatcagtgccattaaaggcagctgccatagaatatgattgcttttggtctgatgcttttctgcccaagtgaatgattttctgaataggccaccggcaatcccacatagggctgcgatgacgatgacaaagggcaaaaaagttgtatcaaagcttgtgtggccaaccaggtaataaggttcagtgcccctgacacttgagctcaccaacatggcgatgattgacatgctgaggctgacaccaactgttcgaaaactgatcttttttagcaggatttcgatgcaaaaaaacatcccggtaattggtgcgttataaactccggcaaatccagcaccagcagcagcggccattaaaagtttaacatcatctttagataaaacggccaggtgatatttaagcaatagatcgttccatttttgggcgatcattgccccagcctctcgtggcgccaactcgcgaccaaccgagccaccggttcccacgtaaaagatttgggtgatgacgtgaatcgctgtttgaagtgctggcatgttttgaccacccaagccggctttaatggtaacgggaggtttcactttggttcttaaaatccaccaaataatggctgaaataatcccaccagcgaaaacggcccataaccgggtactgggggcaacatcaatgcccatcggataacgggcggtttcttcaaagtgtagaaaaagatgctcaacaaaatttagtaataatcctaaaaatagtgagctcagcccaacgatcaatccaagaacaatgcttgaaattattaaaataatggtttctttttttctcataaaaataatataccacgttttgactagcatgtgagaagaagcgataacctcggaaggttagaagaattagtactgcaggttttcttctgagtcgtctggtagctttacagaaaatgctgatgattgacaacaccacaaatataaatgatttaaggattccaccagtaaatcatttagaacgattgagtggtgaacaaaaaggatagtttagcatcaagattaatgatcaatatcgaatctgcttttaggttgaaagctcaaacgatttcacgcatgtagaaattgttgattaccattgaagataggagaaattgatatgaatgaaattccaacacccaaaattagtggatgtaagctgattcctgagacaacttttaagagagcgtataatgaataaatcgtctctcaaaaggaaggaatttttacatgccaactcgttacgacaaagaattcaaacaaaacatcatcaacctatataaacaaggcgaatcagccgc

SEQ ID NO: 212 - DNA, 354 bp, Lactobacillus buchneri
atgctgatccacgattactagcgattccaacttcatgtaggcgagttgcagcctacaatccgaactgagaacggctttaagagattagcttgacctcgcggtttcgcgactcgttgtaccgtccattgtagcacgtgtgtagcccaggtcataaggggcatgatgatttgacgtcatccccaccttcctccggtttgtcaccggcagtcttgctagagtgcccaactgaatgctggcaactaacaataagggttgcgctcgttgcgggacttaacccaacatctcacgacacgagctgacgacaaccatgcaccacctgtcattctgtccccgaagggaacgcctaatctctta

SEQ ID NO: 213 - DNA, 1580 bp, Lactobacillus buchneri
cttgtatattaaagatgtcagcaaggtaacattaatttgtactaaactgatattaagcgctgtggattagtccatctgaggtacggatcctaacggatactggttacgttagactctaaccacagtcttttgttgtactgttgattagtttgataacacatatcccaagatatgatgtttcatttaatgcaagaatacagggcaagagatttgtggagcacagcgttaattacatacgtgaggagcggtaatgatgatttatgctggaattgatgttgcaaaatatgagcatcatctatcaattattgatgaccagggaacggtactattagctgatctggaatttctaaataatcgtgagggttttttgacggctcaagcgacacttgacaatgcgcggacggctgatggtcaagtccaagtgggattagagaataccggccattatggttataacttgatcagctatttgcgacagcacaagtttcaagtgtttgcttacaacccattactaatcaaaaagtatatccaggccaataccttgcgtcacacaaaaacagatccacaagatgcgttggagattgccaaaaagctaaggtcagataccactaaggttagctttgaagcagacgccgatatcattgaattgaagagtgatacccgctatctggaaggacttaagcgtaaacgagtaaaaaccaagctcgcatttacaaatgtcctcgaccaagaatttcctgagttggcgccaaatctagggccagtatccgcaaagtacagtcagtggttgttggcacttttgaagagatacccgtcaacagataagttggctcatggacgaatcaacacgatgacaaacatcattaccaaatactccatgaagcagcatggcgaggaaatggcaattaaagttcgtgaactggccagagaaacgattggtcaagcatctgatagtctttcatttcaactcctgcagttgatcgatgcgctacaatttgagacccagcagatcaaggaagctgatcaaaagatccacaaaattatgaatcggattaagacgccgctcctatcgattccaggagttggagaaacactagccgccattattttagccgaaattagaaatgtgaactactttcaatcaccaaaccagattctggcatttgccggtgctgagccctcaatcattcgctctggtgaaatgcaaggtaactacggtcacatggttaagcacggttcaacgcagctacgctgggcgctctttcaagcagccagactgtgcgcaatgtattcgccaaccatgcgagcgtattatcagaaaaagaggtctgagggcaaaccatatttggtggcattaagccatgtagtcaagaagctagttcgaattatttaccacattctaaaatacaatgacccatggtctgagacggtgattagagattaaccaagcctaaaaaccatgtaattatcaaattcaaaaaataactatttttgaagcttatttcttatacgctcaaaaatggggtaataaacttcaataaagtcattatttttccttgacgtaatatagtttgtctaac

SEQ ID NO: 214 - DNA, 165041 bp, Lactobacillus buchneri
  misc_feature (136585)..(136594): n is a, c, g, or t
  misc_feature (152037)..(152046): n is a, c, g, or t
tgattagagattaaccaagcctaaaaaccatgtaattatcaaattcaaaaaataactatttttgaagcttatttcttatacgctcaaaaatggggtaataaacttcaataaagtcattatttttccttgacgtaatatagtttgtctaacgtatgcagctggaggttgcctttggttccttggaacattttgaaattgtattgtctgatcggctccatggtattgggatccatttcaaggacggtgttgttttcatcccggttgcgcagatcggtcagcgtattatcttcaaccaggtacaaatgcttgttttgtgggttgaaggtcaatgtttggccgtggccaatatcgacttgtggactgagctgagcggtttcggcaatttcaatgttcttgaataattcaggatttttcgccttgattttggcgatctgtgactggccgtgcgcaatttgtttttgcaacgcggttaatttggtcctgtcagcggccatctttttggcatttgcttttagactcgcggctaaatgtttcttagtcgtgctgctggtctttcgatatttcgcctgggtcgtccgcttggcgtttgccaggtcattcattgctgccttaacggtggcttccttgctggtaagtgacttgacagttttaaaggtatctttcatcgactcatacagatcatcgtactggttgttgtgggtgacaccgtcttcagtatacggattgaagtagttaaaggcgttccatagggccattgggtcattttcaagccccagctgtttgagcttattggtatcaaatttgatgatcacgcctaagttggtatcactaccgtttgattcgacaaagtagacatttccggaatcatctaaggcgacgctttggaagttaccgtgttggtagtcggtcacgttgaaaccgtcagggaggaaccactgggttttaaacgaattggcggttgttgtcgttgcatcagtggtcgcaaaggtgtcgccggcgttgtcctgagttggatcgatggttccctggttatatttgcgatccatgttcccgatcggcgaagtattatcaatatttttgagatcacttgaatcatagttggtgaggacattgccggcgttgacttggggaattgatttgaccgcaccgggaacgtcgatgatgtcggcttgggcgttggtcgaggctgcgagaacacccgcggcggtaaatgccaaggcaaacgtgaagatcgttcttaaaggtttattcatcttatctcgtccttttctaaataaatgattattgcgcgtcgaatgtgtaggtcaggctgagggattggtcatccgcattttgtttgaccgatttggcgtggtaggtaatggtttgccaagcaatgttaatcgacccgttggcgtcttttccaaagaccggatattttggcgattgaagcgttgaccaactgctgttcttcaaattgcttttggcagaatccaggtctgcccggttcaaactggcagtttggccattatcgacgtactgcatctcggcagctgatttaaaactgttattgatcgctgccagcgaatcagaactgtattttgccagtgcctgtttgaagttagccagattggtggctgacaaaccggcaatgtctgccgcacttaactggctgtaggttggctggctgctgccgccgacgtctggaaattcccagctgttgttcacgtacgtcagcccggttggggtcaactgttgagcgttggcgctgtctcctgaagaactggcagcgtataagttaaagtgagttgagttgttggccttgccgacattgatcgaaacggaactgccaaacttggcctgggccaaagtgctctgctggtcatcggaaaggtgttcctggttcaacagataaccggttccggataatgacgaggcagccagggcgttgatttcaacgacgtcactgtcaccaagcagccacttgccggatttttgggtgcctaaagtggtgcctttcttggccggatcatccgcatcggtgttgacatagtcaattgatttgatgactttcccgttacttgggtcaacaaaattgatacgaactgcgttatcggcgattgatgtatcggagctgttggctttcaggtaaacgtccccgccaaacttggttttggccaagtctgagatttgatctgttgacaagtcggtcaattggtacccagaatcctttaaggccgtggaaatggcggactgaattgccttttgatcagcatcatttaatgaggccgtcccgtttgaactggtccccagtaattggccaggttgggcgcctgttggggtgtagtcgacagtatcgatcactgcgttggcatcgttcaccagattgatgcggatggcgtttccgggaatgggatcggcactcttaacggtcagtgaggctcggtgaccaaatttagcctgggcaagaaagccggcctggttggcagaaatcgtgtccaggttgtagccggtcccttggagtgcttgacgaacggccacttgaatgttggcgagatcgtcgttgccgagcgtccaggaagtttcgtatggggtacccagtggttggtcgtattgggcgttggcgctggtgtaattgatgtagcggatcaaattaccattgctgtcaaccaggtcgattcgcaaggcattatttggaatgggggattctgcttgacgcaggcctttgtaaagaatccagccatttgctttggcgtcggcagaattcagcgcactgatgtgaacccaaacatcgccttcgcgagcccgggtgcccatgccgtcaatcttaaacgtggtattggcatatctaacggagtcgccaatctgtttgccagcttggtaggtcgtgttgatgggtgctttgtatgtaacggttttgccgtcgttttggaacccgggagcggcaattttgaaggtgtatttactcagactggccggtggggtcgtttggttgaacgtccggaaaggttccagaccgccactaaactgaccagcttttttgccaccgtaaatccagccatggtattggccgtcaaaggaagtcactttgtagtagacggcaccatttttggcagtggcctgacgatcagccacaaaattgtcagcagaagatttagccgaggctaattgctttaaagtcgctttgccggcaacaacgtgggcacctttgctaacgggtggtttagagtaaagcgcagacgtcccggtaaaggttacgttatggctggcagggcttccagttaacggatgttcagccgtaagtgtttttggggcgctggcgtgggcggtggaagcaacgcaactgacgccgagaatccccagcgcaacggctgagataaagatcgaacttttcaacttaacaatcatcaatttcatctccatgaattcttaagattttgtttctgcaatttcatagtatcgtgaaagaggggatttgaattgaagttggttaaacttttacgtgttggttactttaattttacaaagagagtgcgaagggggacgtttcggctaagtagcaggaaagcgacgaaagccgagtcaggctttcgggtggtggggcttattttctccctgctgtcccccgaagcacgtttcagctaagtaacagaaaagcgacgaaagccgagtcaggcttttggctggaggggcttagaatccaatcgctgtcccccgaagcacgtttcagctaagtaacagaaaagcacggaaagccgagtcaggctttcgtctggtggggcttattttctccctgctgtcccccgaagcacgtttcagcaaaatagcagaaaagcggaaaaccgagtcaggcttttggctggaggagggagggcaaaaggttctgcctttgaccatcaaaaagtccacagaaaaaaggcccaaaggtatcattaccttcaggccttcaaataaaaccggtggattacttatacttaaccgcagtcccataagcggctactgactgcatatccgcaccaatcgatccggaatcaaagcgcatcatcacgaccgcgtcggcacccattttaatggcgttttgctttagacggtcaacggaaatgttccgggcttcatccaacatcttggtgtaatctttgatttcgccgccgacaatgtttttcaatccggcgccgatgtttcgaacgacgtttttggattgggtggttaagccaaagacttcaccgatcacttcgtattcttttccggggatgtgttcagttgttgaaatgataaaatggtcttctgccattattcatacctccaatttcctgtctgaatctgccataagtatagcctaaatgatcaatagcacaagcgtgatataagaaaacccgcccgaccgaagtcagacgggatgcatttgtgagacgctaaatgtggtttagaaagatcgtcatcaccatgcagtaaatattataacgtggttcagacttatttacaaagctaaaatgtaaccgttattttgaagtggtcccagcaagcttggcagcttgctcttgagcggcttgtgccaaaatgttcaagtaattgaatgggcggtcaaattgtggttggaacagcatatcaaccattgccaaatcatcgattgtgttttcattttggatacataccgacagggtatttgctgattgggaaacatcgtaggtacttagtaatgaaccaccaagaattcgacgggtttctggatcgtaaaccaatgacatcaaaacaggttcagtggttggcatgaactctggccggtagttatcggtgatgatcacctcgctggcgttgatattttgtgcctttgcggcagccatggtcaagccggtggaaacgatggtcttgtcgtataacttgagacctgatgaagattgggttcccatgtacttaaccgttggcttttcaatgttcttgccgaccaagattccttgacgaacggcattggttgccagtggaatataggccaagccgtgagttgggttgtagtgaacagcaacactatcgccggcaccgtaaatgtcgggatctgaggtctgcatgtattcgttggtaatcaacgcaccgttgtcggtcattgccaacttgcctttgaatagaccagtgttgggacggaagccgacacagagaacaactaaatcggtttcgtaagttcctttggtggttttaatggtaacggtatcgtcaccggaaatttctgtgacctgttgatctaggccaagggtaacgccgtgatcagtgaagtctttttcaacaacgtcggtgaattctttgtcgaaatacttgctcatgatgcggtcggcaccatctagtaaggttacttcatgtcctttggtgttgtaagcttcggctaattcggcaccgatgtagccggcaccaacgatggtgatgcgtttcttttcgggtgcggtttcaaagagttctttggcgtgattccagttcttgcaaaggtaaacatttttgttgtcaacgcctttgattggtggaataactggccatgaaccggtagtgacaactaatttgtcgtaagtgtcttcaaatgattgatcatttttaaggtcggttacttcaatggttttggaggcggggtcaacgttggtaacttcatgattcatcttaacgctggcgcctagttttttaagttcgtctgggctagaatagaacaagccttgcggatcctttacatgtcccccgagatataaagcgattccgcatgaaagaaacgaaatgttatcattcttttcgtaaacggtgacctctgcgtctgggtgttctgctaaaattgttttgatggcaaaggttcctgcgtgagtacaaccaataactgcaactttcatattaacttctccttcgttttataaaagattcacaagcgtttgcttgtacttacatattacaagttgtgcaagcgatgtcaaggccttgacaaaagcctttttctgttatgcaatgtggttcacatgctgggattgctgttagggcgggatttataacgtaagcaaaatagttgtacacaatataaaaatatttttttggaggccattttgaaattttcttggacagtgacagacaatgacccacaatcgttgaaaaaatttttgaataccaagggcatcagccaccgaatgtacaagagcgctaaaactgatggtggtcaatttcgagtaggtgggcgaaaagttgatgcaacagttgttctgcgagccggtgatcaggtaacggttgattttcctgctgaggcaagcgatccaaacgttgccgtcagtaggcaaccaatttcagttatctatgaagacgacaactggctgattgtcgataaaccggctggcctaacggtggtgccgggaccggcgaaccgcgatgataccctggtgaatcgggtgaagggccacctggttgagaatggcgctgaagacttggtcccccatattattacgcggctggatcgatttaccagtggtctggtgctaattgccaagcatcgactggccaacagtttggctaatgaaatgttggcggccaaaacgctccacaagcagtatcaagctgtggtcgcaggggttgggctggagaaacacggcttcatcgaccggccgattactaaagaccccaccggatacggtcaacggatttctgatgatggcaagccggcacaaacggaatactgggttgaccaggcgtacgaggatcggacattggttgatgtggtcctgcataccggccggacccaccaaattcgagtccactttgcttcgattgaccatccgttacttggggatgccctgtatcacggcccgatggacttggggattggtcgacaagcactccatgccacccagctcaggtttgaagatccattttccaacagggcgttaagctttaaatctcaactcccacaagacatttcagcacttcttcattagaggtctactcatattgtgcacaaatgaacattgcaagaccaatggttgatcggcttgcgttaatttcaaattagaattcgatgaaagcgggttcatttccgttgtattttcacatacttctggtatagtatgggtatcaacttaaggaggagactagatatgtctaccaatggtgaatcggatcagacggttcaaaaaattattgctgagatggaaactaacttgtctgtattatcgtggatgaaggccgcagaggaagacaagcaaacccgcgagcacatccgtgctttgaaggccgctttgttgaaagcaaaatcagatttaattaaggcataatgtttcacgctttggttaggcgctagttttagacgactattaaatgatttgaaaagaatggcttactgatataataatcggtgagacattcttttttgcatacatacattagggagggattgagaacatgccagaagctaaaacagcgatttgctttatcgaccaccgggagcatatgttgattgatggtcgatatctaaaggatttagagccggcaaccagaaatttgatcaagggggattatccgaaagccaaggtcaccgattttatttgtgaccatgacttactgaagtaccaattaatgcgcgtcgatgggatggtgaatgccgacgtcaagcagaccaaaaagatcaatcgtcgactgaccaaggcgatgcagagtgatgattacgatattattgatgtcaatgataatctggccaagagtttaacgtttggtcagaaagtctccgacgccgttgcccgcttcggtggtagctggggtttcattggcgttttcacgtttgtgttaattgcttggatgtgtatcaatggcttgcagttgtttggcatgcactttgatccctatccatttattctcttaaacttggcgttaagctgcattgccgccattcaagctccaattatcatgatgagccagaaccgggccgccgaccgggatcggatgagctctgaaaatgattatcacgttaaccagaaatctgaacatgaactgcgaatcttacatgcaaaattggataatttaacacaaaatcaattaccacattcattggaaatccagaaattagaaattgaaattcttggccaaatccgtactgaattggacatgattcaacgaaatcagtttggcaatcccaaaagcaatctaaatgaaaatgaccagcaggatcatgaaaaccattctgaaaatgatcagtagtttcatcctcaattttgacaataaatgaaaacttcagtaatatatgacgtaacacatactgaatgttcatttacttaggaggatttttttgataaccgttagagaagcacagcaagatgacgccggccagatagccccgttaattgatattatttttgatgagatggaccttgatgaattagaagacgttcccgaacctggattagccaaggtcatcacgagggcttaccagacagacacgtatctgtccagtaaggcatccaccgtggtggccgaggccaatggccaagttgttggggtcgtctttggctaccccagcgaaaatgaggacgctattaataaggttctgatcaatttatcgaaaaagagtgctgattttaaagagccgtatatccctgattccgagaccaattctgacgaatggtacttggattccatcgccgttgatcctaattggcagggccatggtattggtagtaagttattggctgccgttccgcgaatggcgttgaatgatggtaaatcagtgatcggcttgaatgtcgattttgaaaatcctgaagccaagaaattatatgaacgaaaaggatttaagacagtgggcacccagatgattggggatcacttgtacgatcatatgcaaaagaccgccaagcagcggagtttgttgtatgtataatagtgtggaaaaatgagcgcttagcttccagagtataagggggtccatcaaatatccagggcttggatatttgatggacccccttatacggccggaagctgctcatttttccacgattcagggaaataatagtgagcatactcaaggagaggtcaagacacaactaattggagggtgtgccttggcctctcttgttttccactgttatctagtttaaacgtggaactatcggctgatcccggccatttaagcaaagaaacgagtcattccaagacaggaataactcgtttctttacttaaattctgggatcaaaacgcctcgcgtcccactcttttttgtcatatatagttgacattatttgttgatggcattatattattgatgacacatatatgtgacaaagtagccaggggaggccggttaatttgaacagagtccgggagtatcgaaagcaggtaggcatttcccaatttgccttggctgaaaaagtcggggtggccaggcaaaccatcaatttgatcgaaaatgataagtataatccgtcgttaaaattgtgtatcagcttggcggaagaattggggacggatttaaacacactattttggaaggtagatgaaaattcatgaaagagagtttcttgattaaaatcatgcgatactttttcagtattcgcggtgtattggatgagcataatgctcgagaaatcggcaaagtcgccacaaacgcctttatgtttttgtggatgtatacagggattgctaatgccgtttttctgcttctcccacaggccattaagaccgggtcaatgatcaatggctttattctgttcaatatgtttattgtatggggtggcgtaggactttacgtcacgcataaagtttcagaattaaaactgaattatcaagaagtctcaactaaagagtatccaaaggcagttcataaagccgtgatccatggcgcatggtttggcatcagttatggattggttacgtatttgatgtttgctcaatttaacggttttttctcgatcgttagcattggctttgcgatattcattattttgatttcttggacatctgatactcaacgagagattgcccacattgtcaaagttgaataggaggaaaataatgcgacaagacgatacgatttccacaaaattattccgatacttttttcacattcgtggggtgttagacaaagccgcccgtcaacaaatgaatgctgccatctcaaaagcatttttatttatgtggttatacatattggttttcaccggcggtgttttgctgttcgtaaagaatacccccaatagcgaatcttggatgctgtttgtctatttaagcctattgattggcgtgggcggctccggcctttatattcgccggcgggcagctgacctgggtttggatatccgcaaggtgattgccaatcagtatgatgacgcggttgaagatgcggtcatgggcagcgtctgggttggctttctcggcggggtggtcctatttgctgtctggatgaacgtcagtccggctgatcggcccttcccagggatttttgcctttttattcttggtggtcgcttgtgtctgggaggcccgagaagcaatcaaccatatcgttgtggtggaatctgatgtcaagaggagaaaataatgaaagctaaagaaagttttggatcaagattattgatgcattggtttggggtcaaacgaccattcgacgagtacaagcaccaacaaattggcaggattggcaccaacgcttatatgattttggcagtctacctattggtttccagcattgtcgccatttttgtgggtcaaaagcacccagaagaagcactgatcggtctggtcatgattaacattgtgatggttggcttcgtggtgaacatttatatcttaattgcgactacccgggcacacattgtgacgcgtgagattcaagcagccagtcgccaagagatcattaaaaaagcggttctgaagggaattggctttggaatatactttatggtaattatgttgatcgcagatattttaatggattggtactttgacggcaccagtccactcaatagtgtcgaaaacatgggagtgatttggccaaacgtcagaagcgggctattttttggagcgacgatggcgatttatgaaattctcaccaccaaggtttataaagaataattcatcgattggatttttcattgaacttgcatgaaccggtaattatcagtagaatgatttttgcgtgattgaataacgatgaatgcaaaggggaattcgatggaagataatattaagcttggcaacccggtgtttgacaaaatgatgtttgtgctggataagccagttaatgaacagaatcaccgggattaccgattcaacaatgaagaattggttcaaattagtgatggaatttgggcgatgcctgcctatatgaaagatgacgatgatttcagtatgttcttcattattactgaaattgatgatggcaacaccgtcttggcattctctactggtgagaaaaaaggcgagcaattttcgttgagtaatccgattattacaggtgaggcgctcaatatgctggttcagcatgacaaggacatggcggcgtcgattctgcacttcttagatcaaatttcgaaagcggatgagggcaattggcggatggtcgaataattcgctgttgcattttgccggtaagctgttagactatcatttgatttgaattttaacgaaatttgggagtaacggttatgaaattgacattgaatgaaacggcagccaaatttaacgtcagtcctgacgtgattgatgattatatcaaaaacggcctggttccaagcaagcctcaagtggcagtaggtgcagaatttgacgacaccgatatgtactggatggaaatggtcaactgttttattgaaaatggttcgtcggtagaagacgtcaaacaactgattaaacgttgtaagatctagacaaagttattgttaaaccaagaattgaatgatattctaaacacgtggggtatcggcactctttaagtcattaattagatgatcgtttgtataactgttagattgcacaagtaatgtgacaaaagagttccatcgtgcgaataaaagcactttgagtattcggttataaaccggatcagtattcgaatatgaacgaagtgatatttgattaaaaccattagagtggccgattccccacaggagggcccagtgcagagtgcactgggcccttttttaagagtgcgacaaggggcgtttagcaataagattataagcaccctcgggtgaagccgagtcaggctttgcccgagggtgcttataatcttattgctgccccatggagcacgtttcagctagatagcaggaaaaagctcgggtgaagccgagtcaggctttgcccgagggtgcttataatcttattgctgccccatggagcacgtttcagctagatagcaggaaaaagctcgggtgaagccgagtcaggctttgcccgagggtgcttataatcttattgctgccccaaggagcacgtttcagctagatagcagcaaagagcagggtgaagccgagtcaggctttgccagaaggtagcttgggtccccatcattgccccaaggagcacattttggctagagagaagtaaagcagtccccaccaaaacagcgaaccatgttttaccagaaaatgaaagcgttgtcattcccgcgaaatcatgctatattatcggagttgacaacccgattgaatcgtaaaagaggtcttgaataatggcaaaagtactagtggtgattgcccgtcccgaaagctcaaagtcccggacattaaaagtgttgagggcgtttatggatgagtatgtgaagatccatccaaatgatgtcatcgaaagattggatttgtacaaagttgattttcaagaaattgacggcgatattttttctgcgtgggatgaacttgaagctggcagacagtttagcgacttaacgtcgatccaacaagtgaagctcgctgaatttaatacctcaactgaccagtttttggcagctgataaagtggttatcgcaaatcccttgattaatttaatggtcccaactaaattaaaagcgtggatcgacacgatcaatgtcgccgggaagacgtttaaatatactgatacgggaactgcagtcccgttgaccagcggcaaaaaagccctccatatccaggcggccggcggcaagtacaataaccaggattttgggactcagtatgttaagggaattttgaattttgtcggcgttcagtcagtggccaagttaagtgtcgaggggatggatcattttccggatcaagcgaatcaaattgttgcggatgctgaggtaaaggctagacggatagcggatgatttttaatagagtgcgaaagaggacgtttagcaatcgaaagctaagccattccggacggaaaccgagacaggttttcggcaggaatggcttagcttttgattgctgtcctctttcgcaggtttaatccagataacaggaaaactccggacggaagccgagacaggttttcggcaggaatggcttagcttttgattgctgtcctctttcgcaggtttaatccagataacaggaaaactccggacggaagccgagacaggttttcggcaggaatggcttagcttttgattgctgtctggcccattttcaacgacttagtggagcgattttctggtatccctaaaaggattgttcacgcgttatggaaattttcataaactaatgcaataatgatagtagattggagtgattaatggatggctgaaaaaaatcataatcacgaagaattagccggtgccaagtttttctgggtgaccgtgctaaatgttgttattaccattgccgagttcatcggcggggcgctgtcaggaagtctgtcactgatttctgacgcctttcataatgctggggattcggtttcaattgttttcagttacgtggccagtcgaatcagtaaacgccggcaaaacgggcgcaatacttttggctataaacgggctgagattattgccgcattcttaaattcaattgccttggctttgatttgtgtttttctgattattgaagcactcaaacggatcagtaaacccgaaccgatcaacggtaatttaatgctgaccattgcggtcattggtttggcagctaacttgctgtcggcctttctgctgaattcggggtcgaaaagcagtcttaacatgaaagcaacctaccttcacatcttgagtgacgcgctgtcgtctgtggcgattattattggtgggattttaatcgatctttataattggacattggttgacccaattgtgaccgtgttggttgccgtgtatattttctacgagtccatcccgattattcgccaaacctgccgaatcttgatgcagggggcaccgagcctggattatgatcagattaaaaaagatctgttgcaaatcgacggtgtcttcagtgtccatcacgttcatgcatggtcaattgatgaaaacaacgttatcttttccgctcacgtcaatatgcatgatatgaagttgagtgaggctgagccgatttattccgaaatcagcaaggtattgaaggacaagtaccacatgtgtcacgtgacgattcaagcagaaacgacccgtggtgagcacgaggacatcatttatgaccgtggtaatgatattccataaagtataggagattttgagttaaatgaccccaatgaaagaggactatttaaaaataatatttgaacttggcggaactgatgatttggtcagcaacaagcagatcgctctcagtttaaacatcgctgccgggtcagtcaccgaaatggtgaataagatgatggctgaaaaattggtcactcaccaaccgtattccggtgttcaattgactcaaaagggtaagcgttatgccgaagaactcgtgcgcaagcatcgcatttgggaaactttcctggtgaacacgctgcactatgacatttccgatgttcatgacgaagctgaacttttggagcatgttacctctgacaagatgatcgaccacctggatgactttttgggcaatccgaagcgttgtccccatggcggcgtcattccagatcggaatggtaattatcaccccgatcatgataaactgctcactgatgcaaaagacggtgaagaagtcatcgttaaccgatttattgacaatcatgacttattaacgttgttgggcgatattaaactcgatattggggataagttaaaaattatttcccacgatcccttcgaagggtcggtaactgtcaagaatgtgacggataagaagaaattggtgattggctttaaaacggctcattatgttttcgtgaggtgattgaaatggccgatactgcaactcggcaggagaattatgatcatttagttttgaacacctgtgtgctggctggacggatcatgattgaatccggctcagaaatgtcccgggtcaacgacacaattatgcgaatcgccaagaatgccgggttaaaggatgcccaagtctacgcgactttgaccggcattatcatgtcaggcggcgtcaaggaagttggcgctgaagtcggttcgattgataaacgggcttttgacatggaaaaagtagccaaggtcaatgaattgtccagggcctacgctgccaaaaagattgatatctatgagtttcgtgacgatttagtccacattgatgacttggtagcaactttcccgctttggttacagaccttgggcgccgggctagtgagcggcactttggtcgtggtgtttcaaaacaatctgccggatttttggatcacgtttattgtcggcatgttcggctgggcagtttactattttttgaatatttatattcaaatacggttcttaagtgagttcctggccgcggttgtcgtgggtgcactagctctgatcgctgtgaaaaatgggatcggcgtcaaagccgatgatattatcattggcgggatgatgccactggtgccgggaattcccttgaccaacgcggttcgagatgcgttgtccggcaacttaattagtggcccggcacgggggattgaagccctgattagtgcctgtgcgcttgggtttggtgtagcaatcgcgctgcacttcttttgagggatgcttatgaatctgtttattattaaatgtatttgtgtttacttttcaggcattggctttggcctaatcgtcaacctgccacaccgggctttgaatgtcgccgggatcaccgccactttgagttggctggtgtactatggcgtcatgaatacctggggtggcttaggatctgctaatttttttggcggcttgacgattggtttggtgtccgtggtgattgcccacctcaaaaaaatgccgagtatcttatttgacgtccccggcttggtgccattggtgcctgggggtcaggcgtataacacgattaaaaactttgcattaggtgattatcaggtggcctttaattatctttcagaggtcgtctggattgccggatcgattgccttggggtttatcgtggccgagttgattaacaaaattcgaattaagattaaatatgtgtctaaaggatgggataaataacccatctttttttctgccataaattgtttgacattcctggttagaggcgtattatttgtcttggataatattatgccgcgtataatactatggaggtggcaatatggcgatccaaataagttcggaattattagatggatgtgtgctgggaatcctgaatggtcaggattattacggctatgcgttaacccagaaggtccaagagtcgatttctgtttcggagtcgacgatgtacccggttttaagacggttgaagaagaacgatctgttgacgacttatgatgagccatatcagggtcgcaaccgacggtattataaaatcacgccggaaggaaaacgacagtttggcattattcagcaggagtggcaggaatttaagcaagggattgataacatgttaggagatgatcagaatgaatgattacattgaagagtttcaggcactgctgggacaattgagtcctgaagagcgggatgaagcagtcgatttctaccgtgaatatcttcaagacggcggctatgcgagttacgacgattgcatcagggagttgggaacgcctcatcaattggcccggaaggtgttggcagattattccattcggacactggacgcgccgatgtctcagcagtctcgacagcagccgaaaaatgatgttaaaaccatttggctgattatcttagcgttgctttcgactccagtgacaattccgctggcacttgcgcttgcaggggtgatttttgccggtatcgcagtttccggttcactgattattgccgttttggcgatcttctttgcggtggtcgtggttggtattaccgggtttgtcgtcggattgggcaccctgtttagttcgttttggacgggcattttctatttgggaatgggtctgatggtcattggggtcatgattatgctggtgccggtcttcaaagccgtcgtcaacggcctgattcgtggtatcacgttattttcgaaatggatttataacaagattgtcccgaagaaccgggctgaacgaaaaggaaagggtgaccaaaaatgaaaaaaactgtcatcgtgggattaactgtgaccctggttggaactgttctgttggtgctcggcctgggcaatggtggtgcccgcacggtctattgggatcacgggttcacaactgatcaatccacgccggttaagtcacaccaaaccagtgccaaattttccggcgtgaaaaacttttctttgtcaacggccagtccggtgcaaattaagaagggtaacgtttctaaaatcgaggtgacttatccaagtgctaccaagatcacgcaatcaggcaatacccttcatttcaatttgaaaagtccacgtaagcaccatggtatcatcttctttggtgactttcgccgagcacgccaggcctttggcaagaccatcatcaccgttccaaaaagcatgaaggtcggtacgatcaacagtgacattgccaactcaattaccatcaaaaatatgaccatcaagacgatcacttcgtctggggtcggcgatgttaatttgaatcacgtgacgaccactgaaaacttggacttggagaataccggtgatgtaaatttatcgaccagcacttttcccagcgcccatcttgatgttggtgccggcgatgtcgatctgacgtccaataaatttgactcaatgtccgttgaaaccggtgccggggatattaattttaattcccaaaaggtcggcaagtcttttaccgcccacagcgacgttggcgatatttcaggacatgtggttaagaacaagcgaacgcagatttcagtgagtgccgatgttggcgatgcatcattgtttggcagctcacacaacaagaagattgacagcaatgccaaaaatccggtgacttacagatttaccagcgacgttggcgatgtcacgattcaccagagttaaaaatgttactcaacgcaaaagaggcgccggcaaagggaatgttcccttgccagcgcctcttgatcgttaattgattatcttaaaatcccaaacacaaaactaattcctaaaatcaccagcacaattgtggtgatccaaacgtacaagctgtcaccttcgcgatagaaggaataaattgagacgaccactcgcaatactggtgtcaaaatcaataggaaaattcccagcatcatgatggcgtatggcttgagttcagcaattcccgcccaaatttgggtaaagtcggtgggaaaggcgttgtgaggatagccgccgttacctttgacaatcaaaagcaccaaaccaatgatcatcacggttgcagaaattatgacccctagccgaagaatcttgccgataatcaattggacgtcggccatttcttcagtcatttgttctttggtatttttgtccatcttatctgatccccttcataaacatttcgatgccgatataaaacaggatcggaacgaaaatcatccgaatcgtccgtgctgacatatcccgcatgattcgtgacccaccgcgggcaccgaccaagattcccagtgccaaaggaacggcgatcattggtttgatcgagccgttgaagaaatagaccgttgcactggcagctgcggtaacgcccatcatcaaattactggtggaagtcgatggcttgagcggcatcttcatgaccgtgtccattgccatgactttgaaagcacccgagccgattccaagtaacccactggcaatgccggcaccgtacatgactgccaagccgccgggaatgtgttcaacctggtagttgatcgttttgccttcaacattatcgaagtagctgctgtccagcttgaatttggacgataattgatcgggatgagcccgatgaaggacttcctggtgactgattaatttgcgaatcatattgtagcctgagaataatagcaataatccaaatagtatgtacaaatatttcggatcaatcacaccggtcaacaaggcgccgctcaatgcccctaaagtggtggcaatttccaaaaacatcgcgacccgcaaattgagcactttgtcacggagataggcaattgtcgctccggaactggtggcaatcacggcaatgatactggcaccgattgcgtatttaatgtcgacacccatcaacaatgtcaaaatcggcgttaagatgattccaccacccaggccgaggatggcaccggcgaacccggcgaacacgccaatggcaatcatcaataaagcatagtttatcaagtctttcactcctttaaaatgtgatctctaactcacaagattatacactttctgtaaataattaaaagatagctaagaattttcagaaaccagaaaccgggttttcgatttgtgatatactcatttttgagtaatacatacgagagggttgttgaactaatgtacggaaacgaagattacatgctgatggaacgcgatccaaaccggttggtcaagctgattgtgagtttgtgttttacgaccttgctgtcaatttcggtagcgtttaattttgattatttgcaatttttagattcaatttttacaacggccattcaaggatccgcgccgacaccgggactggaacatttctattcagtaatcacatttctggccagcccgaaaatggacattttctgggtgttcatcatcgcctttttcctttggggatttaagtacaaagttcccgcactttgggcattagggacgatagtcggcggcgacgtgattggcgcagtcgtcaaacaactggttagacggcatcgaccgccgctgcatctgggtgtcgacaacggctacagttttccaagcggccacgtcctgggatttttcctggtcgccggggtgttatggatcatcgtcctgccgttgattgagcgggcatccattcgagtggtgatcaaagtactgctcgtcatcgtcttggcgctggtgatgctttccagggtctacttgaacgcccattacccaaccgatacggtgggagcctgcctggttggctattcctggctgttggtagctgaaatgctttatgccagttacgcgccccgagttgcccgctaccggtttgtggttcacactaaaatctgattgaaaatgccgaggatttttcctgggcatttttttgaaaggagatcgccatggatttaccgattgagaccaaccgacttcaactgactgaattaactctggccgacttaacggcttacgaaaaattaatcagcattccagaaattgccgccggcgccggttttaatctggtcagtaatcaacaaatgctgggggcagtggccaaaagacagattgcgacgcctaactcctttggcatccggatccacgatcgactgatcggggcaatcctcttatatgaacaagttggttttgatcaccaacccgatcctgccaatctggaactgagttattttcttcacccagacctgtggcatcaagggatcatgtctgaagcccttactaaattaattgaggaactcgctgttaacccaacgattgagacgttgaatgcagaggtgttcagcgataatcaagcctctaagggcgtcttaaagaaggtcgggtttcaagtgaagacaacattgattgatccgctggtgggcaaagaaaagaccatttatcagctggctttgcagtgagaaaagtcgttctggtttgtcaattcaacccaagtgagttacaattttgattgtcgaagttattaacaactaaattaatcaatctaatcgagtagaggcgcattcatcaagagtatatttcaggaacttgaaggaagttatgactgaagtaaaaagggatgagtgccgaaacgatcagctgccttccagctggttgttggggcccagtttaagaagctggggactgtcgcgaaaatcgcggagagctatcaagatgttgagaaacgcaaactgtctctttcaatattttgaaagggatttttttgtagatttagtgagattttgaaattattggatataggagacgaaaagatgaacgataatgagagccaagaagccaacggacaagtcaagcggggcctaaaagcccgtcacgtgtcaatgattgctttgggcggctgtattggaaccgggctgttcgtggccagtggttcagctatcagccaagccggccctggtggtgctttaacggcatacgtcctgatggggatgatggtctatttcctgatgaccagtctgggagaaatggccactaatatgccgatttccggctcgtttgccgcatactcatccaaatacgttgatccggccttaggatttgccatgggctggaattactggtttaactgggcgattacggtggctgttgatattagtaccgccgctttggttatgaaattctggctgccaaatgtgcctgcctggatttggagtgcaattgccttagtgattattttcctgattaatgccatgtcagtcagtaccttcggtgaaaccgagttctggatgtccgccattaaagtggtcacgattattattttcctggtagtgggtgccttgacgatctttggaatcatgggcggccattttgtcggcatgcgtaacttttctattaagcaggcaccatttgtcggcggttttccggcaattctgagtgtcttcgtggtcgccgggttctcatttcaaggaactgagctggttggcatcactgccggcgagtcccaagatccccaacacagtgtcccaaaggcaattaatgaagtgttctggcggattattttgttctacattttgacaattttcgtcatcgccgccattattccttacaccagccattcactgctgggatcaagtgccactgacattgcgatcagtccatttacattggttttccagcgggctggtttggccgctgctgccagtgtcatgaacgccgttattttgacctccgttatttcatcggcgaactccggtatgtacgcctctacccggatgctgtattcactgtctaacagcggatatgcgccaaaatccctgggtaaaacggctgccaatgggattccatattattcattattggcaacgacttttgtttcgctattgacctttatttccagtattgccgggccccaaatctatatgtggctggtggcagcttccgggttaaccggctttattgcctggtttggaatcgccatttcacattaccgattcagacgggcgttcattcgccagggccatgacctcagcgaactcaagtatcatgccaagctcttcccgttcggtcctgtactgtgcctgattctgtgtattctggtgattgtcggtcaaaatccacaggcctttgcaagctttgactggaagcagattctggtcacttacattagcgtgccgctggtattgattttgtacttttggtataagctcaagcaccatacgaaaatcattccgctggatcaggttgacgtttccccggcccataaagacgaggatctttcaaaattgaacaacaagtaatatattaattataaattggtctatccgtcttggatgggccaatttttattattttatcagcctaaaacttgatatttgggcataatgtttggtacaattttaccaattggtatattaaaaatatgaggtgaaagatatatgaaaaagtttatgtcaaaaggtaaatttgaaagaatgaacaaattgtccaatgatcagaacattatcgatgcattggcgttagaccaacgtggatcgctggttaaggggatgaaaacggcctccgaaaaatacggaaagcttttcagtatgaagatggtctatgatttcaaggagattgtctctgaaatcctgagtccactgagttctgccgtgcttttggacgagcaaatgggtttcaaggggatccaggccaaggctaaagacaccggtctgattatgtcttatgaaaagaccggatacgatgccgacaccccgggacgattaccaagcttgattcctgatcaatcagctcaaattatggttgagaagggagcagatgccctcaaagtgttggtttactacaatcctaacgaccctgatgaaatcaatgacgtcaaaaaagcgttcgctgaacgatacgggacggaaggtttggcagctcagacgccgaccttctttgaaattgtcacttacgacgaccgttacgatagcaagtcgttggattttgccaagatcaagcctgatctggtgttgcagtcaatgatggaattcaccaaggagaaatatcacattgacgttttgaagatggaaattccatttaacccgacctacgtcaaagaatgggctgatggtggcgattacgcctacaccgaagaccaagccaaaggctatctcaaagagttgagcgacgaggcgacccgaccatttattttcttgagtgccggagtgccgacccctgttttccaacgggaattgaagctggctggagatgccggtgccaagtttaacggtgtcttaagcggtcgggcaacttggttggaaggtgtcgacatttacattcgtgacggtaaagacggcctggttgactggctcaaacgcaagggaaccagaaacgtcactgaattaacccagatcttgtctgagaatgccacaccgtggtttgaagcgtacggtggtttggacaacatccaagtggttgacgtctcaaacattaactaaatttccacaatatgttgcacctatctcttctaactagtacaatatgtagcgttgataaaatattgtgcgatgattgcacgcaaaaacgttaggggaataattatgcttgtacttgctggaacgattggtgccggaaagacatcactgaccaagatgctgtcacaacatttgggcacacccgcctattatgaatcagttgaacacaaccgcattctgccgttgttttataaggatcccaagaagtatgccttcttgctccagattgattttttaaatcgtcgaatggatgacatcaaaaaagcttggcaaaatgatgagagtgtgttggatcggtcaatttttgaggattcactactcttccatttgaatgccgacttgggccgggccaccgaaactgaggtgacgatttacgactcattgctggagaacatgatgcaggagatgccacaaaccgatcacagcaagaaccccgatttattgatccacattaacatctcgtttgaaacgatgttaagaaggattcaaaagcgcggccgttcctatgagcagattgataatgatcccgatttgtaccaatactataaagatttgaatgcccgctaccagacgtggtaccaagaatatgacaaatcacctaagattcaaattgacggtgacaagtatgattttgttgaaaatgatgctgataagcacaaggtgatcgatctaatcgacgccaaagtggataagttggcaatttaatttcagaccgctcttgtggtttagggattgattcgttataatcgatttcagataaaacgttttgtgcctattaagtagatttcagagagacagtggttggtgtgaactgtcatcgaatattccagcacaagtgaacgggcaggtaatgctgcacggtgtatgccgttaccatactttgagagcttggcaagattgtcgagaacttgggtggtaccgcgaaaaggatccttcgtcccatagacgaggggtcctttttgtatacagattgggaggatttgaaatgttagatattaagaaaatcagaaaagatccagattttaccaaagaaaagctcgctacgcggggaatcaagcccgaaaccattgatgaattagtgggctacgatgccaaacgtcgggatctgatcgttgaatcagagtcacttaaagcaaaacggaacgccgtttctgaccagatttcacaaaagaagcgcaataaagaggatgcaacagaggccatcaaccaaatgaaacaggtgggccaacggattaaggaacttgacgagcaattgcggcaagttgaggaagatgaacacaatttggctgcccatctaccaaatattccacatgatgatgtcccggtgtcactcacagaagaaggatccgttgagcttcgtaagattgggcagatcccgtcatttgattttgaaccaaaacaccattgggaaatcggtgaaaatcttggcattcttgactttgaacgggctgccaaagtgtccggcagccgatttgtttactatattggcgacggggctttattggagcgggccgtttacaacttctacctcgaccaaaataccgctgccggttataccgaagtaattccaccttacatggttaataacgattcaatgtatggcaccgggcaatttccaaaatttttggagaacaaatccggctatgagattcaggacagtgatttaaccctgattccaactgccgaagttccattggttaactattatcgcaatgaagttattccgacagaaaagctgccggtatcggttacggccttgtcgccagcattccgatcggaagcaggaagtgcgggccgtgataccaaggggctgattcgattacaccaatttaacaaggttgaaatggtgaaatttaccaagcccgaagactcgtggaaggcactggaagagattacccaccaagcagaagttaacctgcaaaaacttgggttggcttaccacgttattacattgacgaccagtgatatgagtttcacagccgctatgacacacgacctggaagtttggttcccagcccaggataagtaccgggaaatctccagctgttcaaactgtacagacttccaagcacgccgagcacacatccagtatcgggatgatgaagggaaacttcactttgttcatactttaaatggttctggactggcagtcggcagaacggtggccgccattctggaaaattaccagaatgaagatggcactgtcacgatcccagaagtattacggccatatatgcacggcatgactaaaattgaaaagcaaaactagtttttgaatgaaatcattcccactgcatgatgaattttgaatgtgggtgtgatcatcgtaccaggagcaaggcgaaggacggctgactgtccttcgcctttttatttgtcgcgaataaaaatgcaattaattcaaaattggactagcaatgttttccgagataggatataatattttttgtcggaaaaagacgttattaactaacggctaaccaatcaggattttttaaaattcatcttgacttgagttgattggtattgtaaaatttaatagttgtgttgatgatgttgctaccaacatttgattcatttagtttcatggaggattagctcagctgggagagcatctgccttacaagcaggaggtcacaggttcgatccctgtatcctccattgagccgttagctcagttggtagagcatctgacttttaatcagagggtcggcagttcgagactgccacggctcattgccagtttttaacaatgcgggcgtggcggaactggcagacgcgctagatttaggttctagtgtcttatgacgtgggggttcgaatcccttcgcccgcataggtgctagttacctaacaatttatacattttgccgacttagctcagttggttagagcgcttcactagtaatgaagaggtcgggcgttcgaatcgtctagtcggcattttgcggaagtagttcagtggtagaacatcaccttgccatggtgggggtcgcgggttcgaatcccgtcttccgcttcaatcaagtactatgattgaggttccttaatttaatacttattatgcacccatagcgcaattggatagagtgtctgactacgaatcagaaggttgtaggttcgactcctactgggtgcattttttattgcaatgaattccttttcgggaagtagctcagcttggtagagcacctggtttgggaccagggggtcgcaggttcgaatcctgtcttcccgactttgtttaacatagatcatatggtatatttatattgttaactcaatagtacttaaatcatcgggaagtagctcagcttggtagagcactacgttcgggacgtaggggtcgcaagttcaaatcttgttttcccgatttttttgtgggaaattacatattaattgaatcgtgtttgaggtcagaactgtactttgggtctggcctttttttgacatctcggcgaacggcaatcccggttgctggtgttgatgttttaatcctttttgccaccatgaatggattatttcgaaagtctctctgcatcggaggggcatagtgttaggtgcacggtcgttctgctgctttccgctttatctcacttcgaaaatacgcttcgacaccccagagtcctactgcataagtgaagagatccggattataaacgtgctccgatgcccttgacccctaccacacaaagcggaaacatcaacgatgaacaaggttcgttcaccattgatgtttcctctagggcatgttcgttttgcttctttctgctttatcccgcttcgaaaatacgctccgacaccccagagtcctactgcataagtgaagagattcaaagatgaacaaggaccgttcatccttgaatctcttcacttatgctccggactctaaccggggttcgtcgcgctctcaaacactttccttgcactttgccgtcacattcgtataataatagtcaatattagtcaaagaattgggtgattacatggcggacgaaaacatttctgatttaattgaacattatctcaaagaaatccttgccgagaacgagcaggttaaaattcgtcgttctgaaattgctgggctgtttgacgttgtaccgtctcagattaactatgtaatcaacacgcgtttcacgatccagaatggttatattgtggaaagtaaacgtggtggcggcggctacattagaatagaaaaagttcatttattagatgacattgacgttttgaattcattaattgccgcaattggtaacaaattatcgaagcgggatagtgaaacgatcgttcaaacgttatataataatgaattaattaatcgtcgcgaggtgagcatcatattagctgcgattgacaaagatgcaattgacctgaataacagcgatttaaccgacattttacgtgccaacatcatggtgtcgatattgaaccggctgcgatacgaacgatagaaagagagggtatctatgaataatttatttactccgagtgctaagaacgttttgaccattgcacaagaacaagccaagaaattcaagcaccaagcaattggaactgaacatcttctattaggcttactgatcgaaacgaatggaattgcctacaaggcgcttcagcagttttcagtaactgccgaagatgtcactgaagaagtagagcgtttcgccggctatggcaaccttaaggaccttagcagtaacgattatctaccatactctccaaaggcaaaggaagttttggctcaagcaggagaattcgccaagaagaacggtgttccaaaggttggaaccgagcacattttgctttcacttctgactgatgagaccattttatcttcccgtattctgattaacttgggactcgatctatcacaaattagaaaagtaacccttcgaaaaatgggcatcagtggtggctcaatggcctcaaacctggcttccaaacaacgtggccgtcaacaaaagccagctgactcaaagacaccaacaattgattcattggctcgtgacctcactgaaatggcccgtcaagaccgtcttgacccaaccgtcggcagggatctcgaagttaaacgtgtggttcaaattttagctcgtcggacgaagaacaaccctgttttaattggcgaacccggtgttggaaaaaccgccatcgctgaaggcttggcagaacggattgtcagcggcgacgttcctggtgacatgtccaagaagcgtctgatgatgcttgacatgggctcactggttgccggtaccaaataccgtggtgaatttgaagaccgactcaagaaagtgattgatgaaatttaccaagatggcaacattattctgttcatcgatgaattacacactttgatcggtgccggtggtgcagaaggtgcgattgacgcttccaacattttgaagccggcattggcccggggtgaactccaattaattggtgccacaactttggacgagtaccaaaagtacattgaatccgatgctgcattggagcgtcgatttgccaaagttatggttgatgagccaacgactgatgaaacggtggaaattctcaaaggcttacggccaaaatacgagcaacatcaccacgttgaaattactgatgacgccattgaaactgcagttaacctttccaaccgctacatcagcgaccgattcttacctgataaggcgatcgatttaatggatgaggcagctgccaaagttcgaattgatcaccttcaaaaatctgatgccgttgatgatcataagaaactctcagatttgttatcagaattaaatgaagccttggtagcccaggattacgaaaaagctgctaagattcgcaaacaaaccaatcagttacaggatgaacttgctcaagataatgattccgaggaaggctcagaggatgcacattaccccgtcaaagagacgccacaagacgttgctgaaatcgtgggcgagtggactgggattccggttactcgtttgagcagtaccgaagctgaccgcttagtcaacttggaaaagattcttcacaagcgggttgttggtcaggaagaggcaatttcagcggtttctcgttcaattcgtcgggctcgaagcggtttgaaagatccgaaccgtccaattggttccttcatgttcctagggccgaccggtgttggtaaaaccgagttggcaaaggcagttgccgaggcagtctttggttctgaagaagacatgattcgagttgacatgagtgaatttatggagaaatattcaaccagtcgtctgattggttctgctcccggctacgttggctacgatgaaggtggtcagttaaccgaaaaggttcgtcaaaagccatactcagttgtgctttttgatgaagttgaaaaggctcatccagatgtcttcaacctcttacttcaagttcttgatgatggttacttgacggatgccaagggtcgaaagattgatttcagaaacacggttatcatcatgacttccaacctgggtgcaaccacattgcgggataagaagaccgttggatttggtcaagaggatgccaaggaaggctatgcagcaatgaaggacacgattcaagctgccctcaagcaacgcttccgtcctgaattcctgaaccgaattgatgaagtggttgtcttccactcattgaccaaggacgaacttgatcaaattgtttacctgatggccaaaccggttatcaagcggattcacgatcaaggcattgacattaagattaccaagactgcaatcgggattatttccaagcgtggttttgaccctgagtacggtgctcgtccaatcagaagagcaattcaaactgaactcgaggataatttgagtgccaagttgcttgccaaggaaattgtccccggcgactcagtcactgttggcggtagaaacaaccagattaccatttcagtgaagaagccggaacgcaaaactttagtgaatgataaaaaataaattgcgattcaaactgaaccatggtctaaaaggttgactttacttctataaattgttattcttttaactgtatttgttgtgaatcgaaatggtcgacgcgatctattgtccgggttggcctgcataaaaagccaaaagcaagaaagtcttgtttttggattttttttgcccaaaacccggtcagatgtgctaaaaagtgcatttgtaatcaaactgtaacatttcgattccggaattttttggagaggtgaaaaacttggcaggacatttagttaaatatggaaaacaccgtacccgacgaagttatgcacgaattaaagaagtgcttgatttaccgaacctgattgaaatccagactaattcttacaactggtttttacatgagggacttaaggaaaccttcgatggcattatgccaatcgatgactttcagggcaagctttctttagagtttgtcgattatcaattattaacaccaaagtacaccgttgatgaggcgcgtgaacacgaagcaaactattctgctccacttcacattaccttaaaattaaccaatcatgagactggcgaaattaagacgcacgatgtattttttggcgattttccattaatgactgatcaaggaacatttattattaatggtgctgaacgagtaattgtttcacaattggttcgttcacccggcgtttattaccatgctgataaagataagaatggccgtgattcatttggtactactgttattcctaacagaggtgcttggcttgaatttgaaaccgatgcaaaaaatatcgcgtacgttcgaattgatcgaacacgaaaaattcctttaacagaattaattagagccctcggctttggcagtgattcagaaatcattgacatcttgggcgacaacgacagtttaggtttgaccttggaaaaagatgttcataaagacactgacgattcacgtgttgaagagtcactgaaggatatttacgaacgtctacgtccaggtgagcctaagactgctgattcatcaagaagcttgctgactgctcgtttctttgatccaaagcgttatgacatggcacctgttggccgttacaagaccaacaagaagctgagtttgaagaaccgtctgttaggtttgacattggctgaaacccttgctgatcctgacacaggtgaagtgattgctcaaaagggcaccgttgtcacgaaagatgttatgaaggacttggcaccattccttgataacgatgaatttaaagcttacacctttaccccttcagatgaagccgttgtgactgaaccaatgactgttcaaatcattaaagttcaatcagttaacgatcctgaccgagtggttcctttaattggtaatgacaacattccattgagctttaagcacattactccagctgacatcatttcagcaatgaactacttctttaaccttcaagaaggtattggttcaattgatgatattgatcacttgggtaaccgtcgaattcgctcagtcggtgaattgctgcagaaccagttccgaattggcttgtcacggatggaacgagttgttcgtgaaagaatgtcaattcaggatacttcaactgtgacaccacaacaattgatcaatattcgtccagttgttgcctcaatcaaagaattctttggttcatcacagctttctcaattcatggaccagaccaacccgcttggtgaattaactcataagcgtcgtttgtctgcccttggacctggtggtttgactcgtgaccgtgccggatatgaagtccgggatgttcactatacccactatggccggatgtgtccgattgaaacccctgaaggccctaacattggattgattaacagtttgtccagttacgcccgggttaacaagtatggtttcattgaaacaccataccggcgtgttgattggaccactcataaggttactgatcgaattgattatttgactgctgacgaagaagataactttgttattgcccaggccaactcaccattgaatgatgatggttcgtttgtcaataacatcgttatggcccgtcacaagtcaaacaacattgaaattggtatcgacaaggtcgattacatggatgtttcgcctaagcaagtagttgccgtggccactgcatgtattcctttcttggaaaacgatgactctaaccgtgctttgatgggtgccaacatgcagcgtcaggccgttcctttgatcgatcctcatgcaccacttgttggtactggtatcgaatacaaggctgctcatgattctggtgttgccctgatctgtaagaatgaaggaactgttgaatacgttgatgctcgtgaaattcgagtacgtcgtgacgacaagtcccttgataaatacaaattaatgaaattccgtcgttcaaatggcggtaagaactacaaccaacgtccaatcgttaaggttggcgaccgagttgatgctgatgaaatcttagctgatggcccatcaatggaaggcggagagttggcacttggccaaaaccctgttgttgcatttatgacttggcaaggatacaacttcgaagatgccattgcgatcagcgaacgtctggttaaagatgatgtttacacttcaattcatattgaagagtacgaatcagaaactcgtgacaccaaattaggacctgaggaaatgactcgagaaattcctaacgttggtgaagatgctttgaagaaccttgacgaggacgggacagttcggattggtgccgaagttcatgatggtgacatcttggttggtaaagtgacccctaaaggtgtgactgaattatcagctgaggaacgtttgcttcatgcaatctttggtgagaaatcacgagaagttcgtgatacttcattgagagttcctcatggtggcggcggaatcatccaggatgttaagatcttcactcgtgaaaacggggatgaactttcacctggtgttaataagatggttcgtgtctacatcgctcaaaaacgtaagattcaagttggtgacaagatgtccggccgtcacggtaacaagggtactgtttctgttgttattccagaagaagatatgccattcttgcctgatggaacaccagttgacatcatgttgagtcccatgggtgtgccatcacggatgaacattggacaagttttggaactccatttgggaatggctgcccgcagactcggaattcacgttgcaacacctgtttttgatggtgctcgtgataaagatatctgggatgcagttaaagaagccggcatgccttcagatggtaagtacatcttgtacgatggccgaactggtgagccattcgataagaagattgccgttggtgtcatgcattatcttaagttggcccacatggttgacgataagatccatgcacgttcaattggaccttactcattggttacgcaacaaccacttggtggtaaagcacaatttggtggtcagcgttttggtgaaatggaagtttgggcacttgaagcttatggtgccgcatatactctccaagaaattttgacttataaatcagatgacgttgttggccgtgtcaagacctacgaagccattgtgaagggtgagccaattccaaagcctggtgtacctgaatcattccgggttcttgttaaggaactgcagtcattaggccttgatatgaaggttctcgatgcgagtcataaagagattgaacttcgtgatcttgatgacgatgacgacgttgtgaacgttgacgcattgagcaaattggctgacaagaagaaagagcaggaagatcatgcagctaaacaacctgccgatcaagttgaaacaccaagtaaatcaaccaacgttaacaacagtaatgactagaaatgggaggtcaaactagtggtcgatgttaataaattcgaaagtatgcagattggactagcctctcctgataagattcgtagttggtcatatggtgaagttaaaaagccagaaaccattaactaccgaactttaaaaccagaaaaagatggtttgtttgatgaacggattttcggtcctaccaaagactgggaatgtgcttgtggtaagtacaagcggatccgttataagggaatcgtttgtgaccgttgtggagttgaagttacccgttcaaaggttcgtcgtgaacggatgggccatattgaactggcagctccagttactcacatctggtacttcaaaggaatcccaagtcgaatgggtcttgtcttggacatgagccctcgtgcacttgaagaaatcatttacttcgcttcatacgttgttaccgaaccaggtaacacaccaatggaaaagaagcagttgctttcagaacgtgaataccgcgaaaagaagcaggaatatggtcctcggttctcagctcaaattggtgccgaagccatcaagacactgcttgaagatgtggatgttgaaaaagaagttaccgaattaaaagatgaattgaagaatgcaaccggtcaaaagcggacccgtgccgttcgtcgactcgatattttggaagctttcgtccaatccggaaatgaactttcatggatggtaatggatgcaatcccagttatcccacctgacttacgaccaatggttcaacttgaaggtggccgtttcgccacttctgatttgaatgatttgtaccgtcgggtaattaaccgtaataatcgtttgaaacgattgctggacctgaacgcacctggaattatcgttcaaaacgaaaaacggatgcttcaagaagccgttgatgctttgattgataacggtcgtcgtggccgtccagttgccggaccaggtaaccgcccattgaagtcactttctcacatgcttaaaggtaagcagggacgattccgtcagaacttgcttggtaagcgtgttgattattctggccgttccgttatcgatgttggccctcatttgaagatgaaccaaatgggattaccagttccaatggcaatggaattattcaagccatttattatgaaggaattggttggtcgcaatttggcatccaacattaagaacgccaagcgcaaaattgaacgccaagatgacgatgttttcagtgtcttggaagatgttatcaaggaacacccagttctgttgaaccgggcccctacacttcaccgtttgggaattcaagcttttgaacccgtactggtaagtggtaagtcgatgcgtcttcatccattggtttgtgaagcctacaatgccgattttgatggtgaccaaatggctatccatgttccgttgtctgatgaagcccaagctgaatcacgtttgctgatgctagctgccggccatattctggcacctaaggatgggaagccagttgttaccccatctcaagatatggttatcggtaactattacctgaccatggaggaagccggccgcgaaggtgagggaatgatctttaactcacctgatgaagcacaattggcatttaagaatggaatcgttcactggcacacacgtgttggaatcaaggcttccgcatatccaaagaagacctttacaaaggatcaacttggaaaaattttggtaacctccgttggtaagattgtcttcaatgagattttgccagaagattttccattcattaacgaaccttcagaaaccaatttgaacggttatgttgatgacaaattcttccttgaaccaggtgaggacattcatgagcatctgaagaatgccaaattaatcctgccattcaagaaaggcttcttaagtgatatcattgccgaagtttacaagatctacaaagtgactgaaacttcattcttgttggatagaatgaaggatctgggttacaacgagtcaaccaagtctggtttgaccgttggaattaccgacatcacacagttgcctgataagcaagaaattatcgacggcgcccataaaaaggtagatatggttaccaagcagttccgtcgtggtttgattaccgaccatgaacgttatgaacgagttattggtatttggaatgatgccaaggatgacattcaaaagcgtctgttggaaaaccaagatccacagaaccctatctttatgatgagtgattccggtgctcgtggtaacatttcaaactttactcagttggcaggtatgcgtggcttgatggctgctcctaacggtgaaatcatggaattaccaattacttccaacttccgtgagggtctgactgttttggaaatgttcatttcaacccatggggctcgtaaaggaatgaccgatactgcccttaagactgccaactcaggttacttgacccgtcgtttggttgatgttgctcaagatgtcatcgttcgtgaaaaggactgtgggaccgatcgtggcctgactatcagtgcaattactgaaggtaacgaaatgatcgaaccattgtatgatcgaattgttggccgttatgctcacaaaaccgttaagaaccctaagactggcgatgtgattgttcctgcaaacaccatgatcactgaggatcaggctactaagattgatgaccttggaatcaaagaagtaacgattcgttcagcattcacttgcaacaccattcatggtgtttgtgagaaatgttatggtcgtaacatggctactggtgatgaggttgaagttggtgaagcagttggtactgttgctgctcaatcaatcggtgaacctggtacccagttgacaatgcgtaacttccatactggtggtgttgctggtaacgccgatattacccaaggacttcctcgtgttcaagaaatctttgaagcacgtaatccaaaaggtaaagctgagatcagtgaagttactggtacagttgagtcaattgaagaaaatcctgctgaaagaacaaaagaaattaccattaaaggtgaatctgatactcgaacttacaccgttccgatcacagctcgaatgagagtcgctgaaggtgactacattcaccgtggttcagctctcaatgaaggttctgttgatcctaaggaattgttgaaggttagagatgttctctcaactgaaaactacctgcttcatgaagttcaaaaagtttaccggatgcaaggtgtggaagtggctgataagcatgtggaaatcatgattcgtcagatgcttcgtaaggttcgtatcatggatcctggtgacactgatgtattgcctggtactttgatggatatcaatgacttcaagataagtaacggtgacacggttgttaatggtggaattccggcaactgcccgtcctgtcttacttggtattaccaaggctgctcttgaaacaaatagtttcttgtcagccgcatcattccaggaaaccacgcgtgttcttactgatgccgcaattcgtggtaagaatgatccactggttggtttgaaggaaaatgttatcattggtaaattaatccctgcaggtactggaatgccagattaccggggaattaagcctgaagaaattggtagttcatcaactgatggtgtttactcaattagccagcttgaagaaaaaatgaaagctgaagatgctaacaagagcaagacgaccaaataatcattaaattgaatgaatcaatttgaaaaaggatttcaacctgcaatgggttggaatcctttttttatttgctatgaaattaacggtaataagattgattggaattggtgggttaaataaaatccgatggtgatgaatggcacaaatggaattttggaatcttttggccacggcgcaacaattaaataaagcagcgcagcgacgcaagcaataaacgtttgccaaagtaagcttggaatatccagtgccagccacaggcaaaaataaatgtcgatgtcgccactgcccatccaggaaaagtggtggtttaaaaattggatgagcagatagatcagaatggcaatcaaaatttcttggactggatgggtgtttgataatccgcagacaagcaacagcatgataattccgtctgttggaattgtttggtcgacaatgtcaaaggaactgagtgcgattaaaataatcaacatgccaacgtacagacaatttatctcaaaaagattcaaactcgcagcaacagatccggccgccaactcaacagtgaacaaatttgctgaaaacttttgtttgcagtaacgacattttcccattaaaatgatgtaactgaagacaggaattaaatcaaaattcttcagctgaccaccacaacgatcacaatgggagcggggagcgacaatcgattccccgcgttgtcgtctaacagcaaccaaattaaaaaacgacgccaggcttgcacccagcaaaaattgaataatgatcatcataatttttacctctgtactttatgtacgttgttacgatttaaattattcaacatgattcattgacacaaacggccagtcatgataaattagacaaggtgctttttgtgacagattcctgaatattcagacatgctgactgtatatgacaaaaagtgttgggcggtacacatttctttttacataaaaaagaaccgcctggatgtgtggacttacattgaaaatttgaaaggagaactttttagatgcctacaattaaccaattggtccgtaaaggacgtcattctagaacttcaaaatcaaagtcaccagctttaaactatgcttacaatagtttaaagaagaagcaagttactgttccagcccctcaaaaacgaggtgttgcaactcgtgttggtactatgacaccaaagaagcctaactcagctttacgtaaatatgcccgtgttcgtttgtctaacttaattgaagttacggcttacattccaggtattggtcataacttacaagagcatagtgttgttttgatccgtggtggccgtgttaaggatttacctggtgttcgttatcacgttattcgtggtgcacttgataccgctggtgttcaagaccgtcgtcaaggtcgttcaaaatacggtacaaagaagcctaaagaataatcttactaatgcaatctaaatatttagtttatagaatcatgaggaggataacgaaatgcctagaaaaggaaatgttcaaaagcgggaagtacttcctgacccaatttataactcaaaattggtaacccgtttaattaaccgtttgatgttagacggtaaacgtggaactgcatcacaaattttatatggtgcatttgatttaattaagaaagaaactaacaacgaaccagttgacgtctttgaagaagctatgaagaacgttatgccggtccttgaagttaaggctcgtcgtgttggtggttctaactaccaagttccaatcgaagttcgaccagatcgtcgaacaactttgggattgcgttggatcgttaactatgcccgttcacgtggtgagcatacgatgactgaacgccttgcgcgtgagatcatggatgccgctaataacaccggtgcatcagttaagaagcgtgaagatacacatagaatggctgaagccaaccgtgcctttgcacattatcgttggtaatctcaggatttttctaaacagctcaaactaataagtggctgatttagccactttttgtacgaatcggaaggagttacacaatggctaacaaacgagagtttccgctcgaaaaaactcgtaatatcggaattatggcccatatcgatgctggtaaaacgaccacgaccgaacggatcctgtactatactggtaagattcataaaattggtgaaacccatgatggtgcttcacaaatggactggatgccacaggaacaggaacgtgggattaccatcacgtcagctgccacaactgctcaatggaaagaccaccgtatcaacattattgataccccaggacacgtggactttactgttgaagttgagcgttcattgcgtgtcttagatggtgctatcgctgttttggatgcccaagcgggtgttgagcctcaaactgaaactgtttggcgtcaagcatctgattatgacgttccccggatcgtctttgttaacaagatggataaagttggtgccaactttgatttctcagttggctcaattgaagaccgtttgaacgctaagccacttccaatccagatgccaatcggtgctgaagatgatttcgaaggggttattgacctaatcgaaatgaaggccgacatctacgatgaagataagcttggttcaaattgggatacagttgatgttcctgatgaatataaggatgaagctaaaaagcgtcgtgaccaattagttgaaactttggccgatgttgatgacgacattatgaacaagtaccttgagggtgaagaaattccaattcctgaaatcaaggctgctattcgtaaagctaccttgaacctggaactgttcccagtattagctggatctgccttcaagaacaagggtgttcaaatgttgatggatgctgttattgactacttaccatcaccacttgatgttaagccatacaatgcaactgatcctgcaaccggtgacaagattgaattgaaagctaatgatgacgccagttttgctgctttggccttcaaagttgctactgacccattcgttggtcgtttgacttatatccgtgtttactcaggtacccttgagtcaggttcatatattttgaatgcaactaaagacaaacgtgagcgtgttggtcgtttgctccaaatgcattcaaatcaccgtcaagaaattccagaagtattctcaggtgatattgctgccgccattggtttgaagaacaccactactggtgattcactgactgatgttgaccatccacttcatttggaatcaatggaattccctgacccagttattcaggttgccgttgaacctaagactaaggctgaccaagataagatgaacgttgctcttcaaaagctttctgaagaagatccaacattcaaagcaacaaccaaccctgaaaccggtgaaactttaattgccggaatgggtgagttgcatttggatatcatcattgatcgtatgaaacgtgagttccatgtggaagccactgttggtgccccacaagtttcataccgtgaagcatttaccaagccaaccaaggctcaaggtaagtttatccgtcagtctggtggtaaaggtcaatatggtgatgtttggatcgaatttacaccaaacgaagaaggaaaaggcttcgaattcgaagatgccatcgttggtggtgttgttcctcgtgaatacatcccagccgtagaacaaggtttgaaagaatcattggctaacggtgttcttgccggttacccattaattgatttgaaagccaagttatatgatggtagttatcatgaagtcgattctagtgaagctgcatttaaggtagctgcttcaatcgctcttcgtaatgctgccaagaccgctgctccagtaatcttggaaccaatcatgaaggttgatatcaacgtccctgaagagtacatgggtgatgttatgggccaagttactgcacgtcgtggacgggttgatggaatggaaagccgaagcggtgccgaagttattcattcattcgttccacttgctgaaatgttcggttatgcaacgacacttcgttctgcatcacaaggccgtggtactttcaccatgacatttgatcattacgagccagttccaaagagcatccaagctgaaattattaagaaaaacggtgggaaccaacctgctgaagattaatttcaaacgtagagatcggaatttaatcccggtctctttttttgactaaaggtctgtcaaatcatcccacggcaatgtataataaattggttgaagttatttacgttcatttgaatatcaaaagaagttaaaatcatttttcaagtaacagtaatgttacaaaacgaattaattgctgttaacacttgttttatgcggctttttttagtacactgtttgagtacttgtttttagggataagtttgccctaaagcaatatgtattagctttgatgtgaaaggttgcgacacacccggatgctttgccatgggtttggcggtaattttcacggagttagtcctattttcaaaatagacgaaggagggaacacaatggcaaaacaaaaaattcgtattcgattgaaggcatacgagcatcgtatccttgatcaatccgcagacaagattgttgcaactgcgcaaagaactggagctactatctcaggtccaattccattgcctactgatcgtacaatctacactgttttagcttcaccacataagtttaaggattctcgtgagcaattcgaaattttgactcacaagcgattaatcgatattttaaatccaacgccaaagacagttgactcattaatgaagctcgacttgcctagcggtgtggatattgaaatcaaactataataaatacaatatatcggaggtgtactcatgaccagaaaaggaatcttaggaaagaaagttggaatgacgcaagtcttcaccgaaaacggcgagttagttccagtaactgtcgttgaagtgacacctaatgtcattatgcaaatcaagaccgttgaaaatgacggttacgattcagttcaattaggttatgcagacaaacgtactgtgcttactaataagccagaacaaggtcatgcaaagaaagcaaatacgactcctaagcgcttcattaaagaaatcaaagatgttgagctgggagactataaagtatctgatgaagttaaagcagatatctttaaaccaggagacatcgttgatgtaactggaaccacaaaaggtcatggataccaaggtaacatccataaagacggccaatcacgtggaccagaaactcatggttcccgttatcaccgtcgtccaggttcactcggtgtcattattaaccgtgttgttcctggcatgaaattgcctggacgaatgggtaacaagaccgttaccattcaaaatttggagatcgtaaatgccgatactgacaacaatgttctcttaattaagggtaatgtacctggtgcaaataaatcatatatcacaattagaagtgccgttcacggctcaaacaactagaagggaggcaaccatagatgactgacgtagcattatataaacaagacggaagcaagaatggtaccgttgcattaaacgatggtatcttcggcatcgaacctaacaacaatgttgtgtttgacgcaattgttatgcaacgtgcttctttacgtcaaggaactcattccgttaagaaccgttccgcagttcgcggcggtggaaagaagccttggcgtcaaaagggtactggtagagctcgacaaggttctattcgttcaccacaatggcgtggcggtggaattgttttcggacctactccacgttcatactcataccgtttgcctaagaaggtttcacgtttagcattgaagtcagtgttatcagaaaaggtttccgacaacaaattggttgttgttgatactttacaatttgatgcacctaagactaaagaatttgctgaattattaggtaaattagacgtttcaactaagacattagtagttttggaagacgacaacgaaaaggcagttctatctgctcgtaatttggaaaacgttaaagttgtttctgctcaaggcattaacactttggatgttgccgatcacgacaaagttgttattacgaaagctgctctttctcaagtagaggaggtgctcgcataatggaatcacgcgatattattttacgcccagttattactgaggaaacaaccagtaagatggacgacaagacatacacattcgatgttgatttacgagcaactaagacccaagttaaaaaggccatcgaagacattttcgatgttaaagttgtccgtgtaaacatcatgaacgttcgtggcaagctcaagcgccaaggccgttacgctggttacactaagaagcgtcgtaaggcaatcgttacattgactgaagattcaaaagaaatcgaattattcaacgaagaataatcaaacaaatctctaatataggaggaacacgttttggccattaaaacatataagccaaccagcaatggtagacgtaatatgacaagcttggactacagcgcaattactaagcgtaagcctgaaaagtctttacttgaatcaaaaagtaaaacagccggccgtaataattacggtcatatgactgttcgtcaccgtggtggtggtaacaagaatcaatatcgtattattgacttcaagcgaattaaagatgatgtcacagccacagttaaagcaattgaatacgatcctaaccggactgctaatattgctttgattgtttatactgacggaatcaaatcatacattattgcacctaagggattaaaggtgggcgacaaggttgaatctggcgttgatgctgatatcaagcctggtaacacattgccattatccaacattcctgttggtacaattattcacaacattgaacttaagcctggtaagggtggtcagcttgttcgttcagctggtgcatctgctcaattgcttggtcgagatggcaagtattcacttgttagacttgcatctggcgaagttcgtttaatccttagcactaaccgagcaactattggttcggtaagtaatgaagaacatgaacttatcaatgttggtaaagctggtcgtacacgttacaagggtcaacgtcctcatgttcgtggatctgtaatgaaccctaacgatcaccctcatggtggtggtgaaggtaaagcaccagttggtcttccatcaccattatcaccatggggtaagaagacagttggtaagaagactcgttctaagaaagcacgttcggacaagtttattgttcgtcgtcgtaaaggttcaaagatgtaatagaacgcatttattaataacaattaatatctgtgcagaggaggttgcaaaatgagtcgtagtttgaaaaagggaccattcgccgatgagtacttactcaagaaggtagatgcccaaaaagaccaagataaaaaggccgttatcaaaacttggtcacgccgatcaacgatttttcctagcttcattggatatacatttgctgtttatgatggtcgtaaacacgtcccagtatatgttcaagaagacatggttggtcataagctcggagaattcgtacccactcgtacattccatggtcatggaactgacgataagaagactgtttaataacaaggaggataacaaatggctgaacaagttacatcagcaaaagcaactgccaaaactgttcgcattgccgcacgtaaggtccgtcttgtagttgatcttatcaaaggtaagagtgttgctgaagcagccgcaatcttggatttcacaccccgcggtgcttctccggtagtttcaaaagttcttaaatctgcagttgctaatgcagaaaataattttgatttagatagtgaaaacttgtttgtaagtgaagcatttgttaacgaaggcccaacgcttaagcgattccgtcctcgtgcaaaaggttcagcttcaccaatcaacaagcgaacaagtcacattacaattgttgtatcagaaaaagaggagggataacgcgtgggtaataagataaatcctaatggtttacgagttggaatcattcgcgactgggaagctaagtggtatgcaggtaaagactatgcagcttacttaaaagaagatttgcaaattcgtaaatatatagagaagcgtcttgctaatgcgtctgtttctactgttgaaattgaacgtgcagcaaaccgcgttaatgtttcaattcataccgccaaaccaggaatggtcattggtaagggtggatctgaggttgaaaatcttcgtaaagaacttaacgacctcactggtaagagagttcacatcaacatcattgaaatcaagaagcctgatttggatgccaagttggttggtgaaaacatcgcacgtcaacttgaaggccgtgttgctttccgtcgtgctatgcgtcaagcaatgcaacgtacaatgcgttccggtgccaaaggaattaagacccaggttgctggtcgtctgaacggtgctgatatggctcgtgttgaatcatactcagatggaactgttcctttgcatactttaagagcagatattgactactcatgggttgaagcttttactacctatggatcaattggtgtaaaaacttggatctatcgtggtgaagttctccctgaaaagccaaaggacagcaacgctgctaaaggagggaaataaacatgttagtacctaaacgtgtaaagcatcgtcgtgaacatcgtggcaagctccgtgggactgccaagggtggcaagacggttactttcggtgaatacggtttacaagcacttgattctcattggatcactaaccgtcaaatcgaagcatgccgtgtggcgatgactcgtcacatgaagcgtggaggaaaagtttggatcaagattttccctcataaatcatatactgaaaaaggtgtcggagttcgaatgggtaatggtaaaggtacaccagctggctgggtttcaccagttaagcgtggcaaagtattgttcgaaattggtggagttgacaaagcaactgcccatgaagcattacgccttgcatcaaacaaacttcctgttcgcactaagatcatagaacgtgaggaagtaggtggcgaatcaaatgaaggctaaagatatcagcaagttaaccactgctcaaatgattgataaagaaaaagattacaaagatgaactgttcaatcttcgtttccaattagccactggccagttggagaatactgcacgcttgaagcaggttcgtaagaacattgcgcgcattaagactgcacttcgtcaacaagaactcaacaaatagaatacgataagggaggtataattaatggctgaagaacgtaaccagcgtaaggtttatcaaggacgcgttgtttctgacaagagtgataagacaattactgttgaagtttcaacctacaagaaacatgcaacatatggtaagcgtgttagatactcaaagaaatttacggctcatgatgaaaataacgaagctaaaaccggtgatcttgttcaaattatggaaacacgtccattgtcaaagacaaaacgtttccgtttaatcaagattgttgaaaaagcagttattatttaactttacttaattatcattattatcgtattcgatccaatgatgaagggaggatatacctgtgattcaacaagaaagtcgtttaaaagttgccgacaactcaggtgcaagagaattgttaactattaaggttttaggtggctcaaccagaaggtatgccggaatcggcgatactattgttgctacggttaaacaagcaacaccaggtggcgttgtcaaaaagggtgacgttgttaaagctgttgtagtccgtactaaggctgttactcgtcgtaatgatggttcatacattcgttttgatgaaaatgctgcggttcttatccgtgatgacaagagtccccaaggcactcgtatctttggcccagttgctcgcgaattacgtgacagcaacttcatgaagattgtttcattagccccagaagtactgtaatcacaaccaggatataaggaggtgccgtagatgttcattaaaactggtgacaaagtccgtgttattagtggtaaggacaaaggtaaggaagggacagttactaaaactatcgcttcaaaagatcgtgtgattgttgaaggaatcaacaaagttaagaagcatacaaaagcttctcagacgaatccacaaggtggaattgttgatgctgaagccccaattcacgtatcaaatgttatgctaattgacccatcaaccaacgagccaactcgtattggtattaaagttgaagatggtaaaaaagtacgttactcaaagaaatcgcaaaaagcgatcgattaatcactagcgaaaggaggataccttttaaatgtcaagtcgtttacgagaaaaattcaatagcgaaattacaccacatatgatggataaatttagctacaaatcagttatgcaagctcctaagatcgataaaatcgttcttaacatgggtgttggagacgctgttattaacgccaagaacctcgatgaagccgtttctgaattagcattgatttcaggtcaaaagccattggttacaaaagctaagaagtcaattgccggatttagattacgtgaaggaatgtcaatcggtgctaaagttacactccgtggagacagaatgtatgacttcttagataagttagtcaacgtttcgttaccacgtgttcgtgatttccatggtgtcagcactcgtgcctttgatggtcgcggtaactacactttgggtgtccgtgaacagttgattttccctgaaatcaattacgataatgttaaccgtgttagaggtttggatattgtcattgtaactactgcaaataccgatgaagagtcacatgaattgttagctcaattcggtatgccgtttgccagataaagaggaggtttcacattggctaaaaaatcattaattgtaaaaagtgaacgccctgctaagttctcaactcagaattacacacgttgtgaacgttgcggacgacctcgttctgtatacaagaaattccatttatgccgtttatgcgtccgtgaacttgcccacaaaggtcaaattcctggcatgaagaaagctagttggtaataattaaaaaggaggttgtgcgctgatgtctatgactgatccaattgcagactttttaactcgcattcgtaatgcaaacatggtttaccatgaaacagttgaagttcctgcatcaaaaatcaaacgtgacatcgctgaaatccttaaacgtgagggttttgtacgcgatgttgaatatatcgaagatgacaaacaaggcattatccgtgttttcttaaagtatggcaaggataagcaacgtgtcatcactggtcttaagagaatttctaagccaggtttacgttcgtatgttaaagcagatgctgttcccaaggttttaaatggccttggaattgctatcatttccacatcaaatggtgtgatcacagataagcaagcacgcgcccaaaaaattggcggcgaagtgttagcttacgtctggtaaaattcatcaaatcggaggtgtaattaatgagtcgaattggttataaaaccatcgaattaccaaaaggtgtcgaggtaaaagcagatgggaatactgtaactgtcaaaggtgccaaaggatctttaacccgcgagatttcatcacaaatcaagatgactatcaaagataacgaagttaactttgagcccattggtgattacaacgacaaagtacgtgcattgcatggtacaactcgtgccaacgtcagcaacatggttgatggcgtaactactggcttcaaaaagactttgaagttggttggtgttggttatcgtgcacaacttaagggcaagaacctgacattaaacgttggttattcaaacccagttgaaatgactgttccagatgatctaactgttgaagttcctgataacacaacgattcacatcaatggtatcagcaaacaagcagttggtgactttgctgcatcagttcgttcagtacgttcaccagaaccatataagggtaaaggtattcgttatgagaatgaacatattattcgtaaggaaggtaagactggtaagtagtaagatgccagcctaataaaattttgaggtgactattttgatttctaaaccagataagaataagaatcggaaacgccgtcataatcgtgtccgtaataaaatttctggtactgccgagcgcccacgcttgaatgtttatcgttctaataaaaacatctacgctcaagtaattgatgacgtagagggtgtaacgcttgttagtgcctcaacacttgattctgcaatcagtagtggtaacaagactgaacaagcagctagtgttggtaaattagtagctcaacgcgctagcgaaaagaacattaaaaatgttgttttcgatcgtggtggatacttgtatcatggtcgtgttcaagctcttgcagatgctgctcgtgaaaatggactagaattctaaaaaggaggaataaccgcacatgaagaaatttattgatccagataagttagagcttgaagacaacgtagtttcgattaaccggatcactaaagttgtaaaaggtggacgtcgtcttcgttttgctgctttagttgttgttggagacaagcacggtcatgttggttttggaactggtaaagctcaagaagttccagaagcaatccgtaaagccgttgaagctgctcgtaaaaacttaattgaggttccgattgttggtacaacgattcctcatgaagttctcggaacatttggtggcggccgaattttattgaagcctgctgaagaaggttctggagtagcagctggtggtgccgttcgttccgtgatggaattagctggtattgacgatgttactagtaaacgactaggttccaatactcctatcaacgttatccgggcaacattcaagggcttggttgagttgaagagtgctgaagaaatttcagctttacgtggggtttcaacccaacatttagctgaataaggagggtgttttagatggctcaattaaaaattactttaaaacgtagcgtaactcatcgccttccaaagcaacgtaaaattgtgaaggcacttggcttgggtcgagttaatagtaccgttgttaaaccagacaacgaatctattcgtggagcccttttccaaattgctcacttaatcgaagttgaacaagttaaagactaaaaattagtaaggaggtgccaatttcatgaaattaaatgaattgaaggctgatgaaggttctcgttcattacgtactcgtaaaggtcgtggccgttctgccggtaaaggtaagactgctggtcgtggccaaaaaggtcaaaaagctcgtagcaagactcgtgtaggtttcgaaggtggccaaatgccattgtatcgtcgaattcctaaacgcggattcaacaacatcaaccgcaaggaatatgctgttgtaaatgttgttaagcttgaaagctttgacaacggtacggaagttacgcctgaattacttcaacaatcaggactcgttaagaatgccaaatcaggcatcaagattcttggtgaaggtgaacttactaaaaagttgaccgtcaaggctaacaagttttcaaaggctgcacaatccgtaattgaaaatgcgggcggtaaaatcgaggtggtttaatgctttcgactttagcaaaagcattcaaagtgaaggatattcgcaataaaatgctttttactttgtttgtgctagttatattccgtctgggagcatacataactgttcccgggatcaatgccaaagcattaacatccgttgcatcttctggtttggttagtatcctgaacacctttagtggtggtgggttgactaattattccatctttgcgatgggggtctcaccttatatcactgcacaaattatcatccagttgctccagatggacattgttccaaaatatgttgaatggggtaagcaaggtgaagttggtcgtcgtaaattaaatcaacatacgagatacttaaccgtcatcctagcctttttccaatccgttggaattaccgcaggatttaatcaattaagtagtctgaatcttgttcaaaatccaagtatcaaaacatttgtgatcatcggcttgattttaaccggtggaacaatgttaacaacttggatgggggacatgattactgagcgtggcttagggaatgggatttcaatgattatctttgctggtatcattgcccgaattccagtcggacttcagtcattgtggacccagtattttgttggcgtttctggcgctgatctatggcaaccaatcctttttgcgattgcattgctgataatcgtgttagtgatcgtaacctttgttacttgggttcaacaagctgaacgaagagtaccaattcaatatacaaggcgagtttctggatccccagacagcagttaccttccattgaaggttaacgttgctggtgttattccagttatctttgcaagttcatttattgcaacgccgcaaactatcttgatggcattcactaacaattactcaactgcaacttggttccaggtattgaataatctattcaatatgcaaacgccgaccggtgcagctttctatacaattctcattatcatgttcactttcttctatgcctttgttcaagttaacccggaaaagctttcggagaatttgcaaaagcaaggcagttacattcctggtgtttggccagggcatgagacccaatcttatgtgtctgatctgttgatgaagctaagtacagtcggtgcgttattccttggggttgttgctttgattcctttgattgcgcaaaacctgtggaacttagatgaatcaattgggttaggtggaactagcctgttaattgttgttggtgttgctattgaaacaattcgtcagattcgtggtttaatgatgaagcgagagtacgttggcttcattcatgatactcgaccaactgatgactaaatttgagcaattccgctattaattaggaggacaataaaatgtcattgaacttgatattaatgggattacctggtgcggggaaaggtactcaagcccaatttattgtggacaagtatcacgtacctcacatttcaacaggagacatgttccgagatgcaatttcaaatagtacaccccttggggttaaggcgaaatcctttactgataaaggggatttagttcctgatgaagtgactaatgggattgtaaaggaaagattagcccaagatgatactaaaccaggcttcttattagatggctatcccagaactttggaacaagcagatgcgttgtcgcaaatgaccaaagacttggataaacctttgacagccgttatcaacattgatgttgatcctaagttgttgactgagcgtttgtcaggtcgcttcatctgtaaaaactgtggtgccacttatcataagttgtaccatatgcctaaagttcccggtacctgcgatgtctgtggtgggcatgaattttatcagcgtgaggatgacaaaccagaggctgttaaaaatcgtcttaaggttaacgttaagatgaatacaccattgatcgcatactataaggatcgaaatcttttattcaatgtcgatggcagcaaagacattgatgaagtttggcaagatgttgacaaaatcttgagcacactctaaacctcactaattaagtgttgagtcggttagattgatgaaatataatgaatgtgttaaactgtcaaaggtttgtcaagattaatttaatttattcaatctaatttaacattggaggtgtattgagtggctaaagataatgttattgaagttgaaggaaaagtcgtagaaacattgccgaatgcaatgtttagagttgaactggagaatggacacgaaattctagctcatgtttctggaaagatccgaatgcattacattcggattcttcctggagataaggttactgttgaaatgtctccttacgacttaaccaagggacgtattacttatcgatttaagtagtcctttttcgtcattttttttcgaggagggttaaaaatgaaagtacgaccatcagtacgaaaaatgtgtgaacattgcaagattattaaacgaaaaggccgagtaatggttatttgctcagcaaacccaaagcacaaacaacgccaaggtaaataaacataaacaggaggtgtatgctcaatggctcgtattgccggaattgatttaccccgtgacaagcgaattgttatcggattaacttacatttttggtattggtaacacaacagctcaaaaagtcttagcaaaagctggagtttctgaagatgttcgtgtacgtgatttgacaccagaccaagaagacaagattcgtgaagttgtcggcgatcttaaaatcgaaggtgacttacgtcgtgaagtaagtatgaacatcaaacgacttcaagaaattggatcatatcgtggaatgcgtcatcgtcgtggactgccagttcgtggtcaacataccaagaacaatgcccgcacacgtaaaggtagcaaagttgctgctggtagaagaaaataattaaagaaggaggtcatcagtttttatggtaaacaaaaagacaagtcgtaaacgccgtgctaaaaagaatattgctgctggtgttgcacatatccattcaacattcaacaatactttagttatgattaccgacaccactgggaatgcggtttcttggtcatcagccggtgcattaggtttccgtggaagtcgtaagtcaacaccatttgctgctcaaatggctgccgaagctgctgctaaggcatcaatggaacatggtatgaaatccgttgaagttgctgtcaaaggaccaggttcaggccgtgaagctgccattcgtgcacttcaagctactggattggaagttactgctattcgtgatgttactccggtacctcacaatggttctcgtcctccaaagcgtcgtcgagtttaattaagacattcaatatagtgaattttacttggtttaagcatattgatattttgcatgaagactcacgcgttttgaaaggggttaatgataagaatgattgaatttgaaaagcctaacattcataaaattgaagaaacaaataattttggtgaagttgtcgttgaaccgctcgaacgtggatatggtacaactctcggaaattctttgagacgtacattactgtcatctcttcctggcgctgctgttaccagcatccagattgatgacgtactgcacgaattttcgacgatcaaaggtgttgtcgaagatgtgactcagattatattgaatgttaagaaaatttctttgaaattagatgggccagaagatgaagaagaaaatttggaaatcgatgtaattggtcctgctgatgttactgccggtgatattcaagctgacagtgatgtgactgttctgaaccctgatttgcacatcgctaccgttgctgaaggtgccacattccatatgcggttaactgccaacaaaggtcgtggatacgtttctgctgtggaaaacaaaaagcgcagttctgaaatgcctattggtgtgcttcccgtcgattctatttataccccaatcgaacgtgtcaactatcaggttgaaagtacacgggttggtcaacgcgatgattttgataagcttacactggatatttggactgatggttcaattactccgagtgaagcagttagtttggcggccaaaattttaaccgaacatctagagatgtttgttgatttgactgatgaagctaagaataccgaaatcatggtcgagaaggaagaaacccacaaagaaaaaatgttggaaatgacaattgaagaattggacctatcagttcgttcatacaactgtcttaaacgtgccggcattaatactgttcaagaacttacggaaaagaccgaagctgatatgatgaaggttcgtaatcttggtcgcaagtcacttgaagaagttaaagaaaagcttgctgcattgggcctttcacttcgtaaagaagactaataaagataaagaaggaggacatccaattatgggttatcggaaattacaacgtagtagtgcacatcgtcgctcattgcttcgtaatttgactactgagttaattattcatggtcaaatcattactactgaagcaaaagctaaggaagttcgctcaactgctgacaagatgatttcacttggcaagcgcggcgatttacacgcccgtcgtcaagctgcatcatttgttcgtgatgttgttgctgatgttaaagaagatggtgacgatattaacgttacgactgctttgcaaaaagtatttggcgaattagctacaaagtatgctgatcgtaatggtggatatacacgaattttgaagactatgcctcgtcgtggcgacggtgctccaatggtcattttagagttagttgactaactagtattaaaccaaatcacatatttatcacgagaatcactcaggtttttggtatagaacgttatgatggtggaacccagttcctagtctagtttgaatgtgggacttatctcatgcaccgattacctgtaagtgatttttttgtacatagataaaacactttgcacagcgtgaggaacatcatgaaggatattattcaaattaaaaacatttctttcaattaccccgaacaagaaaaacttttcaataatttttcgatgaatattcaggaaggtaaatggacggctatcattggccaaaatggaagtgggaagagtacactggcccgcttaattgacggcctaattgttctgaagtctggtcaaattattgttgatggactgacagtcaacgatacaaatatctttgagattcgaaataagattggcatggtttttcaaaatcctgaagatcagtttgttggagcgaccgtagaggatgacgttgcatttggcttagagaatcgccaagttccgcgtgagcaaatgcatcaaattgttgaacaaagccttcgacaggttggcatgtgggactttcgtgatcggattcctgctaatttatctggcggacaaaagcagcgcgttgcgattgccggaattattgcccttagtccgaaaatcatcattttggacgaagctaccagcatgctggatcctcgtggccgacaagacattttaaaactggttaatcagattaaacgcgaaaataatctgaccgtcatctccattacgcatgacatagatgaggccgctggtgcagaccaagtcattgttgtcaatcaaggtcaagttgttgaagctgatcagccggatcatatttttggtgacattgaaaaattgacatcaattggcttatccgcaccttttacgtccgaattgctgtctgccctcaaaaagcgtggaatcgactcacatagtcaatatctcaatgatgagaggttaattacatggatcaaacaattaatttcaaagaagtaactcatacttatcaacccgatacaccatttgcccaaaatgctttgaatcaggtatccttaaccattgccagcgggtcatttacagcaattatcggtcacaccggtagcggcaagtccactttggtacagcacattaatgcgcttctcaagccgactatgggagaaattgaggtgtcagggcgaacgattacacctgcgaccaccaataagaatttaaagcaacttcgtaagcacgtcggcatggtatttcaatttccggaaaaacaattatttgaagaaacggttatcaaggatgttatgtttggccccaaaaattatggggcttctgaccaagaagctagagccgatgccaaacaggcgatggcattagttggcctcgacgaagatttgcaggagaagtcaccatttgatctttccggcggccaaatgagaagagttgcgattgctggggttttggcaatgaagccggaaattctcattctggatgaacccactgctggcttggatcctcgcggccacaaagaaattatggacttggctgaagacctgcacgaacatcagggcatgacgattattctcgtcacgcaccaaatggatgatgttgttgattacgcttctgacgttattgtgatggatcaagggaagattgttaaacatggaagaccgcaagagatttttgcggatccccagtgggtctatcagatgcatctggatttgccgagtagtgccgaatttgcttctcgattgatcactgcaggggttccgctaaaaagtgttccactgacaattgacaaattggcggatgcaatcgtcgaagttgttcaaggggggcatggccatgagtaatttcctatttggtcggtaccttcctggtaattcttgggttcatcaaatgagtccccaatccaaattgatgctgagcttttatttcgtggttgtgattttctttgccaataacatttggacttatgcggcattgagtgtgttgattctcatggtggtcctcatgtcaggcgtgtcgattggttattttctaaaagggattaggccacttatttggttgattatttttactgtcttactgcagattctattcagcagtgggggacatgtctattggcattttggtccattttcagtcagtgataccagcttaattaacggtggttttattttcatccgatttctgttgattatcatgatctcgacggttttgaccttgacaacaacgcccttggcgattgcagacggggtgcagaccgttcttcggcctctcaaaaaagttcactttcctgtggacacattggcgttgatgctttcaattgctttacgttttgtaccgaccttaatggatgaaatggaaactattttaaatgctcaacggtcaagaggggtggactttgggtccggaagcttacgccatcggattcaagcagccgttcccctgctcgtcccattatttaccggagcaatcaatcatgcagaaaacctgtcaactgccatggaagcccgtggctttaccgacagtgagcaccgcagcaaataccggatttatcggtggcagcgaaaagataccattagttgggcagtctttttgttagtcggggtgctcgttttattcataagaaagagttgaggtgttcaatattcgatacaaagtgacgttagcctatgatggcacgttgttcagcggctttgagcgccagcccaagcgcagaacgattgagggtgttttgacccaaaaagtgaatatcatggcaaaaaatcccgaccccccaattgtcgtctacggatctggcaggacagatgccggtgtccatgccctcggacaagttgtccattttgatttcccgtttgatttgccaaccaaggcaatttatcggggactaaacagtctcctgccgcttgacatggagattaaaaaagcggaaaaggtatccaatactttccatgcccgctacgatgtgtccggtaaacggtatgtttatcggctggatttaggcgaatttaaggatccgttcaaacggaattataccggcaattggcgttttcccattgatattgaacgggttcaaacggcaatgaatgatttcgttggtgaacatgacttttccagttttgtcgcttcggggtcgactgcacgatccaatgttcgaacgatttatgaagctaatgcgattttggacaaatcagccaacgaaattcggcttgagttctatggcaatggtttcctctataacatggttcgaatcatggttggggtagttgttgagattgggtctcaaatgcgccctgagcacgatatattgcgcttatacgaggtgaaagatcgtgaccaggcccgacgaaccatgccggcatccggtttgtacttaaagaaagtctattatgagggtgaagatccgaagcaccccacgaaattgccaaaacgacaacgataatttaggaaactaattgactttcaccagaataatttgtattatgttaattggtattgtttgccccacgataagccccggaatcttatttggtgtcgaacaaacacaggaacaatggaggaatatacagtgcgtacaacttatatggcaaaacctggtgaagtagaacgtaaatggtacgttgttgacgcaacagacgtatctcttggacgtttatcatcagcagtagcatcaatcttaagaggtaagaataaaccaacattcacacccaacgtggatactggggataatgtgattgtaattaatgcaagtaaagtcggtctgactggtcacaaagacactcggaagatctattaccatcacagtcgctttattggtggcttgaagcaacgaactgccggtgatttgcgtgctaagaatcccgaaaagttaattgaaacttccgttaaaggaatgcttcctcatggaacattaggtcataaaattggtttgaagttacatgtctatgcaggtcctgaacacgatcatcaagctcaaaaaccagaagtattagacattaataacctaatttaaggaggaattcactttggctcaagtacaatatcgcggcactggccgtcgtaaagattcagttgctcgagtacgcttggtacccggaactggaaaaattatcatgaatgacaaagcaatcgaagactatattccatttgctaacttgcgtgaagttgttgtgcaaccattcaacgtaactgagactttaggtaactatgataccttggttaacgttaacggtggtggattctccggccaagccggcgcaactcgtcacggaattgcccgtgcattgcttgcagttgatcccgacttccgtggaccattgaagcgtgccggtttattaactcgtgacgcacgaatgaaagaacgtaagaagccaggtcttaaaaaggcccgtaaagcttcacaattttcaaagcgttaaaatttactttgctttttcaaaacacttctcttttgaggagtgtttttttgttgagaatattttaagcttgttggtaaactgacattcaccagcaaaattgtattagaatacaatccgttattgtataatggttccaacaactttaaaggggtaagaacacatgcctgttaagaaaaatactttacgactgaacatgctggcaatgtttattgcgatcattctgttgcaaacttcgattcctttgatcgggtacatcccaattggtccacttgaaattacgattatcccgatgactgtcgtcgttgcaacggttttgcttggaactgttgacggagcgatcattggtggtgtttgggggatgacgacttttgtccgagcttttgtatggccgaccagccctttagcggcaattgtcttcgttaacccgattatttcggtcatcccccggattatgattggcgtagttgctggtatgacgtacacgtatctcaagaaacacttgaaaagccaggcagccagtatttctgtatcggctgtcttgggttcattaaccaacacggtcttggtgctgggactcatttatctgttttataaggcgaaagcccctcaactgtatcagattaatatcaaagaactcctcccatatttactaggggtggttggtacgaatggtgttccggaagcaatctttagcggaattgtcacaccgttgattgcggtgccggttaaaaagatttttgaccggaccagcagataaaaaatagaccttgcacaaatatatgcagggtctacttttaatcattatttcttgctcgattttttggttctcgaggatttagtttcattatcgtcctcgtcatcatcctcaacttcaggttgaggagctgccttgatcattttgagatgacgattattgatgacaacctttttgtggtacttgtcgataatctcaggatcatccgattcaaaagtgattaaaaatgagttggtgtaactcttatcaacgaagccggtaaacgtctgtttttcgatcttgaatgaaacctcatcaccaacatgaaattttgattgagcttctgatacttcggtgtttttagccattggttttcatctccagatttaagtgtcagaggataacataaccgaaattaacagatttgtcaatttttacgcatttataaaaattgaacaaagcacaaatttcgtttgtctttattcggatttatcgttagaattaattttaaagttagaaagtttgaggttggattggcaaaatataagaaggggcggaaacgccgcgcaaaaaaagcaaatgccgttttgatgttgattctggtgatctgtgggttggtgatcatttttggtttccacgctttgtacgaaaacggttatcattcgagcaatattcaaagctcaaacgacgaagtagccattgagcaccgtaaatttatcaacaaattagcgccacaagcccagcggctgcagggacaatataatatcttaccaagtattactttagcccaggccattttggagtccaactggggcaccagcaagcttgcgagcaagtattataatctgtttggcgtcaaagctcaggataataccaccaactcggtctacctgaatacgcaagaatttgtgaatggccgttatgtgacgatcaaagctcggttccaagtatatcaggattggaatgaatccttggctgatcacgccaaattgcttgcttacggcacgaaatggaacccacagcagtacaaggacgtggtggccgcaaacaactacctgcaggccgctgatggccttcagcaggatggctatgcgaccgaccctgcttacaccaagaaattgatcgccatcatcagacaatacaaactttatcaatacgatgactagaaaggaattttgagatggacttacttaagaaacgcattttggaggatggtactgtattaccaggaaacgtattaaaggtcgacaactttttaaatcaccaggttgatgcaaaattgatggaccaaattggtgccgaatttgcccgcttatttaaagatgaaggggtaaccaaggttgtgaccgttgaatcttccggaatcgccccggcattgacaacggcgatccatatgggggttccgttgatctttgccagaaagcataagagtttaactttaaccgataacctgtacaccgccagtgtttattcttataccaagcaagttagcaacgatatcagtattgataaacgatttttgaagccaaatgatcgaattttgattattgatgattttttggcaaatggtcaggccgttcaaggactgttggaaattgccaagttggcaaatgttaaagttgagggtgttgggattgtgatcgaaaagagcttccaaaaagggcacaccatgattgaaaaatcaggtgtccgtttggagtctttggcccgaattgcctctctggataaccaaaaagtcacatttgttgattagagctgtgaaaataatggtacgataagtttagtgatgacttacaattaataaaatgacgatatgaaagtagtgaattaattggcaaacgcaaatgttatctatcccggtcaaacaattgggattcttggagatagtatcagcaccccaacgttattggctcgcgcaaaacaaatgggctttaatgttggcatgtacagttccaacgaaaacagtaaggcgatggaactggcagactataaatacattggcccctacactgacaaggaaaccttgaaaatgtttgccgaacgctgtgaagcggtgatctatgacaatcaatttatcgattcagatgtcattcgatacatttcccaatacacggctgtggcgcaacgggacggattattggatattgtccaagatcgactgattgaacgaactttttttgaaaccctgaatattaacatggttccttactcgacgattgtcacgttggaagacatttaccaagccattaattccattgggtacccggctattttaaagcccattcagcggggactaaacggcggcaaggaattgctgattaagaaccaggctgatattgtcctggcatccggttttttagattccggaacttacattttggaatcctatgtggaacataatactgactactccgtggtcgttacccggaccgagtcagggtcaattgtgatgtttccaccagtcgaagtgatgtatgaaggcgatcagttaatgaccgcctatacgccggcaaaactcgatcccagtgtgaagaaggaaatgacccgaattaccaatgaaattgccaacaaccttgactatgtcggtactttcgaagtcacactcttcttggccaagagcggttcgatttatgtcagcagagttgctcccaaattgagtgcggctgggtttgtatttgattacgctgctaatgccgatgaatttgaacaacatttgcgggcaattgccggtttgcctttgacacaaattattcccggaattgcaacggtttatcaggccattcgacaacaggaatatcaacgtgtccaaacccaatgggtcatcaaagataattggcacttcacgttttatggcaacgagccaactgacgaccatcagctggttgggcatgtcttgattccgaccaaatctatttcagataccttggttaaactggaggccactgggatttggcatgacatagattacaaaacaaaatatagcaacatgtagagagtcgggaagccgacttttttgttataattgaaaagataaatgcgagaggatggaatatttagtggcagaagaaagtttattagcaggattaaataaagatcaaaaagacgccgttatccatactgaaggacccgtcctcattatggccggtgccggcagtggcaagacccgggtattaacccaccgaattgcctacataattgaacataaccatattatgccgtggcggattttagcgatcacttttaccaataaagctgcccgggaaatgcgtgaacgggtttcaaaattgttgggtgaaggtggtaacgatgtttgggtttcaacattccatgcactatgtgtgcggattttacgccgccatattgatttgctgggctacaataaggcttttacgattgccgataccagtgagcaacggacgcttgttaaacgagtactgcgggatttgaatattgatcccaaaaaattcgatcccagagccgttttatcggctatctccaacgccaaaaatgatctgctcacgcccaaagcattcaaagctcaggctaatagtgctttcgatcaaatcgtggcggacgtttatgatcgctaccaagcagagctgaagcagaatcaatcattggactttgatgatttgattatgatcaccatccaattatttgatgaacatccagatgttttggaatcctatcaggacaaatttcaatacatccatgttgatgagtatcaggataccaatgaggctcaataccgactggtgaatacccttgccaagaaaaatcgtaatatctgtgttgtcggggatgccgaccaaagtatctacggctggcgtggtgccaacatgcagaacatccttgatttcaaaaaagactatccggatgcccatgtgaccttattggaacaaaattatcgttcaactaaaacggtgcttgatgccgctaattcggtgattgcccataatgacaatcgtgccgacaaaaatttgtggactgaaaaccccaaaggcgatcagatttcgtattatcgtggtcagaccgaaaacgacgaggcaagatacgttgttgccaaaatccaagaagaaatggccaagccaaaacgcaattacggcagttttgcgatcctttaccgaaccaatgcgcagtcacgggtaattgaagaaaccttgctcaaatcaaatattccctacaccatggttggcggacacaagttctatgatcgaaaagaaattcgagacgccttgtcttacctgactttgttagccaatccaaatgactccatgagttttgaacgagtcatcaacgaacctaaacgggggatcggccaagccagcattgaacgattacgactattcgccaacgatcatcagtggagtctccttgaggctgctaaaaacgttgacttagccaatgagatttctacccgtgcaaaaaattcgattgctgaatttgaacagacgatgcgaacgatttcagagaagatggcacaattatcaatcactgaaattactgaagaaattctcgataagagtggctatctaagtaccttgaaagcttcgaagtctttggaagctcaaaccaggcttgaaaacttggaagaatttatttctgtgactcaaaagtatgatgaagaaaacgagggcgaaaccggtcaacagaacttagtgaatttcttaagtgatttggccttggtttctgatcaggatagtctcgaagaagacaattcccaagtgactttgatgactttgcatgcagccaagggactggaatttccagtggtctttttgatgggaatggaagaaggattattcccgctttcacgagccgcagcagacgaatcagaacttcaagaagagcgccgattagcgtacgttggcattacgcgtgccaaagaaaaactctatattaccaatgcctactcacgaatgttgtatgggcgtcgtcaaaacaatccagagtcgcgcttcgtgaacgaaattagcccagagcttatccattcggataatcaacagcaaactgagtcccccctaagcacgccgtttgatcgccgaaccaggcgggcaactgcaactacttatcggcgacctggaaaagtcgtcgaaagccctaaaggatccggtgcagacaaactcgcttgggccgttggtgataaagtgtcacacaaggcttggggaaccggcacggttgtcaaggttaccggaaccggcgaggatatggagctcgatattgcattcaagcaagagggcatcaagcggctgttggctgcatttgccccaattaagaagcaggaaaattaatcaacagaaggtgttattgtggcatttgaaaatatgtccgagcaacaggccgctgctaaggctggcgatctgaggaaacaattgaaccagtgggctgacgagtattacacctatgacgcaccaagtgtcgaagatgccgtgtatgaccaaacttatcagcagctggtcgcattggaaaatcaatttccacagattgtgacccctgattcacctactcaaaaagtcggggatcacacgcttcccggttttaccaaggttaaccatgaaattcggatgctttcattgggagatgttttctctaaggaagagttggcggaattcgtcgaccgtctaagtgaaaatgattcagtcgcgtttgattataattgcgaattaaaaatcgatggtttggcaatcaaccttcgatatgagaacggggtctttgttcaaggatccactcgcggaaacggtcaaattggtgaagatattacccgtaacttaaagacgattaagtcaattccgcaaaagttgactcgaccgatcaatattgaggttcgtggcgaatgttacatgcccaaagaatcgtttgccaaattgaatgaacagcgccagttggatggtgaagaaccattcgccaatccaaggaatgctgcggccggaagtttgcgtcagctggatccacgtgtgacccgcagtcgcaaattaagtacttttatgtataacgttgccgatatcgatgatttgcaatctgacactcaaagcgggatgcttgccgaactcaaagaattgggctttacgatcaatccagatttcaaagttgcccacaatatggctgatattgacaattacgttgataaatacaaagatttacgggatggtttgccctatgggattgacggcattgtgattaaagtcaattcactaccgctgcagcgctcactcggggcaaccgttaaagttccccgttgggcgattgcatacaagtttccaccagaagaggttcaaacgattgttagggacattgaatggaccgttggacggaccggggtggtgacacccactgcggttatggatccggtgatattagccggcagtactgtcagccgggcatcacttcataatccggattatttggcagaaaaagatattcgggtcggcgataccgttaagctgcataaagctggcgacatcatccctgaaatctcgcagtacttaccagataaacggcctgccaacagtcaggcctatgaaatcccaacccagtgtccatcatgcggttccaccctggttcacttggaccaagaggttgcgcttcgctgcattaatcctcagtgtccggcgcaactcaaagaaggcttaacccactttgcttccagggatgccatgaatatcgacggtttggggccaaaaatcatcgcccagttgtttgaaaaacacatggtctccgatgttgccggactttatgatttgtcctttgaccaactattaactttggacaaatttggtgaaaaatcagccactaagctgctggctgccattgataacagccgatcgaattcttgtgaacgactgctttatggcttgggaatccgccatgttgggatcaaggcagctcgattaattgcccaacgttttaaaaatattgataaggttatgcaggcaagcgcgcaagatatcgccgaaattgctacaatgggaatgatcattgctgacagcgtggttacttacttctcaatgcctgaatccaagcagttgatcgaccaactcaaacaagtgggcgtcaacatggattatctgggtgtgactgatgaacaacttgctgaaagtgattcattcttcaccggcaagaagttcgttctgacagggaaattacaaaatatcacccggccggatgcaactcaatggcttgaggaccatggtgccaaagtcagcagttcagtttccaaaaatacagacatcgttgttgtgggtgaagaccccggcagcaagtatgataaggcgaaaagcctcggcattcagacatgggacgaagcccgtttccaccaagaaatggccgatgaaaagtgacaatggaggaacgaatcgtgaaaaaaattatcctggggatttcaatcattctgtcgggatttatgttggcagcgtgtgggagcgttgataatctgtcgaaggataccagcaattccagtgggtcaaaagccaagacgcagttaaccggccaaacgaacaccgactattatcaaggtgtgatcaagaatggccgttatcagaccagtaaatctcgtggtgtgagtgtttctcaagaatcaaatcagttcaatattaaggggtttgaaaacggcctgttggatatttccaaaaaagaattttcaactaaaaaatacattttccaagaaggtcaatatctttctaccagcacagttgaaaattggttgggccgtcaatcgaaatcaaacccaaccggcttaaatccggttaagtccaaatcgaccaaccctaacactagaaatccaatttatctttcccaaattgatgagcaggatttcatgacccaaagcggcaaatcgcttcgcttgtcagggatgaccatcggactgggaatcaactcggttgattactataagaagacggcctatgggccaacttatgaaaccgacatttccgatgcccaagttaaaaagcagggtaaagctatcgccaaccaagtgattaagcggctgcgacaacggcgatcgctgaagaacattccaatcatcattgctttatacaagcaagcttcagatgatagcctggtcggcgggaacttctttgcatattccatgaatgacgatggtgaaaccaaagttgccaagtgggacaaaattaatcaaaagaactatgtcttcccattacaatctgacaagaagggtcccagccaaaatgatgctgattcgtttgataacttcaaatcagaaattcaaggcttcttcccgaatttgagtggggtgactgctcaagcacaatacaccgatggctcactcagtgggatgaatatcagcattacgactcaattttatagtcagactgagatcatcagttttacccaatacattcaaaatgccgctcagcgatatttgccggccaatgcaccaattgacattacggtatcttcgactgaaggcattcagagtttcttgagccgtaagcaaaatgagaagaaattttctgcccatattttcaatagttattaatttctaaaaaatgcgattctttatatggtagaattattgttgttattaaattttggatatattcagaagagagaaggatttcaatgactgaaaagatctccgaagatcaagtaaaacacgttgctgaattagcaaagctaaaaattgccgacgatcaactgccatatttcaccactcaattagaccaaatcattgggttgtttgaaacactgagcgaagttgacactgacggcgttgaacctaccagtagtgtgactgatcaaattaacgtgatgcgagacgatatcgccgaagattggcaccaacgccaagcattgcttgataacgcaccggacacggccgatggctacatcagagtgccaaccattattgatgaaagcggggataacgaataatgaattatttcgatcaatcactttccagcattcacaaacaactggtcaacaaagaaatctctgcgaaggatttgacccagcaaactttggataacattaaatccgttgataatgacatcaacgcttttattactgttgatgatgaaggggctttgaagaaagctgccgacgttgatgctaagggcattgatgccgataaccttttatctggaatgccaattgccattaaggacaatatggtgactaaaggcttgaccacaaccgcagcgtcgaaaatcctggaaaacttcaagccgatttatgatgctaccgctgttgacaagttgaacaaacttggcaccattacagttggtaagaccaacatggatgaatttgccatgggcgggtcaactgaaaactctgcatttaagattactcataacccttgggacacaaccaaagttcctggtggttcgtcaggtggttcagctgctgctgttgctgccggtgaagtcattgccgctttgggatcagatactggcggttctattcgtcagccagcatcatttaatggtgtggtcggcatgaagccgacttatggccgagtttcacgatggggactgattgcttttggttccagtttggatcaaattgggccaatcactcgtaacgtcagcgacaatgcaacgattatgaacgccattgccggccacgacgagcatgacttgacttcttcgactaaagaagtgcctgacttcaccagcacattgaacaaaggtgttaagggcatgaaaatcgggattccgactgaatttatggcccagggactggatgacgatatcaagcaaaccgtcttagatactgcggaaaccttcaaaaagctgggggcaaccgttgaagaagtttcacttccacataccaagtacggtgtggcggcttattacatcatttcctcatccgaagcttcttccaacctgcagcgttttgacggcattcgttatggtcgccgggcaaaagacgtcaaagacttggaagacttgtacgttaaatcccgttcagaaggttttggcgacgaagttaagcgtcgaatcatgctgggaacattctcactttcagctggtttttatgacgcctacttcaaaaaagccgctcaagttcggacgttgatgattaatgactttaccaatgtcttcaaagactatgacttgattttggcacctactgcaccgacgcctgcatatggaatcggtgaggatgtctcagatccgatgaccatgtatatgaacgatgtgttgaccctgccggttaacttggctggcttgccagggatgtcaattcctgccgggttctccaagggcttaccagtgggtgtgcaattgattggtcgcccatatgacgaattgaccgtttaccaagcaggtagtgcatttgaacaagaaactaattttgcaaaacaaacaccaaagatgggaggtaacaactaatgaattttgaaacgacaatcggactggaagtccacgttgaattaaaaaccaattccaaaatttttagtccatctcctgtagaatttggtgatgaacccaactccaataccaacgtcattgactggggatatcctggtgttttaccaaccaccaataaaggagttgtccatgacggcatcatggctggtttggcacttcacgcccaaattgaacgccacccacactttgaccggaagaactacttctatcccgataatcctaaagcttaccagatcactcaatcagaaaccccaattgcccatgatggctgggttgaaattgatgttgacggcaagaaaaagaaaatcggaattgctgaaatgcatatcgaagaggatgctggtaagaactcgcatgcttccgaatattcttacgttgatttgaaccgtcagggaacgccactgattgaaattgtttccaaacccgacatttcttctccagatgaagcatatgcctacttggaacaattacgtcaggttatccagttcacgggtgtatccgacgttaagatggaacaaggttccatgcgtgtcgatgttaacatttctgttcgccccgttggccagcaggaatatgggaccaagactgaattgaagaatttgaactccttcacgtatgttaaaaaaggtttggcgtttgaggaagctcgtcatcaacgtgttttgatgtcgggcggcaaaattgcccaggaaacccgtcgttttgacgagtcaaccggccaaaccatcttaatgcggactaaggaaggctccgatgattaccgttacttcccagaacctgatctcccagttttgaatatttcacaggactggattgacgagattcagtcagaactgcctgaggcgcctgcaaaacgtcgtgagcgttatgtcaatgaacttgggattacagattacgatgcgatggtcattacccagaccaaggaaatgtctgatttctttgataagatgattgctgccggtgctgacgccaaattggctgccaactacctgcaaggcgacgttaatgcttatatgaatgataatcaggttgaactacaagataccaagatcacccctgagcatttggcaactatgatcaaacttatttctgacggcacgatttcatcaaagatggctaagaaagtctttaaagccatcaccaatggtgaagagcccaagaaattcgttgaagacaagggcatggttcagttgtcagacccagccaaacttcagccaattgttgatgaagtcgtagcggctaacccacaatctgttgaagatttccataacggtaaggatcgggccatcggtttcttggttggtcaaattatgaaacaaacccacgggaaagctaacccgcaagtaatcaacaaaatgctaaaggattcaatgagtaaatagaaagtcaggatggatatgcgaaaacgggcccgggttatttataatccaacttcgggaagggaacttctcaagcaaaagttagtcgacattttgaatatttttgagcaagctggttatgaaaccagcgcttatgcgacaacccccgccaaggactctgctaaaaacgaggctcgccgtgctgccaaagacggctttgaactcgtggtagctgcaggtggggatggtaccattaacgaggtggttaacggcatcgcgccactgaagaagcgtcccaagatggcgattattcccgccggaacgactaacgattacgcaagagcgctgcacattcccagagaagatcccgtcgaggctgccaaggtggtcttgaaggaccaaaccctgcggatggatatcggtaaagcgggtgaaaattactttatcaatattgctgcgggtggattgctaaccgaactgacctacgatgttccttcagacttgaaaaccttctttggttacttagcttatttggttcgtggagctgaactgttgccacgcattaagccgattgagatggatctgaagtatgacgatgaagagtttaaaggtaaggcctcgatgtttttcctggcactaaccaactcggttggcgggttcgagcaaattgttccagacgcttccttagatgatggaaaattcactttaattatcgttaaaaccagcaacttggttgaaattctccatttagcatcaaaagtcctcaacggtggccggcatgtcgatgatccacggattatctataaaaaggtgcgtaaagtcactgccaagccggttcatgatcgaatgcagatcaatctggacggtgaatatggtggagatgcaccgatgactttcgttgatctcaaacaacacattgaattttttgccaataccgacgaaattcctgatgatgcgtattctgatgaaaccaatgagatgcgcagagttgaaaagaacttcgtcacaggcgttgacaaactccctgataaagaatagtttaataagatgttataattgcgttacgaagctttcgtttcgcaatttttgtttctaggaattaaaaaggtgaataaatgaaaaagatggtaccagttgaaaagaaccagaactacgacgttgatattactgatttaacgtatcaaggtctgggagttgccaagattgatgatttcccaatttttattgaaaatgctcttccaaccgaaaacgtgaccatgaaggttattaaggttaaaaagaactttgccttcggacgggtagttaagatcaatcaaaagagtaaagaccgggttgaattggtggataaagcatacacccaaaccggaattgcgccgcttcaacatctaaaatatgatgcgcaattaaaattcaagcaacatcaaattcaagttgacttcgataaaatgaagcttgatgtgactgttaatcccacgatcggcatggacgatcccacccactatcgtaacaaggctcaaattcctgtccgctcaattaatgggcagcttcaaaccggtttttatcggaaacactctcatgacttggtgccgattgaagacttctatattcaagatcccaagattgatgaggcagtggtggttgttcgtgacattttgcgcaagttcagagttcaaccctatgatgaacaaactaacaaaggcgttgtccgcaacatcatggtccgccgcggccattactctcatgaaatgatgatcgttttgattaccagaacagagaaattgccaagcagtagcgagattgtggctgaaattgaacagtcactgcccgaagtgaagagtatcgtccaaaatgtcaatcctgaaaaaacgaatgccttgatgggcaagaaaaataaagttttggctggtaagagtaccattgaggataccctgcttggactgaagtttgatatttcagccagctcattttatcaagtcaaccctgtgcagacggaaaaattatatgatttggcgaccaagaaagctgacttgtcggctgacgatgttgtgatcgatgcctattgtggaatcgggacgatttcgctttccatggcccgcgtggccaagcaggtttatggggttgaaattgtccctgaagctgttgaagatgccaagaagaacgccaagcttaacaatttaaccaatgtgcacttcgttaccggcaaagccgagacgcaaatggccaaatggcaggaagacggcttaaagccggatgtcatttctgttgatccgccgcgtaaaggccttgatgccagtttgattgacagcgtggtgaaaatgcagcccaagcgagtggtctatgtgtcatgtaatccggcaactttggcacgagatgttaaattatttactgagcaaggttatcaggttaatcaaccgattcaacccgttgaccaattcccacagaccgtgcatgttgaatcaattaccgtcttggaacgtggtcattaagcgttgaatgagcccatccaacggatatttgttcaatttacaaaaacgaattgatgattccatcgattttcattattgccagaggtcattcaatgttgcagttaacagagaatgtgtgagggaatcaggacaaaagcagtcacttttgtcctgattccctctttttttatcagcaaatttaaaaaaagccaaaaatattttccaatcccgttgaaatcctattctaaaagtaaatgtagcaaccccggcaacaagatacagtgcaaatgtataaaattgctattatgtagataaggtcaaccataaaaccggttacattcccccaatgagggaatctgacggatttgctaattggttgaactgaatgcatatttttgttaaggttttataagtcgttcaattactggcttccacatacgtttgtgctttaggccggtaattgatttttatttatcatgaatgatgtaaggaggagcacatgacagcaaaactacaagtgcaacatcttaccaaaatctttggccgcaggattcaaaaagctgaagaactattaaaacaaggtaagtcaaaagctgaaattttacaaaatgctggagcaacggttggcgttagcgatgccaactttgaggtcaatgatggtgaaatcttcgtgatcatgggactatcaggaagtggtaagtccaccatgattcgaatgattaaccgtctaattgagccgacatccggcaaggtactgattgatggcgagaatctgacagatctgaataaaaaagaactgttggatgttcgtcgcaacaaaatgagcatggtctttcagaattttgcgttattcccaaatcggacaatcattgaaaatactgcctacggattggaagttaaaggcgttgacaaggatgaacgcttaaaaaaggcccacgatgccttggaattagttggtcttcacggctacgacgaccaatatccaacccaactctctggtgggatgcagcagcgagttggcttagccagagcattggcaactgattctgaaatcctgttgatggacgaggccttttcagcccttgatcctttgaatcgaaaagatatgcaggatgaattactggatctgcaggagaacctgcacaagacaatcgtttttatctctcatgatctgaacgaagccctgagaattggtgaccgaattatgatcatgaaggacggtgtgattgtccagaccgggactccagaagagattctgactcagcctgctgacgaatacgttgagaaatttatcgaagatgttgaccggaccaaggtcttaactgcttccaatgtgatgattcgcccaacttttgtcaatatcgataaggatggtccacggatcgcaatgcgtcggatgcgtgagaatgaaatttcgtctgtttacgttgtcaatagtaagcgggaattcgttggcgttgcggatgctgatcacgtgatgggattaattaaacagaaaaaccctgatctgatgtcagttgtccaaaccgatgtcccaacgacccatcccgacacaccgattacggagattatggaaaaaatctcgcagacaccgattccatttgcggtgcttgacgatcaaaaacatttactaggaatcatcattcgaggtgccgttctgggcgccatttcaggaaatgaggtgacagaggatgaataacattccacaattaccagtctccagctggattgataaatttgtcgactggctctcaggctttgaaggcttctttaacggtgtcaccaattttatcggcggcatcattaacggtttccaatgggtctttgacatcctgccaatttggctgttcatgctgattgttctgggggctacttactggctgaaccgcaacaccaagcattggacattactgatttttgaagcgattggtctcctttacatttggaatcaaggtttctggcgggatatgacccagaccctcacactggttctgacatccagtttgattgcgttggtgattggggtgccgcttggaatctggatggctaaatccaaagtttttgcggtgatcaataagccaattttggactttatgcaaacaatgccagcctttgtttatttgattccagcggttgccttctttgggatcggtatggttccaggggtcattgcctccgttatttttgcaatgccaccgacggttcgaatgaccaatctgggaatccgtcaagtgcccaatgacttgattgaagctgcagattcgtatggatctactggttggcaaaagttgtttaaggttcaattaccgttagcgaaatcaaccttaatggccggcgttaatcaaagtatgatgctgtcgttgtcaatggttgtgattgcttcgatgattggggcgatgggacttggaaacaaggtctactttgccgttggtcgaaacgatgctggtggcggttttgctgccggtttggcaatcgttattctggcaatcatccttgaccggattacacaggcgattaaccgaacaaaagtccctaagtcatagaagggggttactatgcgaaaaaagaacaatcgatttctattaaccattgccttgttcttctcgatgattctcctttcggcatgtggtagtaagcctgctcggtatcatgctaacgaaagccttggcaagcagatcaactacacaattaccgggattgaggccggtgccgggatcatgtccagtacgcagaaggccatgaaggcatatggtttggacaaaggtaaatggcagctgcagaccagttccaccgcggcaatgaccagtaccttgggtaaagctatcaaaaatcatcagccgattgtcgtaaccggctggactccgcactggatgtttaccaaatacaatttaaaatttttgaaagatcctaagaacgtatacggcaaagccgaagacattcacaccatcgttcgaaaaggattgaagaaggacaaaccacaggcgtatgaaatgctgaaccgctttaattggcggccaaaacaaatggcagatgtgatgttgaaagtcaataatggagaagatccacataaagctgccaatgattggatcaaggccaatcaaaagcaggttgatacctggacgaagggcattgcccacgttcatggtcaatcgatcaagctgacgtatgtcgcctgggattctgaaattgcctcaaccaatgtggtggccaacgtattgcggtcattaggttacaaggtggaaatccaagcaatggaagtccaaccactgtgggcatcaattgctacaaatgcagcggatgggatggtaagtgcctggctgccgacaactcagggactgtattataaggactacaagggcaagtttgacgatttgggtgtcaacttgcatggcgccaaggtcggcttggctgttccaacgtatatgaagaatgtgaatacgattggagacttgaagtagagtgcgagtcagcccggttagccccggtgtataaggccgaagggcgaatggataagcgatgtgtgcttatcgatttgcgcttcggccttatacgttaggggctgggctgaggagcacatttcagaacagagtgcgacgagacccgggtgatcccggagcataaagtgaacccttcaataaggcgtggttctgtgccttattgaagggttcgctttatgcagtcagtagggatcagggtcgtcggagcacattttcactatgtaagtagggacaaccaaggctcggattatcgatatctccaccaaccagctcgtttaacatgcacaagcaaccatggatgttttcaacaacagaaagtaaaactaatcaatattcccacctcccaaaagccaccgcccctcaaggacgatggcttttatcaatccactaaaagctcataagttcacataacagaacaaaatttcaacaaacatctttacatatgttctaaattcctgtaaactatccttgtaaagaaatgaaaggggttacatgaccatgacaaaagaaatcacgaccgctcaactcgcaaagtatttggaccacacaaacttaaaaccagaggcaactgaggccagcattcgccaaacttgtgaagaagcaatcaagtataatacggcttctgtttgtatcaattcacactggattccacttgccgccgaacttttaaaggacacaactgttaacccaattacggttgtcggcttcccactcggagcaaccaacactgaaaccaaagtttacgaagccattacggcgattgatgacggtgccgaagaaattgacatggttttaaatgtcggtgaactgatcggcggcaatcttgattacgtcactgccgatattcaagccgttgctgaagcggttcatgcaaagcacaaaatgctcaaagtcatttttgaaacgtcattattgaacgatgagcaaattgtcaacgcctgccacgcttccgaagctgccggggctgattatgtgaagacatcgactggctttagcacggaaggggcaacccttcataacgttgccttaatgagaaagactgtcggcaacaagttgggcgttaaggcttccggtggaattcattctcgacaagaagctttggcaatgatcgaagctggtgccagccggttaggtgtcagcgcaaccgtcaagattttatcttaagcagctggttgtaggggaggaatttagatgacagttaaaaaatataaacgtatttttggcatcgtaatggactcggttggaacaggcgaagcaccggatgccgctaaattcggcgatgtcgggtcagacactttgggacacgttggcgaagcttatcagggaaagctgcagattcccaatttacaaaaacttggcatttccaatttgcgccaaacggcaattgaaggagtcgacaaagtgacttcaccaatcggctactatggtaagatgcaagaaatttccgccggcaaagacagtatggacggccactgggaaatgatggggttgccggttgaaaagcccttaaacacctttccaaatgggttcccagaagagattctcaaaaaattggcagatttttcaggccgtaaaattattggtaaccggcctgaatccggcaccaagattattgcggaactcggggagcaacagatgaagactggggatctgattgtttacacgtccggtgactcagttctccaaattgccgcccacgaagacgtcatcccgcttgaagaactctataaaatttgcgagtatgccagaacgttggtcaacggtcccaaatacacggttggccggatcattgcccgcccatacgttggtcaggataaggatcatttcactcggactgccaaccggcacgacttcacgttggagccgactggcacgactgatttggacgacctgcagaaggcgggggtccacaccgtcgggatcggtaaaatcaacgatattttctcaggccacggaattgatgaaggctaccataatgaaagtaatatggacggcatggatcacgttgaccacgtaatggcagaagactttaccggcttttgcttcaccaacctggtcgactttgatgcaatgtacggccatcgccgcaatccaatcggttttggtcaagctttaatggattttgacaaacgtttgggaacggtgctgaagaatttgaaggacgatgacctgttgctgatcacggccgatcacggcaacgatccaggttttaaaggtaccgatcatacccgcgaactggtgccattgctggcctattcaccttcaatgcaacacgctggcagcttaggcatccgtaaaacctttgccgactttggcgcaaccgtgctggataactttaacgttgccggcaacggggttggcgatagttttctggctgatttgaaataaacggaggcaatcatatgagtacacatattggcgcaaagcccggcgaaatcgccgacacagttttaatgcctggagatccattgcgggcaaagttcattgctgaaacctatctggataatcctgtccgctacagtgaagtccggaatatgttcgggtatactggaacttataaaggtcatcggatttcggttcagggatctgggatgggaattccgtctttggccatttatacgactgaactcattaaagaatatggggttaagaccatttatcgggttgggtcctgtggcgggatgagtccggacgtaaagatccgtgacgtcattttgggccaatccgggaccaccgattcatcgatcattcaaaacacctttggtccaggaatgtactactcgccaattgctgattttggcctgctggattctgcttaccataccgcgcaagaaatgggcattaacaccaaggtgggtaacatttttgccgctgatcgtttctacaacgatgagttggatattcacaaattaattgattacggcgttttggcaactgaaatggaaacctccgggctatatctgctggctgccaaacatcacattcgcgcactgaccattctgacggtcagtgatcatttgctgaccggcgaagccctctccgccaaggaacgggaaacgtcatttgacgagatggccagattatcactagaaaccgccattaaaaatatgtcataaagagaaattggagcgatcacatggatgaaattaaggacatcaccaaactcaaacaaagcttgcgcgtggcagaattatactttcaggataatttgagtcaaatcgaaattgccgctcgattgggggtctcccggccgacggtgtcacgattgctgcaatatgccaaggataacggtttggtgaagatccagattgtcaatcccttggttgattcgcaggtgttgtccaaacagctgagtgataagtacggaattgaattccatgtggtgccaaacaattacggcgggaccgtcagtattcaagatggtgttggccgctataccgccgactttttgtctgccaacgttcaagctggtgacatcatcgggattggctggggggaaaccatccattcggtcaccaagcaactcgaagagcaggatgttgccggcgttcaggtggttcaactcaaaggtagtatcagtcattcccaggaaaaaacttgggcctatgagtcagtcaatgaattggcgaaagcctatcatacccatcccgagtatctgccgctgccggtgatctttgataaccaagtcactaaggaaatggttgaaaccgaccggcatatcaagcacattcttgatcttgggcgccgagccaacgttgccttattcactgtcgggactgttcgatcagaggcattgattttccaacttgggtacttcaatgatcaggaaaaagctgaaattcagcgactggctgtcggcgatattttttcacgctttgttgatgaaaatggccaaattgtctcaaaagaaatcaacgatcggaccatcggcattcagctggatgatttaaaagataagccacacgcaatcttggtcgccagcggcaaccgaaaggcggcagcagtccatgcggcaatcaatgcgcactacaccaattgcgcaattttggatcaaagtttggcacaactcttactagattattaacggcaacgcccaatccatatttgaaccaatcagggttgggcgtttgttcaattctcaaatgagaacgctttattttaaacgaaatatcaaaggagaatcgacaatgagaatggtagacgtgattcacaccaaacgagctggcaaacagctgacagatgagcagattcaattttttgtcgacggggtggtttcgggcgacattccggattatcaaattagtgcgttattgatggcgatctttttccaagggatgaccagcgaggaacaagccaaattaaccatgacgatgatgaaatccggtgaccacttggacttgagccaaattcccggcgtgaaagtcgataagcattccacaggtggggttggcgacaagaccagtattccattggcagccgtggtagccgctcttggaattccggtaccgatgatttccggccgggggcttggacataccggcggaacattggacaagctggaagcaatcccggggtatcaggttgaaattagcgaggatgactttattgcccaacttaaaaaagaccaattggcaattattggcgcaactgggaacattgccccggcagacaaaaagatttatgccttgcgggatgtcaccgatacggtcgactctattccattgattgccagttcaattatgagtaagaagattgcttcgggggcagatgcgctggtcattgatgtgaaaaccggtgcgggagctttcatgaagaccctggacgattcaagagcgctggctaaagccttggttgagattggcaaaggcgtcggcatgcagtgtatggcgctgattaccgacatgaatcagccgctgggtgatgcagttggtaacgcgctggaaatccaagaatcaattgatttgctaaagggcaatgggccggcagatttggaaaaattgatcgtcgtgattggcggctacatggcagttatgggtggccaagcggaaacgactgaagaaggccagcaaaaatgtgccacagtgatccataacggtcaggcgttggagcgattccgcgcaatgatcgcggatcaaggcggcgacccggcggtcatagacgacccggaacatgtcttaccgcaagctcaattcaagattgacctgcccgcaccaagcagcggcgtcgtttccaagattgtggccgatgaaattgggattgccagcatgctcttaggcggtggccggcagaaggccgatgaccagctggactatgcggttggcattatgctgcataagaagattggtgaccaggtcaaaaccggggagtcactgctgacaatatatagcaatcgtgacgatgtcgatgacattaagaagcggttgtatgacaatatcgaaatctctgagtcagccaacaaaccaacgttggtttatgaaacagttgaataaaaacagagtgtgaaagaggacgtttagcaatcgaaatttaagccgctccagacggaaaccgagtcaggttttcggctggagcggcttaaaatttagttgctgtcctctttcacacgtttaaaccaaataaaagtaagacaccaggaaaccgagttaggttttcggctggagcggcttaaatttcgattgctgtcctctttcacaggtttaatccaaataaaagtaagacaccaggaaaccgagtcaggttttcgactgaagcggcttaaatttcgatggctgtcctctttcacacgttttagctagataacagtggaattcacaaaagtcgcacaccagcgaagccgagatataaccgataatgagttatgtctcggcctttttgttaggccaacccgcaagttcaaaagaaagacgtctgccatttccggacgactagtcacagaaggccttttgtggtaaacttcagaaacgcaacacgtggtattgaaatttagtttgatattcaaactaaattaggttattatgttgtgtgttccgaaaagaacctcggtaaatgtcaattttgtgcgtttagttttagctaatagtttgatagtcgaactaaattttaattggcattgaccaccctgtaagtgaaaggaagaaatcaatgagtgtattagatgcatctgaaattatggatttaattcccaaccgatacccaattttgtttatggataaagttgatgaattaaaccccggtgagtcaattgtggttaccaagaacgtcacgatcaacgaggaatttttccagggccatttccccggaaatcccgtgatgcctggtgtcttgattattgaatcattggctcaagcggcctcaatcttgattttgaaaactgaaaagtacaaaggcaaaacagcttatcttggcgcaattgacaatgccaagtttagaaaagttgttcgcccaggggatgtcttaaaacttcacgttaccatggaaaagcagcgtgagaacatgggcaaagttaagtgtgaagccaaggttgacgacaaagtcgcctgctctgcagaattaacctttattgtccctgatccaaagaagaaaatttaattatcagtctaggggagctaagaaatgaattcgcaaagtgatgaaataaaaaaagataccgactttatcaatgagtcgctcatcaacgtctacgacagcatcatgcggattgaggagagcgaaattcgaaaaagtcggttcaaagacattactgcgaaggaagttcacttggttcataccattggcctgcatgatcgaaagacgacctcggaagtggcccacattttgaaattgagcaaaggaactttgactgccaatttgaataatttggaacgtaaagggtatgtgatgcgaatcgccaaccaggaagatcaccggattatcaatctgggattgaccagtaaggggcgattgttgtatcgggcccatgacgcgtttcataaattgttggtcaaacggttcttgaggggctttgacgatgacgacattcggttgatcaagcaggcgatggttaacctggaagactttattgatgaggtatctgcaaaatgacctttgaagatttcaaaatcattgagactgccagttcagttccacagcgcgtggttgataacgatgagctttcatcgatgatggatacttctgatgcgtggattactcaacgaaccggaatcaagcggcgtcacgttgccgtcgaagagacgaccagttcactggcgaccgcggttgcgacaaagctgttggcaaaaagcggcctcaaacccactgagattgatctaatcgtcgtcgctaccatgtcaccggattatttgacgccgtcagtcagtgccatggttcaaggcaacctgggtgctgatcaggcgattgcctttgatatcgacgcggcctgctcagggtttgtctacggcttgaaggtcgttcgtcagatgttgaaagctgaccggccgatgcacgctattttaattggggccgagacattaagtaagcttttggattggcatgatcgttcgacgtccgtcttgtttggcgatggcgctgctggggtattgatgaccaaccaatctggtgattccggttcgtttatcgctgaagacttgaagacgctgggtaagttgggtaagcatttaacggctgggcaggttggcgttaagtcaccatttgctgcaccgaaaaccagctactcgccatttttcaaaatgaatggccatcgcgtttatggtttcgcggttaagaatgttcccgaatcaattaaccgtgcccttgagaaagcaaacctgaccgttgatgacatcgactgcttcgtcttacatcaggcaaacgaacggatcatcgaaaagattgccgatactttgggcgcttcaatgaatcaatttcccgtcaatatcaatgaatatggcaacacatcagcggccagcgaaccgattttacttgctgagctggttgccaaacaacgcattaaaaggggggatgtcatcgccctatccggatttggcggcggattaactgttggcacaatgattatcaagtactaaaaataaaaattggaataacataaaatttggaggaaattaaaatgactaaagaagaagtatttaacaaggtaaaagatattatcgtggaccaattggacgttgacgcagacaaggttaaggaagataccaactttaagaatgaccttgatttggacagcttggacatctttgaagttgtcgacaagattgaagatacttatgatattgaaattgacaccgatgaaggtatggaaaccgttggcgagttggttgattacgttttaaaacaacaaaccaagtagtcagaaagtaggcaggtagataatttgaaactaggatatttatttagcggtcagggtaaacaatttgccgggatgggacaggatctctaccagcaggagccgatttaccgtcaaacaattgaagaagcttctcagatacttggaaaagacatgagtgattcaaagatttttgatgatcccgccaatacacaagtttcaattgtcatcctgagtacaggaatttatcgaattctggcacatgatttagggcagccagtcggcgccaccggattgagtttgggcgaatacagcggcctgatcgctgctgacagtctgagctttgaagacggtctgccgctggtcggcgaccgcaatcactatatggatcaggctggacagcattatccgggtaaaatggcggctgttttaaaagctaatgccaatcttgtggatgaggcctgccgggtcggctcaaaagtcggaccggtctatccggccaattacaacacggatacccaaattgtgatcggtggatcggcagccggtttaaacgctgcgaccgagtatctccatgagcacggcatcaagcgggtggttcctttgaaaatgaccgtggcttcccatacaccatttatgcaggaagccagcgacgagctgtcaaagcgactgcagacggtcaattttcaagatcccgattttccggtgttcagcaatacgattatcaagccgtttacgcggctgaacgtcaagcaaacgctggttaatcaactcgttaacccaacgcattttaacgaatgcctcaaggaattgttgaacctggatgccaatgttttaattgaaattggccctggtgataccttgatgaaatttgccaagccgctcatttgtaacgctgacaaattccatgtcgatagtgtggaaaccttaaatcaagttcgatcaaacaaaaagctggtgaaataatgacggaaacaaaacaagttgcgttagtgaccggggctgccaaaggaattggtttggcaattgccaaacggttggctgacgatgggatgacggtggttatcaatgcccatcatgaattaagcgacgaagacagtcagcagttagccgctgccgggtattcattcgatgtcttagttggcgacgttgccagtgaagcagatgctgagcaaatgatcaattcggtggttgagaaatacggccaaattgatgttttggtcaataatgccgggatcaccaaagacaaattgctcagtcggatgaaattagccgattttcaggcggtcttggagaccaatttagtcggtgcttttaacatgaccaagtttgcgatgaaattaatgcaaaaggccagaaaaggctcgattgtcaacatttccagtatttccggcctccacggcaaccttggccaggccaactattccgcaagtaaagccggcttggttgggttaaccaagacggctgcccgtgaaggcgcattgcgaaatattcgtgccaatgccgttgcgccaggaatggtcaagacggacatgactgaaaaaatgagtgaacgcagacaaagcgaattcactgatcaaattccactgaagcgcttcgctgaaccgacagaaattgccgatgcggttgcctttttggtgggtaaccaatacattactggccaagtcatcacggttgatggcgggttgacaatttagattgttaaaggagtaattaaatgagtagagtcgttgttacaggtttgggcgctgtgacgccaatcggcaacgatgttgacagctttcttgaaaacctgtttgcatccaaggttggtatcgccccaattaccaaatttgattcagagcccactggcattacggttgccggtgaagttaaagattttgatcctttaaaacgggttgataagaagtttgccaaacgaaatgacctcttctgtacatatgcgttgtacagtgccactgaagccatggaaaatgctgggttgattgacggtggcgttgaccccgaagaactgggtgtcatttatggttccgggatcggtggcttgacaacaattgaacaacaggtcattaagatgcacgataagagtcccaaacgggtgtcaccattattcgtgcctgactccatcattaacatggcggctggtaacatttcaattgcctttaatgccaaaaataccagtcaagcaatcgtaactgcctgttcttcagggactaacgcgattggaaacgcttttgaatacatcaagcagggcaaggcccaagtcatgattgccggcgggacagaagcttccgtcaacgaaatcgggattgccgggtttgcggctttgaccgctctttccaaggaaaccgatccgaaaaaggcctcaattccatttgataaagaccgtaatgggtttgtcatgggtgaggggtcagcaaccttaattcttgaagattacgatcatgcaaaagcccgtggtgccaagatcttggccgaagttgtcggctatgggacaaccagcgatgcttatcatatgactgcgccggacccagaaggtaagggtgccaaacgcgccatgcaacaggctgttaaagaagccgggattgatgaaacccaggttgattacatcaatgcccatggaaccagtactcacgccaatgatagcgcggaggccaaggcgattaacgaagtctttgccaataatgatcatgtcaaggtcagcagcactaaaggaatgaccggccatgcattaggggctgccggtgccattgaagccgttgcaacaattggtgccattttgcataaccaaatgcctgtcaacgtcggtgtggttaatcaggatgaagaatgtgacgtggagctggttgacgacagcaataaaaatgccgaagtcaactacgccatcagcaactcgtttggttttggcggccacaacgccgtaattgcatttaaagggtgtgattaggtaatggatgagaaagaaattgaacgtttattagataaatttgaccgttcgtcactgaagaactttgaattggctcaagatgacttcaagcttaagttcagcaaacgggagggcgatgaccacgccgtcgtggaagattctgcgcaagcggcatctgccagcacaaatggtttaggccatggacaaaatagtcaaccaaccacggtagagcagccagaaacaccggtcgcccaaaacgttgccgaaatcaaggcaccgttggttggcgttgtgtattttgccccaagtcctgacaagccggctttcaagaagcagggtgaccacgttgaaaaaggcgatgtggtttgtgtcattgaagcgatgaaaatgatcaacgaagtcaaaagtgatgtgaccgggacgatctccaacattttggttgaagatggcagcatggtcgaatacgatcaaccaatttttcaagtaacgaaggggtaatgagatgaaaccagatgttcaagatgtgattccacagcgctaccccttccaaatgattgacaagtttattgatgtcaagccaggggagagtgccgcggctgttaaattaatttcaattaatgaatggttttttgccaacaaacaagccaataacctcgtggtcccacggccgattatgatcgaatcgatggcccagaccggggtagccgcaattctgtcaatgccggaatatcaaggcaaaaacgccttttttggcggcatcaagaatgcagtcttccaagatgatttccgccctggtgacaaattgacctttaccgtggaattaaagaagttaaagcacaatatcggccttggccacggcaccattcatcgagaaggacagcagatttgtgaagcagatttaatttttgcagttgagtaatagaggtgagcgcatgtttaaaaaagtattagtggctaatcgtggggagatcgccgttcaaattattcgcgctttgcacgatatggggattaccgctgttgccgtgtattccagtgccgacaaagacgccttgtttgtccatttggcagacgaagccatctgtatcggcgggccgcagcccagtgaatcttatttgaacatggcccagattattagtgccgccaatttgaccggatgtgaagcaattcaccctggctacggattcttatccgaaaatgccgagttcgcagaattatgcgaaacctgccacattaaatttattggtccaagccatgagttgattgctctgatgggcgacaaggccaacgctcgagaagcgatgaaaaaagccggggtccctgtgattcccggaagtgacggggtagtcaataccgttgcccaagccgaacaagtcgctgaccaaatcggctttccggtgttgttgaagtcagcagccggtggcggcggtaaagggattcgtgaagttgatcgacctgaagaactcaaaagtgcttttgagcagacccagcaggaagcccgaatttcatacgacgacgaagatatctatgttgaaaaattgattcgtcaggccaaacatgtggaaatgcaagttatcgccgataattttggtcacgtcgtttatctgccggagcgtgactgttcactgcagcggaatcatcaaaaggtgattgaagaaagtccctgtgttttgatttcagctgaagagcggcggcatttgggtgagattgtcgccaacgccacgcttaagctgggatataccaataccggaacctttgagtttctaatggacgatgagcatcacttctatttcatggaaatgaacacccgacttcaagttgagcacacaattaccgaagaagtgaccggaattgaattggtcaaagggcaattggcggtggctgccggagaagaactgccgtttacccaagccgatgctgccgtgaaggggcacgccttggaatgccggttgaatgcggaagatccgactaacaattttgccccgcaacccggtcagattaatcatttatttttccccgccggttcactcggcgtcagaatcgattcaggtgtcaccaatggcagctttatttcgccgttctatgattcaatgattgccaaagtgattgttcatttgaacgatcgcgataccgttatctcaaagatgcaccgaattttaggggaactggaaattgacggcattcggaccaatcaaagctttttggattacttgattggcaccgacaaatttcatcaggggatttattcgaccagttacattcaaaatgaagtgttgagcgataaggagggattccatgctacgcagtcggtttaatatgccaagccatgaagaactggtaaagcggatggatgccattcccgatcatgtgctgcgggaatgcccaatttgtcacgcaacctttttttcattaagggctggcagcacgaaaacctgtcccaattgtggctatggttttcgaatcacggccaaacgacgggccaaaattacctttgattcatttgatgaaattgacaaatcaatgacggttccggaccagtacaccgatgaaaagtatttggccaaagtgaaaaaggctaaaaaagtcaccggaatcaacgaaagtgtcctcacgggtattggcacccttgataagcagcaagtcggtgtgggcatcatggatccattctttgtcatgggcagtctgggaagtgcaaccggtgagaagattacgcgattgttcgaagaagcgacccggaaaaaattgccggtgatcatgtttaccgcttccggcggtgcccggatgcaagagggaattcattcgctgatgcagatggccaaagtatcgggggcggttgcggaacacagccgggccggcctgttttatgtcgttgtcttatgcgatcccacgactggcggggtcaccgccagttttgccatggatggtgatgtcattttagcagagcctcacgcgttggtcggatttgccggccggcgagtgatcgaacagacaattatgcaaaagcctcccaaagactttcagagtgctgaaacggtgatggctcatggctttatcgatgcgattgtgccgcgtaaacaaatgaaagcaactttgagtcgcttaatttctctgcacacaaaggagaacgtctatggcagataaaacagcatatcagcgggtgaaagcagctcgccgtcctgataaaatcacgactgccgagttgatcaatcatttaaccagtgacttttttgaacagcatggcgatcgactggaagctgatgacccggcaatcattggcggtattggcttgttgaatgataaaccaatcacagtagtcgggattcaaaagggatcagataccgatcagaatattgccagacattttggcagtccaacgcctcaaggttatcgcaaggcgttgcggttgatgaagcaggcagagaaatttcatcggccaattttagcgctggtgaatacccccggtgcttggccagatgttgaatccgagtatcatggtcaagggtccgcggtggcacaaaatattattcaggggatgcagttaagggtcccgtatatcaccattattgttggtgaaggcggttctggtggtgctttggcactgtcctgcggcgatcgggtcttcatgtttgaagacagcatttattcggtgctctcaccggaaggatacgccagcatcatgtggaaagattcatccaaggtcaaggaagccgcagaagaactcaaattaactccagaagcattattagcagatggcattattgataaaattattcatgagtatcaacccggggaagatttgagtgcgttacgtgacttcttggatcaggaattttctcaattggccaagttaccaattgatgatttggtggaccgtcgaaataaacgttaccggaatttttaattgaagataagatttggaggctcaaatatgagtggctttttagatggaaagacaatcgtcatcatgggggttgcaaataaacgcagtatcgcctggggctgtacccaagcgattttggatcaaggcgccaaggttattttgacctatcaaaatgaccgcattaaaaaaagtctggaacgctttgtgccggacgacttggatttaatcgagtgtgatgttgccgatgacgcaaacgttaagcaggcttttgaaactatcggcaatcagtatggcaaaattgatggggtcattcacgccattgcctatgctgacaaggatactttgacttccggactggtcaacacgaccaaggacggttatgatttggcacaaaacatcagtgcttattcactgattgccgtggcgcgttatgcccaaccggtcttgaataatccagccagcattttaactttgacctactttggctccacccgggcaattccaaattacaacatgatgggtgttgccaaggccgctttggaagccaacgtgcgttacctggcatctgatctcggcgaaaatggcattcgtgtcaacgcaatttctgccggcgcggttaaaaccttagcagttactgggattaaacatcatggtgaattgttgaaggaatccgagtcacggacagttgatcaaaagagcgtcaccaccagtgaaattggtaacgtcgccgcctttttgatgagtgacctttcaaccggtatgaccggtgacgtggtctacgttgataaaggtgtccatttaatttaacgacgattgtaagtgggggatggccaatggtcaatcatcaaagacaaattttagatgcattgctaacggcggctggccgctatgtttccggcaatgaactggctaagaaactgcaaattagtcggccggccgtctacaacaatattcaaaaattatcgcactgcggtcatgtgattaccacacgcaaagggctgggttattgttatcaaaaatcccaattttttgatgatgctgtgatcgaccattatcggacaaccactttcccggtggcgatccatgcgtttgccagcatttcctcaacgaacgattacgccaagcagtttggcagcagtcaggactttaccattccacaggtgtttgtggctgatacgcaaactcaggggcatggccgactggggcgacatttctattcgccggcgaagggtggaatctatttgagcattttgattcctttacagaatcgccgaaccattcactctgggttgataaccaccggaaccgcggtttgcgtagtccgaaccctgcaacagttttttcccgatgaggactttcgggtcaaatgggtcaatgacattttggtccatgataaaaaatgcggtggtattttgaccgaaacgatttccagtctcgaagacggtcttcatgaaaatgtggtggtcggaattgggttgaatattgattccactgattttcctgatcaaattgcccataaagccggggcaattgtgaccaacacagcaattgacaagaatcggattgctgccagtctcatcgacaactttttttatatgtatcaaacttacaccagtggtaatttcctccaggagtacgccaagttatcagaaacccttgggaaacgagtccaaattgtgatgggaaatcgaaccatcactgggctggccgatcgttttaccggtgatggtgccttggtggtcaagcaggattccggagaacccattaccgtttcgagcggtgaagtgacgaaagtttatctgcctggaaatggttattcaggctaatttaatatccaatgacggttaagcggcgtatagaagtcggttaaccgttttttgaaaggaaaatgatatgaaaattagacaattgacgcaaacggccttgatgatcgcagccattatcgtattggggatgattccaccaattcctttagggatcattcctgtgccgattgtgatgcagaacttagggattatgttggcaggcctctttttggggtcaaagaacggcacgatcgcagttggggtattcttactgctggcatttttaggtttcccggtcctctccggcggtcaagccggcccagcagtctttatcggccccacagcgggctatttgttcggttggctcataacacctctcatgatgggttatcgccgctcgcggccgtttatgagccattcatggggtcaactaattgtcatttggatcagcggtgttttgatcgttaacctgatgggtgccctctggctgtggtgggtgacgccaatctcactgatcggtgcattgacttcaggcctgttatttatccctggcgacacgctgaaggcagttgttgcatacttggtggctgtccgaatgaaagtgctgagtcgagcagctaggcaggtttaattgactggatacaaaagactcgagcaaacatgattggtttgctcgagtctttttggagtttgtatgattgaagtggtgcttaaaagctgggcgcctgggggcacactctggttaaaatgtgttctctcaggcagctttttccgcttagtccaatacaggccgtcaacgcaaaaccagcgttaacggcctgtattaaactaatgctcaaaagctaaccgcctgagctcacactctgattaaaatgtgttccccaagacagcttcctccgctttatccaacaagcggtctgatgctaaaaccgcatcaaaccgcttgttaaataaatgctcagaagctaaccgtcttggttcacactatgattaaaatgtgttctctcaggcagctttttccgcttagtccaatacaggccgtcaacgcaaaaccagcgttaacggcctgtattaaactaatgctcaaaagctaagcgcctgagttcacactctctcattaatggaaaatcaagttcagtcccataaccatgatgataccaacgacagaaatgattgattccaacacggtccaagtctgaagagtttgcttaattgttaaatcgaaatattctctgaacatccagaagccggcatcgttaacatgtgatgcggccaatgagccggcaccaatggccagaaccatcaatgctgggtcaaccccagcttgggccatcaatggggcaacgattcctgcagctgtcaatgaagcaacggttgcagaacccaaagcaattcggagaacaacggcaaccaaccagccaaggattaatggtgaaattggtgaaccaatgaacagttgagcaacggctttaccaacaccaccgtcgatcagaacttgtttgaaggcaccaccaccaccaataactaatagcagcatggcgattgatttaaccgcattttcaagggattccatgatttgagcagtggttcgtttacgaccccagcccatggtatacattgcgaagaataatgaaatcaacattgcgatacttggagatccaatgaattcaatgattgaatcaatcacagaagggttctttggatcaactccaccattgacggtcattttataaattgtggcaatcgccaacagcagaactgggaacagggcagttaatactgacagtccaaacgatggtgattcttcaggggtaaattgtttaacttcaccgatcgaagaaaggtttccttttcgctcgaatgcagcgggtgcaaatttacgagccatctttgagaacaatggtccggcgatataagcggcaataattgcaatgacaaatccaaacaggagaaccttaccatcgttggcacccaagacctgcgcaatggcaactggtgctggatggggtggcaaaaatccgtgggtaactgacaaggcagcggccattggaattcctaaataaagaattggcacaccggcttcaacggcaattgcgaagacgattggaaccagtaaaaccattccaacttcgaagaacaacgcaattcctaaaataaatgaagccaacataacggcgatctggaggcgtttcttaccaaatcgtttgatcagcgtttcggcgatcatataagcaccaccggaatcagaaaccaatcgccctaacatggcaccaaagccgaagaccatggacaattcgcccagttgacttccaataccatttgagacggaatcagcgatcgtacctagtggcatctgcagcatgatcgcagtaacgacagcggttaataccaacgaaacgaaggtattaattttgaacttgataatcagaaccaacaggaaaataattccgatcagcaaggctagcagctttaatatcatagttttcccctttcaaataaaaacggacaggtgctattcagacttctcggcgtcttcatcttcgtgttcgtgacgacgctgatactcggcgatattcttgtattcgggttgaagtgaacgacttaggcgaatatagattggaatcaattcccggtacgcctggaagttctttggatctgggtgatggacaaccgtggtgccgacaaaattggaaacgtcggaaaggctgtcaatcaggcccaaactgtacattcccaaagtggctgcccccaaagcggtactttcgaaactttcaggaattgcaacgtcctgttcgaaaatatcggtcagcatttgacgccaaagcgcagagcgggcaaaaccaccactggcttggatgctggttggttgaccaacgacttcttcaagggccaaggcaaccgtgtaaaggttgtagacgataccttccaaaacggcccgaatcatgtgggcacgcgtgtgggtccggttaaggccgaagaatgagccacgggcattagcgtcccagattggggcacgttcaccgcccaggaatgggaagaacagcaagccatcggatccagccggcactttggcagcaatttctgtcaagaggtcgtatggatcgatgtgcatttgttcagcagtgactttttccggggcacagagttgatcacgaacccagcggaagacgacgccaccattattgacagggccgccaacgacccacatgttcttggcgaggtagtagcaaaatacccgggcctttggatcggtatgcggtttatcagtgacaactcgaacggcaccggaagttccaatggtgacagcgacaaccccgggttgaatcgcattaacccccaagttggccagtggaccatctgaagcaccgatgataaatggggtattgatgtcaattcccagcactttagcgtactcttcacgcatcccttttaattgataagtggtgtcaactaaatcaggcaattgatcccgtgtaaccccggcaagtttcagggcttgttcatcccagtccatattgtagatgttaaacattccggtggcattggcgattgagtaatcttcttttaagacaccgaataatttgtaaagaatatattccttaatgccaacgaaccagcgggcttgcttgaatagatcggcatgatcattgcgcagccaaatcagtttggtgagtggggtcattgggtgaatgggcgttccggtatgcttatagatttccattccctcagggctggccttcaacttatcagcataattgaccgcccggttgtcaccccaggtaattgcccgggtgagtggtttgtgattctcatccagaagaattaaactatgcattgcacaggaaaatgcaacgcccttcagctctcctggtttcatattggcctttcgaaccaattcggtaatgccgtcagacatcgctgaaaagatttcttcagggtcttcctcggccatatcaggggtgtcctggtataggggatatccattgttggaatatccatgcaccttacccttaacatcgtagagcacggttttaacactggttgttccaatatcaacacctagcgtataatccatgtaaataacttcccttctgtattagttgagtcaacggccgaagcgctttcaaataatggcaaaaaatatagctgcatcgttaaaccaatgtcgagtgctgaagaattggctcggtaccgcttctcactaaaaatatcattatcaccgggagacttcaaatatttcgaccattgaatttcctggtaatggaaacgcaaacacaattatatgaaaaacaatttcacaatgcaagaattttgttgtaaaatatttacattgatgaaaataagacacttacaatccatgaaaggtgatcattatgagctcgccagttcaattattaaaacaatcgtttgatgaattaagcagaaccaataaaaaaattgcaaaatatgtgatggagaatcctcaagcggcctcagaagccaatattgaagatttggcagaagtgactgaaacctcaactgcttcggtttcccggttagtgaagacactgggctatggcaatttccgtgagtttactttggcgctggcctacacgcagttgcggccccagaacctgccgatttttaaagatatcgatgccaacgattctttaggaacgattgccgacaagatttttaacagcagtcagcgggcaattcaagatacccgggcaggaattgatgaagatgaatttgctcgggcagtcctacgaattattcattgtcgtcgtctgggcttatttggccttggcggctcgtcagttgcggccctggacggttatcataagttcttgcggacgtcgattgactgcttctattatccagactttgacgtacagttgatggaagctgtaaaattgggtgaagaagattgcgcaatcgtggtttcccactcgggcaaaaatcgccaaactttaaaagttgcggaaaccttaaagaagcgaaaggtgccggttatcgggattaccagctatccggactcaccgctcgcactgcatagtgatattacatttatttcgtctagtgatgaatccaattaccgttctgaagggatgtattcactgcttgcccaactggctattgtcgatacgttatttatgatggcaacggttcggatgggtccggcgacagaagacgcgattcgcaacgttcaaaatattattgaaagtacccggacttaatttaactggatttttcgggtaactgagatgacctttatatgaagcgaagagacattcaaccaatatatgctgaaacttaccagcgcaggaaacgcacacgcagggtagttttcggcatttttttgttaatcttgattggcttttcgacctttttgctgttgcgctggcacgaaaatcagcagctgaaaaaatacccaattcatggggtgaccattgatcaaagtaatggctatatcgactttgaaagcttgaaaagtaaaggcatcagtttcgtctatctaaaggccactcagggagctgccttcaccgatgacagctttcagagtaatttcgaacgcagccagggttcccagttgccgattggggtctaccattattttagttttaccagttcaccaactgcccaattcaaaaactttgtccggcaagtcaagtacaataccggtagtttaccgatctgtattcaaattcagtattacggaacgtttgatcagtcaacaattcattggcaggcggccagaaaagaagtccggcagctttcgcacttgttaagacagtactataaacggccggtggtcatttcggcgacccaacaaatcatcaagagcctgcagttaaaggcgaatgctaagacccaattctggttgactgacggtaagatcggccggcccaatgccgatgcaacatttattcaggcagacgataaggccggctttaagcttgactcgcaactgatctttctgccgatgtcggtctttaacggtaatcgcagacagtggcgggaatacatcaattaaagcgtatggaacaggccaaaacaaaaaggccttaccacagtaagtcctcactcaatttgactgttcaatttcattggccgattgtaaatcataggtatagttttcagattcatcgtagaatttgattggccgggcttcattcccccgaatttccaatttataaccaaatttgtcaacgtacgacaattcatatctggttaataatgaaaccttggccgacatatcttttccgtcaatgagcaattttaaatccgggtcgatttccagtcgatggacacgctcccggtggtccttaaactgccaggttccaacgaaaaacattgggtctgcaggatctggacggtgttttggtgtccgtttggtatggaacagactaattaaaaacgacaccataaaaataaaaaaacttcttttgcgcaaaaaatcatccccctagtcatagtagaaacccagtatagtcgataaatataacagagagtgtctgatttcgttttcattgggttaaaaccttgttacaatttaattaaagaagggcggttatcaaattgattaaattaggaattattggaaccaactggattacccagcaatttattgacgcaattaaactatcacgcaaattcgacttaaccagtgtctattcacgacacgaccaaacggccaaaacttttgcggccaaaaacggcgcccaagaaacctttacggatctgaatgcgttctttaccaaggggcagtttgagacggtctacattgcctcacccaatagcctccattttgaacaggcccaaatggccattcaacacggcaaaaatgtcattgttgaaaagccggcctttagtactcaaaaacaaatggcgaagattcaagctttgttggacgagaatccacaagtgctctattttgaagccgcccgcaatattcacaccgaaaattttcatgcgatcgaaaaaaagctcggtcaacttaaaacggttcaaggcgctgaattcacgtattcaaaatactcttccaggtatgatctggtgttggagggtgaagaacccaacgtcttctcactcaaatatgccggcggtgctctccaggatttgggcgtctataccgtctatgatgccgttgccttgttcggaatgccggaagaggctgcttattacccacagctgattcgcaccggggttgacggaaaaggaacagcaattttgcagtatccggagtataatgtgactttaaacttctcaaagatcaccaactcacatatgacatcggagatttacggcctcaaagacttaatcgaaatcgatgatgccggagaaattaacgccgtcatttacattgatgacgatcgcaacaagcaggtcattggcaacactattgatgagaatccgatgctgccagaggttgaagatttcgccagagtgattaacgatccaaagaacccgcaaaacaaacatgattatgactactggcgccaactcagcgtgtacgttaataagttaatttataatcttagacaggatgctcacatctcatttgtgggcgagaaaaagtaatcgattagaaaatggagaaccatattgatagaagaatttaagcaacatgccaaagaattaggctacaatcagccgactgcgattcaacaagcggtttatcaaccactcaaggacggtcaaagtgtcctggggctggcaccaaccggatcggggaagacagttgcctttgccctgccgttgttggaaaatattcaacctgaagacgggctgtcattattagtcattgaaccatctgccgaattggctatgcagacccaaaaagttttattggaatggggtaagctaatcggcttatcagttcaagggattatcggtggtgccaatatcaatcgtcaagttgataaattaaaacagcacccaaacgtgattgtcggaacgaccggtcgaatcgtgaacttaatcgatttaggcaaacttaaattggattcactgaaggcgatcgtgatagacgaagccgacaacttattaagtgaagatacgcttgcttccatccgatcattggtggatttggctgacgactcagtgacgctgggctttttctccgcaacccaaaacgacttattggcacatgtgaatcgctggtttggtcaagatattcagacctttgatgtctctgacattgacgatacccgcggggaagtcaaacataccttgctggaagtttccaatcggaaaaaggctcagatgttattgcggttccttcacatgaaggacttcaaggcattagtgttttttgaccaattggataccctgcaaaaagtcgctggtttcctgtctcatcgacacattaaagaggctgcacagctgaccagtgaacagcggcaaactgccagacaaaaggcgcttcgcgattttcgcgatggcaaaattcgcttgttattgaccaccgatgttgctgctcgggggatggatattgaaaagctgcccgtcgtggtcaattttgatttgccgtctgatccgaaaacttatgttcaccgggttggccggactggccgcatgcatcaagacggcatggtgatcaatatgggtgacgaccacgatttgagagatttaaagaagttggttaagccttacggatatgaattgagcaacatctacttcgatggtaatcagttgtctgatactcgacctaagcagccggttaatttggatgatgaacccaaaacttcaaaggctgcatcgtctcaagatgtcaagcggagcagtgaggctaaaaaaactggccgaaagccaatgcccgccaaaccgcacggcaaaaagaagcacaaacactccaaacgcaagggcatgcaccataagcgcacggagggataatttctctttacagcctctgagataaatgagaaaattgtagtgcagttgttttggccccatagcacaactggatagggcacccgcctcctaagcggttgatcccggttcgagtccgggtggggtcatggcgtattcgatcgcttttacgaaatacgaagtaaaaataagaacgtcaatgatgaatggatattgttcatcattgacgttcttattttatcggatcaattcaatttgattaagcgtcacgttgttcagcacgcgcgacaagatcggctttgatttttggctccatcttctcatacttgagatgaaagaccataatgccggcgacaatcgcgtagatgataaccggcagccagataaaataaaagttaatcgcacctgaagctgctggtgtctgggtcttgttggcgataaagccagtcatatccaagattttggacggaataaaactgccaaagcctgatcccagttggatacagaatgcgctccccacggcggttaagaaaccggggcccgcacgcctgtcttccactcgccaaagtcgaccgtgtcggccaacatggcaaatggcattgacattgccagagccgatcccaaaacgccgatcaaccaagaaacaatcaccaagatgaagttgccgccaaccagtgccatcattgtctggccaacagcaccaattcccaagccgattaacatagttgctgttttgttggtaatcttaacaataaacggaattgcaatgcttgagatgatccccagaacttgtaggccattgaataccgcggcaagttcagtattacccaggttgtatttggcatagtaggtcgagaaactattgcgatcagcctgggcgatccaaaaggtggcaaaagaaatcactaagaggtaccaaggaacgttgccgacagttgcctttaaactttgcttgaacggcagtgatttttggctgaccgggacccgctcacgcatgttcttaaatgccgtgatcagcaagagaattgctgcgacgccaaagatggcaatcgtcatcatgaatccgtgtttgtcattcccattgccaaagaacgctaccagcggcagggtaaaggtactggttacaaatgacccaatcagactgccgaccatccggtaagagttggcgccaatccgttcggtgggatcaagggttaaattcggcaggattgcggaaatcgtcgtttggatgccggtgtagatcactccagccgccaatacataagtaatcccggcatataagagcttggggacacctgaaatattaggagcggtaaatgccaaaaaggtgcttaacgcaaaagggacggcaagccacaaaaagtatggtctgctctgcccccatttagtatgtgtgtggtcaacgattgatccccaaaaaatcgcactgaccgcatcaacaatacaagcaatcaaaataatcatgcctgctgctgaaaccggaatgtcaaaaacatccgtataaaaataaagaatataactggacatgctgacgtacaacaagtttccagccatatcggtgaaagaataactgactttctcaagcgttgataattttgcgtttgcctgaacagcctcttttctgatgtccatcaaaagccgccattcaaatttattaacaagtgatgtttgtcacttcaaatgtttttattatataccaatctaagtgtcgttcaagggcaattctaatatgactaaatactgattggctaaaatatgcgactttaaagcatttggagccaacgctaaattgacgatcactttggcgaccaacaattatttatcaaaaattgaggggatttataatatttaacaattaatttatcagctattgtgaaatcggtttcacatgcctataatgataatgatccaaaaactttaggaggttgacaatttatgcgcagaattaagttccgttggttgatgttgttaggcgtatttgcggttctgggcttggtgattactggctgcggtcagaaaaaatcagcagataagggtccattgacagttgccacatcggggacgctttatccaacatcatttcatgatcaaaagactaacaagctaaccggctttgacgtcgaagttgttcgtgcagttgccaaaaagttggggagaaaagttgatttcaaagaaatgaacgttgatggtcaggaaacggctgtgaagacgggtaaggctgatatggcggctaatgattttgccgtatcaccacaacgagcaaaagagtttgctatttcgacgccttacaagcactcatttaacagtattattgttcgaaagaagggggattcaggcattcattcctgggccgacattaaaggtaaaaaagctgccggtgaggccgggacaggatatcaacgacttgccaagcagttaggcgccaagaccgtcaactacaacaacgtttcaaacgatgtgtatctgcgagacgttgaaagcggcaagactgatctgattatgaatgattactatctgcagaaattagcattggctgccgttcccaacaacactttgaagatcatgccaaacatgtacttcagaaccaatgaagatggcaaaggtgtcggtatcttaatgaagaagggcaataccaagctgcaaaagcaggtcaacaaagccctcaaagagctcaagaaagacggtactttgaagaagctgtcagagaagtattatcacgctgacgttactaaacagccccatgtccacatttcaaagacctttacgattaagtaaggggcggtgctgttggatattattaagtatttatcaattccggatttttttaacgcaccattagcgtttcgttcaattcccagaattttagcgggctttccgatgtcgattggattaaccgcgatcagttttattttgtcattaatactgggattgttcttaacgctggcccaattaagtcaccacaaattgttgcactatcccgcacgggcatttatttcctttatgcgtggagtgccgatgctggttttattgtttatcatttactttggctttcgagccgatgcattgccggctgcggtaattgcttttacgattaactgtagcgcttttgtgtccgaggtttaccgttcatcatttagtgcggttgatcacggacagtgggaggctgcatactcactgggcttaccataccgcaaagtcatttccaagattgttttcccacaagcttttcgaattgcgattccggcgttgggcaacattttgctggatctgttcaaagggacttcgctggcagcgatgattacggtcagtgaaatgtttatggacgctcagattgttgccggtgccaatcaggattacatgaccatttacatcacgattgcggtggtttattggttcttctgctggctgatgacgattggtcaaacccagttggaacgggagttggctcgataactgtgatacaaaaaattggttcaaaaaaggtcgaaacacagattaattgtgtttcgacctttttcagattgtttttacataagatatttggcaaccacgatcaaaattagaatcattaccgcagcgattgccagcagcttgaagccgtcagctttggtgtaatagccttcgggaaattcttggcgttgctgtctgagcgtttgtctgttgatttttggcattaactcaccgtccttgcttgggctggtttctgttggtgctgtttttgaacacggcccattttgaccagaaataattcaagataatcacaacaatattttcgaatattttaaccaaaatttggttttgatgcatcaaagaaataccgatccataacagaatccattcaatgaccaaagtggcgacccgaccgccaaagaacgaacccatctctttcaaatcgctcacaaacgacttggaaggtgagtggaaaacataggctttattggtaatgtaggcgaacaggacactgatgacccaagcaatgaaattattcaccatgtagttgatgttggtaaacagatgtaatcccgaaaaaatggcgacattaacgagggtggtcaagacaccccaaaaaagataggcgataacctcttcgtatttatcatatagcttcttcaatcgatcaatcatattaacgtttctccgcaatcacaaatttagggcgatgcttggtttccagataaatcttgccgacataagttcccaaaattcctaaactaaacagttgaacaccacttagaaacaggataatcgagaccattgatgcccaaccattgacggatccgccaaagaacaaggcccgaatgacgacaaagaacagaccgataatggacaaaaagaaggtcaggatgccgacaaaggtcgctaattttaacggcacatccgaaaaatcgacgatcgcttccatcgagtattcaaataactggaaaattgaccaggaagtctccccggcagcgcgaggaaccccttcgtactcaaggtatttggttttgaaaccaacccaagagaaaagccccttgctaaagcgattgtattcgggcagctttaagatggcgtcaacgtacttgcggctcattaaccggtagtcacgaacgttttgtttcatttggacctttgacattctgttgatgatcttgtagaaactggcggaaagaaatgcacgaattggattttgtttccggctggtctgaacacagccgacgacgtcataatcctgtttgggatcttccaaaatatcgaccatttgcagcaacagttccggtggatcctgcaggtcgacatccatcacagcgacataatcgccatgggcgttggctaagccggcagcaaaggccgactctttaccgaagtttcttgaaaatgaaatgtaatggacttcgtcgggatgctgtgaatgaagccgccgcatcacgtccagtgttttgtctgccgaaccatcgttgatgaacaggtagtcagggtggtagtgttcttcatgggacgcgtttaatttatcgaatactttttctgtcgtgttgtagaaaagttcaaccgttggctcctcattataacaaggaacaattagactgatcgttttcaaaatatttcctccagtacgtttgttaatgactttgcttttgccaatttttattggtaagctggaatccgtttggagcagcagaccaaatcagtggctgaagtgggaatcccacctcgctatgtaaaaatgaacatctaacagattataccatatcatattttttacaaaattaagtagctgttaagtttcttgccatttttgatataattaaccacataaaaggagaattaattgatgaaaccaataaaagtaatgaccatctttggcacccggccagaggcaatcaagatggccccaattatcctactgatgcagcagcatttagacgaattccaacccattacggtcgtgtccgcgcaacaccgagagatgctcgatcaggtgctggatgtatttcatatcacgccggactatgatttaaacattatgaaacagggccagtcattgagcgacattaccacccgggtcattaccgaactggacccgattattgaaaaggcccagcctgatattatcttggtccatggcgataccaccacgaccttctctgccagtatcagcgccttttatcaccaaattaaaattggccacgtggaggccggtctgcgtacttggaacaagctctcaccgtatcctgaagaaatgaaccggcaattgaccgatgtgttggcagacttatattttgcccccacttcattaagcagggataatttacttaaagaaaatcatccagataaaaatatttttgtcaccggcaatactgccatcgatgccctcaagcagacggtgaccgaaaactaccaacattctgtgtttgatgagctgaaggaaaactcgaagatgattctcttaaccatgcatcgcagggagaaccagggtgaaccgatgcgccgaacgtttgaagccattaaagaagtcttggcgaaccatccagacgttgaagtggtctatccggttcacctaagtccagcggtacaaaaggtggctcatgaagtctttgacggtgtcaaggccgttcatttgattgaaccgctggatgttttggacttccataacatgtccgctcggagttactttattatgaccgattccggtggggtgcaggaagaagccccgtcgcttaagaaaccggtgttggtccttagagacactacggaacgacccgagggtattcaggctgggaccttgcggttggttggaaccgatcccaaagttgttaagtcagagatggagcgcctgcttgacgatcccaaagaataccagaaaatggctgaagccaagaacccatacggggatggtcatgccgccgaacgaatcctaaaagcgatccgagaccagttcaactaataattgcgggaagtcgatgcctgatgaaacgattatacgaagccgttaaaaactttatcgaaatcattattaaacgctattcatccggagacgtttccgattccgccgctgtgttagcgttttatacattgctgtcgatttttccaattttcttcattgtcggcagtattttgaacttgtttcatattcatatcactgaagttgaagtctatctgcggccgctgtttcctgatcgaatttattccatgctggaaccgatcatcaattcgaccttgcaaagtgggggtgccagccaattatcagttggtttaattgtgaccatttggtcagccagccgggcgattgcggcctttcagcgcagtatcaataaaacgtacggcgtcgctgccgaccaaacagcaatctcgaatcggctgatttccttcgtttggatgctggtgttggttctcgcactggtggtcttgatgatggtttttgcgtttggccagatgtttttccagtggttaacgccgattttgaacgtcccgggatggatattgaacctgatcagtaccgttaaatggccaggaacaattgccgtttcctggctgctattaagtctgctgttttattttgtcccgactgccaaggttaaattccgctatgtctgggtcggcgctttgatcgccaccttgggcttgatgctgttggcccaagccttcaccgtttatctgaaattcttctctcagagaatcgatgcttataagacaatcggaactttcattgtcttaatgttctggctggacttctccggagtcatcatgctgtttggcggggtggtcaatgctacgattcaagaaattcgccagggcaaaattcaggagcaggaagacgccattgaaaatgtttggaaacgggcccgcaagatcaggaaacataaatgaggccggtcaggtaatcttgacaaccaaagaggagagagtgggactaaaggcgttttgatcccagaatttaaaagcacagatcgattattcctggttttggaatgattgatctgtacgcttaaatggccgggatcagccgattgccatgtaggctaggcaagcatgctggccgtcgtcgcacgttgttgataaataatatgggatcacaaaaaaaggccgaggcaaaagcgtatacttttgtctcagcctcccccattgatgattcaaccgactggttattgattgactttggcaaccagttcggcggtaaactgatccaacttttcgatatctttttggtcgggttccaaattaattttgacactctctgcgcctttggtagccccagtcttttcaaacgcctcttcgaatttatcaaccgatgtgttgtaaaattcttcataaaaaacgtcccctgaacctgcgaccccaaaaatcttaccctttagatcgaggtcggagagatcatcgtaaaagtccattccttcttcgggcaaagccccctcatcataggtgtaagggcagacaacacaaatatcgacgttttcaaaaacggacgggtcagtttgagaaatttcggtttcttcgacttgaacatccgcatcttccaatgcttcagtcacgatgtcggcaatatcttcattgttgccggtaattgttgcgtaaactacatgagcagtaatcatatttttcatcctctatcttaaattgttctcagtataccaaatcaaaatgacaaagtgaatttcaatcacgcagaaaagaaaggacgcttatggcaaaaacaattactaaaattgaagcccagaaacgtaaaggccgcttcaacgtctatgtggacggtcaatacgcctttccaatcagtgaagaagtcttcatcaaatatcgggttttcaagggaatggaactggacgatcaattaatcgaaaccctgaaaaatgccgataacatttccaaacttcacagccgggcgctgaattatctcgctcacaacctgcgaaccgagtacgaagtcagacaaaagcttgctgagctgactgaagatgaggacgccatcgaccaggtcattgatatcctggctgatcaaaccttaattgacgaccaacgatacgcagacagctttgttcgcactgtggtccgtgaacgcaaaaatggcccggattggattcggcggcatttgaaagacaaacacgttgcttccgaccaggcggaaaattcgctgaaccaatattatccggctcaagaggtcattgaaattggcggtgaagttgccgaaaaacagttgaaacgctatcgccgcgattctgccaaaatggccatcaacaagaccaaggagcttttgatgcgtcgggggttcccttatggtgatattgaggagattatgaatcaagtcgatacttcagacatggcaacaaaggatcaagcggtcattgatcaagtcgcagaaaagtattggcgccagtatcgcaaacttcagccctatgaacgcaatcaaaaagtgaaacaggcacttttccggaaaggctttttgatggatgacatcacaattgccatggcgaagctgactgaataaaataatttcgaaaataatgcccactctgatataatgaaaaatggattgggaacaatcgatgtttttaggttagtcagaaagtgggtaccatacatgccacgacttcaaaaattacctggagaaggtcagtttattgcgattcaaagctacaagcatgatggtagcctgcatcgcgtttggcgggatacgatggtactaaagacgagtgagaattcgttgattggatgtaacaaccataccctggtgaccgaggacgatggtcgccattgggtcactcgagaaccggcgctggtctattttcataagcattactggttcaacgtggtggcaatgattcgagatgatgggattgcctactattgcaatctagcatcaccttatgttttggataaagaagctttaaaatatattgattatgatttggacgtcaaagtctttccagacggccggcgcaaattactggatgccgatgaatatttggccttcagtaagcgttggaattatggtccagaaattgatcatatcttaaaacgaaatgtccgcattctcgttgattggattgaaaatgagaagggacccttttccaaagaatttatcgccatttggtacgaacgctatttggaactggctcgtcaaaataaataatcaactcttcagggatgggctgccgcaaaatgaggattttgccgacagccttttattgtggccgtttttcgctggccaagaatggtttcccggtgaatgaaaatctccaaagcgcttacgatgtatggtacaattaccgttataagcaattatcatgatccgttatgactattcaaataatcaaggtaaggagtcattcgatgttcgaacgattaaaaaattccccactgatgttttggtcactagaaatattgattgtggtcgccatcatctggatctctacgaagattaattttgtcttttcgccaattgccatcttcttttccacggtctttattcccatcttgttggcggggattttgttttacatgctcaatccaatcgtcaatttgattaccaagatcaaattcggtaagcaccaaatcaccagaacctgggcaaccacgttggtgttcttactcttgttgggattggttgcgttagccgcaaccgtctttattcccaaaattttaaaccagttgattacgttggccaatcagattcctgacgctgccagccagggtcagaagttggtcgataaactgtttaaggacatgaactctcagcagatgctcaagaagattgattttacgaccttgacgaataagttgtcggcaaatgtcaataaatatgctgaaacgatttttaatggcgtaaccaacggcttggggggcattatttctgctgccgccaatgcggttattatcgccgtaactgtgccggtggtcctgttttacatgcttaaggacggctatcgattagccccaacgattaagaaattcctgcctgaacgtcaccgtgaacagaccatggatttactgggcaaaatgagccacaccatttccaaatacatttccggtcagatgattgaatgtttgtttgtcggtactttcacggccattggctatgtcatcattggcacgccgtacgccttattgttaggtgtgattgccgggatctgcaacatcattccttacctgggcccttatatcggaattgccccggcactgatcgtctcgttttcacacggtggcttgtggtccgtggtttataacatcatcgtggtcctcattgtgcaacaaatcgacggtaacctagtctatccaaacgtgattggaaaatccctggaaatccatccactgacgatcatcatcatcttgctggccgctggaaacattgccggtctgatggggatgattctggctgttccgctttacgcagtggtcaaggtagtggttgtgcacatgtataatatttatcaactggaataacacaaaaacgttaataatctttaataaatattgacgttgtcggtgattatgctactatttaagatgtgtttattttagttcacattcagagtaatgattaagtaggagattctatgaaaaaagtaattacgtatggaacgtttgatttgctgcataaaggccacgttcgtctgctcaagcgggcaaaggcgttgggtgaccacctgacagtgtgcttgtcatcagatgagtttaacgctgagaagggcaagaaagcatacacgtcatacgaagatcgcaaatacattcttgaagccatcaaatacgttgatgaagtgattccagaaaccaactgggatcaaaaaattcacgacgtccaggaccgagacattgatgtcttcgtgatgggtgatgactggaaagggaagtttgacttcttaaaggattattgcgaagtcgtataccttccaagaacggaaggtatttcaaccaccaagatcaaagaagatttaggcttaacggataccgaggattggaaagcttaacatctgagattctgattatcccggcacttggccaatctggacgggctttcccgccacggacattccaaaccaatacccacaatcaaatgtgtagcacacaagattcaaatgaggctgaggacaagactacatgttttgttccagcctcgtttttattcaggaggagaatcatgggacgagcaatttttttggcaacaacgattcacggaattcgcaaagcgacatttcgacgacagctgttatcgttaattaataatcagtatcaggtggttgtcttgttggcaatgaccgattttgatgaaatctggcaggcaaagcgtgaattttccaagattgacctaccgaagggaactcctagtgtgcgcttgatttcactggcggatatttacgcagaacatgacggtgtgagtctaaaggccgccgatttcatggatccggatctgtctggattacagacctttaaggcgcatcaaggaaaattgccggtgaccagatacattgacgctgacggaaacatcgtcgctgaaaccttatttaccgaagacaacacccggatacataccctttactttgacaaaagcagccggatcagccaaatcaacagttacgatgatgccgaccgattatttgggattgaaaaatatgttgatgatgcactgactgaaagcttgctgctgaatgccaaaggtgaactggtttaccgatttaccaactacgtgaaggaccaaaaggtgagttataacgtcacccccagttcaacgattgctgcccctcaggaattaagcgagattcaagatgacaagtctaattcaaaggacgaaatgctgacagcctacgaaggccaaggtaagtcgaccttcaccaaagcattatcatacagcgattaccatcgctacgacgatattaatgccttttatcatcaagtcttgttaaacatgaatattgaagacgcccggacatacatcgatatcgacaacattgtcgatgcatccaagtacctgccaggcaaacgaatctttaattattaaggggaaattaaattgcgagcgatattatcaggtgtccatcaaaagaagggcaaacaagtccttgaatttgaattattagacgttgcggtgtcattagatactgcttacgttttatttgtcgaaaaaaatagcttggcctcgatcatgaagccgatcagcaaagtgctgtcccacaatattatccgggtcaacatcgatgcccaggacttccattttcaatcagaggatcaaactgaatttgaatggcagatttttctcatcaacaacaacttgaccaacaaaaatgtgattcaggttgaaagtgaatatttaagtgaccgtcatcaactggaattaaccagttattaccaattcaacagcgatgcccagggaatggcgttgtttaacattcggactcaccaatccgatgaagaattcatgatcaattcggtcaacttaaccgatgaaaacttggaaattaccggttataacaagatcaacgggacgctaatcaaaaatcaacgcatcatcctgaaaaaccacacgaccgagggcacactggaatacccagtcaccaaaaagctgtttgaagggatgtttacggttgccattccgctaaccgacattccccaaaattcaatcggagaacttttcatcgaatacgagttgaacggcaaatctatcaagcagcgattaattatctccaagtcactagccggccaatcaaccgacattcaactggctggtaaccgtgagatcactttggaaaaacgatatgataatggcattttagtcaaggaatttgctggcgcttctctgctccagaaggtgggtgcagctggcggcaaggccggcaccattattgatgttattaagatgattcaagacaaattgaacctggttagaatgcggttcctgttcaagtcgggccattcaccatacgataacaccacgattatttttgaaagctttggcggccgccaggttagtgacagtccgtacgccatttataaggtcttcaaaacgttatatcctggtattaatatgatctggtcaattgatcgctctcagaagaagttttgtaaggaaaatcaaattgcctacgtgattcggcgaaccaacaagtgggttcgggtcttggaaaagtcccaattttggatcagtaatgcccgcttcccaacttgggttaagaagcccaactatgtgacctatattcaaacctggcatgggacgccccttaaaaagttgggcctggatatcgaaaacgtttcaatgcctgggaccaccaccgtcaaatatcacaagaactttgtcagagaagccaatcgttgggatgccttggtttcaccaaatgactactcaacgcagattttccgttctgcatttggcttcaacaaccaaatcttaaagattgggtatccgcgaaacgatgaattaatcaatacccagccggaagatattgatgctatcaaagagcagttaggaattccgttggataaaaaggtggttatgtatgcccccacgtatcgggacaatcaatttgccgagaagggtaagtataccttcgagctgccgtttgatttggatgacttccggaagtcgtttggcgatgacacggtcttaattctgcggatgcattatttgatttccaatgccttggatatttccgattattcagacttcgtttacgattattcgaattatccaaacatcagtgacttgtatttggtatccgacctattgatcaccgattactcgtcagttttcttcgactatgcctacctaaagcggccaattttgttctacccttacgattaccatttgtacaaggaggaactgcgtgggttctatctcaactatgagaaggatctgccaggtaaaattgctgaaaactccaagcagctgttagccgaaatcaaccatgccttggcgcatcctgatatgtcagccaacgagaagttcatgaacttctataaccgcttctgtgcgattaacgatggtctgagttcattgaaagtggtgaactacgtcatgcatcaaattgaaagtggcatgtaatttcacatcaaagaggggatggcacaaagctgatgttttgtttccatcctctttgttttggattgcaccaacgaaattgacgtgggttctaggagagtcgcctaaaacgtgttaaaattaattagttattgactcgcctgaaaggaagtaaacatgaatacccaacaattagaaaaggaagacagtacccggcggacatttgcgatcatttcccaccccgatgccggaaagacaaccatcacggagcagctgctgctctttggtggcgtcgttcgttcagccggaacggtaaaagcccgaaagaccggtaattttgctaaatccgactggatggaaattgaacagaagcgggggatttcggttaccagttccgtcatgcagtttgattacggtggcaaacgaattaatattttggataccccgggccatgaggatttttccgaagatacttatcggacactgatggcggtggactctgccgtgatggtgattgattccgccaaagggattgaaccgcagactaagaagttatttcaaatctgtaagatgcggggcattccaattttcacctttatgaataaactcgatcgtgatggtcgcgaaccaatggatctggttgatgaattagagaatgtgttaggcattgaagcctacccgatgaattggccaattggcatgggcaagaccttgactggaatttttgatcgctataaccatcacgttgaactttataatcacgaaaaaaacaaccagtcttcagaaattgttgatttggatgataataatgatccggtgaacaacgatcaacttgcccaggacgaacagtttgaagacgccaaagacgcgattgaactcttggatatggctggtaatcaattcgacgagggtaaaattgcgactggtgatatgactccggtattctttgggtcagccttggtcaactttggtgtcaagacgttctttgacgcttatttgaaatacgcaccggcgccaagtgcccacaagacggaagagggcgatttaatcaagccggatgacgatactttctctggctttgtcttcaaaattcaagcgaacatgaacccgaatcatcgggaccggatcgcgtttgtccgggtttgctccggtgagtttgagaaggggatggacgttaacctttatcggacacagaagaaactgcgattatccaatgtgaccgaattcatggctaataccagagagaacgtccagacggcggttgccggagatattatcggattatacgataccggtaatttccagattggtgacacgatttatactggtaagaaaaaagtcgagtttgaaaagctgccccaatttactccggaactatttgtccgagtttctgctaagaatgtcatgaaacaaaaatcattccataaaggaatcgaccaactggtccaagaaggggcggtacagctttaccaatcctataccaccaatgactatattctcggggcagtcggtcagctgcagtttgaagttttccaattcagaatgaagaacgaatacaattctgaggttaatatggatccaatgggccataagattgcccgctggattgaccctgatcaacttgacgaaaagatgtcgtcctccagaaacttattggtaaaggatcgcgccggcaatccgttattcttatttgagaatgaatttgcccttcgctggttcaaggataagtaccctgatgttacattgaccgctaaactataatttaactttgaaagaagagatatgatggtttccaaacatttgtccgcatgcaccacagttcttgtcggtaaaaaagcttccatcgatggctcaacgatgattgccagaaatgatgatacatttttgccgctaacaccccaacgtttctatgttgaacccgccaatgatcaccaaaccggtgagtgggtttccaaccaaaacggttttaaggcaccattgccaaagcaggcctatcgttactcattgacgcccaacgttgaagttgataaggaaggtgtctacgccgaaagtggctttaacgaaaagaacgttgccatgagtgccactgaaagtgtttacgggaatgagcgggcgctggcctttgatccattggtcaaagacggcctagctgaggactctttgcagtcaatggttttgccttacattgattctgccagagacggtgttcagtatcttggtaaattaatcaagcagtacggatcacccgagggtaatggggttttgtttagcgataacaatgaagtctggtacatggaaattgttaccggtcatcactgggttgctcaacgaattcctgatgacgcctatgcgattgccgccaatcaagttgctatccaacaggtgaaatttgatgatccagacaacttcatgtattcagacggcatccaagaatttgtcgagaagtatcatttgaacactgacaagcagggatttaacttccgccacatctttggaacggataacgagaaggaccgtcattacaatacgcctcgggtttggttcggccagaaatacctgaatccggaaattgagcagtcaccaacttcctcaaatttaccgttcatctgtcatacggaccataaaattagtgtcgaagatgttgagtacattttgagctctcattacaacgaaacgccctatgatccgtttagtaaaggccatgaggacactaagacgctgtttcggccaatttcaatgaatcggacccaaaattcacatgttttgcagattcgtaatgatctcaaaaataacagtaatgcaattatgtggctgtgctttggggtaccggcattttcaccatatgtgccattctttgctaatgcaacggataccgatgatacttatgccaacacgccggtccattgcgatgatgtcagcgcctattggatgtaccgcaaattgtcgatgttagtggaatcccattattctgaatttattcaagatgatgttgatttcttaactgacatgaaggaacaactgcgtcgccacgtccaaagcgcgattgatgaaagtcaggcactgaagggtgaagaattgaccagctacttgaccgagcaaaatcatgaagttgtcaaaatgatgcgaattgccactgaacatttcaatcaccaattgattgaaaagggactgacactgtccaagttgacgtttaatatggataaaaatctttagagacaagaccaagctgattagcttcggaacatgtttcaaccaacgagggaacaatttcactcttgtggtctcatgaagaagaactggctggtgaacagatttgttcaccagctttttttgtccaacgtgttaagtcatggttgataaagcgaagcgctagatacaacgtgtttatataaaaaaggcaaactttgagattgcggtttgcgttcgccaacctgcgaggtgtcgcattgactttccattgatcattttggtgacaatatacggcaacgtgacagaaatcgtcccaacattcaggtatacttttggatgaggagttgaggaaatggacattggcaataaaattcgggcttatcgagaagtccgtggtctttctcaagaagaattagcatctaaaatatatgtttccaggcagacaatttcaaattgggaaaccggcaaacagtatccggatattcaaaacgttttactactaagtgttttatttggcgtttctgtagatgaactcatcaagggggatttggaagcgatgaaagctaaattatctgataagaaagtcaatacggcaatgtcagcttatacttgggtgatgctaatcgcagctgttttgggcacaatgtcaatcgggttagttatttactttgagcaatcgacgttgattattttggtgccgatcatctgttttgcggtcatgttcattagcgcatctcaagtcgagcgaataaagaaacgcaaaaacttgagaacttatgctgaaatcgtggccttcacggatggccaagatgttgaggagcaacggcaaaagcgggatccggcaaagaatcggttggaaaaattaatgattgttggtggatttgcggttgtcgtttgcatgattgcgctagtatcggttttcatatttgtcatttttaaatagccgtcagctttgatcaccacgtttatactgacaaaacttgcggcgccggccagcgtgcttgccaagccacctggcaaacggctgatcccagttttttaagcaaaaaatcgagtcattcccaaaacaggaataactcgatttttacttaaattctgggatcaaatcgactttgatcccaatctgattaaattaggaatcaattctaacatattcactaaagatgactgactgatcagccagctcgtaccaaatcaggccctgatcatcgataattcgggctttaattgaaacccgttgtccgtctgccactgttccagtactggtgccatacggtttatcaaagacctcaattggcctgccagctacgaaatcaactgtcccaaacagcatgaccggattcctggaagttttcgtaatcggtggaacgagatgattggtcggcgggtcactgggttcaaggtcggcatttttaatccattcaaaaccgccaatattcagccagctttgattgtccgtcgtttcgatgcgggcaaaaatcttggtgataacattggccggtaatccggtttgtaacgcatggccatttggttggtccaagacagcgtgtcgcttcttcagacggacataatactcaactggttggacagtttgccaatggattcgtcgataataaaagatcattccatgggtgcggtcatcaaagtggccgtgagtgggaccgacatcattgatgacgcggtagccggggatatccgcagctgaaacgtcataagactcacccagtttgcctgagtggattgtgacgtgatgcaacgtttcaccggtatcaatgtccaaataataggctaggaccggcaacccttgtttgagagcatatcggaatgtcacttcttgatcggtatctgcaaaataagtcgaaaagttatcaattgagaccaggtaatattgtttaaagctgggaagttgaagggaaaagcgctcaccatcgttaccaattaaaatgtcaggctttttgattggatcgtcattttcatcgagataaaagaaggtcacttgagacttgatttgaattgtctcctcggcttgagaaggtgcaggggaagggtcgttgagcaacccatccgcttggtctttaaccgcgtcttgattggaagagttgtctacttctgccgtttggtcactattatccgggtccacttgtgcagactgccaccgctttcgttggtgatagtcccggcgacggccccgacgatttgattgccgatgggatcgcggcgacacaaagatatttaattgttgtttgacccaatccatgaacttcatttgataaatgctccgatctacaatcttctaataaaaattatagcataatcagcattggcaccaccgaatttaaggattattttaacgattcaacccagaaaaggcgacagttagtaccatagttggggaatcatggtgagaatacaaaaagggtaacgatcaaagtctcaaactctgaccgttaccccttaatgttttaatacttatttatctgaatccttgctatcaggctttgctttggttgaagcttttacttcagccgcgctgtcgctcttgataacaatgttgccctttgaatctacgtcagctgttaatgtagcagcattttcgtgatccaagtagaagtcggcaaccttgtcttcaatctgctcttggataactcttcgaagtggacgagctcccatagctggattgtagcccaagtcaaccaatttggccttggccttgtcagtcacgttgatcttcaatccttgttgcttaagcataccgttgacatcgtcaatcatcaaggaaacaatcttcatcaggttgtcctttgataatgagtggaactcaacaatgtcatcgaaacggttcaacaattcgggcttgaagtagtcggtcaacttatcaataattgaatgggtcttcccactggctgcagcaccgaaaccaacgttggcttccgcattaccctgaccggcgttactggtcatgataatgatggtatccttaaatgaaactgttcgtccctgactatcagtcaaacgaccatcgtcaagaatctgcaggaacatatgaagaacatctgggtgagctttttcaacttcatcgagtaaaatcaatgagtatgggtgacgacgaacctgttcagtcaactgaccggcttcttcgtacccaacgtagccaggaggtgaaccgatcaacttagccactgaatgcggctccatgtactcagacatgtcaaaccggatcatcgaatcctttgaaccaaacagttcataggccagctgcttagccatttcagttttaccaacaccggtaggtccgacaaacaggaatgaaccaattggtcggccggtaccgttgaagccaacccgattacgacgaattgcccgagcaactttttcaaccgcttcgttttgtccgataacgtgtttttcaaggttaggggccaaattacgaagttgttgttgttccttggtttgaagttcaccaaccggaatttcagtcttctcttcgacaatcttttccatgtcttgagcagtgacctttggtgttgctgccgagtcgacactgccgttcttcttggcattttcaagcttggtaacttgatcacggtagtaagcagctttttcgtagtcttcactcttcaacgcagcttgcttttgcttttcggcactttgaattttttcatcgaccgtgtgtggatcaacggcattgatggtcaaattctttcgtgatccggcttcatcaagtaagtcgatggctttatcaggtaagaatcgatcctgaatgtaacggtctgacagcttaacggccgcttcaatcgcgtcatcggtgtacttaacgtggtggtaatcttcataacgcttttggatacctttcaaaatcttaatagattcttcggggcttggttcatcaaccgttaccggctgcaaacgacgagccaaagcagagtccttttcgatatcacggtattcctttaaagtagtggcaccgatcaactggaactcgcctcgagccaatgctggcttcaaaacgtttccggcatccataccaccttcagcgttaccggcaccaacaatttcatgaatttcatcaatgaacaggatgatgtcgggattatcttgaacttctttaattaactgctgcattctttgttcaaattgaccacggattccggttccttgaaccaaagaaaccacgtcaagacgaataatttgcttattctgaagctttgaaggaacgttgccggaaacaatttcttgagcaagtccttcaacgacagcagttttaccaacaccggcttccccaataaggacggggttattctttgtccggcggttcaggatttcaattacccgttgaatttcattgtcacgaccgataaccgggtcaactttgccatctttggcaagctgggtcaaattaattccgtattgaccaagcagggaatttccgcccgctccgccggttcttggtcggttggggccgccattgttgggtcccattggttgggttggtggcacttgttgaccattggttggatcaacgtttccgccttgcattgcacggaaaatgtcatctaatccaccaaaaccaaatggatcttgagccatattttgagcacctcctgtattacgttgttgattggataggagttgatagcaattttggcaaaggttaatagtttgcttttgcccattcacattagtgtacaagtgaatcgttgctgggttcttatggcaattttgacatagcattaattgctttcctcctttaatatagaaataaaaggacaaggaggatctgttaatcactgaccaactttgacctttgaaattattatacaacatgattatatgtaatcaagtaattgaacttcacttaaattgaaaggagatgagacgttgtggcagaagagaatcaagactacaatcagttgttagaaaagttggaatcaggtgagattgaaaaaatcgaagtcaagccggaatcattcatggcctttcagacagcatacatgaactttgaccatcgaaagcgggtggttgggtccgcgaccgaaggcggtgtgattacctatgtttatgagagagacgacaagcaaaaaagttcttaaaaaccctgtaagcggttaagtttaaacttgtattttctcttatatattgctattcttaattaagtaaagaacaaatttaaattttgagcatcatcttcaaaatttataatcttatcagaggagattgattaataatggaaaaacgtcaatttaatatcatcgcagaaacaggaattcatgctcgtccagctactttgttggttcaaactgccagcaagttcaactcagatatcacccttgaataccaagaaaagtcagttaacttgaagtcaattatgggtgtgatgtcactcggagttggtcaaagtgcagctgttacgattactgctgacggcgatgacgaaaaagaagccattgatgcaattagcgaaacgatgaaagcagaaggactgactgaataatttcatgaaagagtttaaggggattgccgcaagtgatggaattgccattgcatctgcatttcggttaactgaacctgatttaagctttaaaaagcggagcattactgatgcctctgatgaaattaagcggctttatgctgcgattgatgtctcaaaagacgagcttttaacaattcaacaacgaacacttgaagacctcggcagcagtgaagctgaggtctttaaagctcatggcgcaattttgtctgatcctgaattactcaatcggatcaaatcaacgattgaaaaagagaaggtgaatgccgaatatgctttaaccaaagtcacggacggctacatcaaaatctttaattcaatgacggataacgaatatattcgccaacgttcaagcgatattcgtgatgttaccaagcgggttttaagtcacctgctgcgagtgccgctggttgatccggccttgattcaccacaaggtcattatcattgcccacgacttaactcccagcgacacagctcaattcgtgccgagttatgtgttgggaatcgtgtccgatatgggtggacggacttctcattcggccataatgtcgcgttcattggagattcctgcggtcgttggattcaagggccggctggcagatatcaagaatggcgatacggtcattgttgacggatcaactgggaacgtcatcgttaatccgactgaagcccaaacagacgaatatactcaaaagcaggctgactatcgtcaacgcaagagcaagttggctgatttcaaacatcaaatgaccagttcttctgacggtaagcatccaatcattgctgctaatattggcactttggacgatctggacggcgctatcgaaaacggtgccgagggaatcggcctgtttcgaactgaatttttatatatggactctaatcacctgcctactgaagatgagcagttcaatgtttacaagacggtgcttcaaaagatggataaaaagccggtgatcattcggactgctgatatcggtggtgacaaggatttaccgtatttggatgttccaaaggaggccaatccatttttgggatatcgggcaattcggatgagcctggataagccggatattttccgcacccaggtccgcgcgctgctgcgggcttcttcgtttgggaatctgtcagtgatgtttccaatgattacgaccattaatgaactgaaaaaagctaagaatatttttaatcaggaacggatcaaattgattcgggaaaaggttcgggtaaaaccggttaagattgggattatggttgaagttccggccgctgccattttggctgaccaatttgccaatgaggttgatttcatgagtattgggacgaatgatttaatccaatacatcatggccgccgatcgtggcaaccggatggtttcatatctttaccagccttataatccagccgttttacgaatgatcaagcatattatcgacgcttgtcatgataataatcttcctgcttatatgtgcggtgagatggctggcgatcagaccgcgattccaattttggttggaatggggctcaacgaattttcaatgagcgcttcttcaattctcaagtcccgagcgttaatcaaacggctcgattcaagagagatggtcacccttgccaacaaggcggttaccatggccagcgccagtgaagaagtcactgcctttgttcaccaggccactaataacgtccaatagatttataaataacttaaagaacaagctgttaatggcgttaaaccgtctgttttcggcttgttctttttattcgggtggtttgcaatagcagaactaaaccaatataattacaatgattgtgagactatgcgtcacaccgggtaacggcctgacggcacatttcacgagcataattaatcgatttttatcagaaaggggtgtcagccgtgaatattgggatttttacggatacatattttccgcaggtgagcggtgttgcgacctcgattaagactctcaaaaatgaattggagagacagggcaaccaggtctatattttcaccacaacagatccgcatgtcgataaggacacctacgagcagaatattttccgtttctcaagtatcccctttatctcatttacggatcggcggattgcggtccgcggattatttcaagcttacgaaattgccaaagaactcaacttggatattgttcatacgcaaaccgagttttcgatgggaatgatcggcaaatttgtcgccaaaaacctgaatattccttgtgtgcatacttatcacacaatgtatgaagattatttgcactatgtggctaatggcaagttgctcaaacccgtccacgttaaagaagggacgttggctttttgctaccacctgtcgggtgtaattgcccccagtgatcgcgtattggacaagttgacagattacggtgttaaaagcgagattcggattattccaaccggaatcgatgttgatatgtacgctgaagaaatcaagaccgacattcgcaaagagtatcatatttctccagatacgccgctgatgctttcgattagccgtttggcatacgaaaaaaacatcttagaggtaattgactacctgccaaaaattttgacggaggttccaaacgccatcttaatgattgtgggtgacggtcccgccaaagatgatttgatgagtcaggtgcatgcgctgcagctggatgatcatgtcatctttaccggtgaagttgctaatgatcatgtcaatgctttctatcgggcatgcgacgtctttgtttccacctctaaatcagaatctcaaggactaacctacattgaagcgatggctgccggacttccagtagtcgtttcggccagtgattataccaatggattgttgagctccgaaactttggggcagacatttgagcacgacgatgaatttgttgggattgtgacccattatttaaagcacgaggtcaatactcagacacccaaagccaaacaaatcttgaaaaagaaactgactgcaatttctgcagaaacctttggcaaacgggtgattaacttttatcattcagtagcggtggctcaagaattacaagacaatgccactactaatatcgactaaatattttgtgaggagtttgtatgttaaggattaatatgttttcaaccgcggataaggtcaagggtcaaggcgtcggcagtgcctatgtggaactggtgagaatgctcaaggaccactttcctaacgattttaaaatcaccattaatagctatgcacctgcggatattactcattaccatacaattaatcccagtttctacctctcgacattttccaggcgaagagggcgaaaaatcggctatgtccatttcctgccggaaaccttggaaggcagcattaaaatcccccagccgtttaaggcgattttttataagtatgtaattgccttttataagcggatggaccacattgtcgtggttaacccatcgtttattcccaagctggaacgctacggaattaacaagcaacggattacttatattcctaatttcgtcagcaaagccgagttctacgatgttgatgaccaacaaaaacaagccctaagagtcaagcatggatacgatccaaaacgattcaccattttaggcagcggccaaattcaaactcgtaaaggggtgttggatttcgtggagctggccaagcaaaacccgacgatccaatttatttggacgggtggtttttcgtttggcaaaattaccgagggttatgctgatttggaaaaaatcgtcaaggatcccccaagtaatttatcgtttccaggaattattgaccgcgccaagatggttcaatattataatatggcggatttatttctccttccgtcttacaatgaattgtttccaatgtcggttcttgaagcgttttcgaccaataccccggtgatgcttcgggaccttgatttatacaagtcgatcatcagcggttattatcttcctgctgctgatgaaaaacagatgaacgaacagctgcaccaactgttattgaatcctgacaaattggcggctttacagcatgaaacgacgattgccagtgaacgctattctgaagatcatctcgccaaagtttggtatgatttttataatcaacaatctaaggaaggttaataatgtcacgaaataataaaattaccctctttacgatggtgataattgggattgcaattattgcatactctttgagggacgttaaattgagtgtgctgatccatgacctgttcaccctgaatccttggtggattttagtcgcctttctttgcatctgtgcctatttattaattgagggcgtaattacaaaagtcttggtgtccaatcgcgttgaacacttcacgtttaaggatgctctgcgggttccgctggttgaacagctatttaatgggattaccccgttttcatctgggggccaacccggacagttgtttgtcatgctgcagactgggattgatggcggtcgggcaagctccgctctgttgatgaagtttgtggtgtatcaaggaatgattgtgatcaacttttttatcagcttggtcattggattccattttgtcgcaaccaaattgcactttttggcgctgttcgttttatttggctttttaattcatctatttgtcatcgttggcttactgttgataatgtattggccgtcgtttaccaagaaactttcaaaattactttttcatcctgttaaatggttcatcaaggacgagaaattttattcaatgcgtgaaacgatgtattccaaaattgataatttgtttgaggaaagcgtcagaatcgggcgtcaacccaagctattattaaaaatcgttgttctcacattttttcaacttcttttttattacctcatcccatatttcattatgctatcgctcggctatactagtatcaacgtgattatggttaccagtttacacatcatgattgtgatgattatttcgttgttcccaattcctggtggttctggtggtgccgaattcagttttgaatcacttttccatagctttatttcgagtaacagcaaattggtattggcaatgattatttggagaattttaacgtattactttggaatggctgctggggcctgtgctttattagtcaaaccagataaagttgatgatcccgataaccgcattaaatagcgggcagggaaacatttggaggaacaggaatgttaacggataagaaatatcgtttttcaaatcttttaaacaccagaattggcttctttttgctggttgtcattttattttgtatcaagacgtatattgcgtatcaaactaaatttacgctgggcgttaaaggcggcatgcaggaattcttgctggcagtcaaccccatcccggcggcactattgacattgggcattgccctttattttagtggccggctatcttattggttgatgatgatcatcgatactttggagagcatctggatttttgccaatattctgtactaccgtgagttttccgactttctttcgttgggtgtcatcaaaggatccggcaatgttcaaaataacttggggaagagcctggttgaaattcttcacttcagtgacttttttgtttttctggatgtgattattttgattgcgttgttggcttttcacgtgattcgaattgacgccgctccatttaagaagcgttatgcatttttcattacgatcgtttcttttctcttaatgggtggcgaatacggtctggcaagcacggatcggtctggtttgttgacccgaactttcgacaataattatattgttaaatacttagggttaaacgagtatgccgcttttaatgcatgccaaacccaaaaagaatccgctacccgatcaaaagccaaggccagcgatatggatagtattttgaaatacttagatcatagtcgggccaaggccaatccggcttattttggcaaggccaagggcgagaacgtcttcattattcatcttgaaagtttccagcagttcttaattgattataaagtcgacggcagggaagtgacgccccacctgaatgcctttttccacaataaaaataccattggttttgataacttcttccaccaggttgctcaagggaagacttctgatgccgaaatgatgttggaaaattctctgtacgggttacctcaaggatctgccatggtgacatatggtgcccagaacacgtatcaggcggcgcccgctatcttggatcaacgaggctacacaacagctgcattccatggggatgttcccagcttttggaatcgggacagtacgtacaagtcctggggatatgattatttcttcagctctcaatattacaagacgaagccgtcttacagtgtcgggtatggtctcaaggataagattttctttagagatgctgccaattatattcagcagctgcctcagccgttttatgccaaactcattactttgaccaatcattatccatatttgctggataaacaaaatactgattttcctgccactaagaccggggataaaacggttgacccatacgttcaaactgcccattatctggaccaggccttcgcggaatttatgaattatcttaagcgaaccggtttgatgaagaacagtatgattgtcgtatacggtgatcattacggtatttccaataatcaccgcccggccattgcccagctgcttcataagaagtcgattaacaattatgatttggcacagttccagaaggttccgttcatgattcatgcacctggccttaagggtggggtcaatcacacatatggtggtgagattgatgtcttgccaactattttgcatctgttaggcgacaagaataataatacgattcagtttggaaccgatctgttatccaagcagcatgatcagcgggttgcattccgggatggcgactttgttacaccgaaatataccaaggtgggcagcgacgtttatttgactaagacgggcaaactgattacgccaaatgccgctcaaaaacggcagttggctagcatccaaaaccatgtgacaacggaattatcattatccgatcgggtcatctggggagatttactcaggttctacacacctaagggattcaaaaaagttaatcgcaaagattttacttatcaatatacaaaggctcttgataatttgaagcaggcccaaaagaaagaaccaaccagcattgaagcaaggaacaatggtaaatcaactatgaatttgtacaagaccgatgcacctgaattgaaataggtttgcgaattaaagtggaacagggatgttccacttttaatttggattaaaacaagtcatcgtttgggataaacagtcccgatcgttaaagttcaattgatttgaaattggggcttgacgaattgatcaaacttcgatatatttataggtgctgtttttgttcgtgaccaaccaatatcaattcaatcaattgagaaagttgttgacataaaacaatcagcgtggtatatttaaatagttgtcgcgagagatgattcatctcttccacaaccaagtagacctttgaaaactgaacaaaattttcgacaaacaaatgtgcagggcgtttcaattcttcggaattggaaccaaacatttgcgaagtcnnnnnnnnnnggcacttcaattcaaatcccaaaaccagggatttaaatcaaagtgcccttagaaaccgccccaaaccgttgctcgtcacactctgactagaaccatctcttcttcttttccggtttttcttcattcttacgttttttatctttatcttttttgtcgtgttttaagaacttatcacgctttttatcttccggatccatttcggcaaacttgccgaacattgcatccatgtcgttttggcgattgacctttaatgccattgagattcatctccttacccttttcgtcataactatagcaaatctgaccgcaaaagtcacatttgttggccattactcactttttgatgcataaatgtattaattatgtataaatacgacttaattaagatttttcttgcataaaatatattttgggtgtaatgtattggttattataaatttggaagagggaaacttgatgaagaagagtcttaaagcaattattcagacattgattatgattgccgctgtatttactttaaccacagtattttcaaatcctgcgtccgctgcagatacgtcactgcaacgagttaagcagcgtggggaactgattatggttaccagtcccgattatccaccgtatgaatttcaggtgaataaaaatggcaaggataaaatcgtcgggatggatatcgacgttgccaaaaaggtcgccaaagatctccacgtcaaactggtgattaagagcatgaactttgattcattgctggtggcgattcaaaccggcaaggcagatatggcaattgggggtattaacccaactgcagctcgtcgtcaaagtgttgatttttcaaagatctattattcaggcggccaaagcttcttgattaattcaagcgatgtcaacaaatacaagagcgccaaaaatctgaggggggcaacaattggtgcccagaccggtactttgcagtatggtctggccaagaaaaaaattcccaattccaccgttaaagggatggacaagtcaaccgacttggtactggccctcaaaactcataagattgatgctttgggaattgaaaagcccagtgccgaagcttatgtgaaaaatgatcccagcctaaaaatgatttcatccgggtatcatttgaacaaaaatgaaattggcgctgcaattgcctttaaaaaagggtctgggagtttagttgccgccgtcaataagagtattgaccagattaaaaaacagaacctgactgaacagtacctggctgatgccggcaagtatatgaaggttaatacagtaaatacctccatgttccattattggaagtattttgccaaaggggttgagtacacaatcctgatctcggtagtttccacgttctttggggtcttgattggcgttatcctagctttgatgcgtttttccaaacagaaatggcttcgaggcctggcaatcagttacaccgagtttattcgaggcacgccattaatggttcaagttttgttcgtttactttgggattggggttgtcgtcaatattccagctttgatttcagggatgattgccgtgtcactgaatagtggtgcttacgttgctgaaattatccgtggcgggatcaattcggttgccaagggccagaccgaggccgctgccagcttgggcttgtcaaagggtgatctgatgcgttttgttattttaccgcaagcctttaagaacatttggccggctttggggaacgaatttatttccctgatcaaggaaagctccattgtttcgattattggggtgaccgatttgatctatcaattaaacatcgttcgtgcggatacgtatcgtggtgtcatgccgattttcgtcgccatgctgctgtacttcatcatgacatttgcattgaccagagttttgaaccattttgaagggaagatgaaacatgcaggataagaaaattcttgaagtaaatcatttaaataaaaaatttggtgacaatgaaattcttaaagacatcaatgggaccgtcaaatccggcgaagttatctgtgtaatcggtccatccggtgcgggtaaaagtacctttttacgttgcctgaatttattggaaaaaccgacctccggcgaagtgaagtttgaaggaaccgatctgactcacgttgatgaaaaacaattgatcaacttgcgtgagcgaatgggaatggtatttcaaagcttcaatttattccccaatatgacggtgattgagaatctgaagttggcaccaattcgggttaaacacatgaaagatgacgaagcccaaaagatcgccatgcacctcttggatcgggtcggattagctgaaaaggccgacgcctatccaagcagtctttcaggcggtcagcaacaacgggtggcaattgcccgggcactggcgatgaatccggaagtgatgttgtttgatgaaccaaccagtgccttggatcccgaaatggtcggtgaagttcttgaagtcatgaacgagttggctaaagaagggatgacgatggttgttgtgacccacgaaatgggatttgccaaagaggttgccgacgaggtttggtttatggccgacggctacattctggaacgaaataaacccgaggagttgtttgacaatccgcaaaatgagcgggccaaagactttatcggaaagattattcaaaatgtatgacgcaggcttttaactattagaaagatcggtgagatgaacctagatgtggttcattgtcgccgatctttttcttgtttaaattgccctggccgaaactcaggtccaatccctggttcaaagttaaaagaggcagatagatgaaattcattgtcgaatcttgtaaaatctattgataccagatggttatgaaaatcccgcgaatgttggttggatgaaagaatggtttgatccctctaagtcaaacactctctgggacacatcggttgaaccaaacatatattcgatgtataatttttagatgaatattatgaaaggagtgagttttttggcgagtgaatatatcgaacataaattggctttactgcctgacatgcctggctgttacctgatgaaggacattaacggcaagattatttatgttggaaaagccaaaaacttaaagaaccgggttcgttcttattttaagagcagccatgaaggcaaaaccgcccggttggtctccgaaattgccgacttcgaatacattgtggtttcgagtgacaaagaagcttttctgcttgaaattaccttgattcaaaagcatcggccatatttcaacatcaaattaaaacagggaaacggtgggtacccctacattaagattacgaatgaacgggaccctcagattaaaatcgtcaatacgttactcaaagatggcggtttttattttggcccttatccaaacgtctatgctgcagaagagacggttaactttctgcagaaggtctatccattgcgtcgctgcaacggatttcagaatcgaccctgcctgtattatcatatgggacagtgccttggggcttgttttaaagtggttccggaagaaacgtatgccaagcagattaaacggattaagtcgtttctgaatggcaatgtgtctcacgccaagcagatgctaacgactagaatggagaaagcggccgccaagatggagtatgaacgggccgcagaaattcgcgatctgatcaagtacattgaaattaccgttgagaaacagaaaattatttcgaccgataatacgcctcgcgatatttttaattactatatggataaaggctggctctcgattcaggttttcttcatccgtcaatcacgattgatgaaacgtgagaaacgtctctttccgatcattgatgatcctgaagaagaaatggtcagttttatctcgcagttttataagcagaagaatcagattctgcctaaggagattctggtgcccaaatcactgccaacagatgtgattagtcacgtggttgaagatgttcccgttagaaccccccagagagggcagaaacgcgatctcttggagatggcgggtaagaatgcccagatggtcctggaggagaaattccgcctgttagagcttgatgagagcaagacgaccggggccatgaaagaactcactgatgcaatgggaattgcgccggggcacaaaattgaagcatttgaccattctcacattcaaggggccgatctggtctctgcaatggtggtctttgttgatggtcagcccaataagaatttataccgaaagtacaaattaaagaccgtggatcacgcagatgaagccgccagcactaaagaagtcatccgccggcggtatacccgactgctcaaagagcacgctgagatgccggacttaattttaatggatggcggggtcatccagatgagcgccgtcaaggatgtcctggtcaatgaacttggattgaatattccggttggtgggatggttaagaatacgcatcaccaaactgccgatttactgtttggagataatgacacgccactgcaattggatcctaagagtcagggcttttatctgctgcagcgaattcaagatgaggtccatcgatttgcgattacctatcatcataaagttcataccaagaactcattgagttccaggttggattcgattgccggtgttggtcccaagacacggaacaaacttctccggaaattcggatcgctgaggaaaatttcaaatgccccaattgaggaattgcgtcaattagggatttcagagactgttgcgcaaacaatcaagttctcactgagtaagattgatgaagaacgaaaagtgaccaattatcaagataaaaaattgactcattaaaatgattcgaaagggctttcttttcaagattattttgacctgatgtaggaaactcggtatactgctagagtactgaacacgtaactaacgacttgggattaattagaattaattaaatggtgataagatgtttgttgatcaagtaaagattaatgtaaaagctggaaacggcggaaatggcatggttgccttccgacgggaaaaatatgttccaaatggcggccctgccggaggtgacggcggtcgcggcggcaatgtcatctttaaggtggattctggtatgaacaccttgatggattttcgataccaccgaaagtttaaagccaagaacggcgggaacggtgccaacaaatcgatgaccggccgaagtgccgacgatttggtcattcctgttcccgagggaacgacggttaccaataccgatacgggcgaagtcattggtgatctggttaagccggatcaagaattggtggttgccaaagccggccgcggcgggcgtggaaacattcattttgccagcccgaccaatcccgccccggaaattgctgaaaacggtgaaccgggtcaggaagtgtctttgagccttgaattaaaggtgctcgcagatgtcggcctggttggatttccctccgccggtaaatcgaccttgctatcggttatcactagcgccaagccaaagattgccggatatcattttacaaccttggttcctaacctcggtatggtgagattagatgatggccgtgattttgcagttgccgatttacccgggttggttgagggtgcttcgaatggtgttggactggggttccagttcttacgtcatgtcgagcggaccagagtcattcttcatttggtagatatgtcaggtcttgagggccgtgacccatttgaggattatttggcaatcaataaagaactggaacaatatgacgagcgcattttgaaacgaccacaaattattgtcgctacgaagatggacttacccgattctgccgataatcttcaaatcttcaagcagcagttggccgagcattcagatgcagataagacacgagagatctttccgatttcttcagtgacccatacgggattaaccgaactggttcgacgaacggctgacttgcttgatacgaccaagctttcagacatggagcagccagcggaaacgaccaaagagtacgcttaccaaccggctgagaccagcgatttccatattgaatacgataaagaatatgagtcatgggttatctccggtgataaaatcgagaaattattcaagatgactgataccgaacatgatcaaagtatgttacgatttgcgcgacaaatgcatggaatgggaattgacgatgccttgcggaaggcaggggccaaagatggtgacacggttactattttggacttctcattcacatacgttgagtagttatttggggaaatacaaattcatatagggcagggaatatttcgatgcaacaggttcaaacaaaaaaacaaggcaaacggcttaaaaacagccgttatatatccggttttgacgggatcagggcactggcggttgttggtgtcatcatttaccatttgctgccgtataagctgcaaggggggtacttgggtgtaccgaccttttttgtcgtttcagggtatttaattactgatcttttgttacaggagtgggagcaaaacggccggattgatttttgggcgttttacgcccgtcgtctgaagcggctgtatcctgctctggtgtttatgctggtgggaaccggcacatacataacgctgtttcaacgctcactattaaccaatttgcggtcaatcattaccaccaatatgctgtacgtttacaattggtgggaggttggccatggccagagttattttgaccggtttaacggtgaatcaccatttacgcatttgtggtccttatcaattgaaggccagtattacttaatatggccgttaattctaaccgcgatggtcctgattattcgcaaacggcggacaattgccaatattcttcttgtgttggcaattggttccggtgtcttgatgggactgctgtacactggtccggatacgttgaatcgagtctactacggcaccgacacgcgaatgttttcaatcgtttttggtgctttacttgctgttatttggccatctactcatctgaagaaaaacgtgacgacgcgatcgcgttggaccctcaatattattgggctagtgtcaatcgcaatcattgcttacctgtattttgaactctctggtcaaaacacgtttacgtatcgtggcggaatgttcattatggcaattgcttcgactaccttgattgcagcctgtgcccatccgggagccgacgtgaaccgctggttgactaatccggtatttagatggatggggaccagaagctacggaatttatctttaccaattcccggtgatgattttttatgagatcaaagttcaaaatattgccgcccatccactgatgaatgcaagcattgaaattgctttgattatgattattagtgagctgtcttatcgatatattgaagcaccgttaagacattaccgctatagaaacctcggtcggtcaatttacgagtttgttcaaccgaattcggaatacggctggaaacggttgtggctgataccagcagttttgctgattggaatttcggcatatggaagtgcaatttcacctaccaaagatgccaagaatgtactggaagaaaacatctccaagaacgaaaagaccgctaatgcaaataacaaggcagcgttagctaaacaaaagaaggcctccaaacttactgccaatcaaaagcggatgaagaaactgctgaagaagaaactgacggttaagcagtataaaatcgccaagcactatggcctgaacaaacgtcagtatctgacggtttatcaacaaccgttgaccgccattggggactcgattttagctgataacagtcacgatcttcaaaatgtctttcaaaatgcctatgtttccgctgccgttggtcgtcaaatttggcaggctgggcaggttttgacccaaatgaagaataaaaacgagctggcacctaacgttttgattaacttggggaccaactcacccatgacttccgcccagattaattcggttatcaagtcaattggacccaagcatcaaattttctgggtaacgactcatgtgccaaccagaaattgggaaaccgaagttaatcacacaattcgagttgctgctaagcgccataagaatatgcatatcattgactggcacagctatagcttgaatcggcgggattggttctggaacgataacgttcatcccaatccaaaagggaatatttattatacacatctcattgcgacgtcgattagcgatttttatagtaaaaaataaaagtttgaaggccttcattccatgcaagtagctggattgaaggctttcaaacttttttggcttattttaagttaatggtgagtgttgaatccggtgagggggcaactttcttttgagtggtggtgtagatggcaccaaactgaatggtgagtttggttgccggctgagtcgcataattgtgaaggtagccggtcatcgcaaagctgacggctcgattagcaccaattttattgccggcagacgagtcggttaattgattagctgtggtcaacatttgtccttgattggttttaacataattgacaccgtttagtgcaatttcaaagttgtgatgattcgtcactgtgtaattgagaacgaaggtgtagtaggtgtctggaatgctgcgaagattaagcacctgttcggcggcctctttagcttgcggcgtcttggcggtattcttgatgactcttacctggttgaccttataagttaatttgtcggctttgatatcaaccggtttggtggtcacgtcggctaattgctgtcgagtcccaaaacggtcaaaagtaaattgatgtttcgtgctcaagtcgccatttttgacatagtgagcattcttttggactgatttgggaactttgtattgataatcactccacgattggctggaacttgaactggttgatgagctggaaggctcgtttgacatatcagcactcaatgactttttctcagttgcttgattgcttttattaccaccgcaggctgctaatccaaccgacaggatggcaaacatgatgattaagtatccttttgctttcatagttttatcccctagtaaaaaacaattgatttattgacaattctaaacccaaatatcaattggcggtcgtttaaagttcttaaatctgtcttgagggagagccgtttggttctggtcatgaattgatccaacgttattgtagcaaatccaccctgagatgggctcgatttacccaacaataacgaatttttatcaattaacagctgattaaccggcaaaaagtgctgaccttctgaaattaatagggtcaactttgggtttagtgtgctgctggcgcggaaaaactcatctaaattcatggctgccattcccttctaatgattattttaacggatttatgatacaattgaaaagtgattttaagcggttggcaggtgccaatcactctaactcgattttaaaaaataaggaaacgataataatgcagattgaatttttaggcactggggcagggtctccaggcaaatttcgcaacgtgtcaagcttggcgttacggttacttgacgaaatcaactcggtgtggttatttgatgtcggcgaaggcacccaacaccagattcttcgttcaacaattcgtccccgcaagattgaaaaaatttttatcagccatttgcacggcgatcatatttttggcctgccggggttgttaagcagtcgctcgtttcaaggcggcaacacgccattggacatctatgggccaaaagggattaaggaatatgtcaatgtgagcttgaagatttctgagagtcggctctcgtataaaattaatttccatgaattgcccaaggacaccgatagcaaaatttttgaaggcaagaagtttaccgtttatgccgcacctctggaccatcgaattaccagctttggctatcgggttgttgaacacgatcatccaggcgaattgatggtggagaagttgactcagttgcatattccatccgggccggtatatggcaagttgaaaatgggacagaccgttaagctggcggatggtcgggtgattgatggtaaagaaatgatcggtcgtgcccaacccgggcgaattgtcacgattatcggggatacccgcaaaactgacaacgccgtcaaactggcagagcatgctgatgccttggttcatgagagtacctttggcaagggtgaaaacaaacttgccaagaattattatcattcaaccaatatgcaggctgctcaaattgccaaacaagctggtgcaaagatgctgctgttgaatcacatttctgcccgttataccggtaaaatggcccatgaacttgaaaaacaggcacaaacggtatttcccaataccaaagttgtgaaggattttgatgtcattgagatcccgtttgagaagcattaacgaatcatttctggggggataagattgaaaaagcaaattagcacaattatcagcattatattgattatcattattgcaatttttgcattgatgaattttgaatctgtcgaggttaactttggcttcgcatcatttcaggtgccactggtacttttgattttgatttgtctcttaattggcgccctgattatttttctgttctcgtcaactcagaatgtcaaaaagaatcgccaatataagcaattggcatctgaaagccaaaaacgacaagacgatttaaacgccgagatttgcgaactcaataacaatctcaaagaattagaaactcgtttgaaaaattcgacgggtaaacaggaaattggtagtcgagatcaacaaatcagtgatttgcaggatgagattgccaaattaaccgagaaattatcatctcaaaagtaaggtagagtgttttaatgattgattccaagtataagtggcagcttgatcaaccagctgattcgtcagtagttgacaagttggccaaggatgcaaatattgacccatttatggctaaaacgttaattcagcgtggcattaccagtgctgatgctgtcgaggatttcttgaatccttctgtcagtgcctttcatgacccatttttgatgcatgacatgcataagggaattgaacgaattcaacaagccgtcgaaaatggggagcatattactgtctatggcgattatgacgcggatggcattaccagcacaaccgttatgtacgagacattgagtgatctgggtgctgacgttgattattatattcccaaccgatttactgaaggttacggcccgaacgtcgaagcttttcaaaagattattcaaaagggcacatcactgattgtcactgttgataacggggttgccgggaatcaagcgattgtggctgcaaatgagttgcattgcgatgtggtggtaaccgatcatcactcgcttcctgaaaagttgcctgatgcgtatgcgattattcatccgcgggtaaaaaatgaaaatggggatgcttacccatttggcgatctttgtggcgctggcgtggcttttaaagttgctcaagcgttgatggacgaagtaccgtctgatctgattgatattacagcgatcggaacggttgccgatgtcgtatcgttacgtgatgagaatcgcgcaattgttaaattcggtgttcaggcgatttcaaatagtcaacgtccggggctgcttgctttgattaaggaagccggcattgatttggggagatttagcgaagaagatattggctttgggattgctccccgtttgaattcgcttggtcggatcaaagatgccacagtcggggtcgaattattatcgacatttgacgaggatcgcgcaggtgaattagccaaatttgccaatcagcaaaacgacttacgcaagtcacttgtcgaccagttcttcactgaagcggttcagtccgttgaagatagtggcgacatttctcaacggcacacgctggttgtcgtcggccataactggcaccagggggttctcggaatcgttgcaagtcgactggttgacaaatatcagcgcccgacaatcgtcatgaccgacaccgatggtagcgaagaggttaagggatccggccgtagtgtcgacaattttgatttatttaaagcaattgaccccattcgcgatcaaacgatcggctttggcggccaccattctgcagttggattgaccatcaagaaggacaaagtgcctgttttgaaggaccagttggaaaaagctgcggaagagcagcaattggatttatctgttaagcccaagttggccattgccggcgttattccggtctctcaggttacagcagtgttatgtgacaaaattaaaactttggcaccgtttggccaggacaaccctaagcccatttttcaagtccaatttgatcagctcgccaacgtaaaggcaatgggcaagaccagtgatcacctgaagttttcactggttcaaggcaataatcggctcactgcgattgcctttggtcgaggaagtgctgccgttgagcttcaaaattctcaagcagccgttcaagtggttggcgagattggggaaaacacttggaataatcgaacgacgctccaattaatggtcgatgatctgaagcagacattaccgccggtgatcgatgagcggactcacgagctgcaccgaaagatgtttgcgacagtcggcacttacgttttcttccacgaaaaagtcttaaaacagctgcaaggatatgtgggtggccaatcgcaagttgtgatgtatgaccaagtcactgaggcatcggctaatggcaatcgcttgtacattgttgattgtccggacgtgcttgacgatttggttcagctcttagccaaagtccaaccacaaaccacggtcctatatctttacaaaaagcaacttatctccaaaatagggatgccagatcggaattcttatgctaaactgtttaggttcgttaaagaacattcaaacgttaatattgcgatgcagttaaaacaaatttcagagcacttgcacatttctgcacggacaattatttttatggttcaagtctttttggagttggatttcattacgattcaggatcgggtgattaatttgaatccgaattatactgcccgtgatttgaaaacagctccaagttaccatcttcgagttgaacagcttgcagctgaaaagaaattgttggtttcaaatactcatgaattagtcagcttcgtcaaggactgtttgggtgtttgatgaaaggaagaaagaatatgccaatcgatttttcaaaatatattgcatcatatccggactttccggaacccggaatcctatttagagacatttcacctttacttgaaaacggtgaagtctatcgggcagcaaccgacaagatagttgattttgccaaggaacggaacgttcagatgattgtgggtccagaggccagagggttcattgttggctgtccagtcgcctacaagttgggggttggtttctcaccagctcgtaagaagaataaactgcctggtgaaacgattgaagaaagttatggcttggagtatggtaaatcatcactgtacttacgaaccaacgctgttaagccgggtcagcgggtcttagtaacagatgacttattggccactggtgggacaattgatgcaaccattcgtttagtagagaagttgggcggaatcgttgtcggaaccgcatttttgattgagttgtcagatcttaagggccgtgaaaaagtcaaagactatgatttctttactttgctaaaatattaaaccaagttcattactgctggttatccagtggcaatgagcttttttgttacatttgaattcgtacttagttaaacaaaaaagcatctcagcattggtacgctgagatgcttactgtcatataaggtgagtacaggatttgaacctgcgcgccggtattagccggttcgccggatttcgagtccggtgcattaccactctgccaactcaccacaacagttttaattatatcaagagttattctgaaagtaaattactgtctacttggaagaggcaaattttgttttagcatagccaacaactgccggaatgagtgagatagcgacgattccaataatgaccatcgagaagttttctttgacaacggggatgttaccgaagtaatagccggcaccacaacagatggcgacccatgagatacatgcaatcagattatacttaatgaatcgtttgtaagggaaatcactcgtagcggcaacgaaggggattaacgttctgatgattggaatgaatcggccaaagaagatggccattgccccatatttgttaaagaactcccgggccttggttaaatccttttctttaatgaattttcccaggattcgatttcggggaataatttctccaaatttgtttccaaagaagaagttgagtgaatcgccgccaattgaagcggccaaaaagatgattacaaacaagccgatgcttaaaccatagtttacgttggctgataatgccgccgcagcaaatagcagtgagtcaccaggcagaaatgggaaaatgactgcgcctgtttcaataaagatcactccaaagagaatgaggtaggtggagttcccaaatgtattcacgatatttattaggtgatcgtcgatgtgtaagataaaatcaatgagcgtgctcaagtaatcattcctttcgaaaatttataattgattttaccaaattccctgagaagttggcgagttattacctgtcctttaacaaaaaataagttttgttgttaaatcaagggatccacgctacaattattaacagattacagataggatgattattatgagttttaagataggcatgaaggtccatggaacagtcacaggtatccaaccctatggcgtattcctggatattggtgaacatatgcaggggctgattcacatctctgagtgtcaaacaggattcgtggatgacctttataagatctttcgggttggacaaacagtttccgcgctcattattgatattgatgagtattctggcaaaattagtctctccactcgcagcactgatgttaatcttgaaatccttcgccggccaaaaagctttcgtccgaagagaattcactactggactgattaccgattgaatatcggatttaagccacttgccagagctaaaggtggttggatgagggatgcccagaacttttttagttagtttggaagaaagttcttgacccagctttcacaaattggtaaaatattttctgttgtcaattatccatttgatctgctagtgacaattaacatttgaaaaatcaattaaaaatcacttgatttcaaaccggatatctgataatattaaatagttgtcaaaagcgagaaacaagcgcttccgacaactaagtagacctttgaaaactgaacaaaattttcgacaaacaaatgtgcagggcgtttcaattcttcggaattggaaccaaacatttgcgaagtcaattcgtannnnnnnnnngcatagctcaaaggccgaagggagctgaagctaacagaacaaccgcaagctctattgaatcgatgcaaatgcaccaaacatcacgtacgaactttgttcatcgttggctgtctttttgtgtagcaggggtcaggggcgtcgccgagtaggctaggcagcctccaaatgcaaaccaaaatattacaaccacattaaatcaaacatcctcagaacttttccctgaaaaacgctagataatttctaccaaaacctgtagtatgaaaaagttgtgcttttcagaaatcaataaaggggatgagaaatcaatgaaaacattcaagtttcaaagcttcgttttagttcttattgcatttgtattggggttcagtgaattcctaattgtcgggatcctggatgacttgagtcaccaattcaacgtgtcggttgcgactgttgggtatctggtcacggcatttgcgattgtctatgccattagtacgccgttcattacaatcctgattggaagattcaatctattctgggatttgatggtcgcaatggctgtcttcacgtttggcaacattttaagctttttggcacccaacttcttaatgctgacggtgtcacgagtggtcactgccatggtggccggcgtgtcgatctcacttggcttgacctttgccggttatgtagcgccaatggctaaacgcggctggctgttatcttgggtattttccggtttctcaatcgcctcggttgtcggcgtaccgcttggaacctggatttcaacccagtttggttggcggatctcgtttctaacggtcattgtgatctcagttttgacgatgggcctcatttttgtcagcctgcccaaggacttcaaacaaaagaagagtaccatttccgggcagctggcactgttgggcaatcaccggatccaaatcggtatgctgctgccaatgtttaacctggccgcaatctacgtcttctacacttaccttcggccaattattaccaatcaactgcatttttcagtctcaatgctgaccattttgctggccgtctttggaattgccaacattattggtaaccgtgccagtggccgcttaagtgaaggtcctgggatgaaagggatgccgtttgtctatattggccagttcattttaatgatgctgatgccattagtcttcaacttcagttggccgggagcactgcttttgacgctggtcatcttcaccatgccgttgattaattcgccaattcaattattcttcttgcaaattgctgaaaaggattatccacagtcgattgtgttggcctcgtctctgaattccattttttctaatttcgggattgccttgggatccgcgactggtggggtgattgtcagtaacctcagccttgacgcggttggccctggtggcgcagtctacgccgttgtcgctcttggactggtgttgtggttgaaccacttgacctcgaaagggctttcatctcgctccactaacctgtaaaatgtgattgaatacaaaaattttggtgggtgagaatatgaatggatttatcggtgagctgtttggaacgtacgtgttgattgtgctggggactggcgcttgtgccggtgccaaccttaagcaaacttacgccaaaggctcaaactggacgtttatcagtgtggcttggggaatggcagtaacgatgggggtctatgtggcctcgtcactggggtcgctgggtcatttgaatccggcagtcacgattccttatgctatttttggcctctttccctggaatcaggtggtgccgtatttattaggccaatttctcggcgcatttcttggggctgcgacgatcatgatgatcttttatccacatttcaaaacgacaacggttgataatggcaacacagtcggcatatttgcgacccgaccagccatctattcgccggtttccaattatctatccgaagttgtcgcaacctttgtgtttgtctttgcgctgctaaacctgggagattttacccaggggctgaaaccgttagttgtcggcctattgatcatggtggttggtcttggcgttgggacgaccaccgggtttgcgctgaaccctgcccgtgattggggcccacgatttgcctattcagtcattccggtgcccaatcgtggcagtggtgaatggtattattcctgggtaccgatgtttggtccattaaccggtggtatcattgcggccggcctccaagttatggttaaatagacagtatcaattattttggaggtatttatggatcgtgttggaatgaaattagaagccaaacgtataattggcagtcattttccgttttttgtcttattgttcctgccggcggtgattattcagctgggatactcagtggcttattcggccaaccctctgcacgaggctgataccaaccaggcctttaatcaaattattcagggaactgcccactttggcagtaatgaactgttgaatttgtggctgatttcgactttgatctcaatcatttccggccttctcttgtccggaatgatgtttgtctgtattgacctaattcgtaacaaagtgccgtttgatcaaccagtaaccaggtcgtttaccattttgaatcatggccaatacttcatcggcgcgattatgattggcattatcacgactgtactgacactgttatggtcggtactgttgattgttcccggaattatcaagggttttgcctattcgcaggccttgaacatttaccgggattcagtggatgccggcaaaccgattgggtatctggaagcaattacccggagtcgaaaaatgatggtcggccacaagatggattactttgtcatggaattgagctttattggctggtacatcctcaattcgttcacctacggcattttgttgctgtggctgcagccatactaccagttatcgtttgccaatttttatgtaaaaatcgctcaaatgaaccaaactgaacaatgaaaaatcctcatcattccaattgctggaagtggtgaggatttttattatggctcactaatattaattatcgaggtgccagactgtggcggatcagtccgaaacgcgacttaatcacccagggcttgggtcaaatcgttggccaaatcttttgggttctccaatcctgtcgacagtcgtaggagttcatcggtaatcccaagttttagacgatcttctttggccatgtcgctgtgcgtttggagagaagggatggtcagcagactttcgacaccacccaggctttcagcaaatgaaataattttgaggtgtttaaacagccggtcaacttggtccatgttttgtagataaaagctgatcatgccaccgacgccaggatataggactttttgaacttggggcaatttcttcaaacacgctgcgacatatttagcgttgctggtgtggcgttccattcgcacggccaacgttttgaggcttcttaacagtagccaggaatcaaaggggtccaaagtgacgccggttgtattgaaattgaattccagttcactggcaatttcttctgacttggcaatcacacagccggccaacatgtcgttatgccctgaaaggtatttggtggcactgtggacgacaatgtctgccccctcacggagtggctgttgatacacaggcgttagaaaagtattgtcgacgcagaccaaggcgttctgattggccgcatgaatcagatcagccactttttgaatatcaattattttcatggtggggttggagggtgtctccagccaaactgccttggttttggcagtcaccaagtcacttaacttttcgtaatccttaccgttccatttactgaatttgacaccgtagtggtctgccaggtaatcgaagtaacggaacgagccgccatacaaatcgtctgaggtgatgatttcatccccagacttgaataacgaaaagaccagttggatggccgccattccggaactgaccgcgaatgcattggcaccgccttccaggtcggcgagggtcttttgaaggacgcttctggttggcgtcgataagcgtgagtaggagtactgtttgtgcggatcaaaagtttccgcatcctccaagtcgcggtgccgaaagtttgacgtgagatagatcggggttgaaaccgagtggtactgatcgtggttatctcggttcccagcttgtgcaagtaatgtatcgatatcaattaatttgtcagacatatgctcattctcctttaaattatttcatcaaaaaagccttcatcctaaacgatgcgtgttaacgctgttcagggtgaaggctatttcactttaccacctggcttcactgagatttcacaacctcagcctcattaagtacgccatcttgatggatgggatacttggcaaagtaacgcttgctgacgtcgaattagccaaaccaaaataacttggtgaccgattcggagttcagagatcatcttcacatttttaaccagtcttctctcaccaatcgaagctctctttatcagtttaaaaatgctactcttctcatcaacacttaagtaaattaaaatttacataattgtagaatatatttcgttaaaggtcaacggtctatcgaaaatttatggttagatatttcacaatctggacagttttacactacctgttcacttaaacgatcgcgacaacgaaaatgaagccctgaaatgaagcctttatttacaaaggattgtgggttaatttaaggcttaaaaaaggtcaaacttttttgttgagcctatttacatatttttcacaaggtgttaggatgaaagcggtttaagaatatgaatagtcattggaggaagaactcatgaaagaaaattttgattttttaatgcctagtgtgaacttttttggtaaaggtgttattaaaaagattggtgatcgtgcgaagatgttgaacatgaagaaaccgttaattgtcactgacaagtttcttcggggaatggacaacggtccggttgctcagacactggattcattggatgctgccggcgtttcatacgtgatctttgatggtgttgaaccaaaccctaagattcgcaatattcaagctgccaagcaagtatatttggacaatgattgtgacagtattatcacggttggtggtggttcttcacacgattgtggtaaaggaaccggaattattttgaccaacggcgatgatattaccaaattggccggaattgaaaccttggagaacccattgccaccattgatggctgtcaacacaactgccggaactgcttctgaattaacccgccactgtgtgatcaccaacgaaaagaccaaattgaagttcgttgttgtttcatggcgtaacattccgctggtttctttcaacgatccgatgcttgaattggatgtgccagccgcaatgactgctgcaactggaatggatactttcgtccagtcgattgagccatatgtgtcaaccaaccgcaacgaaattaccgatggtcagtgtattgaagcaatcaaattatgtgaggaaagtttgcgcgaagctgttgccaacggtcacaaccttgaagcccgaaccaagatggtcgaagctgaaatgttaggcggcatggcctttaacaatgccgaccttggctatgtccatgcaatggctcatcaactgggtggtcagtacgatgcccctcatggtgtctgctgtgcaatgctgctgccaattgttgaagagtataacttggtggcatgcccagaaagatttgctgaattggcaaaagcgatgggcgaaaataccgacggcctgtcaacacgtgatgcagcagagctggcaatcaaggcaatgcgtcaaatggccgatgatgtccatattccacgcagtatcaaggcaattggtgccaaaccagaagactttgaactgatggccgagaatgctctgaaggacggtaacgctttctccaacccacgaaaagggactaaagaagaaatcgtccagttgttccagaaagcttatgacatgaagtagagtgcgacgagacctgtttagggcccggagcataagcgaaagcttccaatgatgaacggtctttgttcatcgttggaagcttttgtttatgcagtagggccctgggtcgtcggagcgtattttcaaggccgaagggattacaaaatggcataataaacgcgccacccgcgacgagatccggttagggcccaccaagtaggctagggcgtttccattcgcccgacggagcatatttcgaggattcaaaagttgtcttccggatccacaaacccaaaaaccttccaacaatcttcacactttcttcacaacttggcgagaatattaagataaaattatggtgtagataagatattacccaaaagaatcagaatcaattttcaatattggagggcgtttattatgaaaaagtttgatctggccgatgcggcattgctgctacttattccattgacgatgatcggcttctccgctagtattcatacccgtgatcgcgatatttctaccaccaaggccgcccaggtgaataagattggtgaaaatatcgatacagaatattcaggtgattccgacttaaacaagggcaacatcagaccgctgtattttcagccgtcgcgggtttttagtgtcaagtaccggacggttagttttaaaacggttttggacgaagactatcgggaagaaaaattatatcgttatgttccgggggctaagaaaaacaatcgcacttatcgttggtcaaccattaaggcccgcaccggcaaacgggtttacgttgataaaaaagcgaaagcctactatcgggacgatgacggcgaacgcgaaagtgaagatttctaccggatccgcgtttccgcgaacaagcatgcaacgcgttactgggtcaatgaagatgcgattgacgactgatttttaatccatttagttgaatcgggatgagtaatctttgccaaaccaactctcaaaaaatgaccaattatttcattttgaaatggttggtcattttatttgaatcatgaatcaatttgtggctaattatgataaattagatgtataaaatcgcttaactggaggtgcaatttgaagatattagtaactggtggtgccgggtttattggatcaaatttcatccattatctactcgaaaatcatccgactgatcaggtgatcaactttgatgccctgacttatgcgggtaatttagcaagtttggcagatattcaaaatgattcccgataccattttgttcagggaaacatttccgatccgcaggcggtcgcacaagttatttcaacctatcagattgattcagtcgtcaattttgcggccgaatcccacgttgaccgctccatcttacatcccgatgcctttgtccgaagcaactttgtcggcgtcagcacattactggatgtggtgaagcaacagcgggttaacaagtttgttcaaatttccaccgatgaggtttatggcagctcacgggggcatgagcagttcaatgagtcggcacacctcaatcccagttcgccgtattcggcgactaaggccggtgccgacctgctggccctttcgtactacaagacgtacggcatcaatgtgtcaattacgcgatccgccaacaattacggcccgtttcaattcccggaaaaattgatccctttgatggtcaccaatggccttcggggaaaatcactgccggtttacggtgacggcaaaaacgtccgcgactggctgcatgtgtttgataattgtcgcgcgattgatgccatcttgcgtcatgggcggccaggcgggatatataacattgccgctcacaattacgaagaaaacattcaaattgttgcaaaaattgttaagcagttggaattgcctcagtcgatgattgactacgtttccgaccgaccggccaatgatcagcgttactcaatcgatgatgcactcattcgcaatgaattaggttggcagccgaccattgattttgatcagggcatttcccaaactgttgattggtatgtgacacatgaaaagtggtggcgaccgctgttaggcgccgtccacaacagataatggggtgaaatcatgaaaatcggttttattggtactggtgtgatgggcactgggatgattaaaaatttactcaaggcgggctacgacgtcacggtctataaccgtaccaaggaacacgccaaggatgcgcttgatgcgggggccgcttggctggatacaccagccgaagtgaccaagaacagtgaggtggtcattaccattgttggctttccaaaggatgttgaacaagtatattttggtgacgacgggattttaggggttgcccacgctggccaaacgttgatcgacatgacgaccagctcaccacgccttgccaagcagattgccaaagctggggaagccagggacattggggtccttgatgcacccgtttccggtggggatgttggcgctgccaacggaaccttgacgattatggtgggcggctctgaaagcacatttgagaaatcaaaacccgtgttatcggcaatgggcagtacgattacccggtttggcggggctggtcaaggtcaaaatgccaaaatggccaaccaaatcatggttgccgggacaatgaccggaatgatcgagtcacttgaatatgccaaacatgccggcatcgatttgtcgcagatgattcgaacaattaatggcggggcggcagcaaactggagcatgactaattatggcccccggattcttcagggggacttccagcctggatttgctgccaaacattttttaaaggacctgcggattgcgttggatacagctgatgaaatgaacattaatttgccggcgactaaagtggctcgggacctctacgagaagatgactgacgagttgcatttaggcaatcttggtactcaagggttgctcaaggtttatgaaccagataacaactgagtgattttgatgcggccggaagctgcttattggcgcacagttctgctaaataacattcaggcgcaaaacggggctggaacaaaatttttagttttgtcccagcccctttctatccgttcgattatttttgctgatttttgcgttcttttctgctttggttggcagaaaccaggttgatgataactgaaaccaacaaacaaattcctgctaaaataaccaagccgattttgacatcgtctggaaatgatgacttttgaatgaagaaggccaatgcgattgaaatcacaagggcagcatctgccacgatcagtttcggcgaaaatcccattgtactcacacctttcaaaaagcattataacaaatcggctgtccttgtcacggttatttgaaaattttgtctggcaggccaaagttgatataataagactataaatgaaggttaggtgaagatcatggcagaattggacagtaacgacgcatttattgatacgaacaagttaatatttggcattggccaggtgcaacagatcaccggggtttccggaagacaattgcgttactgggaagaacagggctacattcaatccatcagccaaaaaaagggtgcagcacgagaatattcgctgcacactttattctttatctttcacgttactcgatttctgaataacggctttacccttcaggcagccgttgacagagctaaaaaatttgatcgccaattgccggtcctgcgacaattcttgcgcgctcaactgcaaggcgtcaacattgatgatgaccaaagtgtcttggatttcggctacgttgattcctcacacacacaacgaatctatggggtcgttaaagatggtgagacgttctttcgaattgaaaatgttgattaagcatcacatcacttatcgaagcgctggctgtggccagggctttttattgtgcgctcaatcaatcgtcttcgttatcgaatttcttatataagccaatgattgtcttatcttttaattcgactggcttaccatccaacgtgacgtcgacaattttgtaatagtcttccaggtcagggacctccaaacgctgattggccaggaagtcggctgcagacttgtattcaatggactcggtgccgccgccgttttcgtatttgatttttaacatgatgccactttctttctatatagattaaccttattgaacaacttaattttagattgaacatttttgaaatacaactaactgcctttatgaaatttctgtgaagaatgtttgccttttttgagactttaaattcgactgaaaaattgggccatgatatattattgatgaggggatggctgtcgtaacatcctaaaatttaatattgtaatgacgacgtttaattagggggaattgaatgttgaagtttaagcatatttttgttcttgtgttaaccacgttgattttagtgattggtttttctgcattaggcagtcaatccgcttcagcacaaacaatcaaatttaccagcgcgatgcacaccagcaagaatttgacttacaacggcacaatcaagtactacgttaaagcggacgcaaaaaaatattcacctgaaatcacctatgcaactcaaaaatggaataaagcccttggcaaaaaggttttccaacgtaccacctcaatcagccgttcccgattggtcttcaccggaactaataagcttaaccggaattacgcgggggtcgcagaaattaacagtggcgtgattgcattgaacacctcatggatgaatcgatacaatcagcagaagcgccgagcagtgatcattcatgagcttggccacacgtttggcaccaaggatttgtacaattatccaaatggggcactgcgaagtttgtttaagcagcagacgatcatgggcggtaactatgccaccagcattaaatcgtttgatgccaaattagccaaatggacgttgagaaaaaccagaagcatgtcccaaaccgagtttcgccactatcgttcgaatgcgggactctactaccaacagatgcttaacggacagctttaatttctgctgagagaccattgacaagcgattgtccaaacactatgattaacttattgttttatggacgttgacgcagtccggtagtcaattaacttgagaagtcagaaactcagcggtagatgtgagctgagcggttaatcgacgaacatacagctgctgagtcttcaactatgtgagacggatcatctcgttaccgatgaattgagtggttggcgatttttcgccagtaacttgggtggtaacgcggaaaacttttcgtccctgacaattaattttgtcagggacttttttatttaggaggaattatggaatgaacattttggaagatttgaaatggcgtggcgccatcaatcaagaaactgatcatgaaggcttaaatgaattggttaatcaaaagtctgtcgggatttacgtgggaattgacccaaccggcgacagtatgcatattggccatttgatcccgttcatgattttgaagcgattccagctggctggtcatcatccagtcattttgatcggaagtgggacgggctcaattggtgacccaagtggtaagaaatctgagcgggtccttcagtcgatggataaaatcaagcgtaatgaaattgcgctgactgctcagatggaaaaattgtttggagaagacggtaagtttgagattgttaacaactacagctggctgtccaagttgtcactgcttgattttctccgcgattacggtaagttgttcaacgtcaacactatgctgaataaggaaattgttgctagtcgtttggaagtgggaatttcgttcactgaatttacctaccagattctccaggccattgattttcttcacctttaccgacacaatgatgttcagcttcagttgggcggggctgaccagtgggggaatattacctccggaattgatctgattcataagatagaaggacccgatgccaaagcctttgggttaaccattccactattattgaagtccgatggtaccaagttcggtaaatcagagggtggtaatgtctggcttgatcccaaaaagaccagtccatacgaattctatcaattttggattaaccaagatgataatgatgttatcaaataccttaaatattttactttcttgtcacaagatgaaattgccgacttggaaaagaaagttcaaactcaacctgaaaagcgtgaagctcagcgtaaattagccgaagaagtgacggagtttgttcatggcaaagaagccgttaagcaggctgaacatatcactgcagcattattctcaggaaatgtggctgatttgacgacaaccgaaattgaacaaggcttcaagaacatgccatcagttgaggtttcatcagaaccgttgaacattgtccagtggctggtagatgcgactaagattgaaaagtcacgccgtcaggccagagaagacattaccaacggtgccatcagaattaacggtgaacgcattgaagatgttgattacgaaattaatccggcgaagaagtttgatggcaaatttgtcattgtccgtcgtggtaaaaagaagtactttttagcgagagttaaatagaagcaaagacagatcgaacgatgatctgtctttttttagttgacaatgttcatcaaagtcggtatattatttagtgcggcttttgcgagaatgacttcttcgcagagttacaaattttaaaaagtcattgacacacattgcgcgtcatgataatattaaatagttgtcaaaagcgagaaacaagcgcttccgacaactaagtagacctttgaaaactgaacaaaattttcgacaaacaaatgtgcagggcgtttcaattcttcggaattggaaccaaacatttgcgaagtcaattcgtaaaacaaataataaatttaaatcatgagctatcacaggcttatcattttaaacaatttaagatgagagtttgatcctggctcaggacgaacgctggcggcgtgcctaatacatgcaagtcgaacgcgtctccgttaatga

SEQ ID NO: 215 - DNA, 8296 bp, Lactobacillus buchneri
gataattgaacgctcctttagctggttggaaaaatatcgtcggctctggaaaaactgtgaacgacagctgcacaccagtacaacgatggtaactttagcgtttgtctcagttttcctacgccgcttttagagatctcaaacagtttctaagggcggccgtggctcttttaaatcatcgacaattagtttaaagctgctgacgatgctaaagaagcaggctcagttaggccataaagtgaacgttgtctgcattcgggaaaatacggttaacctgcgtgactctgtatatggccaaatttgctgggcaatcgatatgctccatatgacggatgaattcaaatattcggtatcaccaatgcgcattacccatatttcatcggggagtgcgttttatttttacggtggtgacaaaccagaaaagttaaaatccaataccattcaaaatgttattgctctttggtacgaagaagcagctaacttcaagagtgctgaagtatttgatcagaccaatcccacatttattcgtcaaaaatctccttgggttaatgatgtaaaggtattttatagctataatccaccacgaaatccatacgattggattaatgagtggattgctttacaagaagaaaatccgcaatgttttattgatacatcaacatatttagacgatcagctcgggatcactcaagagcaacagctggcactgattgaaacatacaaaaagaatgatcctgattattacaaatggttatatctcggcaagatcattgggctgggaactaacgtctacaatatggagctgtttcatcccttaactaaattatttgatgacgacccattagttaatctttacttctcaatcgatgctgggcacattaattcagcaactacttgtttagcaattggtgttaccgctgaaggcaaggtcatcttgctgcacacgtactattacagccctgaacaccaatcccataaaaaagctcctagtgacctggtgcctgaaattaagtccttcgaagactcaatggattatcaccagccgattggcaaacgaacaatcgattcagctgaaggtgcattacgaaacgagtttgttaaagaatataacgaggtttggcatggagtagccaagagcgacgaagctacgatgattgattatgtatcatcattgttggcacaaggacgtgtgtactatcttgatacacctgaaaaccaaatatttattaaacagcatgagcaataccaatgggatgagaagacagttcatagtgacaatcctaaagttgtcaaggaaaacgatcatacttgtgacgcttttaagtatttcgctattgataacgcaaaaatgctggggctaaaaattgacccacaacgtaatgccaaagttaaattgtttaagcgaggtctttaaaaaaatgaaaattgatgagattctgcaaaaagaatatcctaatattcaagatacgtttatttctggtaaggatgcatcaaaactgggatggacgaataatgacacggttaatctgtctggcagtgcttatctagacgataatgatgtttttcattattccgctactcaaaatattaaaaataacccaattgatttattcaacatgattaacgtgcaccgaacacggttaatgccaatatatatcatgaaacgccaatattataagggacgccatataaacattttgaatcgggaaccgacaccgcatggtgatccagataatcggcgcatcgttaacatgcctaaaaaactggttgattctttcaacggctattttatcggcacaccaattgatattgcttatcaggatccatctgatgaagaaacagcggagagcaacaaagttaacgatctgattacggcaatgactaagcatcaagtcttggatgatgtatttacagaagcgtccaaatggtcaagcgtttatggacgcgcttatttgtatctctatactgatgagaaagcctatccccatatcacttttctagatcccttaaatacgtttattgtctatgacaatacgattcaaaataaacccttatttggggtaacctacagttactatccggatagcaagggtaacgaatcgttacatggacagctaattgagattgatgatacggtgccatttagtaactctgctaccagcgatgcgtccttagtatttgatgaaaatcccgatccagacactggggtagatgataatttgggacatcccttcagccaactgcccattgccgaaatcatggacaacgaagagcggattggagttttcgacgatactgttagtttggttgatgacttggatagtgctgttagcgctaaatctaacaactctgactcatttgcggctagcatcttgaaagttattaattctgaacttgatgatgatcaacttaaagaaattaagcagtcaagagtccttaacctatatttggataaagcctgggctgaatctgatgagtctaaggctttaccaacgccggatgctgaattcatggagaagccttctggcgaccaactccaggagcaccaaattcaacatgatacggacttcatttaccaagttgctcaaatccctaaccttgataatatcgatttcagcacttcagcagcacaggcgcttgattttaagattcattccatgaagatcaaagcactgaataaagaaaccaagatgaagaaggcactaactcagatttgggcgtgtgctttgcaggcacaggggatcaatgttgatgacgttgataacttagagtacacctttaactttacaattccgcacaacctgttagctgaagcacagacagcaaatgagttacaatcaaccacttcgcaagaaacggcgattgcttctctttcaaacgttccggatgctaaaaaagaaatgcaaaaaattgcggctgaacaagatcagatggcacaacaggcgaaagcccgtatgtcagacccatacgccgataataataacagtcagaatgacacttcacagactgagagtgatgattgatgaaaccaattagtaacgctcaagagaaaaaatacattgccaagttgcttaaaagtgatgagcaggtttacggcaaaagccacgacttttatcaagtggcactgcaagagattgaagatcatcttaatttcttcattgctgagtatggtgtcgacggcttattaaaatatgttgaacttttgaaacgtgattcggctgctgataggcgtcgcctgcttcatttccagatcaaggcacggataaacaatgatacccagtctcagaatcgatctaaagaatatgccagaaatgcgccgattgatcggtaccatactttgaattctttgattggtttcagtgttgctggcgcaacgattgccaccattaagttacttaatcaaacgttgaaaagtgattttaaacgtgatgttagtcgccaattcaataacaaccggttagccaagaaagccggtgcggacattgttaaggccgccaggattactaaacgagaagtcttacgtaattctgagcagatcattagcaaaactgttgatggcagccaatggagcgatgatctatggctttacaatgacaatctggttaataatgtgcaatcgttagtggcgaagtcgttgcgaacgggattaaaacaagcagatgtcaaccagttatttccgagtattcgtacggctaaaccacagacgataaccggcttatttaacactaataatgcttatatcagacgcatgattgttactgaacgagcccgggttcttgaccggtctaccacacagatgtttaagtcacaagggattgcttattttgactggataactcagccgggcgcgtgcgataaatgtgagggaattgccgatgatggcccgtatgctgttaatgatgctagctctccgagcattcctgatgattcacaccctaattgtcgttgcactaaaattgcacacgtttcgttagttccattattaggcgttgctggcgccatagcagcaactgaccattcaaataaaaatcaaacaagtgatgatgagcaatgagtaaaaatttcattgctttttattttgccccaaacatgcttaaggcattaaactgcgcaaggaattaacagccgacaggctataaacggaggcaacacatggaatcagataagttaaacatgaacttgcagtattttgctgacgctggccaagtaggtagccaatcacagcctggtgcacaaggcggcgataatggcgaaggtggtcaaaatgctgacaataataccgcaacaaactctggtaatcaaaacggacaatcatctcaagactttattaagagccttgttgataaagtcgccaatagtgccaatcagagtcaaagtaatcagaatactaataaaaatagtgatcaaactgataatgatgacacatcgtcaaaagacaatactgatgataataatggcgataacagtagcaatgacaagacatttacgcaaaccgaagttgataaattgctcaaagatcgcgaattccgtgcccacaaaaaaggtattgaagaaggtaaaaaagctggtaagagtaacgctgaaaaatacgcacagatgaccgacgaagaaaagcagcaggcacaaatcaaggaaatccttgaagaaaacaagcagcttaaagccgaaagaaaccgttcagatatgcgtgatgaagtgcttaagcagcttaaagatactggatatcaatttaccaacgaagatgttgacacactggttagtgacgatcctgacacaactaagcacaacgtagacaactttaagtcaatgcttgaccgggttgttaaagaaaccaaaaaaaacatgtttaaaaataatcaaattccaaatagcaacacacagcaaaataatgctgctcctagttttggcgaattagttgctaaaaaaacgctgggagatccagatagatttaaaggaaaattctttgataaataaaaaaataggagatgtaacctatggctgatacacaatactttgccaactctgatccaagagttcggcaagatttaactgttggcttaccaggaacaattgacagttcaactgttactgctggttccaatggtaagaaagttattttacaaggtactccagttggtgcggcagttgactggctaagtgccgatcaatccgcaggcgttaccaaattatcagaatttacgggtgcggaaggacaagtgtttgcgggcgttgttgctgcagacacagatgttactgcaggagatgcagacgtaacaatttggtttgaaaatgtttatttgcgccagaaattacttgatagcactgttgtagccgcattacaggcggtcgctggtaagacatccggcgttaaattaattaatcgataaggagatgttatatcgtggcaactgcatttgatttactaacttccaattacctgcagggctattggaacactaatccgcaatacacagctccctatttgatggaagctttatttacccccactaaacaacaggccgataatgttaaattaattaacggccaagacctatatccggcaccacttgatttaaccaaagaagattcagcagcattgcctgttgaacgtggttcacttcaaactggtacattaccaacttacaaatttaaaaacaagttgaaccttaatgagtacgattttaaagatttaaataatgccattgcatctaatgacgaaaatttgattttgaccatcactaagaaattgtatgatgatcaagccaatttacttttacgtgctcggtttactcgcgagtattacgccgtccaagcacttttgaacggcaagctgcttctaggtaatcaactggcagactttggctatgagtcattccagaatatgaaagttgctaaagtatggactgatgattcctctaatccatatgatgacatcagtagtgttaaggatactgcctcacaaaaagttggtacggctttaactcgggtcttaatgaattcaaagactatgtatattttgatgcacaatgctgcactaaaaaacaccattttttctgggacggtatcaccacagggaaacattcttactcagcctgttgttgagcaatggttctcagcgttcctaggattacaggtagttgtttatgataaaggatggaataacaacggtacgtttgaaaaattcattccagatggcaagattattttcttaccagggactgctaatgaaccaattggtcaaatgaactttgtggaaactccagaagaaagcgtttcggtttcaggaacaacagtatctatttttgacactggcgtttcgctatcaacgagcgcttcctctgatccagtgacggtcaagacaattgttgatgagaagttcgtaccgacgattaccgttgctaagcaagtgtttattcttgacgttacaacggcggcttaaaaggaggaatttacatgtttccagatcaaattgatacatcaaagaacttctccgaaaatggcaatgtttactacattgttcaagaaggagacgaattgtgggcagttgctacggctaacaacacctcgacacgtatgcttgccaaccttaaccgcatttacccacaagaagatttaaagccaggaaagaaacttattatttcaaaaggtgctaagtagaaggtgatcacatggattatccgttcgaccaaaatgacgttattgccagtgtcaaatccttatctgacgttgaactaagtgatgatattcttaatagcttactgccaattgcttatggattgcttaaaccattgaatattcccattaatgacaagttcgtttggaaccaaattatggaaatgaagatgttatcgcttatctggattaattctgaccttggaaagggaattctagtggataacttcaaagatttacacacccaatataacgggaatgcagttaaccaatgggaagaattattaaatgatttcctgatccggtatggatattcaggttggaggattaaacttggatgatttattctcagacgacaatcgattccctgaaatcaaggaagagtttagaaaattgaatcattatatggttgaagttggtgtaatgaagcccgtgggtaataagtcgttagcatttatgcagatgattgctacggttaacgagtttggcgctgaaatatatcccaagaatggtccatatttaattgtgccaatgagggatggtacattttacaagcttaagcacgtcaaaataccagaacgttcatttttgcgtgatggagttgatctagggatgcacaaaattgtttcatgtgtcgaggacggattagctggcatcatgggtggtgatatgacagcacgagaactatatgaagctgtaggattactgatagagcagcgtattaaagatgaaatagttcttaaaactagtcctcacaatgctgctttaactattgaaaataagggaaaagacgatcctctagttgatacaggcgcactccacaagtcaattggtgtgaaggtgatagaaatatgaaattcagtaaaaagagtttgatcaaacgttatggtattccgattagaatatatcaaaatacctcatatactgacggtggagcaacattaacgggagatttcttaagaactgattttcgtcagcaaccatatattgacgatagtgaaccgataaccccagttagtcctaatgccgatgccaaccaaataatccttactggtgatggtaaaagtgtcaattatagtcacgaatggtattcaatgcatctacatgtccccttgggaactgtcattgccattaaaaacggtgacaaggatactcaatgggaatatcttcaagtcgttggtcaggatccatattatggcatgtcggatgcttgcatctattacctaaggtcgaatagtcaggaggtgcaaagcgataatgaagcgaacgatcaattggcaggaaatactggcaacaatgattcaggagatccgttctttaactagggtccgtctgaaaactttatttcaggcgaatcagaatcgccgccaagtaaacgcgttctaaataaacgtgagctaacttgtcatagcgggtcgcaattcgccagaagttcttcagttgattgaagaagttttcaattaagtgccgttcacgatacacgtagtagtccaccggccatttctctttagcgttactcttgggcggaatggtataggtgccttcctcagcttccaagtattggcgaaaagcctcactgccataggctttatccgcaatcacattgacgccggcaatttttaactga

SEQ ID NO: 216 - DNA, 7797 bp, Lactobacillus buchneri
tgaagcttccagatcctggcggatcaaatcgaattgttgccgagaaatatcgctttggtaatgatgactaaaatgttgcatatgatcaccaacttttttgacagtagtttatcaaattattgggtcaaaatcaaagatactaaacagcttcttaagccggatatactttcaagattccccaacgcctcaaaaaattcataggcaccatcctgctcaaattcaagcgggccatcaatcttaagctttttaatgcggtcacggaccccatcctgttgccaaggaagtgaaaagttctcgtgaatttttttgatcgtgccgccatataaagtcagctggtcatccttaaccgtgtaggagacatcttcgacctttcccgataggtctggatttgcctgctcgtcttgtgaagggtcactcgtgggagaaaccacggcactattggaacttggggcggctttcaccacgttggtagacattcccactcctaaagagaggccgagaatggtgctatataaatatttctttgctagtttcataattagccttctcactatcctgatattttgatttgcgcaacttcggtttggtgaccagttgtggacatttaatgaaaacgctactaattttaaaatattgtatcactttaaccatttatgcggtgacaacttgctcatcgcaatggtctgtgctaataatccgaatctttaaaggctgaagtcagtgtcttatatcaccaaacaaaattcaccgcccgcacccgtcctggtggtatcataaatgcatcaagattaggaggcttcatcatggaattaacggcaacagactatgaaattttaaaggcaatttataccggccgggtatcatccggcaccccggtcaaccacttcgtcgattattgtgataacgtcattggcggcgatcccaagccactggtcgcagccggctacatcgtgaccgaccacaacgaaatcaatggtttaacagaaaagggcaccaaggcttacgaagcccatgcagcccaagaatcaaacagctaacaaaaagtcatcattttgcatccttgagactctctcaagcaaatgcaaaatgatgacttttaatttagtgattttcttgttctttttcggcagctgtcgcatccggaataatcacggtaaacgtcgtgccctcacccagtttggatgaaactgaaatcttgccgccatgggatttcaccaactggtgaacaatcgccaatcccagtcccgactcaccgtacttaccggttcttcgtgaggcatcggctttataataacgttcaaaaatatttttttgctgatcctcggacatgccaataccggtatcggcaaccttgatgatggtctcgttgtagccccgttcaccggtcacggtaatcgtcccttgatcagtaaactggatcgcattggtcacaatattgaagacaatctggacaaaccgatcataatctgcataaattgacaggtctttaggggcgttcaaaacgagcttgtcctgcgattcttctgctttgctgtccaactggtcgatgacgttttcaaggaccttagcggcgttaaaatgacgcttgtcaagctgaatagagttggagcgaatcttttcgtaatccaaattctcattcaccaaccgaatcagccgctgagtttcactactcatcaagtcaatgctcttggcccttgactcctggggaatcacatcgtacttgattccttccaaaatgcccgagattgttgtgagaggagttcgcatctcatgtgccgcattggccaagaattcctggcggcgttcttcctgccgttgaatttcattgttggcctgctgcaaggattgggtcatgtggttgaaatcgacgatcaattcgccaatttcatctttcccaccgggtttcaagcgaatcttgtaattgccgtttgaaacctgattggcggcacttcgcagtttgctaatccgtcgattcagccgtctggcgatgaagtaactaatgaacatcgaaatgagcaacgccacaaacagcgcctttaacaaatcgcggttaatccgcttgacgttggagttaacatccgaaataaaggcaccaaccgtcacggcggccactagttttttcttataatagtatggctttaaaacttcaatcattgccggccgggtcttgccattgctgagcttgaaattcttattattgaccttccgaacgatctgattgcgccgcaaatgctcccagtctttctgggtaattcggggggcaacgccgttattgggatagatcacctggtcttgtggactgaagacggtaaaatggaccgcttggttctccaacaaggcttcagagttcttcaacttctcttcgtcaaaggtcactttggccttattcttggagctaatcgtcagcgattgttgaatcaaactatccgaatacttttccaagttatgccaggtttggtcatatacaaacgttttcgacatgcggctaaatgaaaaacccagcaataaaattgtacagccaattaccaaaaagaacgccaataattgctgataaatcattttcatttcttcttgcccacttcactatcatcaaatttatagccaacgccccaaacggtttgaatcacttgggtgccaaccttctcaatcttttgacgcaactttttgacgtgcgcatcaacagttcgttcatcaccatagtactcataattccagaccgtttccaaaagctgctcacgggaaaatacctgacgtggcttttgggccaacgtctttaacagttcgaactctttgggagtcagatcagaaatccgcttgtcatccaaatacacttcccgagtactggagttcaatttaaagtgatcagtttgaacgtcaaagacatttttggccttctcgtcctcagatttctcttcagtttcagtgtgggcccgtcgctgtaaggctttgattctggccaccaaggtaattggggaaaacggcttggtgacgtaatcgtctgcgcccatctcaaatcccaagacctgatcactgtccgaatcgcgagcggtcaacataataatcgggaccgtttgtgacttggcccgaatttctttggcgacttccatgccgtcttttttaggtaaattaagatccagagtaatcatgtcccaactatcaggatcttcgttaaatttgtccattgcctcaatgccgtcataagcaaatgtgacatcccagccttctttttggaagaacatctgcatcatttccgacactgatttgttatcttcaatcatcaacaatttcattctaaaaccccaccttcaataactgattgcttccaagttcccgcgtttccaatgctttcttaaatgattttgagaaatcgactctagtttgccggtccacggatcgttgtagtagtaaagttttctgttaaaaccggtcaacaagatcaagctggactttaaattatcgaggccggcaactttgactaaaatcggtcttctgcgcaaaagctgcttatctaatttgcgaaaatcaacgccgttcagatcacgaattgagtgggttaacgaaataatcaagtcactcaaatccattagggttcccgattgcgcgtgccacttctcaactttgtctcggatatcgctgacgtcgacattaatgccggcgctgttaagcagcattaaaatcgccgtacactgattatcaatatcggattgcgtgggctgcttaatcggttcaacgtccaatcggcgaaatgtctttcgaatatttcgtttgggcagccagccttccagatctccacaagtgaagtggtaccagactaatttgttgaagaagctaatctcatcaatcaaaaaatcctgtgccttgatgctgtccggaactttaattttattttttggatttacatttttttcgttaccgtttgctaaataccaatgttcgccgggaattcttcttagtcgaacgaagaaacggctggtcttttcattcgcaatggttgttttttccaatcgtctcaccccatatataacccattttaccaataattagaagaacttgcttggaaagtcgcaatattgttatgatagtaaagtatatgattataaaattgataatgaaaaggatggcttatctatgtataaaggaattgcgttctttgaccttgaccatactttatttaatgaacacacgcgtgtcgacgacgaagtggctgatgcgatgcgccaattaaaagcaaatcaggttctcccagtgatttcgaccggcagaaatttatttgaaatccccaatacaatgcaaaagactgggattaacactgtggtttccgcaaacggcagttacgtcatttttgaaggccagccggtttacaaagctgtcctggaaaaatctgttgttaaggattttgtggcgtttgccaaatccaaccacgaagcaaccacggttatgaacagccagggtgccaagattaattttatcaatgacatcgtccgcggcaattataacttcattaactcccggatgccaaacttgggcgtagatgatttcattgagaatcaagaagtgatcatgatgttgattaacaccaaggggcctgacgaaagatacattgaccggttcgccgacaccctgacattcttcagaaataccccgtttagcatggatattgttcacaaaggcagttccaagaaaaaaggcatccaggagttgattgccaacgccaatctctccggcatcccaacttatgcgtttggcgacggcaacaacgacattccgatgttggatttcgttgatcaccccgtcgtgatggaaaatggactgccacaggtgaaaaagtatgccgagtttatcacgaccaagaataccgatcatggtatcgttaacggcctcaaatattttgacctgttgtaagacacaattcttctcagttcccgtgatttatgatatgatgtgtattgtatcggggtcgttatggattcgacgggtataggttgagtctggattgcgtttcgtgcagcgccacgttaaaccgcccagtttattataactgcaaaaaataataacaattcttacgctttagctgcctaataagcgcttaacgtagatcctcctaatctcgcccatgggttagatctgggtcctaaatttagtgggctcacgcagtttgctcccacctgaagtgaactgaagagactaatcaggttagcctgctgtgggtgccttgatttatggcgtttcagtaggtgaaattcaaataatagatctatgaacgtagatatctaggtggcaatatgctcggacgcgggttcaactcccgccgactccatcaatatactaaaaggtcagccatgacagtgcacaaagcattgtcatggctgacctttttatgattacattgatttggtcattcaaagtaacaacagaaaaattaataaaatggcgagaaatgtcgtcttgcaatcgttaatcaaaactctttcgtacccggttcaaaacgattagaatggccaaagccacaaccgtatagacagccccactgtatcccagtgattttaatcccaagtgattgaacaagaccccaccggttgcagatcctaccgcgattcctacgttattaaaaatcgaaatcaaggatgaggccaagaccatcgactgcggatagtctttttcagccacagccaggtagaaaatctgcattggcgagttcagcaagtacatcgtcaggcccatgataattaaggcggccagtgcagcccacggcaacccgaataacagcgaaatcgccaacatggtcaaagcttgaatcacaaacaccgtgaccattgattttaagccattccgattcgccaaccggccgctgtattgattactgaacaacgatgccagtccaaagacaaacagaaacggcgtcacaaaactggttggaaaatgcagtccagacgtcacaattggtcgaaggtaggtataaacaacgtagaccccgcctaagttaagaattggcagacaaatccccaagagaatgcggggatctttgaaaaggctgaattgttcacccaaactctttgctttcccttgccgcaaatctccaggcagcgacaacatgaacatgaccgtaatcatgactgagatgaggacaattaaccaaaatgcccagcgccagccgacctgatcactaatccaagtcccaatcggtactccgaaaaccgaggcgacactgtaccccgaaaagacccaagaaatcaaccaggcacgtttatctcgtggggcaatgactgccgcaaaggtaatcgcaattgaaacagttatcccggcaaccactgcattcagcactcgggacaaggacagaataaagaatgagttggccagagccgtcatgacattggagattgtgaagacactcaacaacagcaacatcacccgcttgagtcgatgctcgcccaccaagatggttaaaattggcgtcacaatggcatagacaatcgcaaacatcgtcaccaagaagccgacgttggaaatgcccacgtcaaaagaatcggccaaatcattgatgattccaacaataataaactcgctcatccctagaataaatccaattgaaatgagaatgaagctttgcactttaagtgatttcatgtgttcccccccgtcaaaaaaatttatcaaaaacgattatacattatctggcactgtggttatacctcaatcgagcaaacagttgcatttgtcgaaatcagagcccccgttcatagatttgcttgcatctgccaagtcagccatgctataatcgattttggtgccaaaccacggtaagtaagtaacgatcggcgcgtatgcgttcagaaggtcgaagctgcttgccatttttttgttttaaggaacttttaaattcgcatgcctggtttccttcccagattgaatcatgattaaaaatgttataatcgtatcgtaaattgtttgagggggattcaacatgcaaaatcaaacaccatcacgattgcagcagaagcaatccaaacaggaacagaaaaaaactaagcacaccaagttaattgtttggttaagcgtcttggtgattgtcctagtcggttttctttacgttggtcatcaggttcacgaattaaccgacgctcagcggcaaaccaatacaattttggataaacccattaagaatacggtcgtgaaggttgtggaacccaagctaccggaagaggtccgtccacaagttgtcaaaatcatccaggaagaaccgctctatcgcctgcagcaggcagccgacaacccaacgactttccagcagattgctgacaagtatcaggtgccggaaacctacgttgcccctgccaagcagtactggttcagtcagcagaacgacgcgttgagatcagacatctatcatgccaagctcatgcagattatgtctgaactacgagcgttagataattcaaatcagtaagcttttggagagatagccaattggcatcttctatttcgacaaacatcatcaagaagccgttgaccaatacccagggattgtcctcggaaaaccaatcaacaaataatcgcatcaaatcatccagcagcgtcattcatggcgttgctttttatctgccatcattttatccaacgtcaactttcctcattttgagtttctttattgaaaaaaacatgtaaaatattaataaatcatcattttcataaatacataagcattggagctcagaacatgaaaaaaatattcgcactcgcattgaccttaatcgccgtcatctccctctcagggtgtagcggtcagaataaaagttcttc

SEQ ID NO: 217 - DNA, 3771 bp, Lactobacillus buchneri
ttcacaaaaggtttcgattttaattcgttcggaataggttatactagacaaaagatcagctcctaaaagatgggtttgtggtaaacaccattttaaaggaagctgatcttttttgtccgaacagcgttcggattaattttacaatctaccaaatgcataaaagatttctgaattgtatagaaatattggtctacttgtttcatcatattgctatctcaatcaaccgttctcacattttccttgcttcgaattaagtcaacaattagtaaaactgctattcctaataaaaaaactacggtaaggagcacagtcgtttgcattccagttaataaatgatgccactctaacttaatccccatcgttttttcaaaatggctttgctgaccatgaaaagcggtttttaatttatctgccataagtatttgtcgataaatggctgctacatatgcacccggagttaatttgataagtaactgcgcaaagttaggaagaataccaattggaatataggtacccactaaaaagccagaggccgtgccaacaattgttcctatagcgttcaaggaatcaaagcgactaataaaccggataaacagcatattaattacaactgctagtaaagagctaaaaagagcaacgcaaattacagctggtagcgactcccatggcatggtcaagttatctgtgattgaaaagtatcctatcatcagtgcgaacataactatttgcataataaagccaatcaaagcggcacttaacatatagctcatggtgatttcaaaatgagaaaggtctgttaaataaaaatctttaataaccttgcgttctttatcttttactaattgtccaagtgaggtaagggtggttgtgatggcagtcactgataaagtccctccaatcaaccaaaaatcaagtaattggtgagaactagggacagttttccagctacttatcattgacttttttagaaagacaacatataagagaaatgaaatcattgctcccaataatgaaaagaatactccggggcgattgcggaaatacaacagtagatttctccttgttaaagtaatcatatcaatgcatcttccttccggttaatgacaaaaaagcatcatccatcgttccctcttgataagtgaacgttttaatgaaaatacgaaactttaataataatgagagtgcttcgtcagaattagcctttaaacaaatggttttatgattaatctgcgtatgaattattttacttggtatcaatgccattaattgatcagcttgttcagaaacaatcacgagtttactgctggagttttgtgttttaatttcatcagcggatccgctggcaattattttgccatgatcaataatataaacctcatctgcattgtctgcttcttcaagatagtgtgtcgtcaaaataatggttaaattattttgactttgcaatgaatgcaacaatttccaaattgccgagcgggtttggatatccaaacccgtagttggctcatccaaaaaaataatatcaggttgattaagtagagctcttgctatatcaactcgtcgccgttgcccaccagaaagtcggccgtatttttgattaataaattcagttaacccgattttctgaatcaaagcatcaatatgattagatttggcttctttataaagtttatttcgaatactcaaattttccataactgtcaaatcattatctaaaatactctgttgaaataccatgctaatctttatgtctggtttcatcttgatcattccactggttggatttaagatctttgtgagcatcgatatagtggttgttttaccagcgccattgggtcctagtagagcagttaagcttccttctttgattgctaaatcaatatggtcaaccaccacttttgattgataagttttagtaagtccctttgtttgaatgatcattatgtcgccctctctaaactagtataaagtaattatcgcatgtaaatctcatctttttatattgcacttcttgcgatatctgataaaagttgttcgcttaataccggtattacgggcgacgtctacatcactcatgcccgtctgataaagcttaaaagcatgtagtaagcggggatcgtcttgggtgtattggggtttgcgcccatgatatttaccctgctgtttggctagggaaatcccttgttgctgacgctcaatgatccgcttacgttcactttcagcttggtatttataaagttcaataatgaggttggtcatgagttgacgtaaattgggatccgcaatccctgtcatggacggtaaattcaacacatctagggtggcacctttgttctgaatggtgttcataatcttagttaagtcctggttgtttcggcccaagcgatctaattcagtgaccattacaatatcaccctcacgaatataggccagcattttttgcagttctggccgattagtgttagccccacttaatttatccgtaaataatttatcaacgtcttttaaagccgctaattgtcgatctaaatgttgctccttggaactaacacgagcataaccgattttagccatttctagctctccctttttggacagttctaatgaacatctgtatttcctagtatagcacaaaaataaaaacggccaatagggtatactctagtggccattaaaaattcattattaaaaattatttttttatatagctagccacattttctttgtctggaaataaagtagtctggtttatttcaaatgattgatttaattcttttaaaatttgttgcttttttcaccaggaattactaatctaattggttcatcgtctctatatgtacagagatactttgttatcaatatcatcatgaatattttccaagctacatggaatgaagtcaatagaagaacatttactcatagatattgtacgccaaaagtagtacaatatagaagaggtgattattatggccagaattgaagccagaattgatgatgaaactaaacaaaaagccattgctgaattaaagaaacaccaaattacattgtcagcttttgtaaaagctcaagtggctactgtcgcatccgatgggcttcctccctactattcaattcccaatatcaaacaagatgaagcgattcaagagattgctgatgaccttaccggcaaaaagaagctgaagagtgccaccagttcagatgaattggagcgtctcttaaatgaatgaagttaaatttacctcagagtttaaaaagcagtataaaaaagtaagtcgtggcgcacaatggggccgcgtttttaagcgcccgctgcctaaagagattgatcaagaaaatcgagctccctgggcatacataaaagattgctttataaacaatgagccaatagatgcctatttttatccgcacaaaattgaaacagataaacacgctgcaaaggttcttaaaaatgtggaaagccaaactggtttaaagaatttgagtgtttggtggttacactttgatgggcacaatggaaatcacttgcttgaatatgtcattacgccatcaaccgtttatctatctaggattggaacacacaatgatcttatgaaaaattagggcctttactttttaaatatggtagattgtaaaattaatccgaacgctgttcggacaaaaaagatcagcttcctttaaaatggtgtttaccacaaacccatcttttaggagctgatcttttgtctagtataacctattccgaacgaattaaaatcgaaaccttttgtgaac

SEQ ID NO: 218 - DNA, 1430 bp, Lactobacillus buchneri
ctgaaacttgaaagctaataatcacgccaaaggcgtgtggttattggcttttttggcaaaaaaataaacgcaagctctcctgcgttgtatactttagtcgaccaaaaccaagatacaaaggagacttacgtcatgaatattataagacaaaaaaatacagaaaacgagcttcacaatattgttcatcaatttacttccctcattggtctatctaaactcaccaagttggtgaattatcgccggcattcagaaatcagcttgatgaaggtcattgaatggctgctcacgacaaagttcctgggacgctcgctttatcgagcccatgaaacacctaactttaccagtcgcaccgtcagaaataatttgaacgatggccggatcaattggcaacgcttgatttgtcaagttgggagtcatttaatcaagcatttacgaccgtttattgaccgccggcggcggttagcattgatcattgacgatacactcttttcccgtgagtacgccacccaaaccgaattactagcgcgagtctttgaccatgacaaacagttatatattaagggataccgggctttaactttgggttggagtgacgccaatacattcttaccgatcaactttgcattaatgtcttccaagaagccacaaaacgtccttggaaaatcagctaaaacaaccgatcaacgaacaattgctggccggagacgtcgccaagcacagcaaaaaatgaacctcgtttcattgcaacttgtcaagcaagccctcgcaaatggcgttctagctgactatgtgttatttgatagctggtatagctcaccaaaaatgttctatgaattaaccaagttgggattaaacggcgtgggcatgcttaaacggtccagcaaaatttactatcaatatcgcggacggcaatattcagttagagcattatacaagcgactgcaggcctcaaaatatcaacccaagcaagcttatcaatacagctgctttgtcgaagcgcacgtcgggaaccaaaaattcaagcttcgcttggtatttgtggctaatcgggcccgtcaagatgactacctagtactggcaacgactcagttaggccttcagccacaagagatcattcaactatacgcccgaagatggcaaattgagaattactttaaagttgccaagcaatacttgcggctcgacaaatcacaagttcaaaattatgacgggctttgtggccatttagcaattgtcatgatgacttatgacctattagcttggcaggaacggcaaaatcaggatgatcgcaccattggggatttattctttataatgaacgaagccatgccagatattgagttgtctcaagcactggtatggcttctaaattcgttaaaaacgattattaatcatgaagtttatgcaagaagagcccaaattattcagat

SEQ ID NO: 219 - DNA, 677 bp, Lactobacillus buchneri
cccgaattaaaaaaaatctcggctatcttttccgccgagattcctttaattcgcaaaaccgaaatttttgatccacaaaaaccatggaacaaaatttcaaaaatcactaaacatgcaatgtttatatccgactttcgtatatgccgtcatagacttccgctttaacaacatccatatctgtaccgccgttatcaacatatttcaaaatattccacaaagaattatgtaaatattcagcttcaatcactaactcttttttactcatatggctgtattcactatttttatctaagtcatgctcatcgtaataatcttcaaataatcccatactcatttatctcctaatcttcatacttcaagcgctcatttaaagcacgtacttttcccttttcaatatcatcagaatgtctatttctagaatcaagataaatctgttttaatcgcttaaaatcaacatcaaaaccatttttttgcatttcttcaacaaaaaatttatccaatctcatcatcataaaaaatacccccctaccacataaaataattttgctttttaaagtcccactttgcaacgacttcttccgcagcttccatttgctctttgctatattcttcattaccaacatgaactaagtcacccttatcaacgtcctcaagttttaaatcttgcttgatctgct

SEQ ID NO: 220 - DNA, 18061 bp, Lactobacillus buchneri
acggcacttaattgaaaacttcttcaatcaactgaagaacttctggcgaattgcgacccgctatgacaagttagctcacgtttatttagaacgcgtttacttggcggcgattctgattcgcctgaaataaagttttcagacggaccctaatataattaatttcacaatgattcaaaatattcttttaatttctgggaaattaattgacgtcgtttgaccaaaaaatcttcgtattctgtataatcatcgtgcttaaggctttcaggaatagcattttcagaaaatgattttgcgttcccatatttaatgatttgttggtcagcaagataatctttgggtgctcgatcacttatttgtaagtttcttggttgtgtgatccaaatataatttgcaatttgattatacattgtttgtgataaaccatttttctttaaataagctcgaggaaaaatatgatgaatattaccctgttcaattaatagatcagccacttcatgatctttttccagccaggctatggtgtgttttcgcacttgtgacattacaaatattcgccaaacattagcctgagtcgaggaggaaaccagagctccattaggtagcgtgttgtgccaataagaatcgggcaattcttgttttacgattgaattcaaatatttaacaggatcagtactggcaaatttccttatatcagtttgagattgggtctctgaagaaccactatatctataggtcaaggccgacataatgatccatttttttacaatagtttctaattcgaaattagtcgtttgtccctgatatttaagcagtaagtaaagagaatacccaaagtttatggcccctttaccacttaaagacaatgtctttctgctaatcattcctagacttcttagtaacataatataacgttcaaaattagatttatttacaaacctaagcaaaccggtttctaattcatgataggctttatccatggcttcttcagtataagttttggttttgaagtctctcccagaaatcagtccgactaaatcggttagtttgcctctgccaaactgaaagttcaaaatgacgtgtaagatatcaccaaaatctggatcatataaatctgtacgttcattagctgcccaagctatctgtttaaaatagttggaagccgtaaagccagcatcattattcttaatatcagccagcatagttggattaactaacaatttagcaaagtagtcgatcgcccttctaattttttctccgttgtgtttttcatcagcagataattttgacataacaaaatcggctgaatttaaaaccgtacccttagaattaatccggttaaaaatttctgttacatcttcaattggtaattctgaagataaaacgatatttccaatatcattgttcgttagcgcatgtaatttttcaatagcattcacggccttgtctctttctgttggtgttttatcattattttttaacaaaaaattgtttataaaagaaaaggtattagccatttgaaataggttagcaatgtcatttatccaacgcttattcttttcaattggcgccgttgtcgtttcaaatttctcattccaaggattaaaggcaatctttatccttttagattccaattgtttatttaaaataggctccccagttaaagctgcccttaaagctgtaattcgttgttgaccatcaataattattttcttaccgacagcggacccgccacctttaagcttcacggttgtattattccaagtaattaaatagccgatagggaatcctcgatacaaagaatcaactaaatctctgactttagatgatttccatacaaatggtcgttgtaactctggtaggccaatttcaccacttttaatccagtttaaaaccgtcccaattgaattattttgtacttcgtattgtttggttactacatttgacaataaactctccccctaatttaatcagattggctattaacaaaacattttttgcatgtagcctttttttagttctttaagcttttcaactttacgctgattggcagcgataattttgtcgactaactcaaacaaagtactgaccttattttgctcgtcctcttttgtcaccgttattggaatattactaattgtacttttagataaactcggaactccagttgattcgtcatattttttccactgaatcaattgtgacaaatcgaaaataaatttagcatcatttttgtttttaggagtcataaaaaataaagtatcaaccgtccaaaacggagcgctaagaaattgaggcttatcaattgatccttttctaccaataccaacagaatctctatcggataatttaccgttcacactcagcatatagccgccagttccaaaaactggaatttttcctctacctagctttttataatccctcccagaattaatctctacaatttctcccaacttacgctgttcccaagcgtcagcaaaacctgcaaatcttaattgcgggaacttgcataatcattatctgctcctacgtcaagttttggtactaaaaaaattagccgtttatcctaattctttcggtgttataccagttaatgtaattttcaactctgaggactaagtcctcaaaactagtaaaacgtgtttgaaaaataaattctcgtttaagtagcgaatggaaagcttcgagcggaccgttatcatatggataaccttgtttggaatatgaatgcctaatcaggtgccgctttaacaggccttcataagcaatactggtgtattgtgaacccatatcagagtgcaaaaaggttggcttagaagccctgctcaagacttgcaacaatgtcttaataatcagtttcgatgccatctccttgccaatgttgaaagcgatgatttgcttactagcttggtcaaagatggtacttagataaacccaagtgcctggtcttagttctaggtaggttatgtcagcacgccaaatagttccaattggatggtttttaatcaagttaggccgttgagaataatctacatgagtgcctggcttcttaaaacgccgccccattagtgatcgaatgcctaactcctgcattaatcggtagacacgattggggccaatgactacaccaagtcttctcatggcaattgtgatccgagggtacccataggctttataattatttttccaaatttcaaagatctggctttttaaaatcgtatcttgtttatcatgacgacttatctgatagtgtttccaatgataatacgtacttttagaaagccctaaggctttcaagattatccagaggcggtgtttacataattattcgttgataaagtctatggctttaactttgcctaatgccttcccagtaacaccgccgctgcttttaaaatttcattttcttcttttaactgctggttttctttctgtagttgcttgaaggcttcaacactcgttacgccaccgtcaggtagttcaactaatttggcccgcttgatccaatgactgatggtggttggatgaaccccatattcattggctaaggatttctttgaacgattttcattgtgataaagcttaacgatgttgtttttaaattcatctgaataatatttcataaaaaaactcctattctgatttttatcattatgacacaaaatctaatgattttggtaccaaatttcagtataggagcatccacaacggcaaactctactaatgatgacacagattcctctgaaagtagttcatcagtcgaaaactctagttcatcagagtcttcttctactcagtctacaactagttctacggccttaactgaatcccaagctaggcaagtcttaaaaaattgggcggatgctgataatgttgatagttttggagggtattcgttagacgagcttgagaccatcaaaggagagaacggtaactggagttttgtcaacgatgacggactttcttggggagttagttctacaggtaaaattcacgcaccgggagacccaatacaataattatagcaaccataaaaaagctacctcagtaatttgagatagcttttaatttataacaaaactaaaagattatacttattgcccacattgttagccatgcgattaacataatagcaccgaacatgccccaatttaggaatatgctgaatacaaatagccagaatgccaacttacgtaatcctttaagaaggctgactgaccactagctttacgagcattcgacctatcagcgtgttgttcgtgatgataccatcttgatagtcctaataattgtaataaacttccgaacatttttcattatctcttctctttatcggcctcattagggaccattgcactggcaacattatctagccagtcctcattagaaggctccttgttagtatcgtaaattccttggatgaagtcttcaaactttttatcggccaacctttgttgttcttctttctttttatcttcttcattcatgcgttagcctcctatttatctctctactattaatagtataacgattccatctaaattgtgattattgctagttattttgagcgtctgctagtatatatcttcttcaccgttcgatattcagcacgttcctcatttgttaaaccttctagtgtgctattaattgtgtgttcaagcatctcatccacacttttaaaattaagcactgcggataatgcatttaccatatcggctgtctcaactgagcatctaattgtagtagttttaggcttagactttttagtgtttgctttcactttcatgtcccgcgaaaatatattgctaggtttcggaacttgagtaacatctgagttaaggcttttcttgagcaggtctttactcatctttaccaaccctttcaacaaattcatttgtaattttcttatatagcgcatctactcgcatatcatgcatatcatgtttttgtgtttttaaatctggatcaacaatgccaataatgtcataacgttttagccgttccatatttttaacaacatttttaaaaatattatccttgtcaaactcagcctcggcttgttctagtatcgactgatcaacctggctgttgttctttagcagaaccggtagtattcctgcaatgttgaaatctgcgtcataattagagacaagctcttgcaggtaagatataaaggcctcagcacctacatacgaccgttcttgagtttgaagcacaattataacgctgtctgaggccattaacgctgagtcagtgtatacactaacagtcggtggcgtatcaatgataatgtaatcgtagtcatctttaattttatctagcaaatttgaaaagtgtttagctcgcttatattggtcatctgtgtttgggtacttcttttctaagaaaattggatatgatgtaaagtctgcaaaactgggcaacaaataaagattgtcacgaatcttagtaacaatagtacttatatcatcattgctgattgcattcattaaagtattatcaaatttaacaacctcattattttgaacttgtttagtctttagatataatgcggttgcattagcctgcgggtctaaatctgctagtagtaccttgtatccttgtttagctagtctgtatgaaatcatgcagctgttagttgtttttccagttccacctttgaaatttccaaacgtaataacttttaccattctgctaacccccttaatctcactattataattcatatagcacagattatcaaacgtctacatgtagataaatatataaatatacaaaaatatatgtagactaaaatacaagagtacatgtagatgtgtagatatgtagatagtttggctaccataaaagcttgtttaaacagcaataaatacattctatttcctattatctatttgtatgtgagtatacataaatacatgtagataaatagatatgtagatttgtagactaaattaaaaaagtgttgacactcgcctaataaggagctacaatatccttgtattaaaaaaggcctagcaattaagccagacctaaaataactgaatatacaaaagaagccccgcgaccctacttcgcgggaaccacaaataaccatgtattaattgtacggtctagactctaaaattgcaagtcttgacattcaattgcttctcgcggaccattctaggggacaagctagagtataaatattaaggggacacgtttaccggtgcgacttcaataacaaccggttatatcacataaggccttagacaatcaggctggtgatgaatggtgagggggaccattaacggcccgggtgtaaaacgatgcttaggcatggtgaccactagtagctggtaaccgaacaaaactaaatacgtgctatcagcgtccattagggcgttttttaatgggtttaaccgagaatgtagattgatactagtggttggtagcaataccgcaactaattgtccaagcgatgcccgaacgaccgagcgttacaacaggtgagttgcactctagctagatagtcattttaattttgatcgtctgactagggtacaactctgcactcaaccacttcactccctcgcattacagcaggggtaaaccaataagtcaactaaattgaataaataaataataatcacaagccagctaactaggacagtttaagctaatttcacagactcagctaaactggctaaatcaaacagtgagttgtctataaacactgatacaataggcctaactagacttcacaaagtttagctttgaatactgtgcattatgttaactagcttaaaattgcacaataaaaaggcctacccaattgaggatagacctttttactttattcagctttgttatctactttaatctcagcactagttgaggtcacattagaaacgttcgcactagttggtgctttatcagcttggctagcggagtccacctcgtttgtaacatgttctaaggtgcctgtcgtgtcctgtgagacgtttatagtttgtacgtctgtaattacacctagcatacctaaaatggtcagaaccgtgttaatgggagattgcaaatttgtccaaaaattcggattaaatttgcaatctcccagaaattaaaaaagttgccgaatgggcaaccaagaatagacacatgctggtaaattacaaagccctcacggctaaatgaatgccttgtaatttagttaaagcatatcagatttgtattttaaagcaaatctaatgttttagcaactctctttcgagacagtatgtgtcagttgagaagggaagttttataatgaatcaaactaatttcaattttattgagtcggaaaaagcttatgcaactcgttttttccaattcccacaggttttaatttatggatctcaatataagacattaagtgatagtgcaaaattaggatatatgattttacacgatagactagattattcattgaaaaacaactgggttgatgaagataaccgggtttatttcatttttacaaatcaagaactaacagatcttatgggctggtcaaaaaagaaagtgattagggtaaaaaatgaacttgaaaaccaaggattattatttcagaaaaccatgcactttaatcccaaaactggtaaaaatgaaccaaatagattgtatttagcagatttagaagttacggcaacagacatttatacaaaatctcggcaacaagagccacgaacccttggtacacgcgaaagtgtcaaaacggaaccttcacggaagttcgttaaaacccttgatacacgcgaaagtgtcaaaacggaaccttcgcggaagttcgttaaagatacaccacaaacccttgatacacgcgaaagtgtcaaaaagagtcacaatctagactatactaataatttagatactactagatataatatagatactcaaaagttggacttttccacagctcatttctcaccagcagaactagaaaagcaaaaccacgatctcgtgaaccatgctaatgatttcttaactgatgaagatagtggcttaccggttttcttagaacccgaagccgtgcaattactaagtttctggtgccgcactccgcaacaaatgcgccggtttattggtatcatcctgaatgctaaatatcgagttgaaaaggatcatcaagatattggggttctaatcccactggacgatgaagaactaaaacctttgatgactaaagccttgagacgctactttaacgcccttagaagcaatgaaaagcacatcaagaacgtggaaaactacttgtacggcaccatgcaaaacctatttggcatttggtggaataaacaagcggctagagaatatgcggccaaacaccccgaagaacagaacactgacaatgggccttcttggaattaaacgtcatataggctcatttaagccgctttaagtgttacatgcataattatattaaaatcgttttaaaatcgcttagaagcaaaaatagacaccttgagtggctgaattggcgatgactgaactaagggaatgtgaaaggagctttttaaatgaccaaatccagcaaagaagtcgaaacaattgagcaattgttggctgacccatgggcagtcgatattcaagacgtttgggagcaagcagcccataatccagatcctgataaacgcaagctgtttgacgcgttacacacttacctcttagataaacgccaagaacaaattatcaacgaaaagcatttcgtgatttaacatgagtgagctaaagagatacatcatcgtggctgggataaacggcgctggtaaaagcactttatatcgcgcgagacccgaattatttactcactccaaacgattaaatgccgatgaaatcctacaaaaaatgggcggcgattggtataaagatcgtgataactttagggcaatgcgcgaagaaataaaacaactccacgcggctttagataccgggcagagtattcatgttgaaacaaccatagctggccaaggaaaggcacaattaaatttaatcgagcgggctcaccaaaatggttttgaggtcacgcttttatacgtggcattaaaaaacgaaagagtagcaattaatcgggttcatgaacgggtcaaaaaaggtgggcacggagtaccagatgaaattattaaaaaacgctataatcaatcaaatcataatttagcaatagttgcattcaaagctgataatgtcgtgatctacgataatagccaaaaatttgtgtcagtttacagacgagaacatgaccaggtaatcaaaaataatttgcataattttccttggataaatcccaaaatcatctttgaggcagctatacagaaacaactaaatgactttgttaaaaataatccagatttaaaaattaaaaatcccatgaatgattcagaaaataaaaacgatcggcctagttattaggctgatcgcctttaaatttattcggtttatgggcattaacgtaattggcaaatatttttaaaagttcttcggtttgttcgaccgataggttatcagcttgaaagtatttttcgagcaaagcccctttttgaattaatcggcgagaacgggctttgcgggcttgccgattttcgtagtatttagattgccgtaatttaaaatcttctcgctcaattttttgttttaaacgcgcttgttgctcaactagtttttcatattgattaggcatagtcattaccacctaactattattggttattttgagcttgatttaaaaaggcggcaacttttttagcaatcatttcaatctgtggagtggtaagtgtcccataatccaaattgactgatctaatgatttgcttaccgagattttgttcaattttatttttttcagctttaatcttttgattaagctgttttaatttggcttcttgtttttctaagttactttgagacataatgatccctccaatcgtattaaaaataatcaccgacactatatcatacagagaacgttaagtcaaaggatagaagttgaaatagcgaagcggaaggcatacactagaagtaaatttaggggaatcagcaggccgagtgaaacgaggtcaatgtgcacttacacgtcatcaaagatgacgttgtgctaaacccattaaaacctgtattagaagtcgccgatggcgacaacaaagtcaaacccatagaatcaaagtgagaaggtgactgatatggcaatctttcatatgagttttagtaatattagtgccggtaaaggacgcagtgccattgccagtgctgcttatcgaagcggtgaaaaattatttgatgatcaagaaggtcaccactatttttatgcccgctcggttatgccagaaagctttattttaactcccgaaaatgcgccagaatgggcgagtgatcgagagcagttgtggaatgaagttgaaaagaaagatcgtaaatcaaactcacggtatgcaaaagagtttaacgtggctttaccaattgagttaagtgtagatgaacaaaaagaattactgacaaaatatgtgcaagaaaattttgttgatgagggcatggtagccgacgtggcaattcatcacgaccacccagataatccgcacgctcatgtgatgttaaccaatcgcccatttaaccccgatggtacttggggacagaaaacaaaaaccgaatacattttagatagtcatggtaataaaactaagacccctgcagggaatgtgagaaaccgaaaaatttggttggttgattgggataaaaaagaaaaaataactgaatggcggcacaattgggcggttagtgtaaatcaagttttagagcaaaaaaatattcccgatcggatcagcgaaaaatcatttatcaaggagggaatagatgataccccaatgcaacatgagggaatcaatagtaagcggcatgaaagaaaagaatttaaccaacaagttaagaactatcgcaaggccaaagccagttataaaaacaaccaagaaaaagtaatcaatagaggtcatttagatagcctaagtaaacacttctcgtttaatgaaaaacgggtagttaaagagttaagccatgaactgaaaacttatatcagtttggagaacttagatgataagcggcgcatgctatttaattgggaaaacagtaccttaattaagcacgctgttggtgaagatatcactaagcaattattgacgattaaccaacaagaaagttcactaaaaaaagcagatgaactcttaaataaagtggttgatcgcacaactaaaaaactttatccagagcttgattttgaacagacaaccgcggctgaacgacgggaattgattaaagaaactaatagtgaacaaacgattttcaaaggcagtgaattaaacgaacgtttaatgaatattcgtgatgatttattgacccgacaattattgacctttaccaaacggccatacgttggctggaagttattaatgcaacaagaaaaggaagtcaaaatcgagcttaaatatacgctgatgattcatgatgatagcttagaaagtctagaacacgtcgatcaagggttactagagaaatattcaccaaccgaacagcaaaagattactcgagcagtcaaagatctacgggcaatcatggccgttaagcaagtcattaaaacgcaataccatgaagtattgaaaagggcctttcccaaaggcgatttagatggattgccattgattaaacaggaacaagcctatacagccgtgatgtactatgatcctgttttaaagccatgtcaggctgaaacaattgaacagtggcaagccaatccaccacaggtgttcagtccccaagaacatcaacaaggactagcttatttatcgggacagctgagcttagatcagttagaaaatcatcacttacaacgggttttaaagcatgatggtactaaacaactcttttttggcgaatgcaaagctgatccgacgattaagaacagtcagatcgagaaaatccaaatgcagttaaaagagcaacaagccaaggacgaccagtacagaaaagcaaatatcggacattatcaaccactgaactacaagccagttagtccagactattacttaaagacggcctttagtgacgcgatcatgactgttctatatgctcgtgatgaagattaccaacggcaaaaacaagaacgtggcttaaaagagaccgagtgggaaatgacgaaaaagcagcggcaacatcaaacccggaaccggcatgaagattggggcatgcacttgtaatcacaaaattagcgactggttaattggtatgaatggtagcccataatgtattttatattgagaaaaatttggtacgtagagtgtgctcgattagttacgtatagctgccagccttgtgtatggtctatcaaagagaccaggcaatcaaaaactttaagccagaaccttattttgaactaaatgcggaaattttagctaatcagcaaaaatttgtcgcaaaattagacccctatcagcgatttaaagacgaaacagggctaatgacattcatgcaggctaaacacgttcagaaaggctcacaggacggttttatcaaggacgtccaaaaacaaggcaaaaagcgtgctagtccccaactattctcgctatccagtctccagagtgccatgaataaacgttatcacgctagcgccagccaaaccttagcggccattcaaagtttatatgaagccaagttgctgagttatccccgaacggattgtgcttatatcactgatgaagaatttggttatttagtggctaatctgacgaagtatctggggttagtctctaagcaagtcgctttaaccaataccacgccaaataagcgttatgttaatgggaaaaaagttgaagaacactacgccattatcatgactaaagtcgtgccgacgaaagagaaactagccagcttgcctaaattacagcaacaagtctacgacctggttttaagaaccacattagccatgtttgctgatccgtacgagtacgaggaaaccaccattattacccaagttggtgacgccaattttaaagcaaccggtaaggtcccaactaagcaaggttggcaagctttatttgatgatcacaaagccgaacagcaagaagcagcaaccttaccgctcgttcaccaaggcgatcaagtccaagcaaatctgcaaacaccgcaaaaagaaacgacaccaccggtaccctttaccgaaggtaccctgattacggccatgaagaccgccggcaaaacgcttgatgatgaagtagcccaggcgattctcaaagatgtgcaaggcattgggacaagtgcgacccgggccaatgtgctggaagtgttaaagaaacgcggctacttagttactgaaaagaataagttgcacgtcagtgaagccggaatcacattatgtaaagcggtcgaactcgaacccttgctaactagtccagaaatgacggctaaatgggagcaagcgttacagcaaatcagtaccgaagaacgcactccggataattttttgagccaaatcaagaagtttgtggaaaaattgattgctgatgttcccacacaattaaccggcaatgcagccattaagcaacaaatcaatcaccaacagcaagcacaaaagtccgccgaggtcttcttagaaacaccgcaagcgaccgttttaaataaacagaagttttatattgtaaagcctaagcaaggcgaagactttaccctgcccaagaaatggagcagtaagaccctcgggaagaccgcgatcaaagcactggtcaccaaaggggaaaccagcaaattaaagggtttcaagagcaaaaaggggaagtcgtttgacgccaagttaaagcttgacggccataaattaagttttgattttgattagaacctgcctaccgccctacactacgttccggttggttaacccgtcatttaggttcacttttacaatcccaaaagtaaacctgaacaacgggtgagattaacaaagcaaaggagatcataaaatgaacaacgaattagcagttttagccagtgaattacccgttttgcaagctaaaggaacctacaagtatttaaaagaaatcactggtaacggcgcttattatcaagtagcctggcaaaaattgtctgacggttacgttgccctttatggcacgaccccgattcaaataagatcattgccaacattgaatgatatttttgaagatgaggaggggtaacttatgccaaataaagcagatgttaaggcttggaaagcacaattagtcgcccaggctgaacaacaaatcctaaaattaaccgatagtgaccgatttaaacagtatcttaataccctggctaaattccaccagtacagtgccagaaatattgacttgatctatgcgcaaaatcctcaagccactcaagtcgccggttttaagcaatggcagaaggcttttaaccgcaccgtcaaccggggcgcaaaagcgattcggattgcggctccgatcattaagaagctaacaccagccgagcagaagcatcttgataccaccgatgagcgcgccattgtcggttatcgctatctacccgtctttgatgtggcacaaactagcggtgaaccagtgttaagtgctaaagactttgtcaaagaaaatttggccgatcatcagaatgtgacaagcttgtataacgcattcaaggactatctaaaccagcaaaccgaccttaaagtcagtgaagtgcccttagcaatgctaaatggggctaaagggtattttcaacccagcactaatgaaatcgttattggtggtgatgaatccgataatgctttaaaattgaagacgttatatcatgaatatgcacatagtcagttacatggattaaaatcagcctttaaagatcggccacgagcctatcaggaaacccaagccgaagcggttgcgtatgttgccatgcaaaatattggcgttgataccagcaactactcactcggttacgtggccacctgggccaaagataaagccgtaatccatagcgctttaagtgagattcagcaagtgagcaacaaagtgattgaacttagcgatggcttaaccaaacaattaggcttacaagaagccccaaaagagcctgagcatgatctaaaaaaactatcagcccatgatcttaataagtcctatcaaggcttgcaacaacaaattcagcaaacgactaatacacagcaaaaatcacaatttagacatcagttaactgatgttcaccaagaaatcagtaagcgaacacaaaaacaactgaaagcatttgctgaacagcatccagaaatcaaacaaccagattctgaacctgatcaaagcctaaaacgttagccagtttttaagggacatgctataatgtaatagaaaaaggaagtcttgcgctaacaagacttcccgcgcaagccgcttcaaaggcggtggcattagttaaaaaatgatagttgagtcaccctgtaacctagccaaagttacgcagggcggcttttttatttgttccttttgtcgatgtatgttagcaacgctaaaataaacattgcaaacagcaacatcaacgagagtgtctggaagacgctcattgactgtgaaacctttctgaagattattccatgttcccatgggcctcacctctcaagggaaaagacagccaccgcccttaaaactttagagtcctaatatacttgactttacgtagaatccacacccgtaattcgaaacaatttttttgcaagtaaccaattctctgatgccactataacacctctatataaacaaaaaagatatcctattttttcaaaaaagtattttaataagatgtgaaattgtgtcactctctaaaataatcatcatgcctaatccaatataaataattgccataatccaattaccaaatttatctaacaatttcttaacaatcttcacacgcgaaaatttatcacccaaatagacaagtatgaagatacagaatgtaaaaacaataaacgtcgttattagttgttcgattgttaacgatacaaagtaaggcacaaaaagtccaatgttatcagagccacaagatgcaacggtgattaaagcaaccgttgcgatcaaatttttgtcttttcgctgttcgattttttcatcaacctcagcggcttcatcttcgtcactcaggatatatttaatcccaaagccaatcggtattaaacctaaaaatccaagaatccacttagcaggcacatagtgaagtactaacgcaaaaaaaagactgattgctatcaatgtgtatgaacctaaaaattgaccaatataaatttgttgcttatgttttgttgaccgatattttgaaaataataacatcagaataactaataaatcaatcgcggtggaggcgtatagcacaataccagttataatggttttaatcatagcaacatcccatttcacatatttattaacccgtaattttacctgtgtcttctgctaaacaccaagcacgttctaatagaatagcagtacattcatcaataatttcatagttgatgaaatttccatcacgttcagttttcacaattttttgatcaactaatcgctgcaactggttagaaatagctgcagttttcatattaagcctagccgcaatcttgccaactgatattttaggctcgcgcgttaaacaatgtaaaattcttaatcttgtatcattggatagaactttaaaaagtaagacgatctcacttgcgttctcttcactcagtaaatcacggctagctaattctggtttatccggacaacagtctacttttatcatgcgtatcctccttgtaggtagcgtcaagaatcttgtgtaaatgaaatgccttcgtacatataatatgtatctaacttaaataaatgatgcttccaaggtgtcctggagtcctttgaaccctcggtggatccgcttcagagacttctcgttataaacattaaactgagaaaccaggaagcgatccagtgaatcttccgttggaaattgttctttgtggtgggtggtgcgcttgagatgcttattaaagttctcaatcaggttagtggagtagagtgattgccggatagctggtggaaagtccatgaaagtgagtaaattcggcattttaagcagatctttgattaatttgggataggtctgatgccagttgttggcgaactcattcagtttcagttcggctgcttcacggttggcggcccgatgaacttgtttaaagtcactgatcacggccttgcggtcttttacgcgaactttgttcatcagattccgcccaacatgaaccaggcaacgttgtcgtttggctttagggaaatgccgattcaagccttcatccaaaccaactaacccatcggccacaaacaacagcacatctttaacgccctgcttgattaaggttcccagcagttcagtccagattccagtcgattccgttggcgccacttggtagttcagcactcctttcgtaccatctggacgaatgccaatcgcaatatgaacggcttctttttgaacggtatcccgctttaacggcaagtaagtggcatctaagaagatggccgcatattgtgaagccagtcgacgttgctggaaagcttgaacctgttcattgacggctttagtcatgttggaaaccgtggctttggagtagtgagcaccgtacattttctcaatgagttcggcaatttcagcagtggtaattcccttggtatacaactgaatgaccgttgtttctaaattatcactgtgccgaccgtaggctggcaaggtatgattttcaaaccggccattgcgatctcgaggaatggttaagttaagttggccgtacttcgtatcaaacgagcgctcataactgccgttgcggttattaccagtgttaatcccagcgtatgagtagcgttcgtaacccaaaaactctgccaattcggtttgaagcagctggttaatcgcaatttcgaggtggtgacgaaaaacttcgtccaaatcttgcttttgggctagtgcagcgataatttctgtggtaagttcattcatggggaat

SEQ ID NO: 221 - DNA, 742 bp, Lactobacillus buchneri
attagggtctgtcttaaaacaagctttttagccaaagttccggtataatctggttaaaaaacaagaaatgaggaatcaccgcatgactaagcctccattaaccactaatcgacacgccatctctgatgaaaagtggcagcaaattgaaaagctctttcccgcctataccactggtcgaccacccaagttaagtaatcgagcggctttaaatgccgtgctctggcaactcaaggtcggctcaccctggcgagacttgcctaccgagtttggttcttggaaaaccgtttatagccggttccgaaagtggacggatagtggtctcttcgaacagatcttcaaaatcatttgtgaggacgacgatcccgacatggagaatgtcagcctggactcgacgaccattcgggtccatcaaaagggcactggggctcaaaaaaatcccgctgcacagtagaaaatcaagcgatcggccgcagtgccgggggcctcacgaccaaaattcatgtcgtcgttgatggcctggggaacccgctcaaaatgatcctcacgggtggtcaagttcacgacagtcaagttgcgcaacccttaatcagtcagttaaaaattgccggcgtcaatgtgattgcggataaagcctatggcagtgaggcttttcgccaatacttggaagctgaggaaggcacctataccattccgcccaagagtaacgctaaagagaaatggccggtggactactacgtgtatc

SEQ ID NO: 222 - DNA, 928 bp, Lactobacillus buchneri
atgagtagcgttcgtaacccaaaaactctgccaattcggtttgaagcagctggttaatcgcaatttcgaggtggtgacgaaaaacttcgtccaaatcttgcttttgggctagtgcagcgataatttctgtggtaagttcattcatggggaatacctcctgtgatgttttctgtggttactaaatatcataagggaaggcattccctatttctatacaattcagaaatcttttatgcatttacacaagatattttacgctctcagaaaacttcttgcttggtctattatacagaaaacttgtataggaagaaatatttcttgtaaccagtgtgtattttttgctttagaatgattgaaatttgtttgattaaaaagcaatagctatgtagttgcttggacattaaagtaggagtgatatttatgataaaagaaacaccaagaaacattgaagagttgaaaaagaaagcaaataataaaaacagttggcgtgaacgtttgtctgctgtaaatgttttaaaagaatatgattgcaagcagtctaaagatatacttgctagacttgctataaatgacccagtatttaaagtgaaagaaacggcgtttcgtgctgctcaagcattaggcgtaaccagtcatggaaatcctatttatttaggtaaaggaaagaagggaaatctggttaaggggattaataaaaaacttgaaaaggttagaaattcattgccagatgattattcgttcgaagattttaagagtgaatttcaaaaaaaatatccaagcgcatatgatgtttatgagggtactaaaaaagattttgatggttggcttaaaaaatcagaagcaaatttaccccatagaaaataaagagagtaagacagattaaaggaatattgatacgtatagtttatctttatggtagatcgcaaat

SEQ ID NO: 223 - DNA, 76538 bp, Lactobacillus buchneri
aacccttcatcactcacgcggcgttgctccatcagactttcgtccattgtggaagattccctactgctgcctcccgtaggagtttgggccgtgtctcagtcccaatgtggccgattaccctctcaggtcggctacgtatcatcgccttggtaggccgttaccttaccaacaagctaatacgccgcgggtccatcctaaagtgacagccgaagccgtcttttaaaccaaaaccaggtggttttggttgttatacggtattagcacctgtttccaagtgttatcccctacttcaagggcaggttacccacgtgttactcaccagttcgccactcgtctcaatgttaaatctttcaagtgcaagcacctaaaatcattaacggagacgcgttcgacttgcatgtattaggcacgccgccagcgttcgtcctgagccaggatcaaactctcatcttaaattgtttaaaatgataagcctgtgatagctcatgatttaaatttattatttgtttttacgaattgacttcgcaaatgtttggttccaattccgaagaattgaaacgccctgcacatttgtttgtcgaaaattttgttcagttttcaaaggtctacttggttgtggaagagatgaatcatctctcgcgacaactatttaaatataccacgctgattgctcagagtcaacaaaaacttttttgattaacacgctttgttgtgtgttccgttcaaatcagcatatataaatatatctgattctcaccgattcgtcaagtaaaaatcgaaagttaatttgcaatcacaattcaaagtggtctacgtgaaggtgacagctaaaaagtttgaagcttcttcgaaaaaatcgccaaaacaaaaagcaatccaggttggattgctttaaaaaattaatcgttattcgtattatcctcggggcgcatcgttgggaacagaatcacgtcacgaatggatggtgcatcggtcaataacataaccagtcgatcaatgccgattccaagtccacccgttggcggcataccatactcaagggcttcaatgtagtcttcatcaattccttcagcctcttcgttaccagctttacgttcagcaacttgagcctcaaatcgttgacgctgatcaattgggtcattcagttcggaaaatgcattggcgaattcgttagttaaaatatataactcaaaacgatcggtaaatcttggatcatcatggttcttcttggccagtggtgaaatctcaaccggatgcccataaataaatgttggctgctccagcttaggttgaacgagctcctcaaaaaatgcattaataatatggccggtcttccaccatggttcgtaatgaatatggtgttcatcagccaattttttagcgtcatcatcagacattggttgccagaaatcaattccggtatattccttaattgcatcaaccatatgctgtcgtttaaacggtttgttcaagtcaacggtgtggccttgataagtcacaacattatcatccgtaacagcagctgctgctgccttaaagatgccctctgtttcatccatcacatcatggaagtcataataggcaacataggattcaagcattgtgaactccggattatgacgggtatccattccttcatttctgaagacccggccaatttcgtaaactcgttccagtccacccacaatcaatcgcttcaaatgcagttcaagcgcaattcttaaatacaagtcgatattcaatgcattgtgatgggtaataaagggacgggcattcgcaccacccgcagaattatgcagaactggggtttctacttcttgataatcgtttgaatccagatacttgcggacagcagaaacaatcttcgtgcgcttaacaaaacgatcgaagctgtcctggttggaaatgagatcaaggtagcgctgacgataacgctgttccttgtcctttaagccatgaaatttatctggtagcggccgcagcgcctttgacaggaaagtaactgactctgcacgaacagtcagttcacccatgtctgttttgataatttggccggaaattccgaggtgatcaccaatgtcggatcgtttaaaaatatggtaaatgtcatcgccgacaatatccttacgaacatatatctggatttttccagttcgatcctttaaatcggcaaaaccgaccttacctttaccccgcttagcaatcattctgccggcaatggtaactttcttgtccttttccattaattcatctttatcttcatcatcaaaatcatgatgcagttgttcagcaagatatgtacgcacgaatcgatgtccaaatggatcgattccttccttgcgtaattcgtccatcttctggcgacggacgatcatttggtcattcatttctttgtctttggccactgtgaaacctcctaaatgaaaatttactattaataatcataacacaaaaagcgccgaatttattgtgctatccggtgctgacgtgcttttcgctgttcgtttttctccaaaaattcatcaaaaatatcatccatcgctgattcgccggatgcgttagtcaaggcaaccttggttcgagctgaatgaggaattccctttaagtaatagccggcttggccgcgaaattcgtgggaaccgatataatcacctttcaattctaccaaacgatgcaaatgttccttggcagtaaccaccttttcctcaggtgtcggctcagctaacagctcgccggtttccaaataatgctgcgtctgctttaagatccacggattaccttcgaccgcgcggcccatcataacagcatcagtgccaacttcagttaacatctttttggcatcttgcggtgttctgacatcgccatttcccataaatgggatgtgaatctcctgcgcaacctgcttcaaaatgccccagtccgcatgcccctcgtacatttgtttccgggttcgcccatgcatcgccaaagctgaagcaccggctctttcagccgctaaagcgttctcaaccgcataaatgtgatcttcatcccaaccggttctcatcttaacggtcaccggctttttaacggcatcagttacataagaaaccatctcatagactttctttgggtccagcagccaacgagcaccggcatcagttttaacaaccttattcacagggcatcccatgttgatgtcaatgatgtcagcagcagtattttgatcgacaaatttagcggcctgaaccaacgtttccttggttccgccaaaaatttggatactcatcgggtgttcgcggggatcaacaaacatcatatccaacgtttttttgtttttgtacataatcccacggtcagaaatcatttcacaaacaactaggcctgccccatattctttacagataattctaaaggcagaatttgtaacccctgccattggtgcaacaaccacctgattagggattgtgacattaccaatattccatttcatactttcacctcaaaattcgtttgcaattgtgaaattccgcttgctatattatcacatatttgtgaaaaacgacagccaactttagtggtggccctcagctttggcgactttaatgatttttcccagctcttcttcattaaaatggtacttgctttcgcagaagttgcaagtcacgtcaattcctttatcctctttgagcatcgtttccaattgggggacggggaggccctcaagatctcggccaaaccgattcttcgagcagttgcagaagaattccaccggaacagtttccaaaaaatgcaactgacctttgccaaaaatgagttccaaaatatcttcaggactttgattgtccaataaaagctcagaaatcatcggcatctgtttaattcgctcgatgacttgattaatggcgtcatcagttgcatccggcaatacctgcacgaggtagccgccggctgcgccgattgtattatcatcgttgacaaacacagagacccccaccgctgagggaatctgttcagattgggcgaggtagtacgtgaaatcgtcgccaatctcacctgaagccagcggcacgcttccagtatagggatcctcaccttcggcagcgcgactcacctcaattaagccgttgacaccaaccgccttgccaacatcaattttatgatgggcattaagtggtaggtgcacatgagggttttgaatataacctttgacatggccgttcgaatcactatcagcgacgatttggccaactggtccttgaccattaattttaaccgtcacagcttcaccatttttttcaaccgattcagcaagcataactgtgccgactaatgtccgtcccaaagccgcggatgatgcactccaagtatcgtggtcttgctgggcagtcgttacaagttgcttggcattcacagcgtatgcccgaaacatgccatcggtcgttgttgctttaactaaataatcatccatatcttgcacctcttctaaaaaataaaaacgagtttagagataattctaccctaaactcatttttgaaatattcaactaattgttatcgtcattgtcatgattgttatcttttggttgatcattgttagagacgtcatctggtttttcagagccatccgtgctttgatcatccgaattgttttggtcagtgtcttgagtttgatccccagttgtatgacccttttccaattcagcttgacgttcagcttccttacgttccaattcacgcttggcttcttcaaaggttgccgcacgctcacttggaaattcacttgtatcggaactttcaggcattttacctgtgtgccaaagtgaaaggatctgcttctcatcaagggtttcatacttcaacaaggcttccgcaatcagcttgtgcttatcacgatgctcctcgataatcttcttagcagtgtcgtgagcttcgttggttaaacgacgaacctcttcatcaacagcagcaccggtttcttgagaatatcttggaccataagtgtcttgggcaggattttcaagctgtaccggaccaagtcgtttgctcattccatactgagtaaccatggctcgagcgatgttggttgcctgttcaaagtcattggaagcaccagaggattgtgagtcaaagacaatttcttcggcagcacgaccacccatcaaaccggcaatctgttccatcgcgtccttcttagacatcaactgctggtcttcacgcggcagcataatcgcataaccaccggcacggccacgaggtacgatggtaaccttgtggaccactcgggcatcattcaagaccaacccaaccacagtatggccggcttcgtgataagcaacggtttcccgttcctcttttgaaataacccgattccgtttggcaggaccggcgatcacacgatcttcggcctcgtccaagtcactcgcatcgatttgcgtcttgttgcgacgagcagccagcaaggccgcttcattcagcaggttggccaaatcggcaccaacgaatcctggcgtttgcttggcaatctcgtgcagatcaacgtcgtttgccaatggcttgttcttagaatggactttcagaattgcttcacgaccgttaatatctggacgtccaaccaagatcttccggtcaaaacgacctggacgagtcaaggcgggatccaaaacatcggcacggttggttgcggcaatgacaatcacgccttcattgccactgaatccatccatttcaaccagtaattggttaagggtctgctcacgttcatcatggcccccacccatgccggcgccacgacgacgaccgacggcatcaatttcatcgatgaagatgatggcgggagcagccttcttggcttgatcaaacaagtcacgaacacggctggcaccaacacctacgaacatttcaacgaaatcagaaccggaaattgagtagaatggcactccggcttcaccggccaccgctttggcaagcaaagttttaccagtaccaggaggtccctcaagtaacaccccatgtgggatggtagcccccaaagttgtaaatttccttggatctttcaggaattcaacaacttcgaccagctcttgtttttcttcctcttcaccagcaacatctgagaaacgaaccttattttgcttactgtcggctggtttggccttggatttgccaaagctcatcactttgccgtttccgccgccttgaccgccagcacggcccatcatcatgtagaagaaccaaacaaacaataacagcggcaagacgtaaaccaatagatttacccaaaaaccgcttgactcttcaggcttggcattcatcttaacattgttagattgagctgccttggtgatttcagcaattgaggagttattctcgaggacagttgtggtaaatttggtaacattcttagactgagtctggtttccaccaatgagtccagattgcacctgtaccttctgaccctgtctataagttccagttaccttatagacaccgccacttggctgtactgaaaagctttttactttgtcatccttcaagttcttaacaaactggcttgattggatttcctgcgatgtggtctggttggtatttccgttaaagaaatagataacccccattatcagcagaaatatgacaatgtaaaacagactatttttaaaaagcccatttctattcgagttcatcaacgtcctcctcaaaactaaatattttcatgttgatagtcaaaatactaacacacttgaccttttttgactattaattgtttgtataaatttcaggcttcaagacaccaatgtacggcaggttacgatacttttcgtcgtaatccaaaccgtagccgacgacaaattcgttgggaaccttaaaaccaatgaaatccgactcggcatcaacggctcttccagcgggtttgtccaacagggtacaaaccttaattgaactggcaccacgatcggcgaacgtgtccagcaggaacttcaacgtccggccagtatcgacgatgtcttcaacaattaagacatcacgcccatcaatgtcggtgttgatatcctgcagcaattccaccgtcccggaagattcagtcgcaccatgataactggaaacgtcgataaagtcgatttgcatgtatgaatcaactgctcgggcaatgtcggtcatgaagaaaatagcgccctttaagacacccactaccaccggcgtcttgcctgcataagtctgagctatttcttttcccagcctttcaacggctgcttgaatttcttccttgctgtaaagtacctttaagatgtcgttattcattacaaattccttttctttccaatcattatttttgtcggacttcaattaaaaaataaggcctcgtgtcctcggaatcccgagaaacaacggcatttttcagacccaacactgataatacggtacctctggcatcgaccagcaacaaggtccgctcacgttggtcgttgggaactttggcattgatcagcacccggctgaccttttggtgttgtccgtgaccgattgataatcgatcccctgcttttggagagcgaacctgcaacggtaaatctgtatcctgcaggtaaaaagttgtcagtttattgttagcaaccgttttgtgtgcagtgaacacaccaaatttggtggacggactcagagaataccatctgtctaatattaccataaaagttcgatctttttcaggtttaccaacgattttttgtggttccttacaaattattagtgattgatacacccgcctgacctgccatccagcctctaaatccattttggcttgcggtctggcggtctgctggatcagccccaaaacttcgtcaagttgatcgactgaaatgttggggattcgaagataatgttcgaacacttcttcaagcaaacacttgacgacactgtcgggaaaatctttgagggaatcgagatcaatttctgcccggtgcttttcggaaaaaccaactgcggaatgaatcagcggctgaatcaagaatttaatggcggccaagttgtcggccaactggttggtataactgagcacatgaggcaacagctgcggattctctgctttgagtaatggcatcacgccatggcgaattcgattacgttcaacagccggttgctgattggtttcgtcttcaaaccacctgagtccagttgtttgagcaaatgattccaactgctgcttgctaaacgacaaaagtggtctaatcatcttggcatctgcaaacgatcgggtttcgcgaatgccggtcagagaagctaattgaccgccgcggaccagcttcataatgacggtttcaaccagatcatcgccatgatgagccgtcaacaggcaggtactaccggtttccttcaaaacacgcttaaaaaagcgataccgaaaggtccgggctgccgcctcaatccccgtcgttgggtggtcatctttcgaccagacggcttgtttgagtaaaagcccgtattcactgcaataattcgatatatagcgggtctcttcaacactttgttcgcggagctgatgatccacataggcgacaataatcttgggccgaacagctcgcggcaggtgctgcagcaaatatagtaacgtcatcgaatccactccggtggaaacggcaaccaccactgcatctccagcctgccaccacgctttttgcttaacaatgaaattaaattgtttctgtaaatccactgtggcctccgcttatgacttgcaggtataaaacaaatatggccggtggcaaatgattgccccagccacaaacttattaattgtcaaattctaatcgattaactacgccggccgccgcgaccaccacgtttgccttcggtgttcttacgcagtgtggacaaacggtcttcactttctttcaaaaagccggacatcatgtcatcaaagctctcttcatgattattcgaatgattgttgtgagcagaactgccgccacgggaatgataaccgtgactttgatgattcccgtggttctcatgactttcgtggttattctcgtggaaatttctgtgagaatgattttcattcttagaatcttcatgttcatgattgtcagaagctttgcggatcgaaagactaatcttgttgttgccctcaattttgaggacctttaccgtgacatcatcgccgaccttcaaaacatcatgaatatccttaacaaatccgtcagaaacttcgctgatatgaaccaaaccggttcgatgatcacctaaatcaataaatgcaccaaaattcgtaattccggaaactttaccgttaactttttctccaacttcaattgccatctaaaaaaatgttcctcccatgtaatagtgttaccagtatatcatattttattttatctcgactagcgattgtcaaaataaaaggcgaagacaaaagtacaaatacttttggcctcggcctgcttgactcatcttatttgacatcataatcattaacatcttttggtgccttattcgggaaactataaactgtttcaccaggttttgtatagtaataacgatcacgaataatttgttccacgtaattcttgtcattcaactgggcgacttgcgttttgagttgtttctggtctgccttttgttgttttaaggtcttttgctcacgggcaattcgaacatgcacgtcagcgtaattcactttggcacgaacaatttggataagaaaaattgacgcaaagaacaggaaaatggcactaataactaaggcccgcttttttcgtcgattagacaaaacagcagtcacccttgagttattcaattcaatctctcgccgacgagtaaaatcgttgtcgagcttccgtactttcccactttgctgcgtcatgctaaatcccccgatcattcgcacgttctagataaattataccaatctatgggcatttgtctaggtgattccacatgttttcgggatttttatgaatatttatttattcgttgcgaaagtcgcgttcatagtcctcggaggtaatctcgtacatccgttctgcatcatcctttttagttgtatccaacagttccttgaccaagatcgtcagagtcttgttaccaaatttgatgacaacctcatcgttaggtttaacttcggttgaagacttggcggcccgcccgttgataaagatccggcccttgtcggcaatttctttggcaacagaacggcgcttaataattctggaaacttttaaaaacttatcgattctcatgagttgtgactcctttaatttttaagaacttaccaacaaacggaatggccaaccattcacggacagtaaatacgtccaacagtcgacaccccgcaaaaaatatgatcacgccaatcggaatggcagcgcagacaaccaacaaagcagcgattcttggattatcagccaagtcagccaggttaatcccaaataccgttgtccgaaccgcaatgaacatggtcaccagcacaaccgcaagcttgccaagctgcttaaaagaaatcaatttggccaactcttttcgactgagcaggttcatcaataacaccattaccattaagcttaacagggttgcaagactagcgccaatgattccaaagtgtgccacgaacaattgattaaccaacaccttgatcaaaaagccagcaagaatggcgatcattgtcctcaaataattatccttgctctgtaaaatcacgttataggtcatcaacacgctggttaaaacgatgctgatgcagtacaggctaatcgtcaaatttaactcagacgaagcaaataacaaccggttaatttggggcattagagcagccaacccgacactcatggcaagtgaaacagccaaattagttctcagattggtggccgcaacgtgttgaaacgtgacatcttgacgatgtttgtttgccaacaccaaaccaggcaaaacggcggttgcagacgcaatgctcaaaacttgtcccagttgaacaagggtctgagaacggtcgtaaattcccttgatattctgggcagcaaccagcgaatagccaaacgatcgcaatccagacacaacggaaaatgaatcagccaactgaagcaagagcatcactgccgataccaagcacagtgtgccgccctccagcaaaatgcgcttaattaacagccgcgtttcgatagtcggacgtcgatttcgccagtttgttggcaatgatctcgatttcatccaaatcaggatgaacaacagggcaatcaggccggcaattggtgctgacagcatggccaactgacccattcgatacgggctaaccgtcgatttgaaggcccagtagccaaccaatagaatactcgatactcgaacaacctgttcaatcacttgcgaatacgccgtcggccgcatttccattttgccttgaaagtatccccgccaggttgacagaaatgggacaaacaggaacatccagctgactgattgaaccaccggtgccaatcggggatcatccattttcccggcaatgaatccggcagcaaattgcaatatacaaaaagccaccaggcaaaccacgattaggatgttttgaattcgaatggccaacccgacctgatctcttggatctttggtgtcgaccactaatttggaaataaaaaccggtagccccgtcaaagcaaaggtcatcccaataccataaattggataaatctgttgataaacataaaagccgatgttaccaaccatgttttggaagggaattcgatacacagcacttaacaatttggcaacaaatgacgcgaccgtcagcagtaaggttcctttaagaacgagttgtcttcttgacctatttttcatcagactttaccttaccggcagcaccatgatgatgccgggtttttgatagttgtttgactaatgcaatcagcccgtccaaccactttgtcatgttgggctgaacagttaattgaatttgatacctgtcattttcggtgttaatggttgcccggaacttggtttgggcaatcgcttccaacaattccttgctggagaattctgtccctgcccgaggtgaaaatgtgatggtaattttgggctgattttggtgaatcttatcaaccaacgcgtaatcggagaacatcttcagctgagagatctttaacaggttggcgacgggttcaccatagtccccaaatcgatcgattagatcatcttcaacttcgtggagctgatcttcattttcaatttggcggatccgtttatacaattcaatcttttgttgattgtcctgaatataatcactcggcagataggcttccaggtcaagctcaatagttgcatcagttcgatactcaaagttcttgccgcgttttttggcaacagcatccgacagcatctgggtatacaggtcgtacccaaccgaatcaacaaacccgtgctgctgcttaccaagcaggttacctgctccacggattgataggtcccgcatcgcaatcttgaatccggatcccaattcggtaaagtcacgaattgcctccaaccgtttctcaccaatttctgtgaggaccttatttggtttgtacataaaataagcataggccactcgactgctgcggccaatccgcccccgcagttgataaagctgagagagacccattcgatcagcattctcaacaaatagcgtattaacgtttggaatatccaccccggtttcaataatcgtggtagttaccaaaacatcatattcaccatttatgaaatcatacaaaatgtcttccatctggttttcggacatttgtccgtgaatgtaaccgactctggcggaaggaaccaaggcactgatttgttcaactgtcttttcaatatcagaaacccgattgtgaaggtaaaagacctggccgccacgcgacatttcccgttcaatcgcctcccgaattgtgccggcgttttgctcgatgacataagtctgaatgggataacggttggatggcggcgtctcgattacagacaaatcacgaacccccatcatcgacatgttcagcgtccgtggaattggtgttgccgtcagtgtcaagacatcaacgtcagaacgcatttccttgatacgttccttgtgtttaacgccaaaccgctgctcttcatcaatgattaacaggcccaaatcattaaacttaacgtcttttgaaagcagtcgatgagtaccgacaaccacatcgaccttaccgtcttttaagccttggagggtctccttgacttgtttggcggtctgaaatctggaaagcactctgactgtaatcgggtactctcgaaaacggtccagcatggtttcataatgctgctgggctaaaattgtggttggcaccaaaaaagcgacctgtttaccaacttcaattgctttgaaagcagctctcaaagcaacctcggtcttaccgtaaccaacatccccaaccagtaaacgatccattggatgctgggtttccatatcccgcttaatttccgtcgcactccgcagttgatcgggcgtttcactgtaaggaaaggcagcttcgaattctgcctgcaacgaatcgtcttgcggataggcgtaacccttttctgcgcttcttttggcgtataaatcgattagttcatcagcgatgtcttcaatcttggaagcaactttggccttggtctttgcccactcactgccgcccagtttgttgatccgcgggtgcttatcttctgaggaaacatatttttgaattaaatttaactgggtgactggaatgaacaacttggcgttatctttataggaaatcgtcaaataatcctggtgcttaccgtcgacttccatggtcttcatgccttcataacggccaattccatggttgacgtggacgacataatcgccaggcttcaaatcggtataactcttaattctttcagcgttgttaaaggtggtctggcgggggcgttttttagtcaccgtgccaaacatttctttttcagtgatcaccacacaactggccaacggcagctcaaagccattatccaggttgctggagatgagctggacttcttgttttaaaagatgatccttatcagtctgtgtcgccgtaatttcaaaatcgttcagcgttgaagcgacctttgccagtcgtttctcatcttgaaccataatgatgaccgtctgcttcattttctgccagcgcaaaatctcggttcgaagcatcggaatttgggagaagaactgctgcatcggccgtacagtaatgtcttcaatggcatccagtcgcatccggcccatccccttttggaacagtgacagaattaaggtggcgtgatgattcgcgctaaaggctttcttgaaatcgttggtgtatgtggtagacttcaaaacctcatagtgcttaatcttgtcgttcaaccactcatcgtcatcgctctcaagctgtctggcagtttcagtaattctggcataatcgtcgaaaataacaacgccatcggcagccaggtaatccaacagggaggactgttttttataaatcatatccgcaaataacaaccagcgtggatcactcaacccattttgcagatccatgatttgtggttccaagttgccctgaagttttttggccgccttatcatccagtttactttgttcagcaattaaccgtttggacagctgcttgctgacggcttttcgctggtcatcggtcattaataagtccgtggctggcagtaccgtgattgacttgatgtttttgatgcttcgctgattggaaacatcgaatgtccgcattgagtcgacatccgtgtcaaaaaagtcaattcgaaccgggtcttgatggtttaatgggaaaatatcgagaatcgacccccgaattgaaaagtctcccggagccgcaaccattttttgaaaaacgtaccccatttgatgaagttgaagctttaattgctccaggtcataggtgccgtccatttcaagcgttaacttagcggcttgaaactgctttttctccggcaccagtcttctgataccggaaacagaggtcacaatgactgcgggatcgccgctggcaagcttgtccaacgctaatacccgttgggctttgtattccggtgaactggtcgccagctcagctgctcccatttcttccaccgggaactcaaacaactgatcgtcatcaatcaagttagataagtcattcaccaactggtcagcatgaaataacgagtcaactaccacaacagttggtttgtcagtcgaatgaattaaattatcgattaaaagtgtccgggccgaaccgccgactccggtcaccaattgacgcgtgcccggtttcaaggttgcgaccaactcctgatactgaggaattgttgttagtaattgatctaacttcaaaataatgtcctttcgttaattatactgattttccaaatccggaatcgacatcccatcaatccaatcatccaaggcattcacggcgtgatcagcagcctgcttaaagattggggcttgatctttgctgaatcggcccagcacgtaattaaccaccgtattgccatgatccgggtgatcaattccaacccgaatccgatcgaaattttgggtgccgacactggcaataatgcttttaatcccattatgaccgccagccgaacctttatccttaatgcgaatcttgccaaccggcagatccatgtcatcatgcacaatgatgagatcttcgattgaaacgtcaaagtagtccattaaggggcggacagccaagccggagtcattcatgaatgttgtcggctcgaccaccatcactttggtgttgttgacaaacccagagccatacttggcgttcattttacgcgtcttaattgaaatgtcatggcttttggcaaattgttccactaccataaagccggtattatgtctggtcccatcatattggggaccaatatttcctagtccaacgatcattttcattgtttaaattcttcctcacgtttcttccaacacaaaatgctgaacaaagactgttcagctgtcgaaaaattaattaacataaagattatatcatatcagacaagcttttaagtcctggaaaaaccggaaaattaaaagatgtttatcagtgaagacgccttcaaaatcatgctataattggcgtgttctaggaattatatattaatgatttggagatgatttttttgactttacaacgccaaaaagtagctttaatcggtgacggtgccgtaggttcctcatatgcgtatgcaatgatgcaacaaggcctcgctgaagagtttgtgatcgtagatgtgattaaggaacgcactgagggagacgcactcgaccttgaagatgcacaagccttcacctccccaaaacacgtttactcaggtgattatgcagattgtaaggatgccgacttggcagtcatcactgccggcgctccgcaaaagcctggcgaaactcgcttggatctggttaataagaacctcaagatcatgaaatctatcattgatccacttgttggctctggattcaacggcgtcattgttgttgctgccaacccggttgacattttaacttatgcagctcaaaaattctccggcttcccaaagaaccgtgtctttggaagcggaacttctctggatacttccagattgcaggtcgctttgggcaagaagttgcaagttagcccacaatcaatcagtgcttacattttaggtgaacacggtgattccgaatttgctgcctattctgcagctcaaatcggtggccgtccattcttggacgttgccaaagaagccggtttatcaatggataacttaaaagaaattgaagaccaggttcgtcataaggcatacgagatcatcaaccgaaaaggtgccacattctatggagttgccacctgtttgatgagaatttcacgagctattttgcgtgatgaaaatgcagttctgcccgttggtgcgccaatggatggcgaatacggacttcatgatgtctacatcggttcacctgccgtggtcaatgcatccggtattcaaaaggttgttgaagttccacttaacgccgatgaagctgccgcaatgaaggcctctgctgagacccttcaaaagacgactgctgatggcatggcagaactttaattccactgtttgtaatgacaacaaagggatgatgaatcagcatccccagcctcaataattaatcaaaacggacaattatttctatcacataggaatgattgcccgtttttttaggaagtcctagcaagtcaacagatggaacatttccttgtgaccagcttgtcaccttattcaagtcagattttcaatcggcattctaatttatttagagattaatgagaataattcaagtttaaatgttcttttctaaatttctctatgttatcatggttgtatacaggttaagttggaggaattaaacatgctattaaaaacattagtaaagcctaaggaacgactggtgaccgtcaaagaagacgccaccttggaagaggctttacagactctcgaagattccggttatcgttgtgtgccaatcttagatgaaaccggcaagattttccgtggcaatatctacaaaatgcacatttatcgtcataaatcacggggtggtgacatgtcacttcccgttaccacacttttaaagaatgcaaccaagttcatcaacgtgaattctgcgttcttccaagtattcttttcaattaaggatctcccctacatcgcggttttggacgaacggaataacttttatgggatcttaacccatacccgtctcttggacatgctgtcacagtcttggaacgtgaatattggcagttacgtgttaaccgtcgttgcaagcggcgagcgtggtgatcttgaagaaattgccaaaattatcaccaagtacaccaacattgccagtgttatttccttggacgctcaagaaggtgaattggttcatcgcattatgttcaccctgcctgccgaagtggatcaggatcgtttaaacagaattattgctgctttggaacgcaaggaattcagagtgcctgaagttgaaaatctgcaagaagaaaaaaattaggcacgttgtacgtgcatatcaaaagaagaggccaagacacaactaattggaggttgtgtcttggcctctcctgcgttccaacgttacctagttcaagcgtggaactatcggctgatcccagccatttaagcaaagaaacgagtcattccaagacaggaataactcgtttctttgcttaaattccgggatcaaaacgcctcgcgtcccactccctcttgattataattgtattcaattgatctaagcgttgtgtgatgttttatgtattgcggtccgtcactagcctttagctaatcccaagcttatctttatcgctttatcgaccttactcataataggcggatcgagatgggttactttatccttcaatcgctgcttatcaatggttctgatctgctcgagtaaaataactgaatctctttctatcccatttccagctaagatccccacatgcgttggcatcttcggcttggaaattctggcggtaattgcggcaacaatgacggtgggactgtaatgattgccaatatcattttggacaatcaagaccggtcgcatcccgccctgctcggaaccgataactggtgatagatcagcataaaaaatgtctccacgtttaaaaataacgtcagtcaccctcatacctcccatcatcgtaacttacattactgtaaattccgtaatctttgacgatactgagttaaatggatatcagcgtcttcttcacagcaggaaaagtccttactgatctcacggttcaaactacccatttcgcgatatcccctcattaagccatcaatgactttcgggtcatcaaaaaagtagttgattgcaatctcaaccgctgcactttcggatattccaaccgttgcgctaaactgttccaaacggtctgcaatttgatcattgatcataactgaaaaatgctttgaattagttgctttttccattggtattttcccctatatgttccagattactgtactgtctaatataccatgaaattacagaaaaatcatacatattttcgacgcaatcgcggactcaagccacaaataacctcataactgatggtatgcagataatccgcaacatcatcggcagtaatctgagcatcacccgattgaccgatgatggtgactgtcgtgccgtaaggataatcatgaggcaatcgaatcataaactgatccatgcaaactcggccaacgatcggacacttgtggccatcaaccaagaccgaaaaaccttgcattgcccgaggaattccgtcggcatagccaaccggaacggtcccaatccactggtcgctatcagtagtgtaagttgcaccatacccgattgagcggccttttttaactaattttgaaaaatcaatttcggaggtgactgataaccctggcttcaactgatatggaagctgggtaatatctcttccggacgggttcaagccataagccgcaatcccaaagcgaatcatgttgccgccgcatactttgtgccacaagctggtagcggaattggccacatgaacatacttcgggcgtttatcaagaactgccataaagtcctgaaaattctggtactggaatttgaaataggtatcgtcaggactgtcagcggtggcaaaatgggtaaagattccttcaaaacacatccgatcggaatgggcgttgagaaccccaacggcagctttaagctcatccggagtttgaaagccaattcgacccatgccggtatccagtgccaaatgaatgtttaaccggcctttaaatgcgctggtgtcgagtaacttggcagcttgattaagccagtcgatcgaaccgacagtcagggaaatgttttcggaagccgctaattgggcacattcgggatcagtaatccctaataccagcaccggcagcttaattcctgcctggcgaagttggagagcttcatctaaaatagccacacaaaagccagtggcccccgctttttcagcaatctcggccacttgaaccgccccatggccataaccgtcagctttaaccacttggaacaagtcgtctccgtcatccaaacgctgcttggcatggtgaatatttgaataaattgccgccaggtcaacagttacctgggcatctcgtaaatttccaactgtcattacctaaccccgattctctaaaataacttgggtaacgacaatgtcatcggtgtgagaaatcgacacaaaagcgttcccatcaaacggttgtttcgaaaagaagggtttgccctcctcgttattaacaatacaaagatcctgaaatctcactttcgatccaaggccggaaccaaaggccttcgaataggcttctttggccgaaaaacgaccagagatatattcataacggcgcttatcagacaattcagccaattgtttcatttcatctgctgttaaaatacgctctgtgaaatgctgattccgttccacggctgcgacaattcttctaatatcggtaacatcaattccaattcctgcaatcattttctagatccctcgcaaaccaaaaagataggataagtttaacataaaaacggcctcctcggggcagatttgaagacttgtcacaaagtcaatgacgattaaccacatgcttgcattacaagttggtgcatacaaggaccttcatcaacgcaatcaaaaaaagtgaccattcatcatcgaatgatcacttcgttaaaaatcttaattaactatttttaatggtaaaacggcgtttcttattgcttgatgaccgtctgtcagaatgcttacggtcgttactgccttcataatggccccgatttcggctgccattattccggtcgccattacgatgactctttgagcccttgtaatgaccaccatgaccgccaccacgacgatcgttacgatgaccaccgtgtccatgaccatgatgtggcaatgggcgttcaggggtaatcttaaccttaacgttgtcgcgggtaacatcgttgagcagagcagcaaccaaatcagttgcttcatactcatcgagcagcttgtcagccatcttttcatacttgtcagtattagtcttcttaattaagtcggcaatatctgattcggcagaattcaattgaccaacgaaggcttcttgaattgttggtggcttcaaaggcagcatgcgcaccttggtcaacttttcaatttctcgaagataatccatttcgtttggcgttgcaaaggtaattgaaaccccatgcttaccggcacggccggtacgaccaacacgatggacgtagccatcaggatcttgaggaatatcgtagttataaacgtgggtcacacctgaaatatcaattccacgggcagcaacatcagtggcaactaagatatcaatcttggcagctttgaattcctgcatgatctgagtccgacgagcctgagtcagatctccgtgaagaccggcagccttgtagccacgggcctggagtcctttggatacttcatcaacccgacgcttagtccgacagaagacgatagttacttctgggtcctgaacgtcaaagaaacgggtcatggtgtcaaatttttcgtattcttttacccgaacatagtactgatcaattaaatcagtggttaattctttagccttaatcgttacttgatgagggtcacgcataaactgaaccccaacccgtttgatttgggcaggcatcgttgctgagaaaagcaaagtttgacgttcctttggggtttgcttgatgatatcttcaatatcgtctaaaaatcccatgttcaacatctcatccgcttcatccaacactaatgtcttaacgtgctctaactttaaagtatggcgtctaatatgatcaagaattcgacccggagttccaaccacaatctgtggatgaccctttaaggcgttgatttgacggcgaatatctgcaccaccgtaaacaacttgaaccttggctttttcatcttttcctaatcgatagatttcttcttgtgtctggattgccagctcccgagttggtgaaatgatcagagcttggacatttggattgtcaaaatcaatcttctgcaagattggtaaaccaaatgcggcagtttttccagttccagtttgagcttgaccgataacatcctcacctttaagaaccattgggatggtttcggcctggattggcgtagcttcttcaaacccactgttattaatcgcagttaataagtggtctgataatcctaattcactaaacttcaaatatgtttcctcctaatattgaaacaatcaaggttccgcggccgactggggaaaaatccgtttcccggaatgcgttggccacttgacctacaatcatttattacaaaataacctttttagtttacaccgtcacataacattaagcaagcaaaacaggccaactcatctgttgaccgtgcttatttaaccagtttggcaacaacattttccaaatgcagaccgtggctggccttcaacaagacctcatcgtcagctctcaattcggcttgaagatcagaggtcaattcatcaagctgatcagcttggtaatagtggagattctccggggcatagaccggcttgagtttctcatatagggcgtccatatcggcgccaatcaggtacaccacgcgaatggaggccggatccagggcatccgctagcgaagcgtgcatcgcttttgattgagtcccaagctccaacatgtcgcctaaaacagcaatccgtcgccccttggttgtcgtgttcttaaaagcggtcaacacttctttagcggcggtggggttagaattatagacgtcacttaaaattcgctcgccctttgaaccactcaaccactgggtccgattcttagtcagatcaaatttagccaacttgtcagccatcatctgcggataaattcggaaaattcggccaaccgaaatggccgccagggcattgttgacattataatcaccgatcatcggaatcgtaaaatcaatttcgggccacaaattgacgtgaaattgcgtctgatactgaccatctttggagtcggtggcaaaaacatcattgctgtctttcctgccaaaagtcgatttgatcacactctcatccacttgttgggcacgctctgtgagcagcggctcgtcgccgtcatagacgaagaagccgtcagctttcaggccatgagtgatctccattttggcgtcggcaatcttatcacgggtgccaaagaactcaatatgggcttcgccaatcatcgtaataacggctacatcgggccgagccagtttggatagaaaatctagttgcccgggtcgatccatccccatttccgccactaaaaactcggtattggattccatctgcagaatcgtataaggcaggccaatctcattattaaaattgtcctgggttttggtgacattaaacgtactggataaaatcgcggcgatcatatccttggtggtcgtcttgccgttgcttccggtgacggcaatgacgcgtggattaatcttatcaagataatacttgctgagctgttgaaatgctgtcagtggatcgtcaacaaccagtgccggaattgttaggggtaagcgatccgcgtggtcactggcccaaagggtagctgatgcgccgcccgcaattgcattgtcgatgtaatcgtggccgtcatgttctgcaaccagtggaacaaacagttgacccgtttgaatcttccggctgtcaaagcacaccccggtcaaagattcgtccagcattgctttgtcaaaattttcagtgttggcattaattgcttgagcaacttcgccaatcgtcattttcattattgaacgctccaattgttaaatagttatgttcaattataacaaaaaatcaaacggctaaacacccaccgtttgatcctgccattctaaatgccattttgatgtttgtaaattataggtcaagtccccggcatagacggtattttcatcgactttaccggttcgcaaaataattgaaacctgatccgggtccttcaaaatccgtaatgggatatgataagtccgggaacgttcacgcaaagaatcaaaggaaataaacaggccgtcgttggctttggtaatcaaatccaagaggatcgagcggtcaatgtctttgatcgccaagggacgcagaaagactctcaaagtgttatgggtttctcgcaaattgcgcttaatggcaatttccaagacgtggttaaagtctgagaagcgccggtaatatgaacgaatcgttccgttgtcttgactcaaataaatgtaatgattgttcaatttggaagaaaaaggccgacccattggcgttcccatgtgggccagatacaacagttccgcaatttcgaatggtgacaagttgttaacactgtcttccacgtcaaaatcaataaacttcttcttttggtcgggattacggaggagataggtccgaatttcacctgtgccattgatcagattgaacttggaatgagagttgtacccgttagcagcctgatcatcattatttaacaaaatgatattttgaggcaattcatccagtccattaataaaatcggccgcagtgatccctgatgataaaatcatgttggagattggattcgtatttataaaaatcaaattgcccttcatcgtttcattaccccgtatttatatctaaactaattgtactaccctcacgtttagttgtcttataattaagacagaaatgtcgtaatttgcccttttcttaattcattggtaacatggtggttaacgcaatattagtgtgaggttattaatatgactaacgtattatttgtttgtctgggaaatatctgccgttcgcccatggctgaggtcatgttccgtcaaatggtgaaggatgcccatttggaaaatcaaattaccgttgcttctgcagcaattagtaccgaagagcatggcaatccgcctcatccaggtgcgattgccgaattagccaaacacggcttgtccgtcggcaataagacgtcgacgcccatcaccaaagaagactttgatcaggctgattacattattgccatggataatcaaaatatcttttatctcaatcaaatggccccaattgccgatcggaaaaagattttcctttgctacaacattattcccgacaagcagggaaaagatatcccggacccctggtttgaccacaaatttggccgaacttaccgccagttatcagaaaccctgccaaaatggttggataaaatgaaaagccaagtggcttaattattgacgggtcccaataaggctcgttttaattttggtgtcgcatgactgattcgataacttttttggagtttaccgcgaatcatcaagcgtcccgcgccggtcgcgtcacaggtgatcaacgtgacaatcggccgcttggtttggcggacaacgtcaacccgggtcgctgcgataaacttgcgctggtaaaccttgtattgatagactttggtcatattactgagatagatccgatcaccaacttgggttttgaagtacagcgggccaaataaaacgtggcggttaaccatgtggtgccctgccaacggatagttgcccttgcccatctgctggtcaggccgcatggtcccggcagcgagcgccaaggtattattagccactcccaacccaattggcaaatgaatatgtgatttgggcaggagaatttcgccgataacctcaatggcgttagtgttcatccgcgcccgcgcagcagtttgaaaatcaagggatttgacttttttaaaatcataactgacattttgtttgtgacgcttagtttgcgctttttgccgccgttcagttttggcaacggtctggcgggtgatttttggatgataagatttgatcaattcatttttgattggccgattaaaaatcatccccaaagcgacaattaccaacaacacaaaaaccacgttaatcaatattttcttgagaagtccttttctcataactacctccactcaacaacgaattataatatgtacaaataataaaggaggaaccgcattgttaacaaaacaagttggtccaaactcctggcggcgcaatttagccgttctctggtttggaaccttcatggccggaatcggcttcagcgaagtgatgccatttctgtcgctatacgttgattcgctgggacatttcacccataacgaattgagcctttacagtggattagcctttgcggccagttacctagtgaccgcaattgcttcgccactgtggggaaaattggctgatcgaaccggccgaaaattgatgttggtccgagcatccgccggaatggccattgtcttcattttgatgggattggtcaccaacgtctggcaattaattggccttcggctcctgcagggtgtcttttccggatacatcagcaatgccaacgccctgattgccacccaggtgccgaaacgcaaaagcggccaggccctcggcactttggtaaccggtaacgtgtccggtgccctgcttggcccgctgttaggcggaactttggcctcattcttcagctatcgggtcacattctttattaccggtgccctgtttgtcggtgtcttcctggtaacgacgttgatggtccacgaagatttcaaaccagtcgccaaatcgaaaatgctcaatacgcgtggcgtaattggtgaactggccaattcaaaattggtactgggaatgtttgttaccaccatgattattcaagcggctaacaactccatcgttccaattttagcattatatgtccgccaaatcatgaataatagcccggcgaccaccttctatagcggaattgtcgctgcggtccccggcattgccaccttggcagctgctccgatgctgggacggctgggtgatcggattggtgctgatcgggtcttgctggtcggctttctgctggcaatcgttgtctacgttcccatggcatttgtcactaacgtctggcaattgattggtcttcggttcctgatcggtgtcgccaacgcgtcaatgttacccgctgtccagtcgattctggctaagaacaccccacctcacgttaccggccgtgtgtttagctggaaccagtctttccaggcgatgggcaacgtggctggcccaatgattggatcagtcgtctcaacctcatttgattacgcaggtgttttcatttcaactgccgtcctagtagttattaacctcaccttagtatttaacaatacgcggggaatgcgccgagcacgcaaacaacggattgaataaacccgtttacccattagtatgagaacgaaaaataggagttggacagtcagtatcgcttgtccaacccctatttgtttgcataaaaaacggggaaccgttaagctcctcgtcttcgtcatgcttatttgttgtctgtaagaccgtatttcttgttgaaacgatctacggcaccatctacttggttgaacttttgcttaccagtgtagaatgggtgtgaatctgatgaaatttcaacacggatcaatgggtaagtcttgccatcgtccatcttgatcgtttcgtcagaggttttagttgatcctgagatgaacttgaaacctgtagatgaatcttgaaatacaacttgttgatatgctggatgaattccttttttcattatctatcgctcctttgccctgaatcaatccgatgacccagagattatcgattagtcaactttgttagtgtaccataaataaaatcgtcaatcaatcatcaattgactctttcttcaacttctaatttaacgtcggcacccacaccccgcagcttatcaacgatgtttccataaccgcggaggatgttatcggcatggcagatttccgtggtgccatccgccatcagcccggcaatcactaacgatgcgccggcacggatttcacctgcctgaactttggcacccattagcttgggggagttatcaaccacaatgatgccttcatcggtatcttctgatttgactttaccgcccaatttattcagttctgtaatgtgcttaatccgtttggggtaaatcgtgtcaatgatcacactgcgcccctttgccttaaataatagcggcgtcaatggctgctgaagatcagtggcaaaccccggataaggcatcaccttaattcgaattggtttcaggtcatgtgatggtccgacataaatgctgtcctcatagaccgttaagtcgcagcccatctcttctaatttggcaacaaaggcttccaaatgttcggggatgatgttggtaatcaaaattccatcccccacagctgcggcgagtgacaaataagtgccggcttcgattcgatcaggaataattgtatgagtattacgagcctgaagggttggcacgccttcaattcgaatgacatcggtcccggcaccacgaatattggcacccatgttgttcaagaatgtcgcaatgtcaataatttcaggttccttagccgcgttgccaataacggtggttccaggcgccttgaccgacgccagaattgtattgatagtcgcacccacagaaacgatgtctaagaaaatctgggcaccatgcaggccatccgggccggtcttaatggtcactgtcccatcgtgttcactgacttcagctcctaaagccttaaatgccttgatatgctggtcaattggccgcggcccgatattatcgccaccgggaaaactaacggtagcacgctgaaaacgacctaacagagcgcccataaagtagtaggaggcccgcaagcttttaatcgccttgcttggcagtggtgcctcgacaatattggtcggatcaattgttaggacatcgcctttgaactcagacgaaacgttcatcgattttaaaattaacattaagttgtgaacatctaaaatgtctgggaccgagtcgaacctaacgggggtatccgctaatatggcagcagggataagcgcaaccgtgctgtttttagcaccgccgatcgatatctctccggacagccgtttccctccatttatgattagtttactcatcaaaaattcctcactttttgtattcgcacatttttcatgtcaagaaatatattatccaatatccacataaaaaacaatacctatacttgaattatacaatctgtaacaattaaaacaattgttccgtacaaacgttttcatttaatgagtgctagtcgggctaatttgacgccgttttcagcgaattattacaagacaaaatgagcacctgtttgcagtaatcgataaccagcgaacccgaaagcgcttttaaaatccaacaattcagtcggtttgtttcatcacccaacaaatggccagatctacttctttaactatccctgaaagtccttagaatattcaggcatacagaaaaaaggagcggttagaaatgaaacgactatttacgacaattggcgaaaatattcatcggcaccacaaactttggatcacggtcatcttgatcatgaccatcggttttgcatttggattgccaaagattcaaatgaaaatgggcaacgacgtcttcgttagttccagttcaaaaacctatcaggattcccaaacctatcagaaaaagtttggtggtgactccctttatctgttgctcgacggtaaccagtcgacattgttatcccacaagacaatgcagcaggtggccaaatttgacagtaaagtcagccaagttgataacgtcagaaatacgaccgacatcgtcagtagtttaaatgatcagttatcccatgccgggaccggaaattccagtgctcagttcaacttcaatagcaaaaagcttcaacaagatctcatggctgaactgagttccaaacaaaaacaaagcattcagtcgaaaatgcaacactcgttaacaagtacgcaacaaaatcaggttcaaacatatttgctgaaacaactcacgcccgcccaaaagaagctgatggcagcagctggtgcccaggcgcagggttccaagcaacagcagcaagcaatgcttcaaaagcaattgaccaccaaacagcaagctgcagtccagtcctacaccatgtcgctgcttaaccatcagcagcaatcacaattggcagacacggtcatcccgatgctgccgaaagttcaagatatgtcaaccaaactgctgcgggatatttttctcagcgataacggtcatgttcccagtgcgatgaagcaattattacctaaggacggcaagcatctattaatcattatcaataccaataagaaatcgtcggatatgaacaccgcggttcagattaatcacgacgctaatcaggcaattaagcaaaccaacttttcctcaagcattaagacccgattgggcggccaacctgcagttcttggtcaggtccgcagtaaagtcattaccagtatggcaaccatgttggcattcgcagtagtcttaatggtgatcatcctcctattgatattcccggtacgaaagcgtttgttgccactcatatttgtcctggcctgcctcgtatggacatttggtttgatgggttggcttcacattccgttgaccttggcaaccatggcaacgttgccgattatcattggtttggggactgactttggtgttcaatttcaaaaccgatatgaagaagaagtcaggaaacgacaaaattcccaggaggccatttcagttgccatttcgagcatgggaccggcagttggcgtgtctttaatcgtcatggtcttcagctttttgacgatgtatctctcaaaggcgccattgatgcagcaatttggcctcacgttggccattggtgtcgcctgcagctacgtcgttgagtttggactgatgttttcaagcctctcactcttggataaacacgcttcaacagctaagttggcacccaagaagctatctcagccgtcgcgtttatcactgttcctaagtcactatgctgaatgggtaacccatcatgcaggcattctgctgacaattggcgtggtgttggctggactaggtttttcatttgaaaaatccatcaatattgaaactgacttcaccaaaatgattccccaaaatatgacggccctgaagaataccaaatatcttcagagcaaaattgggtcgacaacctaccttacctatttggtagaggggaatggtcgagatatcagggatcaggacaatttgaagacaatcgatcaagttggtcaaaaagtggaccataagtaccatgacgtcaccgatgtcaccagcttatcgaccgcctatcaacagacgaacggctcattgaacacttctcaaaagcagttaactgtgggtgttgacaatttgccaacgtctttaaaacaaactttgattagcagcaaccatcacgatgcaacaatccaattcaaaattaaaaacggtctgtcctcaaaagaacaacttaagttgatgaatcggattaatcatgacattaaaggaacccatcatggcttaaaaatttctcctgcaggagcccaagtcatgatgctattggggattaataatatgtccgctaatcatgatctgattattattgccggtctttcgatcattttcattgtcctattccttatttatcgggactggcgactcgcgctgtacccagtcattccaattttactggtattaggactttctccattaaccttaaaactgttgggaatttcctataacccggtcacaattgccctcagttcgctggttcttggaattggaaccgaatttaccatcttgattctggaacgataccgcgaggaattacaacggggaattagtacccgggacgcgattgtttcagccaccgcgtctgtcggccaggcaattacagtttccggcttcacggtcatgggcggcttttcggccatcatgttctccagcttcccagttctgaagtcatttgggctgattactgtgctggacacaggttattcactcatctgtgcattgacgattttgccggcagtcatttatctgctgcgaaaaagaaagccggcagccactcaatcctcatccgaacaggcaactgaaagtaaggattaatcgacccattgaaatacccttttctaactaaaaaatggcttccataaatgaaattgattcatttgtggaagccatttttgtgtttgacgctgtttcttggcatctttgtgccatcaatcagccgccttaattactgagcgtttagtttattaatgattgaaatgagaaactactccaactgcggccaatcaatattcgccttgagaagctgctcttctaaaaagcccattattgtattcgccaaaaaactgatcatcagcggttgtgaagacgattgcttaatcaacgttacgacaggatcattttgataggctggattgttggcccgttcattaaacaaattctccaaaatgttccgaaattcatcatagaacttgctttggctttcgggaatcagatggcgaattaaatcaatgttgtcggaaataaaatgggtaacctgggttaaaacaacggtttccctgaaatccgtccccagcaattcttcagacaggttatagataattgtatttgccagatcaaccttatcttggaaatatcggtagaacgtgctgcggtggatcatcgcttcatcacagatttctccgatcgtaatatcatcaaatttcttttttctaagaagcgtcatcattgcctgcaaaatatctcgcttggtgcgctgttgagattgggtgtcggccatagtcaaagtcctttcaaaatttagattataaaattaagtatacatcataaccaactattcttaaagaaaccaatgacaactttcacaaatttgctgccaacaaaaaagccccgacccgccacgggatcagagcttcatttgatttgttaaccgtcaatcagattcaccctaaaagtgtatcgtcagttacagacggtttatttatttttttcgagatacaggtcatttgccgcagcaacgaagtccttgaagagcccctctggacggttgggacgggaaataaactctggatggtactgtgaaccaacgaagaaccggttctttggaatttctacaacttcaaccaagtgattgtcaggtgaagtcccagaaatgaccatgccatttttctccattgcatcgcgataggcgttattaaattcgtaacggtgacggtgacgttctgagatgacatcggcattgtcataagccttggcagcaaccgttcccggctttaatttacatggataagcgcctaaacgttgagtgccgcccatatcgtgaacatcttcctggtcagccatcaggtcaatcacattgtgtttggtccgcggattcatttcagtcgagttggcatctgggtatgacaaaacgtcacgggcaaattcaacacaggccatttgcatccccaggcaaacacccagatatggaatgtcttgttcacggacatatttgatggccgtaatcatgccttcaattccgcgatcgccaaacccgccgggaacaatcaccccatcggcatctgacagcaagtcggcaacgttatccggtgtaatcttttcagaatcaagcatctccaaatcaatgtcggcgtcgacaacgtagccggcatgtttcagtgcttcggcaacagaaatgtaagcatcttggaggccaacatacttcccaaccagggtgatatgaatcgtccgtttgagatgttgaacgtgatgctcaagctgcttccattcagtcatgtcagcagctggcttatcaatgccaaagtgatcgaggatctgttgatccatcccctgcttttgcaggttcaacggaatggtgtacaaggttggcacatcaagtgattcaaccaccgcctgtggcttaacatcacagaacagtgaaatctttttgcgcattgagtcggtaattggcttttcggaacgaacaaccaacagatttggctgaatgcccaaaccacgaagttccttgacactgtgttgtgtcggcttggtcttcatttcaccagccgctctcagataaggaatcaaagttgtatgaacatagaagacgttttcgtcgcccacttcggtcttcatttggcgaattgcttccaagaatggcagtgattcaatatcaccaaccgtcccaccaatttcggtgatgacaatttcagcatccgaaaccttggcagcccgcataatcttttctttaatcatcccggtaatgtgaggaataacctgaacggttgccccaagataatcaccatgacgctcttttcttaggacttcatcataaatcttaccagtcgtcacgttggagtatttattgaggttgttgtcaataaaccgttcataatggccaagatccaggtcggtttccgtaccatcgttggttacgaaaacctctccgtgttggtagggattcatcgtgcctgggtcaacgttgatatagggatcaaacttttggatggtcacattcaacccgcgatttttcaacaatcggcctagtgatgccgcaacaattccttttcctaaggaagaaacaacgccaccagtaacaaaaatatatttggtcattatataatcctctcctcttgatagttagccggggaattcaaaaataaaaaaatccctatccaaaaaagtgaatagggaacaatttaatcatcgttcagatgtccttgaaactcaaggagcccaaaaaacataatacatactttttaaatattagtcaagaattaatggtcgtcttttgaattgaaatcatcatcgtcatcatccaatgaatcgtcatcatcattcaattcgttaagttgaccttcgatgccatctggcaagtcctcatcgtctgagtcatcgtcaatatcctgcaagtctttgttgtacttgccaagatcttctgattcatcatctgaatcgtcgtcatcatcagtatcgtcatcaaagtcatcgtcgtcctgatcttcaggatcatcgtcatcataatcgatcacgtcgtcatcatctgaagcgtcggcaagaaaggcattcaccttacggcgcttctttcgcttgggacgatcctcgtcttcttctgtatggacagttgcttcatcaattgattcataagggtaccatgttcgtaagccccaaagattgtcaccaagtgagataaagctgccatcaatgttcaaatcggtataaaattgtgataaacgatcacgaatttctttgttactatcacctaaataagcctgcaccgcattggctaaatcggcaaatggcattgtgtctccacgttgtgccaagattgcgtgtgcgacctcaatcatcgatagttcatttttgttttggcctttaaagacttctaactccaaactggtacacgtcctttcaacagtctaacaacagtctaaaaattactatactcgattaaattgtaaattgcaatcgaatattgtatttccctaataaagcatcgccggcatacagcaaataatcaattccgatgttgccccgaagcggtgcatccaaaatttccatgtccaaagcagaagtaacggtttgaacatccatcaagccatatggggttcgatagcgggcagcaattcgtttgccgtcgctaaacaataattgcaggcgattctcacctgagcgggtcagtttgacattaccgttatctgaaattttaatggtaaccggaaccccgccatcctcagtttcctcttcataccgaatatacaagctgctgcctactcgaactaattggccggtgacatcaaaaacaaagtttgatttctggccttcctgtaaaatgttagtttccaaatgaatttgaactggaacgccagttgttaaattgtccataatacaccttcttttaaatctcgttctaactaatttattatatatcccacggcaacattttgcactcatgttaccctgacgatttccggcaactttacctatttatttggtggtgtctgttataattaagaagattgtttattttatgaaacggagagttggcatatgtcttttacaaacgttccgattaccgtcatcaatcaaatttattctaaaagcaccaagctggatgcctttgcagacaccaatgccctattggaaatctgtgaccaaacgttgaagccgttcatccatttttggacgacttccgaagcaactttgatcttggggatcaatgaccgccatctgccgaaactggccgacgggctcaaaagtctgctggccaaccactatgattattttctgcgcaattctggtggtctggctgtcgtcagtgatccgggaatcctcaatatttccctgttcattccccaaccggataccgtctacacaattgatcaggcatacgaactcattaaagggttgatcagcatgtcgtttccacaactggacatcaagagttttgaagtcacaaactcctattgtcccgggaaatacgatttatcggtcaacgggcaaaaaatcgccggcatcgcacaacgacggacaaccaacgcgttggtgttgatgctttatttaagtgttaatggcgatcaagatgccagaagccaaacggttgctgaattttatgaaactgccgatgcttattcgcagtctcgttggacctttccaaaagtcgacaaggacacgatgaccacggttcaagatctcggcttcccaaatatcacgctcgaggacgtcgaacataaatttttagcgagcgttaaccagcaaaatatcgaagtggacgtaaccagcggccctgattttatgctttcaccggctttcactcaagagcgggccaaacagttacgcaaaattcagctgagaaatgaccaattaccaattgtctaaggaggcaattttttggattacgcacatcaacagttaaaaagagaaaaggtctttcgagatccggttcataattacgtttacgtcaaatatcaagtcatcttagacttgattaacaccaccgaattccagcgcttacgtcgggtacatcaattgggaaccacgtcactgattttccatggtgcggagcattcccgtttttcgcattcggtgggggtttatgaaattgctcgaagaatcattgaatcttttcaaaagaactttatgtcacaacaacctggcgatggtctctgggatgattcagaaaaattagtcgccctctgtgctgccctgttgcacgacgttggccatggtgcctattcacacacctttgagcacatctttggcaccaatcatgaacagattacccaagccatcataacatcgcccacaacggaaattaaccaggttttacgaagggtctctcctgacttccccgaaaaagtcgccagtgtgattaacaagacctatcccaacaaacaagtcgtcgaaatgatctccagccaattggatgccgatcggatggattacctgcttcgagacgcttataacaccggcgttaaatatggcacgtttgacctttccagaattctggaagtaatgcggccgtacaaagatggaatttgctttgaaatgagcgggatgcacgccgttgaagattacattgtcagtcgctttcaaatgtaccaacaggtgtatttccatccggtttcccgggcaatggaagtggttttgaaccggttgttgcaacgggcaaaagttatctttagcggggaggttcatcacgatccacagaccccctacctattactgccgtttttcaagggtgattttaacctggacgactatctccaattggatgacggggtgttaaacacctacttcatccattggaaacggtacccggatgatattttaagcaacctggccagccgttttatcgaccgaaagccactcaagtcagtcaaatttgacaagtcgaccgctgacttgttgccaagactcagagagattatcgaacaatctggatttaacccggactactacacggcgaccgacaacagttttgacttgccttatgatgcctatcaggcggacaaaaaacaaattcatttaatgcaggatgacggtaccttggtatccttgtcatccgttagcccattggttcgggcaatttctgatcgacagaccggcgataaccgcttcttcttccccagagaaattttgaagccggatgaaaacgtcgatttgttccaaccagaatacgatgaatttaatcgccacattcgaaacgataaattaattaaatagctaaaggagattctcccatggatatcaaactcattgccatcgatattgacggcacccttttgaacgaaaaaaatgaactggcgcaaccaacgattgatgcaatcactgaagcccgcaaaaacggcgttaaaatcgtcttgtgtaccggccgaccgctcagcggagtacagccctatttagataagctggccatcaagggtgccagtgaatttgcaattacctttaacggcgcaatggcacaatcgcttgacggtcaagtcatggtcaatcacacgatcagctatgataacttcttggagaccgagatgctcagccgcaaattgaacgtcaattatcaaattgagacaaccgacagtatctatacgaccaaccgtgacaccaacccctatggaatcgccgaaagcttcctggttcgcctgcccatcaaattcagatcaccagaagaaattccgcgtgacctggtgatgtcaaaggcaatgtttgtggactacccggaaaatatcactaaagccaatgacctcattcccgccaagctgcgtgatgagatgtacgtggttcaaacggaaccgttcttcattgaaatgatgaataagcaggctagcaaaggaaaaaccttaggtgaattagctgatcagctacatttaaccaaagacaacctgatggcgattggcgatcagggaaatgatttaaccatggtaaaagctgctggcttgggagttgcaatgggaaacgcaattgatgaagtcaaagatgcagcccaatttattaccaaaccaaatacagaggatggcgttgcatttgccatcaacaaatacatcaaccattaatggctgagtatacgaatagaggctatgaacaaaacgttggttttgctcatagcctctttatttgtatcaatatctgttattatccttgccaagtacaatcaacaactcagcatcaaattgttgaccgcttattggggcaaactggttaggatgacccctaacacaatcaaaaagccacccacgcccaggcaatagcgggcgtatttattaactttgattggctgatttttaattgaaccgacatcctttgccttgggatgcttgggatcattttcagcttccaagtcgcttttcttgcgaatatggaatcgccaaccggtaaataggtgccccgagccgactataaagaccgatcccaaaacaatcaggaacaatccaaccaaaaaatcaaggttaccaagcaccatttccggcattcggaaaagaatcagcaaaaaattgatgatcacaacaacaataatcgaagaccagactggcgattttttaaccaaatcgaccattaattctcttcaccacgaaatcgattgttgaacagcggactaaccggtttgttttcattgatgcgtttaattgcatccccaattaacggtccaactgagacctgttcaattttatcgatttgtttttctttgggtaactgaatcgtatcagtcacgaccagttgtttgattgcagaatcttgaatccgctgaatggctgggcctgaaagcaccgggtgggtacagcaggcgtaaacctcgctggcaccggcatccattaatgcctgggcacctaaggtaattgtgccggcagtatcgatcatgtcatcaatcatcaaacagcgcttgcctttgacatccccgataatattcatgatttcggcaacgttggcccgcggacggcgtttgtcaataatggcaattggtgccttcaagaattccgccagagctctggctcttgatacaccaccatggtcaggcgatactacgacatcatcactgccaaagccttgcttaataaagtgatcagctagtaatggagcacccattaaatgatcaacgggaatatcgaagaaaccttgaatctgagcagcatgcaaatcaagggcaacgacccgatccacaccatcggtctgtaacatgttagccactaatttagcggtgattggttctcgtgaacgggctttgcgatcttgacgagcgtaaccatagtacggaatgacaacattaatcgtgccggcacttgctcgccgcaaggcatccaccatgatgagcaattccatcagattgtcattcaccggtgcggacgttgactggataatgaaaatattgtcgccacggatactttcgtcaatattgatgcggatttcaccatcactaaatcggtcaaccgaggtcttgcctaatggaacaccaaccgtttccgcgattttctcagccaaaggccgattggaattcaaagcaaagatctttagtttcgaatcaaaatattgctgagccatatgatcctccaatatgttttttgttaactcacatctcaataacttaattatacaatgttttaattaaaattcagagttaatctttctgataaggcaattttttgaaatagccggctttatttgtctggcgggcacgggcaatcgccatgtcgtattgattaactgtcttattaatggtggatccggcagcgataaatgaatggtcagcgacttccagcggcgcaatcaaattcgagttgctgccgatgaaggagtcgtcaccaacggttgtttcatgtttgtgagcaccatcgtagttggcgaagatgaccccgcagccgacgttgatattcttgccaagtttggcattgccaacgtaagttaagtggccgactttggttccctcgtcaatcgatgacttcttgatttcaacaaagttacccaaatgaacgtgcttgccgattttggcttctggccgtaaatgactgtttggcccgatgtctgagtgatccatcatttcagattcttcaattagtgaagatgtcaccgtaacgtgatcatgcaggactgagtcgcgaatttcggagttcgcaccaatgtagcagtcattgccaatgacggtgtggccctttaattggacgccgggttcgataattgtatccgaaccgattttgacatcggcatcaatatacgtgcgttccggatcaatcattgaaatgccgtccatcatatgttgacggttaatccgtgtccgcatgatcttggtagctctggctaaggcaatccggtcattaacgcccattgactcgtcaaaatcatccatcttgtaggcagcaatggtttcgccctcagacttcaaaatttcaatgacatcggtgaggtaatattcaccttgagcattgtcattggtgagcttatgtagtgcctcgaataatgcctgattgtcaaaaacataaacaccggtattaatctcatcaattgcttgttcttctctggtggcgtctttttgctcgacaattttttcaacaatccccaaatcattgcggacaattcgaccatacccggttggatcaggggcttgagacgtcaaaattgtcgctttggcttttttgttttggtggtaggtaaacaaatcttcaaaagtcttggttgtcaataacggggtgtcaccactgacgaccatcgtcatcccatccaagttgcctagtagtttttctgcctgcaaaacggcgtgcccggtcccgagttgtttttcctgaacgacatattgcgttcgcttaccaaggttttcccggacggcgtcggcaccaaagccaactaccgttacaacgttatccatatcagctttttcgacggcggttaaaacgtgatcaaccatcgttttgccgcagaggcggtgaaggaccttgtaaagtttggacttcatccgggtccccttaccggctgccaatatgattgtgttttttgttgccattatctatttctccccaatgcttaattaaatattttctcgatatagtttccaggttgtgaaacaaccgtgttattctcagcgtcaactcgcatcaatgacgtgtagtcgccgatcgtccggccgtttggtgccgtactttctgccacaacgccgacaccgatcagattggcgtcaaactcttcgaccatcgaaatcatgccaccgaccgttccgccgccacgcatgtaatcatcaacgattaaaacgtttgaatcgggtttcagacttcgcttggatagcgacatcttttcaattcgggtggatgatccggacacatagttgacgttgacggttgagccttcggtgatttcagtatcgtgtctgacaatgacaaacggcacgtttagaaaatccgcaacactctgggcgattggcacccctttagtggcgatggtcataacggcatcaacattttggttcaggtactgagtcgcaaaaattcgaccaatttctcttagagtcgctggacttcccagcaggtcggacatgtagacatacccacccggaagataacgggtgtcggaagacatctccgcaattaatttgttgacgacctcttgggcctcttctttaagaatatacggcaaaaacctggtcccaccagcggcaccaggaatcgtttcaagcagaccggtcccccggttctgaaatgttcgttttaaaattgttaagtcttcactaatcgaggacttggctgaatcgtaacgatccgcaaaaaaggtcaacggcacaagtgtgtgtggccgctccaataaataacgggtcatatcgatcagtcgatcacttcttcttactttcaaaaattccacctcgagtttatgtaatatctatttgattttatcataaatgttcgtctttcggggaagatatagcaaaatataatcacagtttaaacttagcggcttttgttggcaattgaattataaatcagtgccaatccatagatggccgcttcgatgctggcaataaagaacgtgaccggccaattcgtgacgtaacccagataaaggccaaaccaaacgccaaagattgcaaagccaattgccaaaagcatcatctggattacggtgtgggcaaagtactttgaactggcagccggtaatgtcaacagaacaaagatcaaaagcgaaccgacaatctgtgcggcaacactcacgctaaatgccaataagaccagaaaaataattgaaatcaaagagctgtgaatgtggttggttttggcaccaacggcatcaaaagagtcatccttaagatttctaaaaataaaaaagagcacaaccagtactaaaacagacagggccgccatttgaacaacctcttggtgactgatgccgatcacacttccaaataaaatgttggtcgcgtaactggaatttttgttggataacgataaaaacaagatccccagcccaatgaaaaggcctgaaatggcactgatcaccgactctcgacgggattccaccgcgccgctgagttcaccaaccaaaatcgaactgactgtggtaaacgccagcatgccgtttaatggtgtccaaccaatgaagattccaaatgctgccccggcaaacccaatctccgacagcgtatgggtcataaagggcatgttgcgggcaacaacgaagacacccataatcccgctgacaatcgcgattaaagtgccggcaaggtacgcgttacgcataaattcaaaactaaacatattcgccctccttagaatcattatgcagttcactgattggcccagcagtgtatccgttcttagtcagccacaggaaatgatccggatattcatgaatgacctgcatgtcatgagagacgaagatgatcgtcagtcccaaagtttgattgagccgcttaaccacatcaagtaactcccgcttagtgttgggatcaagactagctgtagattcatccaaaatcagcaggtcgggatcgttaatcagtgcctgtgcaagataagctttctgcttttctcccccagacgccaatcccaatggccgtttggaaatgtgctcaagattaacctgcttgataacggtttgaatcttttgcttctcttttcgcgatagccagggcagtttaatgccggtgaaattaagcgagataaagtcttcaatggacaatggatactcgacatcaacattacgaaattgtggcacgtagccaatttttaaaccggctttaagcttgatccggcctgctgaaggcttcaattgattcaagatgaccctgaccaaggtggtcttgcccaccccattttcaccaatcacgccaagaaactcaccccgatgaaccgcaaaggttaagtcagaaagcacttggtgattggggaaacttaatgataaatcttcaaccgaaattaatgtttcactcaaatggaaatccctccacaactttgtaaaaagtaattattactattttagtttagattaaattgaatttttgtcaatcgctgttggcaaattaaaaggactgcttgaacaaaacttaagctttgtcggcagcccgttctgatttctttaaatgaccggatgtgaatcgcattccggctgggaaatgtaggcttcattacagaagccggaaatgctattgtaaacgcggcgagcgcgggattcagttcggcagatgccaaaaactgtcggtccgctgccgctcatttgggagccgtcggcaccatattcaatcaaccgcgatttgagcgttttgatttggggatgaccagcagttgtaatctcttccaatgagttgccaatgtttgccacaatgcggtcataatcctgattttcaatgcctgctaataattcgtcaattggcggatgactgacagacgttgtcgcaagctgtttgagaattttgggtgttgacacactcacgtggggtttggccaggacaaaccacattttaggcagtttggtgagtggggtcacaatttctccccggccgctgaccaaggctgtgcgactgtagacacaataaggcacatcggaatcaacctgaacgccgatttgggctaattcttcaaatgacagcccagtctcaaacatttcgttgagtgcacgtaaaacggcggcagcatccgatgatcccccacccagtccggcagcgaccggaatattcttctcaatggaaatctccaggccaaccttaaagccaaccttgtcaaaaaataaccgggccgcctggtaggccaaatttcgccggtcattgggcagaaaactgctatccgaaaaaatccgaatcgccgagtgactgctcttggtttcaatttggatatgatcacttaacccaattgacgtcatgaccatccgccattcaattgagccatccggatggacaaagggggcatccaagcccaggttcaattttgctggtgctctgacaattcgtttcacttggatcgacccccttcatttattaataacaaaattatactaaattattaataaaatgtcagttattggctgataaaaggcagtcggagcaaaaaatggccaaaataaaaaggcctcaatggcccccacgctgactttgactccctgcagttaaactgcttgggatgcatcaaaatcgacctcaatatttttggtcaaaatatccgtatagctgtacgaaacccgttcaaaattcgcgttgcccggatccaattcgacaacaaaaacagccggaaacgtttccctcaaaattccccggcgcttggttgtctttcttcgcccaatttgagaagttactaggacgtgctggccgatatgatcgtccatcttatgcttgataacagataaagtcactggcattctactcacctcacgatatttaattataccataaaagtaatagaaatgcaattttttaccacaaatcacactatctggcaataataaaacactaagatttagattaaatttttcaaagtgtgaaaggcattcgccaaggtcacaaactgatcaacagtcaaattttcgggccgaacacccgcgtcgatattgacactggctaaaacttctttaatgttggccttcacttccggtgttttgccaaatatcccctgtaaattattccacagggtttttcgctgatgcataaaacagccacggacgaaactgataaaagccttttgatcaaagggttcaacggcccttttaacccgcggtgtcaatttaacaatggccgaatcaactttgggctgtggaataaaagcggttttgggaacaacgaatgaaatctcgacctgatttaattcctgaacaatgacagacaacgacccatagggctttgttgacggttcagcgttaagccgctcagcaacctctttttgcatcatgacaacaatcgcatcaaactgggtttcgccggtaatcaagtccatgacaattggcgtcgtgatgtaataaggcaaatttgccactactttgagcggcttttcagtgtcaaagacgtcatcaatgatttttggcaaattagctttgagaatgtcctgattaataatctcaatattatcatatggcgccaaagtttcatccaaaaccggcagtaggttggcgtcaatttcaaaggcgacgactttgttggcagccttggccaactgttccgtcaacccaccgatcccaggaccaatctcgatcacgttgtcggctttggtaatctttgcggcagcaacaatattgtccaacacaccgagatcgactaaaaaattctgccccaagcttttcttggcggataagtggtaacgattcaggattgcctgagttcgtgtgggacttgcaatctgtggatattcagtcatgagcttcctcctgattaatctgttcaacagcggctaaaaattcatcgtgtttgatgccaaacattctaaggcgatgctgcagctgtttgccgttaacatagccgattcgcaaaatttcaccgaggcgttcccgccgttttttggcactgggattacccatgaggccgtacttcattaattcagccttggaaatgagttcaccagctgattcatcctcagtataaacctgactcaaggcttcgcgaatcgattccacactggcgtgctcgacacctaacgacccatcggatcgattcggaactccctgcttcttggtgataaaggcatgcttagcgttgggaacttccgcagaaatggttttgcgaattttttcaccagaaaaatcaggatccgtgaacacaataatcccccgagtttgagccacctttttgatcaggtccaaggtctcttccgggatcgccgagccgcgggtttcaatggtgtcggcatcgactgctctttgaacgcgtttggtatcgtctttgccttcgacaacaatgacttctttaatttttttcatgattcctcgattccaaataaccgcagcgtattttcataggtatgcgccgcaatgacatccgggttgacatcacaaattcttgccagtgcctctaccgtgtaaagcgaataagccggctcgttttgcttgccccgcaatggttcgggtgataggtacggcgcatcggtttcaaccagcatgctgtcaaacggtgtttgacggacggcatcgtgaacttcatgggttttcttaaaactggcaacgccactgtatgagaccagcatccccaagtcaagaaacttcttgagccattccggatcgccattaaagctgtgcatcaccccgcggatatcggagacatccatttccttcaaaatggcataggtatcctcaaaggcatcccgattatgaaccgaaatcggtagatgcagttgtttggcaatatcaatttggcgtttaaagacccgcttttgcacgtctctgggagaagttgtttgatggtagtccaagccaatttcaccaactgcaaccaccttttggctctggagctgttcaatcaacagctgttcttgttgttcatgataatggatagaatcttccgggtgccaaccgatgattgaatacatgtcagggtattgggctgccaattccaatgatcgatcgttcagctgttgattagaaccaacgttggccagcttaacaacccccaagttctgtgcgtgcttgaaatatttagccgcttcaggataaaggtgttcgtcattcaaatgggtatgtgaatcaaaaattttcattatttgctcccaaactatttagatagaaatagggattgtgacaaaactcgcgtcttgttgccaatccctagtctttcacgatgttaactttgccacaaatcggcaatttattccagtgtgacaccattttccaagtgagatccgacggttaccaactcaacgttgccatctttatgttccacggacagtaacattccttggctgacttgaccgcgcatctttcttggtttcaagttcgacacgataatcacttttttaccaattaactgcttataatccggataccattcagcaattcccgacaaaatttgtcgatcgccgtcatcaccggcatccaagcggaattgaagcagcttgtcggcgccttcaaccttgttaacgtctttgatttcggctactttgagttcaatcttttcaaaggcttcaaaacgaacttcttttttggttaaattcaaattggtttcttcaggattaaaatcagcttcagcagcttctttcatggctgcacgacccttggccttatcggtcttggtcatttgctgcttaatgtagtccacctcatcgtcaacttcgactcttgggaagattggggtccccttggcaacggctttcacaccggcaggaacgtcttcaaacttcaaatcttcgaggtcaatgtcttctgtaatccctaattgagcaaagatttctttaggggcgtgagtcataaccggactgattaattcagcgatgacccgaagaccggctgccagatgagccatgacagcgtcaagcttatctttgtcatcaggatttttagccagattccatggttcggtctggtcgatgtacttgttggtttgggaaacgagtttccaagtttccgctaaagcatcggagaagtgcaaatcattcattaattgcttgtaatgggcaatcacggtggcagcagtctcttccaattctttgtcagcttcgttaacgccggcctggtatgcaggtaagatgccgccgtcatacttgttgatcatagaaactgttcggttcaacaagttgccgagatcattcgccaaatcaaagttcaaccggtcaatgaagtcctctggcgtaaacagaccatcattggcgtaaggcattgcgcggagcaagtaataccgcaatgcatccaaaccataacggtcaactaaagtttccgggtaaatgacatttcccttagacttggacattttaccgtccttcatcagcagccagccatgaccataaacggttttaggcagcggcagtcccaaggcgtgtaaaatgattggccaataaatcgtatggaaccgaacaatttccttaccgaccatttgcacattggctggccaatatttcttaaagttgctgtcatctttgccgtcataaccaagagcggtaatatagttggtcaaagcatcgatccaaacgtaaaccacgtgctttggatccgacttgaccgggacaccccaagtaaaggtcgtccgcgaaaccgctaagtcttccaaaccgggttcgatgaagtttttgatcatttcattcatccgggttgccggctggatgaagtcaggattgtctttgtaatattgcagcagccaatcagcatacttactcattttgaagaagtatgactgctcgtgaaccaattgaacttcgtggccgctgggtgctttaccaccggttaccttgccgtttttatcgcggtaaacctcggcgagttgactttcagtaaagtactcttcgtccgataccgaataccagccggtatattcacccaaataaatgtcgccattgtccagtagtttctggaagatatcggcgaccgctttttcatgataatcatcggttgttcgaatgaatttggtgttggaaatttccagctttttccaaagttgtttgattgatgcagccatctgatcaacataatccttaggcgacatccccaactgctctgctttttgttcaatctttaatccgtgttcatccgtccctgtcaggaagaagacgtcatagcccattgcccgcttgaaacgtgcttcggcatcacaggcaattgttgtgtaggaattgccgatatgtaacttcccggatggataataaattggtgttgtgatataaaatgttggcttactttctgccatgaaagtacctcttttcatgcttaattattctttaggatattacaatccagtatagcaaatattttttggaatggcgatgagaattggatttgggtgagatggtcgtagtcgaagttcaatatcgctttgaatcggtggtggtttgcttttacctagtggtaacagcagcaacctgcacctaagtatggtcggacaaaaatcaaaatgattttcatccaaccacactcaggctccggttgctaagcgctctggatcgcactcattcaaaacaaatccatctgtaccggcgacaggccgccaaattcaatccccaacatctttttcaactgcagggcgttgtctgctgcgtccccgccgctattattattgaagatgacacaaacttctttggcctgtttgtccagatccaggactacttttcgaaaagctgccagttcttcttccgaataccggtacaacgtccttttcccgcgccaatctgctgactgctccgtccagcctttgacgtttcgaccgtgaagccgcagcaacgccagattctccgttgtcaccagcggttcgaaaggcacgccggcattggtggtatgcggttcgtcaaccgccaccaacgtcattcccagttcgctgagatagccggcaacgtcatcggtaatctcgtcaccataccaagttgagttgcgaaactccactgcaacaggatatccggccatcaactggctaattcgacgcaggtactgaatcgtcgcaatctttctggcaaagtatggcggaaactgaaacaggatcgccttgagctgaccggtgtccattaatggggcaaccgcccgcttgtattcgttgaaagccacaaaccgctgctcattatcaaccgggtcggcgctgccctgatcgtgcatggtcatcacccggttggccttcaaaataaattgaaagttatccggtacctgtttttgccagttggtgaccacttcaattttgggaatcgcataaaacggcgtgtccagttcgacgaccggaaaatacccactgtattcagttaagcggactttacgtttagcaccgtcgatcagtgaaggatgctcggaaaacgtcgttaacccaatggtaatcaatcagcccacctcccggctgtttagacattcaccgtcaaatctttgaagaagtcaacggcattttctttgaccatcgtaaacggaaaaccaaattgaagcggctcttcattaaccgccagaactttggcattttgagaacgataatcaatcaagccggcaaacgggtaaacccgcattgatgtgccgacaatcacaatcagatcagcttgggacactgcctcaacactcttggaaatggcaactggatcaagcccttcaccgtataagacaatgtctggtcgtaaaatgccgccacagttttcgtgatacatactctttaaataatcctggtaattgactgtcttgtggcacttctgacaatacactttgtatagattgccgtgaaactcgactaaatgctgcgtgttggccttgcggtacaagctgtcaatattttgggtcaccacaacggcattgcgtttctgggtaaactcagcctggcgctcatgaatcacatttggcttggcatccgggtaatacatatttgatttttcgtattcccagaaaactttgggctcatcacgaaggcaatcggtacttaaataatactcagcgggtttatcagatttgtcattggtatacagcccgttctttgatcgatagtcaggaatccctgatgccgtggaaacaccggcaccagtcaaaaagacaattctttttgcgttatcaaattcagcttgcagcttagaatcaatcatcgtattcctccttcaaaagttcattatttgcgaacgatataaggcattttaagatcgtcgaacaactgcttggcgcttttatcatagacccctttgaaaaattccggatcgtcctggttacccttggggttggccagcacaaaggagttctgatcatctacccgattaaagccgacgtaacccttggtgttgctggtaacctcggtcaagtcggaatgataaatttcaaatagttgtttaactttcaatcccagctgccgttccgacaaaacactggtaagggtggtgaactccgtgttgtgcagggccggcagttcccagtcctttaactgttcgtcaaaggctttaaagagcttgacgacgttgcggcgcaatccaaatggtgaatccgtcggcttatcggtgatcacttgatacaacttttgggcagcctcaaaggaaaccgggaagtcttgtttgaatttgtcagccaccttgtcaattccctcgccgtaaaagaccagcgcatccaataatgtggttaaccgtaacatcatctgatcgtccagtggatccggttcaggtttgatggttgcatagacacctttgagatacatctcttcgatgtcgtcattgatcaaattgtgctttcgctgctcggatacaaccacaaaatgagagacaatgtcgtagagttccgttcccatcatttttaattgttcatccagagtatcatcgccagtggtcagtgaataaaagacctgtggaaaaccacggaggaccatcaataggtgcagcagttcatgtgaagccgtgtagtcgggagcgcttaagtctgcgatttggacgatgatatttttgccgtcctgaaccgtttgggcctgatcgtgacgtacatatcctgattgcagcttgccgataaaagtcaccgtcaccgtcccgggaaagaagttgttaacggcgtcaattaagccgtgaacgtctttgtttaactcgatatcaatattgttatccatcatgttctccatcatgttctcctatctgcgaagtatttttaaaatttctttaactgtttgtgaactgggatgatccatcccctgaagcttttgaacaacaactggcaactcctgcattgtggttccatttgaaagagctaaggaccttaattgaagattcatatggcccttttggatgccatcggtcaccaaagcttttagggcagctaagttttgagccaaccccaatgcggcgaccacctgcatttcctcgcgggaattgtcgatctgagcgatctgtttgttaatgccggccaacggcaaaaccttgctggcaccgccaacaaatccgattgggactggcagcgacatgcgtcccaccagttggtcttcgtcaatctcccatgtactcaggccttgatacgacccacttcgagccgcaaacgcatgagctgcgctttcaactgcccgccaatcattaccaaaggccatcacggcggcgtcaacaccattcataattcctttgttatgcgtcgtcgcccgccgaatatccaactgggcgatctgactggcatcggcaattttttgggccacctgagggccagataacgacttggttcctagtttggccatcgccaccttaccggaaacttcaacgatggctttatcagcaaaattcgttaagattgccatcgtggtttcgaccgtcaactgctcagaaagccaattcgacaccgcttccaacatcgtgttgatgatgttagcacccattgcctcacctgtatcaaccagcaggtcgaccgacaggaactgctttgagagaatccggacatcgaggcctttggcacctccaccatactttaaaacgcttggatgactctggtccgcaatttgaatcagctgctgctgataatcatgaacaaactttgtcacctgatgaggatctgcgtctttgacgatgacctggccgctcaccaggttatcagggacgctgcaatgaatgcctgctcctgccgataacagtttggcaccattgctggcagccgcaatcactgacggttcttcagtcaccattggtaccaaatgttcgtggccgttgacaaccaggccaactgcgattccctcggggagtggataatccgtcagattgttttcaattaattctccggaccttgggttcaaggaccgtccaagcaaatcgagttgagcctttgataaattggcagcttcagcgatcagcgaaagacgctgctcgtaagactttttatagaaatgatcccatttgttttccatgatatcaccatcatctgttagaggcacaaaaagctggtacaattgccagctttactcgatgccgtattctttttgaatgtactcggtaatgatgccttctctgacaccactttctgaaaataagacttttttggcatcaattttgtccattaaaacaatcaacggcaacaggccgccgacaataatgtcggcccggtcgtgctcaagcccctgaattttccggcgccgattgacgttgcccttcaataaattcagataggttcgattaacttgttcagcagttaaatgataaccgtgaattgcatcaattcgaaccatattttgacgacgacgattgattctcgccaaggtccgattggcaccgcccaagagaactaacggctgatgggccgcacgattcaaccaatcaattcttgaataaatcttcctgatattaaattgggcgttaaataaattcgcaccggtaatattatcatttaaatgatatctttcagtgatattcactgcaccgattggaatgctggtgagatttgagcttttgccctcattgacccgaatgagttcacaactggcgccgccaatgtctaggatcagacaattcctgattcctaatcggttaatcacgcccagataatcgtaataggcctcttgattgcccgaaaggacctgaagcgaaatgccaatacgctcagaaacggcctttaaaaacttcgcctggtttttggcttggcgaacggcggctgtggcaattccaatgacccgtttggcttcatattgagaatagatttgtttaaaatctaacagtgacttaatcgtccgttccatggctgccggctggaggatcttgcccctgcccatgccttcggaaaggcgactgtcgcttttgatgcgtttgatttcacgataactgccatcatcagaaatttgattgattgccattctgaccgaatttgagccaatatccaaaattacaaggttttccatccctgccaccctttctggacatattagtcaaaatagttaatgccaatggcatcgcgaacttctttaagggtttgattggcaacctcgttagcgtgttcactgccctttttgagaatctggtagacaccctgttcatcttcggcgtaacgctgacggcgctcacgaattggtttgagctcggcttgcaggacatcgtttaagtaacgtttaattttaacatccccaaggccaccatggctgtattgatcttttagttcctgaacttttcgtttgtcaggatcgaaaatatccaagtaggtgaagaccgtgttgccctcgacttggccgggatcttcaacgtgaatgtggtttggatcggtgtacattgacatgacctttttttggatggtgtcttcatcgtcggccaaataaatcgcgttgcccaaagatttgctcattttggcatttccgtccaagccgggaattcggcccattccctttggtgggaagtaaccctctggctcgactaaaatgtcatcattataaacggagttgaaagttctgacgatttcacgggtttgctccaacattggttcctgatcgtcaccgaccggaacagttgtggccttaaaagcggtaatatcagcggcttggctgattggatacatggcaaagccaaccggcacactttggccgaacttcttttgtttaatttcattcttaacagttgggttccgattcagacgggaaacggtcaccaaattagaataatgctgcgttaattccggtaacgccggaatctgggattgaaccagaatagttgatttttgggggtcaattccaacggccaaataatccaatgccacttgaatcaaactgtggcggatcttttccggatcacgggcattgtctgttaatgcctgcatatcggcgatcataataaatgtttcgtagtccccggagttttggagctcaactcggttctttaatgagcccacataatgaccaatatgtagtttgcctgtgggtctgtcacctgtcaaaataattttcttcgtcattgtaaccatcctttcaaaaaacgccctattgctttaacaataggacgcttatacgtggtaccacctaaattgtaacttatatcaagttaccgctcgagacgatatgggcgtcaccctttacatactccaattcgtttcgtcgtggccgttttcagcaagtcggcctctctgttgctgacgattctactcagtttttaataacaatctaattttactgataaaccgctaaaaagtaaaccccgtttgcgggtaaaatacgggaagttttggcttaatatcctgcagataaatcaaccttgttcacagcaactttgccggtttgaatgaaactggtcaggttttgatacaaaatgtcaaatgcctcatcaccatattcttgaaagccaccggaaatatgtggcgttaaaataacgttatccatcccccagagtggcgaatcactcggtaatggttctgattcaaacacgtccagcccggcaccagccagttggtgttggtccagtgctgcaatcaacgcctcggtgtccaccgatgggcccctcccgacgttaataaagattggctggttgcgcatttgatcaaagaacgcctggtcgaagaaatgatgagttgctggggttaatggcatgatattgatcacaatatctgccttggcagcttgcactactccttgatcgtctccaaccacttggtcaaaatgcgccgttggtttgccatgccggctgacgccaaccgttttggtaccgaaagcttggagtttttcagcgattgcccgaccaatatggcccgttccaaaaatcaccgccgttcgatttttgattgtgtagttctgcattcgaacctggtcaccgagccacttttgatcgcggcgggccgcttgagtggtgacgatgcccctggcaaatgccaaaacgtatgcgatcaccatttcactgatgggttcggcgtggatgccactgacgttggccaaggtaattcctttatccgcgaagtcgttcaatggcatgtagtcgaccccggcagaatttgactgcacaaatttcagcttcggcgattcactcagcacggtgcgggcttgctgattccaaccatagatggcatcgacacttttgacattgctgctattcaaatcagccggttcgatgacctgcacatcgccaagcgctgtgagtttggcctgctgttcggtcgttaaattgaataaatccagaatcttcatggtcccatccctttcattcgtcttgatctcaataaaaagtatacgcttgaaattggttcaaacaaagcaaaatccccaccccacattgaagggcaacacaattgacaacggggttaataccaactaaaattgtcgaagcattcttaattcacagtcgagtcgaatccgaatggaggaacccttttggaaaataatgaaaagcaaatcgaacagtcacgtgtggacaaagtggtgaccaaaattgaccagaaaatcatcagcacggatgacgaacttaaccgtgcccacgcagaaaccaaaaaggttcagcagacttattccgacaatacctcggttaactattttgaggtggatgatcgaattgaaaccagtgccgaactccagcagcagcggggtttggtttctcgtttaaccgaaaatgaaagcatcttaaaaaatcagctttcaactttgaaagatctcaaaaaatccccgtactttggccggatcgatatccaagacgatgacgaggatcaaaccgaaaagctgtatatcggcattgcttcatttgaaaatgaagacggtgagtttctggtgtacgactggcgggcacctatctccagtgtttactataacggcactctgggtgaagtcgcctacgatactccaatgggccgacagcaaaccaatttaaaaaagaagcgtcagttccaaattgtcgacggtcaaatccgcaacatgtttgacaccaacgaaacggttggcgatgaaatgcttcaaagtgctttgggtgagcaaaacgacgaatacatgcaaaatatcgtcgccaccattcagcacgaacaaaacgatattattagagataccaccagtaatctgctggtggttcaaggggttgccggatcggggaaaacctccgccattttacagcgaattgcctttttgctgtatcatagccgcgatacgttggaagccgatcaaattattttgttctctccaaataaattattcagccactatatttccgaagtcctccccagcttgggtgaacgcaatatgcgccaggtcacctttgatgaatttattgataaccgactaaagggcctaaacgtccaaagtttgtttgaacgatacgaaactgatggtgacttgaccgaacagcagcgactggttcgcggcttcaaagaatctgccaaatttatggacgaactccaggaatactgtgataagctccagccagcccaaatcttcttcagtgacatcatttttaacgaatcaaccttctttagcaaacaggaaattcaagacattttcgacagttttcccaaagcagccaaagtttatgatcgcttcttacacaccaagaatgaattgatcaagcgactcaaacgccggatcgacgacgaaaccaaggctgattgggtcaacgacgaaatcgatcaaatgagtaatgagaagtaccacgatctcttggccggcaaagaactgggtgagttccaaaatgaagatgccgagcgcttcttcattgcccgaaaaatcgtcagtgcccgcctgcgggtggtctacgatgcgatctttaacgacaacttcttcgatgcctacctgcagtacgccgacttcttgaaaaaagtcgacctgccgcaaaacattgaaacgccccagtggctgcagtccgttgatgagtttaatcattcaattgaatttcatgccatcaaattggacgattgtgcgccgttgctttacatgcgcgactatatgtccaacagcggacagaacaacactatgaaatacctgtttgtcgatgaaatgcaggattattcagtggctcaactcaaatacctgcgctacgcctttccaaagacaaagtggacactattgggcgacagtgagcaggcactgttcaaagacgttgaacagccaaaagaaattcttgataaattaaacgccgctttccatgtgcgccggtcccgactaatcagtttgatgcggtcgtatcgctcaacgctgccgattaccaactttgccaaatccattttgcctaacggagatgacattgaggcgttcacccgccccggcgacattccggaattggttttgacatccgacttcaatgacggcatcaaccagctgcaaaaagtgattgccgaccaacgcaagcaatacgccaccgttgctgttttaaccaaaaatatgactgaggcccagcaggtctatgaacgactgcatgctttaggagatgtcacgttattgcaagatgcggaccgaacattgccaaagggcattttagtgctgccaatctatttggcaaagggcttggaatttgattccgtgatcgcttgggatacctctgagaagaactattccgatgaaagtttgcttggaaccctctacacgattatcacccgggctatgcaccacttaaccttgatcagtctgggcgacgtaaccccgctgatttccgatgagagtttaaccgatcgcaagattaaaatcgaaaaaaagattcggaagtaattggtgtgaaaacatctgattataagcaaacccggagctgtggtcattgatcacgctccgggttttttagtttcacttagattgtctggggatagacactgttcacttttatctcgcaaaaacgtgctctttgagccagctttctcctgattacactagttctcagaagctaaacggctcaatagcactctagatcaaatactgcacatcactcgccagagttggataagcgagaatttcccggttgaagtcgccgattttcatgtgctgatcaatcatcatcgtcaaaatattgatcaaataatcagcgtgattactcaacacggtggccccaacgacagtttccgtatcgcgattgatgaccactttagccttggcgagtggctcattgagtcgatgataactgtaccacttggtcatgtcattggtaatcagcatatagcgactatcgtgcgtcgcgatactcgacggcagtcccacttgaccgagtgagggttggccaaagacaatcgtgggaatggatttgaattgaatcggatccgttgacccgttaaagtagccggccaagtagccagcttcaaaaccggcaaccggtgttagcttgggacgtttggtgctgacgacatctcccatggcaaaaatctgtggatttgacgtctgcaggtggtcgtccacgatcacaccgtgttggtcggttttgacaccaacattttggattccaatcgtatcaacgttgggaatccgccccgccgtgcagaagaccatgtcagtcggcagcttaaaattgtctccggataaaacaaactgctcgcccacttgggtaatttcttgaacatccgtatccagatgaaaatcaacgcccaacgtggtcagtctgtcaatttcttcgtggactaattgttggtcaaactgtttgagtggccgattgttatgatgaatcaggtgaaccgtcgctccggccgcgcgggcaatcccggccagttcaaagccgatatagccaccaccgacaaaagtgacgtcgtttggcagatcatcgaggttcaaaaagtcggtactggttttgaaaaattgactaccgggaatatctaaaattcttggccgctgaccagttgcaataacatattgatcaccggaaaggctttgatttccagccgtcagcagcccatctgaattgaattgggcatgctcatgatacgtgtcgaccccatctgaaatcaacccgttgttggtggcatcagaaattggattggtatactgccgcttgtggcgcatgagatccggccaattaaccgataccgagccactgatcccgttaccctgcatatcattgacaacttgagtgatctctaaaccggacaataaaattttcttcggatcgcacccgcgattggggcaggttccaccaaacaaattgtcttcgacgaccgccacggttttgtgctgtcttctgagtgagtgggccaaagacccgccggcaaccccgccgccaagaatgaccacatcatattgttttgtcatttagtattcctccataagcacctaattcatcgttgattgacgatttcacacgactaatttcataatcttaaatccattgtagaacacttcggaattatttccacgttgccttgattgacaactccccgcggaatttgtatcttagataatgtaattaaaattttattaaattgaggtatatcatggtccatgcactttggcgtcaatttccgcgcattaatttaaaactaattgctttggaaccctatttgttaaacgccgtcaatcttcccaaccagcccattcatcataagatcagccagttgctcaaatccggcggaaaattcctgcgtccgggcttcttttacatttattcagaatttggtcaagaggtggatccagctaaaattaaggctggtgccgccgcagtcgaattactgcatgtggcaactctgattcacgatgacgtgattgatgagtcgccgatccgaagaggcatcgagacaatccatactgaatatggccaaaaaaacgccatttatgcgggggattacctatttacctgttactttacgcaggtactcaaatcgactcaggatccggctaatatgaagcgacacgttgatgccatgcaaaccattttagccggcgaattggatcaaatgaaatacaacttcaatcaacaaatgactgaggcagattatttccacgaaattaccggcaaaaccgccgaattattccgcctttgtttccagcaaagtgccttggtaagccaagcttcggatcaaattttcaaacttggcggcgaaattggtctaacgatcggccaagcctaccaaattttagatgatatcttggattacagcggtgatcctcaccagaccaagaaacccgttcttgaagacctcaagtccggcgtttacaccctgccattaatttttgccctgcagacggctcagaagcaattaaagccactgctggataagcgtgaacaactgacccacgaagacattgcccaaatccaagccatcgtcgttcagtcgggtggcttacagcaagcaatcaaatctgccaaccagttaactgctaaagccgaaaagctcattgcccaattgcctgagcaaagggccaagcgcgacctccagaccctgacacagctattattaaccagaaagcaataatttattttgaaatatcaattgccacaaccagaggaccgatatctcctggctgtggcaatttttgcgtttgatgcggttgattgaaatgttgtgccgttgaccctgtcccctactgtgtaaaacaaaccgcccaacgatgaactaaacccgttcatcctttgacggttcgctttacactccggggccaacccgggtctcgttacactcttcctctgtccaagtcatacagctgcctgaatcttggttgagccttatacagttcctgcggggtgccctgcatatcgaactggccgttttccatgaaacgaacctggtcgacgtgggcgatccctgccaaatgatgagtgacccaaataatggtcttgtcatgaagtaattcaaagactttatccaacaacttcttttctgtgatcggatccaagcttaccgttggctcatccagaataataatcggtgcatcctggagtaaaatccgcgccaatgacaatcgctggcgctccccacctgagaagcgtttaccagcctcttgaacttgggtgtcgtattggtcgggcagcgactcaatcaactcttttagtccaacggctgcaatcgcatcttttacctgctggtcactggcattcacgttgcccaagcggacattgttcatgaccgtcgtgtcaaaaagatacggttgttggtcaagaatgccaaacagtgaagagcggacgtcctggaggcttaaaatattttgctggttaatcagcacttggccatcggatggtgtcaaatctccaacgaccagcttcaagaaggtactcttcccagttccgctgggtccaagcaatgcgaccttttcgcctggatgaatggtcatcgagatatgttgaaccacgtcccgatcgccatcggcatacttgaacgtcaaatcgttaatcgaaagttccttgaacggttcagccaacgccgtctgcttaacgggtttgaccgtgccggaatctaaggcgttaacccgctcaatcgaccgtttataaaccggccactcactggcaccttgactcatgttgacaaatggtgacaccgctgggaaaatggccagcgcaaaggcagccacccagttggccaaggatttggaggcggtgaactgattagccgaccagaccagcagaaccaaagtcgttagtaaaataacaaattgaaccagaaatgatcgccaccactggaagtaatggtctcgtttccgcagggctgcaatggccttaattggtttcttctgcaggttgatgaagtcgttgtaacgaccggaaatcagccagtcgcccaatcccaaaacttcatcggttaaattcgtatagaattcgtgttgaatttgatgctgtttaaattcccgaaccccgttggtggcaactgacgccaagggcatcacaatcgtgataatccctaataacagtaacatcagtaaaccgaccacccagttcagtgaaccgacaccgatcaccacgaaaatgtacaacagccaaccgattaccataggaaaaacggttcgcagatacaagttttcgatgtgatcaatatcgtcggctaaaatactcaagatatcaccggtttggtgagagcgttgaatggccgatgccttttgctcaacggtttggtacagcttttttctgaagtcggacacaattcgcagcacccaattatggctggttaaccgttcaacatatcgaaagactggccgagcaattccaaaggcccgggccaaaacaaccggtacataaatataaataatacttgacggctgtctggcagcctcactgatcagatatccggagttaaacatcaaagcgccgccagagaagaaggtcatgaatcccaggaataagaccaggatcagtaagcctttgtatttacgcaggtaaggcatgacccaggtatcgttttcgaatgtttttctaaaatttttcataggtctgccgcctccatttctgaacgaagcttgacgtaatcaccatttcgctgagcgagttggtcaggtgtcccctgttcaaccaaacgaccatgatccatgactaatacgtagtccatctcaccaatccagtgaagccgatgggttgcgaagaacaccaggtgatcattgaagaccggcagaatatcctgcttcaaaccggcttcagtttcaatatccaaatgggcagttggctcatcaaataagagcacttttcgattgggatcaagaaaagctcgggctaaagcaatccgctgtgcctgaccaccactgaccgtccgggcaccttccccaatcatggtattaagcccgtccggcaaggtattaatccagtcggtcaggcccgccttgtcagctgcatttgaaatcgcagcttcagtagcatccgcgacgtaaaacgaaatgttatcggctaacgtggcgtgaaagagatagggattttgtggaatatacagaaagtttttctgccaattagcttggttcaagtgtggcagcggctggccgttaatcgagatttgattttgaccgtccggggataagaagcccccaatgagattgatcaaagtcgatttgccggatcccgatgcaccgatgatgccgatcttctgcatccccttgatatcaatcgaaatatctttaagcgtcggttccttgcttcccgggtaggtcaaggaagcctgattcaatttcaaggttgaatcgttgttccatttcaaatcaggcaaaacttcgcgttggctcatctcaggctcatgaaggacgtccaagacggcgctcattgcgttcttaccattcaaagttgcgtgatagtcgttggcaaaattccggattggcagaaaatactccggcgccaataccaaaatggtcaacgcaggtaagagcatgactttaccatccatcaaatcaaatcctagaaagactgcgacgactgcgatcgacaaagtggtaaagaaatccagggcaaatgtcgatgttaaggcgattctcaacgtggacatcgtttctgtccgataagattcgctgacttcatagacattgtcagcatagcgcttagaaaggcccagctgctttaaagtcggcagaccccgtaaggtatccacaaagtgattagacagccgctgatagctttcatattgccgatcagccttactctgagctgcaagtccaagaataatcatgaataaaatgataattggaaaaatagcaaataagaaaatcgcttgttcccaacgcaggaacaggacgtataacaaaatcagccacggcgtaatcgacatatccaagatcttgataacaactaacatcaaataagtctgaacctggtcaattccttcaagggccatcgtgacgatgtttccagttccccgtttatcaatttcagcgggtccgagtcggaaaatcttggccatcaaatcttcccgcatatcgccacttgtcttttcaacgaacggaaataatacgtggttttcggcgacggtcaacaaatgccgccctaaaaatgcaacggtaaacacaacggtgggccaaataattgtgttgatcgactgcagattccacaggttcacgattgcaattgacagtgcgcgagcctgagcaattattgcgattgcctgaatgaagaccagtatccctaaaataacggcatactttttcatccccggcagatcaaacaatcttttatcaatcaaacttttcactcccccagaacaaaattaattacaattcctagtataaagaattattgcgcacaatgaaatatgtgagcggtttatttcttgatttatttggtttttaacacagctttggggctcacgggttaccgccaaaaattccgggcaaaacaaaaaggccagcgataagccgaaacgtttatcagtggcctttcagttgatacgcatatcattaactgaaaatcatttacccggatcgttggattcagttaaatactattcagcaacttgctttggtgacttgattcgcttgtagaatacccagtaactccaaatgaagtagatgagcacaatcggtaaaatcgtgaatgtcaaaatcgtcatcaagtgcagcgtatacggtgaacttgaagcatttttaattaagattgaatttgcgttgttcgtcgcaatcataacccgtgggaacaatccgttgaaaatcaggacaacgacactgattaaagaaagcccactggcaatgaatgatgtccaatcatggctggactgagcgccccaccatgcagccaaggtaaagatgaccaaggcgatcaagattccccaggttgacattggtttacgagtaaagaagtcagttgttaagtaaagtaagataacaaagacaacttcaccggcaagcagaaccggatagagaactttactccacttttctgctcgttctcttaattcaccgctggtcttcaaacgcaggaagtttaatccatgaatgaagcaaagcagtgaaacggcgacaccgccgacaatcgagaaccagttgacataagtggtgaagcttccaaaaatatcgccatttttatcaatcggaacaccttgaatcatactggtgaacatcatcccgaataagaatgcggcacagaaactaccaattgatgatgcccattcccagaaattacgccaagtatccgtctgcatatttgcacggaactcaaatgacacgccacggaaaatcaaggcaaccaagattaagaacaagacaaggtagtatcctgaaaatagtgaagcataccacattggaaatgatgcaaacatcgcaccaccggcagtgatcagccaaacttcatttccatcccaatgcgggccaattgtttggatgacagtatcacgttcagcccggttcttagcaaagaatcgaacggacatgccgataccaaagtcaaacccttcgaggaagaagaacccactaaacaacacaccaattaataggaaccaaataaattgataactagtcattatgagccgcccccatttcgtatggatctaccttttgatcagctgcttgtggttcgctggagtatccgtcagtctgaactgaatccggtccttgtttgagaacccggtgactcaggatgatcatgacagctccaagcgatgcaaagatcaagaagtaaacgatgttggtgaacatcaggcttgccacggtagacgttggcgataccgcatcggcaatggtcaaaagtccgtaaacaacccatggataacggccaaattcagtcacgaaccagccacaggtgttaacgataaacggcagccaaaccatcaagcccatgaggtataggaaccagcgttgcctcataatgctttgtgacttcttacggttgaaccataacccaatgatggcaactaagccgaataagccggcagaaatagccatgattcggaagctccagaataaagtccgagtcggaacataatagttcttcgtttgatcattcttattgtactttgcctttaattccttgttgaccgtttgttggcctttgaaagtaccgttcagactgtgatgaccaagaatgttcaagacataaggaatttcgattgaccaagtcttatcgtgacccttaaatcctgaagccaaagcccaatcacctttattagtagaatctttatagataccctccatagcagcaaacttcatcggttggttattaatcaggtaacgtgtttgcgtatcacctgaccatacagaacctaagcaggcacaaagcccaatgatgagtgaaaccttcattgacttgcggtagaagtgctcatgatccttcttaagtaaacgccaagcagaacagccggcaacaacaaatgcagccgttaagaatgctccgaaaataacgtgtggaaattcgttccacaactgacggttcataataacagcagagaaactggtcatttcaactttgtgttgagcaacattcattgcgtaaccaactgggttttgcataaagctgttggccgccaaaatccaaagtgcagacagcgttgaaccaaaagcagtcagccaaatgaacaaacagtgaaccactttgttgaaacggtcccacgtgaacatccaaaggccaatgaatgtcgattccaagaagaaggctgccaaggcttcaattgccagtggcgcaccaaaaatatcccccataaatcttgaataatccgaccagttcattccaaactggaactcttgaataataccagttacaacaccaacggcaaaactatacaggaaaatcttcccccagaattttgtcatgtttttgtatgtttcatccttggtcacaacgtaacacgtttccataattgcaacaataaaagctaaaccaatggaaaacggtacgaagaagaagtgaaacacagtggtcatcgcaaattgaaaccgcgacaacccaagcatcgtgacgccaatatttaacattgtcgtatccccccttactaaatattaatgagttatcctcatatacccttattgtatatagaaatggttcaacattcaatcaaaatactaattaattatcagcaattactcataatcctgcactgttgttgacacaatcccgcctgaaacatgtaaacgtcgtcaatcaatcaatgtgaaggacttagattagggaagaaatgcttgtgaaattattgcaatggctttcattagacaattgtcaaagccacatttataataagggtgataagattagtttatgctattattgtaattttctaaagcaatcttattttaattattccaaagggggaaaatttcatgacaaagaacatcgtcgtcattggtgccggtttcgcaggcgtttacgcaaccaagcaattggctaagcgattcaagagcaactctgacgtccaaattacattgatcgatcgtcactcgtacttcacttatctgacccgattacacgaagttgcgaccgagcgggttgacccaagcagcatccagtatgacctgcaacggatttttcacaagcagaaaaacgtgcagctcgttacggataatgtcacgtcagtcgataaggacaagaaaattgtcaacggtgaacatggcacgtatccatttgacagcctgctgatcagtatgggtggcgagcctaatgacttcgggacacccggcgttaaagaaaatggcttcacactctggtcaatggaagacgcactccgacttcgagcgcacattcgtgaaatcattggtcgaggagccgttgaacgtgatcccgacaaacgtcgtgcaatgctcacaattgtggtctgtggttccggatttaccggtgccgaaaccattggtgaattaattgattacaagaaagtcctggcaagagattacaagctggatcctgacgagattcacattctcttggttgaagctgccccaacaattatcaacatgcttgatcgaaccaacgctgctcacgccgagaattacatcaaggatcacgacgttgaagttcgaccatcatccatgattacctcagttaatccagacagcgtcgacattaaggatcaggattcaattccaaccaacaccttgatttggactgccggggttaaaaccaaccacgttgccgacagtttcggaattgacgccggccgtggcggtcgattgattaccaatcaatatctccaggcaaagggctttgaagataaaagtatttacgttgccggtgatgactccaacgccactgagcaaggtgctgaacgtgccgttccacaaactgctcaggaggctgaaaatgaagccgttgtttcctctgccaacattgctgctgacattgaaggcaaccacaactacaccgaattccatgacaagaacatgggcttcaccgtttcatttggtgctcgttacggaattgcccaagtattcggcggcaaacgagtccgtggctggctggcaacgattatgaagcacgggactaacctcctgtacttcatgcgaattcactccggctacttcatgatgcagtatatcttgcaagagttcttccgggttgataacaaccgaactgtgctgcctggtattactgcccgtcaggggaacgctttgtggagtgttccgctaagaatgttcttgggaatcgtcttaatggttgatgcattctcttacaacgccataattccagttggctttggcctgactgcgattgaaggcattattggctgcctgttgttcttcggtctattcacttggattgccagtttggcattaatcgtgatcttcttcatggggattgccagctggccgcatgcttggatcgtctttgcggcgattgccttaatgaatggatccggtcgttccattggtttggactactggttcgttccatggctgcaaaagacttggggccgttcacgttatggcattccaaagtcactttacaaaaaataaataaccgttaaatgaaataagaggctggaacaaaagattttgttccagcctctatttgtgtctgaatgttatctagcacttatgattcagcttgagtttccggtatctcaacaatgtacttgccataatgagggacatcgacaatttgaatattagtctcaaaaatgttggctagtaattcacgatcgtagcattcttccggtttgccgacttttaccacttcaccccgtttgaccagccacaaaacatcactgatcttaaatgcctgattgatatcatgaatcaccatgataatcgtgatgtgcttctgctcattaagctgcttcaaaatccccatcagttcggcttggtagtgaatgtccaagtaagtcgttggttcatccagcaatagatatgtgggatcttgggccaaagctgaagctaaccagaccctttggcgttggccgccagataacgacgatagtggccgctgtgccaatgatgtcaaatgagtggcctgaatatacttggccacctcggcgtcagaaattgttgccagcaggctgtggtgtgccaacctgcctgttttaacaacatcaatcactttcatatcatcaaaaatatcgttttgctgactaacaactgcaaccttggtcgccaactgtttccgaggaatcgaactaattggctgcccgtcaagatcaacctcaccaccggacggttgaagaatgccagccatcaattttaacagggtcgacttgccggcgccatttggaccgataatcgatagaatgtgccccaccggaattgtcgcactgatctcatttaaaagggtcggttgttgtggataatgataactaacttgatttaagtccattaaaattcttcctttgcaacatcaagattaagaatgggccgccaatgacggtcataatgaccgcggcggacaattcactgggcaacacgacaattcgaccgatggtgtcaacaactaataacagccaagcgcccatgagcatcgacagcggaatgatggtttgataatctctccccactaaataacgaacaacgttgggaacaacgattcccatgaacggaaccgtgccgacaactgaagaaacgcccgaggataagtaaacgaccaccagcagtaaggccagacgcatcatagaagccgaaaccccttttgtctgtagctgttcggttgataatttgagatagttggcccacggtgaaataacgactgccgcgaacatcccactgacacccaaaaataacagcacttcggtctgcgaccaggtaatcccgttaaaagagcccgtcgtctggccgccaaatccattggcaaacagctgctcgaaaccggtaaaggtcagcatcatcgccacaccaatgataatcagccggtatgggctcttgagtgccggtccccgggttaacagtaagagtgcaaataagccgccaaggatggagaaaataaacttgctggcaggaaatgccggtagaagcattgtcccaatgagaatgaagaagtctgaagcgctggtcactcccagaatactggggtctgccaacacatttcgaaaggcagcctggctggcagctcctgctaccgcaagcatacccccacacagcatggttgaaagaatccgcggaaagcgaatgttaatcaaaatgtccagttgattgggattgccaccttgaaaggcggtcatcatttgttgtggagtgatgaagctggcccccaacatcatcgcaaacaaaatggtgatgaccagcatcaccaaaattgtcgaataccatattttttcagatttggtcaattcgtttggctcccttcttgaggatacagccaattcgaaacgatctgcaaggctttggcagcccgcatattggcagttgcatcaaagttgggttcttccagatcataaacgcgatgattcttaacggcaggcagcgtcttccacatcggatcggatttaaattccgagttaaattgtgggatcacgatattgggtaaggcgtgtgccaatcgcaaaataacctgtggctgcgcttttttgatggcttcatcgttgggagagacaaactcttgtgtctttgaagagaaaacattgtgaccaccggagattgcgaccaaatcaccaacgtaggattgattagtggcaatcatataggaagccccgggtaatcccatcaagacaagcacacgaggtttggtggcatgacgcttggcaaccagtttgacatgctgttctgcctggtcaatttgatcaactgcgtgtttggcctgggcttttcgctgatattgtttccccattgcggtcaccgtttgtttcaatttggcgacactggttaaattcagaaaatgaggcgtaatatggcgttccttaaatgcctttccaaattggtcctgcagggtcgtcacggaatagacgacggtcggttttaaactggcaattttttcaacactaggattcatcggattgccaacccgggcagcgtgcgcataacgcgccggaattttattttgagttgtcggtacaccgaccagcgggagatcaagcttatctgcaatttgaacgaccgcaaaagtcgttgccacaatccgagcttttttctgatgattggcagcaccgattcggctcataaaaataccgcccaacacgccaactaccaaaacaagtgagagcacaattaaagcgatcttacgagatcctttcattatccttattgccccctctaatgtttaaagtaaatccacaatcctgctgaaagtccggcaatcacagtcacgccgccgacaatccaaggaaccccgctcttttttgcttggggtttgtctgaagtctttttagctggtttggtcaggttactgctggccttacttggctgtgacgaggctttcttggcggaagactgttttgctttgggttgctttgtcttggttgagctagcagtcttagcagcttttttggtcttctttggtgcattggctttgggtcgactgttggtttgctttgccttcgtacttggactagtagccgccttaggctttgtcgttgacgtagccgtcttaggtgtcgccgctgcggcgtgcgtccttcccaagcttggcagaccagcagtactaaatttgaacgaaatcaagtgatgggccttataaaccttgggcacgtcaatagcgagcttggcattgatccgtttcttcaggttattagcataaaatgaatagtacagcagcgaatctccggcccggtctttcacgcgacggacatttaatggcgctttaccgttgacccaattcactttgactggaaatgatgacaaactcttggcagttttaatttccatcgtgacatagtagagatgatttttcaccaccacattggccggcttaacaaaatagccgtctgccattgacgtttgattggttccatagcgcaatgggtgataggcaatggtttgagcactagctggaataattgaaacgatgaacagtccaatggcgacaaagaggcccaatagccactttgatctatttgacaattccatgattactcccccaaacaaaagataatcctgatacgagtgctaatccaagcattgacaagctgttttggctggcatcaccagtttgtggtaatttagtctggctggaagtactcagcttagctgaagtggctgttggtacaacagcaacatgcttgctggccttggcaggtgctttttggctaaacttgaaacgaattggccaagttgtattgatttgggcttgagggacaaccacatggattgaacctttgataactttcttcaaagttttgaatgatgaaacgttaaatgaataagtcatggtgtagtaattagtcgtttgaccataactaacaactgaggatttcactttgcggccattgatggtcactgggcgaacagcttttgaccccaactttaagttcttcttgtaagcaaccttcagttggacgttgtagtgcttagcaatttttttaatcacggctgttcgagtgtaatattggttagcaattgaccttgaatttgagtcaccctttaaaaccacatactttcgagttgtggttggcacctttgctttagcggtggtcttctttttggtggtaacagttgacgtggtcgttgtcgtcggagttgtagccgaactgctggtagctgcaggcgttgtggcactactgctggtggctgcaggttcggtcgtggtacttgaatcacttgtcgtggttgttgcggcatctgatccagggaccttgacagcatctgcccagtcaaacgaaaagtcggcagattcttgcatttgtccaagaattggaatgttatgaagcgtaaagctaaccggcatagtgctgcttggattggtcaaattgaacgttaaggttccattgttcccagaggtcacaattggcaatgccgtttgatcccccatcgtcatgctggcaatatagttggcaccgtttgtcgtaatgacggtcgtataggttcctttagacactgtcacctgggcagtttggtcaaaaaaatgattggcaatcgattgagaactgctgccgctcttcaataaagtaattggtacagtgtacgaagcgtcacttaggttgacagaatcagccttagcattggatgaaaatgcaccccccacaaatgcgaaaataattgctacaaaaacaaactgaataaaatgtacaaaacgttttttcatgcgaaaatccccctttaggtataaaaataattgtacacagtaagtttaccattagtttggaggtaaataacgtcaaatttgtgaattgataggcaaaaagcattactttttctcaagcgctttcttgccacattgtttatggattttgctcttaaacaactgacgaagttaattaatcaaaatatttgtctggttaatgaacaacggctgatttgttaggaacgcactgaacaaagaaaacccagccagtacttcacatcttttgccggaacaagcggtcttggggacgtgtgggctctagtctcacctccggtatcacagcaagcgaagtccatataagagcgtcatacatcgtctgttgtttgagatacttcgataccactgagccttacaaaaaatgcctccagccctcatcataagaggctggaagcatctgtgcggttcatcaatctaaatgtatctgacagccattgccaggatttgaacctgggaccttttccttaccatggaaatgctctaccttctgagctacaacggcatggttgaatcaaagaacataaatcgatattatcaaaaaaagcaccgatagtaaatactatcagtgctttaggattgcgtggcaacgtcctaccctcgcagggggcgatcccccaactactcttggcgtgcagaagcttaacttctgtgttcggcatgggaacaggtgtatccttctggctatcgccaccacactatttttccttgaaagaacttcgttctctca

SEQ ID NO: 224 - DNA, 2343 bp, Lactobacillus buchneri
aacatcatcaacctatataaacaaggcgaatcagccgcccaactggccagagaatatggcattggctattcaaccgttcataagtggatccagggccaagccaaaactcaatccggtaaatcgccagacgaaattaaagcgatggaaaagcgactggcttcgctgtctgaggagaacgaaatcctaaaaaaagccctgggcttccttgcgcagaagtaaccaatatctttgattacattcaccaagaaagccatcaccaccaggtaaccaagatgtgccgaatcctcggtgtttccagagctcagtattatcgttatcgatcccccaaaccttcaaaacgccgggccgaagatgcggacttgaaataacggattctgcggatctttgcggaatttaagcagcgatacggtgttatgaagatccaccatgaattgaatctggaacttcaaccactgcagcttcggtgcagtccacgacggatttcccgaccactggtttaaatcaaaaatggacaacttcttagagttaaaccagcttcaggctctattggcataaaattaggatcttaaccccgactaactcgttcttggcttattattggctaaatttacggtttttcagcgggtttaaaccaatttaagtatctttatatgttaactggctaaaatggcgaagaaaccattttagggctaaatctcagcattacaaaaggacccaagccgataatcatcggtctgggtccttaataaacgccatgacaaattatgatttaaacaaccctttagttaattaatggaactgcatgccgccatcaacaatgattgtctggccggtaatataattagaatctttaccagccaggaatgagacggcagcggccacatcttcgggctctgataaccgtttcaaagcaatatcttttgcgaattgttgcatgccccactcatcgtctttaccggcattcttaccaacttgatgtgcaatatcaagcatcatcggtgtcttaacaatacctggtgcataagcattggccgtaataccttcttcagccaaatcacgagcaagcacttgagtgatcccacgaactgcaaatttggttcctgaataaagggccaggttaggattcccaacaacaccggcttgtgaagttgcattgataatcttaccgccgtgtcctaatttcttgaaggcttgatgagcggcctgagcaccccagagaacgccaccaacgttaacgccgtatacgagtcggaattgatccggtgtaatggtatccaaaggtgtggttggtccaaggcctgcattattgacaatcacgtcaaagccgcccaatttatccacagtttcattaacagcagaaaagacagaatcacgatctgcaacatctaccttaacgccaatggcctgactgccatccggcgataatttagcggctaccttatttgcattatcgatattcaaatccgcaactgctaccttaaagccatcttcgtgtaaccgtgttgcaattgcttcaccaattccttgaccgccgcctgtaaccaacgctactttttctgccataataagtgcctccattttcttttttgcatccgcttacattatactttgcaagcaaataattcacaataagaaaaaggcctttttcattgtgaatcacatgatatagtcagcaatgactttccttgctccaactagctaataattttagcgattgctttattgctgaggttgataaaaagggtctccctgggggtgggtggccaagtattgctcaaagttattctgagtgatggcgtccaaatctttaactgagttagttgtaatcgtcttgacggtctttaattgtcgtgcgacttggcgatcagcagcctcggttaacttgtgaatcccggtaatgatcactaaaaccggtttaacctggccagtcacttctacccaagctaattgaccaatcgcaagattctttttccccatggttttgtgatggcgaacccgccattgataacttttaggactaaaataatgatttttattcacatgatggccgttaataacggtttcgatatgatgagttgatgccataaaattcctccattctgttaataaccaacttagagttaatcagctaagacctcctaaaaaactacgtaaaatattttttgcttttttatttaccaagataaacttaagaagctgtctaaaatctcttaagtaatagtgctaaaaacgctaaaacgaccatttgcagactggtggttaattgacgctcacaatttttccaaagtcgccgacaattctctagccaactaaaagatcgttcgactacccaacgttggggca

SEQ ID NO: 225 - DNA, 305 bp, Lactobacillus buchneri
tgcagctaacgcattaagcactccgcctggggagtacgaccgcaaggttgaaactcaaaggaattgacgggggcccgcacaagcggtggagcatgtggtttaattcgatgctacgcgaagaaccttaccaggtcttgacatcttctgccaacctaagagattaggcgttcccttcggggacagaatgacaggtggtgcatggttgtcgtcagctcgtgtcgtgagatgttgggttaagtcccgcaacgagcgcaacccttattgttagttgccagcattcagttgggcactctagcaagactgcc

SEQ ID NO: 226 - DNA, 603 bp, Lactobacillus buchneri
ttcatcggcttctagtgccaaggcatccaccatgcgccctttttaacttaacctgtacatcacgacgtgatgcaaagttaattgagtatttgcgattttttctagttaacaaactcaaaataacgcggtgttctcggttgaaattatataaatacaatttcaaaaaaattattacagaaaattaatattatctagttttcaaagaaccaagtctgacactctcgtgtcaatggagaatagcgggatcgaaccgctgaccccctgcttgcaaagcaggtgctctcccatctgagctaattccccatgttactccggtgatagctaactatcaggccgtggatgggcctaaatggactcgaaccatcgacctcacgcttatcaggcgtgcgctctaaccagctgagctataggcccaaaaagcgtaaccacttttgagagtagacctctcaagactaaacaaaactttcgacaatgtgcaggattccgtttttccttagaaaggaggtgatccagccgcaggttctcctacggctaccttgttacgacttcaccctaatcatctgtcccaccttagacggctggtccccgaaggttacctcaccg

SEQ ID NO: 227 - DNA, 703 bp, Lactobacillus buchneri
aacaccatttctacttggttaagtcctcgaccgattagtattggtccgctccgtacatcactgcacttccacttccaacctatctacctgatcatctctcaggggtcttacttccatataggaatgggaaatctcatcttgaggtgagtttcacacttagatgctttcagcgtttatctcatccatacgtagctacccagcggtgcgcctggcggcgcaactggtacaccagcggtatgtccatcccggtcctctcgtactaaggacagctcctctcaaatttcctacgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccagggtagcttttatccgttgagcgatggcccttccatacggtaccaccggatcactaagcccgactttcgtccctgctcgacctgtctgtctcgcagtcaagctcccttctgcctttacactcgttgaatgatttccaaccattctgagggaacctttgggcgcctccgttactgtttgggaggcgaccgccccagtcaaactgcctacctgacactgtctcccgccacgct

SEQ ID NO: 228 - DNA, 1171 bp, Lactobacillus buchneri
tggctgcttctgagccaacatcctagttgtctatgcaactccacatccttttccacttagcatatatttagggaccttaactggtggtctgggctgttccccttttgacgatggatcttatcactcaccgtctgactcccggataaaaatcaatggtattcggagtttatctgaacttagtaacccatgacgggcccctcatccaaacagtggctctacctccatgattctacgtccgaggctagccctaaagctatttcggagagaaccagctatctccaagttcgtttggaatttcaccgctacccacacctcatcccagcacttttcaacgtacacgggttcgggcctccagtgcgttttaccgcaccttcaccctggacatgggtagatcacctggtttcgggtctacagcaacatactaaaacgcccatttcagactcgctttcgctgcggctccggcttttaaaccttaacctggcatgttaccgtaactcgccggttcattctacaagaggcacgctatcacccattaacgggctctaactgcttgtaggcacatggtttcaggaactatttcactccccttccggggtgcttttcacctttccctcacggtactggttcactatcggtcactagagagtatttagccttgggagatggtcctcccggattccgacgacgtttcacgtgtgtcgccgtactcaggatcctgaactgagggtcattgatttcacctacggggctatcaccctgtttcgccaaccttcccagattgttcgattatcaacaactttggtaactcaaatgttcagtcctacaaccccaatgagcaagctcattggtttgggctgttccccgttcgctcgccgctactgagggaatcgaaaatttctttctgctcctgtgggtactgagatgtttcagttccccacgtctacctctatacagctatgaattcactatatagtaacagtcgattaaaactgctgggtttccccattcggaaatctccggatcaaagcttacgtacagctccccgaagcatatcggtgttagtcccgtccttcatcggcttctagtgccaaggcatccaccatgcgccctttttaacttaacctgtacatcacgacgtgatgcaaagttaattgagtatttgcgatttttt

SEQ ID NO: 229 - DNA, 2163 bp, Lactobacillus buchneri
ccgaatttttggacaaatttgtcagcataacctgatacggtgtttgccagtcgagtattttaagcggtcgctggttaatttggagtaacgtcgtcgttaaatcttgagcactaatgtgctcaaaacgagtccctttaggataaaaataacgtcaattccgattaaagcgttcattactaccacgttcagctggcgtataagcatggcagtaataggtcttaataccatattgtgattcaagtgatactagcccactaaactcagtgccacggtccacagtaaagctgtgcaccggaccattaaaagtggttaggaacttagttagggcttcattaacagtcgctgtcgtccgatcttttaaccggtatgcccaaaggaaccgtgatttgcgatcgattaaagttaataaaactgccttactatgcccacggtctcgccaagaaaactgtctcgaacactcgtgaaaacatcttcatcgccattgccaccgtggccttcctactgattgggctaatcttcggttatatctacatggccagtgggatgtttgtccatgaagctagtatcttagtcgttatcctcaacgctatgcggttaatcaatttccaaaccaagttcgacaagcaccaaccaactaaaaccattcaagcagccacagcttaatcaagtctccccaacttggttacaggcctagccaccaatagcggcccaccaactagtcttcccagctagtcggggggccgctttaggactggtcacatctggacaaataacttgcttataaataccaatgggggtatattatttaatgaataataattactaaggagtcattcaaaatgattaaagaaatacatgaccaagattttgccaaagaaacagatactggtatcgccgttattgattttcgcgcagactggtgcccaccatgtcgcatgatggacccaattcttaagtccctttctgaagacccagcttacaaggatcaggtcaacttcgtttcattgaacattgaccatgaccaagctacggccagtcaattccaagttcaaggaattccaaccttcctgattaagaaagatggccaagtcgtcagtcacatggtcggagcacgtcctaagcctgattttgaagccgaactcaaaaaagcacttgcctaattacgaagggggcatcatgaatcatggcaactactgaagaatatgtcactagcaagcagatcaagacccggctgaaacgctcggctggtcaactggacggcgttttacgtatgatggacgaaaatcgtccttgcgaagatgtcttggttcaactttcagcagtgaaatcaagtatcgacaaggccatgaaactcgtcatcgcccgtaatattaataattgtgtagatgcgatgaccacggctgatgttcagaatcttgaacactccttggatctactgctaaaaaccaaataacgcaaaaaggacggtgtcgtcaatctcgcggtaaagcgaaccccctgatctggagtaaatccaaactcagggggtttattttattccgaagaaaacaattttttgctccagatttatcaatcattcgtctcgtgaattctcacaaatctacaaatgtgttcacactatatttgcaggcctgtcctataaaatgaatgattctgatctcttacaaacattttcttagccggagtattctgtgcagaaaatcaaaaatatctacgctttccaagccaccattaaacccggcgaaagaagccataactgatcagagtaactatcaaagtcacagattacacttttctgggaaacaatatcatgaaaaaaattcatttaaatcttcctaatcataatacggaaattttttgtcaaaatatcgctcagcttagttttccgaccacatcgtgatcgcttgtattcggcatctgtttgtgctaattcagcctgataaggttgacatcgagataattcataagaaattgttgacggtgatcggttcagccgaacgcccatttggagattggacagccctagttcacaaaaggtttcgattttaattcgttcggaataggttatactagacaaaagatcagctcctaaaagatgggtttgtggtaaacaccattttaaaggaagctgatcttttttgtccgaacagcgttcggattaat

SEQ ID NO: 230 - DNA, 880 bp, Lactobacillus buchneri
agaagctgtttagtatctttgattttgacccaataatttgataaactactgtcaaaaaagttggtgatcatatgcaacattttagtcatcattaccaaagcgatatttctcggcaacaattcgatttgatccgccaggatctggaagcttcaagaaaacgaactcatccaaaacacattgatccttatgatatcttctgtgccatgctctatgtccttaaaaatggttgtacttggcgtgatttgccggctgattttccaaagtggtccactgtttactactattggatgaattggtcgaaagcccccacccctgataaaccagctttattaactcaggttttaaaaaaattgtcgctgatcgacgattaaggcaagggcgatcagcccgaacttcgttcgtcattttagatgcccaaagtatcaagaacaccgctaccgctgaaaataagggttacgatggtggtaagaagatctcgggaattaaacggcatttagccgtcgacatcaatggcttcccgcaagcgatccatattacccgggctaacatcactgatcgtgacggggcgattgcactcgttacccttaatttagagcagtttaaattggttcgaaccatgatggttgatagtggttataccggccaaaattttgctaatgagattagcagtttaacgtcagccaaggtaatcgtcgttaaaagaaatgagttacaccaattttcggttatcccccaacggtggctcattgaacgttcatttagttggttgggaaattatcaccgtttatggcgtaactgtgagcgtaagctcaacactagtctcatgatggtttcgttagcttttatcaggttacttcttaaaagatactaaacagcttct

SEQ ID NO: 231 - DNA, 496 bp, Lactobacillus buchneri
gcataacctgatacggtgtttgccagtcgagtattttaagcggtcgctggttaatttggagtaacgtcgtcgttaaatcttgagcactaatgtgctcaaaacgagtccctttaggataaaaataacgtaaattccgattaaagcgttcattattaccacgttcagctggagtataagcatggcagtaataggtcttaataccatattgtgattcaagtgatactagcccactaaactcagtgtcacggtccacagtaaagctgtgcaccggaccattaaaagtggttaggaacttagttagtgcttcattaacagtcgctgtcgtccgatcttttaaccggtatgcccaaaggaaccgtgatttgcgatcgattaaagttaataaaactgccttactatgcccacgaggaccaacgactgtatctagttcaaaatcgccgatgcgattacgttgattaatcatcatgggacgctgttcaattgatcgccccaaaga

SEQ ID NO: 232 - DNA, 548 bp, Lactobacillus buchneri
aaacattgaactttggcaaactctttacccctatccggggtaatcgttaacgatctaccaggccatagcttcattaagtcgctcaaagtatccgtgactgcttctgaagttcttttagcagctttaccaataagcaggtaacgagattttcggtcaaccaatgtaacgacacaagcctttccgcttttgcctaacacggtatcaccttcccagtgaccaatttctacacggttgtcagcttctcgcggacgatcatgaatcttgttggggattggaatcttgcctcgcttttcttgataagctttattgtggcgagacttgccgtgatgccttagatggcgcacggcactagagctgccagatttaaataaattatcaaataagccattgaaaatcccacggtaaatagtcgtggtactgatctgcaccggatacttttcgactgccaagcgattcgatatttcttccggagaccaaaggtcttcgcagaagtgttctctcaccacttcaaacacctgaggattactcaaaagagagactctgccaca

SEQ ID NO: 233 - DNA, 414 bp, Lactobacillus buchneri
ttctgcccgtttggccgttatttgcccgttattatttatattttaatactttctagtacgtttttataaattaaaaaaattaggaatgcctatttaacagcattcctaattttaatatttcttctaatttgcataattatgccgactgcaggagtcgaacctgtgaccctcggtttacgataccgatgctctaccaactgagctaagtcggcaaatccattgtacaaaaaatgctaacaattaagttagcatttcgacaaagctccggcaggcgggctcgaaccgtcgacaacctgattaacagtcaggtgctctaccaactgagctatgccggaataatcgcgtggcaacgtcctaccctcgcagggggcgatcccccaactactcttggcgtgcagaagcttaacttctgtg

SEQ ID NO: 234 - DNA, 305 bp, Lactobacillus buchneri
acctgtctgtctcgcagtcaagctcccttctgcctttacactcgttgaatgatttccaaccattctgagggaacctttgggcgcctccgttactgtttgggaggcgaccgccccagtcaaactgcctacctgacactgtctcccgccacgctgagtggcgcgggttagagtgttcacacagcgagggtagtatcccaccaacgcctctgccgaaactagcgttccggcttcaatggctcctacctatcctgtacaagctgtgtcaacacccaatatcaagctacagtaaagctccatggggtctt

SEQ ID NO: 235 - DNA, 1597 bp, Lactobacillus buchneri
ttcacaaaaggtttcgattttaattcgttcggaataggttatactagacaaaagatcagctcctaaaagatgggtttgtggtaaacaccattttaaaggaagctgatcttttttgtccgaacagcgttcggattaattttacaatctaccaagtaacagatagggcacttagctagtatatactaataattcatgaatataatgtatattcatcatttgcaaacatacgtgttatgtgttattatgcatgtagcgatatttattaagcttacttagcatgtatgaggagggacactaatggaaattattacattttcagctataaaaggcggcgttggtaaaactaccctagcttttaattatggtgaatggttagcaaaaaatggcaagcatgttttatttattgacttagaccaccaaagtaatttaacccagacttacaacatttacgacaatcaagacaccgttggcaacattttcttagatcgagggaaagtcaaaatacatgaaataagtgcttatattagtataattgccggagatatgcaccttgacgatattgagcgtaccattgaaaataagactaacaaaaacatgttcctctacatgtggttgtcagataattatgaacgtttaaatttaggaaaatttgagtatattattttagattgccacccagatttttctactgctaccaaaaatgcagtcatcatcagtaatgctattcttagtccaatcacgcccagtgaacatgggtataatgcaaaatttaacctagaagaaagaattaacgagttacgcaaagaagccattgattactctactagaaaatcttatgtcacgaccaaattattttttatcgccaacatgattaaacacaacacaagatcatctcgcgagttattaaaagccttaaaaggcgatcccagtgtattggctacagttccagaaaaggagctattcaatcgttcaacgttggataaaaaatctctttcaaaaatggctgaagaccacaaaacatatattgatcaacatgaatttttcgacagtatggacaaaacatttaatgaaatcacggaaaaattataaatatttcgtacacgtatcaatcacatgtatactcaatacgtgtgcatgtgaattataaaggaggactacctatggcattcgatccagagaacaaaaacataaaaaaggcactacaaaaaaatgaaacagaacagccaactgatactaaagataaacttgttattcctgtttttaaagatgaagaggaacgtactaagaactataccttttcacttcaacctagcgcacgcaaaagacttgacggtctggccaaagaacataattttaagtctgcctccaaatttttaaatgagcttataaaaaatatgtgatgtcactttaagggggggtcgttatgggaatttcaataagtgttactgaaacttgaaagctaataatcacgccaaaggcgtgtggttattggcttttttggcaaaaaaataaacgcaagctctcctgcgttgtatactttagtcgaccaaaaccaagatacaaaggagacttacgtcatgaatattataagacaaaa

SEQ ID NO: 236 - DNA, 565 bp, Lactobacillus buchneri
ctgatcttttgtctagtataacctattccgaacgaattaaaatcgaaaccttttgtgaactagggctgtccaatatccaaatgggcgttcggctgaaccgatcaccgtcaacaatttcttatgaattatctcgatgtcaaccttatcaggctaaattagcacaaacagatgccgaatacaagcgatcacgatgtggtcggaaaactaagctgagcgatgagttaaagcaaaaaattctcaaccatttacgtctaagctggtcaccaggaatgattgctcacgaatttaaactagctactaaatctatttataattggctaaatcaggggagaattggtttctccttgaatgatctacctgaacatggcgtacgccaacggcgtaacgttgaccaacgatccaaatataatcaatctttggggcgatcaattgaacagcgtcccatgatgattaatcaacgtaatcgcatcggcgattttgaactagatacagtcgttggtcctcgtgggcatagtaaggcagttttattaactttaatcgatcgcaaatcacggttcctttgggc

SEQ ID NO: 237 - DNA, 347 bp, Lactobacillus buchneri
attattgccgggaaaggaaaaagcaatcttctggaaaggctgatttcaagaagattgccatgggtgcaattagtcgtcttaaccggactatttaccacttgatcctaaataaccagaaatacgattatctcaaaactcgaccaaaagctgagtcataaatctgattacgataatcataccagccttgtaaaaaatattaaattgttaaggcttatttagtttaccctcaaagccactttacctaaccagaaaaacaattaatttacggcacagccatgcccgacagaaaaagaatggtcttaaattgccggtataacttgactataggtagaaaatacgctccgacg

SEQ ID NO: 238 - DNA, 338 bp, Lactobacillus buchneri
agtgattgccggatagctggtggaaagtccatgaaagtgagtaaattcggcattttaagcagatctttgattaatttgggataggtctgatgccagttgttggcgaactcattcagtttcagttcggctgcttcacggttggcggcccgatgaacttgtttaaagtcactgatcacggccttgcggtcttttacgcgaactttgttcatcagattccgcccaacatgaaccaggcaacgttgtcgtttggctttagggaaatgccgattcaagccttcatccaaaccaactaacccatcggccacaaacaacagcacatctttaacgccctgcttgat

SEQ ID NO: 239 - DNA, 305 bp, Lactobacillus buchneri
gaaactcacctcaagatgagatttcccattcctatatggaagtaagacccctgagagatgatcaggtagataggttggaagtggaagtgcagtgatgtacggagcggaccaatactaatcggtcgaggacttaaccaagtagaaatggtgttcaagggcagaaaattaatattagctagttttgagagaacgaagttctttcaaggaaaaatagtgtggtggcgatagccagaaggatacacctgttcccatgccgaacacagaagttaagcttctgcacgccaagagtagttgggggatcgccc

SEQ ID NO: 240 - DNA, 305 bp, Lactobacillus buchneri
ggcagtcttgctagagtgcccaactgaatgctggcaactaacaataagggttgcgctcgttgcgggacttaacccaacatctcacgacacgagctgacgacaaccatgcaccacctgtcattctgtccccgaagggaacgcctaatctcttaagttggcagaagatgtcaagacctggtaaggttcttcgcgtagcatcgaattaaaccacatgctccaccgcttgtgcgggcccccgtcaattcctttgagtttcaaccttgcggtcgtactccccaggcggagtgcttaatgcgttagctgca

SEQ ID NO: 241 - DNA, 305 bp, Lactobacillus buchneri
atgacctgggctacacacgtgctacaatggacggtacaacgagtcgcgaaaccgcgaggtcaagctaatctcttaaagccgttctcagttcggattgtaggctgcaactcgcctacatgaagttggaatcgctagtaatcgtggatcagcataccacggtgaatacgttcccgggccttgtacacaccgcccgtcacaccatgagagtttgtaacacccaaagccggtgaggtaaccttcggggaccagccgtctaaggtgggacagatgattagggtgaagtcgtaacaaggtagccgtaggag

SEQ ID NO: 242 - DNA, 1374 bp, Lactobacillus buchneri
atgagtagcgttcgtaacccaaaaactctgccaattcggtttgaagcagctggttaatcgcaatttcgaggtggtgacgaaaaacttcgtccaaatcttgcttttgggctagtgcagcgataatttctgtggtaagttcattcatggggaatgcctcctgtgatgttttctgtggttactaaatatcataagggaaggcattccctatttctatacaattcagaaatcttttatgcatttacacaagatattttacgctctcaggcatttcatttacacaagattcttgacgctacctttattagggacagggtttgctacatccatttctaaagttataaataaagtaaatggttttagatttcatactcttaccgaagacgcctatgaagaactatatattatttctcgaggtggtgatgttcgctttgttcctgatacttatgtggtcaatgaaaactattcacagataaaacaagctgggagaggaatgttacgctggagcagggggactgtacagtgtatgctgtactttttaaactatgctttttctcattgtgtcattagtcctagttttaaaagctttcatatattgtgccgaatatcatctctatctaaaatgatgcaacttatcattatttgggggttttgggtatggaactatatatttggagcagcctttaatttaagagtaagctggttaatctatccaatgtggtttcaacatgctatgcttatattgtcaataataatgacacttaacatggtggtatttgaaaacttttatttattgtaccccagctatggtttatggaaaacctgttatttaattgcaaatgcatatgtttttcaaatattttataactgtattaatttgtgggctttagttactttttggaaaaacaagtgggttgttagtactcatggaggaaaataaagaatgaactaggatcacccccacatgcgtggggaatactactgtttaatcagcgtattaaaaatatccattaggatcacccccacatgcgtggggaatacactaaacgattcccgccataacagcatttttaaattagtaaatgtccattttctatgagcttggtctccaattcaagggttgcttgagcatcagataatgcatgatgtggttttgaatttctgactgagtattctttaagtaccgtacttaaacgataattatcaagaaatttatttgttttttttagaagctgtctaaaatctcttaagtaatagtgctaaaaacgctaaaacgaccatttgcagactggtggttaattgacgctcacaatttttccaaagtcgccgacaattctctagccaactaaaagatcgttcgactacccaacgttgggg

SEQ ID NO: 243 - DNA, 390 bp, Lactobacillus buchneri
taagaaactgtttgagatctaaattgaattttggtatacttttgcaaaaaaggaaattgttatgcctaattatcccagtaatattactcgccaacagtttgaagtcattcgctcagaactagaaaacttttgtcaacggacgaagccgcggcaagttgatttatatgacgttttctgtgccattctatatatcttaaagaccggcgctcaatggcgggcattaccgcatgattttcccaagtggcaaacggtctacacgtattttcgcttatggtctcggcaaccaacgccagcagagccatcactgttagatcaggttttaaaaaaattgtcgctaccttacgatccaagcaggatcgttcggcgttaacttccttcattatcgttgac

SEQ ID NO: 244 - DNA, 305 bp, Lactobacillus buchneri
atcaaaatcaaaacggtcaaccagcacataccgcttatggaaacgggattctttcgttttaacactatttacatcaaatttagtggcttgatacgttttaagtttcgcttgacgctgtttagtttcattttcaaccgctgctaacttttgtttcccctgcttaatagattcccgcatggctttatattctggtaccgttaaacttttacgttctgattcttgaaccccacgctgaatattgaaaccatgctgttgtaaataagtcggtaattgatcttgaatatctcgcaaagctgtgcgattaa

SEQ ID NO: 245 - DNA, 1738 bp, Lactobacillus buchneri
tttcgaggcttagttcgcttacgaaaattttctaaagctggtcgaattaattcaaattgttgccgagtaatattgctgggataatttttcatagcttaaactcgctttttacatagaagtatatcaaaaatcatagatcttggacagcttcttagggattaagtatgacatactcaaagaactgaattgcaatagaaaaaaagcacttaacaactgcaaaaagcgtttgtttttaaagagaattaattccaacaatttatggctcttatgcttctcattaagaaggaaaagtaagccactaaaaaaagctgttcctagtaaaaataaatacaatttaaaagagctactgttagcagtcaagttaacaataaacatcaacgtcgttgtcaaaaaaatggccaagaaaatgcccccacggacatcaaagggaacgtaatgaaccggtgaactttgttcaatgctaagctcaccaagcagccaggtaaccataataattggtattaaaattataaatagaaaatgccaattgaatgtgtcctgaattatgccaccatatatgggacccactgctggtgcaaaggcaataactaagctacctagccccataaaagtgccaacttttttctttggcacttgatctagtatgacagcaaacatcaacggtaacgcgattccatcagcaatgccttgacataagcggcctagcaaaactaaattaaagctgttggaaaagcttgcaatcaacgtaccgactaaaaagcttaagcacgaaactctaaataaagttacaacacgaaaccgtcttaaaaagaatgaacccaatggaatcaaactagttgagactagcatatatccagtagtcaaccattgaacttgactgataggtatagaaaaatacgttgttaattgtgggaaggttatgtttaacgctgtttcaaccactattcctaaaaagcttaaaagaccaatcgaaattattgcgctcaatagtttgttgtgtttctcttgaaccaagaattgcaccttccaaacactacatatagtttttattacatattataccactatatatggttcttaggccgttgctcctacatattttcaagaacgaacaatagtttctctagcctttgagaaactacacttaaaatagtcgcaagtccgttatagccatgctataatgtaaacagaaaaaggaagccccgctagaacagggcttcccatgtagagccgtttaagacggtggcaaagtttaataatagattaaataatccgttagccctgccaaaagctaagacggattattttttttgctgacttttgatcagctcaacaattaatgcaatcaaggccacgataaatgtaccgaaagctagcattaattgtaaagcgtccgaaacggacacttaggctactcctttcgttaggatttatgggctttaaaggtttaacaccataagcaccgcctccgatcggaaatagccaccgccttaacttctctacttgattcattatacagagatataattcttttagaaacatatttttaaatcagtagtgtacttcattctaacctggattagtgtatgtcaagggcagtttaaaaatgtaggttttcggcagaaagaaatgtaggttttcggcagttacttgaggccacgtaatcggtaagatttaccagtgatcttcactacgtgaacatgatgaaccaagcgatcgagaatggctgctgtcacag

SEQ ID NO: 246 - DNA, 305 bp, Lactobacillus buchneri
acctggcgtaaatgcatggcatgtaaagcgatcattgcactggccccgtctcgatcagagacgttcgctcgcgtcatgtgaatggcctgcggaaagccattgatatcaactgccagatggcgcttaatccccgagattttcttaccagcgtcataacctttgttttcagcagtagcggtgtttttgacgctctgagcgtcaacgataataaaggaagttaaagctgaacgtccttggtaagttcgccgagcaatgacaatttttttaaaacttgttccaataaagaatcagccgtaggctcagct

SEQ ID NO: 247 - DNA, 628 bp, Lactobacillus buchneri
ggttataccaataacgtctttaccgtcattaattccatatattaaataacagtcatgatgatgagcagtattagtaaaactaagaatatcctttaaaagctcactatttgtattttcccatcgttctttaaaatcataagtatcagtttcatgttgcgacgaatgtaaaatttctagtaattcattttcattcatacttgttctccaataattactaaaaaactattttaatccctgataagggagaatttaccaatcaatgaggtgaaaaattgattggctatataaatgcgagcaatacagtgatttaggcgtttcaaattaattgaatctgataaaatttatttgacacaattagattaatcatttgacctcaaaataacaattaagaaggaagccatttttttctgatttaagggggaaatggccttcccagataatttttcatgtatactagcaattcaaacctattcgatattagggtctgtcttaaaacaagctttttagccaaagttccggtataatctggttaaaaaacaagaaatgaggaatcaccgcatgactaagcctccattaaccactaatcgacacgccatctctgatgaaaagtggcagcaaattgaaaagc

SEQ ID NO: 248 - DNA, 322 bp, Lactobacillus buchneri
agaagctgtccaagatctatgatttttgatatacttctatgtaaaaagcgagtttaagctatgaaaaattatcccagcaatattactcggcaacaatttgaattaattcgaccagctttagaaaattttcgtaagcgaactaagcctcgaaaatatgacctctacgaggtcttctgtgcggtcctatatgtcttgaaaaccggttgccaatggcgtcaagtccccggtgatttcccagaatggcggtcagtttacaactattacaaaatttggtcaactaaagctgagcctacggctgattctttattggaacaagttttaa

SEQ ID NO: 249 - DNA, 1219 bp, Lactobacillus buchneri
taagctgaaatgtcttcatctgtccgccctttaagcaaatcagatttgaggatattgaactgatcttgggggtcataattcagcgaattggtagttatggagtgcgtacgaatttcttctccgttataataaatgtggatgcgctgctcatcattggagatttcaacagcaaccgtacaaccaatgtatcgcggatctactgagtacttacatttgcggaaattgatcatggcctccttcgaaacgacacgggtaatgttttcttcgaagtatggttcaaggagattaactggaacgcgatgaaggtactctttttcttcgtctaaccatttcaggtacgggacttcgtccgtggcctgcgaagtttcatgatttagatcatctcggagcatatgaactagttcgattagctcagttccatcagcaaattcagtattgtatggccgtaaacgttcaaccgtgcgagcaagggcttcaactgcacctttagtttgtggtctgaatggtcgacaagcaattggtgtgaaaccggcatctttacagaattcgtggaaccgttcgttaaagacagcgtggccaaactgggattttgtatgatccacaacggttttcatattatcaaaccagatttccgtcggaatacctccggtatgaaggaaagcgtcgtgtaagcaagaaaagagggtatcttggctccgatcaaaggttagtgtcatatatttgagttttgaataaggcaatacatacaagaaaatattgaatttaaacagctcaccctcgctgctcactagggccatttcttctttccagtcaacttgagcagagagaccaggggaatgttcaatccgaatggtagctttcttaactcgttctcggcgggtttggcgacaataatctttcacgagggtatagctgccggtaaagcccttcttctggataaatttaaaaattgaagcagccgaacaatttagttcaagctttgaatcgatggtttgcttgaatggatccagtaaacttggccgtttcggtcgaccacttggtcggcccttaagtccagctttgacttcctcataggctttcttaacggttcgataatcaacattatattgccgggcaatctcggcgaagttaggcttaatattttcagtcacgtaaatcgtcactccttctcttaaatcacgtctcacatcaaattcctcctacactctgatgtgattca

SEQ ID NO: 250 - DNA, 305 bp, Lactobacillus buchneri
gggtaggtcttagttttcccccatgtataggtggtactagcctgtaccgataaggttgactgattatttgaaaagcctacgccacccgctaaagcccctaaggctaaggcggttaaaatgatttttttcatgattgcttcctccattaatggggatcattgtttcatttaacagtataaccgggtaatcgatgtcaaccaactgaaccgcttaatttaaccctgctgtaacttggcaacctaacctaatagatctctactcacaatcagttcttcagacaagctgcggaacacttatttgttact

SEQ ID NO: 251 - DNA, 305 bp, Lactobacillus buchneri
aagcagatcagcaaaaatcgctgaactgcttttttaagaccatggctttcagccatactgaccagctgaaccagctggaccccacaaatgagcgggagcccccgctcaaactcaccccgtactcgccgtaaggcaggcaaaaaaagcaggggcgcttttctttgcatgcgcaaaagtattctaatccagtagtcaatcaactccttaaagcctcaaaaagggactaactgctaaagcagtaagtccctttaattcgatttaccgttgactgacggccattaaacagctccaatactcatcagcgg

SEQ ID NO: 252 - DNA, 101254 bp, Lactobacillus buchneri
  misc_feature (42158)..(42170): n is a, c, g, or t
gagagaacgaagttctttcaaggaaaaatagtgtggtggcgatagccagaaggatacacctgttcccatgccgaacacagaagttaagcttctgcacgccaagagtagttgggggatcgccccctgcgagggtaggacgttgccacgcgattttatggaggattagctcagctgggagagcatctgccttacaagcaggaggtcacaggttcgatccctgtatcctccattccttgagccgttagctcagttggtagagcatctgacttttaatcagagggtcggcagttcgagactgccacggctcattacaattgaatattattaagcgcataatatttgtatgccgacttagctcagctggcagagcacctgtcttgtaaacagggggtcggaagttcgaatcttctagtcggcattttgcggaagtagttcagtggtagaacatcaccttgccatggtgggggtcgcgggttcgaatcccgtcttccgcttgttatgccggggtggcggaattggcagacgcacaggacttaaaatcctgcggtcagtgatgaccgtaccggttcgatcccggtcctcggcatattatgcacccatagcgcaattggatagagtgtctgactacgaatcagaaggttgtaggttcgactcctactgggtgcattgttttaacgggaagtagctcagcttggtagagcacctggtttgggaccagggggtcgcaggttcgaatcctgtcttcccgattgatagcataactatcatttttcatcgcggtgtagctcagctggctagagcgtccggttcatacccgggaggtcgagggttcgatcccccctgccgcgatataggtcttggacctttagctcagttggttagagcaaacggctcataaccgttcggtcgtaggttcgagtcctacaaggtccatcgactcaattatatactggagtttttatacagcttttatggaggattacccaagtggctgaagggggcggtcttgaaaaccgctaggtgggtcaaaccacgcgagagttcgaatctctcatcctccttattatcgcgggatggagcagtctggtagctcgtcgggctcataacccgaaggtcgttggttcaaacccagctcccgcaattttggttcgttggtctagttggttaggacgcctgcctgtcacgcaggagatcacgagttcgagtctcgtacgaaccggttttggctcggtagctcagtcggtagagcaatgcattgaagctgcatgtgtcggcagttcgattctgtcccgcgccacttgtttttaatattatttttgcgggtgtagtttagtggtaaaaccacagccttccaagctgttgtcgcgagtccgattctcgtcacccgctttttcatataatgggcctatagctcagctggttagagcgcacgcctgataagcgtgaggtcgatggttcgagtccatttaggcccatattttggagaagtactcaagtggctgaagaggcgcccctgctaagggtgtaggtcgcgtaagcggcgcgagagttcgaatctctccttctccgttttaaatgacccgttggtcaagtggttaagacaccgccctttcacggcggtaacatgggttcaaatcccgtacgggtcattcaagagaatcttattatattatcgcgggatggagcagtctggtagctcgtcgggctcataacccgaaggtcgttggttcaaacccagctcccgcaattttggttcgttggtctagttggttaggacgcctgcctgtcacgcaggagatcacgagttcgagtctcgtacgaaccggtggaacatcgaaagttttcaagttacttaggtagcttgttttttttacagaaaattctgatccaacacaaaaaccgttaatcagtgaagtcatttgcacttcatcaattaacggttttatttgaatgaacgttttattgagtctttttggtcttagctggtgtgtaataagcttcatgtgaatagaagtttggtgaatcacggtactcttttggaatgaattcatcagaactgttcttccaaagttcgaaatcggcgtaatcatcccaagtccccaaaatgattcgttggctgatgtccttgtgataattaagggaataaattgaatgcatgccatcgggaaggccatttgttcgcagcttgttgattcgcgcatcaaaaaccttctgttgatcaaaattcaaatctaatgtggagaagctaatgaagccgtcccacttatcttcaccactgtgacttaaaatatcatagaaaaccggtgccttgaagactgaatctttacctgaatggtccagcagcataaattcacctggttggctgagagcctggtacatcattaaatcccgatcaggatgcgctgccttgagttctgttaaaattttttcatttccaaatgtaatgacgatctgttcgttcatttgacccacctcctatatacaattttattatactttctttcaatattggaaccaaacatttaccccaaattagcgtaaaatataaattggataaagatgaaagaggaggaattcttttgaaactaacagtgattggttttcttggcggctatccggatcatggtgatgccaccagcagttatcttttggaatcgggtgattttaaattactgattgattgtgggagtggcgcactgttgagcttggaacaggttgtcgaccctctgaaactgaatgccgtcattttgagccattatcatcacgaccacacagccgacgtgggcgtcttgcaatattattggcaattgcatgaaaaacggtacagcgagcccgtattgccgatttacgggcacaccctcgatgagaccaacttcaagggacttacctggccgaaatctactaaagggatcgcctatgatccaagtcaagcactgactgttggcccgttcacgattacatttttcaaaacccatcatcctgttccggcatttgcaatgcgtattcaagaatcatcaactggtaaggtactggtgttcactgccgatacagcttatttcccggaattgacccaattcgttcacgatgccgatcttttgatgactgatacgaacttctttgcggaaaaaaccggccagaaatggcatatgacatcgactgagtccgggcaactcgctcatgacgggaatgttcacagattgctgctgacccacctacctgcagatggcgacatcgagcagttaaaggcggaggcccaaacgaccgctggggaagccatgccgattttggttgccaaaactcatctttctgtggatatctaagccaaatttgcccaaaataaggtctttgtttgtctattctgtgaatcttatgatttatataacaatttccgatataatcaaagcatcaaatgattactaggaggattcacattatgacagtcaatttattaacaacccccagctgcacttcctgcagaaaagcaaaacaatggctcatcgatcacgaggttgattttgtggaacgaaatatttttgccaagccactttctgaagttgaactcaaacaaatcttgatgctgtctgaaggcggtacagatgatgtgatttcgacccggtcatttttgtacgaccagtacaaatcaaagatgtcttcaatgaccatcagccaggtgatttccttgctggcaacccatccagaactgattcgtcggccaattttagtggatgccaaacggattgaatttgggttcaatgaagatgaaattcgttgcttcatgccacggagcactcgaaaatgcgaattggaaaagatggtcaaaaaagccttatagtcttggaatcttaattgcttgttaatattcatgtttagccgtattatttacttagacaataatatgatacaatgttattattaattaccctcagatattgaaaggggtggctaaatatggaaatggaacggattaatgagaatacgattcgtgtgttgattggtaatgatgatctcgacaagcgtggcattaccgtgcttgacttgctgggcaaccacaagcagatcgaaagcttcttctacagtattctcgaagaagttgataaagaccatcaatttcaaaataacgatgccgtcactttccaagttcttccaaaccaaaatggcttggaattgtttatcagtaaggatgtagatatgtctgataacgacatgttcgatgcaggtgactctgattcagatcaccctgaaaaacgtgatcgggtttccaaatatatcgcagaacatgccgataataacaaaccgcaacctgtaagtgataaaaagactaacgatgaatttggtcatcaaaagcggactgtgattcttgagttcgaccaattagatgattttgtgtcgctcgccaaggcattgcgacttgaaaatggcacatcggatttgtacttgtatgaaggaaaatactacttgaagcttgaactattcagcaatgaccccgttgacatggtcgtcagtgatgaagttgcaattgccaatgaatatggcaagaagactgctgttactgaagaggttctcaacgaatacggtcagcagttgatggaaaacagcgcattagagttaagcaggtactatttcaaataaagttcaaccaactaaaaacgacagccgttaatggctgtcgtttttagtatgccgattattgttgatacgcacgtcccttgatcgttgttcgatagtacgtttggcgactattttgactttgtggggtgcgaaaccccaccgttttggaaacgatatacagtggccgtttacgtgatgcctcaaagactcgataaaggtaggcgcccaacatcccaatggtcaatagagtgatgccgaccattaagaatagcgcaaagaccgcaaagtgaatggtatccatcgtggtaaacagcgaggtaaccaagtagccaacactaaatatgattgacaaggttcccagccagttggccaactggaggggaaatgatgaaaacgaggtcacgccatccattgccaaacgaatcatttttcgcaacgggtatttagaagtcccggcaattcgctcttgacgttcgtaagtgacgtcggtctgcttgaaaccgacccagctgaccataccgcggacaaagggatcggcctcattcatttgtcgcaattggtagaccacttgcttgtccattaaccgaaagtcaccggtatccagcggaatattgacgttagtgattcgttttaaacctctgtaaaagagggctgccgttgcctttttgaaaacactttcgccatttcttgaaagccgcttgccataaacgacatcgtagccttcatgccatttgtcgatcatatccacaatgacggcggggggatcttggagatcagcatccattaccacgactgcctcgccttgggtataacgaatgccggcagtaatcgcgagttgatggccaaagtttcgtgaaaattcaaccaaccgaatattattgtgcttggcttgctgattggaaatcagttcgacacttttatcggtggagccatcatcaacgaaaatgaattcaaaggtctgcggttgattggcagcaaagttttccaaggtgttgatggtggtttcaatgccttgctcttcattgtaaaccggtaggacgattgaaattaattcctgttttttgtccattaaatgacctcctatttataaattgacgacaagtcatacagcacgcccgatgaacccattccgccaggaccttgcatggttgtctgtttctgggtagacttactgttcgattgaccagctttttgagtggattttagtttgggattgctcttcgttgaaggcttggttcccggcttaccagttggctttttcttgcccgacggagctcccgttggtgcctggttgctgttaggggctttggcttgtttggtggacttggtggtcgtcgtagctcctgggccacccatgccggcttgagaaccgttgctgcttgaagattgatacaagctggttttgactttggtagcgtgtttcttaatccaattgataatcttggtattccccgatctgccggagtaatagaagtactttaagtcaccgtttttgacgagtttcttgaattgagacaaggtaattgccggatcagttccgttaaagccacccatcgccatgaccgccttcccggttttgatgatgtaaggcgctgcggttgtcgaatcactggtggcaaacagatatttggcgtttccttgatgtttttcaacataattgagcagtttggtgttgactgagctgttacccatgccgccaccgccacccggcatgccgttactgctggatgtgagcagcgatggcccggcggttggaatcatggctgattcagcggcaatcgttggtgttagcgaccaccaggttggagctgccatgatggaaatgagaccgccaaccaacagtgcctggaatgctcgaccccgtggtaaaatcgccatcccaattgaaaagccgattgcggcaattagaatcacccaggtgagccatggatagtaactgtaaacgtaccaggactggagtgccgctgtcgccacgatcgcaatcgggagcagatagaatttccagcaggttcgtaaactgtttttaaacaggccgaccagcgcagtgacgccagttccaaatagtgctgcgattggtggggccaacatgatcatgtagtagggatgaaagaaactggcaacgctgaagaaaccgtagaccggaatcagccagctggtccacaggatcaactgtttttgctgcttggacaggctaaaccaacgtttgcgacggtctctaaagaagactaagccgccaattaagccaaagagggcaaatggtaataaccaactgacttcaggcccgagggctgattggaagagtctaaacggtccggcagtgccgatgttgaaggcgccaccgccaccaccgccgttacccatcttgccggggccacctttgccgccgtttggctggcccttcatttgcttaccgccaggtggggtttggtgtttgccggtttgcttcatgccggtaggggcttgaccacccggcattccaccaccttttttgttggtcgttttgctgttcattccggcaccaaatgtcccgccggttccagtggtttgaccaagcagtcgttcacttccgttatagccaaaggccagttccaacaaggagttggtttctgaaccaccgacgtaaggtcggctgctggcaggggtcatgtcgacagaaattgggtaggccagggtgaagactaagagcgacacggtggccaacgttaatttggtgattttctttttccaggtttcgttggctgccaaccagtaaaataaatacatggctggcagaatcatgaacgcttggagcattttgacgttaaaagcaattccaattaacgcaaagctgatcaacaatgaccaaattttgcggctgccaatggccttttcaagaaagtaaagggccaacattaagaagaaaactaacgtggcatccatgttattggttcgcgaatcagccaccacgatcggtgtcagggttaatgccaaggcgctcagacgagctgcgttttgaccaaagtacggctggatcaatcggtacattagatagaccgatccgactccgaaaagaaccgatggtaagacgatgctccagccgtggagaccaaagattttggcactgattgccatgaaccaaagtgcgactggcggtttatcaaccgtgatgtaaccggccggatcaaaactgccgtaccaaaagttgtggaaactttcggtcatacttttaatggccgcggtgtaaaaggcgtttgcagaccccgccttccagatttgccagccgtagaggaatagcgcaaggacgaggattacgcctaaaatccagtcaaacctgaatttgcgttgataacgattttgggtattttcaatagatagattattggttgccatagtggcggacctcctttaagtgatgttggttgaatacccaaaactttgaaagcaaaaaattggtgggtacggtgatcatcaaactgacgataggaattagtcggctgtcaagaatcggccaaccgctggcaaaatgagcgaacaaaacactgatcagccaggtgaaaatgtaagtggcgtagtatttccatgcaaccgttttaactgaagcacctgtctgaaacacccagcggttatttaacgccaaccccagcagagaggtaatgccgtaaccgattgccatggcaatggttgcgttggttggatgaagcaataacagatagatgacataggtcagcacggtgttaatgaatccggtaatcccaaattttaataattgctttgtactagtaatggatgactcactcctttctgaattgatgaaatgagtttatatgtttaaccataaaacaagcttaaaacatttgatttatgataaattgtgaataactgagttgacggaatgcgtaaaaacctttaatttagtgtcaacgacaaaaggagaacattcaaatgaaagacttacacatactaataattgaagatgatgaggacctggcgaagagtctgcagctgtttttgggcgaaattgcgcaaacgaccgtctcccacgatggctttgaaggccagatgctggggcaggagggaatctacgatctggttgttttggatttgatgctccctcaagtcagcggctacgacattttgaaacactggcggaccgaggaccatttgagcatgccggtgctgatcttgaccgccaaagacaccctggacgacaaagtgcacgggtttgaacttggagccgatgattatttgaccaagccctttcaccgtgaggaattgctgatgcgggtgaaggcccttttgaagcgaagtggccaccttggtgacgacaataccctgtcagttgggccatttaaagtgaacttaagcaatcggattgtggaagttaacggcaaagagctggcactgaatggaaaagagtttgacctgttggtctacttcattcaaaatccggataccatcattaccaaggaccagatttttgatcggctctgggggtttgagtctgaaaccgcgatttctgtcgttgaagtctatatgagtaatttgcgaaagaaaatcaagcagagctcatcgcttcagccaatcaagaccttaagaaacgttggttatatgtttgaaacggaggaatcggattgaaaaaaggtgatccgcagcaaaaacaacagctgagccttttcctaaaggaattggtggggttcgcactgttgtttgctgtacttggtttagttgttttcttcttatttcaccaatcgatttataaaaatatcgaccagggattggtcacgcaaaagcaaaacgtgttaagtaaccggaaagctcctcaatttcggacgggcggcaatgcgcaaaatccagccccggccaaacccaataatggtgatacgccatttagaaccaacattttagtttttaacaaaaaagggcagattatcaatgctcaaatgctgggcaatcggatttacaatctatttatcaataccgaactggataagtcgcaagtcaacaaggtccgcgaagtaaccttaatgtcaaccgacaacaccttacattatttccgaaccctgttgattaaggtgcccaagtccaattccaatccaatttatgccggtaactatgttttgattttggaaaatattgataccgatttgatggcggttaacagttttaagcgctcactgctgacgacactggttttcttttggatcgtcgcgattgcgattgcttatttcctatcccgatcgagtatgaaaccgatcctggacgcctggaaacgccaacggcaatttagtgctaacgccgcacatgagctgcggacgccgctgaccgtcatccaaaatcaaatggagtatatgttaaccaaacccaagaccaaggtcatcgaccaggtcgatccaatctcaacttctttggatgaggtcaggcacctgcaaacgttgaccaaccggctgttgatgctcgcccgatcagattctgggacaattgaaatcaacaaacaggaagtggatttgaaaccttggttcagccaaattctcaaaccatacgacgatatcgccgccagccaacataaatcgatggtgacggtccttaaagccgatggtaagggacgcctggataaggatttgattcgccagctcttaatcattttgttggataacgcgatcaaatacacgcctgccggtgggacagtcactgtgatgacggcattgaaccgtgatcgattgacgattgaagtgcgtgataccggaaccggaatacctgatgctgacaagaaacgaatttttgaacgcttctatcgttctgacaaatcacgaaattccaagactggtggtaatggcttgggattggcgattgctaaatggattgttcaacagcactcggggaccatttccgttaaggacaattatccaaagggaaccgtgtttgatgttttgatcaagctgtaaaatgataaagtaattactgtgcacaaagaaagctcggagtaaaagtgatttgacttttacctcgagcttttttgtgattgggttccactagatcaatgattgatcctgcttatcggccttgttaattcctggaaataattcgtgcagatattcaagcggttcaactttaccgactttgtcagtgtagacgacttgagtcacgttgtcataggttaaggtgatcagtgactcaccgtcttcatctttgacaacataataacggataccgagttggatggcgtaaaagatcaaccgttgggcatcaaatgagattttgccaattgatggcagaagggtcgttgcgcccaaacgttgggcccgccagcgcttggcgaccgtggttccgaagtccatcaagctgccatttttgatgtgttttaacaacattgccgaagctgttagttccgggtgggtgaccacttcactgaaatcgtccagtgcctggagctgttcggaatgggcatgaagtgacttagccatttcaatcaactgatcaaagatttggatgccttcagccattttgaaagtcggctggttggggttctccaacgccacctgattgttatcagtgaaagattgttttaaatcagcggcaatattttcatggtcaactggggtgactaagagatacattaagaagaattttaaaaagtacattgcgtgacgactgatgccattaggggtaaacggcgtgttatccagtactcggaattccagataagagatgcctttagtgcgataatctttaatgtcgtcttggccgcgaagtcggaccggtccataaaattcagctgtggaatatagataatggtcgtcgattgcatgattaatgccgtcaatgtaatgatccaagctggtataaatggtggcgtcaacctgatcttgtggttcgttgacatagccataaatgctgttgcggatacttctgaccggatgggtgagttgtttttgatcctcagcggataaaaagcctttctccgcaattgggctggcaccgaacaaataagtcagcagccaacggtgaaggacaaaattttgagctagctggaagtacaatgcatttttgaaggccaccaaggtactgaactggtcttggtagtggacataaagccgattgatgaccggttcggggatgctgaagttgacgtgaacgccagtaatgatttttctggcgaccccgtacttttcggttaagtaatcacgatatttggcgtaggcgggccgaccaaaatggcctttaatatagttgacatcatcttcgtccattgctggcggcatactcagcggccaaaaggattccgatttatcaatcgaccgatataaaactgtctgcaaagtatccaattgatccaacacgccgccaatattggggttgggatcggtaataatttcgctcattgattcggaaaaatctgattgcaaatagggatgataacgtctggaacccagattttgcggatatggcttgcggcttaatcggccgtggtcatcgattcggtgttcttcgatttcaatgccgattaggctatggtaaagctgttctgcaacgcgttcttcttgaatgtgttttaataaatttttcagcatagtagtcccccagccggatttagttatacataattataaacaaaaatcggcagaatggtagtcatacggccgttctgatgaaaacgtaaggttatttttaacttcttgaaaatcattgccatcggtttcgtatttaacccatagaaggtgatgaaatgctgatagcgatgattgataatcaattagtgaatgcggctgaattcaaaggccaaaagaatttagccaatcgactggtttgcccgggatgcaggcaaaaagtgatattcaaacgcggcaagtaccgcattccccattttagccataaatccaatcgggtttgcggtagtttcagtgagaatgaaagtcaggcccacctccagggcaaactgacttttcaacggcagctgcgagccatggcgacagaggcggtgttggaatattatctgccaacaattgagcagcgggcagacgtttatttaccgtctccaaagctgattttagaatatcaatgcagtcccatttcgtttgccgaactttctcggcgaacggtgaattaccagtcacttggaattgacgtggtctgggtgctgggggatcgccatttaaatgccgccaaacgattggatggggttgccaagtttgcccgttttagcagccaactgggcttttacatcatcttttattctgctaaaaatcagcagttccgaattgattttcagattcgcgaagttgccggtaaactcactagtcatatgcgactatttaaaactttggccgagttgaagcgattcattgaccacccgccttcagctcttcaacggtattcagtccgggctactaatacggcgattttgcaccagctcaaccggattcagcggagtattgttttgaaaaatcccacttacctggacatggtcacgcgatgttatcaacgacgaaaagtctttgtcggctgccctttgatttgtcatggaaaagagggtgagggatggccgatctttcggcggactgctttgtgttggcgagtgtggattgttttgcagctgtttacgggcagtaatcgggaaatttccaatcaggagttaaatcaggttttcaagcaatcggttcaactttttggccaacaatttgcccaagtagatgattacgttcgtttctttcaaatggcctttaccagttttatctttagcctccgggccggcggctatcttcgacacacggtagccggcgtgcaaatcattaaacaaccggtgtggtttgccgattatgatgaaaaacggcaatatatcatgaccgccaagccggaggtgtgctaacctattggtaactaactatttgaaggaggacgttatgccaaaaccacaagaattaccgcttagaaaagatgttccagaagaactgacttgggacctgacgacgatttatccaaccgatcaggaatttgaaactgactatgacgctgttcaaaccggtgccaaacaattcgctgaattagccggaaccattgagaagagtgcggcctcactgctgacagcaactgagcgtttgatgaccttaagtcgaaagcttgaaaaagtctatgtctacgcccagttgaaaaatgaccaggataccagtgaagacaagtatcaggccatgtattcccgtgcggaatccttgggggctcaatttggggcggccactgcctggtttgaaccggaactcctcaaaatttctgacgatcaaatcaagcagttttatcaggatgaacccaaattggccgattatcgacggtttttcgatcaaacctttaaacgccgtaatcatattttaagcaacgatgttgaagccgttctggccggggccggcgatattttctcgtctggagagaaaacctttggcattttggataacactgatctttcattcccagcggtcactgatgagaatggtaatcaggtgaagttatctcaaggtgtttatggtattttattggaatcgacaaagcaaagtgtgcgtaaagaagcgtttgaaaaattgtatcaagtctatcgtcagttccagcacacgctggcggcaacactgaccactaatgttaagaatcacaacttcaaagccaacatccgccactataacaatgcattggaggccgctttggctgataacgaagtgccgacagacgtttataacaacctgatcaaagtggtcaacgagcatctcgatctgctgcacaggtacgttgctttgcgtaaaaagattctgggccttgatgaactgcatatgtacgatatgtatacgtccctagttggtaaaaaatcacccaagtatacgtttgaacaatccaagcaaatcgccttggaggctttgcaggtaatggggccggattatgtcagccacgtcaaagaggagttcaacaaccgttggattgacgttgttgaaaatcaattcaaaagaagcggcggctattcctccgggacttacgataccaatccgtatattttactgaattggaaggacaatttggataatctctacacgctgatccacgaaaccggtcatagtatgcacagctactattcccatcataaccagccttatcagtatggggattactccatttttgtggctgaaattgcgtccacgactaacgagaatatcttgacggattatctcttgaataaattcaaagatgacgatgaaatgaagaaatttattttaaattactatctggatggatttaagggaacggtcttccgtcaaactcagtttgctgaatttgaacaatacattcatgaacaggatgcaaaaggtcaaccattaaccgccaactttatggatgattactatcgcaatttaaatcaaaaatactacggggatgccgtgatttctgaccctcagattggtcttgaatggtcacggattccacatttctattacaacttctacgtttaccaatattcgaccggctttgctgccgcatcgacattggctgatggcattgtgaacggcggccaggccaacgttgataaatatttgaattacctcaaatcaggcagttctgacacgccaaccaacgtcatgaaaaaagccggcgttgacatgacgcaaccggaataccttgagaaggccttccagatttttgagcagcgtctggatgaatttgagcgtttgtacaacaaatagtttcgctaataaataagcgtaaaaaataccgacatttgggagttcccagatgccggtatttttgtggattaaattagttgaatcgtaagtttgatttgggatacggaactgtcgttggtttctttgaagcctgctcgaagtgagcagccgatcccagactcttggcacaaaagccaaagagagaattgtaatcaaagtccttgatacgaatgccactgtcagcaacgtcggaattaaacaaaacggtggttgatggatcgcggacttccatttcgtggaccactcgctgatcacaacgaaacattttttctgccaaatcagagcggcggtctgccatgaacatctcgacatccaaaccatttcgttcagcgagcttggcaaccagttcatccgagtatggtactgaattaatcagaagttctttttgcaggtccatcaagaagcgtcggccaaacttctttccctgaaatgaagctgccttgaaatccaaaatggtatcgtagggcaggttgtgatcaagatggctgagttgctcattctttgaaaagtcgtgcagaattttgatgttgagcatcgaaacaaagcgcacgctgatttgtttgtttaatttttgtgaaatccgttcaatcgttttttcggcgtcgtaacaatgtcgattaagtggatcaacgaataaataaatctcaagtaccattattgcccctccatgtgtaaccgacaacaaaattaatatactaattattttctccattaagaataccaaattttcacgtaaaaacaacaattttgcttgaagtgtgtatgattgattgggaaaggttgttgaatatggtaaaattaagtctgattgaattttaccttgaagcaatagagcgttcggatgagcgcaacagattggaagtgttagcttggttgagaattgggatgactttttagttccttacaaacaagctgttgatgaattaaaagtaaaattacgtggcatcagagcgcaattcttaaaaattgatggtcgcagtccgattgaatttgtgaccggtcgggtgaaacccgtcgacagtattaaagaaaaaatggtcagaagacacatttccgaagaccggcttgaagaagatatggaagatattgccggtttgcggatcatgtgtcagttcgttgaagatatttatcaagttgtggatttgcttcgcaaacggactgatattaatattcttgaagaacgggattatgttcataacaagaaaccgagtggatacagatcataccacattatttttgaatatcctgttcagatgcttgacggtgaaaaagtcattttggccgaaattcaagtgagaactttggcgatgaacttttgggccaccgttgagcactcattaaactacaagtatcaaggcgaatttccggatgatttgaaaggccgactggaacgatctgccgaagccgcctttcatttggatgaagaaatgtcagaaattcgtgatgaactccaagaaaccaacaagcatgagccaggcaaagatgtaaggaagtcgtctgatgaagatagccatctacagtaatcttggtgagtcgtcaaacattgtggcgacttcattaaagaaaaaaattgaagaatcacccgatttaagcatcgacggactgaatcctgaaattgtcatttctgtcggtggtgatgggacactgctgtctgcatttcaccactatcaagacattagcgatcgaatccgattggttgggatccatactggccatttgggcttttataccgactggcgggattacgaagtcgccgaactggttgacagcctagagcacgacaatggtcaaagtgtcacatatccactgctggatatccgggttaattatgtgagtggcggcccagctgattatggcttggcgcttaacgaatcgaccctcaaacagattagcggttcgatggtggctgacgtctatattaaggacacactctttgaaagttttcggggtgacggtctttgtgtctcaacgccgagtggctcgacggcctacaataaatcagttggcggcgcaatcattaatccaaccctcaatgccattcaaatggccgaaatctcctcgattaataaccgggtctttcgaacgctgggctcaccgttgatcatttctccagatgagtgggtgaaaattgttccgaagagttccaaccggacgattttgacttgcgatcaccaaatcatctccaacgaagccgttgaatcggtcgaataccggatttctaaacgccggattgcttttgcccagtatcggcacacgcagttttggcggcgggtaagcaactcgtttattggtaaggttaatttagatgactgaatttacgtggaaatatacaggccaggccccgatcaaggtccggacattcattatgagttacgggatcacccggacattgttgaaaaaaattaaatatcatggtggaaagactttggtgaacggtgaagcctcactggtcaaccgaatgcttcaaaccggcgatacggtcaaagttgtcttgccgcctgaaccggagaacgaccatgttagcgtctccaacgttccaattgaaatcgttcatgaagatcccaactttttggtggtcaataaaccatacggggtggcctcggtaccggcgcacaaccatgttgattcactggttaatcgggtgaaaggctattatcagcgccagggctatgccaatcaaaaaatccacattgtgactcgactggataaagacaccagtggtttggtgatttttgccaaacaccactttgctcattcagttcttgataagcagttgaaggaccggacaattcaaaagacgtacctggcgattgtcgctgatcgaatttcaacgccccactttgaaatttatctgccaattggtagagccgatgattcgttcgtcaaacgccaggtcgttgattccggcaagatgtcggtgaccgaagcttggacagtgcgtcgattagctaaacaaaccttgttaaaagttcgactgcacaccggtcggacccatcagattcgggtgcatatggctgctattggtcatccgttgattggcgattggctttacaattcagatgaccattcaatgaccaggcaggcacttcactgtgccgagttgactttttatgatccatttgccggtcgcctgcttcattgcgaagcgcggctgccggaagatatgcagtcctacattaatttgcataaactttaattgacgttcaaccaacagcttcccacaaaacgtgtttgagaattttggctaggaagcttttttggttggctgctgtgatataatgaactgcgtttgtggaggattttaagtgaaaaagattgattttggccaaaaatttatgaagcagaatttacagttattccgttgtcctgtctgtcaaacaccattcgatgaggtggtgggatatagcttaagctgtccccatcatcatacttttgacatctctaaaaaagggacgctgtttttcctcaccaaacaggcaaacaacgaatatgacaaatcgatgctccaggcccgccacaaaattttacaggctggtcttttcgacccgattgtcgatgcgatcgcaacgtatttgggcccggaaccagaaaccattttggatgtgggctgcggtgagggcacgccgctggcacgcttgctggcgcttagagatggcaaagataccgcaatcggctttgatatttccaaggatgggattaatttagcaacccaacagccagccgacgcttttttctgtgtcgcggatttggctcggctgccatttaatgaccacacaatttcgaccatcattgatttgttttcaccatctgcctatgatgaatttaatcgggtagccaagactggcggccgattgattaagattattcccaacagcgactacctgcatgaattacgagtcgctttatttggcactggtcaaaagaacagttcttattcaaataacaaagtatttgatctgttcatgacgcactactccagtgccagcattgataagcttacatacgaattttcaattcccaaagggatgcagcaggatcttttgacgatgacgccgcttcactggggcaagggacggcaagataacgcccttcaactggttaatgcactcaagacgattaccgttgatgtttcagtgatggtcgcagacttttagaatatttggaggaaacaatgactaatcatatcgtactatttgaacccttaatgccggcaaataccggtaacattgcccggacttgtgccggaaccgacacggtccttgacttgattgaaccgctcggattcagcattgatgataagcacctcaaacgggccggactcgattattgggataaggtccagatcaattatcatcaaaacctgcctgaatttttgaagtcggtcaagaatcccaaaaacctattcttagtttctaaatttgccaaccaggattacaccgatccggattattctgacccaagtcaagattactatcttttatttggtaaggagacgaccgggttaccggaaccatttatgcgccaaaatcctgaaaaggcgattcgaattccgcaggatgacgacaacattcgggcactgaacctgtctaacacttgcgccattgtgatctatgaagtactgagacaacagaacttcaacaatttggaacgaacgcatcaatatgaacatgataagctgaaataatcaacagtcattttacgggaaggggggaacagcatgaaaaccaagcgaaccaagcgaaccaagcaaaccagcagcaagccggttaaaaaacgcggccgtccacgaaagacgaccaagaagactggcggccagtcgagctttcttcagaaatatacggttaatgtcatcggtggcgtcgttgccattttggccttactgggattatttcaagccggaattgtcggtaccttaatgatcaatattgccaaactgtttgtcggcagtctttatccggtctttcttttggttggaatcgttgtcggcgttttcctggcaggcttttcccggttccccaaaattccagccaagtatacttggggaacggccttgattttgctgggcgttcttctttggctgaccttaattgaatacattcaggctgcccagccggttgactttatcaattttaattggcagaagctggttgatgatgttgtttcatctaacagtgattccaacatcggtggcggcattctggcaacgattgtgttttatcttgcccacgtactatttggcaaaatcggcaccggaatcgtcgccagcctgatcattttgatcggtggttttattctatttgatatttcatttgcaaaaattttcatgggtctgcggacttgtttgacatttatcaagactcgggctgcagccatccgacagcagacggaccagaaacggtctaagaagccggctaagcagccttcatcggcaacggctgccaatcacccacaaactgtggaacagcctcaaaatgatgattctgagccaaataagttgtcggcgtcagcgatcacgatttctggcatgccagtgactgatgaagctaaacagtcacgtaagcctgtctctaagccgacacctcctaaagaatccgaaaaagcggacgattctgccgacgttaacctggtcgacgtcaaagaagatgatgcctacaagttgccgacaaccgacttgctgacgcaaatccctcaggatgatcagtcaagcgagttgcagtcaattgaccataacgctcaagtccttcaaaagacgttggacagttttggggttaaagccgaaattaagcacgtcagtttaggcccgtccgtcaccaaatatgaattgcaccctgatattggtgttaaggtgagccggattgtgaacctggctgacgacattgccttggcattggctgccaaagacatccggattgaagcgccaattccgggtaaatctttaattggcatcgaagttcccaatcgaaagattgcgacagtttccttcagagatgttgttgaacatcagcctgataaccatggccacgtgctccaagtgccgcttggaaaggatgttaatggtaatgtgattacggctgatcttaccaagatgcctcatttactgatcgccgggtcaactggtagtggtaaatcagttgcaatcaatggcattattaccagtattttgctgcacgccaaacccagccaggttaaattaatgctgattgatcccaaaaaggttgagttgggcgtttataacggcattccccatttgttaagcccggttgtttccgagcctaagaaagccgccagagcactgcaaaaggtggtttccgagatggagaaccgttatgaattgtttgccaaattcggccaacgaaagattagcacttataatgattttgtcgcgaaaaacaatcgtgaaaatgacactaaaatccagccgatgccctatatcgtcgtgatcgtcgacgaattggccgacttgatgatgaccgtctccaatgatgtcgaagcagcgattatccggctggcgcaaatggggcgggctgctggaatccacatgattttagcaactcagcggccatctgttgacgtgattaccggcttgattaaggccaatgttccgtcaagaattgcctttgcagtatcaagtgggattgattcccgcacaatcatcgatactaacggtgctgaaaaattgcttggtcggggcgacatgctgtttttgccaattgattccaacacgccgattcgagttcaaggggcctttattcccgataaggatgtctccagagttgtcaaattcattaccgatcagcaatcagctgattatgatgaatcgatgatggttagtgatgaagagatcaaagaagaggatcaagaagattccgaagacgatttattcaacgatgctttggcctttgtggttgatcaacagaaggccagcacgtcacttttgcaacgtcacttccggattggctataatcgggcagcccggttaattgatgatttggaaaagcgtggctatatcggaccacaagatggcagtcggccgcgtcaggtctataaggaaaaacaagaataagtttgaatgacaaaaaagaggctggcacaaaagctttcacttttgccccaacctctttaagtcgtttgtttataagaatgtcatgattgctgaaatgaccagtgaactgatcgttgcaataatcatgatccaaacaaataccaatgtaattttttgaaatctggttctctttttacgcgccaatatttgcaccactttctcttgtattccatacacagtttaactatcattatcgttcaatgcaatatgttttgtcaaaatcaggagggtaactcatgcatatttctccttggatgactgacacggtaacctttataacgcaatttctgattctatttgcagttgccgggttcttagttgttttaagaaaaaatcaatttttcaggtcgaaggtgccgattaaaccactcgatttttggccgccaattttgctgtacttcattcacgagattagtaaaaagggtttgtcggggtcattcattcccgaagtggtgattgtttggttagggctcacattgattgtgttgatctggcaaatttttgccaatccgaatctaacctacagaaaattttttatcactttttggcgattcagtgatttatttttattcggctgttggatcgtcgtggggatttatgtcatttttgagtctatctgaatcaataactgttcatcggatcaaagcagatttttatgctttggtctttttttgtgcagaaatgggcaaatctccccaccactttctcattgccgtcagatcagtcctggacggatttttagttgaatatgaaaacggtttataacaaaaaagtgacaaattttgaggaggcgtggttgatagtggtggattgtggtagaatgtgattgtaaactgaaattgggggtgatgacgacatgttcatgggtgaatatcaacacaacattgacgccaaaggacggatcatcatccccgctaagtttcgccaggatttgggcgacaaactcgttgtcacccgtggaatggatggctgtttatttggctatccgatgagtgaatgggaaaaggttgaacaaaagatcgacactttgcccgtgaataaaaaggatgctcgttacttcacgagattctttttctccgctgcagttgaatgcgaatttgacaaacaggggagaatcaacatccccgcaactttgagggattacgcaaaaattgagaagaaatgtgtcgttgtcggtgtctccaatcgttttgaaatttggagtgacgatcgctggaacgactttagtcatgacgccgaagagaactttaatgaaattgctgaaaatatgattgatttttagataagcagacatgctggaaacgggggtgatcgaatgtctgaatttaagcacgtaactgtcctcttaaacgaggcggttaaggggttgaatattaatcctgatggtacatatgtcgatgcaacattaggtggtgggggacataccaccaagattcttgaacagttaaccaatggccatctttattcttttgatcaggacgaagaggcgattgcttataaccaacagcacttggctgaatacattgaagccggtaaattaactttgattcacgataatttccgtcatttaaaatcagctctccaaaacgttgatgtttcgggaattgatggaatcgtttacgatttaggcgtctcgtcacctcaatttgacgaagccggtcgcggattcagttatcgctttgacgcccgccttgatatgcgaatggatcaggataatccaatcgatgcctggaaaattgtgaatgaatggccttacgaaaagttggtccggattttctatcgatatggcgaagagaagtttgccaagtcaattgctcggcggattgaaactgttcgacgagagcatccaattgataccactaacgatttagtcgaagtgattaaagagggaatcccggcagcagccagacgccacggcggccatcctgctaagaaagtctttcaagcggttcgaattgctgtcaacgacgaattatctgcgttggaagattcactggaacaggcgttggatttgttgaatgtcaacggccgaatcagtgtcatcacttttcaatctttggaagatcgcttggttaaaaccatgttcaaagaaaaaacgtccttgccggaattaccgcctaatttaccaatcattcccgaaggcatcaaaccaaaatttaaaagtattactcgaaaaccaattgttccaactgaagctgagttagaagagaatcatcgatcacatagtgccaagttgagaataattgaacgaattaaaaactagataaaggaagagtacatattatggcacaaaataatttagctcgtaacttaaccgaacaaccgcaaccgtatgtttccagccctgatcaggctaaagtaaaacgggtgagcattgcaaaagccctcaaactttcgtcctttgaaaagctgttaattgtatgtggcagcgcagtcttaactgtgttaatgttagtagttgtatcgtcaaaaattgccttgtctaattcacagcatgaacttcaacatttagacaaccaggttgtgacggttcgcaccagtaatactaatttaaaacaacagattggtgagctgcaaagcagtacccgtctggacaaaattgcacacaagagcggcatgtcactctccaatgcaaatataaggaatgttactaaatgaaagagccatctgatcgttccgcagacaaactgaatgcccgaaaaagccggaaaattgttggaataagtttgttccttgcatttttcctgctttttgcatttttaggcagtcgtttacttgtcattgcggttgggaaaaatgttaaaaatgtcaatttaaatgaccgcgccgaaaaactttatactcaaactcagaccctcaaagccaaacgaggatctatttatgatgcaaacggtaatccaattgccgaagacaccagtacatattcgctatatgctgttttggacaagcagcaaaaagggttgaatggcaaaccactttacgttgtgaataaaactaaaactgccagagtgctcgccaagtatttacctatcaccgaaaagaaggcattgaaaattttatcccccaaggataaacagcccttccaagtggaattcggcagtgccgggaccaatatttccttactgactaagaagaagattgaagcagccaaactgccagggattgactttgtccaaaagcaagcccgcctatatcccaacggcgtcttttcatccaatttaattggggtggcggtttctgaaaccaacaagaagaccggtaccgccaacttggttggccaaatgggcattgaaaaagccttcaacaaaacgctagccggacagaatggctttaaaaacgctcagtacgatgtatacgggtacaagcttcccggtaagcagcaaaaagaaaagccggccaaaaacgggaataatatttacacgacgattgattcgcggattcaaaccctgctggagagcgagatgaactctgttcagtcacaagttcatccggctggaatgaatgccgttttgatggacgccaaaaccggaaaaatcgttgctgcttctcaacggccaactttcaacgcggcaacgctgaaaggcatcggttcggcttggaccaacacgttatcctccgatatgtacgaaccggggtcaacaatgaaagtctttacgctgtcatcggccattaattcgggtcattataacggcaccgacacctatgagtctgggcgttattcaattgacggcaagattgttcccgattggaatcctgccggatggggctatatcacttataacaaaggatttgccttgtccagtaacgttgccatggctcatttggaacaacaaatgggtcccaagacttggaaaaaatacattaagcgatttggctttcttaagagcaccaatagtggccttccgggagaactcaccggcagaattcagttcaattatccgatcgaacaggctgacacctcatttggtcaaggaattgaagtgaccactttacaaatgatgcaggctttatctgccgtttcaaataatggtacaatgatgaagccgtactttatttctaaaatcacaaacccggcgaataataaaacgattaagcaatacggcaagcaagttgttggtcatccgatcactgctgcaaccgccaaagctgtcagaaagcacatgcaagacgttgtctacaagtcttacggaatcggtgccgattacaaaatcaagggctaccgggtggctgcaaagactggtaccgctcaggtcagcaacggaatgggcggttatgcttccggtgacgacagctatctctactctgtggccggaatggttcccgccaataatccacgctacgtgatgtttatcacgatgaaacagcccaaactgactgggaccaagacagctacacaattgctggcagagattttcaaaccagtgattacccgtgcgctgcagaactcgaataccaaacaggcaaccgtcaagcggcaggtaccaacggtgacctatcagacaacgacctatgccaaacgggtgatgaatgaaaaaggctttaatgttgtgacaattgggtctggcgattcgattctcaaacaatcgccgagcgctggaacaacacaagccgaacaaaagcgggtctttttactgacaaataaagactggaagatgccgcgaatcatcggctggagtaaagccgatgttgaaaagttttgctcgctgacaggcttaaagctcgagtctactggtagtgggtacgctgacagtcaaagcatcaactttgagaagtcaattgatacgggcgatgttttaaaagtaaattttgaataatgaaggatggtaaatggcgactatgggtaattggttaacacctttattgagtacatttgtgataacggcaatttttatgccaagtttgattaaatatttccgaagccgacatgaaggtcagatgattcgagaagaggggccttcgtggcacgaaaagaagtctggcacaccgacgatgggcggcattttgttcatcgttgcgatcgtcttatccgacttggccttcggtggggcaaaagggatgttgaacccgacgcttctcatcttactgtttgtcctgatcacctatggtctccttggaatgtgggatgacagtattaaactgtttcggcgtcagaatgaaggattaaaggcctggcaaaagatgctgggacaaattgtggccgccgtgattttctcagtggtatacatacacgaaggctttccaatggcgatcaaaattccgtttggcggcgaccttcgattaggctattggtacattttgttcattgtcttttggctggttggcttttccaatgctgttaatttgaccgatgggttggatggactggttgcgggcctggggacgatttcctttgcggcctacggggttattgctgccgttcaaaagcagccggaagtggccgtcttttgtttctcggttgtcggtggtttgttggcattcttcattttcaatcacaaaccagccaagatcttcatgggagatatggggtcgctggctctcggcggagctttggcagccgtttccgtgctggttcaccacgaattttcactgttgatcattgggatcatctatgtgtgcgaaacggccagtgtgattattcaggtggggtcgttcaaactgactggtaaacgggtcttcaagatgacgccgattcaccatcattttgaaatgagcggctggtcagaatggaagattgatatcgttttctggctgattgccttggtggcatccgccattagtgtgatgacgatagtatagaggttgggacaaaacggctggttttgtatccagcctatttgactattcatatgatgaaaaacgagggaataaaatgaaaaaaattgatgattataatcataagaaagtattggttttgggtgctggtaaaagtggcacccacgctgctgaactcttaaaagaattgggggcaacagttgttttgagcgattccaaacccagttctgaactgcctgaagtcgctgaattgcaagattccggcattcaaacggtcaccgggaaacaggatccggctatcttggacgatggttttgacattatggtaaagaatcctggtattccatacgacaacgcggttgtagccgctgccgtcgatcaccatctaccaatcattactgaagttgaactggcttcacaaatcaccgatgccgaaatcattggggtaactgggagtaatggtaagaccacaacggtcaccatgataactgaaatccttaaccaggaacgtgccaaagggcatgcctatgctgccggtaatattggcatttctgcgaccgaaactgccaagaaggcgacgaccgacgatacgatcgtgatggaactttccagttttatgctgctgggaattaagactttacacccacatgtggccgttttgaccaatattttctccaaccatttggattaccataaaacccgggaaaattacgtgaatgccaaaatgcggatcaccatgaatcagacgcctgaagatttctttgtggtcaactttgattctgatgaatggcgcggcttaagcaaacgcagtgctgccaaggtcgttccctttgccagaacaactgagattgacaagggtgcttacgagaagaacggcaagctgtattacaacgacgaattcatcatgaatgccgaggatattaaagttcccggaaagcaaaacgttgagaatgccttggcggcaattgcctgtgccaaagtgctcggcaaatccaatttggcaatcaccaatgtattggaaacgttcactggcgttcgccaccggcttcaatttgttcttgaagccaacggccgcaagttctacaacgattccaaagcaacggatatcgaagcgacccaaatggcccttgaaggttttgacaaaccagttgttttattggctggtggacttgaccgcggttatacatttgataaattgattccgcaatttaaggaacatgttaaggctgcagtcttatttggcgaaactgccgatcttttggaagattccctgaagaaggcgggcattcaaaatattcaaaaagttgataatattgatgaagctgttccagcggcatactcatttagtgatgaaggcgacattgtgttgctttcaccagccaacgccagctgggatcagttcaaaacctttgaggagcgtggcgatcgctacattgcagatgtggagaaattgacgaataagcaggaggggcactaatgcgtttaatcatttctggtggcggtaccggtggtcacatctacccggcactggcaattatcgaggatttacttaaacaggaacctgattcagaagttctctatgtcgggtctcagcgtggcctggagagttccatcgttcccgagcagggaatcaagtttgttgccttggaaattcaagggttcaagcggtcgctgtcattggagaacttcaaaacggtggcgttgttcctaaagagcgtgcatgaatccaaaaagatcattcgagactttaaacctgacgttgtcattggaaccggcgggtatgtttccggggcagtggtttatgccgcggccaaagcacatatcccaaccatgatccatgagcaaaatagtgccgttggattaaccaacaaatttttgagtcgctatgtggacaagattgcgattggctttcatgaggcggccagtcaatttcctaaagaaaaggttgtcttcgctggcaatccccgcgcccagcaagtggctaatatgaagagtactttcaagtggtccgatgtggggctgcaagacggtgaaccgaccgttctcattttcggcggcagccaaggggcaccggcaattaataaggccgtgatcggcgctgtcagcgagcttaacaaacgtcagtaccaagtggttttcgtcaccggtcaaaagcgttatcaaaacgtgatgaatttgctggataaaacgcggatcagcagtaacatcaagattctgccgtacataaacaacatgccgcaagttttaccgaaagtttcactgattgtcggtcggtcaggagctaccagtattgctgaaataacggccttggggattcccgccgttttgatcccaagtccatatgtcacggctgatcaccaaaccaagaacacgatgagtttggttaaccgtggcgcggcattgatgatcaaacaggatgatttgaatcctaaaagtttgttaaaggccgtcgatcagttgatgcacgattcaacggcacgtgagaaaatggcagagaattcaaagcagctcggcgtcgttgattccgctgacgaaattttgaatttagctagaacactgatcaagtagtctgataatcgggggtagagatcgttgggagcacaagaccaaaatgggaagaatcacggaggattgtttcgcgatttccaaaataggaacgtcaaaaaaatgtggccgttggtgatgctgattaccatcattttgttggtcatgatctttatgatctcgtcatacagtcgcgtgaaaaaggtcaccgtttccggtaatgagattgtcagcgatcaacaaatcaaggctttttcccctgttaagaagggaacgtcactgtttgctgtctgggggaaaacggacaagcttgcccaatcactcaaacaacgcagcagacggatgcaatcggtgaagatgaagctggtcaactttaatcaggtgaagattaaagtcgaggaatatccaacgatcggctatctcttcgttcacggcggctatcagccaattttaaagagcggcgtgattattaaggggaaagttttgaatcccaaggccggttttccggttttgaagaaatttcaaaatcctaagaaactgcggcggacgatcaaacagtacagacgaatcagtccaccggttcgcgcagttatgaacacgattagcttttcaccgactaagagtaaccccgatcgaatttttattcagatgagtgacggcaacaaagtctatgcttcaatcagtacatttggcgacaaaatggactactatccaagcatcagttccaagctgaaagtcaaaagtgtcatcaatttggaggtcggcgcctattcgtacccaatccccaaaaagcagacttcaacaaaaacgaccagtgtgcagggctattagagctaattaatctttttcgttgtttatgattgtgttaaacttatgttatgttcagaaaatattctagatgtggaggttccttacatatatggataattcgggtttatatgtgggacttgatataggaactacctcaataaaagtaattgttgcagaaaaagtaaaagggcaattgaacgttattggtgtgggaaatcagccttcaaatggattgagccgtggtgtgatcgttgatattgaccaggctgcagacgcaattcggagtgctgtaaatcaagctcaagaaaaagcaagtattgagattaaagacgtgattgtaagtgttccggcgaacatgttacggattgagccatgcaatgggttaattactttggatgatcaatcacgtgaaatcactgaggaagatgtccgaaacgttgcggcatccgcacttggcaccagtttgccacaagaacgagagataattgatattcagccggaagaattcatcgttgacggattcgacggcatcaaagaccctcgggggatggtcggcgttcgtctggaaatgcgcggtaagttaattaccggttcaaaaggcattatgcacaacctgcaaaaggccgtgaataaagccggcttgaatattatttcaactgttttaacgcctctggctgaaagccacgtggtgttaaatgacggcgaacaggactttgggacgattattgtggatcttggcggtggacaaacaaccgcttcagtcattcatgaccatcaattaaaatatgccacaacggatcccgagggcggcacatttattactaaagacatttcaattgttttaaatacatcaatggaaaatgctgaaaagatcaaacgtgattacggttacgccgattcgctccaggcatcggcggataatgaatttccagttgaagtagttggccaatcagaaccaacttacatcgacgagcgttatctcgcagaagtgatcgaagcgcgtttaagccagatttttgatcggatcaaagatcgtttgaatcagattcaagcgcttgatttgccaggtggaattgttctgactggtggtgtggctgcacttccaggaattgccgaattagccgctgaccaattcaacactaatgtcagggtctatattcctgatcagatgggattgcgacacccatcgtttacagctgcactttcactagtgtcatactttgccgatctggcagacgttgatatgattgttcgatcggccgttggtgcaacattgaccaaagcgcctaagttgagtcagcctgagcagacaccaatgcctgcagctgggaagactaagaagaccaaaaaaccgacacagaagaaaaaacgcggtgaaggaatcaagaatttctttagtgatttctttgattaagcacttaaacggagggaaaagacaattatggaatattcattagattccaccgataaccacggtgcaaacataaaagttatcggcgttggcggtgggggaagtaatgccgttaacacgatgattaactcagatgtaaaaggtgttgaatttatcgttgccaacaccgatgttcaggctttggcaacttcaaaagccgaaaccagaattcaattgggacccaaactcacacgtggcttgggagctggctccaatccggatgttggtgccaaagctgctgaagaaagtgaagaagcaatcacggaagcacttgaaggtgccgacatgattttcgtgacggccggaatgggtggtggtaccggtaacggtgctgcaccaattgttgctaaaattgctaaagaccagggtgcactcacagtgggtgtggttacccgtccatttagttttgaaggacctcgtcgggcaaaatacgccgatgaaggggttgctcaactaaaagagaatgttgatactttaatcgttatttccaataaccggttacttgaaatggttgacaagaagacaccaatgatggacgcctttaaggaagccgacaatgtcttacgccaaggggttcaaggaatttcagacctgattaccagccctggctacgtcaacttggactttgccgatgttaagaccaccatgcaggatcaaggttctgctttgatgggtgtcggcactgctaacggtgaaaatcggactgccgaagcaaccaagaaagcgatttcttcgccattgttggaagtttcaattgatggtgctgaacaagtattgttgaacatcaccggcggaccagatttatcattgtttgaagcccaagatgcttctgacattgtgtcacaggctgcgacgagcgatgtgaacattattttcggaacgtcaattgacgaaaccttgggtgacgaggtccgtgtgacggttatcgctaccggaattgacaagaaaaaggctgaacaggatcggatgtcaacgcgacggacccgttctgctcgtccacagccaactgcccggccacattcagaccgtcaagctccagaaaccaatcaatcacaggattcttcaaatgctaagagtgatccacttggtaactgggacatcagaaaacaaccagcgccaactcgtcctgctgctcaggatgaatttagcgacgttgagaaaaaggattttgatcctttccaacctgatgttaattctgacgataccagaccagataccagtgatgattcacaagacgatattccaccattcttcaagcaccgtcgtcggggcaagtaacatcagctgaccggtgcggatgtttggtgaaatgtgaaaggacacgaaatgccaaaatttaatttagctaatttttttgggatggatacagaccaaccagaaaatcaaattgataagccggcggacaacgttgtattgatgaatcgacaagaaccagaaaccagcagcattgttgtttttgaacccgttaattataccgatgttgacaccatcgcccaaaaactattggaggacagtgcggtcatcatcaaattggacaaattggataacaattcagctgcccggatggttgatttcttgaacggtgttttgtttgccattcacggatcaatcaatcggctcggtaggaacatcttcatttgttcaccgaagaaatttcaagtaactgagtaatctcgagaaaataaggagcaacctattggtcacatttgttatgtatgcagtttggtttatcgacaaggctatcaacatttatatgctgtgtattgtcgtgtatgccctgatgagttggttcccgaatgcttatggaacagcaattggccgatttttggcccggattgtcgaaccatttgaaagcttgtttaattttgccacgattgggatgattagtctcgctccgattgttgcattagcggtgctgacgttcgtccaaatgggcgttaactatcttggacaattgttaatcggctactaattggggtatggacatttcagccagagggggaaatatcttggtagactcgaatgtttcgcaacactatcgacaggctgaattgccttttttagagtcaatcgacagtttgagcggcagggttgcgaatgaatatcgaccgatccttactgattttttaaatcctagacagctttatatacttgaaacaatcgtcaacagatacgagggtgtctcatttcaaacttttggtgggtatccctcagctgaattaaaacgagcggttgcctttccggattactttgttcccaaggccgatgattacaatattacggctttccagattgactatcccagtaaatttgccacgttatctcacggacaaattttggggtcgattatgggaagcggcattgatcgggatgtcatcggcgatattgtcaccgatggtttgaattggcaatttatgtgtgaatctgagatggccgattatgttcaatcacaagttgaccggatcggcaagatcaaaatcaagctgaaacaaattcagcctgaggagattattgtgccggttgatgaaggtgaagaattaacgacaaccgttgcttctttgcgggtcgacgcactcgttagtgaaggattccacatttcccgtcatcatgccaaggaattgatcgaaggcggcatgattcgaatcaattgggaagatgccaaccgaccggatcttgaaatttccattcaggatattatttcggttcgcggtttcggcagactagttgtgcaagatattgccggcatgactaaaaaaggcaagattcgaatcggattaaaagtatataatcgaaataaataggaggattgaatcattatggtattaagcccacaagatattcataacaaggaattttcgacaaaattacgaggttacaatgttgacgaggttaacgattttcttgaccaagtcatcaaggattatcagatcgttttgcaggagaacaaggatttgaactctcagctaaacgaagccaaggacaaactttcctactttaacgatttgaaagattctttgaaccagtcaattttagttgctcaagaagctgctgataaggttaaaaccaattcgaagaaggaagctgaaattaccagccgtgaagctcaaaaaaaggctgacgatattttgaacgctgctaacgaaaaagcggatgctgttcttgaagaagcatcaaaacgtgctaagaagttggcaattgagactgatgatttaaagaagaacacccgggtattccggcaacgacttcaagtcatgttggaaagccagctcgaagtcatcaaagggtctgactgggatcgcttggttgaagaaaagccaaccacaacttacgaagatatcgaaaaagttgttggtagccttgacaacatcgcaaacccaggggtacaatctgaaactaaacagagtaatggtgctgcagatgttgaagaaacaccggctactgtggatgattcaaaccagaccgtcgtgatttatccagatggtcgcacacaaaatgaataattaatcgattagagaaaagaaagttattggctgaaacaacagcgagctgaagatagtggaagttcagcagtcaccaaccggtaaatcgatcacctctagtacataaatcgattatctgaagagatagaattttaaattctaaaattgggtggtaccgcgaagacttcgtcccttgtgacggggtctttttttgtagagtgcgacaagagccgggtgatgcggtttctaagactactttggttaaaaccccgattttgggttttgaccaaagtagtcttagaagttagcatctgggtcatcggagcacatttcaactagtgtgggactcgctccgttaattgccgtgagtcgcgttttatcaataccgcccaaacttcatccaccaaccaaatttctcaacaccaacacatcatcactccactaaatatctccatgaaaggaagtccagcaatgcgggtaaaagatacattaaacttaggcaaaacaaagttcaaaatgcgtggtaatcttcctgttaaagaagtcgatcgtcaaaaggcttgggaagataacgatgtttatcaacaaagacaaaaattaaacgagggcaaaccaacatttgtccttcacgatgggcctccatatgccaatggtgacattcatatgggccatgcgttgaacaaaatttcaaaggatatcattgttcgatacaaatccatgacaggttaccgggccccttacgttccaggttgggatacccatggcctgccaattgaacaaaagttgacgcaagccggatatgaccggaagaagatgtcgaccaatgatttccgtaagttgtgtcgggattatgcgttgaaacaggttgaccgacaaaaagaagaattcaaacgtctgggtgtttcaggtgactgggacgatccttacctcactttgaagccagaatttgaagcccaagaagttcgcgtatttggcgcctttgctaagcgtggcttgatttacaaaggtaaaaagccagtctactggtcatggtcttcagagtctgccctcgctgaagccgaggttgaatatcatgacattacctcaccaaccgctttttatggtgaacacgtcgttgacggtaaaggtgtcttggatgacgatacctacatggtggtttggacgactacgccatggaccattcctgcttctgaaggaattaccgtggatgccggatttgattactcagttgttcagcccgaaggtgaaactcggaaatttgttatcgccactgagttggttgacaaagttgccgacctcattggctggacgaatgttaaaacgatcaagaccgttaaaggccaagaccttgaaggcattttggcagaacatccatttgatcatagtcgtaaattgttaacgatgttgggcgatttcgtggaccttgaagaaggaaccggattagtccataccgctcctggttatggtgaagatgactttaatatcggccgtcaatacggtttggatatttttgcaccagttgacgataaaggctacttgactaaagaatccggtgaagactttgccggcgttttctatgatgatgccaacaagattgccttggataaattaaaggacgctaagttgttgcttcactacatgccgttgaagcatagctatccatttgactggcggaccaaaaagccgatcatcttccgggcaacgcctcagtggtttgcatctgttgataagattaaagatgaaatcttaaaatcattggacgatgttcaattcttccctgattggggtaaggttcgactatccaacatgatcaaaaaccgtggcgactgggttatctcccgccagcgggtttggggtgtgccactgccaatcttctatggcgaagatggtgaagcaatcattactgaagagaccgttaaccacgtagctgatttgttcgaaaagtatggttctgacatttggtttgaaaaggatgccaaggacttattacctgatggtttcacaagtgagcattcaccaaacggaaagttcactaaagaaaatgacatcatggatgtttggtttgattcaggttcctcccaccaaggggtgcttgaagaacgtaaagagctgacttatccggctgatatgtaccttgaaggctcggaccagtaccgtggctggtttaactccagtttgattaccagtgtcgccgtttctggtaaagccccttacaagcaagtcgtttcccaaggatttacccttgatggcaatggccataagatgagtaagtcacttggtaacaccattgcaccaatcgatgtgattaagaagatgggggctgaaattgtccgcctgtgggttacctccgttgatacttcagctgacgtacgggtaagtaccgagaacttcgtcaaggtttctgattcttataagaagatccgaaacacgatgcgattcttgttggccaacacgtcagactttgatcccaaagaaaatacggttgcctttgacgacttggaatctcaagatcaatacatgttggtgctcttcaataaattcttagccgataccagaagctatatggaacgatatgacttcctggactggaacaagaaggttgttggatttattaccaatgatttgtccgcattctatctggatatcgccaaggacattgtctacattgacaagcaggacggtcacaaacgccgttcgatgcagacggtgatgtatgagattgccgttggcttaaccaagttaatgactccagtgttgcctcataccactgaagaaatttggggattcctccacgaacccgaagaatttgttcaattaaccgatattccggaacccaagaagtacgaccacgattctgaaatcctcgccaactggacgaaattccgaagctatcgtgatgacgttttgaaggttcttgaagaggctcgtgacgccaagaagattggtaagtcatccgaagccgctttgacgatttacgcaaccagtgaagtggctgacttgatgaacagtttgcagactgatttggcaactgttttgatggtttctcaattgacgatgaaggactttgccgatgcgcctgatgacagtaccaaatttgacagcgacggcttggcattatcagttaaacccgctgaaggcaagacctgtgaacgctgccgtttggttcgccaagatgttggtgcagacagtgactacccaaccttctgtcaatcctgtgcccaaattgtccgtgaccagttccctgaaaccgcaactgaaggttttgaggaaaagtaaagcggcctttgagacgttgatcgtttaaatttcatcaaaagctgttccaatcttcatgattaaacattaaaatgagactatgacttaaatgttgtagtcttatttttgtattttaattaattgaaatgtgctttggctcacagattgtgccaaacacctgggaggatattttgcttaaaggaaaaattaaaagttacaacccacaaaatgcatttggtttcattacccaagacagcggtgaagacgatctgttcttcttcaaaaatgcctttcctgaagatcaatacggcaccattcaagttggcaagccggtagaatacgttgtcgttgccggacaaaagggaccgcaagctgccaaggctcacgtgatcgaagattagccgtcttgattgcaatgacccggtattatttgtagaatgagagtattaactaaaaaaggtgatcgagttggactttgaagaaaaagtaattggcacagagaagatctacgatggcgcaattatcaacgttgaaaaacagacagttaagctgcctgacggacagacatcatttcgagaaattgtccaccattccggagcggtcgggatcttagccctcactcacgacaataaaattattcttgagaagcagtggcgggcaccggctaaaaagaccaccattgagattccggcgggaaaagtagacggacgggatgctaattttcacgataccgtcattcgggaattgaacgaagaaatccgttatgttcctaacaccgtcaaagaactctacggcttttattcctcagtcggcttttctgacgaatacatgaaattataccttgccgaaggattaaaacccgttgccaatcaattgccgcgggacaaaggtgaattccttgaagtgtttgaaaaaacgctggatgaagctgtggcaatgattgcggatggcgagattcaagatgcaaagaccattactgccattcaatattggcagttaatgcaaaagtaggtgaccatttaacttggcgatcgatgataatcacaaaaatgacggaaaaccgttaacgcgagaacagtaccgaaaattaaaattacagcaggaagcagactttgaggcccgcgacaaacggcgggttcaagtcgaacgcgaatatgcaagaaaacaccaacagccggtttccgaagcgacgcctgaacctcaggaaacgacgcgggcacatgaaaatcatccagaagatgacgatttcaaaacgccgcgttggcaccggattaaccgcaaactgaattggacaatcacaatcttaattttactgatggtgatcgtttttttagtgttgttttttgtaaattaaggagaatttgaatgacttacggaattatttgtgcaatggacgaagaactggcaatcttaaaagaagccttgtctggcgaagaaaccaagcattacggcaatgctgattattatttgggaacaattcacggccaaacactggtcatcgttaaatcggggattggtaaagttcaagccggcatcacgacctcaactctgatcaatgaatttcacgtggacgccgtgattaactcgggttcagccggtggcattggtgacggtttagcggttggtgacatcgttgtttcgaccgagacagcctatcatgacgtggatgtcaccacttccggttacaaaatgggccagctgcccggctttcccgcccgctttaaagcctcggaggaactcgctgacaagattgtcaaagcggcccaacaaagtggcgtgactgcccacaaggggttaattgtttccggtgaccaatttattgccgattcaagcaaaattgcccaaatcaagcataattttcccgatgccttgtgttctgaaatggaaggggcagctgttggccaagtggcctatcaaaacaaagtaccatatgccgttattcgggcaatgtctgacgttggtgatgaagaggcggaagtcagttttgacaaatttatcatcacggccggtaagaagtccggtcagatgttgattgacctctttaagaacgagtgactttaaggagtgaaaataatgaaagagatatatcttgataatgctgcaaccacaccggtttcggatgaagtgtacacagaattaatggataagtataaaaatatttacggcaatgcttccacgctttacggcttggggagagaatccaaagccgtcatggagaatgcccgggatgtgattgctaaaagcattaacgctgatcctgacgacatcgtctttaccagcggcggttctgaaagcgacaatacggcgattacccaaactgcgattgcccgcaagtcactgggcaatcacattatcacaaccgccattgagcacgaagccgttatcaggccgtgtgaggccttggagaaaannnnnnnnnnnnntcatgactggaaacaatgaggttggttcagttatgccaattcatgaaattggtgaaatcttgaaggaccatcaggcttggttccatacggatgctgtgcaggcatatggtctgttggatatcgatgttcaacgtgaccatattgatatgctgtcgacatcggcacacaagattaacggtcctaagatgattggttttctctaccggcgtaaaggggtgaatttccccagtttgattaagggcggcgaccaagaggaaaagcggcgtgccgggactgagaatgttcctgcaattgccggatttgccaaggcggtccaaacaatcacaccagaagagaaggcgcaccgccaagccaagtatttgaaatttaagtattatatcgccgataaattgaagcaaaacggagtcgagttcgaggtcaacggtcgaatcaccgaggataatttgaaccacgtcttcaatatctggctcaaaggcatctcgacttacgtgatgcaaactaatctggatctggcaggaattgcggtttccggcggatcagcatgtacggctggtagtatcgagccatcgcacgttttggtggcaatgtacggcaaggatagcccaagaattagtgagtcgattagaatcagttttgggcgttacaatacgactgaggacctggataagttggtagatgcaattaccaagattgttaatcgggtcaaaaccaagggggtaaagatgtaatggcattcgcaaaaacaggtaaggttaacggtgatgatacggtgtatgaactaagggataacgttaaacggttcacactgcgtgatttgggctttattgagggcaagaccggtgtcttttcactggaaaagtcattggacccaacgtcgccgtataatgccaattataaattcaaaatgaaggttgataaggatctaagtggttttagaatggcgatcaccacgggaaatggtctggaaaaagtcaacatcttcaagaatccggatacccaaccaagtgttgagcaatatcaatttattattaacgatttgattgatagagatgtgctaaaaagaagagtgtgacgagagccgggtgacccggtttctaaggccgttccactttaaaccctggttctgggtttgaagtggagcggccttagaatttagggtcaggctcgccggagcacgtttgatgagagtgtgagccaagctggttagcctccgagcattaggtgaataaacaggtttgacgctgcctttgcgtcggacctgtttatttggctaagcggaggaggctggcttggagaacacatttcaagaagagtgtgacgagacccggttagggcccggaacataagtgattaaggtcaatgacgaacgctttttgttcgtcgttggccttaattgcttatgtggtagggccctgggtctcggaacacgtttcagctgagtaacagtgaactaaacactatatgggaggaaaaggccaaccaccaatttaaacaagtaattgtacatcacaatcaaacaaacccaatttgcaacattcaatcgttgggcccgggcaaaactaatccttttgcctgggcctttttacagtctgccattctacctagtcgaatcttgcccccatcagcagcttccggccatataagcgggggacaccaaatatccaagccctggatatttggtgtcccccacttatcctctggaagctaaccgctgattgaggcacactgtttttttccaagattaacattgacacgtccacgtaaaagcgataaattagattataattaagatatgatgataaacggataagtgatgatcttatgaacaactcgtgtttcacgttcgtctgatgatttcttacatatctgaattgtagaaaccatacttagttacaacgcttatcacctgcttaatcaatattttaaggaggacacatatacatggcaaaacaaaagttagaagatttagattggaccaaccttggattcgcctatcgtgatttaccatacagttacaacgaggaatttaaggatggcaagtggcaaaacggcgggttaaccaccgactcaacactgactttcaacgaagctgctgaagatttgcattatggtcaggaagtttttgaagggatgaaagcctatcgtaccaaggacggccgaattcaacttttccgtcctgacatgaacgccaagcgctttacgaattctgccaaacgtttggtaatggaaccatatcccgaagacaaatttgttgaagctgttaaagaagttgttaaagccaacgctgattttgtgccaccttatggttcgggcggctcgctttacatccgtccgttcatggttggaaccgaaccactggttggcgtttcaccgtcgtcaacttacaccttccacatctacgccaccccggttggtgcatacattaaaggccttcatccaatgccatacatggtcagcaaatacgaccgggctgcttacgctggtaccggtcaggctaagactgccggtaactatgccggaagtttgttagcagctaaggaagctaaagataacggctttgccggcgaactttatttggatcctcgtcaacataaatacgttgatgaatttggcggtgccaacttctatgcaattggcaaggacggcaagttctacacaccaaaatctcattcaatcctgccgtcaattaccaagaaatcaattctgcaaattgccaaagacttaggattagatccttctgaaaccaacatcgacgtcaatgacttggatgaatacaccgaagccggtgctatgggaaccgctgcggttatttcaccggttggctcattaaccaacaatggtaaaaagcacgtcttttacagtgaaaccgagccgggacccattacacaaaaactttatgatacattatttgggattcaatcaggtgatgttgaagataaatacggctgggttgttccggttgaataataaaaaaagttggccgtcgcacctcgcgacgccaactttttttgaccgccgaatcccttggaaagtgtttgacattttttctggcaaacattagaatattagaaaatggttagaccgatgacaactatttactacatatcctcaggagggacactatggcaaaagcaaaaccggcaacagaaattgattgggaaaacttaggcttcgattatatggacttaccgtatcggttcttagcgcattatcaggatggtcagtgggatgaaggtcaactcactgaagatggtactttacacatcagtgagggctcgactgggcttcattacggtcaggctgattttgaaggcttgaaggcttatcggactaaggacggcagtattaatttgttcaggccggatcaaaacgccaaacggatgactaaatcctgtgcccgtttattgatgccggcatttccggaagataaatttgtggcagcggttaaaaaagtggtcgctgccaatgccgactatgtgccaccatacggaactggcggaaccctttacttgcgtccgctgatgattggtgttggtggtaacatcggcgttcatcctgctgacgaatacatcttcacgatttttgccatgccggttggggcttactacaagggcggtctgaagccaaccaatttcacgacttcatactatgatcgggctgctcctcatggaaccggtcaaagcaaggttggtggcaactacggcggcagtttgctgcctggtgaccaagctcacaaagccgggtattctgacgtgatttatttggacccggcaacccataccaagattgaagaggcggggtcagccaacttctttggaattaccgcagacaatgagtttgtcacacccaaatcagattcgattttgccaagtatcactaaatattcgctgttgtatctggcggaacaccgacttgggttaaaggccgttgaaggtgacgtcttcattgacgatttagatcgattcgaagaggccggtgccatgggaacggccgcggtgattgcaccgattggcgggattgaatataaggacaacttgcatgtcttttatagtgaaacagaagttgcaccgattactaagaaactctacaacgaattaaccggcattcagtttggggatgtggaagccccagaaggttggattcaaaaagtcgaggtttaatcgattaacaaatgattgcaccagaaaagcgggctgggacaaaacgaacggttttgcccagcccttcgtgttttaattggtgatccccggcccgtcaggttagtcgattgtctatgaaaggatggtcattgtgatcaaacgagaaggtcattcccacacagaattttgtcctcatggaagtggggatgatgtggaattaatgattcaaaaagcgatcaagctgggttttcaagaatacagtattaccgaacatgccccgttgcctgatggattggccgataagtatgccgggaaaacaaccgggctgactgaggcttcaatggcggccactgatttggacgcttattttcaaaaagccaaccaaatgaaagccaagtatgcagaccaaatcaaaatcaatattggatttgaggttgacttcctgcctgactttgtcgattggactcgcgactttttgaacgaatacggcccgcagacaactgataatattttgtcggttcacttcatgcaaggagcaaacgataaattctggtgtgtcgatgatactgtgggagatttccaggccggattgttgaatcaatgtcccgactcacaagtcctatatgaacattattttcaaaccgttctggcctccgtgaatgctgacttgggtccatacactcccaaccggattggccacatgactttgattaaaaaattccaagattattttggcttggatcgtcacttttctgaagacaatctaagactggttgatcaaattctcaaggcggttagcggccaacaccgtgaactggatttgaacgctgccgggttgtacaagccttactgtaatgaacagtacccgtcatattcagttatccagatggcaaaatcgttaaacatcccatttgtttatggcagtgatgcccatagtattgccgaagtcggtcagggttataatggcgtgatttcattagttgaataaatcgcttgacaatcgatggtttggtgataatatatgaaactaaataaagtaaaagttaatataataaagttttgattagaaaaagtaactagtagtaatttaaaagagagtgccattgctgagaaggcacattttacgctggcgaacacacatctatgaactaatcggttgaaccaagtaggccggttcgcatgtttagcgttatcagggttaccgtatctgttatcagaggatgactagatattggcaacgtaaggccgactactgtgaggtagcggcaaattgaggtggaaccacgactttaaggcgtcctcgaagactgaatacagttttcggggactttttttatcgaaataggaagtgacagttatgaaaaataagaatttaccaagcggcacccgtgacgaatttggcacggaagcggaagtcaaagaaacgattcaaaataaactttttcagggctttcggcggcggggatttcgtaagttaaccaccccggttttagaatattcagatgtttttcaacctctgaatgccgaaaattatcgtccctaccaattattggacgagcaaggcgaaccactggttttacggcccgatttgaccctcccggttgcccgagtcatgagtacgaccggcattgagctgccagtgaaatggtattacggcggcgacgttttccgagtgaagaagcagttatccggaagttataaccaattaactcaggccggaattgaaattgttgggtacaagggcttgaaagccgattgggagtgtctggaagttgctttagcaggatgtcgggacatggccatcgaaaatgtcacgattgaactgagtcacgccaagtttgttgatgtgctgattgatcagctggatttgccggaacccaccaaagctggtttgaagcaagcgttgttcgccaaagatctcagcaagtacaaccaactcgcacagccactggcagaaacaccgttttcatcgttcatcaatgaatggccgtggttgtttggcaattttgatgaggtgatgaaagtcgttgataccttaccgccgattgaggagctgaagggaatcgttaatcacttaaagtcaacggcggccttcatccaacagttattccccaaagtcaacgtcaccttggacttaagcattccttctccacagagctattacaccggcatggcctttcgcggctttaccgataaatcctcaggctatttattcagtggtggtcgctacgatgacttattaaccaatttccaaaatgtcaaaacgtctgccgtgggagtggcattcgatgtcgatgccttggtcgaacggactagcttcccagacgacacaccgaccacgttgatcttctttgaggatgaccaatggcaggaggcagaagcggctttatccaagttcgccaatgcgaccctctgtctgaccgacgattttgaagatgccaaacggctggcagccagcaccaatagtcaactcattgatttaacaaaagcaggtgaaaaatgatggaacgaattaaaattgcccttactaaaggccgaaccgaagatcaagtggtcccgttactcgaagcagctgggattaactgcgaggggattcgcaacaagcaacggcggctgattttcgatgaagatccccgttacgaaattatcttggttaagggcccggacgtcctcacataccttaacagtggttcggttcaaatcgggatcgttggcagcgacatcctggccgaacaggaaaatttccaatacgcaatgttggatctcaatgtcggcaagtgccggtttgtcttggcatcaaccaaagatttcaatccccaggcccatcggcgaaaaataattgccaccaaatatcccaacattaccaaacgttatttccaagggattggcgaagacgttgaaatcatcaaaattgaagggtcagttgaactggcgccattgattggcttggccgatgcgattgtcgatattgtcgaaactggcaacaccctgcgtgaaaacaatctccaagtcttcgcaaaactacagccggtcaacaccaaagtcgtggttaatcgattggcacttcgccagtatcaacctcaaatcaaaagcttaattgccagccttgccaaggccgacgatcaactgatccaatccaaattaattaaggagtgagtaaaatgcgaacagcaacgatttctcgcaacacaaatgaaacccaaattgaattaagtctcaacttggatgactattcaaagattcaaattgataccggaattggctttttcaatcatatgctggatgcatttgcccgccacggccgcttcgggttggtggtcaaagccaaaggagatttagatgttgacccgcatcacaccacagaagacgttgggattgctttgggactggcactcaaacaggcgttaggcgataaagcaggcatcgaacgatttggctccgccttaattccgcttgatgaaactctcagtcgagtggttatcgatttgtccggccggtcttatctggtatttaaagccgaatttgccaacgatcacctgggcggctacgataccgaagtcaccgaagacttcttccaagccttcgccttcaacgctgaaatgaatcttcacgcagaagttttatatggcagaaatacccaccataaaattgaaacacttttcaaggcactgggcagatcccttcgagcagctgtgaccatcaatccagaaatcaaggggattccgtcgactaagggggttatctaatgatcacaattattgattacgacactggcaatacccgcaacgttaaaaacgccttggacttcttgggcgtttccaatcaattatctgccgatcccagtgagatcttgacggctgatgggttgattctacctggtgtcggcgcctttaaaaaagccatggattctttaaatgaacgtggcctggttccagtgattcaacaggctgccgatgcagaaatcccaattttagggatttgcctgggaatgcagatcttgtttgataaaagttatgaatttggtgaatcgaccggcctggggttaattgccggcgaagtggtgccgattcctgagaatttgggggtcaaggtccctcacatgggctgggatcaaaaccagtctcagcagaccgatgcacttggagatgggtttgacggtcagttcagttactttgttcattcctactacgttcaaacggcggctgaaaacattgtttcgacagtcgattatggcgtccagattccaagtatcgtgcgaaaagacaatgttattggttttcaatttcatcctgaaaagagtggtgaagttggactgaacggtttggcaaaattcaaggagatggttgaaaatgcagattattcccgcaattgacttaaagaatcaacaaagtgtccggctttaccagggtgatttccagcagacaaccgttattagcaagtcgcccttacaacaggcattggcaatcgattctgccggcttaaaaaatttgcatctcgttgacttggatggcgccaagtcaggacggccggtcaaccggtccctgatcgaacaaatttgcgcccaaactgatctcaaagttgaagttggcggcggaatccgctcactctcccaaattaatacttacctcacatcaggcgttaaccgcgtgattctggggtcagcagccctgaacaaccccaagttggtgcagcaggccatcgaacaatttggtgccgatcaaatcgttgtcggcattgacggcaaagatggtcgggtggccgtttcgggttggctggaacaaagttccgtggaaatgggtgaactgatggcttcaatggtggcctttggggtcaataccttcgtggtaactgatatttcccgggatgggacgatgactggtcccaataccgctcagctcagcagtctgcaggccaaattccctcaagtcaccgtggtggcttccggtggcatccgtaacgtttccgatcttgaggatttgcaaaccgctgggattaaggccgcaattgtcggtaaagcaatggctacgagtgatttgccgctcgatgtcttggcggaggtgaataccagtgttagctaaacgaattattccttgtttggatgttgaccacggccgagtgaagaaaggcgtcaacttcgtcaatttacaagatgttggcgatccaaccgagattgcggctgcctatcagcagcaaggtgccgatgagctggtgtttctggatatcaccgcgaccaatgagaagcgtaaggcgattgttgagaccattgaaaaagtcgccagccaagtcttcatgccgctgacagttggtggtggcatccacagcgtcgacgatatgcaaaatctgctgaaagccggcgccgataagacagccgttaattcagccgctgtcagcaacccccaattaatcacggccggagctgaaaaatttggcgctcaatgcgttgtgttagccattgatgccaaatggaatccagaatccgggcagtatgatgtctacgtcaacggcggccgtcaacgcacgaatttaaatgcgattgagtgggccaaaaaaggggttgcgctcggagccggtgaactcttagttaccagcatggataaagacggcaccaagagtggttatgatattaacctgtacaaacagctaaccgctgccgtgaacgtaccggtgattgcttctggtggctgtgggcaactgggtgactttgctgaagtctttgaccaagcagatgttgacggtgctttggcagcctcggtctttcactttggtgaactgacgattgctgatgtgaaaactgatttacgcaaagacggggtgatcgtacgatgaaacctgattttgaaaaatattcagatggcctggtaccgacaattgtgattgatgacaataccaaacaagtgttgatgatggcctatgttaatgaagaaagtttcaatttgagtatgcaaaccagacaatcctggttttggtcccggagtcgtcaagaattgtggcacaagggcgaaaccagtggcaatacgcaaaaaatcgtgtcaatcgatatcgactgtgatgaagatactttattgatgaaagtgattccggccggaccggcatgtcataccgggcacaccagctgcttttaccggaccattttaccggaaccaaccaaggaggaataatatatgcaagatttagacgaactttatcaattaattctggaacgcaaaaacaaccccgagaagggctcatacaccgattatttatttaccaagggtctcgataagatcctgaaaaaagtgggtgaagaagcaaccgaagtggttgtggctgcgaagaatccgtccgatcccgactttattttggaagttgccgatttggcctaccatgtcgaagttctgatggcccaacgcggaattacccccgaccagattaagcaggagcttgccagccgtgaaggcaaaaaaagcatcaccaaggatcgtaaacaaattaaggagtggtaggaatggtcaaagaagccgtcaaaaatctgaaaccgtacgttcctgaactcactttggaacagctgaagaagcaaaaggggctggataagttagtcagaatgtccgccaatgaaaacgcctatggcacatctgccgatgtggccaaggcactggacaagtggcactatcgcgatgccaatctgtatcccgacagtaacgctgatgagctgcgggaaattattgcttcccagtttgatatcaacgccgacaagctcatctttggcaatggcttggatgaaattatcgaattgctgtcgcgggtgattcttgaacccggggatgaagttttggatccggcaccaactttttcagaatatgcactccatgcagaaattgagggtgccaagattaaatcggttgggttggacgactccggccggattgatttaaaagcaatggcccgctcaatttcttccaagaccaaaatgatctggatttgtaatcccaacaatcctaccggaacttttctggaggctgatgccatccgggcatttgtcgaagatgttcctgaagcgattacagtaattgttgacgaagcctacattgattttaccggcggcatccatgactcggtcatccagttgaccaaggaatttaagaacctggtggttttgcggacattttccaaggcttatggtttagccaatttcagggtgggctttgccgtttgctcagacccattaattggctatctgcaagcagcgaggttaccgtacaacctgagcacctttgctgaaattgcggcaaccgcggcctttaaagaccagtcattcgtcgacaataccgtcaaaaaagtgattgccgaacgcaaaaaatgggaacatttcttaatcaaagccggcttgccgttttatgattcggcaaccaactttattttcttccaagtgaagggtggggatgctgatgcgcttcatgaatatttgttggaaaatggttatctacttcggaacggtttacgcaaggactggctgcgagttaccatcggcagaccggaagacaatcaagccgttcaaaaattgattgccgattatcttgcttaaacatttacttacaaaaagtagcattcatttcgagaatgcgttaatattagttttactggaaattacgaccttcaactcgtggattctccagaatctaattgaaatgatggtggttttatgcaagacaacagtcaaacacgtgttgttgttggaatgagtggtggtgtcgactcctcagtcgtcgcttatctgctcaaacaacaaggatacgatgtgattggcgttttcatgaagaactgggatgatactgatgaaaacggcgtatgtactgcaactgaagactataaagacgttgctaaagtcgctaacaagatcggcatcccatattattctgtcaactttgagaaggagtattgggaccgcgtgttcacttacttcttggacgagtataaaaagggcagaacccccgatcctgacgtgatttgtaataaggaaatcaaattcaaagccttcttggattacgctttggaattgggtgccgattacattgcaaccgggcattacgcccaattaacccgtgatgcagacggtcacaatcatttgctgcgggcatccgatggcaacaaggaccagacctacttcttgagccaactttcagctgaccagctggaccgggttatgtttccaattggtaacctggttaagccggatgttcgaaagattgcccgcgaggccggcttggcaactgccgacaagaaagactccgttggtatttgctttatcggcgagaagaacttcaagaacttcttaggccactatctgccagcaactcccggcaagatgatgaccgttgacggtaaagttaagggtcaacacgatggcttgatgtattacaccatcggccagcgccgcggacttggaattggtggcgatggtgttgataaccagccatggttcgttgtcggcaaagatttaaagcaaaatattttatacgtgggcaagggttatcacaatccattgttgtatgccgattaccttgaggcttcagatattcactgggttaataacttggaccgcggcaaggacttccactgcaccgctaagttccgttatcgtcaaaaagataccggcgtgaccgttcatatcagtgatgacggccagtcggttcgcgttgattttgacgcaccggttcgtgcaattacaccgggacaagccgttgtcttctatgatggcgacgagtgcctcggctctgcgattattgatgcggcttacaagcaggctaaggaattacaatatgtttaatctgaaaaagttgacgattgccgtcaactttttttgtggacagattgcgcttgtcagaaaatacaactgtgactcctggataatcgttatcatcagttgttacttttagttgagctttaaaaataaaaacaaatttttcattataaatttcgttaggcttttgaaatcaaaccgttttcctgtcataatgtaagaagctaacagcagtttggaggaatgtcatttgactaagttgtactttgttcgccacgggaaaaccgaatggaatcttgaaagccgttaccagggtgccggcggcgattctccgctgctggctcagagttatacggaaatggatctgttaggcaaacattttcagaaaaccgattttgcccacgtttattccagtccgatcaagcgtgctcgggtgacggcggctcgaattgaccgcaaattaaagagccatccggatatttcactcttatccaggttggaagaatttcacttggggaaaatggaaggtcaaaagtttgccgatgttgagcaggcttatcccgaagagtttgaggacttccgcaaccatcccgatttgtacgatccaaaggccatcggtggggaaagttacttggatgtgattaaccgcatgacgccggcaatcacttcaatcgttaaggcctacccgggtcaaaatgtgatgatcgtcagtcacggggctgcgcttaacgctgagatcaatgcgttgctgggtgtgggactgcccaatttacgaaaacgcggcggcctggcaaacaccagcacgacgattttggaaagcacagatgaaggacaatcctatcaactgattgattggaacgacaccagttatttgaacaaaaaattagacccgacagatttggtataggtgacaatatggcaaataattcagataaaattaaaaaattacaagcaaaaaatcaagaaaatcagcgtaaatatactaggaagcgcgaggctgaagaggcgaaagccaaagccacgatccataagctagttgaaaaagtggatcacgaacccaacaattatcacaattactatgatttagccacgttcctggtcgaagctaaagattacgagcaggctgaagagcttttaatgaaggccctcggcttatttgacaaggccagccaagccgtcaaagatactttgaaatttggccttggaaatgtctactatgccgccgcagaatacgataaagcaattaaaatcttccaagaaatcgaagacaaaaagctgcaggccgaatcttacatcatgctggcccaaagctatatggccaagggtgacaataagcgggcgatggtctttgctttatctgctcaaagtgctcgccacgatgaccctgacgtcaaccaaatgattggggacaatctcttggccctgggcaactttgctcaagcgggggacttctacgatattgtcttgaaaacagagcctgaaaacggcaaagccaactttaatcgcggcctggttgccatggtgaatggcgaagattttgaaaactattttgcaaaagccaagcaggctgatccggtttattttgaaaagggtcaacaaaagttgaaagatattgaaaaagtgatccagatcaacaaagacaagccgaagaagtaaatgtcagcatgagtaaggaggaccgtcttggaccattcaatagatttatttggctcagaacagaataatcacgaaccacaatatgtcgatggccgattaaaggcgatcttcttttcgagtaatgacagtttttataaagtcgtcttagttgaaattacggagaccaatgtcaattggccggaagacgaaatcgtcgtcaccgggaactttggcgatttggttgaagaaaacagctatcatttcaccggaaaactggtcgatcatccccgttatggcaagcaatttcaagccagcaactacaccagtgtgatcgccactaccagagaaggggtcgtcaagtatttatcaggcgatcagttccccggcattggtaagaagactgccgaacgggtggtggatgttcttggcgatgatgcgattgaaaagattaccgcggataaccgtgttttggatgatgttcccattagcgccaaactgcgatcggcaattattgaaaatcttgatgccgatgataacttggaaaagaccattgttggactgaacagctatggtttttcgagtgcgattgcttcggccatttaccaaaaatatcatgaagatgctttgaaaatcatttctgataatccctaccaattggttgaagacattgacggcatcagcttcaagaaagccgatgccattgcccttcgattggggattgtgccggattccaacgaacggattcgggccggattgatgtatgcgattgatgaattatgccttcaaaatggggatacatatacgacgacggccccattgattcaaactgcctcgagccttctggaggggaatgcccagcagcagattcctggaaaaaaattggccgagagtttggttgagctggctaaagaaggcaaggttgtcggtgaagaagaccgcatttatttaacccggctttacaatgccgaagttcaaattgccgatcatttgaaccgggtaatcaaaaatcaggatgatgaagatcagctcaaagaagatgcgatcaaaaagcaattgcgagtcgttgagaagcagttcgatattaattatgatgattcccaagttgccgcgattgtccaagcgatccagtcaccggcatttattttaaccggtggcccgggaaccggaaaaaccaccattatcaacggcattgtcaacacatttgcccgactacatgagtattcactggatattaattcctataaagacaaaccgtttccaatcgtgttggccgcaccaaccggtcgagccgccaagcacatgactgaatccactgggttgccagccagtaccattcatcgactgcttggtttgaacggccgtgagtccaatgacaccactggtaccaaggatattgaaggtgccctattaatcattgatgagatgtcgatggttgatacttacttgttcaggtcgttagttcgggcaattcccaaccatatgcaggtggttttggttggtgaccaggatcaattaccatcagtgggaccaggccaggtattccacgatttgctggtttctaagcagattccggccatgcagctgaatacaatttaccgccaggagaagggctcatcgattatccaattggctcacgatattcatcgggggcagctgtcggaaaatttcactcagaaccaatccgaccgctcgtttatcccgtgcaacgaataccagatctcttcggtcattgaacaggtcactaaacgtgccaagcaaaaagacttcggcttgatggacgtccaggttctggcaccgatgtatcgcggtcgagccggaattgacaggctaaatgacgtggttcaagacgtttggcagggtgatccaactggtaaaaagtcggttacgatcagagaacacacttatcgaattggcgacaaagtgctccagctggttaataaccctgaaaataacgtcttcaatggcgacattgggatcattgtggggatggacgcccctaaaggacagcaagtccccaataagattacgattgattttgatgagaccgaagtgacctatgagaaaaatgagtggacccaattcaccttggcttactgcacttcgattcataaagctcagggtagtgaattcaagatggtgattttaccaatcgttcgccagttctcccggatgcttcagcgcaacttactgtatacggccgtgacccgggccagcgactttttgattatgctgggtgaaaaagaggcctttgagcaatgtgtccgcaacgtgtcggttaaccggcagaccagtttggtcaaacggctggtcgacgcaattggcattcagccgcaatcaaaaggcacggacagagagccggaagctgaggatcaaaagcaattgccgactgacacgcaaccagcccaagagactgatgatgctaaggccgataatctgcccgatcatttaaccacagcggttatcaatcaaaatctgattgacccgatgattggcatgggggatgtcactccccgcgatttcttgaagtcataggtttatcagtgaattcttaacaagttcaggccgaaattatggtagaatttaaataaataggtaaagaagaatacttggaggaaatcatggccgaatcaaaaacgcatcccaatcttaaattattttctttgaattccaaccgccacttggctgaggaaattagtaaagcagtcggtgtgccgcttggcaagtcaacagttgaaaagtttagcgatgacgaaattaaaattagcgtcgatgagagtattcgcggcgatgaagtttacatcatccaatccgtttctgatcccgttaattctaatttgatggaattattgattatggtggatgccgttcgtcgggcaagtgccaagtcaatcaacgtagtgattccttattatggctattcacgtgccgatcggaaagcgcgctccagagaaccaattactgccaaattagtcgcttccttcttagagatggacggcgttgatcgcgtggttgcccttgatctgcatgctgatcagatccaaggcttcttcaacattcctgttgaccatttgaaggcggatacgctgctggcagactactttgttaaaacccacaagagttccgatgttgttgtcgtttcaccggaccataccggtgtttcgcgagcacgaaaattcgctgaacttctgagtgcaccaattgcgattattgacaaccggtcgccggaagatgccaccacggttcccgaatcagttatcgggaacgtgaagggcaaacgggcgattattgtcgacgacatgatcgatacggcatttaaattgacaattgctgccgaaaccttaaaaaaggccggcgcaaccgatgtctttgcgattgcaacccacgctgtcttttcaggggatgcccaacagcggcttcaggattcacccatcaagaaggttattgtgacagattcaattagtatttccaaagctgaccaatttgaaaaactggaagtggtttccgtgggtcaattatttggtgaagccattaacttgattcataatcacaaatcggttggtaagctgtttggaagataaaatattttacgaggtggtttaatttatgtataaggcaaatgacgatcgttatgaaaacgcagtggtacgcagagctgggaattccgggctccaactgccggcactatcattcggattgtggcatagctttggcgatgacgccaactatggcgacagcgagaaagtcattttgaaggcctttgatttaggaatctttagctttgataatgcttataattacggcccaagtgccggcgctgctgagcggatgttcggtgaagtttaccgtgccaacctcaagccgtaccgcgatgagctggtgattaccactaaagccgggtttaatatgtggcccggaccttatgggaacttctcatcaaagaaaaccttggttaatgcgcttgacggcagtttgaagcggatgggcttggactatgtggatatctattacagccaccggtttgatcccaataccagccttgaagaaactgctgaggccttggatgagatcgttcgttccggaaaggcgctctacattgggatctccaactacaatgccgcccaaaccgctgaaattatcaaatatttcaaggaactccatacaccattcgttgtgaaccaggcatcgtataatatgctcaaccgcggtatcgaagaagatggtctgctggatacattgagccaaaataataaggcgctggtcgcatacggaccattggctgaaggcctcttgaccgacaagtatttagacggaatgggtgatgacgttaagattcactggagtaatgaatttgtcatcaaacatggtaaagacgagttggtgaagaaattaaatgagctcaatgacattgccaagaaccggaaccaaaatctggctcagatgtcattagcttggctcttgcacgatccaacggttgtcagcgtggttactggggcctcgaagattaatcatctggaagataacctgaaagcactcaacaatcttgactttacgtccgatgaattagctcagattgataaaatcgttaaagaataattattaggttgttcatacatgtttgaaataagcattaaattgggattaaaccggtttaatgctttttatttggtataatctaatcaaagacatttgcccgtgaatggagaataattatgacaaagaaagtgacaattactgatttagccgctcgtgcccaggtctcagtgacaacggtttcacaaattctcaatggtaaggctgcccgttttagcagtaagaccgttgagaaagttaagcagttgcaaaaggaaatgggttacgttcccgactttaacgcgcaaagcttgattcgtaaaagcggtcggacaatcggtgtgatcatccccaacatgaataaccctttctttagcagagttttacttggcattgagactgaggcaattaagcaggactatgtgccccttatttttggctctaacaacagtcagtcacaagagacgcactatctcttcgaatctgttcgaagggccgcagacggcatgataatcgcttcagcggtgtccgacattaattatattgataatatcttgaatcaaaacggcattccctatattttaattgaccaggcaccggtggttaagggtgatcgggttgatgccaataatcaaaagggtggggctttactagccgattatttaatcaagaatggtcatactgatgtcgcggttgtctgtgccaccaaaccaaccctcaatcttcaggaacggctggctggatttgtggaaacctacaaaaacaacggcaccccaattcctgaagaccgaattattacgactgagatgaccaaaaaagggggttacgctgctacgaaagcagcgttagccaccaagccaactgcgatttttgggatcaatgacgaggttgccattggggtctatcgtgggcttgaagaagccggcttgaaaattccaagtgacatttcggtggttggatatgatgacattgatttgggagagtacatttcccccaaactcacaactgttcatcagcctgcttttgaaatgggaaccaacgccgctcaaatgatcatcaagcgaattgaagaccataatgagccaatccaacaggtttccctgccggtatccttggtagaaagagatagtgtccgggcaattaactaactgggatagttgttaaatttcaggaaatttgatagaatttggttaaaggttttaacacactatactaagggatttagaggagcttattatgacaaataaagtggttgtgctcggaagtctaaacgttgatacaacattgcacattgaccaaatgccaaaaccgggggaaacgattagtgccaagagtaaaaccaattccgctggcggtaaaggggccaatcaagcagtcgcagctgcccgttccggtgctcagacgagttttattgggcaagtgggtgatgatagcaacggcatctttatgatcgatgctttgaaacttgacggcattaataccgatcatgtgggtatcaatcaggttgatgggaccggttctgcggtcattcttctggacagccagggtcaaaacagcatcatggtttatggtggggccaaccaagccatgaaaactgaagtcattgccgacagccaagccctgattaaaagtgccgatattttaatttccgaatttgaaacaccgcaggaagtgacctacgaagcgttcaagttggccaaacaacacggcgtgaccacgattttaaatccggcaccggcttcaaaaatcatttacgggttgctcgaagtcaccgatttaattgttcccaacgaaaccgaaagtgccacattgaccggtatcgaagtcaacgatactgattcaatggatcaaaacgccgctaaattcagcgagatgggtatcgacaacttgatcattactgtgggcgatcgcggcgcgtactatcatactccaagtgacagtgggtttgtgccggcgttcaaagttaaggcaaaagacaccacggcagctggtgacacatttattggggctttcagttcacaaattgacaaagatttatccaatattgaagccgctttggtttacgctcaaaaggcctcatccattacagttcaacgtttaggggccttaccttccattcccacggccgaagaaatcaaagcagaatacaaataaaaattatcttaagtattagtttaatttttcttccaaactgttttgcgagtagggtgttgctttctcgaattttatctggtagtatatccagacgttagcaggaaatgttaaaaaattgataacattcccacgttagaaatcaggattgacgattcgaaattcaaatttcatgttcaaaggagtttatagctatgagtaataagttagaaattctgagagaataccaaaaggcatcctcgaagcttgatcaattaaagtccgaagaagcagacaagatcaagtctaccccagtgaatacgagttctaccgaagtaatcacaccacagtttggcaacgaaatgacgcatttgaatgaagaatgcatgcagttaaacatgatcttagaagcaatggatgcttcggaagactaggtcgtgtgaacgcgggatcgtctattgacggtgccgtttttttgttacaatccagtgcccaactggtctacggaaagccaaaacaagagcgtgggccaataagcggttagcttccagagtataaggggattacccgaatatccagaacttggatgtttgggtaatccccttatatggccggaagctgcttattggcgcacagttctgctagataacattcaggcgcaaaacgaggctggaacaaaatttttagttttgtcccagcctcttgttttggccttcagtttttattttttgaattttaatgggcaacagccaatcggcctcaaaaattgtctgatagtaacgccactgacaccgcacttttaatctgatttcttccctggagctttgacagccagttttcagggaacgtcaccggcgcaaagagtagtgatgccagcatggaagtaattgaaccgatagtatcggcgttactgccaagattgacagcctttgacacggcaacgttatattgttccgaattcatcaggcaccagaaaacggcgttgagggtggcgatcacatcgctggagggccttaacttcgtactcgactgtcggaggaagtgagactcctctaattgctcaaaaaacggcacctgagcggcgaattgatcttttgagcggtaatagtccagggattccttaacggctcttagcatggcgtatttgttgggattttgaatcaggcgaataatgacgttggttaaaacgccggaaccaataaatgtcttgggggttcggttggtggtagccgtgtaatcatgaaccatgtcggcaacggtttcattaaaggtgtactgctggttcttcgttaaaatataaaaggctaacggcatcaaccgtttaagggcagtattgtcattgtctgaatccaaagtgccgccggacaaaaccggtggggtgccggtatcaaagcgttggatggctgctttggtggtctcatcaacgtcgtatgcataattaaagggcgtgtaatcaccaaaatggacccattgcgaataacgtgtcatgaggtcataaagattatatccaaacgttaagctaactaaagaagcaattgatagtgatgtatcatcagaccaagtgccggctgggatttgattcgtccggtgttcgaccatctcatggattggatcatcgaaggggttcaggcgggtatcgtgttgaatcggatatccaagcgcgtcacccagggcaactgctgttaatgattgaaataaaaggtagctggtggaatacatagaattacctcgtcgttagtttttcgcggtactgaaacttaccgaatccagaagggatatttaaccgtgtcaagcttcaggttaaaagtccgctcgccaagttcttcgccatcgatttgacccaaacgattaccatttgtttttataaacagctctttttcatgataatgatgaataaatttaagccgtaagtgtctctttaaaaatatcatagatacaaataaaatcaattgccaaaggctgggtttttcgaccactactaaatccagatggtcgtcgaacactgatgcgctgggcatgatgttgatgcctccgccgaaataaggaatatctgttgtggttaataaaaatgtgttatcgaatgtgactttaggcatatttcccgggagaatttcggtcttgaaccctttaaagtggatgatcacgtttaatatagccgccatgtatgaaaattgtccgaagaattggtgactttttaaagaagaatgatttgcgaggtgcacaacagtggcgtcaaagccgatgccgaaattgttggtgaagaagccttcggaatgatgatcaaggtctgtgtagtggccgacattgatggttttagcagctgattgggtcaaaatgtcagccaatgctttttcccagtgcaaaggaatctttaatccccgcgcaaaatcatttccggaaccgaccggcaaaaaggcaattggaactggatgatcattttgatggacgcggtagtagtgctgacagcccaacagtgtttcgtgaagggtcccgtcgccgccagctgcaatcaacacagcgtcagtttggttggcggtgtcaatttcactgagagcttgttcggctagttcaacagcatgatttgggtaggcggtatagagtgtctgataatctgcatgtgcagccgccagttgtttttggatatccggccaaacctttttggcgttatcaccaccggcatgcaaattgataatgatgaaatatttcattggtgaatgagcccccaactcagatggttttatgtaaaaaacttgagaatcgaatataaaatctatccgcttctcaagttttcgaattagtcacgtttagttttgttaatctttaccattcatgatgagcattggcaaaatcattggatggcgttcggtcttgtcgtaaaggaattcttgaagatcatcaataatcgcatttctaattgaagactcggttgcttttttagcacgcatcgactttcgaatggtcttaaatacgcggcgtcggccttcatccaaaagttcaccggattctcgcatgtagacgaagccacgtgacaagatatctggaccggattggatttcctggttggccaagttgattgttgcaacaaccacgacaataccttcctcagaaagcagttgacgatcgcgcaagacaacgttaccaacatcaccgatgccgctaccatcgatgtaaacatctccggcagtgaagtgaccagccatacgagcattatcttttgaaagggcaaggacatcaccattttgcatgataaagctgtgatcaagcggcacgccacattgttcggcaagctcagtatgaattttcagcattctgtactcaccatgaatcggcatgaagaacttcggcttcatcagacgcagcatcaatttctgttcttcttgaccaccatgtccggaagtatgaatgttgttcacccgaccgtgaatgacattggcgccggcttcttcgagcttgttgatgacgctgttgacactggtcgtgttaccaggaatggggttacttgaaaagataaccgtgtcaccaggctgaattgaaatctggcggtgggtaccgttcgcaatccgtgaaagggcagccattggttcaccttgagagccggtacacaagatcaaagtcttgttagctggcagtgactgcagctcatgtgcatcaacaaacgcatcatcaggaatatcgagataacctaattcgcgtccattcacaatcgctgcatccatgctgcgcccaaagacggcaatcttgcgaccgtgggccatggcattatcacaagcggttttaatccgtgaaatgttggaagcgaaggttgcaaagatgattctgtcttcaatattatcaaaaatgtgggcaattgaagttccaacccacttttcagatttggtccaaattggcttttcagcgttggtgctgtcagacatcaaacaaaggacgccttctgcacccaaacgggccatttcctgaagatcaggcggctggttggtcactggtgtgaggtcgaacttgtaatcaccagtttccacaatcacgcccaccggtgtatgaacggcaattccaaccgtatcagggatcgagtgggtggttctgaagaatgaaactttcattttttggaacttgagaaccgacttgtcactaatttcgtgtaattcaacggaattcagcaagccgtgttcttccaatttattcttaatcagcgccatcgcaagtggtccggcataaatagggacgtttaaaaccttcatcaaatatgggacaccaccaatatgatcttcatgaccatgggtgatgaccaaagctttgatcttatccttattttcaaccagatactgatagtctgggatcacataatcgacacctaagagatcatcttcggggaacttaattcccgcatcaatcaggataatttcatcctgaaactggatcccgtaagtgttcttaccgatttcacccaaaccaccaacgccatagatagctgcttcgttattcttgacgtttagttttttcatttattattaaactccgttactttgtaatcaggactactttgctcatactccaagtgctttccttggaggggttcgatgaattcaatatcataatcagtattgtcttcaactaacgcgtgagcttcaacctctgtgtcggcctcaacatagagtgaatgagtcgtttcccggcgagggctttccttcttgctgggttgatataaaaccttccaaatcataaaaaaactcctttaaaattatacaatttttttgcagaaactcgaggtttccttacggacaagtggttgtgaaaacacaactaataacgatattctaccataatttaaaaaataagtatataaacatgaaagtaatcaactcgcaccattgcatggtaaaattaaatcaatgaaaagaaatggggctcagttatgaacattgatttgattattcaaattatcatcgggttggtcgcagcatttgctgtttacaatttgattcattatatctttgtaacgagacccggcagaaaacggctggcgttggcacagcggattgccaatgaagctgtgaaaacttcgattaaccagctggttgaccaaaaggcggttttgccctttgatgaaagtgattttaaatctgaagatattgccgaagtgtggggcagaggtgtgatggcatttgaatatcatctgcccaaggcaaaaattgaaagttcaattcccgatttccgaaaggccttggcaacgacgcttgagcaatacggtgatacacaccacatgcacgcgcataccgatcaggctgatcggccggcgtttatggtcaccgatgtctggcagctggatgatcgggtgcactttgatgttgcctacctggtgaacgtgacgacgattgaatatgtggatgacttaaagcggctgcactgaaccattatggactagtcaacggcgtttgcttttcgatactgtttggccagtcgcttgcgtactttgatgattgcaagtagattatgatccactggcggggaatatagattttcaacagcgaccagcttggcaatcagtgccaggccttttttctcactgccaaaatagagctgccagaccgcggtgatcaattgttgttggaatcggccattccaacttaaatccagggtgttgacctgacggattttgtttagaatttcttttgccgactgatattgagccaagttgagctcgatttgaaaaagagaaagataaagatccattaattcatcggcaatatgaaatgggtcatccactgcttgaaggtattgtcgacaattgttttcaaatctgcgaacaatctcggaaataagcttttcttgatgccggctgaccgcaattggcagtaaaatttgggcctgcctaatttcttcaagtgtccaggtctgtgatgcaaaaagggtgtcccagagattttccattgccggagtgactgtgaatgtttttgaataataagtgacgaccaatatttgacccatagcagcaaccgatttgtaactgaggcggctgcttttttgcgtttcagcgatgatttggcccattgtttgaaggtcgtggccgttataggcccgtagcaggcgccttttcagtgatgttgcagtgggttcgtgataatcgttttgaataaaacggaattcgttggctgaaatggacagattatctaaaattttaaataacttggcggcactgatgtcgttctccccattttcaaagcgatgagcaaatgaacgtgacatcacgcctgagtacacttcgctttgagtgaatcctttaatttgtcgaatcattttgactgtctgcccgattgttttcatgattgcctcccaagctttgaatgtggcatatacgcaacacattttacatctatcgctttaataatggtagtaggcttcagttaatcaaaattaaagcgggtgctgacaatggaaattagtgatcatgagtcaaatatgcaggttataaaagatgtatcgagcaacttcaccagtactttttgtggcgacatgttttcatttgctctggggctcatgctgctgcgggccacggggatgtcgttaagctttggactctcaatgattatcatgccgattgtgaccttgatcgggttggtgccgattggcaacttggtcgacacttatccccacaaacggcttttgattattagtctggtcgtccggatcaccgcactattcatttattcgatcgcaattggtcacttcgatggcagtggtaaattaatcccaacgattgggtttttgatcatcaattacgcatctgtcaatctttcgaattccggctacatggcatcggttcacgaattagtcaacgagggtcatattcaaaaattgaattctttgagccaatctgcggcatcgtttgcctcgaccttttcgccgattgtggccgccggattgtatgtgatagttggctttaggctgtttatcgtctttcagctgactgctcacgtgattgccctgataattcttttgacgatgaattttcattatttgagctatccaaggaaaagcagtcagacaccgcaggaatcccagtgggcaaaattcaaactggggttaaattatttgatggcccacggctttttacggtatctcatctgtattgccctgtttttgaattttatttttgcggtcattaacgttggcctgccatttatgattgtggaacatttacatttgggaaacgtgacgctggggattttgaattccgccgatgcccttggcatgctgatcgggaatttgatcatcagtgtctcgaaagaattgaggcacttggcaaaaatattagctgtcacgatggtcatcattggtacggggttggctggagttggcgctttattgatggctgctcccgaacaattagtggtccaattggtgggctcgttgatgttgtttgcagtggggatgtcactggcttttatgaacacgccttttggtatttacatgcaaaaaacagttccgactgaactgatgggcagagtctcgtctaccgaaatgtctttgaatatgatgtcaattcctttgggaaccgtcttttattcatttgttttccaacagattccaagtggaattgtgttcattatatctgggatagctctgattgctgtcacgggattgacgatgccaacttttatgcatgtccagatgccaaagactggtcatgccacccaaaaggcggatcgtcagcgtctctaagttgagtttgtcgggtaatatgtctataagtaaaacggtttgttacaaattcaatgaaaaagaaccagcaacttacaaaaagttcatttgatatttgttcacaaggcataaccaaacagatctaattcaggaaaggccactcgccacaattaaattggataagaaaaaaaccgggcaaaagtttttccttttgctcgattttttaatatggatgcttattgaaatttcttagatcggcatatgaacaactgatttggtgcaccgatcaatacacaaagatttcgtcatctgttttggcaaatgggttgtccttattaatgtgatcataaaagagtgttccatgaaggtgatcgatttcatgctggcagacaattgccgggtaatttttcaatcgaaccttgtgctctttgccgtcaacgtcttggtattttaaggtaattctggcagcccgagggacatagccgggaatgtccttatcaacggacaggcagccttcgccctctgtcaatgcgccacgctgaaccgaattcgacacgatcaccgggttaataatgacatctttgaaaaccggttcatctttttcatcctcgtcttcacttggaaccaacactgaggccatcatttcagagacaccgacctgtggggcagccaagccgacgcctgcacgcagacctaacttttcacactgttccggatcctggctgacttccagatattccatcagatcatgagccagttgtttatcttctttgctcaaagggaatttgaccttttgagcttgtttgcggagaaccgggtctccatctcgtacaatatccttcattaaaaacacgctaaagacctccgaaaatattttaagcattaattgaataacttctattctaacttaattttaagaaaaaaacactattcacaaagtgggtgaaatttcacaaagtatactcccgcaagcggtttcaacccaaaatttgtcaagtgaaaattatattcaaaaaagttggtttcatcacaatgaaagggcttgcaaacgttgctgaaaaatgctaaatttaacttgtggtttagaagtgatcagtttgtacatcacaagtctagctttacaggaaaggaaagtgttatctatggcagcaaagagtaagcatgttgttgattttgccaagatcaaatcaacgatgagcgatccatataagaaaccggttcaagttattgatgaaagcggtaaaatagttaatcaagaattatttgaccaattcagcgatgacgaactagttacgctgatggaaaagatggtttgggaacgtgcattgcatgaacaaacaatgaacttttcacgtcagggtcgattaggtttctatgctcctacttacggtgaggaagcctcagaaatggggattgcccacgcaatgaagaaacaagactacctattcccagcatatcgtgatttaccacaattaatccaacacggtgcaaccgttaaagagggttacttatggtcaaaaggtcactaccaagcttatgactacgtacgacgcggtgtacgtgcatttatcccacaaattattatcggtgctcagtatgttcaatcagctggtgctgcattaggaatcaagaagaatggtgagaaggataccgttgcttacacatttaccggtgatggtggtacttcacagggtgacttctatgaaggaatcaacttcgctagttcattccaagctccagaagtattcttcgttcaaaacaacggctgggcaatttcagttccacgaaagactcagaccgccgctgaaacccttgcacaaaaaggtgttgcttccggtgttcctggtgttcaagttgatgggatggatattttggcaacttacttggttgcaaaagaagctcgtgactttgttgttgccggcaatggtccagcattagttgaaaccttgacttatcgtttcggtgcccacagttcagccggtgatgatcctagtcgttaccgtactaaggaacaagaaaaaccatggttcgaccgagacccactaattcgtttgagaaaagttttgactgacaagaaactttgggatcaagacaaagaagacaaattagttgctcaatacaaagatgaattcaaggaagcaatgaaggatgccgaagctgctcctaagcaaaaggttagtgacttcttgaagaacacatttgaagttccaaccccagatgtagcagctgacattaagaaatacgaagcaaaggagtcgaagtaatcatggctaaaatgacatatattaaagcaattaccaatggacttgaccaagtattacaagacgatcccaagactctgatttttggtgaagatgttggtaaaaacggtggtgtgttccggacaactgaaggacttcaagataaatatggtgaagaccgagtattcgataccccacttgctgaatcaggaattttaggaatgtcaatcggacttgcattaaccggctggcgtccaatcccagaaattcaatttatgggattcacaatggaagctgttgattctgtcggtggtcaaatgtcacgtaaccgattccgtttctcaggcgacgttacgatgccgatcacaatcagaaccccatttggtggtggtactcatactgccgaacttcacggtgactcacttgaaaacttgttcattggcatcccgggactgcgggtagtaactcctgcaaatccttatgacgctaaaggaatggttatctcagccgttgaaaacaacgacccggtattattcatggaaaacctgaaactttatcgttcaatgaaggatgaagttccagatggccactacactgttccgctagacaaggcaaatgttgttcgtgaaggatctgacattaccgttgttgcttacagtgccgaagttaacgaagcacttaaagtagcagataaattagaaaaagagaacatctcagttgaagttattgacttacgttcattatcaccaattgacgatgaaacaatctttgcttcaatcgacaagactcacaaagtagtgattgcccaagaagcacaaaagatggctggtgccggagcaaaagttgcttcagacattgctgaaaacgacattatgtcattggacgcaccaatcggccgtgtttctgctcctgacagtatcttcccatttgctatggctgaaaatgattggcttccaaatgctgatgatatcgaagctaaagtacgagaaattttaaactactaaaattctaatttgttacagaaaggaagttagatcccatggcttataagtttaaactaccagagatgggagaaggaattactgaaggtgaaatcgctacctgggatgtaaaagttggcgataccgtcaaggaagacgatccgttagttgaaattcaaaacgataagtctgtccaagaaatgccatctccagttgccggaaccattaagagtattgaaaagcaggaaggagaaaccgcagaaaagggcgacgttttagttgtcattgatgatggttctcctgatgaacctgatgatgccgcaccagcagctgcacctgcaaaagaagaagctgctccagctcctgctaaagaagaagcacctgcaccggctgccgcaccagcacctgccgctgctccagccgcagtaactgctgcaccagctgcttcaaatccaaacgcaattgtcaaagcgatgccatctgttcgtcaatatgcacgtgacaaaggcgttgacattactgctgttcctgccacaggaaatcatggtcagatcaccaaagctgacattgacaacttcaatccagctgccgctcctgccgcaccagctgccgctgcaaccgctgctgcacctgctggcgaagcaaaagctgccgcaggtcaagctatcaaaccttggaagtctgatcaacctgatcttgaaacccgtgaaccaatgtctccaatgcgtaagatcattgctaagtcaatgcgtacgtctaaggacattgcgcctcatgtaacttcatttgacgacgttgaagttagtgcattaatggctaaccgtaagaagtacaagcaagcagctgccgaccaagatattcatttgacattcttaccttacattgtgaaggcattggttgccgttatgaagaaatatcctgagttcaacgcttcaatcgatgacaccactcaagaaatcgtttacaagcattacttcaatgttggtattgcaaccaacacggaccacggtctgtacgtaccaaacatcaagaatgctgattccaagggtatgtttgagattgctaaagaaattaccgagaacacccaagctgcctatgacaacaagcttggcccagatacaatgaagggtggttcaattaccatcagtaatgttggttcaattggcggtggctggttcactccggttatcaaccaacctgaagttgctatcttaggtgttggtaagattgccaaggaaccatatgttgatccagaagacggcgagattaaagttggcaatatgctgaaactttcattgagctacgatcacagattaattgacggtgcccttgcacaaaatgctttgaattacatgaatcaattgcttcatgatccagcaatgctgttgatggaaggatgatcgaataatggctgatgttgaaaagaaagaaacagtaattatcggagctggccctggtggctacgttgccgcaatccgtgcatccgaattaggacaaaaagtaaccctgattgaaaaatcagatacacttggcggtgtttgtttaaacgttggttgtgttccttccaaagctttgatcgctgctgggcatcgtctgcaggaagctaacgatgcttcgacgtatggaattacaactcaaccagctacaatcgattttgctaaaacccaggagtggaagcaaaagaaggttgtcgaccgaatgaccagtggtgttaagatgctgcttaacaagcacaaagttgaaatcattcatggagaagctgttcttgacagtgatactcaattacgagtaatgcctacaggaccacaacaattcatgagtgccgataccggaaccacgattcagtttgacaacttaatcattgccagtggatcacatccaattgaaatccctggtttcaagtttgacggtcgggtgattgactcgactggcggcttgaacctgccagaaattccaaaagaatttgtcgttatcggtggtggctatgttggaaccgaattagccggtgcatatgctaacctaggtgcccatgtaacaatcattgaaggattggattccatcttgaatggatttaccaaagacatggtttcattagttgttaagaacttgaagaagaagggcgttgatattcataccagtgctaaagcaatttcttcaagtcaagatgacaatagtgtgtctgttacctacgaagaagagggcaagcagaccactatcaaagctgattactgcatggtcactgttggtcgtcgtcctaacaccgatgatcttggtttggaatacaccaaggttaagttggacgatcacggcattgtccaaactgatatccaaggcagaaccgattctgagcatatcttcgcaattggtgatattgcttcaggtcctgcattggctcacaaggcattcttccaaggcaaagttgctgccggtgcaatttccggtaagaatactgccaacgattatgttggcgttccagcagtctgcttctcagatccagaaatcgccgttgttggtatgactcaagcccaagccaaggataagaacattgaagtttccacttcgaagttcccattcgcaggtaatgcgcgtgccgtatcacttgatgaagccgacggatttgtccgtttgatcttcaccaaagacgataagacgatcgtgggtggcgaaattgttggaccaggtgccagtgatttggttgctgaattaagtttggcagttaacagtcacatgaatgttgaggatattgccctgaccattcatccacacccaaccttgagcgaaccagttcaagaagctgcagatgttggattaggattcccaactcatatttaaaaagttctgttttaattaatccggttaattccggaataaaggattcaatgatgaatgaagcttgttcatcgttggatccttttgtttatccagaattacgatctgttaagtcctccgagaaatgaaaaactcacataacttcgaccttttctatttcacaaagtcctcaactatcatataataaagtcaacttggtaatgatcggagtgaagaagatggccgaggggtatgagtacccactaattgatggtttggatgttgatgaaattattgacgttgttaatttttttgaggcaattgaacaggcgtatgaggaagctgaaggcattaaacgagcagactttatcaaagcttatcggaagtttcaagaggtggtccctgccaaaatggaacagaaacaattggagaaggaatttgccaatcgttccggatatgattcctacgaagtcataaagctttctaaggatgggcaggcagctaatttgaaggtacgtgaggcataggatggaaattaacgaactcaaacaaattgataaaacggttaaaggttggctgcatgagtcacgggacaacgttctaagaaaaattgacacccgactggaagttgatactaagaccagtcgacgtgatttggtgaccaacattgataaacaaaatgaaaagtttttagtcggtaaaatccgtgaatttgaccccaacgcccagattttgggtgaagagggatttggcgaccaggttcattcaacagaaggtcggatctggattgtggacccaattgacgggactatgaactttgtcaagcagcggaatcattttgctatcatgattgccctttatgaggacggtaaaggcctccttggctatgtaatggacgttattggtaagcatttgttgtctggcggaccggatattggcgtatttgacaacggccacccgctgccgcaagttaaggacacaccgcttcgagaagggttaattggcctaagtgggccgatggttcttcacaacgattacaatatggtagacattgcccaacagtctttgggaatgcgcatttatggcagtgctggaattgatattatttccgttctccgtggtgaattggttggatacatttcttatctcaagccctgggattttggggcaggcagaattctgtgcgaaactgccggacttaagatgacaactattgacggacagcgattagatgtgttatcatcaacaccagtattgttagcaacacgaaatgcacatcaagacattcttacaattgtaagtcaatgatcggactgtgacagttgtcacagtttttttatgcgaataatatgatgtacaatattcggtttgatttaaatgaagggaagcaaacgacttggatactaaattaaaaacacgcgacgacattcgtaacattgctattattgcccacgttgaccacggtaagacgactctggttaacgaaatgttgaagcagtcagatacgcttgatcaacacgtacaaattgaggatcgggctcttgactcgaatgcgatcgaacgtgaacggggaattaccattctgtcaaagaacacggccgttcgatatggcgacaaacaaatcaacatcctggataccccaggacatgcggacttcggtggtgaagttgagcggatcatgcgaatggttgacggctgtttacttgtcgttgatgctttcgaaggcactatgcctcagactcgtttcgttttgaagaaagctcttgaacaacacttaaccccaatcgttgtgattaacaaggttgaccgtgaaggtgcccgtcctcaagaagttgtggatgaagttcttgacttgttcatcgaacttggtgccgacgaggaacagcttgattttccagttgtttatgcgtcagctatgaacggaacttccagttatgatcctgatatcagcaaacaggaacatactatgaagccaatctttgacaccattgttaaagacattccagcaccaattgacaattcagatgaacccctccaattccaagttgcaatgcttgactataatgacttcgttggtcgaatcggtattggccgaatcttccgcggtacaatcaaggttggtgacagtgttactgttatgaagcttgatggttccaagcagaatttccgagttaccaaattaatgggattcttcggtttgaagaaggaagatatccagtccgctaaagccggtgatttgattgccgtttccggaatggaagacatcaacgttggtgaaacggtggttgatcctaaagatccagagccactaccaattcttagaattgatgccccaacactgcaaatgacctttggtaccaacacttcaccatttgccggccaagacggtaaattcgtgaccgcccgtcaattgggtgatcgtttgaagcgtgaacttcacaccgatgtttcattacgtgttgaagataccgaccaacccggttcatggattgtttccggtcgtggtgagctgcatttgtcaattttagttgaaactcttcgtcgtgaaggctttgaattgcaagcttcacgtccagaagttatctaccgagaaattgacggcacaatgtgcgaaccatttgaatccgttcaaatcgatactccggatgaatataccggttcgattattgataccctttcacaacgtaaaggtaccatgcagaacatggaaacaaccgacaatggtcagactcgtttgacattcttggcaccatcacgtgggttgattgggtattcaactgaattcctgtcattaacccgtggatatggtatcttgaaccatactttcgagaaatacatgccagttatcaagggctggaaccctggccgtaccaagggaaccttggtttcaatgaacgccggtaaagcaacgacctatgcaatgatgggtatcgaaagccgtggaacattgttaatcgatccaggtaccgaagtctacgaaggaatgatcgttggtgaaaacaaccgtgagaatgatatcactgttaacatcaccaaaggtaagaacctgaccaacgttcgtgctgccggttcagatgatatggcccggattaagacaccaactcatctttcgctcgaagaatcacttgaattcttgaatgaagatgaattgtgtgaagtaaccccacacttcatccgtttgagaaagaaaattttgaactcaaacacccgtgaaaaagaagctaaaaagaagcgtcataactaaaatcagtaaattatcaggaggggctgggacaaaactaaaaattttgttccagcctctatttgctcttgaatattatctagcaaaactgtgcgccaataagcagcttccggccatataaggggattacccaaacatccaagttctggatgttcgggtaatccccttatattctggaagctaaccgcttattgtcccacgctcttttgtattgaatggagtttgttgtaacttcttaaattcccctaaaccgtttagcaatctctgaatccggttttttaattatgatataataaagctcgatgcacctacatataatttgaaaagtggagttggaccaatggggaaagcacgtttaaaaaatctcgactatgttatttttattccgtatattgtgatgtcgattatcggtgttgtgatggtctattctgccagcgcaaatatttcgctgcagaacgggggaagtccgctgagttacctgatcaagcagttattctttgtcgtccttagtgttattattgttggcgtgatgacggcaatgaacattaagtacttacgcaagcccaaatttttgaaattcttactgtatgctttgattgttgttttgattggtctgctgttagttggcaaaactatcaatggcgcagctgggtggattcatttagggccaattaacatccagccggccgagtttgtgaagttctttttgatcatttggcttgccgacacaattgataaggctcaaccagagatcacgctgtcttttcgggactggtggaatcacatgaaatggccgttgtttttcagcgccgttttgatcgccttgattcttaagcagcctgattcaggtggtgctgccattaatttggcaattgcctttattctgtttaactgcagtggcttttcatggaaacgagctttggcaatcatttatggttgtatggtggccgccgtgctggcatttgaatttattctggtaccaatggccaaatcggattcgttctcccattcctatcaactgcaacgaattgtcgcgtttaccaatccttttggtcatgcgcaggggacaggtcaacaggtggttaactcctattacgctataagtaacggcggccttttcggtgtcggcctcggaaatagtgttcaaaaaaccgggtatctgcctgagcccaacaccgattttattatgtcgattttaaccgaagagctgggggcgattacggctgtcattgtgttggcattattgacagttatcattttgcgaacagtccaaattggtgttcgcagtaacgatacttatcaaagcctggtttgctacggcgttgcaacttatatgagtattcaaacattctttaacatgggtggtgttttgggggtcctgccaattactggtgtgaccttcccgtttatcagttatggcggttcaagtattttgaccctttcgttttgtttgggactggtactgaatatcagtagtcgtcagcggatggaacgaaaagcacttatcgctgccagaaattaaatttgaggagatggcataatggctttaactgttcaacctacgaccgggttaatcgtttatctacattcgattcgtcattccagaaatctgaagtcatatggccgactgtattacgtctccaaacggatgcgctatggtttgatctatgtgaacaaagatgatgaggaagagattactaaaaaattggcttctcaaagttgggttaagcaggtggtcccttcgcatttgaatgaattggtccaagaagttgaaggtaaaaccgagttggacgatgacgattcggttgacgaagattattagagttgaggtaaactatgaggattgtatcaggaaaatacggtggtatccgcttaaacccggtgaagagcgatcaaactcgtccgaccactgataaggtgaaagaatcattgttcagtatgaccgggccctattatcatggtggtcggttcttggatctgtttgcgggttcgggagcagttggcatcgaggctgtttccagagggatggatagtgctgtgcttgttgatcgacagtatcaagcgatcaaaacaatcaaagacaacattgccaaaattcacgctgaagatcagttcaccgtaattaaaggtaacgctgagacagttttaaaacaattagctgccaatggtgataagttcgaccaggtttttctggatccaccctataagcttcaaaagatcgttaacactttggaagaattgaaaagccacgatctgttgaatgaaggggcaacggtaatttgtgagactgataaccacactgaattgccgctcaatctcgatggatttcacgcagtcaagcaaaaaaattatggactcacaaatttgacaatttatgactatcaaatggggaatgtgcaatgacaaaagctttatatgcaggtagttttgacccgatcaccttcggtcacattgatgtcatcaaacgggccagccgaatttttgataaggtgtacgttgctatcagtattaacacccacaaacatgctttgttcaccgatgaggagcgggctgagtttgcccgccaggcattaaatcagttacccaatgtcgacgttgtggtctctgaagagctgaccgtccagcttgcccattccttgggcgcaacggtattagtcagaggcgttcgcggcggcagtgacctggattccgagatgtcaatcgcggggcttaacgagaagttggccgacgatattcaaaccatttttatcccaaccgcggccaactatcgcgacctatcgtcaagcatgatcaaagagatcgctaagttccatggcgatgtatcaaaatttgttcccggacctgttgcacaggcattgaatgacaagtatcaacaataaaatagtttttagagagtggtgaactaatgaaaaagtgggttaaaaaatatttaatttggtttgccattttactttttgtggcgatcggctttttgtggccgcttcccaaatacattgagggacctggtgacgccgctaatctgagtaaaattgtgaacatccaaggtcatcccgaccgacagaaaggtcagtttatgctgatgtctgtcagcatctctcaagcccgaccatttacttatctttatgccaagctcagcccatattattcaattgagccggaagaagacgtgacgggcggccaagacatgaaggaatacagcaaggttcaacagatttacatggacggatcgatcaatagcgccatttacacagcctatcatcaagcccataaagccgttaagattaagtattccggcatttatgtcatgagtttgatgaaaaattccaactttaaaaataagctgaaggtcggcgacgtggtggttgctttggatggccatcacttcaagagttccctgggcttcatcaagtatgttaagcagcaaaaatatggtcagaaactgacggtcacctataaacgtcacggaaaattgcatcaagccacggcgccacttggcatgattgccaaacatcgggcagggattggcatcactttgaccgacgatgttcaagtgaagcccaagattccaattaaggttcaccctggtcaagttggcgggccttccggtggtctcatgtttgccctccagatttatagtcagttgaccaacaagaatctgcgtcacggtcaaaaagttgctggaactggaacggtcgatgggttgggcaacgttggcgaaatcggtggaattgataaaaaagtcatcactgctaaaaagcatggtgcgaaaattttccttgcaccatatgtgaagccaaccaaaacaattttgaagtatgaggaaggccacaagacgaattatcaactggccaaagcaacggcgaaaaaatatgccccatcaatgaaagtgattcccgttaagacgtttgcccaagcggtctcaattttagaaaaaaatcaataagcaaaatcaaaaagggttagataatctaatcctttttttcgtatgtattttttagaagggaggcacagtatggataggatacgtgagtttattgatgaatatctttatcagatactaattggtttagtggcggtcatcgtcatttttatgtttgtaattggtgggctgttgattggtaagggcggtgagactgccagttctgaagagccggttgctgtccaaagttctagcgcaagttcagatacgggatcggccgcgagttcatcgcctggtgatcaacccaagcaagttgctgccggcactaatcaacaaatgtatgttgacgttaaaggggcagtgaagaatcccggtgtttatcaggtcagcagcaatatgcgggtagtcgatgccattgaattggctggtggttacaatcggtctgcggacaagaagaaaatcaatttggcccagaaactgaccgatcaacaagtcatttatgtaccgattcgtggtgagaaggggacaccggtcacgtcaacggttgcggccagcccgacgccatctgagactccagcagattccgggtcggacaactcagcgccatcggcggacggaacttcaggaacgtctcaacagatcaatttgaatacggctgataagtccaagctccaagagctaaccggaattggggacaaaaaagccgatcagatcattgcttatcggcaggcacacggccaattcaaaaacattgaggagcttaaggaagtccctgggtttggtgataagacctttgccaatctgaaggcatcaatttgcgtctagcccaaaaagcgtttttgagatatgatttacaccagagaaggtggaatgataatggataagcgaattaaatgggaccaatattttatgatgcaggcggttttactggcctcacgaagcacgtgcgaaagattgtcagtcggagcggtcattgtcagagacaaacggattatcgccggcggctacaacggatccgtcgcgggagatgatcactgcattgacgtcggctgttacctggaagacggtcattgcgtgagaaccatccatgcggagatgaacgccattctgcagtgcgccaagttcggtgaaagcactgacaatgctgaaatctacgtgacggattttccgtgtcttcagtgcactaagatgctacttcaggctggaatcaccaaaatcaattacctcagaaattaccataataatgattacgcccaaaaactgattaggttgaaaaatattgaattgaacaaaattaagttaactcaagccgatatggatagagtgccattcggatcctatttgtctgactagttatcaataaaaactggctcatttttccggcagccgtcatgcttttgatgagcatggccatgtacgggaaccggctgattgcggcagctttattaagcattctgattatgcggatttattttctgcgggacgttaaagttgttagtacatgtatccttgctggcctgatctttgcctttggtgggcttttgaccaatcgacaggtctctgcaccagtctcacaacaaaattatttggttaaagtctatccggattccgccaaagtgaacggggcaaatttgagctttattgcccgtcctgagggtgcaaaacaaaagatggtgttatatgccagattgaagtccagtagtcaacaacgtcgtttagcagccggtattaacccaatgatgcttaaggtgagtgggaaatcagccccttttttgccggcaaccaacctgaatcaatttgatatggaaaaatattatcatcaccaaaagattcaaagttgctttttggtcgaccatttcgttcttctgccgccaccagctaaactgtcaattgtcgatcgaattcatattattcgttcgaaattcaaccagtattgcagtcagctgcccaaaactctggggatctatgccaccggattgattagtgggtatcggccggtgaacttcttcgatgaaatgacgggggttaagaagctggggttgctgcatgtctttagtatttcagggatgcatgtggcctattttctttcgattgtcgaccagctgctggcttggctggggttgtcgaggtttaaaaaatcaatcatctcaatcacctttttaggcgcctattttgtcttctctggcggatcccccggattgctgagggcagtgatgatggccatcattggtattcttaatcggctgtttaaattcggtctttcccaactggacatttggagtggatcattaatcattaacctgctcattttacccgaggcgatgtttttaatgggggttcaactcagttatggattgtctttggggttgattgcctctgagaagttttcatacattaagcaaacgattttgctcaattttttgaccgtgccgattttgttgtttcatctttacgagtggcactttttaagtgttgccgttaatctgattgtcttaccgctgttcggccgggtcatctttccactggttatcattggcgtcattggcggactggttgcggaaacgttggttctgccgatcgacatgtttttgcgcatctttaatgatgggttaaatgcagtgagtcgtttgccggggatgttgacctttggcaaaccggcattgccgattgtcctaaccatgttggcggtgacaatgctattggccgttgttgatcgtgttcgggcacccaaactgattggcatcttggcagctgtttatctggtgacgtattgttggatccattttccgctcaatggtgaggtgaccatgtttgacattggccaaggggacagcttcttgattcgggagccctttaaccgttctgtgaccctgattgatactggcggcaaggttcaattcaatacccagccatggcaaaagggtgctcaaacctaccaagctaagcgactctcgattaattacctgaaaagtattggcatctcaaagattgacaatctgtgtgtaagccatcaagattcggaccattgtggcgatttgccggcattcattgaagaaatggaaattaagcggatcattattcctttgggaatggaccaaaacccgagttttatgaagagaattgccaaccgcagtcgatctaccaaagtgatttctgtcaatgatgagacgcaagtaccaggtttgccggctcaaatctttcatccctatcttgccggtaagggtgagaatcatgactcaatggtgatcggtactcaaaaaggcggtttgcggtggctgtttacgggggacttggaccgcccaggagaactggacacgcttcaaaggcatcccggcttgtcagcagacgttcttaaagtcggccatcacggaagtaaaacatcctcggaccctcagtttattgcgaccgtcaaaccacggatcgccttaatttctgccggtcgaaacaatcggtatggtcatccaaacgacgaaacacttgtcacattgaaacagcatcacgttaaaatatttaatacccaaaaacacggtatggtaagatatatctatcgaaacaataccggtcatttcgaaacggtgttagccggtcatgaagggaatttataatgaactattctcaattaattcaacagttaaaccaaggaaacctcgcccaggtttatttgatcttaggggatcaggagtatctttccggtcgaattaaggatgcttttgtcaaaatcatcccggacaacgagcgttcgatgaatattggcaattacgatatggaagataccacgatttcagccgcggtggaggatgccatttctgtcccatttttcggtgagcgtcgactggtcatgattaaccgaccgtattttttgactggaatgcgtacgaagtccaaattggatcaaaatatcgacgactttttggaatatttaaaacaccccgaagagtccacggttatggtgatctttgccccgtatgacaaattggattccagaaagaaagtcaccaaagccctgaaaaaggtcgccaccaccattgaaattggaagccttcgtgaaaatgagattaaaaaactggtcacggataagattgctgctgcgggattcaaaattgatcacgacgcattggatcggatggtcgaattaaccggtggtaagctaacggcgatgatgagcgacttgcccaaattgattttgtacaataatgatacgaaagtcattgatcttgcatccgttaatggattggtcagcaagtccatggagcagaacgtttttgacttggttaatagcgtccttgcgaagaatcccaaacagtcaatggacatttatcatcaattaattctggaaaacgatgaaccaattcggattaacgctgttttaattcagcaatttcgattgttgctgcaggtcatgattctgcaaaagcacgggtactcacaaggaaatttagcttcaacactcaaagtgcatccgtatcgggtcaagttggcgatgcagacgatcagaaagttcaattacgatcaattacgagaagcttatattggcctggttgatactgaacgtcagatgaaatcaacccagcgcccacccgaattattatttgaactatttgtgttgaaatttatgaaaagtgtcagttaataaaaaataggagtaagcaaagtcggtcgaccttgtttactcctatttttgtgggacaaaaaaagttgttagtctgactaacaactaagaaagaattattttgctaactttgaagttaaacgtgacttgtcacgagcagccttgttagctttaattaagccctttgattttgcgcgatcaattgcgctgattgcgttaatgtataaatctttaacgtcgtcagaaccggcaacttgtgccttttggaacttcttaacggcagtgcggtatgcacttaattgtgcagcgttgcgacgctgtgctttttcgttagttttaacacgttcgatagcagatttgataattggcatttgactcacctccgagtattattctaagtaaaaattattaaatttcaacaagcatcattatacaaaaaccaacgactgattgcaagccaaactgtcaatgaatatcggcggtaagcttgtatttgtcagagaaatccgttatactattttttgtgtgttgtacaagaccttcaacttagtttgtcgggtaccacttccgcatactcagttgttggcgtcaaaaaataaaaaggtggttatacattatggcaattacacagactaagaagaacgaaattatcaacaaatttgctcgtcacgaaggcgacaccggttcagcagaggttcaaatcgctgtcttaaccgcagatatcaacgaattgaacgatcatatgcgtactcatcgtaaagattaccattcacaacgtggactcatgaagaagattggtcatcgtcgtaacctgttggcatacttgcgtaacaaggatgttacccgttatcgtcaattgatcaaggatcttggtcttcgtcgttaatattaatatcaggagagcggataatatccgttcttttttttatacataattattttaagaaagcacaatgttttttgaaaaattcggtttcaacaaaaaatatgttaaactaaaagaagctgaaaacgaacgtaaaaaagaacatattaatttttgaggtgaatcatgaaaaacgaaatcaaagtaatggcgattggtggggcccgcgaaaatggcaaaaacatgtacgcggtcgatatcaatggcggtatttatattttggactgtggtctaaaatacccggaaaatgaattattgggaattgacgttgtcattcctgattttagctggcttgaagagaataaagatcgcattgtcggtgttttcttaacacatggccatgcagattcgattggcgcaatttcttatttcctgagcaaattcgatgttcccgtctttggatctgaaatgacaattgagcttgctaaaattaacgtctccgactctgaagaagttaagcacttcgatgactttcacgttgtcagtgaccgtagtgaaattgattttgaagacattaaggttactttcttcaagacgacacactcgattcccggttcgctggggattgcgttgcatacatcagatggaatcatcgtttataccggtgactttaaatttgaccaaacagcggcgccaatctatcaaacaaattattcagcattgacccagcttggtgatgagggtgttttggcattgcttgatgattcaagcaatgcggagaacccaaatcccagtgcctctgaaaagaagatcgctgaatatgtttatgataccttcaattatcaaaacagccggattattgtcgccggtgtcgcctcaaacattttaagaatgcagcaggtcttcaatgccgccgccaggaccggtcgcagagtctatttaaccggccatgacctggaacggattgttaagactgccatgggattgaatacgctgaaactgccagaggacgatttgttgattggctcactggatgagcttaagaaaatggcccctgataaagttgtcatcattcaaaccggcaaaatgggcgaaccaatcaaagcgattcagcggatggcgaataaagaacaaagtgatattaatattgaacccggcgacctggtatttatcacgacaaccccgtcaactgccatggaaacaacggttgccaagacgcgtgacatggtttaccgtgccgatggcgaagtcaagatgatttctgatgagatgaattcatcgggggatgccagtcaagctgatttacagttgctgatgaatttattacatcctaagtatattatcccagtccaaggggaataccgactactggaagccaatgctcaactggccaaagaaatcggctatactgatgatcaaatcgttattcctgccaagggtgatgtgatctcgatttcagaagatgacattcatttgggcaagggagttgatcttgcggataccatgatcgacggtatcggcattggcgatatcggcaacattgtccttcgcgatcgaaaggtgctctctgaagatggcatttttgtggcagttgtgacgattgaccgcaaaaagaagcggattgtgtccactcctaaattgacatccagaggatttgtttacgtcaaagccaacaaagacttgatgaaggatgccgccgggattatcgaaaagacggttaccaacaaccttgaacacaaagagttcgattggagtaaccttaagcaggacgttcgcgaggatctgagtgattacctgtataaacaaaccaagcggcgaccggttattttaccagttattatggaagttaaccaacatcataaacgttcaaagaaaaagcaaaaagcagctgaaaaaaattagccaactgagcgagtaattcatttttttgaattactcgttttctatctctaaatgttatggaggaaaagatgactgagatgacaaaaaacgatcgcgtcatcctgttgagtgctcaagaggatttgcgggatggccgttataatcaggtcgtaaataaggcggagcatttgttggggaaatatccgcaatccgtggaattgaacgatttgtatgcaaatgcgttgtaccatttgaaaagatatgccgatgccggacaagttgtggccgattttgccgaggatttcatcgctcaaccaaggtatcaaggccatgcgatggaaatccttttggccaacaatctgttcatgtctgctcgagaggtgcttgcccaggtaccgacttcaaagaagggggagtggaagcaaagaatcgtgactgctgaaaacgattatcgtcaacagcattcaaccgagctggcggcgaagtcacgtaaatttgcctatcttggggcactttccgtcactgagcaggttcatgaggttcaagcagcgcttcatctgccactaaatgaatatttgtcggccgctaagacattactgaatgatccgtatgggtggcaggtttcgaaaacgcaggtcttgttacaattaatgaaagctcaagtttctgaaaacgttgatttgatctggttggatgggaagacacatacgataagtttggacgaattaaaaccattggagaaaatcgatgcttttgtgcgtgttcttcaaattgttgagcaacaatttgccgctaaggacccaatcaaattggatttgctggaaagagagttattcactcagagtaattatatttacccctattttgatgatgtgataactgggcccaacttctgggcacaggcaattatcgcccagtcatttggtgagccgttgcccgccaagacacaacagcagcaaagaatgttatcttggatcaaccggatccatgatcaggaaattaaaattggtctcatataactgaattattttcggaaaataaagggaatctgtttacaaacattaccagtatcgatataatacttaaggattcttcgaaaattgactactttgtcttttccagaagatgtagtataataacacttagaaatgcattgatgcgaaattgatgtaattcttgaaaacaacaggaggtttcattaatggcaaaagaacattatgaaagaacaaaaccccatgtaaatattggtactattggccatattgatcatgggaaaactactttgactgctgcaatcactaaggtattggctgcaaagggtctcgctaaggctgaagactatgctgatatcgatgcagctccagaggaacgtgaacgtggtataactatcaacactgctcacgtggaatacgaaactgaaaagcgtcactatgcccatatcgatgccccaggacatgctgattacattaagaacatgatcactggtgccgctcaaatggatggtgctattttggttgttgccgcaactgatggcccaatgccacaaactcgtgaacatatcttacttgctcaccaagttggtgttgattacatcgttgtattcttaaacaagactgatttagttgatgatgacgaattagttgacttggttgagatggaagttcgtgaattactttctgaatacgattatcctggtgatgatattcctgttctccgtggttcagctcttaaagcacttgagggcgacaaggaacaagaacaagttatccttgacttaatggatgttgttgatgagtacattccaactccagaacgtgacgacagcaaaccattcttgatgccagtcgaagatgtcttcactatcaccggtcgtggtactgttgcatctggccgtatcgatcgtggtactgttaaagtcggtgacgaagttgaaatcgttggtttgaacgacgaaccattgaagtcaactgttactggtttggaaatgttccgtaagactcttgatgaaggtcaagccggagataacgttggtgttcttcttcgtggtatcgaccgtgatcaagttgtccgtggacaagttcttgctgctcctggttcaatccagacccacaagaaattcgaaggccaagtttatatcttgactaaagaagaaggtggccgtcatacgccattcttctcaaactatcgtccacaattctacttccataccaccgatgttaccggtgttatcgaattggaaaagggcgtagaaatggttatgcctggtgataacgttacattccaagttgaattaactaagccagttgccattgaaaagggtactaagtttaccatccgtgaaggtggtcatactgttggtgccggtgttgttagtgatgttaacgactagtttttatcattagacacacttaagctgtgaggataattcctcgcagctttttttatgtttttagttcgtttgaaattaattttacattttatgattaatacgttaaaataacaatgttatgcaattatgaaattgtaaaaaattcttttggtctcggaggaaaaaagatgtctgcaaaatgggaaaagaaaggtaccaatgatggcgaattaacattcgaaattggtacagattcaatcaaatcaggattagatcgtgcatttaaaaagaataagaacagcattcgggtacctggcttccgtaaaggaaaggttccacgtcagattttcactaagatgtatggtgaagaagcattgtacgaagatgccctcaacattctcttgcctgacgaatatgaaaaagccgttcaagacgctaagatcgaaccagttgaccaacctaagattaacgttgagtcaatggaaaagggcaagccttgggttattaaagctaacgttaccgttaagccagaagttaagcttggcgattacaaaggcttgagtgtgcctaaacagaatacccgtgtctatcaaaaagacgttgacgctgaattggaaaagaagcgtgaaagccaagctgaattggttcttaaagaagacaaggctgctgagaagggcgatactgttgttatcgacttcgaaggaagcattgacggcaagccatttgaaggtggcagtgctgaaaaccattctcttgaactgggctcaaactcatttatcccaggctttgaagatcagttaattggtcacaaagccggcgatgaagttgaagtaaaggttaccttccctaaagattaccaagctaaagatttagcaaataaggaagccatctttaaaaccaagattcatgaagttaagacaaaagaattgcctaaattagacaatgactttgccaaggatgttgacgaagatgttgacagtcttgatgaattgaaggaaaagatcaaagaagacctcaagtcacaaaagaagtctgaagctcgtgatgccatcgaagacgctgcaatcagtgaagcaactgataatgctgaagttaaagacatcccacaggctatgattgacgaagatattcaacgtcaaatggatcaatatcttgccggcatgcaacaacaagggatcaaccaggacatgtacttccagttaactggaactaagcctgaagaccttaagaagcaatttgctgacggtgctgagaagcgggttaagactaacttggttcttgaagcaattgttgccaaagagaagattgagccatcagaggatgatgttaaggctgaggtgaagaaccttgccaaacaatatggcatgaaggaagacgctgttcgcagtgccttgactgaagacatgttgaaacatgatatcgcaatcaagcaagcaattgatatgattgttgattcatcaaagcaagacgccaaagcaaaatcaactgaaaaggattcaactgaagccagctcagaaaaatagctttttgcttaattaaaagacccgttattttgacgggtctttttttaaggataaagccgattaattgcaatttgtatgtgatatggtaaagttactcttagttgattactactaattgtatttaaagtccatctcggatggaggagtgaataatttgtttgaagataatgaatcaagcgggcctattacttgctcgttttgtggaaaaacacaggatcaagtgaaaaagattgtcgctggtcctggcgtttatatttgtaatgaatgtatcgatttatgtaaagaaatcatcgatgaagaattggcacccgaaaaatcatcagacgatttactcaaagttttgacgccagctcaaattctggataagttaaatgaatttgtgattggtcaggaaaatgccaagcggacactttccgttgccgtatataaccactacaaacgggttaacgaaatgattagcgaacctgatgatgatttggagcttcaaaagagtaacatttgtatcatcggcccgactggctcaggtaagacttacctggctcagacaatggctaaaattttgaatgtcccatttgccattgccgacgcaacaacgttgactgaagctgggtatgttggtgaagatgttgaaaatatcctgctgaaactgctgcagaacgctgattatgacgttgaacgagcagaacatgggattatctacattgatgaaattgataagattgccaaaaagtctgaaaatgtttcgattacccgtgacgtatctggtgagggtgttcaacaagccttattgaagattcttgaaggaacaattgccaacgtgccgcctcagggtggtcggaagcatccacaacaagaatttattcaaattgatacgacgaacatcttgtttatcgttggtggtgcctttgatgggattgaaggaattgtcaagagccgccttggcgataagacaattggtttcggtaccaactcagatgaagctgctaaggtcgatgccaaaaacatcatgcagtcggttattccagaagatttattgaagtttggcttgattcccgaattcattggtcgtctgccaattttgaccgcattggataagcttgatgaacacgatctggttcgtattttaactgagcctaagaacgctttggttaaacaatacaagaagttaattgaacttgatggtgccgaactggaatttgcgcctggcgcattggagaagatggctcaactcgcaattgcccgtgatactggtgcgcgtggtcttcgctcaatcatcgaaggcgtcatgcgtgacattatgtttgacctgccgagtcgaaacgatgtctccaaggtcatcattaccccagagactgtgacggatcataaggaaccggaattaatcttaaaacaagcatcgtaattcctagaaatctgatgtagactttagatagcttactgtcagatttcttttttattcacacattttattcattgaaggagtggtttcatggaagttcacaacgtcgaccttacgattagtgctgtcgcagaaaaacaatatccaaatacacaatttccagaaatagcattggtaggtcggtcaaatgttggtaaatcttccctgaccaatgtgttgatcaatcgcaacaaatttgctcggacgtccagtcagccggggaaaactcaaaccctgaatttctacaacatcgaagataagctgtactttgtggatgtccctggatatggttatgcaaaggcatccaaagccagccgggaaaaatggggccgaatgattgaaacctatttaaccaaacgtgaacagctgcggggggtcattaccctggttgatggtcggcatgcgccaactgctgacgatgtgtcgatgcataattggttgaagtattacaatattccaatgttaacggttgcgaccaaaatggataaaatctccagcgggaaatggaacaagcaggaatcattgatcaaaaagacactgcagttggatgctgatgaaccactcattttgttctccgctttgacaaaaacgggtaaaaacgagatttggcgttggattgaggggagaatgaaacgatgaattttgatgactatcaaaaggcagccaatcggacactgatgggtaacgagcaagttttaacgaactgtgcactggggctcaccggagaatccggtgaagttgctgatttaattcggaaatatacttttcaaagcaagaagctcgatcacgatgaattggttaaggagatgggggacgtcttgtggtacctgtcccaaatctcagagtgggccgacattccatttgatgaggtcgctaccgacaacatcaaacggctcgaaaaacgttatcctgagcaatcaggtggcgttaatcaagtgaatatttaaggatcaatttagaagcagtcattttgagatggctgctttttttgcagcaatttctggcaaaatgacctcttatttgcatattcgacataatattttcacaaataatgaataaaacataaaaacagttgcattaaatgaatattggtgttaatctcaatacattgaatttttcagaagataagagggaatatatatgtcagaaaataataaagtcattttagcttactccggtggccttgatacctccgttgcaattgcctggttgaaagacaaaggttacgatgtcgtcgcttgctgtattaacgttggtgaaggaaaagatctcgatttcatcaagcaaaaggcactgaacgttggtgctgttaaggcttacgtcattgatgccctggatgaatttgccgacaactatgccgctgtggctctgaaggccaacgcgatgtacgaagggtcatacccgttgatttcagctttgtcacgtcctttgatttctaagacgttggttcaaattgcccatcaagagcatgccgttgccgttgcccatggttgtaccggcaaaggaaacgatcaagttcgttttgaagtggccatccacggccttgaccctcagcttgaagtgttgagcccagttcgtgattggcactggtcacgtgagcaagagattgaatacgccaaggatcacaatattccaattcccattgatttggactcaccatactcaattgacgccaatatctggggtcgtgcaaatgaagccggtattttggaagatccatggcaaagtgcaccggaagatgcatttgcaattaccaatcccattgaaaatacgccggatacccccactgaagttgaaattacttttgaaaagggaattccaactgaattaaacggcaagaaaatgaaattcgctgacattatccaagaactcaatgaaactgccggtgaaaatggggttggccgaattgaccatattgaaaaccgtttagtcggaatcaaatctcgtgaagtgtatgaagccccggctgcaacggtgctgttaaaggcccataaagagctggaagacttaacatttgaacgtgacttggcccatttcaagccaactattgaaaaacaactgagtgaacttgtttataatgcactgtggttctcaccactgatggattcaattcaagcattcattgataaatcacaagaggtcgtcaacggcgtcattaaattgcaactgtttaaaggcaacgtgatggttcttggtcgcaaatcagattcttcactttacgacaaggatctggcaacttacacttcttctgattcatttgaccaagaagctgccaagggcttcatcaagctttggggattgccaacccaagtttatcaacaagttgcccttaaaaataagaacgcacagttcgttcaagcagttacaaagtctcagctaaaggacaaagtgacggttcatgaacacaattctgcacatacgggagctaagaaataaatgagtactaagaaactatggggtggtcgatttcaagaacaagcagcgcaatgggttgatcaatttggggcctcaatttcgtttgaccagttaatggccgatgaagatattgaaggctcacttgcccatgtcaaaatgcttgggcacactaaaattttgccaatggctgatgtcgaccagattgtcgccggcctcaacggactccgagaggaccttcatgcaggtaagttgcgttttaccgttgaaaacgaagacattcacatgaatatcgaagctttattaaccgagcgaattggcccggttgccggcaagctgcatactgcccgttcacgaaatgatcaggttgcaaccgactttcatttatacttgaagaaccggttaccacaagtcatcgatgaaatcacgacgttgcagaaaacgttggttgagatggctgaaaaaaatgttgagaccatcatgcccggctatacccatttgcaacacgcccaaccgatttcatatggtcactatctgatggcctattatcagatgctcaaacgtgacaaggaacggtttgctttcaacatgaagcatacggacatcatgcctttgggcgctgccgcgcttgctgggacgacttttccgattgatcgggaatacactgccaaagagttggattttggggaagtttatcccaattcactggatgctgtttccgaccgtgattttgctttggagtttttaagcaacagttcaattttgatgatgcatctgtctcgtttctgtgaagaaatcagcatgtgggtcagccacgagtttaagtatctggaattaagcgatgcttatacgactggcagctcgattatgccccaaaaaaagaatccggacatggcagaattgatccgtggcaaatctggtcgggtatacggccatttaattggtttgttgtctacgatgaagtctttacccttggcctataataaggatcttcaagaggacaaggaggggactttcgatacggtcaaaaccttattgccttccttaaaagtgtttaacgggatgctaaaaaccgccaaacccaacgtcgagcggatgaagcaggccactgagaatgacttttccaatgccacagaactggctgattatttggctgccaaggggatccccttccgtgaagcccacgggatcgttggtaaactggttttaaagggcattgagacccaccagaacctccaagacatgtccttagaggaactacaggcagcttcacctaaaatccaagaggacgtctaccacgaccttaaatcagaggtggcggttgaacgtcgtcattcatttggtggcaccggatttgaccaagtgcggctacagatcaaaaatgccaagaaggaacttggcgaatagttattgcgtaaatgatatatattttctgacaaaaacaaaacgaggcatcgctgaatcagcggcgcctcgtttttcattgtgtatatattggattgagtggtgagaatgctgttggtggatccataagcagttgttcgttgcactttggttgaaatgtgttccgacgggccagatgctaacctctaaaggcacttcaattcaaatcccaaaaccagggatttaaatcaaagcgcctttagaaaccgcatctcccagtcctcgtcacactctgatcgaaacgtgttccgacgcaactggggcttgtatattaaagatgtcagcaaggtaacattaatttgtactaaactgatattaagcgctgtggattagtccatctgaggtacggatcctaacggatactggttacgttagactctaaccacagtcttttgttgtactgttgattagtt

SEQ ID NO: 253 - DNA, 9591 bp, Lactobacillus buchneri
  misc_feature (5453)..(5462): n is a, c, g, or t
  misc_feature (7357)..(7366): n is a, c, g, or t
  misc_feature (8420)..(8429): n is a, c, g, or t
  misc_feature (8583)..(8592): n is a, c, g, or t
gcggtcgctggttaatttggagtaacgtcgtcgttaaatcttgagcactaatgtgctcaaaacgagtccctttaggataaaaataacgtaaattccgattaaagcgttcattactaccacgttcagctggcgtataagcatggcagtaataggtcttaataccatattgtgattcaagtgatactagcccactaaactcagtgccacggtccacagtaaagctgtgcaccggaccattaaaagtggttaggaacttagttagggcttcattaacagtcgctgtcgtccgatcttttaaccggtaggcccaaaggaaccgtgatttgcgatcgattaaagttaataaaactgccttactatgcccacgaggaccaacgactgtatctagttcaaaatcgccgatgcgattacgttgattaatcatcatgggacgctgttcaattgatcgccccaaagcttgattatatttggatcgttggtcaacgttacgccgttggcgtacgccatgttcaggtagatcattcaaggagaaaccaattctcccctgatttagccaattataaatagatttagtagctagtttaaattcgtgagcaatcatttttggtgaccagcttagacgtaaatggttgagaattttttgctttaactcatcgctcagcttagttttccgaccacatcgtgattgcttgtattcggcatctgtttgtgctaattcagcctgataaggttgacatcgagctaattcataagaaattgttgacggtgatcggttcagccgaacgcccatttggatattggacagccctagttcacaaaaggtttcgattttaattcgttcggaataggttatactagacaaaagatcagctcctaaaagatgggtttgtggtaaacaccattttaaaggaagctgatcttttttgtccgaacagcgttcggattaattttacaatctaccttatatacaaagaaaaatatactctttatgggtatggtatgtaagtcaagttttgctgtgaaaacactgcgtttatttattagaaaataaatcctgttgacatttaagttgacatttaattggactcgtagtttagtataccttaaggggtatattgagatgttttaataagggggaaatagtatgtttaaattttttaatacagtagcaagcatttcagtaactgagttgcaagaaaaaatgaaaggcacaattcatttacttgatgtacgcacaccaaatgagtaccggtcagggcatatatcgaaagctaaaaacgttccgctaaataaggtcgatggctataaaggaagtttgactgaggaagtttatgtgatttgtcaatctgggatgcgcagtaaaaaagccgcaaaaatattacaaaaaaaaggctatagcgtagtaaatattcgtggtggcatgagccaatggaccggtcaaataagaggaggaaaataattatgacaaaaattattatcgtaggtggagtcgctggaggaatgtcagctgcgactagattacgtcgattaatggaagatgctgaaattgttgttttagaaaaggggccatttgtttcatttgccaattgtggattaccctactatgtatctggagaaattgaagcgagagaaagtttattagttcaaacaccagaggctttacgtgcacgttttaatttagatgtgagaccacatcatgaagtgatagcaatcaatcccgtggataaaacggtcacaattaaacacagtggtcaaataacgacagaatcttatgataagttgattctatccccaggagccaaaccatttattccaccgattattggattagccgaagcaacgaatgtttacagtttaagaaatgtaccagatttggataaaatcatgactaacatagatcaggaaaatcctaaaaaagcaattgtggtcggtgctggattcattgggttagaaatggcagaaaatttaaaaaaacgtggcttggaagtagctcttattgaaaaagcccctcatgttttgcctccgttagatgaagaaatggctgcttttgttaaaaatgaattagttagcaaaggagtagaagtgattacttctcaatcggctgcagaatttagaaatcaaggaaaattagttattttagaagatggaactgagttgcaatcagatttaactattttgtcagtaggagttcaacctgaaaatactttagcaaaagatgcaggaatcaaattaggattacgtggaggaattttggttgataataattatcaaacgaatctttcagatatttatgcagtaggagacgcgattttagtcaagcaacaaatcactggtgaagatgcccttatttctttggcttctccagctaaccgacaaggcagacaggtagcagatgttattgctggattgaatcgcaaaaataaaggaagtattggtacggcaattgttcgtgtatttggtttgagtgctgcttccacagggttaagtgaacgtgttgctagactggctggacttgatgtggcagttgttcatatctctggaaaagatcatgcaggttactatcctggagcgacagaaatagttttaaaattaatgtataatcccaaaacgggtgaaatttatggcgctcaaggaattggtgaaaaaggggttgataagcgtatcgatattctagctacagcgattaaaggcgggcttactgtttttgatttacctgaattagaattttcttatgcaccaccatttggagctgcaaaagatccggtcaatatgattgggtatgtcgctttaaatcagattgaaggattaagtaacacgatccaatggcatgaattgacagacgaactcgctaaaggaaagatcttattggatgttcgagaagaaagcgaattagccaatgggcgttttaaagaagcaattaatattccgctaaatgatttacgatgccgtgtttctgaattagatccaacaaaggaatatatcataagttgtcatagtggtttgagaagttatgtcggcgagagaattttaaaacaagctggatttaaagtagaaaacttagatggtgcatttgctttatataaagcagtgagattggaggatgtagactatgtttagttcaattggtgtagatgaattttatcaaaagtccaaaacagaatcattgacaattgttgatgttagagaagccgatgagtttgaaagagggcatattccatccgctaaagcacttcctttaagcggattagaacaacatatcgatcagttaaataaagatgaaaaatactatgttatatgtcaatctggcagacgttcagcaatggcctgtgattttttaagtagtgaaggatataaagtagtcaatgtaatgggggggatgtcagcgtggaaaggagaattaacctatggggacttgtgataaaagtattctgaatcgtttaacgcgcgcagaaggtcaaatgcgtgggattcagaaaatgattgaagaagaaaaagaatgtattgatgtaatcacccaattaagtgctgttagatcgagtgttgaccggattatgggaataattgttgctgaaaatttgaagtcgtgtttagataatccggaattagattcagataaacaatcacagaaagtggagcaagctattaatatgatcatcaaaaaataaggatggaaaaacatatggaagaattaaatggtgctttaccttttaatgcgtctttaagcgaagaagaaagagctaatttacgctttttaaaggcgacccaagggacaccagtcaccgagttcaaagacgctaaagaggtcgctgattggctcaatgatccagatgaggactaatgacttagtcagcctatacgttagttttgtagaaactaacggtggcaagtctcgatcagttttaattcgtcgggtatcagaacagacggtcgaggtttttaaaattactagtcagtatgaaaagaagtcggcttatatcaagcaacaatattatccgattcaagattggcaatccgctgggttgaagaaaccttcctgggtcgatcttggtaatatttatcgctttcccaaagccggtttaaactttaaagaaatcggtcatttaagtaagctagatcaaaataaaatttcagtaaagttaaggaagcagaaatagaaaaaggaggagactgcttgggactcatattatttgttatagttggttatttcatttataaatacttggaggataaacagaatggaacaagtatttttagagagcagaatagtgcgttggatattttaaatgaacgatatgccaaaggtgaaatagatgaggaaacatatagaataaaaaaagaaacattaaatgaataaggagtgattcaatgcacggctattggtataacggttttgataacatgatgaattttggttatgagaatagttggtggtttatgatatatgatggattgaaattgttagttattattggggcagtcatctttatcgcaaaaatgctgatgaatcgttcgaataatgaccatgcatcaaactcaaatcgtgccattaatatattaaaagagagatacgctagaggagaaatatcagaggaagagtatagagatcaactaaacaagttgagagagtaatcaaaaatataaagaggagaagaaaccaatgcacatcgtatatgaaaaaaagacaaacaagaaacttggcgaggctattgattcgttaactgaacaattaaaagaaaatgggtttggtgtattgtggcaacttaactttaaagacaaacttaaggaaaaaggattagactttgaagaggattttgttgtaatggaagtatgtaatcctaaaaaagcaaaagaagttatgggaaaaaatatccatatcggctatgttctaccgtgtaaaatggttgttagagaaaaaaataatcagacatatattggtatgacgcgtccggaagccttaatcgatttattcgatgatttcaatttgaatgaaattgccaaagaagttgaggggacacttagacaatcaatagaatcgactgtttaaaaaaagtaattaggtagattgtaaaattaatccgaacgctgttcggacaaaaaagatcagcttcctttaaaatggtgtttaccacaaacccatcttttaggagctgatcttttgtctagtataacctattccgaacgaattaaaatcgaaaccttttgtgaactagggctgtccaatatccaaatgggcgttcggctgaaccgatcaccgtcaacaatttcttatgaattatcgcgatgtcaaccttatcaagctgaattagcacaaacagatgccgaatacaagcgatcacgatgtggtcggaaaactaagctgagcgatgagttaaagcaaaaaattctcaaccatttacgtctaagctggtcaccaggaatgattgctcacgaatttaaactagctactaaatctnnnnnnnnnnagtttctccttgaatgatctacctgaacatggcgtacgccaacggcgtaacgttgaccaacgatccaaatataatcaatctttggggcgatcaattgaacagcgtcccatgatgattaatcaacgtaatcgcatcggcgattttgaactagatacagtcgttggtcctcgtgggcatagtaaggcagttttattaactttaatcgatcgcaaatcacggttcctttgggcctaccggttaaaagatcggacgacagcgactgttaatgaagcactaactaagttcctaaccacttttaatggtccggtgcacagctttactgtggaccgtggcactgagtttagtgggctagtatcactttggattgaagtcaatatttgagacaggttttaagagacattcagaaccgcgtttaccttccacagctcaaataaatcattaatcgtgattaataacttatttgaaccctggaaagcattaaatcaggcggccatttggcttgtaagtgttgcaatttcaacttgtaagggggtctggtagcccagtgaactgttgaatagccaatgccatattctctggccagttgggcagctgatttgccttgcttatataggttgataatgttttgtttgaattctttgtcgtaacgagttggcatgtaaaaattccttccttttgagagacgatttattcattataccctctcttaaaagttgtctcaggaatcagcttacatccaataaagatgctctaaaaataagatacgataaattgctttcagatgatcaaattctcaaaaacaaagtcggtgtgaacgccattatttggtatgttttggaaaaaagtatgaactgtaaatattaataagcaaaaaggccactagggtataccctaatggctatttttagcttagtgctatactggtgattataaatgttcactagaactgtccaaaaggagaactggaaatggctaaaatcggttatgcgcgtgtgagttccaaggagcaacatttagatcgacagctagcggccttaaaaggcgttaataaattatttacggataaattaagtggagctaacactaatcggccagaactgcaaaaaatgctggcctatattcgtgagggagatattgtcctggtcactgaattagatcgcttaggcagaaacaaccatgatttgactaagatcatgaactccattcaaaataagggtgccaccctagatgtgttgaatttaccgtccatgacagggattgctgaccccaatttacgtcaactcatgaccaacctcattattgaactttataaataccaagctgaaagtgaacgtaagcggatcattgagcgtcagcaacaagggatttccctagccaaacagcagggcaaatatcatggtcgcaagcctcaatacgctgaagatgatccacgtttgttacatgcctttaaactttatcaaaatggtatgagcgatgtggatgtggctcgaaatactgggattaagcggacaacctttattcggtatcgaaagaaattcagtgtgtatagataaatttctcattaaataagcagggcagtgaagaaaaaatttaaataggagtgaaataacagatatatggaaataaaagagagcgtaaaatatcttgtgtaaatgctggattgaagtcaatatttgagacagattttaagagacattcagaaccgcgtttaccttccacagctcaaataaatcattaatcgcgattaataacttatttgaaccctggaaagcattaaatcaggcggccatttggctcgtaagtgttgcaatttcaacttgtaagggggtctggtagcccagtgaactatgaattctcttcctattgtagaaagcatgcacatattcaaaaaggannnnnnnnnnccgactggcttcacaatatgcggccatcttcttagatgccacttacttgccgttaaagcgggataccgttcaaaaagaagccgttcatattgcgattggcattcgtccagatggtacgaaagaagtgctgaactaccaagtggcgccaacggaatcgactggaatctggactgaactgctgggaaccttgatcaagcagggcgttaaagatgtgctgttgtttgtggccgatgggttagttggtttggatgaaggcttgaatcggcatttccctaaagccaaacgacaacgttgcctggttcatgttgggcggaatctgatgaacaaagttcgcgtaaaagaccgcaaggccgtgatcagtgactttaaacaagttcatcgggccgccaaccgtgaagcagccgaactgaaactgaatgagttcgccaacaactggcatcagacctatcccaaattaatcaaagatctgcttaaaatgccgaatttactcactttcatggactttccaccagctatccggcaatcactatactccactaacctgattgagaactttaataagcatctcaagcgcaccacccaccacaaagaacaatttccaacggaagattcactggatcgcttcctggtttctcagtttaatgtttataacgagaagtctctgaagcggatccaacgagggttcaaaggactccaggacaccttggaagcatcatttatttaagttagatacatattatatgtacgaaggcatttggtagcgtcaagaatcttgtgtaaatgaaatgccttcgtacatataatatgtatctaactggattgaagtcaatatttgagacaggttttaagagacattcagaaccgcgtttaccttccacagctcaaataaatcattaatcgtgattaataacttatttgaaccctggaaagcattaaatcaggcggccatttggctcgtaagtgttgcaatttcaacttgtaagggggtctggtagcccagtgaactatgaattctcttcctattgtagaaagcatgcacatattcaaaaaggannnnnnnnnnatggtgatggctttcttggtgaatgtaatcaaaaatattggttacttctgcgcaaggaagcccagggctttttttaggatttcgttctcctcagacagggaagccagccgcttttccatcgctttaatttcgtctggcgatttaccggattgannnnnnnnnncagcagcggcagtttcataattctcaaagaccggcactggataaacacattcctttttgagggaagcatgaaaagattccattggtgcattatcgtatggacaccccttacggctgtgagagtggcggatatgtagttctgttaaccgttggttgtaatcatcgctggtgtactgtgatcctaagtctgtgtggataatcaggtccccagtaatggttcgatttttaaccgcgctttccagggtctttaagactaaatcagtagccatcttttttgagaatgaatagccgataattcgtcttgagtgcagatccatgatggttgataagtaacaccagccattacgcttcgtttgaatataggtcatatcagcagtccatttttgatttaaaccagtggtcgagaaatcctgcttaagcaagttgggacgctgttcaaccttggttttggaagccgaagccgctttccatttattgacggtaacggagtggatatccagttccttcatgagccgggaaatccgtcttgggctgcaccgacgctgcagtggttgaagttccagattcaattcatggtggatcttcataacgccgtatcgctgcttgaattccgcaaagatccgcagaatccgttgttttaagtcctcatcttcggcccggcgttttgaaggctttggggatcgataacgataatactgagctctggaaacaccgaggattcggcacatcttagttacctggtggtgatggctttcttggtgaatgtaatcaaaaatattggttacttctgcgcaaggaagcccagggctttttttaggatttcgttctcctcagacagggaagccagccgcttttccatcgctttaatttcgtctggcgatttaccggattgagttttggcttggccctggatccacttatgaacggttgaatagccaatgccatattctctggccagttgggcggctgattcgccttgtttatataggttgatgatgtt

SEQ ID NO: 254 - DNA, 305 bp, Lactobacillus buchneri
aagctcatataagccgattgtgaacgttgaagcggttcgagtgaataaatctaagggaaagtcttctttgcttgctagcgcgcaggaaacggccaaatatcaagttaagtctgcggattacatgacggacgatgataatcgcaatcaacaggcgattgatgacttggagcaagccttggctggtactcgtcaaattggttatggaggtttgttgaaacagattaaacagcaattgaaattggacgatgccgataatggtgatttagtaaatgttgacggggacaaattgtctgaaccgactgaag

SEQ ID NO: 255 - DNA, 305 bp, Lactobacillus buchneri
gctggcgccctgtttaagtttatcaaaatcaaaacggtcaaccagcacataccgcttatggaaacgggattctttcgttttaacactatttacatcaaatttagtggcttgatacgttttaagtttcgcttgacgctgtttagtttcatttttaaccgctgctaacttttgttgcccctgcttaatagattcccgcatggctttatattctggtaccgttaaacttttacgttctgattcttgaaccccacgctgaatattgaaaccatgctgttgtaaataagtcggtaattgatcttgaatat

SEQ ID NO: 256 - DNA, 305 bp, Lactobacillus buchneri
gggctctaccgagggtcgccttgccagcgggacagaccccaccgctcatttttctagcgaaaaatcttgctctcgtggcagttaattttagctgttctcttccgccaaaataatcgccactcactagcttaatttttctaagaaaaattgactcccgaattaaaaaaaatctcggctatcttttccgccgagattcctttaattcgcaaaaccgaaatttttgatccacaaaaaccatggaacaaaatttcaaaaatcactaaacatgcaatgtttatatccgactttcgtatatgccgtcatag

SEQ ID NO: 257 - DNA, 305 bp, Lactobacillus buchneri
aaaccggatactgactggtagtcaacggtaccggaacgaccgacgggagcgaggataaggagttgactagctaaccaaaccctagacactgaattggctgaaagccaaagttttctaaactttgctttcctgcctaacggcgagtgaaggggagagtttgagcgggtgctcccgctcattttttgcgatcaagctggttcagcttggtctgggttcggggcgacagcgcccgagggtttgaaaccgtcgttttttgacggtttcttcttatcttgatacatagtagacacaattattttttctaa

SEQ ID NO: 258 - DNA, 305 bp, Lactobacillus buchneri
tgtaattaaaaccggatactgactggtagtcaacggtaccggaacgaccgacgggagcgaggataaggagttgactagctaaccaaaccctagacactgaattggctgaaagccaaagttttctaaactttgctttcctgcctaacggcgagggaaggggtgagtttgagcgggtgctcccgctcattttttgcgatcaagctggttcagcttggtctgggttcggggcgacagcgcccgagggtttgaaaccgtcgttttttgacggtttcttcttatcttgatacatagtagacacaattatt

SEQ ID NO: 259 - DNA, 305 bp, Lactobacillus buchneri
aacggtaaatcgaattaaagggacttactgctttagcagttagtccctttttgaggctttaaggagttgattgactactggattagaatacttttgcgcatgcaaagaaaagcacccctgctttttttgcctgccttacggcgagtacggggggagtttgagcgggggctcccgctcatttgtggggtccagctggttcagctggtcagtatggctgaaagccatggtcttaaaaaagcagttcagcgatttttgctgatctgcttttttggggtttgaaaccgtcgtttttcgacggtttcttc
